United States Patent 8,877,916 (PROMOTER, PROMOTER CONTROL ELEMENTS, AND COMBINATIONS, AND USES THEREOF) - sequence listing, part 7

SEQ ID NO: 7509 - DNA, 1470 bp, Unknown
  misc_feature (1)..( 1470): cDNA_ID_1818017_gDNA_ID_1621149_Annot_ID_56821 3000 nt of promoter + ATG
gaattcgtgttattgttgccaaaacgatgtgataataatggaactatgttcattgtattggcgttgcccgctggtttacaacgatctatttcatcgatgaattttggtaattaacgatataaaattttcaatactaaaagacacacctttttcaacatttctttttataacttatgatgttcccattccattatattatagctcaacttacaaactaacttgtcacatgtaaattactcattgactcgtgacaactattgacggcaatattatcaaactcgtggttggaaatattttaagtccacaaaggaggagaaaataaaattcttgaatattgaaaattcttatacctctatgatataaaagaaaataaaatcaaagagaagtaccacaaaaacaaatttttagtatttaaaaatgccattactttggaaaaggtcccaaaatatcacaaaatctaggcttaggaagggtctctaaacgtttattaagaattactaagcccaaaacttgaaaactcctaaaactctttcttcaaatttagactaatcatttttaattctctccaaaatattagtaacccttgtaaagcctaaacattttagtaaattttatgatttttggtggtaattttggaaaataaagcataaaatgtggtattccgaggactgaccaaatttcaaaaattcaaataaatgattaatatcctaaatcaatcattattttttataattgtttttgagaaacttatattaatactattttcaggcattttcttataaattaccctatggttttagtaggcaacaaaaagatgaacgtctcagatttttttgaattcaatttaatcttaacaaaagcgataaatatcaagaagataattgggtacgtgtattgtgtactatttcaaaattgatatttgcttccataacgtaacgtaacgtaagacccaaagattaacacttggtttcttcatggtcgtagattattaaaagtttataactaatgacgacaaagtttaaacgaaaaacaatattttctcaattttcactagttttttttttttattccagaaaattattagtatacaaccaactatttttacgattataaacttttatttgatgatattcataatttagaaaaaccttaaacggatcttaatgtcaatatcatcagctcatgcaccgcctctcggatatgttgacaaaattaccccatacaatataaaccaccaaaccataaccacaaagggtatattcgtatattataaaaatatctgaatagtcgaacttgtcgttacactcaaaaacgaaatctttccctcctctgttctcaatctttctataaattctcttcttcttcttcttccattttcccaacaacacaaagtctctctctctctgataaaatcttaaaacccacctcgagatcatagtcttcatcaattagccataaaaaagcacaatg

SEQ ID NO: 7510 - DNA, 3000 bp, Unknown
  misc_feature (1)..( 3000): cDNA_ID_1818013_gDNA_ID_1621149_Annot_ID_56822 3000 nt of promoter + ATG
cattttgtgggctagggatctacaatccaatgactgcaaaatatttacggcatgcaaaacttcttatgacaagtgtgtttgacacacgtctctaaaatttcaattatgtggatgtgcttatttgtatcaatgcatttcatgcttgcttggcttcgtatggaaaaagtatgagccatcataaaaatttgttaaaaaagattcgagtcatttacattgttttaggagccttttttgatcggttagggtgctagagaacccattacatactagtcatctgggggtattagtattttgtaagctgttttaaacgattccgaattttgtttctatattttgtggtcagatctgatggcctgaaaatcatccccaataatcaaatcttaatgcgcgtttaatattttactaaattatgatcatattattttttgcgatctagtcagtagtcactgtagtgaagttggtgagacgacacccacccaaaaggagtacgtaaagcaattccggcttccaattattttatgctaatcttgtcggcagatgagatggatacatttatacatatcatatataataggttgggaaattgttagtttcgttgataaaataattaaggttttgacttttgactgattctggatttgatttcaggaaatgtaaaattttccagattctgtatgtactttttgataagaaatttcaagttgctgcatgtcaaaaatttcaactaatctcttttgtagtgtataaatttatttactgtccaatagacaattgccaccgatcctaaggagcaacgtacaataccaaaagtttgcatgcataataaaagttcatttaaacataacgtataataattttcagagtgattattgtaactttcaaattttcacataaattttagagtattaaatcaaatagcctttgtaatttttgagtaaactaaatgacggtctttttttactcaaaatcaattacaaccctttaaaatatcctaaaagctttgttttaaaaaagaagataaattatcacaacaagaatataatctaactcactacaaaatgtaaggccaaagaagagatacgttcactgattggacgtgatggagagagctcacatctcgtctggccttatcatcatcgtaatctattgaagatatatatatggtaagacaaattaactttactcacggattctattctttttacccattctcggttttgtaacgaacgacgaaccaccaactagacaacgaaacgtcccacttgtttccattagttaaatttgggtaacaccaaaatcgcattaacttaataaaacactgttccaatatcaaccactgccatattttctcccttatttttttttgacatcaaaactgattttggagaggctttgaaaccccgactataaatttgatttaggtgttattctgatttatgagtgaatagttacacagtcggagtttgaactgaaagttataggattacatttttggtaaaaaattgttgagtcgtatttttggtagaaaacagtaaaattatgttttttgacagaaaattggaggatagtaattttggaggaaatcatatatatgaaaattgaccaactctctccatatgattgacacataatcactttagcatttgacatgtgtctattaaataattaatgtaagctcttcaacttctaatttataggttaaagatatatttattatttaattttacatcttattttattttacgtatttaattatactattactatatttattttaatattacatgatttttcaataaaaccattttaatagttttcttatactctgaagttttttttttttttttgtaatccaaactcaaagtatgagtgtataatagtcgtggattacttaataatttgagtaagttattctcttaaatgaatatttatattttcttaaattgatatttatataataaatcactaagggtgaaaaatgcgtaaggagttccatcatcaaattcttaggtttctagaatccaacactaacctctgttaaattggtttaaaacaaacgttgtttatgaattatgtatatgatgcattgttgagaacgttgctagaaaaaaatatttttaatactaaaagtaattgtttattgcatgattgaatgattagataaatataaattatatttaaattaaacactacaaaagaatccgaaaaaaccgcgacgtagcgcggataattacctagtagtgttaaaacaaaattggaggaaattttggagatcacatttttaacataaaattagtagaaatatatattttaattattaaataaaaaattaaagtaagcgctaaatgtcattaagaaaattttgtgaaaggcggaaacaaaaattttaaaagaaaaagaaaggactaatcacatcatcgccattcaatgatatagtttgacaatgatatgattcattaactaccattcaataaatcggtttatgaaatctaacggttaaatattagttggtaaagcatgattaattaagataatcactcaacaatcaattcaggaccaacgtcacctagctaccaccacgaaggaaaatgctaatacaagaaccaaatcgtcttattaaccagttatctttttctcatggaccacatttaaatcgtcacggcaattaagctagattttaagaaagaataaatgggatactcaactaattgccacaaattttattacttttaaaactcggctgctcggcccaaacttatccggtacggatggatagacctatcttttatcgtgtaaagaaactcttgggctccactcttgacgttgctcattttatctacttttgttggtttcttagtgacctttgacgtttatttacatagagttgacagatttgaattgacgttttctcaataatgcagaccaaaattttcacgtttcttacatgtacatatatatagtaaaacaaatctctgaagacacacaagagaatcaagaaca

SEQ ID NO: 7511 - DNA, 3000 bp, Unknown
  misc_feature (1)..( 3000): cDNA_ID_3050623_gDNA_ID_1621149_Annot_ID_173175 3000 nt of promoter + ATG
gattctcagatctccaccatcgttacggattatccacaattgcttgtagctgatgctgagaaatcacttgctcccaagcttcagtttttgcagtctagaggagcttcaagctctgagctcactgagattgtttctacagttcctaaaatcttgggaaagagaggccacaaaactatcagcgtattctatgatttcatcaaagaaactttacttgataagagttccaagtccgaaaagtcatgtcaaccttttccacagggtaatctggagaacaagatcagaaatttatctgttttgagagaattggggatgcctcacaagttgttattccccttgctcatctcttgtgacgtacctgtcttcggtaaagaaaaatttgaagaatccctcaagaaagttgttgagatgggttttgatccatccacctcaaagtttgtggaagctttgtgcgttgttcaaagattgagcgacaaaaacatagaagataaagtcaatgcgtataaaaggttaggctttgatgtggaatatgtatggacagtgttcaagaggtggccaaactttctgacacactcggagaagaagatattgaacaccattgaaacatttctaggcctagggttcagcagagatgagtttagcgtgttaattaagcgctttcctcagggcattggattatccgcggagatggttaaaaagaagactgagtttttggtaaagaagatgaattggccactaaaggctcttgtttcaaaccctgcggtgcttggatacagcctagagaagaggactgtcccaaggggtaacgtagttcaagctctcatctccaagggattgatcggaagtgaactcccttcgatatcgcgtgtcttcgtatgtaccgatcaggtgttcttaaacaggtatgtgaagaggcatgaggacaagcagctggagactgagttgatggctatctatcgtgcttcatagatcacaaggctgatcaaggattttggtttctatctttaaatatctgaaatcctcaatttagactttagttctcaatttcatatcgatccaaactgtttgtctctctctatagatgcttgaaattgtaagttttgaatccattttctgctatattactgaagttaaattccaaattctttgtgaccttgttcggatatagatttgaatgatgcaatgcagctcctgcattcttgaattggtcatgtaagccttttctatttctcagttagtgtttactttcacattattctttaaattttgggattggagtactgaaattacagctactgataccaaaatcctcttatggtacaataaagtctttgctttatatattctttgctcctgagatcctggagtcctcatgtaagctctgtctttgctttatatattctttgatcatatgattcatctgatttgtggaatgtttgtatttcagatttgtgatcttggtttttactcgtacacgttttttgtgagctttatattacattgtcttgaatatattgtcaggggcactggaaacctatcctacatcattaggacacatcaatcagataatcatccagtccaaggtggtaaaatctttatatctagcttctagctgaagaagcttgggacgttgaacgttgttttgagcttttgctatggctaacgacctctggagtgaatactcaagttttctctctttgactcgcaaggtaatatgcttattagcgttattataggtacattgagatagtataatgtgttggttgtttattaatgtgctcattcaatgcatttgctcgatatctctaggctatctatcagaactatcttttcctttacttgatcttattgagttttagacgtatgagatatggttcccttgaaagaatgcaatctacaagtttacaatggtacgtcaaaactgtgttaagtttctttcatcattgaagaattcagaatcttgtttcaacttggactcagcaaacacttttggcaattgaatctcttatttattctaggaaaattacattatcaactatttgttcgttcttgataggaacttgagggtgaatctcttggcgcagaaaaaatgtttcagagaactttttcttatagtttgtgattctcatatctttttttttcagtgatgaatccagaaactattgaagagagctattcatacagactatagagcagtcaccattgttacatcagagcagtcactaatgttgcatcagagcagtcaccaatgttgcatgttaattttgtaggatcacatttggttgacagtaaccagattacaaatgtactctggtatacatacagttggttcgtgatcaacaattgaatagtatctaaaccagaccaaaatgaatccggttctgcttggttaataataccaagtcttttaaattgatgcagaacgtgagatcctagtgaaccaaactgaaacaatatctgaagatgacaggaggcgtaatgaggctagagtatgcaatttgaggtcattcctaaatagataaagcaaatgacatttggtgaatgaagaagctctacaaccatatgttcgcaatttaaaacaaaccgatatcgtttgagatctcagaaatagtgtgatcaccttttttctcctccaatttttgaagatctcaaactttgttttgggcttgaaacataatgtccatatccgcctgccgtgatactatatgggccgagtcaggcctgtcaggcacctgactcttttgagaaaaaaaaagaatcataattgaaattcttcaaggtttactatcggtggagcaacacataaaccctaaattttgggatttagggtttcgcgatttggaagcggattcatggtgagtttcttgttattgttcgtaattccagagaaattttggtatctatgattcatgactgcgcgattcatcttctcgaattgaaacagagagtagttgggtcggaatagctttcaacactgtagcatttgtagcattgtcttttgta

SEQ ID NO: 7512 - DNA, 3000 bp, Unknown
  misc_feature (1)..( 3000): cDNA_ID_3050633_gDNA_ID_1621149_Annot_ID_173172 3000 nt of promoter + ATG
gttttatatttttaaatttcaactttagccagaaaatagagatttctacaggtgaaaatacttgaattaagaaagaacaaaacgctctagaggtacttttgtagcaataatggaataacattaggtccatcaattcactattacattgtatacttgcatagttaagaaatgatatagtacatttttatagtcagatattttagtgtttgatatgattcttcataataacaatttacacgttcattgacttgatgctttatagttatcgattctcgaagaactatagttactttttaattttcaatggcttaaaaaatcagagaatatatatttgtttatctacttaatctgcatcttgtaggaaaaatttattctaaacatatactatacatccgacttaaacaataatgaaacattattctctagaatatctttacgaagagccaatggtggtcataatctaatatttgtcacctaaagtttcaacagagcttacgctacatattctatttcatttttttcaatattatttgtagaaaactttttaatattttttttcaacaaagttaatttattaaatgttgcaggtttggttgccatgacaaggcaaatatcaaagatattggtgttaagatgcgaagaacagaaatgagtttgtgcaagaatggattttacgagttcgggatttgtacctatgtctcgccggaattatatctaggaaactcaagatcaattgctctatacttgagcttttcttccggtttcagtggctaagaaaacagaagtagataacaaagttgtttataacaacgactcaaaaaacacttgcaccaactaggacaaataagacaatcaaattggaatcctcaaacatcatccaagagttcactaaatcaaaatccaagtccaactttaagactgaatgatcatagtagaagcacctacaagtgctaggtcagcaacatagacaatttgacatgtgctagttagccacgggcaatgcgagtaaatcttcttctcgagtgtaaccgcggagaacgaatttcttgaggattgcagagttttttgcaaagtacaatgcaagtttcaattcatacgatggtgtatgctttttatctctacaaactcgagcaatgacagcaaacactgaggtgcgaacgagaggaatccattcagcctcatactgctaccaagtacagtctgtaaaatacacaacacaaagatgattgaagttcagataccgttaaacacatttcacaagttttctaactaaactgaagagtttgtgcaagtttccgactttcgcaaactggaaaatgtcgttttcattctcaggttcgttctcaggagagctactagctgaaatttttttccggaagacacaatgtctctccacccattgaagtcgagacaccagctctgttcttccaatctaggcactttgctcttaagaacaagcactccttccttttgaccagaaggagacctgaatgacacgaaattatcgagttctgtctgagttgtagctgttcctccaggttttactgctgatgcagagatggcatccatgacgcaatgcgtcctctaaggccccgttattctggtttgacacaacaatgatcacaattagcaaaagccacaaaaagcaaaccatcttttactctctgtaactgtaaggaacgagataaatatcacctaaaaaccgaagaccaagattttgactttaagaatctcacgtgagatatgggctacaggatagtttccagattgacttattaggctcacttggttcagactgacaaaatatttttgcttcacctccaaggtatagatagaaagtttgattgctacggtttctcttaacatagcattgaacaagtgatcctcctggaccaggctataagaaatatcagagcaaagattattagtctgaagaagcacacaagtcagttataaagtaaaacatagaatgtgacctgtttcaaggagattggaaaagtgaatttgctagaaacctcaggaacgttaacgatctctttgaatatttgtcgccagttcttacacacacctacacaagaaacaacattcttcctagaaggccaagtgtcttcggatcgctctatcctcatcagaacatctctcagaagctcaggaggcatattagcccaacagctcagttcttaaaccattccttgagacttcccccatttttcccacaatacccaaatctcacatcgaatctctttcgagacgacatagctctaccacacttcaagcaatgctgacttttcaagaaccctaacaaggaaacaatagtaactatgagatctcaactgatccctacaacttatgaatattggaaatatggaaatgtgttcctcttctcaaggaacaagaccgattcttcggccttttaatagaaatatttggaccaaatttctccttcatattcatcctttggatttggttctatctagcatttaaggagctaattaaagacagccacttgaagttttatacaaacatatatttcgttaacctaagctcaaaaaaaaatcatgacattttttcttctgtaaatgtgtagttgtatataggattaaatataaatgaagatggagatattttttgttacttttatcaatcagccatttttttctatctatgaattcactacttataacatgcctgccacttaaagagccaatcacattgatatagttttgtataaactctttagtttcttgggtgtccatggaaaatttcaaagataccacacgaaaatttcaatttttaatatagagaaatataaaacaagaataaaatgttgctagttgttgaaatttatatttattcttggtgttatctcatatttgacttggaacatatttcactaacgtgcttaggtgtccttatgaaatccaataaatacattaaacacaccaaatctcttaactcttctaaggctatgtcctaagatttccttgttcagtacaaaaa

SEQ ID NO: 7513 - DNA, 3000 bp, Unknown
  misc_feature (1)..( 3000): cDNA_ID_1817989_gDNA_ID_1621149_Annot_ID_173166 3000 nt of promoter + ATG
ttttttcttagatacatacatatgacgtcacacactcacacaacacccagcaaattaacatggattaatttatccatcaatgtggcctccatactttgtctttgtgtttatcagtttccattttcaaaacgtatggagagtacattgattgataaatgtattaatcctattcaaaacatctaatttgtattttggcaaaaacataaaagagtactttccaatatttgttgtgaaccaccgccaaatacgtctcgggtttgcgttggacccttatgtttgtgatatctgttcgaattctttgttgattcagcttaaaattgtgtgattaaccaaaacctcagcttgtaacaacttttgtatgtgcttttatatttgcttagattgactcaactcttaacataaataacttaaatgacacgtttggtttcaaaaactgtagtaacccatatctttgataaaaagacgaaataaccttaatgattaattgtaatcaaattaaaacaaaaaataaaaaaataaaacaaattttttatattttaaagcacaagtcactctaccaataaaattttgacaaatcagcaaaatcaaattatttttcaacagaattataaaaccaaaaaagaaatcgtggataaaaaagaaaaccaaaacctatattacataattaaaacaaaaacaaaaatccacgttaacaaacttttaaaaaaataataattttgaacaaaatttagataaagaagaatctgcttcacatatttcgtttttgattttaaaaatagtaaagaaatgttttttaattttgatattgcatattataaaatgacttgttttagcttaccaataatattttgacatgtatcaattcacaaataattgatttgatggtaggaatagaagaagaaaaaaaacggttatgaaaacccttggagaatttatcatgactcacaattggatatttaatacattaaaattcaaatatgacaatattatgtaaaaatttgccgatattaataaaagtctgttgtaacattttcaaaaaaaaaaaaaaaatcgagtcaaaccagatttaacatacaatcaaaccggaaataatttaattgagggctagctaataaatctcatataacaaaaaattttgaaattttaaaaacaaatctgccaaaaaaagtctgttagtactaaaaaggttattgtagtcataaacaaatcagccataacattgacatgagtaaatctgttatgctttgacactgaaaaacaaaactgtcatcactaaaaacaaatctgttatcattatgtgactgtctagtaattttatttttaaacaaaaaactgttgtaaaacaccagatttgttaacaagttaattaaatctctgattacacaaaacaactctgtcatgcctatataacatttttcgaggttaacaaatctgttataacacaacagatttttgggtacaaatagaaaatctgttgccaccataaagaaaaatatgcggtatggaaaacaaatcagtgacatatttggtttcaacattcttacttttgaaatttaaataaaatctgtggaaactatatgaaacaaatcagtcacggttgaaaaatctgcggaaaaaaaaaatctggcgtaatataacacagtaaagtctgtggtacaaaacaagtctgttgtaaaaagtctgtggttgaccaacaaatctgtgatcgataacaaatccgtcgcaacaagagccacagatttaccaaaaacgacgatggcattttcgtaaataaatgtggttttattgccatgctggaattaaatagtagtgacatttctgtaatattgtttttttctgcaaaggaaaataatgatatttttggtataattattattcaaataactcatatttttagcatttcttttgggtcattatgtataaaatatggattactctagtaattttcccttttatatatatataaaaaaccatttgtgtgtgctcgattttatctatttctatttttttttgaaaattagattaaaaaaattcaccaaaacttaacattacaagtttatatataacataatattcttatgaagtaagaacaatgatctgatcacatattgtgactttgaatatgttgatgaaaaattactgtgatattatacaatttttaattttaatttaatccctaaaacttatgaaacttataccaactgagtaatcatcaaaaattctattttttcatttaaaaaattcaacttccattttcaaaccgttatgaaactatgaaaaggatcggggttatattggttctttgattttcataaagttattgtcaacttgattagttttggaagtttgttaattagatttatgatttcaattgatttgttttttttgaaaattttcaattgatttgttattcaatttgtagatttgaacatttattaaaatttagtgttatttaactaaaaaagtcaaaatacacttaacatatttaacacatcttcacatactgtatatctcaactaaatatccaaataaacaaaatttagcatactttttaatattcagaaacttactttttaaaaatatttatatatatacacacttttcttatatactttttcttaaatttggaaatagtaacaaaactccaatggctgtttttaaaaaaaacaaatttaggttggacacatcttatgtgtgatatagcctcataatagtacgagaaagaaaaaaaaaaaaacaaataatacaaaagggcaaaacaggtaaaacagcctttcctcgttacttcatttccatattattaaaaaatatattattaattccgtcagctatacacggcaaaaactcacattatataaactctgccaaagctgcagagacaacaacacagaactagaaaagagaaacactattagatcatcacttctcagatttcgatattcccaataaataataaatactctcagttcttctcttctccaagaacaaaaaaaaaaaatg

SEQ ID NO: 7514 - DNA, 3000 bp, Unknown
  misc_feature (1)..( 3000): cDNA_ID_2139034_gDNA_ID_1621149_Annot_ID_173163 3000 nt of promoter + ATG
tcattttatctacttaacatttttgaagtgcataattgctctttttttaatttataaaatttttgacccgggtctttctttatacttcatacatattagtctaatttaataaaatcaaatcctttactaatttagatttttgagatctttgggttttctttttctaattaatgtaaaattaacaaaccatttaccaagaaacatttgttggttcaaaagttttaggaaacaatgagatgattatgtcaaatcatcattatttataaacttaaatatatttgtttcctaaataataagaaaaaatattaattctatatttaatcccacaaaatgaattaggaatatgtattaactaaaagattttttatccttattttctatagcatctacataacatatctttaaattataaaaaaatcacataaatattttcgggattcagatttcaataattaggatgtgaacaggttttctaaaaatatcgttcgaatatattgaagataaaaaaaatacaaataggaaatataataatttaaaagatacaaaatatttataaagaaattttgttttaaaaaaaacaaatttcaatgaattcaatataaaatcttcaatacgaatccgatattgattcttaaataaaaatattaatataatatacaatttttcttattagactgaaattttaaattgactcgaagtatcttaaataataatattattaaaaatagaaaataaataatttgatttttagttatcacgggacggattatacggtggaacgggtttagatgagacatgacaaaatattatcccgtggtgtggtctatcaccagtcaaattctataagataaaataatatatattaaacttactaatatcataattacgactcactaaaaaccgtacacaaccttatcgagaattattaatcaacacaaacaacaacaaattctttatcttataaaaaaaaaaatatatatatttaacccgcggtataccgcgggtcatatcttagtacgttataaactttatactacgggtgaaatcctagattgatattaatacaaattatatactatgggagaaattaacaatcaaatacaattataaaatcttaaacactaaataaaataaacaatattatttaaacaaatataaaattaaaatttcaaatttttagtttaaaaaatatagttttgtgatgtaccatacatttaaattaaacaaaataaaaacatatatttattgatcaacttaaaaataaatatttaattttttaataaaattataggcatgcagtataccgcggattaatatctagtttaaaaacttaaaaatattataaattaaaatttaataatcatattgaaacgaatgacgacgttttgtaactcccataagattatcgagttaccaaaactcaggcgagagagagagatcagaaacggaagagaagaataattcagtgaagaatgagactactctctcctctgatcatcactcattgatcagatttgcatttttgagtctccatttctgaatcatccaatccgatcgacgttctccggtattgatttcgttgatcgggtttttgttaagtttttaatatcgatagctccgattccttaaccaaaccagtacgtaccatacacgagagagactagcacatcactagctcagctcacattacaccatacgagagagactagcacatcactagctcagctctcaagtctctcatgcgagactcgcacaattcaacaacaacaacataaagcataatccctctaaattgatctctttccttatttatactagaacggagtttgttagagatatttttatatcttcttcaagcaagcttccttctcacgtgcctcttcacttgcacatgtcttcttttgctttgtctcccattcacatgatacaccaatcgtatcagttttcagtcatacaatcctttgtcagcaaacacactttgttagccgatccaaaataaccaattcggtttgaagttcaccgattttcgttccacctctacacggttttttgtagtgaaaaatcgtcgagaaaattatgaaaattgagagcatcgtctcgtgggagagttcaactagatctttatatttacttatgctctttttattgtaaaaaataattgattatatacttcttcattatatacatattttgatttacactgtttcactaattgtagtttccatggtatgaaatcacttttagaaatttgaattatttctatgttttttttttttggggtaggagatgggatcgaacccccacttttattaataactaaaaaaacaatcacacccgaacattcagagagcccgcatacccatttacatactcaagaacaatcgacataacactatccaaagtagaattaaacaaatgaaaatctaagggtaaagtgtaaatatatagctaactcattcgcaagacgattagcctttctatacgcatatgaaatccgtactacccattcctttgaaaaaaagttatttatctatgtccaaagaaaaccaaccaccatctctaagccaatctccagctcgaagtgtatgataccgcgatccagctatatgtgagccataatatgctccccatagttccatggtatcacttttagaaatttcatttatttctgtcatacatattttcccagatgtaatgcatatttttttttttctttttggatattcgaattattcacctttcaagcgaacgacgacgtttggtagcgtcacattgattattatcaagtattcaagttactccaaaacttccaggcgagagagatcagaaaacggaagaaaaggtgatgagagagttagtctcttctgatcatcacttcttcatcttcaaccattgatcggatcacattttgtttatcgaattcaatcgaagattaccgattttgattcgaaattctcctgttttgatttcaccctccagcggtgatcggagaatttcgcc

SEQ ID NO: 7515 - DNA, 3000 bp, Unknown
  misc_feature (1)..( 3000): cDNA_ID_2139022_gDNA_ID_1621149_Annot_ID_173159 3000 nt of promoter + ATG
cctcgccatacgggaactgtagccaggggaattcagaaaccgaacctttcatagccgcacataacatgatccttgcacacgcaaaagcggttaacatatacaagaccaaatatcaggtaataaaactcatacatcaaattaagacctggtttcgtgagttatcgatataaatataatgtttttgcagaaagaacaaaagggaagcattggcattgtggtacaaacatcatggtttgaacccattagtgattccaatgcggataaagaagctgctgagagagctcaatcattttactctaattggtatgttatattactatatatgttgagatcatatttgtagatatgaagtatagtacttcacccacatatggaatatatattgttttatctatttgtattctaacatgtactaggattctagatcccgttatatatgggaaatatccaaaagaaatggtagatattcttggaccagccttgccacaattttcgagcaatgaagtgaagaacttagagaagtcgagggcagatttcgttggtattaatcactatacaagttacttcattcaagattgtttgacctctgcttgtaatactggacatggagcttttaaggccgaaggatatgctctcaagttagaccggaaaggcaatgttactataggagaacttgtaagtacattcattcagtttcttatattcaatattttacgactatattcaaatgttttagtaaattttattgtttattgaccatgtttctattgttagaccgatgtaaattggcagcatattgatcccacaggattccacaagatgctgaattatttaaaagataggtacccaaacatgccaatgttcataactgaaaacggtacaagacctcaaatttgatcaatgatcgagtcatcaaccatatttgaaattatcatgaaaaattattattaatggcttgaaggttttggagacttgcaaaaacctgaaacaacggataaagaacttctaaatgatacaaaaaggatccaatacatgagtggatacttagaagctttacaagcagcaatgaggtaaataatttatgtaaatttatgcagaaatccaattcttaaaatcatgcattcaaatagtctttaaaccaatttttatctaatgaaaatttactaattctatataagttgtgaattgttttggtagggatggagcaaatgtgaagggttattttgtgtggtcactattagacaattttgagtggttgttcggatacaaggttcggtttggtctattccatgtggatctaacaactcttaaaaggtcaccgaaacaatcagcttcatggtacaaaaattatatcgaagaacacgtgaatcgaagagatatcgtagataattattaaacacatttatttttaattcgtattcactgccaaagaaagtcaaaaattacaaaagcatttaaaattgatacttatcattgttgttgattgttgaatgattaaatttgtcttttcctcctaaaagtgaatgtttaatgtgttacatgattatttgtctaatcttgcacaataattctattagcttaagatgttgaagaacacgtgagaagagaatttaggttttttttttggtcaaaggaagaatagtaattcgtattcctaagtaaagaaagtcaaactaggaaagaatttatgtaacttcgttaaatgaatgattaatggttttctttaccttaaagtgaatgtttaatcagtgttacgcgccatacggaagtaattgtctaatcttgcacaatcattcaacacgttttcaaagaaaactttttttgttctctatgatgataatagtgttaaatcaaaagtagtacaaaagtaaactaaacttattttagattaaaaatcaccgaaaaaactaaacacgcgttagaaagcatttgacatcacctccaaatttaatttcacgcaagcaagcgtttctaagatatggattctaaacgctatatcactgttttttgtaagataaattcttcttaattttttcaataaaaaaatttaaaattaaaaataaaatcataaactaactgataatgaccaaaggaaccataaacacctagaaaattatatttctgtgttttctatctgcggtttaacgtcagtaacatctaggaaagttattttacgaaagtgaacttggtttttgtttgattgaaatatgtttcagactttcagaagaaaaaaaaagatacttatttaaaatatgttaagattttagttcacttcaaattatgtaaacatgctgatttttttttttttttttttttttttttttgcaatcatccttcaatattgtctgcgaaacagtcaagtttcaagtacgattcacaacatttttcaaaaaatttattcattcatttcactcccaaaactttttaatttacaaaactacccgtacacgtatattggttgaatagaaattttttgaatatttattatattttgagttacatatagactatgatttaatcaaatacacaatgagtcgttaaacaatctaaagaaaaagacacacgaacaaactgataacatagataacatataagcaaaataggtcggaatcaacaattacatatataaatggttgcgtggttaatgatttcatttggtattttcacgacaagatcgtttctaggtacatagaagtcaacttcgttgccatataaactgtataacacttagtcatacaatctggtttatttatcaagttcaaaaatttaatttaatcaaaatatttgtttgcgaaattttcaatcgagaattaaaaaattaaaaaaagttgcgtggttgagttaatcgtttggtctccatcgctgatatcttcaatttctctgaattaatcttcacatagctgtataaagacctagaaaagaaaacagatatactagtaaccaaacttagaatcaagaaagaaaaaaacagctatagagttgaataagaagaagaagaag

SEQ ID NO: 7516 - DNA, 3000 bp, Unknown; identical to SEQ ID NO: 7510
  misc_feature (1)..( 3000): cDNA_ID_1818013_gDNA_ID_1621149_Annot_ID_173158 3000 nt of promoter + ATG

SEQ ID NO: 7517 - DNA, 1470 bp, Unknown; identical to SEQ ID NO: 7509
  misc_feature (1)..( 1470): cDNA_ID_2139018_gDNA_ID_1621149_Annot_ID_173157 3000 nt of promoter + ATG

SEQ ID NO: 7518 - DNA, 3000 bp, Unknown
  misc_feature (1)..( 3000): cDNA_ID_1818009_gDNA_ID_1621149_Annot_ID_56823 3000 nt of promoter + ATG
aatataatgtttttgcagaaagaacaaaagggaagcattggcattgtggtacaaacatcatggtttgaacccattagtgattccaatgcggataaagaagctgctgagagagctcaatcattttactctaattggtatgttatattactatatatgttgagatcatatttgtagatatgaagtatagtacttcacccacatatggaatatatattgttttatctatttgtattctaacatgtactaggattctagatcccgttatatatgggaaatatccaaaagaaatggtagatattcttggaccagccttgccacaattttcgagcaatgaagtgaagaacttagagaagtcgagggcagatttcgttggtattaatcactatacaagttacttcattcaagattgtttgacctctgcttgtaatactggacatggagcttttaaggccgaaggatatgctctcaagttagaccggaaaggcaatgttactataggagaacttgtaagtacattcattcagtttcttatattcaatattttacgactatattcaaatgttttagtaaattttattgtttattgaccatgtttctattgttagaccgatgtaaattggcagcatattgatcccacaggattccacaagatgctgaattatttaaaagataggtacccaaacatgccaatgttcataactgaaaacggtacaagacctcaaatttgatcaatgatcgagtcatcaaccatatttgaaattatcatgaaaaattattattaatggcttgaaggttttggagacttgcaaaaacctgaaacaacggataaagaacttctaaatgatacaaaaaggatccaatacatgagtggatacttagaagctttacaagcagcaatgaggtaaataatttatgtaaatttatgcagaaatccaattcttaaaatcatgcattcaaatagtctttaaaccaatttttatctaatgaaaatttactaattctatataagttgtgaattgttttggtagggatggagcaaatgtgaagggttattttgtgtggtcactattagacaattttgagtggttgttcggatacaaggttcggtttggtctattccatgtggatctaacaactcttaaaaggtcaccgaaacaatcagcttcatggtacaaaaattatatcgaagaacacgtgaatcgaagagatatcgtagataattattaaacacatttatttttaattcgtattcactgccaaagaaagtcaaaaattacaaaagcatttaaaattgatacttatcattgttgttgattgttgaatgattaaatttgtcttttcctcctaaaagtgaatgtttaatgtgttacatgattatttgtctaatcttgcacaataattctattagcttaagatgttgaagaacacgtgagaagagaatttaggttttttttttggtcaaaggaagaatagtaattcgtattcctaagtaaagaaagtcaaactaggaaagaatttatgtaacttcgttaaatgaatgattaatggttttctttaccttaaagtgaatgtttaatcagtgttacgcgccatacggaagtaattgtctaatcttgcacaatcattcaacacgttttcaaagaaaactttttttgttctctatgatgataatagtgttaaatcaaaagtagtacaaaagtaaactaaacttattttagattaaaaatcaccgaaaaaactaaacacgcgttagaaagcatttgacatcacctccaaatttaatttcacgcaagcaagcgtttctaagatatggattctaaacgctatatcactgttttttgtaagataaattcttcttaattttttcaataaaaaaatttaaaattaaaaataaaatcataaactaactgataatgaccaaaggaaccataaacacctagaaaattatatttctgtgttttctatctgcggtttaacgtcagtaacatctaggaaagttattttacgaaagtgaacttggtttttgtttgattgaaatatgtttcagactttcagaagaaaaaaaaagatacttatttaaaatatgttaagattttagttcacttcaaattatgtaaacatgctgatttttttttttttttttttttttttttttgcaatcatccttcaatattgtctgcgaaacagtcaagtttcaagtacgattcacaacatttttcaaaaaatttattcattcatttcactcccaaaactttttaatttacaaaactacccgtacacgtatattggttgaatagaaattttttgaatatttattatattttgagttacatatagactatgatttaatcaaatacacaatgagtcgttaaacaatctaaagaaaaagacacacgaacaaactgataacatagataacatataagcaaaataggtcggaatcaacaattacatatataaatggttgcgtggttaatgatttcatttggtattttcacgacaagatcgtttctaggtacatagaagtcaacttcgttgccatataaactgtataacacttagtcatacaatctggtttatttatcaagttcaaaaatttaatttaatcaaaatatttgtttgcgaaattttcaatcgagaattaaaaaattaaaaaaagttgcgtggttgagttaatcgtttggtctccatcgctgatatcttcaatttctctgaattaatcttcacatagctgtataaagacctagaaaagaaaacagatatactagtaaccaaacttagaatcaagaaagaaaaaaacagctatagagttgaataagaagaagaagaagatgacattttttaaaccaattagaatcatcaattttttattcctatttttcatatttcttgtggtatacgcaaccgtgttctgcaaattttgttcagacactggaaacttcaaaagaagtaagttgaggtacgaaacttccgatgatagttatgaagctaggagtagcc

SEQ ID NO: 7519 - DNA, 3000 bp, Unknown
  misc_feature (1)..( 3000): cDNA_ID_1817997_gDNA_ID_1621149_Annot_ID_56826 3000 nt of promoter + ATG
atttagatttttgagatctttgggttttctttttctaattaatgtaaaattaacaaaccatttaccaagaaacatttgttggttcaaaagttttaggaaacaatgagatgattatgtcaaatcatcattatttataaacttaaatatatttgtttcctaaataataagaaaaaatattaattctatatttaatcccacaaaatgaattaggaatatgtattaactaaaagattttttatccttattttctatagcatctacataacatatctttaaattataaaaaaatcacataaatattttcgggattcagatttcaataattaggatgtgaacaggttttctaaaaatatcgttcgaatatattgaagataaaaaaaatacaaataggaaatataataatttaaaagatacaaaatatttataaagaaattttgttttaaaaaaaacaaatttcaatgaattcaatataaaatcttcaatacgaatccgatattgattcttaaataaaaatattaatataatatacaatttttcttattagactgaaattttaaattgactcgaagtatcttaaataataatattattaaaaatagaaaataaataatttgatttttagttatcacgggacggattatacggtggaacgggtttagatgagacatgacaaaatattatcccgtggtgtggtctatcaccagtcaaattctataagataaaataatatatattaaacttactaatatcataattacgactcactaaaaaccgtacacaaccttatcgagaattattaatcaacacaaacaacaacaaattctttatcttataaaaaaaaaaatatatatatttaacccgcggtataccgcgggtcatatcttagtacgttataaactttatactacgggtgaaatcctagattgatattaatacaaattatatactatgggagaaattaacaatcaaatacaattataaaatcttaaacactaaataaaataaacaatattatttaaacaaatataaaattaaaatttcaaatttttagtttaaaaaatatagttttgtgatgtaccatacatttaaattaaacaaaataaaaacatatatttattgatcaacttaaaaataaatatttaattttttaataaaattataggcatgcagtataccgcggattaatatctagtttaaaaacttaaaaatattataaattaaaatttaataatcatattgaaacgaatgacgacgttttgtaactcccataagattatcgagttaccaaaactcaggcgagagagagagatcagaaacggaagagaagaataattcagtgaagaatgagactactctctcctctgatcatcactcattgatcagatttgcatttttgagtctccatttctgaatcatccaatccgatcgacgttctccggtattgatttcgttgatcgggtttttgttaagtttttaatatcgatagctccgattccttaaccaaaccagtacgtaccatacacgagagagactagcacatcactagctcagctcacattacaccatacgagagagactagcacatcactagctcagctctcaagtctctcatgcgagactcgcacaattcaacaacaacaacataaagcataatccctctaaattgatctctttccttatttatactagaacggagtttgttagagatatttttatatcttcttcaagcaagcttccttctcacgtgcctcttcacttgcacatgtcttcttttgctttgtctcccattcacatgatacaccaatcgtatcagttttcagtcatacaatcctttgtcagcaaacacactttgttagccgatccaaaataaccaattcggtttgaagttcaccgattttcgttccacctctacacggttttttgtagtgaaaaatcgtcgagaaaattatgaaaattgagagcatcgtctcgtgggagagttcaactagatctttatatttacttatgctctttttattgtaaaaaataattgattatatacttcttcattatatacatattttgatttacactgtttcactaattgtagtttccatggtatgaaatcacttttagaaatttgaattatttctatgttttttttttttggggtaggagatgggatcgaacccccacttttattaataactaaaaaaacaatcacacccgaacattcagagagcccgcatacccatttacatactcaagaacaatcgacataacactatccaaagtagaattaaacaaatgaaaatctaagggtaaagtgtaaatatatagctaactcattcgcaagacgattagcctttctatacgcatatgaaatccgtactacccattcctttgaaaaaaagttatttatctatgtccaaagaaaaccaaccaccatctctaagccaatctccagctcgaagtgtatgataccgcgatccagctatatgtgagccataatatgctccccatagttccatggtatcacttttagaaatttcatttatttctgtcatacatattttcccagatgtaatgcatatttttttttttctttttggatattcgaattattcacctttcaagcgaacgacgacgtttggtagcgtcacattgattattatcaagtattcaagttactccaaaacttccaggcgagagagatcagaaaacggaagaaaaggtgatgagagagttagtctcttctgatcatcacttcttcatcttcaaccattgatcggatcacattttgtttatcgaattcaatcgaagattaccgattttgattcgaaattctcctgttttgatttcaccctccagcggtgatcggagaatttcgccatgtcgtggggattaggatggaagagatcatcggagagtttccgtttaagtctcagctacggcgccgatgatctgaacgacgatccgattcaatcaccgtcggcgtctccattcggatctccaacgtcg

SEQ ID NO: 7520 - DNA, 3000 bp, Unknown; identical to SEQ ID NO: 7513
  misc_feature (1)..( 3000): cDNA_ID_1817989_gDNA_ID_1621149_Annot_ID_56829 3000 nt of promoter + ATG

SEQ ID NO: 7521 - DNA, 3000 bp, Unknown
  misc_feature (1)..( 3000): cDNA_ID_1808995_gDNA_ID_1621149_Annot_ID_56830 3000 nt of promoter + ATG
gtaaaacaaacaaatgtgtggattacatattacatgtatgcatgagaaacatacaaaataaataatagagatgaataatttgatttcctgataaagactaaagtgttaagtggactactccacgaattaataaaaagacatctttagagaagaaaagtagacatccaacaaagttggaacccgtgagactgatcggtgatttgctattttcttcgtctcaaattgacaacatacatccctagtttaaagtttaaacctgccccaaggatactcaggtcaatgatccatcacatttactagcatgtccattacttaactggtcgtttttaattgaatctgaaaaagttggaccttttatcggattatttaggtttgggccctttggggccgggtttttctctgccaaccatcagcccaataaatttttgttttatatttgtcaagaaaagatctataaaaaaaaaacagtttcgcaaatccaaaccacaaaaacgaatactagcagtacaattgttcaaaatttatttgacaactgtgggatttgaacccacgccctttcggaccagagcctaaatctggcgccttagaccactcggccaaattgtcaattgttaagagcatcataaactatttatataaagcaatccacattttaatgttattattaaagatcatccaatttttttttatgtgaaagcatgaaatattcagcgttacgttgatagttcaaatggtgtactagacttttattttttatcttactgaagaaaactttaaaaatcatgaattcggatactggctgcaatgaagaaaccagtttaacatgttatgtcctccagtgtgaggaataataagttttcaagtttcactatagaacatcttgatcatcttaaagcgtaagattatattcgatttttaaattctttattatgaaagtaaattgtttctcttgggtctttttataaaatttattcaaatatctcatgaaatatgaagatgaaacgaaaacatatgtcactgttaaagttaatctttataagccagaaaaagaatgacaagatcttcggtcactcacaagtcacaacctaggggataatgaatttgggtgatctcaaaactcaaaaaggaaaattaaggtggtgtgacaatataaggaaagaaaattggttgattttaatattagaacgtgggcctgtaaaggcccattaatagtccagcattatgatctggatccctctttaatcttatctccaaaagcagtaagcacggttccgctcacgtgaccataccctacgccttaagcatagtcacgtgccattagtgttccatttcttcagcacgacgaacctatcagaaagtaaaaaatcaataaataatatgaaagttaattattttgtattttcttgtttcacctatgaaagttaattatttgatttacagtttatgttttttttggtggtgaactgtaatttacctattattttagggggtctcttatttttatccgtaaaacgacatattgtagaaatttttctagttaaaaagttgacttagaataatcgtgtatgacttttgcccataactaataatatatacacgtatcctaaagagtctgaaattaatacgaacacaattcattcactaattcactttgtactttgtagaatgattgatttattatacttgttacatgctttaagattatggacaaaaaatataaaattatggacaaagaattgaaaattatgggcaagaaagtaaaaactttctaatgtaacaacatatttggttgaattaaatacgaccacaataatagccttacttattatatcacatatctttcatgtccccaagtcgcgaagttataaatgcgatccaatattctcaattttggaccggcttaaaccaacaggcgttataacagctccaacggtttggttctgttaatttatttcgcggtacgatgaacattcaatttagctgatgtactagctactagctttttttttggtcattgaggttaattttcaatgaagttatttttttttgtcaatttatagtcttgttttagagaatttactttcaagtacaatcgatttcacgataataaatttattataggctaaacaacgatcattagaataactccaaacttgtaatccaaaaataacatttacactaaaaaaaattcaacttattatacaaaactaaaaaatttggtatcacttcaaaagtttaacttcggataaaattgagacattctcatttttatataaaaatttattcgagatattcttttttttcatctccaactaaaataacaacaaaaccgattataaacaaaacaagcaaagtagcaaaaaaactattaaacatcattaagatttttaaaactaaataattacctaataatactaaattatatgatcctcaacaatcattcggttaatttggataaatcagaacccggtttaaatttgatatgatatgaaatccggttaagttccggtaccggtccgggttttggttttgtttaatttccactatggaaagagtgagagagagatagagaaaaaggtggggggaatttaatggaggagtaataaatgctctcaagcgctctctcttcccttctcttctcccacaacagactgtgttcattactcgtggggtcggtctctctcctctctatctctctctttctctgtgaagacgaagacagctgtttctgagtttcccttttgtttttgtgtctatcttctcaaccaagttttttggtgtccaaaattcgcaaagaaacgcctttctcttcttctccttagatttctcggactttctttcaatagtgggaaaaagacacagaatctcaaaaaagtcctctcttgtccaaagtccaaagcttttgaaagagaccataaaaacagagcttaatctctctctgtctctgtctctctctcttttggaggcttgaggatgacgagaagagctgaatttgagatg

SEQ ID NO: 7522 - DNA, 3000 bp, Unknown
  misc_feature (1)..( 3000): cDNA_ID_1817967_gDNA_ID_1621149_Annot_ID_56841 3000 nt of promoter + ATG
cggtgaagaagaagactgagtttttggtcaaggagatgaattggccagtaaaggctgtggcttcaatccctcaggtacttggatacagcctagagaagaggactgtcccaaggtgtaatgttatcaaagttctcatgtcaaaaggattgcttgaaagtgaactccctccaatgtcttctgttttgacaagtactagtgagtcgtttttaaatttgtatgttagcaaacatgatgacaagcagcttgtggctgagctgatggcaatcttcaccggaaatcgtgtttcactcaccgatcagaaggcacgcctagaacaatgagcaacgttaaggattgttttttgttttctgttaggtttagattcattagtgagtcttgttgcttgacttttggaagtagataatagattttgtgtatgagtgtctaagcctttgaccctgaaggatgatgaatcagtcttgtatgaaaaaaatctttacaattatctttctttgtcttgttgatatgaattatggttaagatctttgtgatgtgctttgttctgttttggaaattaaacagagcatatgatatatttcattttactagtttcgtggcagaaatctttcctgtttcgcaggatttggtagacaactctgaggagtaagatccactcgcaaacgatggaacggtttattcaaattcctagtttgctttttctacttgagtccttaagtttgtattagagtcttcagtatacttcataccttcttgttcaacccaattccaactcttcagtctctgctacatcttcaaactccatcaagcctcaaactaataatctttcaagtgagattataaatcttcaagcttcttggattggatatatcaatagactataaaagctagtagaaaagagtagaaaagctagttgaggatttataataaggtaaataagtagaaaagacttttatagtctattgatatatccaatccatttacttgatccatctctgtatgcaatctgactgacaaattgtaattgttaaactcttttttactagctttttttaactcttcaacattaaaagtctagaaacagaagacaactatttactacatgatatttttggttatttgttaacaagaagcactgtggtaaagcagccgaggatgaataattttagtgtttgtttgatgagtgttaatcttcatggaatccataaccacaaagatttggttgatccatctatataaagcaaataggtgtagttaatcaattcaaggtcttttagtgttatcccttgccaaggagggcaacactagagtctagagtttcgttttccacttgagtccttctgttggagacagtgtcttcattacacttcctaaccgattccaaagcttcaaatttcatcaaacctgcaacataatgatgacttcacaatggtgtcgagtgagctccattaaaacatgtataggcctaggattcagcataatgatgatcaagcgctatcttgagtgcattgtaatttgatgaaagaagttgacttgaccagtggcaactagaggctggagaagaggattgtcccaagttataacctaatcaaagctggtacgtctcgaagcatgatgataagctggtattggagattactgtttttgctccaaggaatgtcatatcaagaaactgtgcattgttcttgtacctcgctagcatcttcctttgttggttacatggtttgctattccaaccaagctctggtactataaggcaaaaggaaaggagaaggagaccattaactagtctatattacaacaatacattatatgtttcgtggatatctctttttcttatcttctctgctgttttcctttcttttgtaaagattgttctttgaacatgaatcaatacactttagaatctattaagatagcaaataagttgatgcaaagagcaagtgtgagatggataattgaacgggagtgaatgaacctgtcactagatctctaatggttgttgttacctcctggctcctcctcagctgcctaaactgcgtttagctcggccgcctatcactttttttttgtgtgtaggtttgattggtctctctcattcagaatcatatgatcaatttgttttcaagttttgcaatgtttttgaaaacattacatttacgctaattggatttttaaactcgataaccgtgattacaaatagagacgtaatattttttagattatttctcatgtttttttgtgatttgttcatcttatgcataatttatttttcacttatgttcaacaatagtatacaaaaatttagaaatgctcatcatatataaaatcacttttgacgttctgaggctccaatctattaaaaataaacgatatagatgataatatatacgtcttttaatcaagtgaatgaatatttagtttttttttttttaataggcttcactttgtttcttactcagtttaatttttatttggtttttataaaattacaacttagttttaatcaaaggttctaaattaaatttgaccaaaaacataaaaaaataattacgtaagagcttttttggcagaaaataatttagagtaattatttattccttcgacgttaaaaaagaataggaaaaaatatgtttaaattgcatcattcgaccaataagattagaactcatcctttttttttttaaggatatatagaattcatcactgaatacatgtttttatcccaaattaacgcaaaagagagaactcgagatctgggcatagcgactcactcagatctatacaccttcttcttcttcttcttcttcctcttcctcttcgcttcgttcgtaaactcatctgatctgtggtaaccaccattgttcctctccttacgatttcgaatttctgttttgatctcactaccattgttgcaatttagatctatttctaattgttcgtgattcgcttttttttttctgtgatctggtttttgtagagtgccattatcgttgagagatt

SEQ ID NO: 7523 - DNA, 3000 bp, Unknown
  misc_feature (1)..( 3000): cDNA_ID_2686130_gDNA_ID_1621150_Annot_ID_56845 3000 nt of promoter + ATG
tgattttcagtgatagcaggaggccttgctgcttataaatcataaattcttgtaagttgaaaatcaccaaatgctattctagttggtcacacttgaaaaatattaaaactcacattccacaaccaccttctccagttcccttatggctttctcgaggattgaggttttagacttcacattagaaccatcttttttctgagtagagacaggttattgcagaattataaagcaagactgatgtaaactttgtggtaagaaaaatgcatggaagcaaagattgaccagaaaaatatcacagaaccgagatgaaaactggagaaacaaaactacgaccttagaatgcaaccaacttactgagtgtattttatgtaattgtagacacagttggaatgtacttacagacgcttgactagattgtctgcttcccgttacatttgccagctgatgcataccattgttttctttctgacggactactgttacctctgcaaagacattggggggagattttcctagcagggacgtagattgttggtgtaagcttttgttgctgtatttctgatgaagggcactagaggatccagtttcccttgacttgtgacttgtatcattcctagactgatgatttgctctatcagaatgcttcacatcatccagaggtactgaagtatttgcatcttgcgctccagaaggcaaaggtgactcctgtgttttccaggacccaggagcagttgattgatcctggacttccccattcgtataatcagttatcagactcaaactccgacataaattagtatgatttgcaataaaagatgttacctttttcctagctgttatagacaacttggtgtgtttatcggatacgtcaactgcatcacgacagggttttgctgaatcttttcgtcgccgttttttgggttgctggttagatgttgttgaaggttccctattgtgaaaatgaatcagggattagataacttgtaaatgaaatatagcatgattaggcaaaatgagaaaaactctatcctatcgaaagtgcaaaacctacatctatatgaacgttttttaaccagaaaagttgaaaaatggactttacccataccaaacaccctacagacattagttaaggcagtagtagcaagactgccaaccatattttaccatttggagagactacacatatccaaataggaagaaaaactgaaaagcaaggtgatttcatatgtttatttcaaaaacttacgacatgcctattctaaacatgatctgagtgattgaaaagtgacaaagccaccaaagagttaagagacatcagataatgaaaagaggaagataactcacatccgctccaacttgcctctatttacataaaatccatcatgtttaactgttgaattatcaacttcgaaatactcatcctgcaaggagtagagtaaaacagagatatgatttctcagctatcaaaaatatttgaaagatatcaacaccaaccagttcagcatcatctataaatgaatcttcagtgtcatactcatcatcatcaggagcaccgtctaactcttccccatcactgctatcgttcccctgagatttattctctgaagtaagcatacacttttcagagatgtgtgaatgcaacagtgctattgcatggtatgcaaaaatgttgtgaatgtgaaaaatcaaacatataacaacctaccaagaaaagtgttttaacaaagagtagcataccttatagagcctctctatcttctcaataacagcgttgaaacggttagaatgaggttgttcattcgtttcaatctctactggatgcccctacattatatacgaaaatacagctgttgaaaatgattttaaccacccatattgtatgcataagaagaatatattgtgaggaagctgcaagcatattataccatcttaaatgaagatccactattatatgcttcattctcttgcactaatagatattaataaaactttctctatattcttcactattacagctatagtttccattgcaactatgtgaaccaaattcctttccagatcaagtataattgatggcatattcacattgataacgatgaagttagcctaatgtagctagcaattagaaatgaagccaaagatcatatatcaggttgtagactttctccgtttaaggagtttgcttattgaactctagtcacagacgtcagagagcaataacaacagaattcctcctataccatatcgatttcaagcattttccccaacaaataaatctgaaaatctgcgaatttagtaaagctcctttataaaccctaacaaagattacaactccccgaaacaagacaaatgcttactccaataacagcaaacgaaacccacaaatgcctacaagtatatatatccgattaccaattcctacaacatcaaactcaccggtgcaattcgaaactcaaggttagggttagcattaggaggcgggtcgggaaccgaagccgataaaccattgaccttaccagcatccctcataagcttcttccacgaaacatacgtcgtatcccctggccgaagctccaccttgagtaatttccgatcaccggccgttaaaaccttcggcgacgctctcaacaattcgccgccaatagaaccaccactcatctcattaacttccgacattaataattcgggtcgggtcgggtcggatcagtttgatccactatatactaacccctgggttcgagacggattgatctaaacagcaatcaagagagtggaatcgatgaatcgatgtagagaaactgaaactgagaagaaaaagttgcgcgggataccaaaaatgacgctcttaattatttcctaatttatttttgttgttttattcactaaaaaggattattattatattatatagtttttcttttttttttaattgtatttttcctcgaaatatctaatccacagatagatagaacactctgtgagctttatccgcttccaatg

SEQ ID NO: 7524 - DNA, 3000 bp, Unknown
  misc_feature (1)..( 3000): cDNA_ID_1818099_gDNA_ID_1621150_Annot_ID_56846 3000 nt of promoter + ATG
cacgccggctacaagttctaactagtccactcaacaacagtcaacaccatcccaatttctcaaatacaaacactttgttccaatcttgaatatgaaaatatctcatcacaagaataatacaagccatcataatcatcaattgaaaacttgaattaaacacctcaaaacttgcaaataagctagcttctctagtcattgaatgttagtccatcaaactattgcatctacacacttttttctagaggcccatattcatctaataacacatccatctctgctgctagtgcagtacctgaggtcaccaaaattgtataccctccaccatatcatcgatttagatcatctgctctcgttttccatctcaggaagaaagttatgctgacttgtcgtttggtgtctctcgagttcttctagaaccaatttgagacactgaagtctcgtagcttcctgagatgtttctccatgtcttctctagtcttggtccactcttctctttctattaccgttgttgggtcatctctttcaccctgaaagaatggaaatatatagacatagagtgaagatgagtaaagctagatgaaggaatacaaatgactgccagatgaaatggatttggtcatttggaaatggaaaggtaccacgtgtatgatcttaaaggaggttccattatctcgtatcacaagcaagtcatccttcctatccctttttcttcctcccggaactgtcacctgaaacaatctaaaaccttaacatcggaaagaagattgtcttcatagctttgagctatgcacagtatttaaagaactcataactcaagatatctgattcagaactagaggcataaatagcactaatataaaccagcatttcattagtgttatagcatgaaaaatattctataagaatatgtcaaaaaacccaattggctatggtctacggttgaggtttgtgctcagactcggaatgagaactttgttaataatgcttaaataacttggaagataagaattagtcataccagaactctggctctggtgattgactttgtcttggaatcaataacatatatctcttcaagatctagcacaaattctggatcgtttgtccttctgttccggtaatgttttgtcaagaaaacctgcataaaaaataaacacgatgaagacaatttgtatcagaaactgtaactactaaactaagtagtttcgtgttgatctcatccttaatgcttaaaaaacatatttcctggtgtggtttccaaaaatgttgtcaaatcaaaactaagtacatccttgttaatacatgttgctcaagactccctgcatcaaagacctaatggatttaacatcaatgtacatggtccaatatgtaccttggatatctccctctcagatttgtacagtggatctctgggggcatcaataggtggttcagtgacattgtaacatccatagtcactcattgcacatcgaatatactgtacttgtaacatcattaaacaagcccttgttagcaccactcactcattgtaacaacttgcttataaataaaccttacaatgtaaaacatacgcaatcatgaagcagcaaagagtacaaaactggccacagaatgaaaggaaagtgactaaacaaacacccagctgctacattctgactctctaatcatactaaatgctgaccatttacggcactttttgagattatatgttcaaaattccagtctatcagtgtgagtagaagttccaaacaataccaaacgtgtacagctctgtgtagataagatttcttaagttatacaattactaggtagagtgaaggtatatgggttatacaattactaggtagagctctgtgcagataagatttcttaagtgatacaattactaggtagagtggaggtatatgggttcaattagcaattaagcacaatatgaaaagcaattatcttgctgaacaaaaggaagtctcagaacaacgcataggcattacaaaaacagcaaccgataaggataaatgactgaccttttgaggcatcggtgcaagaactctcggaattgagtaaatatctgtatccggaggagtaacatacatctgcagccacccacacaaaacaatttacaattgaagaatgagcacagactctagagaaatcgaagaaatgagcaattagagtcactgggaattcacacacctctctgaaatcataaacatcattatctggatcaggaggttttctgataaagaaatcacagtccattaagctgagtttatgaaactcatcttcgtttatccgataatcaaccaccatatccgaatcccatccttgtgtcgatataaaactcttactctgaacaaaagcgatatctccatcaccaccaccgcctgcagcggctatcgcggcggccaaggggtcatactcgacatcatagtccttcttgttgtcaacttcctctacctcctcatcatccatatcatactcgtccgctccacctccatcagcatcgacgtcatctactttaacgactataccacggccgcgtcgggatttcagtgttaaaggcgcgaaaagaccgtccgttctgaatgacgcaaatagccgctgagagccggagggataaggtggcttcgaggtgaatgagagtagagataaggaaggagaagcggcggaagacgccattggaagcggataaagctcacagagtgttctatctatctgtggattagatatttcgaggaaaaatacaattaaaaaaaaaagaaaaactatataatataataataatcctttttagtgaataaaacaacaaaaataaattaggaaataattaagagcgtcatttttggtatcccgcgcaactttttcttctcagtttcagtttctctacatcgattcatcgattccactctcttgattgctgtttagatcaatccgtctcgaacccaggggttagtatatagtggatcaaactgatccgacccgacccgacccgaattatta

SEQ ID NO: 7525 - DNA, 3000 bp, Unknown
  misc_feature (1)..( 3000): cDNA_ID_1818091_gDNA_ID_1621150_Annot_ID_56848 3000 nt of promoter + ATG
aatctcaagctcttgcaatcctacagaggaaacaagagtggtcaagagaaagaacgaggctgtaatggctgagaaacaagtcgttcttgccctgaagaagcccgaacatccacagacacgtgtaatcccagctcctcagaatctgaacatcccacgaacaaccccggacctgaacttgccaagttgacatcacgattgacaaaggagctcttagaaacgccggagacaataacctctggcctcttccttccttgtattttgaggtggcacggcattagtcctggcgatgccgatgcttggtttttttagctacaaagcatggtttataaagttgtctgtattccagtttggctcttattaagttagttactctatttacgtgtcctttttcaaaactctaatgtataaagttatgattttacgggcaactctttacttttgagtaaaaaaaacagagcaggttttagtactgaattttgggtaacgtagttgaaaatttgatttcggacgataatgtaaaattgatgaaatacatcaaaatgactacattaatccttttgacacaatatgaataatcaattttaattaatattattattacttgtaaaacagtataaatatggctcattatttcacagattctcaacactctctcattctccacaatttacgatggcacaccagctccgttttgccgccgcaagagaacccatctcagaagagtatccggcggttgctcttcctcatccacgttgcatctccgtcgcgtttcctcctccgagattcacaccatctccgtcgcctttaactaattactcattcttggccgcattaactcctcaagaactggagatgcgtttgcaaattgcaatggatgtccgtaatgactaataacgaagatcatgttgcggctccgtttgaagagatgatctcgaagttagaccaaagaaagcttcaaacgatggcgtcattgctgacatcagatcccgattacttcttgatgatcgcaagaaacatgaacggctccaaacgcattcagaaacttctcggaaaaacagatgacgtggacgctttattcgccgccgctatcttgcgccgcttcctccacatcatcaccgacaagtacgcgtcgtacgtggtgagacgggggatgacagttttcgataagaagaagaaaaaagcaatgtacgagcacattctccactacgcgagccacatagcgcgtgataaacacggtaacctcgcgctcaacgacatcataaccgacgcggtacagaaacaagctctttgacgtaatcgcgcacaaagctcttgtactaagcaacgatgcttatgggaactttgtgatacaacgcgtgcttaaactgaatgacttgcgtagcaagaacaacatcgtcgttagtctacgtggccactttgttgatctctcgtttcagaaatatggaagctacgttgtggatgtacttttggagacgaaggagtcaatggttgtggtggtggaggagcttatggaatgtgaaggagatatgttgatgaggttggcgaggaatgagtatgggaatttcttggtgtgcaaggcactgagagtcacgcagaaggagatggttaggactgatctgttttggggtttggtgcataagctcaagccttttcacaatctcttgcgttggtctcgtggaaagaacattgcatccatcttaaactcgattcgttagttcgtctcaaaactagttaacattgttcagttattaaaatctctgctgaaagttctcgatttgatgttgttagctaactcttttaaggaggtttaccataacttgtcaaaaacacaaagaaagggagaagagggattgatatacagtatatagaattctctctttcgtgttattacttattagaacaagtttgaaagctgaagcactcacagtaatttctgtaattaaggacgttttgccttatgatcaaattctacaatagatcacctgaaattttaatacaaatcctaaatccatcaaggtatgtatcaaattgagatttctgtaactactagagtttgaccaaacagttttagttaacctgaatgtgtatgcctaattgcctattgcctcataatgcatcaagcaataccatctactaagcgaaaatggctcaagaaacaaacgtagagaaatcaaacattaggcattaagatttgggatagatgtgctagaattttctttgattgttacgataaagaaacacaaccctccaaaacatttttatatgattgctttttttaggtcgggtttttatatgattgttatttccaaggaaaactaaacacaaaaaataattatgaaacgtttttcggattgttattattagtaatagattaaatctgtatttctaaattttaaattttattaccaacaaataaaatgatatgatttcatatatcaaattgtaagttttgtgagcaaattttcaaaaagaaactgtgggtattcatcaatgataatctatatttggattattatcatgacaaaaaaaggttacagaaaaattaaacaattgtagatattgtttttattttagatgaaaccttctgtccgtattataatttgcatctcgaggttcttatacgatttgtactgaataaaacatattttttttgtttttaatcataactttcccaaaaaccatctcttccatcgctagctgtaccggtttcaatctcaaatcctgggaattgaaatttgtttctctgtcggagaatcatcatcgacttctctgctacttctctccgcgctctccttcgtcgtcgtcgatctcttcagcttcaccgatctcatttccaatcctgaaaaatcgatgtggtactgatctacgattgtgctccgttggtagccttatgaattagggtttttcttacgcatcttcgtatgtggagattggatcgtgttcggaaaacttctggacactgtcttcgctgctagatttttggatcatccttttgcgaaa

SEQ ID NO: 7526 - DNA, 3000 bp, Unknown
  misc_feature (1)..( 3000): cDNA_ID_1818046_gDNA_ID_1621150_Annot_ID_173214 3000 nt of promoter + ATG
gtggatgtttttttttcttaaagcattttggtgatagttaaagatgatataataatatgattcttaagtttcttcaaatacaaaattaaaatactatatgtaggtaaaagcgattaaaaaaacaatttacaaaataactcgaactagagatattttaaaatatctaaaaggtgaaattaaaatctttgatagtacaaaattattggcgtaacacaaaaaaaatacagataaagcctcctatgtgaaagtgaaactatactgatctaatcatttactaatagaaaaccaccatttttcccaccagatcgtatgttatcattcgttaattatcaccacatcttaccgtttttgtatgtaactcttgagatgctatattttttaatcaccatgttttactcaatgaaaatcatgttatttttaaaatgaaacaaagatcagagaattcttttacatatatttatgttcaaaactaaatagtaattaatggttgtatacacacttgatcatgatgaggtgagtagggggttacatgcatatataaagacatggtaattaaacagagcaataattatgaacataactctattgttgcttttttcttttctttttgccttttttctgataacctactgttgcttttctttgcatatctatttgcttagatgttgattattatgtcgatctttgcatgccaaatttatcggtggccaatttgttaggttcggtttttaagagtcaattaagatagtcctaattaaatacactaactagtttaaatacacgtatagtgtattaacgtgactacacgtgtttatgtattttttttgagaaaatgcatcaaggatttcaatgaaatatttgacaaaacaaaaaaaaggatttcaacgaaatatcaactcaacaagttacagaaactaaaactgtataaatcatcttgtaattttgtaaacggtgattactagttaattttagtaaatctaatatgttatctacagtctaataacatggaactccatgaccaatgataaagcggttctagtagtttctcttacaacaatcttttacacattgaaaacatataaatttagggaatatatatatatgtatgtatattgtatcctgatattccatacaaaagagtttcgaagtgtttttttgtattttattaggaaaaagtgcaaaaattcaaaatttgaaacttaataatatttgagtgaagaaactagaaaggtccgaattgacaaaacataaaattctgtcataggggccataattttttggagccgtgcaacaacaagggtacaactttaacaaaaagataaaaataacaagggttaaaggggcaattcttagtgacaatgttaatgtagatcaactatatgaaattttatgatggtagaaaaatacacactagctagacggtagaaataagcacatcaaagcaccacaaagccactacactaaattgcaataagttgaatagttaaaacatttgtgtgatttgggacgagaaggtgcatgcgaaccggatttgacaaagcacgtgagaaccggatttggtagcacgtgagtggcacactttcctagtggcatgtctcagctttttcttatagctctctctctctcagcttcgtaacatgttcatgtttcctgcatgcaattgtttattacccctactggctactactactactactagtatttcgagcatcgaagctctcccactccacaattttatactgaaaactttaatctttacatttccaagtctccataatgtctatctgtaaagtgtaatctaaaaaaactgtactgtagtttatttctttcagtaacaatatacacagttactggtggatacgaataaacatttctatatgaaaatgaagtgacccaaatccatccgagtaacgtcgattccaacatcaactatactctgtttctgtttacgttttatagatttttcaagtcatgggactttataaagaaaacataatcaataaatataaccataattttataatgtttgcctcattactttccaattgtttttttttaaaattacagattccgtttactgttatactaaaaagaaacaaaaaaacctgtcaattcataacatttctacctaccaaactagcaacactttttactgttttcttcttaataattatagagtcacatagcttaaacctttttcttttcttcttgaaactcgttataaagagtaaaaagataaaagtaaaagtacagggcaaaagggtaaaaagtggaaagtaataaggcccaaaaaaaacaaaattaagacacggtcttatcccaaatctcctttcgtcgtcgacgttgtttctcttctacaatttcccggaaaaatttattgttgaattctcacaaacaaaaaccaaattcgcctttgttttttttacctctgtttctcgtctctcacactttcttcttccccattttccaatttgcatttaagttttgcccaaatccctagctttcttacacacatccctatccgttaaatttcgtagagatcgaaatcgaaattaattgcaacaagacgaatccttttttctctttttagcttatttacaaaaaaaaactaaaaccccattaaattttcttttatttaactagttgctatcagtctctctcttctgattcctgtctgctacggtcacgtttaaagaaagaaaaaatcagcaaaccccatggattcttctgtctctcctcctctctctgtcactctctcgcatgcacgagacctctcttcctcctttcctcttttgtttgtttcctctcattctcactctctcataacgacaactaattaatcatccctactctgtttttccgatttgaaaaaacaaaacccagatttcgaatttggggaaagcaatggtctttccattaaccaaagcatgagacttgaaacagcattttgtagttgtgtggcgacaacgacgacgatattaaagttagggtttttctcac

SEQ ID NO: 7527 - DNA, 3000 bp, Unknown
  misc_feature (1)..( 3000): cDNA_ID_1842620_gDNA_ID_1621150_Annot_ID_173210 3000 nt of promoter + ATG
aaccagctctctcagccgccacaacagccattacagacgcgtgtggccggatcacaacacgcttaaccactgccgggaaatcagagatgcgcgaaccagaatcttcaactacctcgccaataccaagtcccggatcgggagttgcgccgccgttttgctgaagctcatcggcattttcaacgtcatccatttcttcgttgttgttgttgttattctcttcgtcttcttcctccatatcttcctcctcttgtttcggtttcctcgccgccgataacccccctctcttcttccttttccatttccctcttctatctgcgacagaattgtaaaaagtgtaattcaattcacacgaattctcgaaatacccatcactacgatctatgtgggtaagtcaaatcccaatttaaatttggattttgagagagataaagatgtgaaacagcaatttaccttcagaagctggcatttttgtggatgaagatagagaaatagaggttttgggttctgtggaatcgaagcaagacccttagtaaaaagaattgctttctttgtcttctctcctccgagtcgttctgatttccagctctcgagctaaacaccaaacctttttctcgcaatttctttcaccatttccttcattaatctctatatattaattcattctccacgacgacctaaccttctcgacaaacaagagggttctgatttcgaaattcaagcttcgttgaccaatccaaattttggtttaacttcggttaaagtcaactttacttcggttttatttttcaattttgaatgagaaaaaccgaatcaattatttagttcggttcttaaagttcaaattggttaaaccggtttaaattgatacattagtcgaccgtcgcgcattaatactggtgtggtggttccgttaacgagcaacggcgatgaagagacctcgacctacatctcagccgtcgatctcttccaccgtcaaaccaccactgtctccgccggtcacaccgattctcaaacagaagctacacagaacaggaacacctaaatggttcccgttaaaactaacccacacggagctgacgttgccgttaacttttccgacgggtcaaacattccggtggaagaaaactggagcgattcagtatagcggaacgattgggcctcacttagtctctcttagacaacgtccaggagacgacgcagtttcctactgcgtccattgtagcacaagccctaaatccgcggagcttgcgttgctcgattttctcaatgctgagatctcgttagctgagctatggtctgatttctcgaaaaaagatcctcgtttcggagagctagcgagacatctccgtggcgctcgtgtgttgaggcaggatccgctcgagtgcttgatacagtttttgtgctcatcgaacaataacattgcgaggattacgaagatggtggattttgtttcgtctttagggttacatttgggtgacattgatggatttgagtttcatcagttcccatcattggatcgattatctagggtttctgaggaagagtttagaaaggctggttttggttacaggtgatttcatcactctctaatggttgcattatgttgaattagacatttaggctaaaactttgcttgaagcttatacttttatttactctgtggctatacattcatagaattgaagctaatgtttggtctaagctagataatcattgtgtggccgtttctctgattggttctgatctcatttgaaaactctcattctggtttatcttgtggtgagcagagccaaatacataacaggtacagtgaatgctttgcaagcaaagccaggtggtggtaatgaatggcttctttctctgcgcaaagtcgaactccaagaggcagttgctgcgctgtgtacattacctggtgttggtccgaaggtagcagcttgcatagctctgttttctcttgatcagcatagtgctattccggttgacacacatgtctggcaggtaacaaagtccatcggtttctatgtattgtacttacttaattgagatccaattacataatggtgatgatgacttcgggcaactttttttttgttctgttttggataatggatcagatcgcaacaaattatctactgccagaccttgctggtgcaaaactgacacctaaactccatggccgagttgcagaagcctttgtgagtaaatatggtgaatatgctggttgggctcaaacattgcttttcattgccgagttacctgcacaaaaaactctcttgcaatcgttttcccagcccattaacaaactggatgagtctgcagaagttaatgaaactagctgtgatacgttgaagccatgactatgtgtctacctaagctacgaggaatcgttttcacaacccattcttgatgcgtcaagtccagaaacttgaccttggaagagctaagaaaattctgaagctgatgcagtatttggctccctggcaaatgagcgtagttatttgttatgatcattgtttactaaggaaccaatcttgatatgtacttgtaactttacattcaaacttccaaattaaattctaattgtttgttccctttgcaattctcttgatttgaaatgagaattttttccttttatctatttcttttgtcaaaaaacaaaactaaatttcgtcgaaattaaatttctataagaagcccaataaagcgaggcctaaattaggcccaaaatactattggaggcgaaaaagaaagtccggctggattttcctccaagccaccgtcgactttacttagtactccctctctctcccctcctccttcccagatttcgtctccgttctgaaaaaaactccaaattctactctgaaaccctaagtttccgatgtcggtaagtttgataattcccagttaattttaatttcggagacctcagctctattagtcttacgcatcaatggtttaatagtgactgaacgataaaattgattgatatttgtggcg

SEQ ID NO: 7528 - DNA, 3000 bp, Unknown
  misc_feature (1)..( 3000): cDNA_ID_1818061_gDNA_ID_1621150_Annot_ID_173208 3000 nt of promoter + ATG
tcgcaaatcaacaggtaactaatacagctacataagtaaacaacacaagcacactgacctcttctcgtaaaggatggctgagacaagactagcgaaagtttcaggcttcatgtctctctcttccctaagctggtaaagcttatgacgaaacaccaagcgctggtatcttcaaacatcaaaagacaaaacaaagaggaaaaaaaatcttctcagttcacttcaaaatgtaaaaacaaacaaatatgaaaaatttagaagcttgcacgatagtttacagtgtttgaacatcggtggcgagaccagaaagaccgatgaagacacgatcgtggatcttggagattctctggaaatcagtggcgattgtctgtagctgaacaccgagtctccgatcactggcgatggcgaaacaattcttacctaccatagcaacaacagcacttccattgtactcgaagatctgcatcgccacaaatatcaatcaattttatcgttcagtcactattaaaccattgatgcgtaagactaatagagctgaggtctccgaaattaaaattaactgggaattatcaaacttaccgacatcggaaacttagggtttcagagtagaatttggagtttttttcagaacggagacgaaatctgggaaggaggaggggagagagagggagtactaagtaaagtcgacggtggcttggaggaaaatccagccggactttctttttcgcctccaatagtattttgggcctaatttaggcctcgctttattgggcttcttatagaaatttaatttcgacgaaatttagttttgttttttgacaaaagaaatagataaaaggaaaaaattctcatttcaaatcaagagaattgcaaagggaacaaacaattagaatttaatttggaagtttgaatgtaaagttacaagtacatatcaagattggttccttagtaaacaatgatcataacaaataactacgctcatttgccagggagccaaatactgcatcagcttcagaattttcttagctcttccaaggtcaagtttctggacttgacgcatcaagaatgggttgtgaaaacgattcctcgtagcttaggtagacacatagtcatggcttcaacgtatcacagctagtttcattaacttctgcagactcatccagtttgttaatgggctgggaaaacgattgcaagagagttttttgtgcaggtaactcggcaatgaaaagcaatgtttgagcccaaccagcatattcaccatatttactcacaaaggcttctgcaactcggccatggagtttaggtgtcagttttgcaccagcaaggtctggcagtagataatttgttgcgatctgatccattatccaaaacagaacaaaaaaaaagttgcccgaagtcatcatcaccattatgtaattggatctcaattaagtaagtacaatacatagaaaccgatggactttgttacctgccagacatgtgtgtcaaccggaatagcactatgctgatcaagagaaaacagagctatgcaagctgctaccttcggaccaacaccaggtaatgtacacagcgcagcaactgcctcttggagttcgactttgcgcagagaaagaagccattcattaccaccacctggctttgcttgcaaagcattcactgtacctgttatgtatttggctctgctcaccacaagataaaccagaatgagagttttcaaatgagatcagaaccaatcagagaaacggccacacaatgattatctagcttagaccaaacattagcttcaattctatgaatgtatagccacagagtaaataaaagtataagcttcaagcaaagttttagcctaaatgtctaattcaacataatgcaaccattagagagtgatgaaatcacctgtaaccaaaaccagcctttctaaactcttcctcagaaaccctagataatcgatccaatgatgggaactgatgaaactcaaatccatcaatgtcacccaaatgtaaccctaaagacgaaacaaaatccaccatcttcgtaatcctcgcaatgttattgttcgatgagcacaaaaactgtatcaagcactcgagcggatcctgcctcaacacacgagcgccacggagatgtctcgctagctctccgaaacgaggatcttttttcgagaaatcagaccatagctcagctaacgagatctcagcattgagaaaatcgagcaacgcaagctccgcggatttagggcttgtgctacaatggacgcagtaggaaactgcgtcgtctcctggacgttgtctaagagagactaagtgaggcccaatcgttccgctatactgaatcgctccagttttcttccaccggaatgtttgacccgtcggaaaagttaacggcaacgtcagctccgtgtgggttagttttaacgggaaccatttaggtgttcctgttctgtgtagcttctgtttgagaatcggtgtgaccggcggagacagtggtggtttgacggtggaagagatcgacggctgagatgtaggtcgaggtctcttcatcgccgttgctcgttaacggaaccaccacaccagtattaatgcgcgacggtcgactaatgtatcaatttaaaccggtttaaccaatttgaactttaagaaccgaactaaataattgattcggtttttctcattcaaaattgaaaaataaaaccgaagtaaagttgactttaaccgaagttaaaccaaaatttggattggtcaacgaagcttgaatttcgaaatcagaaccctcttgtttgtcgagaaggttaggtcgtcgtggagaatgaattaatatatagagattaatgaaggaaatggtgaaagaaattgcgagaaaaaggtttggtgtttagctcgagagctggaaatcagaacgactcggaggagagaagacaaagaaagcaattctttttactaagggtcttgcttcgattccacagaacccaaaacctctatttctctatcttcatccacaaaaatg

SEQ ID NO: 7529 - DNA, 3000 bp, Unknown
  misc_feature (1)..( 3000): cDNA_ID_3050703_gDNA_ID_1621150_Annot_ID_173205 3000 nt of promoter + ATG
attccttatttgcctcaaatcattactttcggattctactgtcttgaactgtgttcatgtgtgtattccctcatcaatcaccttcaattcatattttcctatttccaaaaataaaaagatacagtatctatgtatttaattatatatcatatcaattatatcataataatcataagatcctttttatcgaaataaaaaaggaaacaaatccaatcatagcaagctttttcttttatttaataaacaaaaataaaaagcttcccgaaatggttaaaatccagaaccactaaagtcaaccaaatttgtcaaattcatccacgtcatcagttccatctataaaacgctcacgccattcgtcaagtcccaaaacaagagtccaccatgaaactcacaaacgctctcttcttcttcttccttatctgtctcctctctttatcgtcagcttcatcgaacaagcctcagctttcaaatggctcgaccatcttattcacgacgatagggagacccactttcgaattcgacatctttactctccccacgagccaccgtccaccgtcacccgccgatgagcaccgtctcaccgatggcaaatctattaacttcaacggctatttcgcttctccttctacggcgttaatctcacttctacccaaaagaactcagattcaaccacaagacgtgcatctcatctacgtcactgagagagccggaactcctagcttaaactacgacgtcgttcacagcgataacgttggatctagaattcaggttccgttattttccggcgaggaacaacagagtggtatgaatgtaaattccatgaaagacacgcctgttttaacaaacggctatcttgtccacgtgtcgacacatgagaatccgggtaagcccatggcgagttgggccgctgtttactcgactgagttacgaactaagtcgactcggcggcttacaccactgggtatcgctgacttttctccggctgtgtctccgtctgggaagtggactgccgtggcttcgtttggagagaaaggctggacttggagcatggtagagaaagagattagttcagacgtctacgttttcctgactcaggatggaactcagcgagtcaaggtggtcgagcaaggcgggtggccgagatgggtcgatgactcgactctgtatttccaccggaaaagcgacgacggttggatcagcgtgtaccgagcgattttacccaaaaccggaccggttaccaccaaatcggttacgattcaaagagtcacaccaccgggtcttcacgctttcacacccgccacgtcaccaaacaataacaacttcatcgcggtggctacaaggaggcctggatcagaaatccgccacgtggagcttttcgatttaaagaagaacgagttcgtcgagttgactcgtttagtctcgccgaagagtcatcactttaacccgtttctttcccctgactcgtcccgagtcggataccatagctgcagaggtgacgcaactggacgtaaaactcctcggaatctcctccaaagcctcaaaacaacttcaaacgacctctctctcttcagattcgacggtgcgttcccgtctatctcgccggaaggtgacagattcgcgttcgtctctttcacaggcgttttcgtggtgaacccagatggttcaggtctacgtcaattgcttccacaaatgggatttggaacagtttgggatcctattcgacatggaatcgtctacacaagctcaggtccagctttagctccaggaaagtctcaaatcgatattctcgccataaacgtcgatgcacctagtccagcaaccgccgttaaaaaactaacgactaccggtgaaaacaacgcttttccgtggccatcacctgacggtaaacggatcgtgttccgttctgcgcggtccggtactaaaaacctttacataatggacgcagagaaaggtgaatccggtggtttgttccggttaacgaacggaaactggaacgatacgatagctacttggtcacctgatggtaattggattgtgtttgcatccaaccgggaatttcccggtacgttgttgatgaatatatatgtggttcatccggatgggaccggtttaaggaagctggcgcaaaacttgaccggtttggtatcgatgcatccgatgtttagtcccgacagtaagagaatcgtgtttactaccatttatgctggaatctcggcggagcagatcggtaatccgcattttaacgtcccgagtagtgagatttttaccgtgaacttggacggctctggtttgacgaggctaacgcataactcggtggaagatggaccacccatgtggttccctaagatcaaagctactggtgatgtggcttggcctaagaggtttggccctagttgctctatccaagatttcaagacgcaaaatactaccgtgaaaatgaaaatgaataagcccgcaacaatgtcatcaatgtgtgttgttccttcacaatgatttgttatgtaacttattcttctaataaaaaactccgctagttcatatcttgttaagtatttggttagcctaagaaattatatagcttgaggtttcacattttcaatattttttaaaaataatttgggtcaatattgatgttggaaatgaaatcaacggttgaattattgtcgtgtgctgcttgcaccatggtccatgctagatggaccgaccactatttttccaaacagtgcctatcctatcaagtagatattttctgaatacgtagataattgtagaatacaagaaaagaaatatcctctgtggaataaatgaataatatacttttgtcagaaacgttacaagttaaaattccacgactgattgccacgtgtaagcttatctcaaaagggccctacagtaccatgatgacgtcatctcttacaccactctctgaaaaattcctccgccttataaaaaaactcgattatcgtcttcacttagtagccaaccaccgaccaatccgcc

SEQ ID NO: 7530 - DNA, 3000 bp, Unknown
  misc_feature (1)..( 3000): cDNA_ID_2990159_gDNA_ID_1621150_Annot_ID_173203 3000 nt of promoter + ATG
ccttggagttcagattccaaacttagtttctccgtaatacctgtgtatagcaccaagatatcctcaataccctcttcacagccttttccatccacacaattcacactttcaataaactcctcggtacaccgttttccaagacgaagcttgaggagaagaaaacacactggccaaacatcagagttatgtgaaacaaaagattttgagctggtattttttattaacatattctgttctttcaaaaattcaaacaacacctctgagctaataaaaatccccttctgttgtaacccaacaaaaatcaaacccatttccgaagcaccaactggttttctcaaagagctagtttcttcagcgataattcgatacacattccttccagtttcaatcaactcaatcaaatcaacataagcattctcatattcgtcaaacttcacacaagaaacactcaaacagcctgtgatcaacccttccttatgcaaattaagtagtgcctcacatatttgcataccaattattcctaaacgtaaagtctcatcttcgaggctatcaaactcctccaacgaaaatccaatgagcttttcacccactaaatacaaaacaccattcttcaaatcaccccacaagccaaaaactttagaaacacctctctgtttaacagagatgatcgcatcaagctcatctctttcctcctctcgcataccccacagacaactcatcatcctctggacataactatacttgaggacagaatcacaatcaccatgctcgaacgaagcaacccgtaaaagactcaccttcgaatcatccctcagacttccacataaacgcgaagatgaatcaaaatcactactttcactctccctaatttccacggaaacggcgtcgtgcactagaatccgatccttccaagtggcgtaaaagtcgtcggaccatgatcgagtgacaaattcaacgactttttcaaaattccggccaggttccagcttaagcttcgaaatcgaagggaacaatctgagaagatcaatgtttttggggagagctgatggtccttgaggtggaaacttgacgagaacggtgcaagcaggacatcggattgtgtccggaaacttcttgggtagatttgttaagcattcttcgcacgccgtgtgtccgcaggcgagtacgcgcgggacagtagactcgccgtcgtaagactgtagacacaccggacactccggttcctccatcacctccgatgattcgatgcgacgaacaactgagttaatccgacgacgttttagactttaactaaaacaacatttagtcccgagggtagttctgtatacctagtgtgtatatacatgaaaactatttgtgttataagtcatcaattttctaaaatgtctctttagtctggtggtaaagtcttccagatgagctcataatttatgggccggctctgattctgatgaagtgaagtgcatttgcaaaggtatattgtcatcttacctctgccaatatcttgcggatcctaagacatatgaagtattttcatagtacaagctagacccgtaaaagctaaagatcaaatgtatatagaattcgtcgaagtcttggaaaagaatgatgttacaaatccaagactttatcaatgccctagcaacatgcattaataaagtcttgcattaggaagattctctcttgtccatctatgatatccacaagccctggctcactagaatagggtggatgtgtgcgataacttaaagtatatgctcacttaaaaaatttacatgagaaaaaagcttttatttttttggtaaaaaaaaaagtccaaatataattgataacaatcctaaatttcttttaaagatatattagaataacccagttcttttatatacaaaaatgccatatttttaaaaatgttaaaacactatttttttatttttttttaacactcaaaatttacttcaaaaaagttctaaaaattgccttttttttttttcaaataacaaaaggtccaaacaaaaacaaattcccgtaatacacaaatttatgttgggtcggggctggacactcagtgtcagttgaaagtttaagcatatttataacttaatactgaagttccataagtttattgatgaatgtgataagtttgtctcaatgtaacagctcgagatccactcaatgtagcagctatgttctccagattcattcgtgtttgtaaaaaatgaaaactagaggtggcttgattgttcgacgagtattgttccaggaagcagccgtcttacttcttttcaataacacatgttaaataaatcgatattgtttgttcaatcatagagagaacttcttttcttcttttattattattgtagtagtaatcatgttcattccaattgagcaattatttgctttccatctacgcccaaaaaccaacttctcaatgcatcgacatgtaagaaaatttgcttttatgttataaagttgtgtaacatttctcttggaactattgattgtctcaacgttgcaaataaagtaataaaatcctacaagatactaataatatccaaactgggcttataatcctaaaaatgacttccataattaaaacgaatttagtttattaattagtgtaatggaatattttgtcaataaaataaataatcacgaaggattatataaaggaagaaaaaaaaaggaaggtgggaattttaaaagggaaagacacctgtctctctgacccacccacccattcatttctgtggctactctatcgtcgtcgtctccacaccgtcggtgccctcacggatcaatttctagagagagagagagcgagagagacgattcgtttttctagattctcgtcaaaaaaattttccctccttcgatctctcctttttccttattcagcatttccccattttttcacgcaagatccgtgattttccagggattgatctgattgggggatcgtgaaattcgtttgtgttttctgctcgattaaccggagaa

SEQ ID NO: 7531 - DNA, 3000 bp, Unknown
  misc_feature (1)..( 3000): cDNA_ID_3050707_gDNA_ID_1621150_Annot_ID_173202 3000 nt of promoter + ATG
aaggtcatctacaccaaactgtttattcttcgttgcagcatcttcagcttctctatatttactagcagtgtcagaagcggaggcactacgtcgcatagtacccatggcaaagtcttcaagttcgtctattgaagacattcctacactcttacctgtggaaataatcgcatgactagttagagcacaatgaaaacagtaaacaaaagctctaatccgacacactttcaggtcatcaaagaaattaacctctgttcactttttgtgttggtttaggcggaggcttgagttttgtagaagtatgtgaagtatttgatggttttatcccctgagagctgactgtagcagcaaattcttcaagaggatccacgaacagaccagtagaagtggttgattctaggaccacaaaaggatcagtagcatcaaagttcgacggtgtagtcttgctgaaaaacataacaaaaacaaaatatctcaacaacaaaaaaattcaaaaccataacagtaaaacattttcctgtacaaaggttatctgagatttcaaataccatccacgagacagtaacatattccatacatgacaaacattagcatctcatacaatataacagaaattggcaacaaatgtttcataaaccgatcacaaacctgctagtcgtctgagtacttccaccaaaaccaggtatcaatccatcataaccagcttcattcttccccaaacccaacaaatcatcaaccgcagcagcatattgcttctccgatgaagagaatgacccaaacaaatcatcattcttaacactatcagagcttttagacccaggaataacaccaccaaacaagtcatcagctgaagaaggagttgtcttccccggattcccaaaattggagaagaacaaatcatcgttcaatgaagacttgctattatcaccggaagatgaagatttgttcaacccagcaaaaacatcaaaatcattcgaaaccttcctattagtagagttagccggaaagaaaatatcgtcaccatcaaacaaagacccattagtagaatccttattccaagagctattggaagaaaaagacgtcgactttgcatttaaaccagaggagcctgtaccgaaattccagctctgaccattgttgttagggttacgcttagaagcagccatcggagcagatttaccttgtggcttaatcccataacgctccgttagaacaccaaactcgtccatttctccggttaatcgagcagaaaacacaaacgaatttcacgatcccccaatcagatcaatccctggaaaatcacggatcttgcgtgaaaaaatggggaaatgctgaataaggaaaaaggagagatcgaaggagggaaaatttttttgacgagaatctagaaaaacgaatcgtctctctcgctctctctctctctagaaattgatccgtgagggcaccgacggtgtggagacgacgacgatagagtagccacagaaatgaatgggtgggtgggtcagagagacaggtgtctttcccttttaaaattcccaccttcctttttttttcttcctttatataatccttcgtgattatttattttattgacaaaatattccattacactaattaataaactaaattcgttttaattatggaagtcatttttaggattataagcccagtttggatattattagtatcttgtaggattttattactttatttgcaacgttgagacaatcaatagttccaagagaaatgttacacaactttataacataaaagcaaattttcttacatgtcgatgcattgagaagttggtttttgggcgtagatggaaagcaaataattgctcaattggaatgaacatgattactactacaataataataaaagaagaaaagaagttctctctatgattgaacaaacaatatcgatttatttaacatgtgttattgaaaagaagtaagacggctgcttcctggaacaatactcgtcgaacaatcaagccacctctagttttcattttttacaaacacgaatgaatctggagaacatagctgctacattgagtggatctcgagctgttacattgagacaaacttatcacattcatcaataaacttatggaacttcagtattaagttataaatatgcttaaactttcaactgacactgagtgtccagccccgacccaacataaatttgtgtattacgggaatttgtttttgtttggaccttttgttatttgaaaaaaaaaaaaggcaatttttagaacttttttgaagtaaattttgagtgttaaaaaaaaataaaaaaatagtgttttaacatttttaaaaatatggcatttttgtatataaaagaactgggttattctaatatatctttaaaagaaatttaggattgttatcaattatatttggacttttttttttaccaaaaaaataaaagcttttttctcatgtaaattttttaagtgagcatatactttaagttatcgcacacatccaccctattctagtgagccagggcttgtggatatcatagatggacaagagagaatcttcctaatgcaagactttattaatgcatgttgctagggcattgataaagtcttggatttgtaacatcattcttttccaagacttcgacgaattctatatacatttgatctttagcttttacgggtctagcttgtactatgaaaatacttcatatgtcttaggatccgcaagatattggcagaggtaagatgacaatatacctttgcaaatgcacttcacttcatcagaatcagagccggcccataaattatgagctcatctggaagactttaccaccagactaaagagacattttagaaaattgatgacttataacacaaatagttttcatgtatatacacactaggtatacagaactaccctcgggactaaatgttgttttagttaaagtctaaaacgtcgtcggattaactcagttgttcgtcgcatcgaatcatcggaggtgatg

SEQ ID NO: 7532 - DNA, 3000 bp, Unknown
  misc_feature (1)..( 3000): cDNA_ID_2173290_gDNA_ID_1621150_Annot_ID_173198 3000 nt of promoter + ATG
ttaaaattttgataaaacgttgatgctcatttactagaggaaactcagtattgtatttttggctagttggcaaaagaacttctacatgtacaactgtatatatgtattcctttgtttatattcataaaatttcctctgttttacaggttggcagcctggaatccaggaaggtgctgctgattgggatgaagattgggataagctagaggacgaaggtatacttgctgtttagattttgattttgttgtcagatgagattattgtggaagcatggctgtagatataatatcgatatcttgtgtctttataatttttttttgggtgacctatcttccaaatttggctatggaatatgcagttgaacacttgaaattgacatcttattttctcttcacttccagggtttaccttcgtcaaggagcttacacttgatattcaaaatgtcatagccccaccaaaggaaaaatcatcagcgtggagaaaagaagttgatgtctcttcaaaagaaggtgaagatgtttcattctcagatgctgactctaaaacggggaaaaagcaaagcagtggtgaagaagattctgagcagtcagagggtaaaacatccgatgttgatgccagagataaaaacggatctctggatgactctaaagttagaaagggcattgaagctgatagttcacctcgaacgaaagatacgaggaggtatgttttttgtgctagacctaatgtgttttggattgcatccttcttagctgttttgaattcatgtgtttccgtgaaaagtactgcaaatagaggaaaaacaggttcttttctccagagaagaatatatctcggttatttacattgtctatgttaattttccagtgaaaatggccatgatgatggtgaatctactgcttctgctggcaaaactgtaaattatgactctcacgacgagacagattcagtttcaagcgtcaaccctgacaacggcaaggtaaaccattttgaacaccccgaagttttgggtttgttgcgtttgataatatatatatatttctttaacctttgtatttcgacatgaaagaatcgttaatttttacgtaactattttttgttatgtttttaccaggacaaggatcatgggaagtatgacagtggttttggatttggatttgggtttgatgacttcagtattaagcctataaaaactggttcgaccatttcaaatgacttcctccctcctaagttatctatatttgctgattccgtcccaagcccaccggcaaatgcaagcgacgtttcccctacaaaaccttctttgtttgctgattcagttccgagcactccagcgacgaacaatgcctcttacccaggccagaaatcattttttgatgactcggtcccgagcactcctgcttatccaggcaacttgtttgctgagaagaaatccttctttgacgactctgtcccgagcacccctgcttatccaggcaacttgtttgccgagaagaaatcctatttcgatgactctgtcccgagcactcctgcttatagcacgtctgattttggtgggaagccatttgcatcagagactcctcgttcagacaacctgttcccaggaagaagcccctttatgttcgactctgtcccaagtacacccgccgcacacgatgacttctctaacaacagcttctcccgcttcgattcattcaacagcaacaacaacgatgctttctctctatcccgcacagactcgatgcgcagcacaagcgagcctgacccattcgcatcaaggtttgattctttcaactatcaaagatatgattccttcaatgcacaaagctatgattcctctagcaacaacaatgcatcggagacgcctaaagcctcattgacaagattcgactcaattggaagcaccagggactctgattacagtcatgggtttgggttcgacgaccatgacccgttcggttctacaggaccattcaaaacaacgacaactacagcagagacacctcggagttctgataattggaatgctttctagccagaagcccacgtgcgatatgaatatgatcacatatcatatactttgctgcttttatagtttgaatttaccagtcgaagagttatatgtatcttcatttctttggtttcacctgcttgcttcattttttattgttaatatataatagtcttttttgccattttttcttttaaggatttttcgaagagtgtcctttgttggtctctgcgtagtgtttctttttatttgtgtctttgtttgttaacttgaataatgaattattatttgtccctgtgaaaacttctattgtatctttgtaatcgtatggatacatttcagatgttgttatattagattgattggtaattttgggaataatccgtatccattttttgatttatactttctattttgtaaactgaaaggtaagtagatatactattagcatttctcaaaatctaatcaagtgttataatatcatacttttgttgatagtaattatgccagaatcatatgcaataattttcttaagagcatatatgtgttggaatttacgaattcaatctgatgccgttcaaatttgtttgataaaattagtgatttactgtatataaataattttccacagtaatatagtaaaaacgaagaaatggatgaacaaatgaaatacgagaaattgaaagaaagaaaaaaaatcattttccttatctttttatggtcataagaagaagagatggaaagtgaaaggcgcgtggagtgcacgcgcagctcaagtgtcaatccagtcacaatcaaatggaagaagcacaagttttaattcaacctcttcggcaatgaagaagaggacgaatccacgaggtccaccaaattcctgcaaacttccaaaacaccatctcaaatatccacattctccgccattaccctgaaccgtttctcgagttgtttctctcatgttcctatgcttttgcccttgccacgtacctatc

SEQ ID NO: 7533 - DNA, 3000 bp, Unknown
  misc_feature (1)..( 3000): cDNA_ID_3050718_gDNA_ID_1621150_Annot_ID_173197 3000 nt of promoter + ATG
gatgtgaagcattctgatagagcaaatcatcagtctaggaatgatacaagtcacaagtcaagggaaactggatcctctagtgcccttcatcagaaatacagcaacaaaagcttacaccaacaatctacgtccctgctaggaaaatctccccccaatgtctttgcagaggtaacagtagtccgtcagaaagaaaacaatggtatgcatcagctggcaaatgtaacgggaagcagacaatctagtcaagcgtctgtaagtacattccaactgtgtctacaattacataaaatacactcagtaagttggttgcattctaaggtcgtagttttgtttctccagttttcatctcggttctgtgatatttttctggtcaatctttgcttccatgcatttttcttaccacaaagtttacatcagtcttgctttataattctgcaataacctgtctctactcagaaaaaagatggttctaatgtgaagtctaaaacctcaatcctcgagaaagccataagggaactggagaaggtggttgtggaatgtgagttttaatatttttcaagtgtgaccaactagaatagcatttggtgattttcaacttacaagaatttatgatttataagcagcaaggcctcctgctatcactgaaaatcaagaagctgatacctcatcccaggcagtgaagagaagattgcccagggatgttaaattgaaacttgctaaagttgctaggattgcggtactagagcttttccatttgttcttctcatttttttgaaacttgaaacggtatgagaaaaaactaatatgccttttgtggcagcaggcaagccagggaaaacattcaacagagttaatcaaccgtcttatgagcattgttggtcacctaatccagcttaggtctcttaaggtaaaattttctgtctcctgtatcctagtctttctgttactaaagcagacttgttaggactttcgtcaaggtgtttaaatagttagtcttcttcaggacattcatgttccagtgaaaaactcttctgtttcaggtacaagcaaacaaaatatggtttcttactctttgtaatgcttattttgcagaggaacttgaaaatcatgattgatatgggagattctgcaacccgagaaaaggatactaggttcaagcaaatcaacaatgaagttcttgatatgataaaggccaaagtttctttgatggaatcacaggttctctctctctctctctgttctaatcttaagttgcttgataggcatttctttcatccatggcttttctatcttattacattcttggaagtgtcattaacttttatgaaatctggagttctctctgataatggttttccgtagatcaagctcttcattcttttgttttcgatgttccctgtgggtcaatctgcctttgtagcgtattttcctcctattaatatgttgaggcacctgtgacatttatgatatttcttgcactatcattttatgttccataggcaatcaaaccagaaggtgcaacatcagacgattttcaggactcagtagaaaagccatctttgaagaagtttgtcatggatgcggcattggaggataaattgtgtgacctatatgacatatttatcgacgtaattatcatttacctttataatctgccatgccaattctagacatagaattagagtcaaaacggttttgttcctgttttttggtatattagggattggatgaagatcaaggtccacaaacaaaaaagctatatgtcaatgtaagcccttctccattcccgattatttttggtattctggttttttttgttccaagcttatctcatgtcttaaatcaccaattagacctagccaaaagctcaaggtggtttgttagagcttgatgaatattgttttggaattattcatgctccagttggctgaactctggccaaatagattgatggattatcgtgggatcaaacatgcaattttccgggcaaaggagagacgaaaagcattgtatggaaaccttgcgaaagagatggtagttaaagaattttctcagccctttacctctttgcattaaaattttcgcaatttgctttgcttgattagattctgctttgttaaaggatcaaacaaagatgaagaagagtatgaagcagttggtaccaagaacagactgtactgctcagcccaacaccgaattagtggttcagagacaacacagtggggaaaaaaaattgattgttgatccaaatgcaaccagcacttccgtggtcactagtcaaactatggttgacagatcaaatcagcagcagcctgagaagctaaagggaatctcaagctcttgcaatcctacagaggaaacaagagtggtcaagagaaagaacgaggctgtaatggctgagaaacaagtcgttcttgccctgaagaagcccgaacatccacagacacgtgtaatcccagctcctcagaatctgaacatcccacgaacaaccccggacctgaacttgccaagttgacatcacgattgacaaaggagctcttagaaacgccggagacaataacctctggcctcttccttccttgtattttgaggtggcacggcattagtcctggcgatgccgatgcttggtttttttagctacaaagcatggtttataaagttgtctgtattccagtttggctcttattaagttagttactctatttacgtgtcctttttcaaaactctaatgtataaagttatgattttacgggcaactctttacttttgagtaaaaaaaacagagcaggttttagtactgaattttgggtaacgtagttgaaaatttgatttcggacgataatgtaaaattgatgaaatacatcaaaatgactacattaatccttttgacacaatatgaataatcaattttaattaatattattattacttgtaaaacagtataaatatggctcattatttcacagattctcaacactctctcattctccacaatttacg

SEQ ID NO: 7534 - DNA, 3000 bp, Unknown; identical to SEQ ID NO: 7524
  misc_feature (1)..( 3000): cDNA_ID_3050722_gDNA_ID_1621150_Annot_ID_173196 3000 nt of promoter + ATG

SEQ ID NO: 7535 - DNA, 3000 bp, Unknown; identical to SEQ ID NO: 7523
  misc_feature (1)..( 3000): cDNA_ID_3050726_gDNA_ID_1621150_Annot_ID_173195 3000 nt of promoter + ATG

SEQ ID NO: 7536 - DNA, 3000 bp, Unknown
  misc_feature (1)..( 3000): cDNA_ID_2173290_gDNA_ID_1621150_Annot_ID_56849 3000 nt of promoter + ATG
agatgctgactctaaaacggggaaaaagcaaagcagtggtgaagaagattctgagcagtcagagggtaaaacatccgatgttgatgccagagataaaaacggatctctggatgactctaaagttagaaagggcattgaagctgatagttcacctcgaacgaaagatacgaggaggtatgttttttgtgctagacctaatgtgttttggattgcatccttcttagctgttttgaattcatgtgtttccgtgaaaagtactgcaaatagaggaaaaacaggttcttttctccagagaagaatatatctcggttatttacattgtctatgttaattttccagtgaaaatggccatgatgatggtgaatctactgcttctgctggcaaaactgtaaattatgactctcacgacgagacagattcagtttcaagcgtcaaccctgacaacggcaaggtaaaccattttgaacaccccgaagttttgggtttgttgcgtttgataatatatatatatttctttaacctttgtatttcgacatgaaagaatcgttaatttttacgtaactattttttgttatgtttttaccaggacaaggatcatgggaagtatgacagtggttttggatttggatttgggtttgatgacttcagtattaagcctataaaaactggttcgaccatttcaaatgacttcctccctcctaagttatctatatttgctgattccgtcccaagcccaccggcaaatgcaagcgacgtttcccctacaaaaccttctttgtttgctgattcagttccgagcactccagcgacgaacaatgcctcttacccaggccagaaatcattttttgatgactcggtcccgagcactcctgcttatccaggcaacttgtttgctgagaagaaatccttctttgacgactctgtcccgagcacccctgcttatccaggcaacttgtttgccgagaagaaatcctatttcgatgactctgtcccgagcactcctgcttatagcacgtctgattttggtgggaagccatttgcatcagagactcctcgttcagacaacctgttcccaggaagaagcccctttatgttcgactctgtcccaagtacacccgccgcacacgatgacttctctaacaacagcttctcccgcttcgattcattcaacagcaacaacaacgatgctttctctctatcccgcacagactcgatgcgcagcacaagcgagcctgacccattcgcatcaaggtttgattctttcaactatcaaagatatgattccttcaatgcacaaagctatgattcctctagcaacaacaatgcatcggagacgcctaaagcctcattgacaagattcgactcaattggaagcaccagggactctgattacagtcatgggtttgggttcgacgaccatgacccgttcggttctacaggaccattcaaaacaacgacaactacagcagagacacctcggagttctgataattggaatgctttctagccagaagcccacgtgcgatatgaatatgatcacatatcatatactttgctgcttttatagtttgaatttaccagtcgaagagttatatgtatcttcatttctttggtttcacctgcttgcttcattttttattgttaatatataatagtcttttttgccattttttcttttaaggatttttcgaagagtgtcctttgttggtctctgcgtagtgtttctttttatttgtgtctttgtttgttaacttgaataatgaattattatttgtccctgtgaaaacttctattgtatctttgtaatcgtatggatacatttcagatgttgttatattagattgattggtaattttgggaataatccgtatccattttttgatttatactttctattttgtaaactgaaaggtaagtagatatactattagcatttctcaaaatctaatcaagtgttataatatcatacttttgttgatagtaattatgccagaatcatatgcaataattttcttaagagcatatatgtgttggaatttacgaattcaatctgatgccgttcaaatttgtttgataaaattagtgatttactgtatataaataattttccacagtaatatagtaaaaacgaagaaatggatgaacaaatgaaatacgagaaattgaaagaaagaaaaaaaatcattttccttatctttttatggtcataagaagaagagatggaaagtgaaaggcgcgtggagtgcacgcgcagctcaagtgtcaatccagtcacaatcaaatggaagaagcacaagttttaattcaacctcttcggcaatgaagaagaggacgaatccacgaggtccaccaaattcctgcaaacttccaaaacaccatctcaaatatccacattctccgccattaccctgaaccgtttctcgagttgtttctctcatgttcctatgcttttgcccttgccacgtacctatcatgagtcgcctttctccggccaccggaatctcttcccgcctccgcttctccattggtttgagttccgatggacgattaattcccttcggattccggtttcggagaaacgatgtcccgtttaaacgccgcttgagatttgtgatcagagcgcagctctctgaagctttttctcccgatttaggtttggattctcaggttacttacttacttctctcgacttccttgcttgttttcattcactttgttcgatcaatctaaacttagagagacagagtttgcgaagctgaatttaattgttcttaggatctttagattatcgaatcgtttcatgatttttaagcgaaacttttgctgatcagagttgcttatttagtatttcgactgacttcatacactttgatattgaaggctgtgaaatcccgcgatacatcaaacttgccttggattggtccagttccaggggacattgctgaggttgaggcgtattgtagaatttttagatcagctgagcgactacatggagcgttg

SEQ ID NO: 7537 - DNA, 3000 bp, Unknown
  misc_feature (1)..( 3000): cDNA_ID_1818083_gDNA_ID_1621150_Annot_ID_56850 3000 nt of promoter + ATG
tctctgttaaacagagaggtgtttctaaagtttttggcttgtggggtgatttgaagaatggtgttttgtatttagtgggtgaaaagctcattggattttcgttggaggagtttgatagcctcgaagatgagactttacgtttaggaataattggtatgcaaatatgtgaggcactacttaatttgcataaggaagggttgatcacaggctgtttgagtgtttcttgtgtgaagtttgacgaatatgagaatgcttatgttgatttgattgagttgattgaaactggaaggaatgtgtatcgaattatcgctgaagaaactagctctttgagaaaaccagttggtgcttcggaaatgggtttgatttttgttgggttacaacagaaggggatttttattagctcagaggtgttgtttgaatttttgaaagaacagaatatgttaataaaaaataccagctcaaaatcttttgtttcacataactctgatgtttggccagtgtgttttcttctcctcaagcttcgtcttggaaaacggtgtaccgaggagtttattgaaagtgtgaattgtgtggatggaaaaggctgtgaagagggtattgaggatatcttggtgctatacacaggtattacggagaaactaagtttggaatctgaactccaagggaagtttaaatcgatggttgaaattcttcgtcaatgttgctgtcttgatcctcaggcacgtcccgttttgactgatctatggaaatgcatcagggagctggtcatgaaacctaggttcaattctatgagtagattgcataagacgatttatgggaaaaggaaacagttctgtttggctcaaagtgaattatgtcgcctggtagaagtggaatccaaagaagtggacaaagagttgcctggaatgaaaattggcgatgaagcagaggagggtaaggttgacatagattttccggggagagtctcagaaggaaaggtgagatctaaagacatgcggggacaccaagactctgtcacaggtttagccgttggaggtacaccttcttcttatattttgtactttcttataaactgtacaaatcttataacaatgtatgttgaatagatgatcaatgaggtactcaatattccttttctctgtataggtgggtttctcttcagctcttcatatgatagaactatccttatatggtctctgaaggtacatatgcgtataaagttagtgataggtcctttatagatttttgtttatgttcttctcagcagctctctgatagtaaggtccttaattcgagctatataaatcgtcatgcaaaacacgctatatgcaggacttctcccatgtgcatacatttaaaggtcatcaggataaagtaatggccttgatacacatcgagggaacagaaccagtatgtgttagtggcgatggtggaggaggtatctttgtatggagcactacttttcctctggaagaacagccgctaagaaagtggtatgagccaaaagactggcgatatactggcattcatgcattggcatactcagaatatgggcatgtgtacactggcagtggagataacactatcaaagcttggtcactgcaagtaagttaatttccctgtacacctgtaattctgataagattttttcttcttcatattatctgatgatgattattttcccaggatggaagcctgctttgcactatgagtggtcataaatctgtagtctcaacgcttgttgtggtaaatggagtactatacagtggaagttgggatggaaccgttcgtttgtggagtctaagtgacaacagtttgttgacagtgttgggggaagagactccaggtattgtaagatctattctgtctctagctgcagacgatcaaactctagttgcagcttatcaaaacggagatatacaggtctatatgtttccttaaaaacaatttacttgatgtgcttcatttcaatcgtattgccagtctctaaacctgaacccttctgattccttttccagatatggagggatgatacattgatgaagtcaatgaaaatacagaatggcgcaatcctcagcattgccgtgaatggtaaatggctattcactggaggttgggacaaaaccatcaatgtacaggtaatccactagtttcttgacaaagctagtgacgaataatctttatcggaagtgtaaaaagaaaatcaatactttatccattacttgatgacggattttcctcctaataatctgttaccgaacaccggtttgtaggaattgtcaggagatgagatatcagtaaactgtgctcacgttggttcaatcccaggttcatcagtaatcacatctttgttatattgggaaggcaagctctttgcagggtttgcagataaaaccattaaggtgataatagtccaaattgtctgtctttttctttgcattcatgatttacctctgttgttaaatttggcatgtaacaagagaagttttgtctccatttcttacaggtatactattttggacgctaacaaaaactattgtgctctccagttttgctcatcttgtttttgaagattctttcttccataagttcctccgtagatgccactctcgccaaaacatgttgtgtgaatatctaaatgtaaatatatgtgaatatgaatccttcgtaccaatctgttgatgatatatacgtgattcgcatttttcttatttctcttagaacatctttatgcgttgagatcaaatcaatacaagaagagataaattcttaagttgtagtgacatactgcgaaagtctaaaatgtcgagggacttaaaagtgaaatattcataaaaagatgatccttcaaattgagtaatttagcgccaccgaacggtatagggaggcaaaacaatttgagtgaaaaatacgacagagagcttctcagttctcatccatggatacttgacctcaacaacgagaaagtcactataacgaagcaattttttttgtaaaatg

SEQ ID NO: 7538 - DNA, 3000 bp, Unknown; identical to SEQ ID NO: 7531
  misc_feature (1)..( 3000): cDNA_ID_1818079_gDNA_ID_1621150_Annot_ID_56851 3000 nt of promoter + ATG

SEQ ID NO: 7539 - DNA, 3000 bp, Unknown; identical to SEQ ID NO: 7530
  misc_feature (1)..( 3000): cDNA_ID_2990159_gDNA_ID_1621150_Annot_ID_56852 3000 nt of promoter + ATG

SEQ ID NO: 7540 - DNA, 3000 bp, Unknown; identical to SEQ ID NO: 7528
  misc_feature (1)..( 3000): cDNA_ID_1818061_gDNA_ID_1621150_Annot_ID_56857 3000 nt of promoter + ATG

SEQ ID NO: 7541 - DNA, 3000 bp, Unknown; identical to SEQ ID NO: 7527
  misc_feature (1)..( 3000): cDNA_ID_1842620_gDNA_ID_1621150_Annot_ID_56859 3000 nt of promoter + ATG

SEQ ID NO: 7542 - DNA, 3000 bp, Unknown
  misc_feature (1)..( 3000): cDNA_ID_1818050_gDNA_ID_1621150_Annot_ID_56861 3000 nt of promoter + ATG
ttattttattttgttgatataacagggaacatctaataatagttgttctcttcgaaatgcagagagttagctaaagattttgttgtatctggaactgcttcagaatcactctatggagcttgtgaggcaatgtacaagccagatatggtttgcccgctaacaacctcatcatctcttgttatatttctaaatcccgacaatgaaaatgcttaaattaccacatctaggcgttgcagtttggtaggttcaaggtttagtgttactatgtagaaaagttgaatcttgaattggtgtgaacattaaggtgcataatgcccgtaggaatcacgatagccattagttttctctttgatatcttcaattatccctctctggcatgaggtgtttaatagtctgagcttgttagccatactccattgtactactctagacttatgtatcgagactctggcttaacacatgaggattttcaggaagctgaggaattgttcgagacaatatcgcaagcacttctctcatctgttgaccgtgattgtctgagtggttggggagggcatgtttacattgtgtaagttctcatttcttctcttcttttccacacatttgttatccaaaattagttcttaaaacaaacttccatggtgatgtgttgtacagaacaccaacagagattaaggagaggatcctaaagggaaggatggattgatctgcttcttctattcaagttgttttccgctgtaatccggttttaagtagtgtaaccttcacatcccggtttaattatatgatcattccttggctgaaattatgggttatgtatgaagtttgattttcctcttggataatggattatatgattttaattcgtagagttatcgaagaataacacttttaactcaattgtttccaactaaataagaaaaaacaggggaaactaaaatatcacagtaaccgccagatcttagagcagttacagcgactaactcctcaaaggcctctctaatttcctgtcctaattcgatcggcttgttatgtctgttaatccgcataataactaatctagaataatccaaaatcggaagttggtcgtgatgggtaacgtaatggactcattcttcaccggattctctcattctatcggaaacttctttggttctccacttgactttttatctggaaaatcttgcaggtaattatacacaaaaccatcacttatattacaataatcttcaaagtttattggtttgcttaacggaaacttaaaactaatcttacttggaacagttcggtttgtccatcaccgtgggatttcatatgctacgttgagaatttctgcgtggctaatcttgcgaaaaccgccttaatcctaatcttatcctacttctttctattcttcatctacatgctatacaaagttggtttttggcattgtatcatccacggtttcttcaaactcctatgggttttggtctcttgttggttctacatgcttggctattgttgtagtttcttctgctatgatctgctacactctaaacgtagaagaagacgcagacacaacagatatatagaggaagattatgatgataatagtgatgacgatgatgatgttgatgatgatgggtcgttcacgtaccatagatcgaagcgagaatgcagaaaagaagaacgtcttagaaagtctctgagaccgaggaaccatcgtgttagagttggtgtgaggaaagaccatcgttctgactcgggtttgagccaacatgctgatggtggtagtccgatacatggtgttagagtgagtagagagtctaagttcgcacggaaggtttcaaaacgcagaaatcgagttcaccatggtgatagaatgaaccatgtcagtcttcttaattaatacatcacaatggaggaattacctgcaactgtcaatgatctcctctaagctttataattcctcttcttgaaagttgaccagctgcatgggtcaatttttataaaccaatctctctgtgtttttggaccttttcattatgtttaattcttgcttcttcggtttaataagtattgtaatcaacataataccaaatatttagttttgttatgacttatgagggcaaaaccaaaacatgaatgagaatctttagagtgctcgcaaaatcttgaatcaagaatcatatttatggtaatgggctcctcaatattgcttcagggacaacagctagaatgtgtgatgtacctaaaggaccacaaaaaaagaacacaagtttcagcaatttgttttcattggtcaacacatcaattgttcacaaaactacaaaacaatctaactgaggttttactaacatgaatcatgtaaatatgataggttgctcgatttgtgcaaacacaaacaataagaaaactataagacttaaggaatttcatcacacacaaaaatacaatttatttttctataatctataatgttttgctttcattccgattatacccttgataatgatgattaggtgagggtaatttcgttatttacaattaaactcacataattacaaaataatgttgccttgccctgagataaacatcaccaaaaaatgttttttttttctttcttagagcaaacaatttgttttcaaaaaattattatttttggcagctcagcaaaattatttaattctttctgtcagttcatcaaataatttaaatattttgtccatgtgataataatatgtagcgcagagagtaaaaataaataaattcatttacagaattgttttgtaaccaattagatagcagtactttaatatctgaggctattttcgtcattttcaaattatggtgtgtttttttggagggagtgggaaaaaaaaaatcgatacatgaatgacgtgacctccattgatttcggcgaacgagcttcttcttcttccctctctctctctctttggctccatctcttacagtaactgtctcttggaaccatttcctcttcactagtatcttctaaca

SEQ ID NO: 7543 - DNA, 3000 bp, Unknown; identical to SEQ ID NO: 7526
  misc_feature (1)..( 3000): cDNA_ID_1818046_gDNA_ID_1621150_Annot_ID_56862 3000 nt of promoter + ATG

SEQ ID NO: 7544 - DNA, 3000 bp, Unknown
  misc_feature (1)..( 3000): cDNA_ID_1985662_gDNA_ID_1621150_Annot_ID_56863 3000 nt of promoter + ATG
aagggcagtgcctgtggtagaaagggctacggagagctcttttggttcaaagactgtgtcgtcgttttcgagcagtgaagaagagtcggagtttcatcatgttaatgatggagaagggaagagtagcagtaatgatttaggtgggcatgagacggttgctactaagagtgttggagaagtagaagaagaatatgtgaggaagaaaggagttagctttgagttggatgaaaatgtaactacttcttttgatgttgaatcttccaagattagtagtctatctgcattgtcggttcatgccactagagatcttagagaagttgtgaaggagatcaagagtgagtttgaggttgcttcttcacatgggaaggaagtggctgtgttgcttgaggttagcaagttgccttatcagcagaaaagttcggggctcaaaggtaatgtttttacatgttctgtttgtatctgtgattgcttccttaattgcataaatagctgcattttgaaataacttatacatcagaaaccattttttggagatcaatcttgttacttgtggagatgataatgcattactgcaaatcatttgcagttagattagagctatagctttaaattagcagtaatttggagctcttcatgcaggagaaatatatgtatactctgatagtaatattagtagactttcgtgaattttcttcattttaccttggatctgttcaaattaggaactacatttcgatgtaatgggaagtaatgttgagctcttgttgctttcgattgaactgttatgggctttttcttctctgatggagcttctagattatgaaccatagatttgatttgcgtcacttgagtcttaccttggtgctttttttctaatgatatttacttcattttttctctagtcatcttctcccggatcatgtatctggttgcaccatccacagtttcatcgcgctctcagcctcaaccgtcaatacgtttaacatctaggatattgaaaattgcaaaatcatacaatggtcaggatgttagagaaggcttaactgggaacctctcagcaaccttggagcaactctatgcttgggaaaagaaactgtacaaagaagtcaaggtatgtatgtgtttcttgattttgaatggattaatctccttagattggagcatcttttgacagatgtagttgtttgttgatggcaggatgaagagaagcttcgtgttgtctatgaagaaaagtgcagaacactgaaaaaactggatagtcttggtgcggaatctagcaagattgatactactcgagcagccattagaaagctgctaaccaaactcgacgtctgtataagatctgttgattccatttccagcaggatacataaactgagagacgaagaattacagcctcaactaacacaattgattcacgggtataaattgatctcaattcttttactattcctacatttatatattttcgtttgtgtgatccgatacttgggatttgaaggttgataagaatgtggagatcaatgctcaagtgccaccagaagcagttccaggcaatcatggagagcaaggttcgatctctcagggcaaacaccggcttacaaagagactccggtttgaaagctattcttgatttggagatggagctacgagaatggtgcattagcttcaacgactgggtcaatactcagaaatcatacgtggagtctctaaatggatggctctcaagatgtcttcactatgaacctgaatcaacggaggacggaattgcccctttctctcctagccgtgttggagctccacaggttttcgttatatgcaaagattggcaagaagcaatggcgagaatctctggagagaacgtttcaaacgcaatgcaaggctttgcctcgagtctgcatgaactatgggagagacaagatgaggagcaaaggcagagagtgaaagcagagtatgtgtcacacgatttcgagaaacggttgaatgatcttcggatggagagggcgagagtgagaatgagaaacgatcagctacaagacggtgcatcagagaaaagcgtggtcttgtccgagagcgggatctcggcgttggatgatttgaaagtggacttggattcaatgaggaagaagctagaagaagaaagagcaagacacaaggaaacaattaaacttgtgaacaatgcagcttcaagcagcttacaagctggtttagtaccaatctttgaggctttggggaatttcacttcacaagttgtgaaagctcatgaagatgttaggtttcaacaacaacaacagcctgagtctgaagattgattttgcacgaattaaaaagttttggtaatgaaattagattcggatttaggaaacaaattgttgtacatattttagcatttatatattcattgattggttggctacttgcttgtagattcttaatctttttctattttaaggttctcagatctttaaattaaattacttctgaaatctgaaccttataataatcattaatctatgagaaaattgataataatcgcaagaaaccaaacataattggtcagatttaagatctatgaccatttacttgcacgaagtcacggacctgagatctcacaacaagatcaacgaaagagaagaagccacgtcattgtcgatatcgtgacgcttgtacattggtgcggaacagtgtgtcttcggtttagacaatttttctcttcttaaaattactttttactgctggtaaaatggagtaaataactaaataaattttataacggcctaggtcaaaattatcaagacactgtataaacattaaaattcttgccaaatccctataaactatgacgacgtaatacccaattagagatagccacgtggatgtatgaccaatttaggagcattcagttttcgtgttttgcagtgataaatatctctgagagctaaccccggagagcttacagaattcaagctaaacattgttagagagaaagagagagcgata

SEQ ID NO: 7545 - DNA, 3000 bp, Unknown
  misc_feature (1)..( 3000): cDNA_ID_1818137_gDNA_ID_1621151_Annot_ID_56878 3000 nt of promoter + ATG
taagcacgataacatattgcaccaattggctaaatctgataattaaaactgacttcaagcaaactccaaaaccaatgaccagaaaagtctctcctcaatctgaatgagcttaaactccttcctttatgtcaaacctaccaccccattaaagtttaactcctcctccaaatatcctccttaaactcaactagatggttttgactcgctattttgagccagggttatacagtcatcaatctgatgagcatccatcatccaggaagggaattactatgtttgaaacacgggtttgaaacacaagtatacaaacccgtgtttccttccatagacacaccctatgataagcagcttagaagcttctcctagtagcagaaataatcgaagaccataaaaagagcccatgttaacaaacagatcagagaattatctgtagcaatctagaccttgattgattcgtattagtcatccttccaccattataaggtctaccacgcggagtagcagaagcggctttacgagcaacggttgttgttacaggaaactggtttccttggaaattagacctcttcttagcaaaagcaccctgaaaatatgatataaatcacaacaccacaaaagaaaaaatcttctaagtgacaggaaaatgaagcttagacaacaaattcaccgagaacacaacaacactaacctgtctaacatcagaccgagagtccatataacgctgtgctttcaccgcactattcttcgcagcaccactaaatttctcctttttattctgctcaaacacaatatgccaaatgttcaataaagaatcaaagagagacataaaaatgtaagctttaacaaaccaagttactaaccaatactctctgtttcttgcccttattcacattggtattgctcttttccatcttgataatctcatctatacccacatacaaatgatcatgaagctataaactaaacaaaggatacatctttatatgagtaaataaattaaacataaacacacctaaagacatgtccattttcttctcagtgagagcaacagtctccgtagtaatcggtttctcagtcgccatctacatagaagtggacacaatttaaaccaaagatttcacaaaatcaaatacataaaccctaaaaatcattagttaaggttcaacgaattttgagtttattgaacttatgagaagcaaggagatacaaaagagataaagcaaaccctagtttttgaagattgatctgattcaagaatcgatcaaacaaaaccctcaattaaattgactcgtgtgaagaatggaggagaagctttaagagatgaaatcgtttaccgattttagaaagtcgattgtctcactgagacaaaaaaagagaggctttttatttttaatccgataacgagttaaaccaaagtgaactgagtcaaaacgtttccgatcatgtatacgtggcacattttcattggaagagatgattggttgttttgcatttttttttttcttgttctctcccttgaagttgaagagtttaacttcgctaagaggaacagagatggacttgagtttaatatgttctctgtttctaacaaatgtttttttttttgagttttcacatacaataaaaaatattaaaagttaattataatttataaatgcattattatttgtaatttacgatttaccattttctataaccttaattaatatagtatacaattatttttcttgaaatttataattcatcaataataactaataactattgcattggaaccaatttttttcctaaatatattatttaggaatagaggagtagttgtttttggcaaaatggtagattattataaatctaaagtggtagcagttaaatttgaaaaagatggatggcatagtaactaaaaattatttaccacaataccttaaaaaactatgaagaattgattaattaactaacagactaattaaaacccatatttgtcctttgaaattataattttaaataattttacgaaacctatttaagattacataatattttttttataaacaataacaccttttaaaattattaaaacttattcactatccagtttcctagtttttatatattttgaagcaataatgttgtgcttaaaatatatgacatcatagtgacaaaagagtttatttgtgaaatctcaatcactcattttgaaatgccattaatccgtttagtttccatattattaccaaagcctttcatgtaattggaaacttttgtgtttaagacttaatcttgtgttgcaggagccaaaagaaaaagaaaaaaacaaaaacaaagaaattgtaaagaagtgtaactagaaaaatcgatcactcatcttcaaatgtcattatccatcaagttgtcatattattgctagacagaagtggtcgtctagacttagttgacctgaaaaaagaatagtcaaagtcttttatatgtggacctgaaattagactttgtagtttgtacgtaagtttgtgttgctagagcctatatgagaaaaaaaaaacagtggatattggtgattggtttaatctggttaactccggttatctagatactggtttaatatcatttatcttgtgtatatataaactaaactttagtttattttgttgatgaacgttgtaacaaacacttaattctgttaataaagattcagtttaatctccgatcttttctcttcttttccgttttaccggaacttcgccggtgttaatatggtatcagagcatatcatttgagcttccgcatatcatcggagatgagtctttcattgaatcatctttctcttatgagagtttttcgattcctacaatcgtttgttgcaatttgcaatttcttcgtcagctatctaattttggttctgattcttcttctttccttcgattgaccttttgtggtgacgaatctcactttcttttcatttcgtctcactttctttgatttttctttaacaatttgttaagaatg

SEQ ID NO: 7546 - DNA, 3000 bp, Unknown
  misc_feature (1)..( 3000): cDNA_ID_1821821_gDNA_ID_1621151_Annot_ID_56883 3000 nt of promoter + ATG
ggaactcaaacatagtcttctgagagtgatatatagagttttctgatcatcttcaagtgtgaaagtaacttgtcaagagtcttgttgaatcttagttgtgtgtgtattgtggtgtggacaggttttaatgagacgacagatgcgtgttgtgggctagggaggtacaaaggatggcttccatgcatctcgccggagatggcttgctctgacgcctccggtcacctctggtgggaccagtttcatcctacagacgccgttaacgccattctagccgacaatgtatggaatggtcgccacgtggacatgtgttaccctactaacctagaaactatgcttcattcttaaatcagctgagaggataaaaatgtacataaaaaacatagtaaattgtaaatgaactttgcaattttgatgtttggtccatggtacataaaggaaaactataggtcttttatgctaaagaaagaaagtacggggttagagaagaaaaaggataaatgttttacaaagttgggctcaatgtatttacgtaaatggcccacatgaaacagaaagttaagagattcgacccataaaaagcacgtgtggtttataaatggaaaatttcatcttcagggagacgaagacataatttcaattcttttctcatcaaagtttctaaaacaaaaatcttggcctaaagaggtgacgtcatctccaccctctcgtaatttttccaattttgcccttggaagctgcttcgccttttttttcaatttcatcaagggttctgagatttttttctctcagcttcttcgtaggtttttgatccgaggtaggtaggctttgggtttacaaaaatttcgcctcgattttttgttctcacgcgtcgttcttgttacaggaaatcgatttcatctctgatcatctttgtgacgaaggaaatggagctcgattttgacgctagtaacttggttgaagatgaagctgttgaagttgaacataatgttagtgtaaaattgtactttctgggctatttttcttttggttgaactaatcatgggtttacctttttcatttcgagcctggagctttaaaacttgtaatttccggtgaaaatggttgtttatgtagctttatagttagaatcatgaacataagttgctatgtcaaccatttcatttagtttgtgtcacgtttcctggaacatatgtggtttttaatctcaaggatgagattttaataaactgtgtttgtgcattattgcttctcagtgttgattttaatttctttgaacagggtatgactgaaattgaaggggaaagatgtggaatttgcatggatataattattgatagaggcgttcttgattgctgtcagcactggtaaaagcttgttttcgcttttcattgtctttaaatattgcaaagttgctatgggtgtttgttaaggagcagtctggtaatttgtgtctatgtctgttaaatttcaggttctgctttgaatgcattgataattggtctacgattatgaacctctgccctctatgtcagagagagtttcagttgattacatgtgtccctgtaagatgtctcatatttgttttttgttttgttttatctgaacatttgtcatgatttttgtaagtagaacttttgagtttaggaataatgagtttttgttttgattatgaaggtgtttgattcaggtgaaagcagcaaggtcgatgaggatttggtatcagggtactatttttttccttgtgtttgttgttgtgataaagtttgcttgcctgaactatctgagcggtctctttgtcctcaattatttgtggcctataatgataaatttatattaagtggcatagtataatcaagtgatttaaaatgtgatagatgtcatgtgtaccatatgtttctgtatttgctaaaaactgttgtgatctgctgacgttaaactaagcaatacatgcagagatgaagattgctgcattgaggaggagactgatgtcgtctcttctccgtcacactatattgacgatacacactatattgatgaaaatgtaagtatatcatatatgggttttcctagttactacaaagtacattaagctttcctaatcattttgtaggcagttgtctgtttagatggagatctttgcaagattcgtaacactttcagttacattgaaggggattcaaaccttgatacatcaattgcttgtgattcgtgtgatatgtggtaactattattacctgttgactttatctatggtttttttttttgtacattgtcgtgattgttgtttttacctcttttttctatcactaattcattgctggtgaacttctggagcttgccttgttgttacagtgccataatgtttgtgtctaccatgcttttagatggattttgtgtctaaagcttagttgtgctaccggtttctaaatgctatcactatcagtctatcacatgaaggaattttgtaatatgaaatgtaaatggcaaagatactagccttttcaatcttttatatgtacttgcttttgtgtacttcgtattgttttagattgttcatcattacagcattctttcaaattagcttctgactgttgctttcaactgtgctaacaggtatcatgctatttgtgtgggttttgacgtggaaaatgcatctgaggatacatgggtatgtccgaggtaggtttcgttggcgtattgactacctatgattgcttaatccatggtttgatcaacttcagcaccgttgtttcattatattgtttctttaattattagcctattaggcaaaaatatttttatattagagtttccataaaattattttaatctttatctagtaaagacactttgtaccaattctaagtgaaacctaatgcctatacatattattcttcctttctctatcttatttagccatcttgtcatagtttccctccttggttttgtgtccacagatgtctctctaatgaaaaaccacatgaacccgatacctcgcca

SEQ ID NO: 7547 - DNA, 3000 bp, Unknown
  misc_feature (1)..( 3000): cDNA_ID_1027071_gDNA_ID_1621151_Annot_ID_173248 3000 nt of promoter + ATG
tatgttatattatattattcacaaatatcaatttaatatatattttaaaaataatgtacttatagaaaaacttgtacttatagccaaaatagttaaaaattatattttttaggctgtgagaaaaaataagaaaagtacaacatgattgtagttttttagtgtctttataaatttcctacaccccaaccaatcaatcatactcggtgtcttgaagaaaacataaaaaatatttataggaagacatgtaactgaagatgcgtgttttaagtcataatttttttttttttgaaagacacccaacaattcactaatggaggttgtctaaaaagaataaccaagaaaatggtctctgaacccatctctaaaactattttataatgtgtatatgtaacagtaagaagtgaaaaaaaaaatccatatatcaattaaggtgttaaaaaaaaaagtccatatatcaatcacttttctaacatcgtcgatcattgtgacgaaaatcgcttacgtctgtaccgtattaacgtaatgccatcaaacgaaaaagtttgctcactcactccggtttagatctttgttaacataagcaaacttttcagagagtgaactaatagattcacgaaacgacaccgtaattagtatcgaaaacttgactgacatcagcctaagaaaaatatcgcaaattgttataaaatattaaacttaagaagaaaaatgaaaatataatagagtttacttaaaaaaaaataatgggttagctgattttatacccataaactaattgcattctcagctttttcccccacactttttggctcttaaatttctaccataaactttgataattctttaaattacaacatgtactttcggattcatccttaaacatacatttccaattgaaccggtcattaaaccaggattaaccacaaatccgcgtttactgtaccacgatgcgatttacccgattaatcacctctatccgttaagaaaagggttggctgattttatagccataaactaattgcattctctgctttccccctcacactttttgctcctgaaatttccaccataaacttcgataattcttaaaattgcaacatatactttcagattcatccttaaaaatatgtttccaattgatttagattgtcattggaacaatcttcaacctcttttgtctattttggatgatgtattttcggaagttgattctctttaagatgatattatttaggttgactaattgatttggagtcttatctatccttatgattaggagttttatctagttcgatttgtcattttccttaccaattaacacaacacataacatatatagatagattcacattataaaacaaagagaaaacgatgtcgttttcttaacgggtgtgggattagtcgggtaaatcacaatagcggtacactaaacgcggatttatggttaatctcggtttaacaatctaaatcaattggaaacatatttttaaggatgaatctgaaagtacatgttgcaattttaagaattatcgaagtttatggtggaaatttcaggagcaaaaagtatgggtgaaaagcagagaatgcaattagtttatggctataaaatcagccaacctttttcttaacggatataggtgattaatcgggtaaatcgcaatcgtggtacagtaaacgcggatttgtggttaattccggtttaaagaccggttcaattggaaatgtatgtttaaggatgaatccgaaagtacatgttgtaatttaaagaattatcaaagtttatggtgaaaaattaagagccaaaaagtgtggggaaaaagctgagaatgcaattagtttatgggtataaaatcagccaacccaaaaataatagaattaacaagaaagtaagagacttaaggaaagagtaatagataaaaataagcattatccatattttatagatagaaatgagcgatggattaccaccacgcttatacgattgcgataattacatctatacttatccagttttacagaaaaaataatagataaaaataagcattatccatattttatagatagaaatgagcgatggattaccagcacgcgtatacgattgcgataatcacatccatacttatcgagttttaaggaaaaagtaatagataaaaataagcattatccatattttatagatagaaatgagcgatggattaccaccacgcttatacgattgcgataatcacatccatacttatctagttttaaggaaaaaataatagataaagataagcattatccatatttaatagatagaaatgagcgatggattaccaccacgcttatacgattgcgataatcacatccatacttatctagttataaggaaaaaataatagataaagataagcattatccatattcaatagatagaaatgagcgatgaattaccaccacgtttatacgattgcgataatcacatccatatttatctagttttaaggaaaaaataatagataaagataaacattatccatattttatagatagaaatgagcgatggattaccaccacgcttatacgattgcgataattacatctatacttatccagttttacagaaaatataatagataaaaataagcattatccatattttatagatagaaatgagcgatgaattaccaccacgtttatacgattgcgataatcacatccatacttatcgaattttaaggagaaaataatagataaaaataaacattatccatattttatagataaaaatgagcgatggattaccaccacgcttatacgattgcgataattacatccatatttattcaattttaaagaaaatataatagataaacataagcattatccatttttataaatagaaatgagcgatggattaccaccacgcttatacgattgcgataatttcatctatacttatcgggtttataacaccgataatccgatttggtcaaaatccggcggagaaaaaccctaaaa

SEQ ID NO: 7548 - DNA, 3000 bp, Unknown
  misc_feature (1)..( 3000): cDNA_ID_1394339_gDNA_ID_1621151_Annot_ID_173258 3000 nt of promoter + ATG
aggaaaggaatagcagattgcatacagttctcattacaaaaatcaagaacaatcattaggtgcaaacttgatcctctcttgctctctctagagttcaagagaactctcctaacgttatatcctttttggtcacttggtttgagttgtttcagtattagcctattaggtgttcgcaagtttggaaatatgttttcccttgcttgctttcgatgctattgtgcttatttaatggaagtttagttattttttaaataaacgttatgagtaaaaattatcatatataagaaatcatccacatatatattcaatattttattttattgttattgttatattttttatctgatctattttctgtatcataaatctgaggtttatgaattaatttcatgtatagtgtttgtatttgagtttggtgaaatactgccaagatggtgtgatgcttgtttgagtctgagaatttctttaattcaatgacctttttttatacatgttataaaatattatggatacttgcaagtcttctcctatttacttgtacaaatttgatttttgattcagctactatgtgacttgtatgacaaatacagtcgaaacttaatatgatattcggtacccaaatgacaaaaacccacgtacatcaaaagcagagaggctttataagaaatctatgactatcaattttattttttcccataaattatatgcatggtagaaatattatgaaatgagtttccttaactatggttggcaactaaaaatgtctttagtgacaaaaatatgcaacttttctacaaactgcaaatattagtttagattaaatcaaacaaatcatgccttcaaaaatctgtaaaacaaatctttttatttttaacgccggtggcaccatagacgaaatcgacaattttgaaggttggagttggatttgtctgaattttttttttattggaatttggaaagcagctgaaagatgactaaatgcgcagcaaaactcttcattcaggcttggcgtaacttgaatttgttttctttcttctatttttttagtttcattctagtttccgatcaagtcttatggttaaaatactcaattatatactcatcatttaggcatcgaaaacggtcctaacaaaacaccaaacatatattcctaggctttcacgtgtttaattcttacccgcatgatacatttccctcaaatggattgacataatgctattgttgttaactttttgtttgacacaaaatctatctagcaaattttttatagttatagatttaatatacgcaatgttagcttgattttgtttctaacttaaggaaaagttgaaggatgttttaatttgcaaggttctctttcaaaaagatttcgtgtaaattcgacaacggcctcaaacctactctaatcctgactctaaataatattataggttgaaagctttgtaattattgtttactaaaataagagaagaaaacattattacttactctcctttagaaatatatgtttgcattatgctgtatatatagatgaataaatgccataaacgtttaaatgtgtgttggtagatgtcattttacttcattcttagaggtctcttctatcaaatttagttacgtatataaatatagatgtcttgtgctttcttgcaaggaaataaacagagataatatactatttcatacacatccacacacatatagatgtctttttgtttgttgcatggatgtagacatacatccattcacatttccaagtatatacactaacctaatgacctaatgttcttgagagagacttctttcacaacctcttctagaatgtgagtttcttatatttttgttggtataaagtatttgaacatctttatcaaaagttaaaatgtttgaccatattcttggtaattcaaccggtaagtaaatgttattcttctatgacagaacccttaattttgcctgttgtatactagaggtttggttgggtgaaaagtgggcatgataaaaagaacaacatttagttttcctccttgatttttctaaattagagtttcgtatcaaaatacctaaaaaagcttgttttgtggtgcttccaatttcgaaatcggctaaactttttccacatgatttcttcttttacgatagtaagatttagaagaaaataaaaactgaataacgtcagattttccttaataaaagaagaagaaaaatctcacaacattttaagttcctttatttttttgatatgtgccctaataaatgcagtgaaataagctcacaacaaaagatgcacaacgagataaagccaaatgaaatttagtactggtatacaaattttaatgacacgttaatactctttttcgttttggttttataatcgtacttaatattcataactagcttcgaatctggtatttgtatacttaaaaagcttacatcagccaatctactatcattgaaattgtagtgagaaaatctaatataattctttagtgactgtttgtcaaaaaaaaaaaaaactcatgtctaaagtacataacaaattcaaattttgatacaaaattagttatttgtatttgttgtgaccatttctattctacattttgtttgattattagttgaattattcttagttaaatagagcaaacaaattaaattaaatgatttcttaatctataattactgtaaatacttcaaacatcttttaaatagaaacaaataaaataattactaagacatttgtccttatataagtctaataaatgtgtgttttaattcaatacctccaaaaataatttcaaaaaactagagttactgaattggtgctttcacacggtgcatgcattgtattcacacctatatgcatgtcatatattcatggtctctatgatctcgctctatataaacaccacccaatcgaccaaccttcttctctgattattttctcaaattatttaattaatttcttcttcttcatcaccaccaattacactcaaaattatg

SEQ ID NO: 7549 - DNA, 3000 bp, Unknown
  misc_feature (1)..( 3000): cDNA_ID_2144115_gDNA_ID_1621151_Annot_ID_173257 3000 nt of promoter + ATG
tttttttccagcacatcaataaaaattaagccaatcaaaacaaaacaaataatacacctcattttctttttttctttttttttttcgtttttaatacacctattttcaattcgttcatattattgtatgttactagatatttgtcgacgtcttgttaaatttcgtcaattttctacctaagtaacgaaattttttcacttttttaataatgtgatatattatcttcttcaaaaattatatgatccattttaagctgaaagcttttaattttcacatcatttaaatcatttgcggcaaaagcaaacaacttgaaatcattttatcccaacttaacatgacgagcaacaaaatttaaaaatattaagaaaaagaataaaaaatgaggaagcacacaatattgtaaagtatggttattggaatacacaaatctttgagtctagcaaattctccatctttctttatatgaaacgttaaatttattaactaaaataaagatgattatgtacgagtgattaagaatattgtaaaatgaacagtagtcatcgagttcttcatgctagaaaccattttcggagaaactttcttaacttggagaaatcttgatactgaaaaaaatctattcgttgacgaatcacacaagtacggagttgtttctagaaatagatgaaaaataaattgtaaatgacaattttaggattactcgaacatggattagacccatgtttttgtttgtttctctcctgccatataaaataaattgttgtttaaaaaactaaacgaagtaaaatttgatcatgtgtatatgattggatatgacaactttttttttgtgtgaatataactaatttacggtatcatataaattagtttaaatggttaagaaagaggatcttgagatagtaataccatagaaaaaacaggtaaaagaaattagaattgagttgttataattaccaaataaataagctttctagagatgattaaattttaccaaatagatgttaaaattatttcggcaaaatataatatagaatgcatagactaattaaatttactagaatattttttggttaataattcataaatataatataaaataatgttaaaataatcaaacaatagtaattttttagtatttgtggaaaactcaaaacgttaacaaataagtatataagaaaaaattagtttggccttttcgagagagaagcgttagggttgttagacttccggatgaagtattattgacatagacttttggaaggaactattattaacatagactttgtggagaaaataatattaacatagactttgtggaggaagtattattttatgactaaaaatcattctgttggatagttctttgactaattattctcttaataatttgaatcttaaccgtaggatgtaattgcattttacacgctaagtgtctaaagtcttttggacaaaggcgatatcccaaatgtgagaaatctatttaagaagaagaagacttccttcattatttctcacatcaaacaaaatctttgaaacatttcaatcttatatatatggctccattgttgcatcaggtttctaattatggttatggtaagtgtgtaaccgtacgcttctgtgatggcaagacgtatgatgccaaggatggagagtctagggcaattaatagagatcttaatgttggtgctgttaagatttatagagactctaaagatgaagatcaagcgtatgtgctgaattacttcccttataatctcgagcttaatgataatcgtggtaagaataaaggtcttcaaggttatcgtgttcttatatggaagcagtacggcactattaatctagatgtattttacgatgaaatgaagatttggtgcaaaactaatgatttagggatatatacttccgatggagaactgaaatattataagtctgttattgcacgtcatcgtgaggaaggaggtatcagcgttataggttttgaaacagccgaaggagcgactactgcagctgctaaaaaggaagaagatgaaaatgaagaagcatcggcgaaggtgaaagaagcaaatgaagaagaatcgactaatgcataagacggcccaacccaaaataccatcaagactaagtcacatttgactaagtatctcgtttttccttttaataaagctttgcaaataacattgtggatttgtgtttttctctttgaggacagaaaccatgtttcctttctattgctttgtgcttccaagtttgtaggagttgatactccaatattatacattgtgaacaaaacaaaaaaaatgaataagtatgtgtttgctttttgaaagcgttgttcttgtgttcgtattgcatcacttttggttttaatccaaaatttattattaaattacgtacatttgattctttgtttttttttgtctcaatatatagttttgatacgtgttaccaaataaattgcttatctcaaaacatttcttcttcaacccgatccaacaaaccctatttgcgaagtattcatacatagctagaatacactagcgtgaattgtcattgtgagttgatttttaaatctatgcctcttgagttttgaatctgtcatgaggcccactggtagggccggtcggggtgttacaagttgttaatagagagaagacatgaggcccactggtagggccagtcggggtgttacaagtggtatcagagccaaacccaaatgagtgtggagtcaagaaggttcgcaccattgggggttacggtcttggtgtgcaacgaggacgttgcgatctgttagtggaggtgaattgtaacaccccgatttcaggaatatggtggtgcatgcagagaggtttaaaagaaatgatttgaccacctacgtgtgcacttatcttttcggtcaaacgtcctaagagaactccacagttaaacatgcttgggctggagtagtttcaggatggatgatattcccagaagtcattgtcggaaccatgcgagtgacaaagc

SEQ ID NO: 7550 - DNA, 3000 bp, Unknown
  misc_feature (1)..( 3000): cDNA_ID_3071787_gDNA_ID_1621151_Annot_ID_173247 3000 nt of promoter + ATG
gttcccaagaaatgataatctcaagcctcttttggcaccgaaagaaatgggaaactcacaaaacaatggaaaacccacagaagccagcaagaccttaccaaaaattagtgctgccaaggggagcagtgtaaaagctgctggatcaaaactgaactcaggaaacaaacagtcggatgggcaacccaatcttacatcaagtaactctaaggaaatggttgaaaatcctgacgatctcaagaaagacaaaaggaaatgggcattgcaggttcttgcaagaaagaaagctttagctggcaacaactcaacccaagacaaagaaggctctcccgagcttaaagggaattatccattgttggtgtgtaattctcatcacttactttgtttcttttaaaaattctggttttttgagatgtcattcgtttgtttctaccatttctatcaggctcaacttccagctgatatgagaccaagccttgcaactagtcgccataataaagttcctgtggcagttaggcaggtacgtggatagctgataatcaagagaaagactattacgtagaattaactcctttaggtagaaatccccaagccgtgcttttattacatttacatacgttaaactgataatacagaaaattgaggctaatctgttattgattttcctgcaaaaacattattaacatcacaacttgtgcaatagctttacttgtttttgttcctaagcaaattgctgtttctgcagacacaattatatcgcctgacagaacatttattaaagaaagaaaaccttctgactattcgaagaagtgcagcgacagaactagccgttgctgatgctataaatatcgagaaggcgattgctgacaaatcaagtagcaaagttgtgtatctgaatctatgctcacaagaaatactgcatcattcagagagcaaaacgatggataatgctgtagaaccaaattcgtcatcaccaatggctgatagtgagtcagaacgtataagtagtaaagattcagataatccagccgtccttgaagcgctcagagcagcaggtcttgctgattcaccaccaaacagcccgacccgttcagtagaagttcttccagagaaaggagacagttccttggacaagaccagggagacaggcccatataatgtatttgacatggattctgttcctgatacagacatctttggggattttgaatatgaattggatgaagaagactatttcggtgctacaatggctaaaaaagcttcagtaatgcagccggatgaaagcttgactaaggtgaaggtagttttatccactgttcaacctggaaagtctttgaatccatccgaagtcgtagaggatgaagagacaacaactgaaaacctgaacgagaccacaaatggaaaagaagatggaaagagctttgttcctatggagcttgtacctgaggctgagggagaaggagaaggagaaggagaaggagaaggagaaggagaagggggaggtgagatcctttctgtagctgaatgtgaagaactatacggacctggtacagagaaactagttgaaagacctctcatcgaaggatttgctgagaatggtgttaaagctaaagcccctgattcagagtgcgagagcaacacacagagagagttcatcgcttcaaactttgaaatcacttgcattcaagagaaaaaacttcccagaagcattcaaaagtgcaaaccaagcgaaaagccgtctaaagaggaaaaaggcaaagctgatggctttggtaactccatcaccaagaaggtactaaaaactgtaaaagtctctgtcatgtcaaaattctcattccctttgtcttcactcttcaatggttttattgttttcgtcaggtggaagcatacatcaaagaacatattagaccactgtgcaagagcggagtgataaacgtggaacaatacagatgggcagtgactaaaaccacagaaaaagtgatgaagtatcatagcaaagccaagagtgctaacttcttgatcaaagaaggagacaagatcaagaaacttgccgagcaatacgtcgaaaccgcttcctctggagctcaccacaaggataagtgcaagtgagaaaatcagatggcgtaaataagaagatgaagtaacaagtagttcagtacaaaaacgtaaatagattttaactagtatctctcttttgtcttctccacgggttttggaaactgagtcttcttctcttagggcgagagaagcaattcttgttgtaccccgaaccagatagacctaaactgtgtctgaaactgagatttacttggtcgctgacaggtttttgaaaaaatatttagagatgaaaatgatatatttattattagttacatactttttcgtcactgtgattattaaactgaactagtaaacttaaaagctaaatgtaaaagaagatgatgatagtttgtttgggtcaaaggctcaaagcaatgaaattcttaaaatgcctattgggcctaacctgacgcatttctttatatttttgaaaattgttaaacgacgacggatctgttttctatagtgactctgacgcacttggataaacatacatgtgcaatgactataatacccttgaaacttgaggctatttcctacagtgacacattttgataaacatttgcgatggtcagttacggagttggagacaaaagagcttctgaatctctctctcttctgcgtctcgccaaatttatttcccgattcaatttgtagggtttctgcagaagaaggaaaccaccattaaaccctaagtacgtcacctttcaagctccttcttctgtaggttttttctgttcttctgattcatgtttacaaagttttttttatgtctcttctaacttcttctccttctcgccgcgtaatcagtccttattgttcttcataatcgcagtaccaatcgcaatcgttttcttcctctctcgatctgttcctcggacgagaaaactggacaacaaacct

SEQ ID NO: 7551 - DNA, 3000 bp, Unknown; identical to SEQ ID NO: 7547
  misc_feature (1)..( 3000): cDNA_ID_1027071_gDNA_ID_1621151_Annot_ID_56884 3000 nt of promoter + ATG

SEQ ID NO: 7552 - DNA, 3000 bp, Unknown
  misc_feature (1)..( 3000): cDNA_ID_1818111_gDNA_ID_1621151_Annot_ID_56892 3000 nt of promoter + ATG
tcgcaagaaggaaaacgaaggccttcgtcggtgacttaatgcaaaatttttgtaaggtttttttttttggcaagccaagccttattagctagttaagtaaattacgacccttcttcatttcttaatatcacattcatataaaaaaaaaaacaagagacatggagaaaccattgggaagcatttctttgttggcaaatagatcacataggcaaataacataaaataacaaaaggcagaaagaagcaaattaagacgggagaaaccatcgagcatcctttagctttaagtgcgagagacttgggaagcgtgtgattttctttgtttcaagattgaacacacagatgtgtcggacccgacatgaaaaatccttttcacagttatagacacggtcgtaacgggtgaaatagatggttcgataccaaggggatggtcagcaggcacaatgatacctaaatccaaacgaaaggcctcatcgcctaaagaatatacctcaacagacacatacggtgtgtataaaagctcatccggatttggattaggaaccttcttatagaggcggaagccgattctagactcacaaacgatgctctcgactaacaaaacctctcctgatgttgtaacaacaatatttctatggctagaatacatcttatcatcactactcgaatgagaagctaggtaacgtggtggtaatagatcagtgttggctacaaattcattgtatgcctcgtaactctctgtgaattacatcgatatatgttggaatggtatggtaatgatcttccccgttcttgcaataggttatatagttggcacctgtatcgaaaaaccacacaacagtgtattcttctttattctcctcatctacccacaaaagacctctcaaattaaccacattctggtttctgtaaccaaagctaggtctagtaaatttctcttcgaaatccttatctcctattcgcttaagagtaaaaaggccttccactgagtctaaaggtgggagattgattctcttctcgctaaacaaatctatgatatagagattggattcaacatctaccgtgaggaacaagttacctgagtttgctaggaaacgagtctttgaaaagtctctctttgtattgtaaactctattatcttcttctggattgtatagcacacaaccatcttctggaaaaagcatcagccacgcagatttccttttcttgtgcgacgtttgtttcgagctcaagtaccaattcgtacacacgatcttagcgcggtggaaatcaacaaaaaatcaaacgttggaacacagatttcaagatattaagagggaggtccgaccatcggctagaattaggagtctccatggaattgatgaagaagtttaggaggagcagagcaagggttgtagcttcctctagtctctctctaattgaaatccctacttattgaaaaagaagaaagaaaaacaatgggccaaattacaagcccaagtagtatgaaaaaagagaataatgggccgaaatgttaactcacacccaacagttgggcctatttatgacgaaggtgaaacgcagatattttttttttgttttttttttttttttggtatttatgttattgtattgaagataaatttgatatttttatttttaatatgtagtatatggcataaattctcctctagtagacgaatcttttaccttatctctttgaatatatcttaacaaataattaaataaaatttaagaatattaattagagtgagatataggaaagtttgctcctaattttggtgacatggaaagagtatcttatcacatgatctatggattgacacaacacaaccgagctggtgtttggttctcttttctattatctcctaattattttacgtttaaagtcttaatttatttgttggtccatcattaccaaaataccaagttgacatttgtttttaaagttatttctctattagctggcacgagcctatcttctctgtcatttccacttggcagtatcataatgggtgaaacaatttgtgagaaacgtcgaactttgtttttgacggtgattacctaccactgcaactactactgtgtgagtacaacgaaggatgatgatgaagcatgtctcgaccaaactaatatccaataggaaaatgctcttattctctttatctgtcttcattaagtcatttgtaagtctttttccaaaatattataattctttgtaatgtattcgtatttttatggatcaatatattcatatttattacttctatgttttacaaattatatcatttaagttttttttccttacaatagtatcgttttatactttcattgcagtttaaaaaaaagaaaaatttatttttatctttataattttattttattaattataagaattttttttaattaagtgtatttataaaagttatagtaaaaatttacatagtatttttttttttgaaatatgtgaaaataatacttttcatgaaacaaagagagtatgtaacactgaatttactaaaactgaataaaaacactaaataacatattatattagttaaaatttaagaagtaataaaatattgaattactaaattgattatggtatcgtggtattacaaaaaaaaaaaaaattcccgggtttaatccatgtttagtgtgtaagactattttttaaacctacattctaacggcaagtttaatctactttatcacatagatgtctctctcgaaaggcgattctctgggcgattttcgccgttctagttttctccatcggagatcttttccgaccaggatagatcacggttttgatgtcaagatcttcactggcggttttaatctgtcaaaaatcaatgatagttactctcttccctcattttcgggaagtaaccaccaactaaaaccgccatggcctctcctatataaccaccgtgttcatccgattatgttctctctttctttgttctatcaattcgagtttaaactactatcaatcatg

SEQ ID NO: 7553 - DNA, 3000 bp, Unknown
  misc_feature (1)..( 3000): cDNA_ID_1818208_gDNA_ID_1621152_Annot_ID_56897 3000 nt of promoter + ATG
ttatataagttttactgtacactatatacttcctgtttttctaaatatttgtagtttaaggttttacacacaaattaagaaaacatacaaatctcatttaatttatttctttcctataaaaacatcattaattacaactaatccaatcaataaaaaaatatgatgtaaaatataattggttaaaatctattaaataaatttaatttttgtatagaaacgtgaaaaacaacacttatattaaaagaagtaaaaaaacctttaaattacatataattagaaacgtatacagtagctactagtgtgactaatgattagtcgaacaattagtaaaacaaaaaaaatgggtaggttacatggaaatagacagttaatgataaccagtgatatgtgtttagtaagatctttagagcacctccaatgtagagagtcccttcaagggctctctcccctttttaatgattaaattttaaaaaagaagaagtagagagctttgtgttttttttatagttttttatactccaatggtaggttctctaacatgagttctctaaaaaaaatattaaaataaaactattttattttatataacttaataattattacaaagcataaactattaaacatacattattctgaaatattttgaaatagatgtggaaaaaaatggaataacgatcagttgttctgttgattgttgcaaaaaatttcccttatatgttctaccaaatcacctttcaattgcaaatgcatcttttgatcacgaacttgatatcgaatgcccataaaatctctgagacttgtaggcatacatgtacaataagataaatcgacttgtgaagttcagtttgctttatattttgttgttttagcaaattcccaaatcttatagatattttgttaaagtaaaggtcaaaatcaatgtaagtggaattgtattgattttcatggctgaaccattttcaaagttgaactaaattctcaagtacaattgtatgttagcatattaacaagattacgaagcacactcgcaattaagataaaacaaaacaaaacagagtggtctctttttttcttatttgttcttcttccacctacaacacacttcttcttgttctcttcttcttttgcttacgagttacgattgttcttatctcaccatcttctcacatctttctcttccaatctctgttgcatattgttaacaaagatgagattccaacagtctctcttattgagagataaaaaatggaacctatctcatcaacacaaatccggcgtctgccaattaaataaatccggcgtctcagatccacgattacacacatcatcgccgtcgactaattgcaaatcataccaccggatttttgttttgtagagagagagatgaaaccgtcgggttcttttttggcggaggaaacaaagcactagtgctttatttttttggttttgttacaaataaaacccaatcacattcggccacgtcgtcgcctctctcactctcaataatctctcttcgtagagccagctctctcaattttaatgacttctgtagcatactagcatcgctgtctcaacgacaatatttattacatgctctgaaaatttaaagagtttgtgagactgatcgtcacagtgtcgctgtaagactactttcggcgaacaatagaagaattaattgaatcagctaacttaattaattttcaatattttggtaacaacttttatatttccgtgaagacaaaaattcagtcaccggaaatatatatcttagtgatgttgctctgaaatcaacgacgttggtgccattctttgaccatcgatcgtttcctttgctttcgtcggcttctacatttctgccgttgaaggtcgtcgtcaacgatacggtgctacacatgccctacgtatactgactatatagagcgtaaatgtctaaataacaaaagaaacattatgacggtggtataattaacaatttggagttgaacaataatagtatataatgactttagtatttgtttagggagtgacagtaattacaagttacaaccaaaacgtgccaccaaatccaaaatgagtggtccaacaccaatgaacccacggctcaacgtgctttcaagctaatataaataatatggctgcagaaccgatactagagtcattttgtttcttcattttttggttgtactttcgtagaaactatattttcttaagaaggcccaactattctccccataaataaattcagccgttttaagagcccaacttgtagataaaagaagatgcgacccaactaaggacatccacttgtgtagcttacaccaacttatagtaaaatttagtcatcaatttgactcccaaaacgagtcacttctccataatcatctctcccaactcaaccaattacacatcgatctctttcgagtagccaatcatcgtcaacattacatccatatacaccaaatcaacaaaaaagatagatattttgagagttgtgcacttgtggctctgtccactcctctccatctcccttttgtttccaccaaccaatatttaaagacaaaatttgacttttacccaaaaaaatatcctaaccagaatgaaaaaacgtgggtttgggctaagacttatgctatgttggaccatttctgtctctattaggtaagaataataataacaaaaaggtgtcttgattcaatgtatcacaaactaaaaacaagaaagaaagaaaaaagatgcgttagattagagttaggaagagagtaggatctgctttaaatgccgaaatgtacggtaaaaaatgtataaacctcaaaaagccgtctagattcaaatcattaactcccacacatctcgggattctatttttacacccaaaatcttttttcactctgtatatattaatacaattctctcccacttctttcaaaaatatcacattctttcttcttctcattttctctaaagattgttgtttgtgtgtgaggctaaggatcaaagatg

SEQ ID NO: 7554 - DNA, 3000 bp, Unknown
  misc_feature (1)..( 3000): cDNA_ID_1818200_gDNA_ID_1621152_Annot_ID_56899 3000 nt of promoter + ATG
agccttttaggcagagatgggtactaaggtgcagatgagcacggcttatcatccacagagagatgggcaatctgagaggactattcagacgcttgaggatatgttgcggatgtgtgtcttggattggggaggtcgttgggcggatcactttagtctggtagagtttgcttataacaatagctatcagatgagtattgggatgactccttttgagacgttgtacgggaggccatgcaggacaccgttatgctggacccaagtgggggagaggagcatatatggtgcagattatgttcaagagaccttagagaggatccgggttcttaagctgaacatgaaggaagctcaggatcgaaagcggagttatgctgacaagaggaggagagagcttgagtttgaggttggggacagagtgtatcttaagatggccatgttgcgaggtccgaacagatctatctcagagactaagttgagtcctaggtacatgggtccgttcaggattgttgagagggtgggaccagtggcatacaggttagagttgcttgatgttatgcgtgcgtttcacaaggtctttcatttgtcgatgctgaggaagtgtcttcacaaggatgatgaggtgttggctaagattccagaggatcttcagcccaacatgactttggagacgagaccagtgagggttctcgagaggaggatcaaggaacttcggcggaagaagattcctttgatcaaagtcctgtgggactgcgatggtgtgacagaggagacttgggagccagaggcgaggatgaaggcaaggttcaagacgtggttcgagaagcaggttgctgcatgagtttgcctttccttggtttccagtttcagtgttgttgagtttttgagcttttgagttgttgttcttatttctcttttatttgtattttcgtttggagttgtaacgatcataacagttgatgattaataagatgagtattttttcttggatttgacttgagttgtcttatttaagattgtgttgtgcggtttccaaaaatgaaaagtttcctagaaaggacttgtctatttttggaaagtttgagtaaacaacctaagagatccgtgtgtttacgagatggccgggagttggtcataaggatattctcgagggatatgatggatggtgagacatagaggtgtcttacgcgaatccatgagagagtctggagatatgctcggaagcgtttaatattgttgctcgagggacatgaaggtcccaacgactcgtgaggagcggggtatgctcctgaggtaccggtaactcgagggacatggtgtatttagagaacgaggggtacggtggcttcgggtgacgatccgagagcacgctttagggtgacgacccgagagcgagttttgtggtattattttcgccaagtgtcgtaactcgatgactttgtggctgagagtgagccgacacaactcagggtttgactttgagtggggaagataatatgtgtgatacccgagataccgtaggccgaggcctgagagtgacggtttatgctcgaagattgcagtctgagagtggagagtgagttgtgagcaacaatgactagtaaatcgtgagtatattgactggatagagagacctagagggggtctggttgaagggagtgcagactgtagtgatggttgcacggagttcctcggagtggaagggtgaagctagattcgaggacgaatctatgttagtgggggagaattgtaacgcccgtgaactggaaaatcggttagggtttgtttttaaatcatccggtttaattggttatgttaattggaaaccctagagtgtgcctataaaagaaggaaactcgaaattagggctttagttagccacttttcgttttataaaggagaaaaagagagttatttccaagtcctttatagttattctccagtttacagaattggatttggattaaaattggttgagttattcgcagtttcgtgagacacgttttctcagacgcgaattaggaccagcggagattgaaactgagatcgtggtctcgtcttttttccgatcggcacgagattttgtgggcatctttgtgacgtctgcagataggattttaccggagcgattgaatagttaacggttagcttatattttagggtttcgtttttgagactgcttgtttctggtttttcctgtccagtttgcttcaaggttgcttttggttgtggacttgttgtaggacgtttctgaactgtttcagacgcaaggagagtctctcctgggtttaattggtattagaatcaatttgttaaggtgagtgcgtgaccatgaatttatctgagcgattgagttgtgtgatgatatataggtgtggtgaatatgttttgggtgaattgttcaatgactggtttgtttgtattgtattcgtgattatatttttttatttgcttttgtgtatagctcgtagatgggagaatcgcctcactaagtatttatgataatacttaagcatcttattgtgttgttgatgcagtaaaaataaagtgtgattgtggaatcatggcaaggaagagaggatgatgtaggaactcgtttgttttatgttttgtgtttttggttattggaacccggttaggattgtctgttatttttggttttgttgatcgaattatttatttatttataaaatagtatttctgatttgcggtttaattattatgttattggttgatttaattaaatatttaattatatatatatatatatatttttttttttaaatgggtctggttgtttcacaaagatatctgagtcatatttggggaatgctgacattaatactttcgataacaaaaagaaaatacactcattaaacagaacaaacctcagaaacagaatttaattaaaaacccacaaaatgaatctaagatagtttgctttacaattcaaaaacccgtctctgtgattcaaaatccctaaatccagagatcgaactctcgatc

SEQ ID NO: 7555 - DNA, 3000 bp, Unknown; identical to SEQ ID NO: 7553
  misc_feature (1)..( 3000): cDNA_ID_2139660_gDNA_ID_1621152_Annot_ID_173288 3000 nt of promoter + ATG

SEQ ID NO: 7556 - DNA, 3000 bp, Unknown; identical to SEQ ID NO: 5422
  misc_feature (1)..( 3000): cDNA_ID_1842707_gDNA_ID_1621152_Annot_ID_56901 3000 nt of promoter + ATG

SEQ ID NO: 7557 - DNA, 3000 bp, Unknown
  misc_feature (1)..( 3000): cDNA_ID_1818193_gDNA_ID_1621152_Annot_ID_56902 3000 nt of promoter + ATG
catcgaaatattgttaaataatagactcattctaagtcgaaacaaaaataatatcgtttcccccacctttttaatatattgtaatatctcgtgtacaacgttttgcctaataatataatcatatttcgaaaacttgccacccactacctcgaggtctctcccacaaatctataaaaatattgtttaataatagaaatgggaacttgcaaaaagcattaaaataacaataacatccaaagtcaaacaaaaacaagaaaaaatgatttgtgtaaaaacatatacatatacatatacatatacatatctctcgcttttctgttcatcacttcagctgagtttctcattcaacatgtaacttttttttgaaatatgttgcaaaaacaaattccaacatatttataaaactagtaacattattatttataatttgcaaaataggtcatgaatcccttttttaatcttttttttttttcatttcccctcatgtttaattattaaactacttaatagtataatatttttcaaattttctatttatatacaaaagcctatgtttttttttctataatttgatatgtagtgtctaataaattcaaaaacatttttattcatacatctcattaattgttaagatgtatacaaattgatacatttttattcgtacaacttatttagtatacattagctatgaatatatgaataaaatatgtatattatgtacatttgtatactaaatgtgttgtatgactcttagtatacaaaacaacacaaaaaactttatcaaaaaaaaaaaaaaagctcccagacccgactcccgaggaaacctaagcttcttcttgctatggccttcgtggccgccggcgaggaccctcccttgccagaaccccctgacccgcctgatcctccctccatcttcgcccaaaccttcatacccgatccaccttctacttcttctctctttccaccttcatcgagtctagatctagatctatgttctaccgtttcttcctatggtgttactcctttcgtttttttgcgattctttactgctgtgtgcagtcccttctatcagatctgtacccgttccgtgtctttgcggttctttactgctctatgcagtccatggaaactagcctattcccagatcttgggatatcctctcgtttcaagtggatatgtttcacaggccataacctttgatgtccacgctgcccctcctacctcaactcagagagcctctcctactcgttccatggcccagacacgacaacggtttgttacttctgtaagatggtgtatgtctttgtttctggttttacccctcattcaaaatttcgtagtggtgcgatttaatgctgcagtatgcagtctctttgaactcaatctggccttttgtgctgtttgttttgtttctctttcttggtggcagtttgaaaagaaactaattaatacacctcgcctgatgaatctggttttatcgggtatttggtaccctagtagcttcttatcggagctagttatcttcccaaagttccctcctcagtggagtggtttggatgtccaagagtcgtcggtattgcaaggatcttcctcccgattgatgttcttctctgcatttgatgcagttcttgtaacctcttgtgttacgttggatacagtcttccaagaatctagccagatcgttcttattgttcgttttgccttatgttattcttatgacttctgttgcatatctatctatcctttaaccattgttatatggtctgttttggcttctgttgttgtgttttatgtagttttcttcatgttggttgtaattcctctttctgaggctcctaaaatttagtgaaaacaactattggtttgaaaaaaaaaaaaaaaaaagaatcttagtatacaaaacaaagagtaaaattgtctattttgcaaattgtaaatagtagtgttactagttacataattatgtttccaaaagtaactatatttccaacaaacccttttttaatgtatttttttgatagatatattagtagattttttttaacaatggaaaacgaacaaggttataagggcagatgagcagagtacaactgttcttaaagtctcatggcaaatcttggcacacttgtgttatctgaaatagccagtctttagattttcttgtactttttattttgttgattggagtttgaagagtgttgagagaggagcgacgaggacaataacaaatttctcagtgattaaaggtagcagagaaccctatacaattatgggttccgcattatcctttcgtaacctagattttttttttatatatagttaaactcctagcctaaaactaaaacacagttgatgactaattggtggagaaccattaaaaaaaaaaaaaaaagacagagtagactaacgaaaccacacctttacatttttctatttatctcaccttcctaaataaaaaatatttattttaaacaaaaacacattttctgtacagacgtgggtttcgtaatgtccataagtccatccatagtctaccatataatttaacatctacttctctccagtggacgcaaaagcttcgaattgaatgtgggcgttgcttctctcgtgtctaatataaaatttggataatcatgaattcttcgatgatagtgatataccgttgacactgagtagttcattgcaataagtaagatcttgtttttgctaaaaagattcaatcatattttgaacacttgccacccaccacttccaaaacttccacaaattcatagatatagtaatacacaggttacttgacaaaaggaataaaagtacaatatgatgctttacacattctcagtcaaacaaaaacgataaaatgaatgtgtaagataatattgtttaaaaaagaaaaaaagaacaaaaaaaagataatattgttttcccgacgactaatccactttcagtattttataaaataactgaactcaagttgctcgatcaaacaagtacccttaa

SEQ ID NO: 7558 - DNA, 3000 bp, Unknown
  misc_feature (1)..( 3000): cDNA_ID_1818189_gDNA_ID_1621152_Annot_ID_56903 3000 nt of promoter + ATG
tacaataaatataccaagattcgtacgacaaaaaaaaatatataccaagattcgttttgagttcctctgccctctgggacctagagaaatatatatcttttttatcttaagaaaaaactattacaaaagtattcaaaagtttttcttgagatatttttttctttttaacatttcaattttttttaattttgttttttgaaaaaaacaaacaattaaaattccttaatttagagacaatgttaaaaactgaataagaaacaataaagaaattctaaagtgagtgacagattaattggttgataacagttaatctgtttcagcttctttcttattttcattcaattttattttagggtacgacagcgtcttttggcacattgttaaaaactacttttagtaaaaagctaatcgattgaaaatgtgattaagaaaaaaaaaaatgaataatagaaagacctgtttaatagagacacgagttatctattaaacgagtttagttactactatataatactgaaagtggattcacggtggaaaaattatgaatatttatgcacattcattattataacttttatttgacttggaatgtgtcaactatcagattagacgtgagcagcgtaatattcaaaatgtgatttaaatgttaagcaaaacgtcttaggtagtatctggtgttgttacatttgatgcgacctaattccggttgattgctcgagtaattattatcttatagacttaactgtaaaatagtacatacagagtagatcacataaatcaatgatattctaaagatttgcgagagtcgtttttacctaaacggacaaattaaatgtttgttagtttttatgcttaaaattaaaattatgaaagaaactaaacgattaaaattatatgataaaacacattaaaccacaaaataattcaaagattgatgattaacgaaactatgaaataaaaaattcaacaaccaaacaccgctttcgaacatgaacacaatattagattactcctctttcaagaaattagtcattaaaattgactacttaattactaaactttcatttgtaatattagtcaaattcgcattatcaaacaaatttgttaaactaacaatatgtgttctaatattaaatttcattggctaaaaatatattgctcaattcagttcgtgaattcctaaaaatagttaatttttaataataatcaaatcatcaaaccaatttagaactctaaaactcaattgaagagactactcccactaaaaaaaaacattatgtacgactatatggggaccaatattattttttcaacacacaaaacactttttccactatcatcctagtctgtaacgggttgatatctagtgtttttgggtgttttaaaacctctttttctcttagtttttgttgctttgcattcatattttggcatatagtattgcatttgcatttggttttcttaggtacatgagtggagtttaaagttttggaagtaaaatggagcaaatggagcaaacaaatgagctacaagaatgcaaagtggccaaagaggagaagctagtaggacaatctaccaaactggtcgattggtcaggagcagagctacggaggaatacgaatctaccaaactggtcgattgggtggtcgattggtccggaccagagctacggaagaatatgaatctaccaaagtggtcgattgcgtggtctactggtcaaggattaatgttgcggacgatattgaatctaccaagtgatctattgcttggtcgattgccttccttaacagggtcaaaacccggtttgttccgggttgatccggtttattttctcattactagaaatactcttaacctagttttagagaaaaagagcttttgtttagggatcaaaacttctcttgaaggttctttatcttaggtttttgtatgaatgttgagttcttaagtttctatatcaagtatttcttttaaatttctcatctattctctaatgattatggctttacaaagatcaaaccaattcctttgtatgatcatgatcatgagtgagtagtctcctagagttctttggttagggtagattaggatggtttagatgttgggttatggattttagggctagattacttaagattcttacttattggttgcttttaaggctagatcaaccttgatcatgttgatttgatgcccggaagatgttcgatgaaattcccgaaccaaaatctttaagtgcttttcatactttacctttggaaattgttgattagggtgattagtggctagatagacttgttatttatgcttattgatcatttgattgcctttggaaattgttgatgattgattgattagtaaaaggattaatatcatggaaatgtattagtcttgtttagtgttccatggcctaaggatcattgcttgttagaagttgtttgttgctccataatccatctctttatcatttctaatcgattaccttaacctgagaattcgtctttagttatcactaagtaatttgttaatttcccgctttgtttactttcgaaacttgttagtcttttgtttcttgctttcttttatcttgttttgcattgtttgcttgataatgcattgttactaagattaggaacactcaaagtcaccttattagcttagattaagcaattgtgtgtattcttggtgagttgattaattgcaaattgtggttcgataattaattgatagaaatgctacatcaatttggcgccgttgccggtttgcaatagttattagccattaggatttcatatttgcttgagactaagccttttactttagttactaatcctttatacttgatctttgctcttgtcttaaaggtgtatgaacctacgaagttacggccgagcaaacttagtagaagagattaacgacattcgccggtttgaaagagaaaacgctagagcaagaagaaaaagagaacgacttgaacaccttgctcggttaggcgtcatg

SEQ ID NO: 7559 - DNA, 3000 bp, Unknown
  misc_feature (1)..( 3000): cDNA_ID_1818185_gDNA_ID_1621152_Annot_ID_56904 3000 nt of promoter + ATG
tcttaaaaattcaaaaccaaaaccaactatcatctctcccaattatcatctttttaatatatcaaaaatatctttgaaaactttcctttacccatgttttaaacctttctcatctatatatatacatttttacaaataaatcctcaagttgaaacttatttacaagaaataccatttggcattaattattattaataaattaatattcctaactactagcattttcttatctgatatatatctccatcaattcttaatacgtcaaaaaaaatcttaggacactattaatattatactttattaaaagataaataatgtagttatttaaagtttattaaaaaaaattagaatatttcacagaaaaaacgttatagtatatttataatatgtaaatctataaaaattaaataaccattgaaagaaaacttttaaattaatttaaattataaatcttttaataaaagtattattaaaacaaaaattaaaaataatatttaattttatgaaatgggattagatggtaggacggatttagaatatcataatatatgaactttataacaattaaataaccatttgaaagaaaacttttaaattgtgttgaattatatatcttttaaattaaaatattatttaaacaaaaataacaaaaataatgtttaatttcactaaacggagttagatgatataaggggtttgggtcgatagtattatgagatggtataccacaagtgaaatacattagatatgtttaatttcactaaacaggattagatggtaggacagatttggatcaatagtaatacgagacggtatacgacggatgaaatcctagatatatcattaaaaataaaattatattatctaaatactaaaacaaacaaacaatattaacaaaacaaatataattagaacttaaatatttagttataatttagattttaacttattgttcctatatttttaaacagtaaaaattaaacatagtaattatacactaaaaaatatatagatataagagttgtacgtttagaaaatacaaaacattaaatcatatttatttttaatctacaaaacaaattaatttttatttttaaaaaatataattatgcggtacaccgcgggttaaaatctagtatatattcaaaagccttcaaattgaacacgagctttgttcttgtatctagggctggaaaaatagtctgactcgaagatccaaactaaacccggctcaaaatattcgatattaattcgatttcgtatattaaaactatctgaatgggatctagaaacttgaaattctgagtgtccaatataattctgattcgaatttacccaaaaaaatcctaacatgttcaatctttagtattttaaattgttttgatagttttattaccgatatttttggttaattatgatacttttaaacaaattttaaatatttttaccggatttttcgagtaatcggataaatagtttcaattatttaggtagttttaaccaaactcaaaacatgattataaatctaaaatattaaaatctttaaaatatctaaaataactaaaatatctgaactatttagttatattttatcaatccactactgcgataatatctcgtgtacttcgagaactctcactaatccacagaaatattgttttatataacagtagtcattagtcaatagctagacatgcatggtttggtacacgtacttggaaaaagcataaaataaacaattataaccaaatcgaaatctgatatacattcaattttaaacaaaaaaaaaaatggaaatctgatactgtaaaattgaatatgtgtgtattattattggttccacgacgagtctactttcagtattttattaccaaagcaaaccaaaacggatctcaaaaaatggatactgaaaaatggagtcaaggtattaagtgatcctttgtccaaaaaaaaaaaaaaaaaaaaggtattaagtgatccacttttgttcttagtggttctgtccctgccttttgctcttgtatctagagctgaaataaaattcggacctgaacatcctaaccgaattcagattaatttttttgattagaattctaatccgaattttaaaagtattcgaacggattttagaaccggaacttcgaatatccaaaaagcccggatttaaaacagattccgaatatatactcgaaaaaatctgaatattcctaagatattaactctttttacctggttttatggatactattgattaattaaaatacttttaatagtataacttttaaccgggattttcgagtaattcgaattattttacatagtttaaataattatacgtagttttaaccgaatcttaactataattataaatctatatcaattattttttaatcaaaataattaaaataccaatcaatataactaaaacacttaaaataaacaattttaaaaaacaatttttattatatctatcaaattatattaaaaaattcaagcaaataatttttttagattatccaaacttcgaatacaaaaatctgaatagaaccagaatttgatctgatatattttgagttatggtagaaatcttaatcagaaaactaaaaaatccttacaatacctaaacgctcagacctataaattttgatttatctacatttcggtgttggtgatatactgacaccgagtcgttaacagcaataatattttgtgtactttgagatcgctcacaaatccacagaaatattgttttataatagacgtacttggaagatgcataaaatagacaatacaaccaaatcaaatttgatactttacacattcaaagtcaaacaaaaacagtgaaattgaatgtgtacatgtattattattgcttccacgaggagtccacgttcggtattttatatttgttactaaactcgatcaataagtaatcaaaagtgtctctgtttatataaatggaaagcgttaccaaaacaaaacaaaaccagatctcaaaaa

SEQ ID NO: 7560 - DNA, 3000 bp, Unknown
  misc_feature (1)..( 3000): cDNA_ID_4257471_gDNA_ID_1621152_Annot_ID_56905 3000 nt of promoter + ATG
tcacgaatggtacgtacacttattttctttctttagattttattggttaaaacttaaaactgtgataaccattttcttgaactctttttattgataggagtgacaagagtgtggagggatgaccgaccatcggataagattctttcgataaccagcttctcaataattaggacgagacctgaaccctatgaatcctctgtttttgaggctgttggttacaaatggtaaagatcttagtatatcttacactctatcccattttttttttgttaattatatcttttgagctaattatgatgcaaataaataaatcaggagattggttttgtacgtgaatggtaatgaaaaggacggtggaaaagatcatgtttcactttacgcgaagatcgtagagacagaatctcttccagtaggatgggaagtgaatgttgatctcaaactctttgtctacaatggaaagctaaacaaatatttgattgttacaggtactttaaactgtgaatggatttttattagatccatatatatattctagcggaaaacggtctatttctccacgataagtatgacatcataacagatagagcccaggctttaacctcgtgctagatatgatgtcatattctagctctatatgttatgatgtcatattctagccattgctattttaagaaagtagacttcaaatactagtctcattagtaaatgaaccgatagttgattgtgatttgccttttttttttttgcataattgtggattgtagatggtacagtgaaacgatacaacaatgcgacaaaagagttgggttacggacaacttattcctcaatcaacattctacgacgggaacgatgggtaccgtgagcaggacactggtacatttggtgctgagatctacatcgttaaaccagcccaacaaaaagagaaagtcacattcatatcaaaccctccagacaatgttttcacttggaagatacttcatttctctaccttggaagataaagtctatcagtctaacgagtttcttgttggagaccgatactggttagtcattttcgtaaccggatattttagaccaaagtccaaattaatcttaaaagcttgttactgttatgtgactttcacagtattattgtataatcaggaaattaggattaaacccgaaaggaggcttagtcccaatcttcctatatgctcaaggctttaaggcaaacgcagttgttacaaccacttatgcagcgactaatctgcggttaaagaatcaacgaagcagcaaccacgtaacaacatatagtaagaaaactaacctaagaataaaagtttatctccaggagaaaaaaacaacaatgaatgaaactaggaatagctaaagtaaatttgtttatgctgctctgttttttctttgcagctgcatattggtacctgattccaagcggattaggtttgggagtgaacactataccgttatcagatgtaaaagatgcatcgaaaggatatgtggtgaatgattccattatcattgaagttgaaatgcttacggtctcggtgacgaacattgtatccgcttaaagatctctacttctttaccatagttcaaacaaccttatgaagaaagagatgtttgtaataagacaacgttaatgtttgtgatgtagtcgttacttcggtttttccgagttttctcttttctgttttgttatcaatgaaaataaaactctccgggttttaaattttataaaaaatgttgaggacgtgaagtgttaaaaatcgacttatctggagtcagaaataaacttataatttactttacataatttgttttgtagccaaattcaaacataacccaaaagaaaaaagtattgaatgtttttttttgtagccacattctatttatgcgaccgttgcccgttggagtaagggtcatgccctgatctacaattttcaatgtacaacgttttgaacgctttaatttgaccactataattcattactctcattaagttaaccatatttatctcgaaagttcatcaaccaatatatgtttcattccacttctaacatttcttatttctaccacttttaccacctctattttaagcatttcgcattagtaccggttgatattatatatgtatcaagtttaacaagattctaactcaaaaataagtggcaacaaacaagtgaggaaatgcatatttactatatatttgtgttgaattacctttacttttaagattggttatatacccatttgtgtttattagattttaaaatcaattaccaaataagttattatgagttcatttgaaaagttatgagctgccaactcaagactatgtgaatggattgtcatataagtatgttatgggcttgattggtataactaattaattatagtagagttgtagcaattacgagcaaagcaagtaagttgatgaagttgtaatctgttatatattaggttgatgatatatatataaataagttgttgctgaaattgaccaagttttgatcaggtggtcatgaacgatggtgaatgaagatgaatgatggtcaatgagagataattgagtgatgatagctcaaacctctggatattggaatgcaaggtttatccgtctacgtacgtggatatgaacattgattttgactactcggtcatgatccacagttatcgattggtagattcggccttccgcgatgatcggtatgtctatggtcattaattagaggtaagggtggtgtgatgtgagtccttacttcatagcttcatatgattggattgttaagcttaacaatccaatcatatttaatattttgaacattatgctacccacatcgaatctgatacttgacacattccaagtcaaatacaaaaataataataagtgaatgtgcatatatatatattctaccatgaatccactttcagtattatatagtagtaacttaacttgttcaataagtaactttgtctatatatatgtaaaagtcttacca

SEQ ID NO: 7561 - DNA, 3000 bp, Unknown
  misc_feature (1)..( 3000): cDNA_ID_1818173_gDNA_ID_1621152_Annot_ID_56907 3000 nt of promoter + ATG
tggttcgtcactgtctggcctacccaaaagcggatggaatcttggtgaatacatgggaagagatggagcccaaatcattaaagtcccttcaagacccgaaacttttgggccgggtcgctcgtgtaccggtttatccggttggtccgttatgcagaccgatacaatcatccacgaccgatcacccggtttttgattggttaaacaaacaaccaaacgagtcggttctctacatttccttcgggagtggtggttctctaacggctcaacagttaaccgaattggcgtgggggctcgaggagagccagcaacggtttatatgggtggttcgaccgcccgttgacggctcgtcttgcagtgattatttctcggctaaaggcggtgtaaccaaagacaacacgccagagtatctaccagaagggttcgtgactcgtacttgcgatagaggtttcatgatcccatcatgggcaccgcaagctgaaatcctagcccatcaggccgttggtgggtttttaacacattgtggttggagctcgacgttggaaagcgtcctttgcggcgttccaatgatagcgtggccgcttttcgccgagcagaatatgaacgcggcgttgcttagcgatgaactgggaatctctgttagagtggatgatccaaaggaggcgatttctaggtcgaagattgaggcgatggtgaggaaggttatggctgaggacgaaggtgaagagatgagaaggaaagtgaagaagttgagagacacggcggagatgtcacttagtattcacggtggtggttcggcgcatgagtcgctttgcagagtcacgaaggagtgtcaacggtttttggaatgtgtcggggacttgggacgtggtgcttagtaatggttactgttttctagctctttagtggttgaatttacttgtcgtttcttaatgtgtatttttcattgtaatagaataatcgatgttttgtaatatattaatgtatttgatatttctcaactaatttccattgtaatattgaataatcggtgtgttgtagagagacaaattattctcctggttatattaaataataagaataaaacgacgtttagatgattcattacttttaatataatcttcacaatttaacactcaagtcgacaacgatattatcatcagactaatcatatgtttaagtcacatctacctgaacctgaccttctagatgaaatcataaaccagtaataaaattaccaaaaaaaacggtgctttgtcactaattgctttttattgaagcacaaaaccatgaagaaacagaaaaaagtacatcgtctcgatgtgacatttcctctacctcgctgatttttctgttacactgaaagcatattttaggaatcaaatcaattaaatagataatttaatacgatgacaggttccaaacatttcataaataaaaaggaacatataccaaattcacttgaattattatgcactgtccacgatatatatagacaaatttaggagttttatatcagatgccaattgcataatttgcagcatatatattttttaactaaattaaagatttaatccgtattgaaacgatatcgtatccctttaaagatcctttcttatttattatagatccaacaactttatgaataaaaaaatacgtgttttatgagtgtttaatgtttgtgatatatcgttatttatgttcttctgcatttatgatccaacaactttatgaataaaactttgcatttttattatttattatttttgaaaaatgttaggaaattagagtgttaaatttctatggactaagtcgacattgttagagacatgttaggaaattagagtgttaattttcttatggattaagtcagcatagttagaaacatagagtcagaaataaacatataatttcatttacaaaatttcggctacaaaatttcagttttgtagcagacttgacatgttgtaataaaaaagagtcatatttttcacaataatgtttttctaataatgcttcacgtctctttatcacaatttttatttttataaattttgatatgttgttaaaaaaatatttttggaaagttgtctttatttatttttattttttgtttgatatttatttttttaaagattttataaatatttttcccagcgattttgcggatgatcagaagcgtaatatatgaaaattagaatgaataacaaatttatttgatatatatttttgaaatcttcttcaatgtaggtagagtttttaatgttatgtgaatataatctacaaaagattaattaaataaataatgatatatatatatatatacaacgtatatatatatttaagttgttgaaattgaccaagcgttgatcatgtggtcatgaatgatggttaatgaagataaatgatggtttatgagagatggtcaatgagagataatcggaaggtactccctatcttggaatacaatgttaattagtttagtatgtggatatgatcattaatttgactaaacgatcatgatccaaaattatcaattggtacgttcatgttatagaggcaaggatggtgtggtgtgagtcctcccatcatccttaatcaactagctactcaacgaactgcttaatagcatcccttgagcttctttcgaagcttcgcgtcgttagttgatgcgggacaagaggcacaatatagtccttcagattgtcgactttacgtgtattgtaaccacacctgataccaccctttacataatgtaagaggtttgacttaaacattttaacaatattttgaacattatgctgctcacgtctaatctgatacttgacacattccaagtcgaccaaaagtaataataatgaatgtgtagaaatatacatatttttccaccatatggatccactttcagtattatatagtagtaacgaaactcattaaataagtaactctgtttctatatatatgtaatgcatttcccaaaaaattgaaaaaccatatgagaaa

SEQ ID NO: 7562 - DNA, 3000 bp, Unknown
  misc_feature (1)..( 3000): cDNA_ID_1818169_gDNA_ID_1621152_Annot_ID_56909 3000 nt of promoter + ATG
atcccactatctctatcctcgcctatagctcttactgattcaaagctttcgtgtgcaagcttgtaccaaacttttttcacgggagcagatactccattctctgctgggaaatcggcgaagatagaccacgtcatcagatctggatcaatgagcatatccctcttctcaaatcctccaatgtaggcaaacgactcatcgcgaattgagacatctcctccatactttatatgcagcttcaaacaatcgaaaccactgcaaaaacaacaaagaataaggggattaagttcaaatgacacaaacctagaactctaaaaacccagaaatcaaacccgacaaaacccttaacctagaaatcgaacccgacaaacatagaaactgttactctaaactcagaaatctaacccgacaaatccagtaatcgatccagaaatcttcccattctcaatcccgacaacccagaaatcgatcccgacgaacaaagaaatcgatttcccccaattctaaccctaagaatcgattcgattacatacctcatcgtgacttagcagactcgttgaaatcaattaccgaccacaacgcaaccagttaaacgacgacacacatcgaaatcgatttggggtttcgaaatcaaagagagaattttagggtttcgaaatcaaagagagaattttagggtttggaatcgaaatcgatttgggggagaatgccaaaagggtaacagtgtctttgattagatcgaaataaacacgtggggttaagtattaacctcggttagacactccgttaacgaagttaacagtcgttaacccgagaagctggtttttccaaacaaaaactaaacgaaagattttaaagcgaaaagaaataaacctaggtattgttcgggcaaattaaataaccgaggtattaaacgggcaaattaaaaatatatggggtgtttttagggttttttccccattttatatttatcagctaatattcacttatggcttgctcagttcagaaaattatggaaatcgttgtaacccaaacctgtgatagtaaaaactgtaggcgatacctgaatcgggaaaagtttactttataatacttcggtttatttctaccgaaactgatcaaatcagccgaatgagtacaataaaaagaaagtaaaaaattatgaaaatcgccgtactatttaaaattttcaccacaattagaagcaaaaatctttagtattttaccaacatatatatatatatatatataaaatctacgaaaataatactggaatgctgaaataatgggatgtagtttcgtttcttggagcaacgtacttacagagctatatttttattttagtttttgttaacaggataataacaataactttatagatatttattgtttatatattttattattgttattgctctcgttgaaaacagaataataataaaacaagcctttttcttgttaacgacttgacgtattttttttctcttttcctattaattatcgtcacgttttattacgtttctctcattgatatttgtggaatctgaatcgtattagtcgactccaactcttaacaggataatgatgtttgaaaagtaaaatacacacttttttggtccaagcaggaatattttgttacgtaattaattttacatgtatgtcaagtggatatagtttacttacaagtctaaacacattatatccgtggtacaatatttcaacaattaatattcaatttttaatttgcatgtgttgtcctactttaatattgatatatcagtgtataggaaaaacttcaattaccaaaaccacaaaagaatgaaaaatcatacatcaaaaatcaaaaacctaaatatattggaaagtcaattatattaaaggtagatatttacttgttgttgttgttgcattgcaacttttcaacgcgtaaacaataactgagtagcagtgagcatatttggttattagtcttatcagaaccaaaaacatatatggttattgtcttttaaagatatggacccatgaactatacaaaagtgactatttggtagatatacacaaataacgtgacaccaactgagaaaaccatatgacaaaacaacacatataaatttaaaaaattggcttcgactagttgtagatattttgttccataatcgtattagaacgagagtaaacaataattgaatcgagtggtgagcaaatatggttatatattataacgattttaaagatttggatccatattcttaattagggaggttggtgggttcgattggtgtcggtctagtactcacaataattgtttcatctcaatatgattctgaaataaaatgttgaatattgcttacggtgttaaaagtatatgggactagatatggcatataacgtaacacttatacataacatcaataaatttagacaatacaaaggacagaattagtaagataaaattcacaagtaacatgacgttggctattttgtatgaacacacggcccaaatcgttcatattctaaaaggtataatacatttcgagatattttgcttcggttgcaagattttcacaacacattgagtcattgacagcgatatgagaaaatgtaacaatctctctaataagaaaggagaatcttataatttaacataaaaataaatataatattcgaggataatactataacaagaaagagaagacttatatgatgatgggcaaattgtatattcaactataaggacttaaggagacgccacataaagcagaaagagtttagaagaaaacgtttgttgaccaatgacttgatgactcagtagcatgtgaacataaaaagagacgtgcaagaatctcattggctgcagataacatctatttttgcttcactacctcaacttctctatataatgaagtaaacacccccaatggtctctttaacttaagtgtttctgtttaactccttgagagaaaataacttttaaactttagcttctaagagatattcaggatg

SEQ ID NO: 7563 - DNA, 3000 bp, Unknown
  misc_feature (1)..( 3000): cDNA_ID_3050774_gDNA_ID_1621152_Annot_ID_173311 3000 nt of promoter + ATG
aacgaggacccaatgttgtacgaatgatatcagcaacagcctgtaccacaaaaacaacgatgatctgaaaccagaggagagaagcaacaagcatcacagagaaaaagagccatagaaaaggattaatttaccttggaagcttggatattaccatgatgaaccttacttccagattcacgcttcaacgaatcgcctaaaccattttcacaaaaggagttaatctcgttaccaaaaaactaatatcgatttagaggaaatgagatctggaggaagatggagatactcactcagaacgagtaccggtgcgtgcatatttgcgatctgaggttttcacagtgaagaagaagcttagagagacacggcgagtgattttcaaagagcggcaagtggaagatcctactgccttctccgatttctttcatcctctctcgtgcttttcattttaggttgagaagcccatccctaaggcccattaactaatatttcacacattgggcctttttgtaagatcaaaacaaagtaatagtatttttatatccggaagattaggtaaagatgcgtgagaacgggagaattgttaacctaatttgttaagagggaaaaaatacaaaaaatacttcatttatttttaatttgtccgtttaatacatgcgttatttaatttacctgtttaatatttaagttaatttttatgtttattgaaaaccttttttttttttttaattttagcaaaatcagacatccgagttaacgggcgttaacagtggtaacgaaatcgctaactgtagttaaaacttaaccatataatgtttactatttatatacaatttgttttctaataattatgaacatattattttagtcgagtggttatgagagagattaccatcatcatcgattcaaaatcgattatcatctccaaaattttttttgattttttttcttttttttttaacaaaaaggcaaaatcgaagtcagccatctctttcacttcaacaggctttgcacttgtgtgttgcttcacttctttctccaaaggatattgcaccaaaatcaatcaccaaccaaaagtcccaaatgttagaccaattaatacaacatagatttgtgataatcgatcttatttgttatcaacagatgcaattaatggtaacataatctttctataagctatcaacgttactaacaatgaaaaacaaagtctggatttttcaacgcaaaatatcagcaaaaactgggaatatgcaatctttgctgacttattcatatcaatcgatctagaaattgaaaaccttaatatgaattgaagagatgaaggaatctaatttagctcgttctcaaaatcgaattgaagcagatctaacaaacgtggtgctaaacaaaagaaagtctcagaatcaaattcaaaatcgtaactcggattactgagattttgccttttgttaaaaaaaaaaatcaaaaaatttgttggagatgagaatcgatctcgaactgatgaggatgataatctctctcaaaaccactgggactaagataatatgatcataactattagaaaacaaattgtatataaatagtaaacattatatggttaagttttaactgcggttagcgattccgttaccattgttaacgcccgttaactcgcatgtctgattttgccaaaatttaaaaaaatgaaggtttttaatgaacataaaaattaacttaggtattaaacggccaaattaaataacgcaggtatgaacaaattaaaaataaatggagttttttttggtttttttcctctgttaatagtataatctccctcgacctaatccatctcccgtcagaaagttgttccaaactcttcagtgttatcatcttttccttttaagattatttttgtcaagtctacttcttataacaagagtaagtgctttccctcctgttttaggtttttgtaatttggttcgctaatttatttgatttctcatttgtgtttgtttcgtttccctgaatttttcttcctttgatttttcagattacagactttgagactcttagtttttactaagacacagtgtgatcaaagaaataggcccatctttgttttatagaattctttgtaatcaggttgtgttgaaccttgttatgtaggctatagtttttgctttgaaagccatgtatgactctgaactattactcaattttttaaagtaatgtgggattttttctacttattttttttcttcatcgattgagtagtatatgtgtgtttttaaaattttgaattacctcatatgcagaaaaaactaatatatttttaactatatgtattatatatatcaaataaaaataaattagatataagaacaaataaaaatgaaagaaaaatcatatatttattattaatgtagatatatagattttaggaaattagcaattaattgaatgtaatttaataaatataaaaattaattaaagatttaaatttaaaataaaatatttttagataaattttgtagggactaaaaaagaaataaagaaaatagttaattcaagtatttaatgcaaattaacgatttgtaaatttttaagaatataacattttggttgagatagaatttataaaaactcatatgttattagtaaatattagagagatttttgatcaaaaagtgcatcaaaaatatatatataaatacttttattttaatttcaaaagaaaaacattacctaatacgtatcttattcctaggacatttatgattgatctatctttacgtattttttacgaaaagaatggtttaagattgaagaagagttaaatatttttatttattctttcaaaaatattaaataatcaataaaaatcatatttagaagatattttatggacatgtgattttggcaatttccccataggaaaaagcgaaactctctataattgattgttactggctttgatactttgaagactgaacacaaacaaaaaaatctcttatcacaccacctcca

SEQ ID NO: 7564 - DNA, 3000 bp, Unknown
  misc_feature (1)..( 3000): cDNA_ID_2139718_gDNA_ID_1621152_Annot_ID_173310 3000 nt of promoter + ATG
gacccatctttcttcttccgttgttcctcactagggtcaaatcaaaattcgatttttataaacttactcatacaatttcaataacatgatcaaaagagaccaaatttaagaagatgaaggagtcatttacatggtggaagaagaagtagcagtgcaagtgagacgagaattggagtttctgagtcggtgagattggtggctgagattaactctgtgagtgatgttaacgagtctaggaagtgatgatgatgagtttctagtgatgaaggtgaaaggagagctgcaacaatggctgccaatgctctccattggaggtggtgtgataagagatttttttgtttgtgttcagtcttcaaagtatcaaagccagtaacaatcaattatagagagtttcgctttttcctatggggaaattgccaaaatcacatgtccataaaatatcttctaaatatgatttttattgattatttaatatttttgaaagaataaataaaaatatttaactcttcttcaatcttaaaccattcttttcgtaaaaaatacgtaaagatagatcaatcataaatgtcctaggaataagatacgtattaggtaatgtttttcttttgaaattaaaataaaagtatttatatatatatttttgatgcactttttgatcaaaaatctctctaatatttactaataacatatgagtttttataaattctatctcaaccaaaatgttatattcttaaaaatttacaaatcgttaatttgcattaaatacttgaattaactattttctttatttcttttttagtccctacaaaatttatctaaaaatattttattttaaatttaaatctttaattaatttttatatttattaaattacattcaattaattgctaatttcctaaaatctatatatctacattaataataaatatatgatttttctttcatttttatttgttcttatatctaatttatttttatttgatatatataatacatatagttaaaaatatattagttttttctgcatatgaggtaattcaaaattttaaaaacacacatatactactcaatcgatgaagaaaaaaaataagtagaaaaaatcccacattactttaaaaaattgagtaatagttcagagtcatacatggctttcaaagcaaaaactatagcctacataacaaggttcaacacaacctgattacaaagaattctataaaacaaagatgggcctatttctttgatcacactgtgtcttagtaaaaactaagagtctcaaagtctgtaatctgaaaaatcaaaggaagaaaaattcagggaaacgaaacaaacacaaatgagaaatcaaataaattagcgaaccaaattacaaaaacctaaaacaggagggaaagcacttactcttgttataagaagtagacttgacaaaaataatcttaaaaggaaaagatgataacactgaagagtttggaacaactttctgacgggagatggattaggtcgagggagattatactattaacagaggaaaaaaaccaaaaaaaactccatttatttttaatttgttcatacctgcgttatttaatttggccgtttaatacctaagttaatttttatgttcattaaaaaccttcatttttttaaattttggcaaaatcagacatgcgagttaacgggcgttaacaatggtaacggaatcgctaaccgcagttaaaacttaaccatataatgtttactatttatatacaatttgttttctaatagttatgatcatattatcttagtcccagtggttttgagagagattatcatcctcatcagttcgagatcgattctcatctccaacaaattttttgatttttttttttaacaaaaggcaaaatctcagtaatccgagttacgattttgaatttgattctgagactttcttttgtttagcaccacgtttgttagatctgcttcaattcgattttgagaacgagctaaattagattccttcatctcttcaattcatattaaggttttcaatttctagatcgattgatatgaataagtcagcaaagattgcatattcccagtttttgctgatattttgcgttgaaaaatccagactttgtttttcattgttagtaacgttgatagcttatagaaagattatgttaccattaattgcatctgttgataacaaataagatcgattatcacaaatctatgttgtattaattggtctaacatttgggacttttggttggtgattgattttggtgcaatatcctttggagaaagaagtgaagcaacacacaagtgcaaagcctgttgaagtgaaagagatggctgacttcgattttgcctttttgttaaaaaaaaaagaaaaaaaatcaaaaaaaattttggagatgataatcgattttgaatcgatgatgatggtaatctctctcataaccactcgactaaaataatatgttcataattattagaaaacaaattgtatataaatagtaaacattatatggttaagttttaactacagttagcgatttcgttaccactgttaacgcccgttaactcggatgtctgattttgctaaaattaaaaaaaaaaaaaaggttttcaataaacataaaaattaacttaaatattaaacaggtaaattaaataacgcatgtattaaacggacaaattaaaaataaatgaagtattttttgtattttttccctcttaacaaattaggttaacaattctcccgttctcacgcatctttacctaatcttccggatataaaaatactattactttgttttgatcttacaaaaaggcccaatgtgtgaaatattagttaatgggccttagggatgggcttctcaacctaaaatgaaaagcacgagagaggatgaaagaaatcggagaaggcagtaggatcttccacttgccgctctttgaaaatcactcgccgtgtctctctaagcttcttcttcactgtgaaaacctcagatcgcaaatatg

SEQ ID NO: 7565 - DNA, 3000 bp, Unknown; identical to SEQ ID NO: 7562
  misc_feature (1)..( 3000): cDNA_ID_2139712_gDNA_ID_1621152_Annot_ID_173307 3000 nt of promoter + ATG

SEQ ID NO: 7566 - DNA, 3000 bp, Unknown
  misc_feature (1)..( 3000): cDNA_ID_3050782_gDNA_ID_1621152_Annot_ID_173303 3000 nt of promoter + ATG
attttctttctttagattttattggttaaaacttaaaactgtgataaccattttcttgaactctttttattgataggagtgacaagagtgtggagggatgaccgaccatcggataagattctttcgataaccagcttctcaataattaggacgagacctgaaccctatgaatcctctgtttttgaggctgttggttacaaatggtaaagatcttagtatatcttacactctatcccattttttttttgttaattatatcttttgagctaattatgatgcaaataaataaatcaggagattggttttgtacgtgaatggtaatgaaaaggacggtggaaaagatcatgtttcactttacgcgaagatcgtagagacagaatctcttccagtaggatgggaagtgaatgttgatctcaaactctttgtctacaatggaaagctaaacaaatatttgattgttacaggtactttaaactgtgaatggatttttattagatccatatatatattctagcggaaaacggtctatttctccacgataagtatgacatcataacagatagagcccaggctttaacctcgtgctagatatgatgtcatattctagctctatatgttatgatgtcatattctagccattgctattttaagaaagtagacttcaaatactagtctcattagtaaatgaaccgatagttgattgtgatttgccttttttttttttgcataattgtggattgtagatggtacagtgaaacgatacaacaatgcgacaaaagagttgggttacggacaacttattcctcaatcaacattctacgacgggaacgatgggtaccgtgagcaggacactggtacatttggtgctgagatctacatcgttaaaccagcccaacaaaaagagaaagtcacattcatatcaaaccctccagacaatgttttcacttggaagatacttcatttctctaccttggaagataaagtctatcagtctaacgagtttcttgttggagaccgatactggttagtcattttcgtaaccggatattttagaccaaagtccaaattaatcttaaaagcttgttactgttatgtgactttcacagtattattgtataatcaggaaattaggattaaacccgaaaggaggcttagtcccaatcttcctatatgctcaaggctttaaggcaaacgcagttgttacaaccacttatgcagcgactaatctgcggttaaagaatcaacgaagcagcaaccacgtaacaacatatagtaagaaaactaacctaagaataaaagtttatctccaggagaaaaaaacaacaatgaatgaaactaggaatagctaaagtaaatttgtttatgctgctctgttttttctttgcagctgcatattggtacctgattccaagcggattaggtttgggagtgaacactataccgttatcagatgtaaaagatgcatcgaaaggatatgtggtgaatgattccattatcattgaagttgaaatgcttacggtctcggtgacgaacattgtatccgcttaaagatctctacttctttaccatagttcaaacaaccttatgaagaaagagatgtttgtaataagacaacgttaatgtttgtgatgtagtcgttacttcggtttttccgagttttctcttttctgttttgttatcaatgaaaataaaactctccgggttttaaattttataaaaaatgttgaggacgtgaagtgttaaaaatcgacttatctggagtcagaaataaacttataatttactttacataatttgttttgtagccaaattcaaacataacccaaaagaaaaaagtattgaatgtttttttttgtagccacattctatttatgcgaccgttgcccgttggagtaagggtcatgccctgatctacaattttcaatgtacaacgttttgaacgctttaatttgaccactataattcattactctcattaagttaaccatatttatctcgaaagttcatcaaccaatatatgtttcattccacttctaacatttcttatttctaccacttttaccacctctattttaagcatttcgcattagtaccggttgatattatatatgtatcaagtttaacaagattctaactcaaaaataagtggcaacaaacaagtgaggaaatgcatatttactatatatttgtgttgaattacctttacttttaagattggttatatacccatttgtgtttattagattttaaaatcaattaccaaataagttattatgagttcatttgaaaagttatgagctgccaactcaagactatgtgaatggattgtcatataagtatgttatgggcttgattggtataactaattaattatagtagagttgtagcaattacgagcaaagcaagtaagttgatgaagttgtaatctgttatatattaggttgatgatatatatataaataagttgttgctgaaattgaccaagttttgatcaggtggtcatgaacgatggtgaatgaagatgaatgatggtcaatgagagataattgagtgatgatagctcaaacctctggatattggaatgcaaggtttatccgtctacgtacgtggatatgaacattgattttgactactcggtcatgatccacagttatcgattggtagattcggccttccgcgatgatcggtatgtctatggtcattaattagaggtaagggtggtgtgatgtgagtccttacttcatagcttcatatgattggattgttaagcttaacaatccaatcatatttaatattttgaacattatgctacccacatcgaatctgatacttgacacattccaagtcaaatacaaaaataataataagtgaatgtgcatatatatatattctaccatgaatccactttcagtattatatagtagtaacttaacttgttcaataagtaactttgtctatatatatgtaaaagtcttaccaatgtctagctcatctaagaaa

SEQ ID NO: 7567 - DNA, 3000 bp, Unknown; identical to SEQ ID NO: 7559
  misc_feature (1)..( 3000): cDNA_ID_4257528_gDNA_ID_1621152_Annot_ID_173302 3000 nt of promoter + ATG

SEQ ID NO: 7568 - DNA, 3000 bp, Unknown
  misc_feature (1)..( 3000): cDNA_ID_3050787_gDNA_ID_1621152_Annot_ID_173298 3000 nt of promoter + ATG
ttcccccacctttttaatatattgtaatatctcgtgtacaacgttttgcctaataatataatcatatttcgaaaacttgccacccactacctcgaggtctctcccacaaatctataaaaatattgtttaataatagaaatgggaacttgcaaaaagcattaaaataacaataacatccaaagtcaaacaaaaacaagaaaaaatgatttgtgtaaaaacatatacatatacatatacatatacatatctctcgcttttctgttcatcacttcagctgagtttctcattcaacatgtaacttttttttgaaatatgttgcaaaaacaaattccaacatatttataaaactagtaacattattatttataatttgcaaaataggtcatgaatcccttttttaatcttttttttttttcatttcccctcatgtttaattattaaactacttaatagtataatatttttcaaattttctatttatatacaaaagcctatgtttttttttctataatttgatatgtagtgtctaataaattcaaaaacatttttattcatacatctcattaattgttaagatgtatacaaattgatacatttttattcgtacaacttatttagtatacattagctatgaatatatgaataaaatatgtatattatgtacatttgtatactaaatgtgttgtatgactcttagtatacaaaacaacacaaaaaactttatcaaaaaaaaaaaaaaagctcccagacccgactcccgaggaaacctaagcttcttcttgctatggccttcgtggccgccggcgaggaccctcccttgccagaaccccctgacccgcctgatcctccctccatcttcgcccaaaccttcatacccgatccaccttctacttcttctctctttccaccttcatcgagtctagatctagatctatgttctaccgtttcttcctatggtgttactcctttcgtttttttgcgattctttactgctgtgtgcagtcccttctatcagatctgtacccgttccgtgtctttgcggttctttactgctctatgcagtccatggaaactagcctattcccagatcttgggatatcctctcgtttcaagtggatatgtttcacaggccataacctttgatgtccacgctgcccctcctacctcaactcagagagcctctcctactcgttccatggcccagacacgacaacggtttgttacttctgtaagatggtgtatgtctttgtttctggttttacccctcattcaaaatttcgtagtggtgcgatttaatgctgcagtatgcagtctctttgaactcaatctggccttttgtgctgtttgttttgtttctctttcttggtggcagtttgaaaagaaactaattaatacacctcgcctgatgaatctggttttatcgggtatttggtaccctagtagcttcttatcggagctagttatcttcccaaagttccctcctcagtggagtggtttggatgtccaagagtcgtcggtattgcaaggatcttcctcccgattgatgttcttctctgcatttgatgcagttcttgtaacctcttgtgttacgttggatacagtcttccaagaatctagccagatcgttcttattgttcgttttgccttatgttattcttatgacttctgttgcatatctatctatcctttaaccattgttatatggtctgttttggcttctgttgttgtgttttatgtagttttcttcatgttggttgtaattcctctttctgaggctcctaaaatttagtgaaaacaactattggtttgaaaaaaaaaaaaaaaaaagaatcttagtatacaaaacaaagagtaaaattgtctattttgcaaattgtaaatagtagtgttactagttacataattatgtttccaaaagtaactatatttccaacaaacccttttttaatgtatttttttgatagatatattagtagattttttttaacaatggaaaacgaacaaggttataagggcagatgagcagagtacaactgttcttaaagtctcatggcaaatcttggcacacttgtgttatctgaaatagccagtctttagattttcttgtactttttattttgttgattggagtttgaagagtgttgagagaggagcgacgaggacaataacaaatttctcagtgattaaaggtagcagagaaccctatacaattatgggttccgcattatcctttcgtaacctagattttttttttatatatagttaaactcctagcctaaaactaaaacacagttgatgactaattggtggagaaccattaaaaaaaaaaaaaaaagacagagtagactaacgaaaccacacctttacatttttctatttatctcaccttcctaaataaaaaatatttattttaaacaaaaacacattttctgtacagacgtgggtttcgtaatgtccataagtccatccatagtctaccatataatttaacatctacttctctccagtggacgcaaaagcttcgaattgaatgtgggcgttgcttctctcgtgtctaatataaaatttggataatcatgaattcttcgatgatagtgatataccgttgacactgagtagttcattgcaataagtaagatcttgtttttgctaaaaagattcaatcatattttgaacacttgccacccaccacttccaaaacttccacaaattcatagatatagtaatacacaggttacttgacaaaaggaataaaagtacaatatgatgctttacacattctcagtcaaacaaaaacgataaaatgaatgtgtaagataatattgtttaaaaaagaaaaaaagaacaaaaaaaagataatattgttttcccgacgactaatccactttcagtattttataaaataactgaactcaagttgctcgatcaaacaagtacccttaaatgtctctctgtctatataaatgtacactcttcccaaacaaaaccatatctcaaaat

SEQ ID NO: 7569 - DNA, 3000 bp, Unknown; identical to SEQ ID NO: 5424
  misc_feature (1)..( 3000): cDNA_ID_3076949_gDNA_ID_1621152_Annot_ID_173297 3000 nt of promoter + ATG

SEQ ID NO: 7570 - DNA, 3000 bp, Unknown; identical to SEQ ID NO: 5422
  misc_feature (1)..( 3000): cDNA_ID_1842707_gDNA_ID_1621152_Annot_ID_173295 3000 nt of promoter + ATG

SEQ ID NO: 7571 - DNA, 3000 bp, Unknown; identical to SEQ ID NO: 7554
  misc_feature (1)..( 3000): cDNA_ID_2139674_gDNA_ID_1621152_Annot_ID_173293 3000 nt of promoter + ATG

SEQ ID NO: 7572 - DNA, 3000 bp, Unknown
  misc_feature (1)..( 3000): cDNA_ID_1818161_gDNA_ID_1621152_Annot_ID_56911 3000 nt of promoter + ATG
tgatgttaacgagtctaggaagtgatgatgatgagtttctagtgatgaaggtgaaaggagagctgcaacaatggctgccaatgctctccattggaggtggtgtgataagagatttttttgtttgtgttcagtcttcaaagtatcaaagccagtaacaatcaattatagagagtttcgctttttcctatggggaaattgccaaaatcacatgtccataaaatatcttctaaatatgatttttattgattatttaatatttttgaaagaataaataaaaatatttaactcttcttcaatcttaaaccattcttttcgtaaaaaatacgtaaagatagatcaatcataaatgtcctaggaataagatacgtattaggtaatgtttttcttttgaaattaaaataaaagtatttatatatatatttttgatgcactttttgatcaaaaatctctctaatatttactaataacatatgagtttttataaattctatctcaaccaaaatgttatattcttaaaaatttacaaatcgttaatttgcattaaatacttgaattaactattttctttatttcttttttagtccctacaaaatttatctaaaaatattttattttaaatttaaatctttaattaatttttatatttattaaattacattcaattaattgctaatttcctaaaatctatatatctacattaataataaatatatgatttttctttcatttttatttgttcttatatctaatttatttttatttgatatatataatacatatagttaaaaatatattagttttttctgcatatgaggtaattcaaaattttaaaaacacacatatactactcaatcgatgaagaaaaaaaataagtagaaaaaatcccacattactttaaaaaattgagtaatagttcagagtcatacatggctttcaaagcaaaaactatagcctacataacaaggttcaacacaacctgattacaaagaattctataaaacaaagatgggcctatttctttgatcacactgtgtcttagtaaaaactaagagtctcaaagtctgtaatctgaaaaatcaaaggaagaaaaattcagggaaacgaaacaaacacaaatgagaaatcaaataaattagcgaaccaaattacaaaaacctaaaacaggagggaaagcacttactcttgttataagaagtagacttgacaaaaataatcttaaaaggaaaagatgataacactgaagagtttggaacaactttctgacgggagatggattaggtcgagggagattatactattaacagaggaaaaaaaccaaaaaaaactccatttatttttaatttgttcatacctgcgttatttaatttggccgtttaatacctaagttaatttttatgttcattaaaaaccttcatttttttaaattttggcaaaatcagacatgcgagttaacgggcgttaacaatggtaacggaatcgctaaccgcagttaaaacttaaccatataatgtttactatttatatacaatttgttttctaatagttatgatcatattatcttagtcccagtggttttgagagagattatcatcctcatcagttcgagatcgattctcatctccaacaaattttttgatttttttttttaacaaaaggcaaaatctcagtaatccgagttacgattttgaatttgattctgagactttcttttgtttagcaccacgtttgttagatctgcttcaattcgattttgagaacgagctaaattagattccttcatctcttcaattcatattaaggttttcaatttctagatcgattgatatgaataagtcagcaaagattgcatattcccagtttttgctgatattttgcgttgaaaaatccagactttgtttttcattgttagtaacgttgatagcttatagaaagattatgttaccattaattgcatctgttgataacaaataagatcgattatcacaaatctatgttgtattaattggtctaacatttgggacttttggttggtgattgattttggtgcaatatcctttggagaaagaagtgaagcaacacacaagtgcaaagcctgttgaagtgaaagagatggctgacttcgattttgcctttttgttaaaaaaaaaagaaaaaaaatcaaaaaaaattttggagatgataatcgattttgaatcgatgatgatggtaatctctctcataaccactcgactaaaataatatgttcataattattagaaaacaaattgtatataaatagtaaacattatatggttaagttttaactacagttagcgatttcgttaccactgttaacgcccgttaactcggatgtctgattttgctaaaattaaaaaaaaaaaaaaggttttcaataaacataaaaattaacttaaatattaaacaggtaaattaaataacgcatgtattaaacggacaaattaaaaataaatgaagtattttttgtattttttccctcttaacaaattaggttaacaattctcccgttctcacgcatctttacctaatcttccggatataaaaatactattactttgttttgatcttacaaaaaggcccaatgtgtgaaatattagttaatgggccttagggatgggcttctcaacctaaaatgaaaagcacgagagaggatgaaagaaatcggagaaggcagtaggatcttccacttgccgctctttgaaaatcactcgccgtgtctctctaagcttcttcttcactgtgaaaacctcagatcgcaaatatgcacgcaccggtactcgttctgagtgagtatctccatcttcctccagatctcatttcctctaaatcgatattagttttttggtaacgagattaactccttttgtgaaaatggtttaggcgattcgttgaagcgtgaatctggaagtaaggttcatcatggtaatatccaagcttccaaggtaaattaatccttttctatggctctttttctctgtgatg

SEQ ID NO: 7573 - DNA, 3000 bp, Unknown
  misc_feature (1)..( 3000): cDNA_ID_1818153_gDNA_ID_1621152_Annot_ID_56913 3000 nt of promoter + ATG
aaaagaatggtttaagattgaagaagagttaaatatttttatttattctttcaaaaatattaaataatcaataaaaatcatatttagaagatattttatggacatgtgattttggcaatttccccataggaaaaagcgaaactctctataattgattgttactggctttgatactttgaagactgaacacaaacaaaaaaatctcttatcacaccacctccaatggagagcattggcagccattgttgcagctctcctttcaccttcatcactagaaactcatcatcatcacttcctagactcgttaacatcactcacagagttaatctcagccaccaatctcaccgactcagaaactccaattctcgtctcacttgcactgctacttcttcttccaccatgtaaatgactccttcatcttcttaaatttggtctcttttgatcatgttattgaaattgtatgagtaagtttataaaaatcgaattttgatttgaccctagtgaggaacaacggaagaagaaagatgggtcaggaacgaaagtgaggttgaatgtgaggttagatcatcaagttaattttggtgaccatgtggctatgtttggatcagctaaagagattggttcatggaaaaagaaatcgcctttgaattggagtgagaatggatgggtttgtgagttggaacttgacggtggtcaggttttggagtataagtttgtcattgttaagaatgatggttcactttcatgggaatctggtgataatcgtgtccttaaggttccaaattctgggaatttttctgttgtttgtcattgggatgctactagagaaacccttgatttgcctcaggaggttggtaatgatgatgatgttggtgatggtgggcatgagagggataatcatgatgttggtgatgatagagtagtgggaagtgaaaatggtgcgcagcttcagaagagtacattgggtgggcaatggcaaggtaaagatgcgtcctttatgcgttctaatgatcatggtaacagagaagttggtagaaattgggatactagtggtcttgaaggcacagctcttaagatggttgagggtgatcgcaactctaagaactggtggagaaaggtatcacttttggactgttattttagtttcctcttacttgttttcctttgaagctggggaataatgaaacattacctcaattttgaaatgtgtttatgtgttcaagcttgaaatggtacgcgaggttatagttgggagtgttgagagggaggaacgattgaaggcgctcatatactctgcaatttatttgaaggtttctcttgtctttctatagcctaacctaagttatcttttctcatatatctgggattcaccttgcttactctttttgtttgtttgtctggcttcttatgcagtggataaacacaggtcagattccttgttttgaagatggagggcatcaccgtccaaacaggcatgccgagatttccagacttatattccgtgagttggagcacatttgcagtaagaaagatgctactccagaggtgacacattttttcgctttcaagatctcgactttcaagtctctcttctcaaatatttgtagttggtgtgttcatagtatcatcttctttaagttggatatgattttatttcgtaggaagtgcttgttgctcggaaaatccatccgtgtttaccttctttcaaagcagagtttactgcagctgtccctctaactcggattagggacatagcccatcgcaatgatattcctcatgatctcaaggtaataactcttttctcctgttttgtcattagatcagtttttttaatggtatccatataacatatctatgttccagcaagaaatcaagcatacgatacaaaataagcttcaccggaatgctggtccagaagatctaattgcaacagaagcaatgcttcaacgaattaccgagaccccaggaaaatatagtggagactttgtggagcagtttaaaatattccataatgagcttaaagatttctttaatgctggaaggtatttctgaaaccacctatcatttcgtctgattaacttgctaaatgatggtcccatggactgtagaattcaatagctcttgtatcttgttgcagtctcactgaacagcttgattctatgaaaatttctatggatgatagaggtctttctgcgctcaatttgttttttgaatgtaaaaaggtaagctctcacttttcttttacatgtgattcagtgcttttctgttggaagtatgcaatatttattgggttttcttgcatgatcttctgaagtggtatttccctagacacagcaatgctagggtagccaccgtaaagatgcagattaaattaataacaacccatccttggttgcattctctattccaataaaaggaaagaaaatcaaaaccaaagggggatgtactcttagaaacgccacaaaaggagaaatgttgatatgtgtccatataatcacatcatttgataaattgtgcatgttatacacaatcaatgagaattttgttattgtagtctcttcataagactgactgcgaaattcatatttccagcgccttgacacatcaggagaatcaagcaatgttttggagttgattaaaaccatgcattctctagcttctttaagagaaacaattataaaggaacttaatagcggcttgcgaaatgatgctcctgatactgccattgcaatgcgccagaaggtgagctattttaaacaatccagcattatcatgtaccaatttatttactaatatagtttcctcgtttcattagtggcgcctttgtgagatcggcctcgaggactacttttttgttctactaagcaggtgtgcataagattttgattgcttttaagagctaaatttcttttggaagttattaaaactcctgctacctttctccgtctcgtcttatgtctcgtcaatgatttgtgtagattcctcaatgctcttgaaact

SEQ ID NO: 7574 - DNA, 3000 bp, Unknown
  misc_feature (1)..( 3000): cDNA_ID_2993732_gDNA_ID_1621153_Annot_ID_56916 3000 nt of promoter + ATG
caaggatgtcacgtttgggaatcacagaatcaagaaagtaagaaacaaaaagaacaaagatcaaataccaaatcagcaataacagcaggatttcgaggatcatcctcgggaattccctgctcaactttcccaacgagatctgccccaacatcagctcccttagtatatattccaccacccaactgagcaaataaggcaacaaacgaagcaccaaaaccatatccgacaagaagaagaggtactgtaagagaaacagaaaattcaatcaataaatcttacaagtttaatagctccactatcgcccatgcaaatgcaaattctggtcaataaatcaagagaattacatatagggttcactgaaaatcttagaactgtattggtaccccacctcaatcaagattaatacaagtcatgacatatttaagaaaatactgctcatgtctgaaaatgatcctttgaaaagataacaataactttttgaaactcagtacaatgattatagaatatacacacaagacgaaaatgaatatttttcataaaaaaaaaagagcagaagacttacggtcagtaacattcattgagcctggtgaacccacgcccaaccacacataaaatgtagaatagaggatggcgataccaatcacagccataccaacaacaaccagggctgaaaacccaccagcacgaacggctatctgcattatatctgccacttagtatttggaaacgtgtacatgacatgttaccaaaatagctaaactaaagaagaacctgcaatgcttctctcgcagatcgtctggcagcactggagacccgcacattagcacgaactgacacccacattccaacatatccagcaatacctgagcatagagcccccaaaagaaatgcagcaacagtaatataagcagacatcgccctgcagcaaaatagtaatatggctaagcttcattcacaacaattcaaaagataaaataaatcttgtgaatgtaatcatgtatcagcaccttcctaaaccagcagcctcttgctggggagttaagctacggaatagatatatgcaaagaatcacaaaagctagcaaaatggccatcttggatatagtgctatactgcgttctgaaaaaaccttcagctccatcacgtatagcatctgatatctataagtaagagaattacctcacaaattagaattacaaatttttgatgagaacaaagaaggaaaaatgtcaacatcatgactaacaccacataatctgagtgagcttacctcaaccatctctggaggtccttcatctttcgctaaaacccacttggttagatatattgacaaaaggaagctgatgatgcatactgtgaagacgaacacgatgatgggagaagtacttgcccccatgtaaaagattgctccgaagcagaaaagcagaattatcgaaaggacacggacatttaatttcctaataatccggaatatctgccaaaaaacaactaaactttatacaatttcaaagaaaatgaaaacgagatgctcaagaaactaagatgctaaacgaaatagaaggaaactagttataatacgcatctcagtgatctgatgcaagcaaaaagaaaagcactcaagaaagagaggaataaaagttgtaccagtggactataggttttactacgcatgttgggaaaagccctaggcctgtcattgaaagacatcaaactggcctgctcaacatcttcatccatcatcatgttttgagctgaattagcccttcggactatgtgtagaggcgtaaagtcaatgctatggggcaactccgccccagaactcggacgctgaattttaatacactacaactttttcctccaaacgttaacaacagcacatcacaaaacgagcacaagttagtatgaaccctcttaactctagctatatctttgattccagcttcttcaaactttctcagtagagttgccacaacaagtttccaccacaatcaaaatttctgaaaaaaatagaaaagtatgaaaagttgtgatgtttctctttaccaaccaaatagcatttttaaatgaaatataatcagagtaaggttctacagtaaagtttagctataactttcatcatttcccatgagcgtaattgcttctacgatcaattccccagaaaagtgcgattaacaaacagacctcaagatctaatcgactaagatttcagtgaataaaacgcaagggactttgcattccgagtttaatgaatcaagcaccgttactttaatttagatctgagttctgttctaagagaaattcacatgatctctagacaggaaatggatacgtttccagaaacgaatccaacgaaaaaaaaaaagcatacgaagagtttatccggaaacaaaccctaaaaatcggtaaaacagagaagatgacggctccggtgagagtgatcagaaggaaaccgccattagcgaaagcttgttgtagccgaagaagcgctctatcctctcgctgtctccgttctaaatccgaagacttttcacagaactttccgaatatttttttcctaaattaatttttctacctttaattttattttcactcctcagtggttcaatactaattttatgacacatcctatccaatgagtcgttgacacttaatcactattctcacttaaaaagttaaaaacttaaaatcatcctcgtttgttaaattatatagatcgagttaaattatcaaaaatacccatcaattttggaatattaacatttgaatattatatgggcctagcccaaaattatgttttgccattcggcccatataatagacaatctgcaaagtgaagaagaagaagaaccactaacgttatcttaccggcccgatcacggagctcacctttcatcgtcaatctccggcggacgaatttctcttcgtagccgttacttctcattatttctttgaaactttcttagaaaattctctgttttggttaggacaatacaaacagagg

SEQ ID NO: 7575 - DNA, 3000 bp, Unknown
  misc_feature (1)..( 3000): cDNA_ID_3000132_gDNA_ID_1621153_Annot_ID_56918 3000 nt of promoter + ATG
ggtgtaaagcctcaatcagttgagacggagatgacttcaaatactgcatatcactccgaggacgaggaataaaccccaaaactcgtcagggtaagctataagatggtcgcaacagtcgtatataactttctattgatttcacgagctgaaagcagggaaatttgaagagcaaatgaacttaagaaaaaactctgctagagtgttgggcagtaaagccttctttagctagcataagataatatggactaaaagtatctaaaatttgccttggctatagacacttcaagattttctttgacctctaatgaaacaaatttcaaaactttgcaggctcttgctcttcaagatttgtagatttatgaacacgaatcaacgaagattcgaatcaccaagagcagctgcaaagacatggtttagacttttagataaggtagagtaaagcaaaccttttacagactgatcagatcctatccagtcttagtgaaattaaataaggaaaaggtgctgttgctttaccctctgttttcttgtaatctcccttataacagtttgttgaatcgtgtgtatatatatttccgcataagctcgcagattcggttctcataccacatttgcagactgttttgtatgatgatgccttgagtccaaaattaacgtgaaaagagaatacaattatagatataggatcggcaagtacatggtgtggaggttaaacaatatcattacatttttcacaaggtagtatgcaacaaatccaatgtacataaggggaaactactctgaagactgaagctatgagcatgtaagcatgagaaaagacgaaaagtataaacaaaagctagacatattatgtatcagaatgtgcttcttgttctaaaatctggccatttcctcgctttagtacacagtttccaagagattgagaagtctgacagagcatggagagacagaacaagcatagtcctgtttcagggagaagaactagtcagagatcattggtttgcaatatttgacacaggcaagacgaagggtttcccaaatggccaacttttgttaaatgctaagaaatccgacatattggtatgtaatgctactcataaggtaacagctcactcttccacattaaaatgaaactttgtataagtttgagacaaaatgtgaatgctttataattccatgaaatgctacttataaggtaagagcacactcttccacattagaatgaactttgtataagtttgagacaaaatgtgaatgctttaaaattcaatgaaatactacactcttccacattaaaatgaaactctgtataaatttgagatgaaatgtgaatgctttacctgcataagcaacggttacacctgatatgagtcgcccaagcgctgataagaagtaaaggcaaattacgacctaaaggaaaaagcaaaaaacaaacatattcagtatagagcacaattactgagttaacaattagcaatgcatttatatggtaactgggtaaagacactagggttctaagagaatctctgtggtgatatattgatgctaatgcattttgatacactcatgatccaagaatagtaacggtatcttgtacatagtaagttggtaacaaaggacacacttaccttgacaaaaagtctcttgtcatgtccagttgctgcaaccctcagaacaccctctgctgctccaacggtattagctaagcgtgcaacgatgttacttgctgtgtcctgtgatatttgccactctagtggatccactggtaccctttagaaaagttataggattgtaaatcatgtggtatgataaagcaagggtcttgaagagttatacacacaatgagcagaagataatgatatcattgaacattctaggattatgactatgcattgatcacagagaacggaagatgatagtaatcaaataagatcgatgcatcattgattcacccagaaatacaatgagaactagtttcagttcatgccttcagagaatacatgaaatcaatttcataatcaagttaacataactgattgcacaaccacattacaaagtacaacccaattaaacaattatatcgagcaagtattcaaacttgtcacaaatcaaaggagccaacaaatttcgtatctactcggtcaccaaacagcaaatgactaaatcagagaccaaagaacaaaatccaataccgtaaccagagagatttaggcgaaaaatgtgagggaacttacgagacattgagttggcgaaaaaggagaccgagaatggcgagagagcataagagaacaatgaaaacatcggagaagagagagagaagagtcgcgttacgatatgcacaatggtaatacacaagcgtcccgctaatcagcaatcccatcgccttccccatttctcccatctctctccccacttcaaaaaaaacttgctttccctttcttcactttcagaaaatttccccgagaaaacaaaactgatcacttttgtgaattttccggcttgatcagagagagagagagattctcaagccgcatgtctttgttgactaaacggacccacttattgggccgtaagtatatattataaagcccaataaataaactgtcacgtggctattaacgacaaagtccagatctacgcgcgtatcgtgtgtagtcatgtaccggatcactccacgatttcgtcaatcagatcaaaacttctccaactctttcaatatctatctacgtgcatccacctctctcttcttcttcttgtgaccactcttcctgtctgttcactggttaggagatctctatccctctctctctgatcctttttgtttctttctgatttattgtatcgctctctttgaaaaaccttaagagttgtctgattttggcgatttctgatttgttgttgttgttgtttgatcggatctcggcattttctaggaggtgaattttgatttttttggccgatcggatttgagtttttgaatctctgattgctgagaaaatg

SEQ ID NO: 7576 - DNA, 3000 bp, Unknown
  misc_feature (1)..( 3000): cDNA_ID_1818275_gDNA_ID_1621153_Annot_ID_56920 3000 nt of promoter + ATG
ctacaaatcttgaagagcaagagcctgcaaagttttgaaatttgtttcattagaggtcaaagaaaatcttgaagtgtctatagccaaggcaaattttagatacttttagtccatattatcttatgctagctaaagaaggctttactgcccaacactctagcagagttttttcttaagttcatttgctcttcaaatttccctgctttcagctcgtgaaatcaatagaaagttatatacgactgttgcgaccatcttatagcttaccctgacgagttttggggtttattcctcgtcctcggagtgatatgcagtatttgaagtcatctccgtctcaactgattgaggctttacacctataatcaaaaacagaccaagtgttaagaaacgctcaaaagaccaaacgttaaagaaacactgtacctaacaaaaaaacatattttgacgctgcaacatttgccactgaagaatgcaaacaccacaatctattataaaacagagtgattattattcgacaagaagcaaaagcaacaagattaataaacactacaatcttttcaaccctataaaggaaagactctctatgttattactgatgatggtcacccatttccataactgacatctgaacctgtaaagaattttcaacaactatataacgataagccaagaattgcctaagtgcatctaagaatgtagcaatacctatgcagattatagatactgcaaatgtaaaaaccaaagctttttcaaaaccgaaacacatacgatcagacaattagagttaatcatataaaaaccacctttgatgaagtaatcagagcaaggccatcctcgaaccgatgagattgaaatagattcttcatcagagatcggattggccagcttctcaacgagcttagcgatcccatgagactgggatctaggaggtggaacccaaaaggaagcaccggggacaaaagggagccaatcaggtgcggatcggcgtaccataatccggtggacagcatcttccaacttattgacaagaggatccgcagcgatatcaatctcgtagattactccgagatggttagagttagaccgacgattggaggattgagatcggatgaaaatggtttgagatgaagggagaagaagagaagctgcggcgaaacggtatcgagagagagaaagtgaaggagataaagatcgagccattgtagagatttaggagaaagatggttccttttttttttggtttggtttggttgttccctttttctagtctttttaacggataaggagaaaaagagcattaatcttgtttatcggaatttccttttttaatcctttttctgccctatctgaaaatttactttctccgataagaactgtcttttttcaaaacaggtacatcatgcaaatattttctgagtataaaacaacatgagacacaatcatacaaagcatatactgatgtccaaaaatccaatctgtgtagtttttaagccatactggtgtttaaaagaaaaagaaaaaaattatacactactctagtgatgaagattgaagaatcaaagaactcaaaaacaagagcctattcgtctagtgggccaccagtccactcaaggccggccttttagtcacctgaagttggacccaacccataagtggggccggaaaacaccatataatccaataggcaataaccaatttcactagtttattaaataaaaatatattaatattattaggtgagatatcataattgataagaaaatgctccaacttagtaataattacaatatacacccttagtttaacacattgtaacaaaactctctcaaactttttaccaattaaatttggacagagacaaaaaaaagaaagtgtgttcttcactttttctttcctcagttggttgtccaaacaaaaaaaatctccaccgctctgagagaaaaaagttggaagaggagagagagagagagcgacaacgcaccaactgttgcggctcaaagagatctcgatcgggatccacaagacggagatagatagagagagagtgagagctaacggaaatgggatctcagctacttgagtgttgcttccgtttcgtcttctactgtcactcccacagctccaactgttttccttgattgtttttcttttatctcggcgttttactcggaagcttacaacacactctctcaggtgcgaatcgacgccgtcttctttttgttttctcagattgggtttttgtcttcctgtgatcatttttacttcattttgggggtttaggtattgttttagcttcgcgttttggtacttgcttcaagctctttttcttagtttctgtgatttggggattttgttagacatggcgatctgtgttcgatttctgctcaatcgcatttgaaattgaaattgcttctaaatcccagagatctcactgggtttcaagagatcagacatagaaattgtgattagggttttgtttttttcatgggttctctgatattatttggtttttctgtagcttttttgggggaagtagttgcaagaaactatgtagatctcaagtgatattagtatattacaagttccctgaattagatgtttacgaatagtcttaagtctcagtggtgctggctctgtcagagaaatggtaaaggcttttggcaaggggaagtgacttaatctcaaatgataactagtcccatcaaaacagctctgctagtgtttggtttctgagtctcattttcttagcatttagggatctatcttgcagcatactgtcctggtcgttcttggtactattttcttttgtgggcataggatgttgaaagctttttattccgtgttggtgtttgccaatgtttcgcttgtcacagttctctatatgcccatttctcatgggttattgttttgttctttcagggatttgaaatcctcacgtttcagcacattctttgtggttcccatctattctctagccagttcggagttgcctgaagaaatcaa

SEQ ID NO: 7577 - DNA, 3000 bp, Unknown
  misc_feature (1)..( 3000): cDNA_ID_1818263_gDNA_ID_1621153_Annot_ID_56924 3000 nt of promoter + ATG
ttttcttttttgaatttcacaccggattcaatcggtaaagtattatagaagttcttactgaaacaacattaatttttttgtaaaatataaatctaagaagaaaaaattactagggaaattaatagcaaactgtaacggttgactggttttgctaatcgtgcacggtttagcattgagattaagataagctctttctaaaatattcgaaacatatcctttaaaaaaaaaaaaaaaaatcaaacaaaaccagcaaaagtaatagattatagcgaaacaaagaccaaaaagtcgttcaaaatactctttaaaatattataaaaccaacaaaaaaacaaagacttccttggctcctcctataaatagaagctttctctctttaccagaaacacaccaaaatccattaacacacacaaaaacaaaatgaaattttcaatcacattagctctatgcttcactctctccatcttcttgatcggatcacaagccaaagttccagtcgacgaccaattccgagtggtcaacgaaggtggctacaccgattacagtcccatcgaatacaaccccgacgtacgtggcttcgtacccttcagtgacaacttccgtctctgtttctacaacacaaccccaaacgcatacactctcgctctcagaatcggaaacagagtccaagaatccactctcagatgggtctgggaagcaaacagaggctcaccggtcaaagaaaacgcgacgttgacttttggcgaagacggaaacctcgtactcgctgaagccgatggacgcttggtatggcaaacgaacacagctaacaaaggcgccgtggggatcaaaatcttggagaatggcaatatggtaatatacgattccagtggaaaatttgtatggcagagctttgattctcccaccgacacacttctcgttggacagtctttgaaactcaacggtcggaccaaactcgtaagcagactgtctccatctgtcaacacaaacggaccgtacagtctcgtgatggaagccaagaagctagtcttgtactacacgacaaacaaaactccgaaaccaatcgcttattttgaatacgaattcttcaccaagataacacaattccagtcaatgacgttccaagctgtggaagattccgacacaacgtggggtctagtcatggaaggtgtcgattctggttctaaattcaacgtttcaacgttcctctcacggccgaaacacaacgcgacgttgagttttattcggttagaatcagacggaaacatcagagtttggagttacagtacgttggcgacttccacggcttgggacgtgacatacacggcgtttaccaacgccgacactgacggtaacgacgagtgtaggatccctgagcattgtttggggtttggtttgtgtaagaaaggccagtgtaacgcttgtcctagcgacaaagggcttcttggttgggacgagacatgtaaatctccaagtctcgcaagttgcgatcccaagacatttcactacttcaagatcgaaggagctgatagtttcatgacaaaatataacggtggatcatcgacgacggagagtgcgtgtggggacaagtgtacgagagattgcaaatgtttagggtttttctacaatagaaagagttcgaggtgttggttgggctacgagctcaagacattgactagaaccggagattcttccctggttgcttatgtcaaagctcctaatgcaaacaaaaagtcaactctttgaggtctgaaagtcatatatatatatgaaattattgtgttgtgtgtttaataaggttcgtttgtgtacctttttaaaaataaatggtgtactgattctcaagataaatcctaatacaaagtgaagtgaaaggaatcaatttctgatatatcttaccatccccaatggttaagaagtaattggttcttaaccaaacatcttaacaattatttatactaaaattttaaaacatgacatgtaactgtttttttcactcatgaaaacttcttagctaagaagcaaatcttagtttttaaatttattttgatttaatttttatagtttaattttaagatattattctaagatacacctaagatacaccattggaggtgctattactcccacaatttctttatataagattttttgactaaaaacagattaataaactattattttgtgcatcatgaaaactagttcaaccaatgaaaataaatactgcataattcttgttctaatgacagattttaaacatttctgtattcccaataaatacagatttaatttagaaacttgaaacaaacaaaattgtttaaacatcttacaaataaaaaaaaagggagtgagtaattcataaaatactatgctttgtcagtaacgcagaagacccaagtgcacgtaatacatcagaggaattaattattgattgtaaagattattgtattgaatagttttgttacgtagctaaatatttcaaaattaaagatgggatcgcgaatttgcaattgcatcatggtcgatagaataagatgcgtgatacgatgcttcagcgccgcgtcaccttttcggctagttttttttttttttttttcatttacaaagtcggcttgcaagctgccgtataacagaagtacatgttaggattttcatacatgtattaataaatcatattttcagttaattgggcctgtaggacacgttttagcccattaatatattcctcttacgtttcaaccgctttcccaaaaccaaaaaaaacttgaaagcgtcgccaccgtcgtcaattatccgacgatctctcatcgcttcgcttttacatcgtcattatctgtgatcggatcgcgccgctgcaggtcagttctctcgttgttcttcttagtctctctactatgaatttacttaacttgatctgtgcttttctgcttaatttttcagcattacatcattgctgaggtctctaaacaaaagcgtcacgattacaaaagacgaaatcac

SEQ ID NO: 7578 - DNA, 3000 bp, Unknown
  misc_feature (1)..( 3000): cDNA_ID_1807363_gDNA_ID_1621153_Annot_ID_56928 3000 nt of promoter + ATG
tgcacaaagaaaacgctcttatacgtaaatatattggtatttctactagatcatactttatactttatgtgttatttctccattccagtattattgtttttcttttgttacgcatcataatagggcggcaatattcgttgacaatgattgctaagctgaatggaaacataattacaattttaatagcaacaaatatatttaaataaagtaaatagtaaacaatacttaaatgctaatcgtacaaattaaaggaagggaaaataatttgataggtctactgattgaaaaagaaagaactaaagcactcttgctggccccatcccctgtctccctcatctatcacttaacttgataatccaaaaaatatcatatacttaatttgcatttacttaattagtttaattttatatacatctacgttttaagtttgtttggttcgaaataattctgaacagcaatcactttactttcaactaaaaacgaacttggttttaaaaaatgatttatatattcgaggttgattaattatagaacactagattttgctgaaaatgaaaataaagtaatagaacactagctttcagtttttttgtagcccttatagatttgatgctacgtgtgtgtatatatattattcccatcaaataatttacgcgagaatataataagatttaattttctaattagtgtataaaattttctaaagttttcccccaccatcattgacatagtttctctatattcccctcttcttctcctttcaagaccaaaagaaaaaaaaaaactttttcttttctgatgaatcgtatctattagctatgagcctgaggtgatgatcatgtcaacataaccatcaacgttctaccatggctagtcatagcaacaaaggcaaaggcatagcagaaggatcgtctcaaccgcaatcgcaaccgcaaccacaaccacaccaaccgcaatcacctcctaacccgccagcgttaagccggtacgagtcacagaaacgacgagactggaacacgttttgtcaatacctgcgtaaccaacagccaccggttcacatctcgcagtgtggatcaaaccacatcctcgatttcctccaatatctcgaccagtttgggaagacaaaggttcatatccatggatgcgttttcttcggacaggttgagccagcgggacagtgtaactgtcctttaaaacaagcgtgggggagtttagatgctttgatcggacggctaagagcggctttcgaggagaacggaggattgccggagagaaacccttttgccggcggcggaattagggtttttctgagggaagtgagagattcacaggcgaaggcaagaggagttccgtacaagaaaagaaaaaagaggaagaagaggaatcctatgaagagtcatgatggtgaagatggtactacgggaactagtagtagctccaacttggcttcttagcggaagcaaacaaaaaatctataataaaacaaagtggaattagttaatggtaagcatttaatactctccataatctctattaattttcagtactttaatcctattttgtgatctatttacaattttacatatagagtgaaaagaaacaattctacattcgtttcttgatagtcagctcttaatgcatagttgaattttatacgtatcatacccaaactataagattaatcttgatcttagatcatatacatatatcatcatggtgtgtaccctaagtttcataatcatttttcttaactatttatgtggatattattactgtactagataatattttatacagcttaaattaatatgttcattaattttacctcgctgtaaaccctagctagagagtatacaatatacatatacacacaaatggtataaaaccctagttttggctcagatgtaagtgtgtgtatacaatcatgcatcgtgatatatgcatctatacatgaatgcataggcgtatacatttaattcattaatgtgaatatgaagggaattacatcgatcagatgttttaggggtttagtttctgcggtggggcttcctgtttaattaagctccggggatattgtgctccttaattaagtgtttacgaatgctacaattttttttgaaatggttataaatttttattaatctatacatgtataaatgtataaaaaagatcaatgctagctaaaaagtttcactgactaacttttgtttcatattttaactgcattattccaattattgtttgcataatagtctactagtttgcaaactaggcctattgcttaacacagcgttgtaagttgtaacgttataaatcgtgtaaaaaaaaaattgcatgtgcactagactatgatatatcacgatgcatgatttacgcttttgttccacaaatgttgattagtgcgactatattaatcttacacataagtgtcataagacacatacacagactatggacagaccaaactaagggtagaaattaaaaaagtttaactcgaaggagagacgacacatcgaagaagtgtggacgtattgccggagaagaggcaaacgattgaagaagtggggctaaagagtttagaaaatttgagaacatgtaatgtagtaaattttacaatattgtggcttacctcttataatgttttttttccccataaagtttcgattgatcttccatgtcaattcgtatctaaaatgttcttcagagaattagaggggggaggggggggggattatgcacagtaaaagttcagggatcagcttgttaaaaacagagattttggggtaaaagttttaaaacgttagaagttttgggtctaacttgtaagaaatcagaggattaggtgaaaaacataataaagtgaaagtttaggcgttaaaatgcagtaaatggtaaattgttaagagaaaagagatctaaaataatataaaaagtgaactctaatgacaaaaacggaaagcttgaagttcttcttcctcatcggaaaacaaacaaagaatg

SEQ ID NO: 7579 - DNA, 3000 bp, Unknown
  misc_feature (1)..( 3000): cDNA_ID_1818249_gDNA_ID_1621153_Annot_ID_56931 3000 nt of promoter + ATG
ctaggatgaacattttggtattgttccattagaagcaatggctgcatacaaacccgtgatagcctgcaacagtggtggccccgtggagacggtaaagaatggagtaacaggctatctttgtgaaccaactccagaagatttcagttcggcgatggctagattcatcgagaatcctgagttggcgaatagaatgggagctgaagccaggaaccatgtcgttgaatcattctctgtgaagacgtttggacagaagttgaatcagtatctcgttgatgtcgtatcaagtcctaaagaagattgagattcctctgtttagtaatcatagatcgttcgtgaaacagcatactttaggcttagttctgaaactacaggagctttattctcggatcactcatcttgaccgtgaagattggttaaatctaggtgaacagttttttgtttgaggataaatttgacgaaataaaatcgaatcagtggtcggatatgggccaagtcaatgaaatttcggtctataagatttgagctttgggcttgtacattgatacaattacatgagatggtgctatatgggccaggcctgattgttctaaaatataggttactatttactaaacggttacaatggcaaaaataagagtgtgtataaggtccggcccacttgtcgcgtgtattttaaatatgcaaataattgaagactacccccatgcgcatgaagagcgcgtttcatcaattcgggttggttatagaccacgaaaatcgcaggattttaaattatttgggaaaatgagctaactaaggcgcgtctgagagatcaaaccaaacaacatgacaattgaagactacccccacgcgcatgaacagcgcgtatagcgcgtttcatcaattcgggtaggttatagaccacgaaaatcgcaggattttaaatcatttgaggaaatgagctaaatgaagcgcgtctgagagatcaaaccaaacaacatgacaattgacaacgtggcattctatgggctgagtcttaatgggttgggcttattatttcaccaaattttacttttatacgttgtcgtttaattcttgtctctttttccttcttcaatcttcgtcttccaaattacacagttctcttccctccaatccttcatcggagctcgttgtcgccgcctcactgtatatcgttgccgtcgttgtatcaacatctcaaggtatatatagcttgtgatctttcaattgtagaatagtttttgtgattttgtatgtaatggctgtgattttccatgattctagttttcctttttcaaaatagtttctgagtttttagcggtctccgttttttttttttttcaccaggaagcttcgttagatgcggaaaacgtcatggacgcgaacaataccttcgattctgtaatctcttctcacgtcttccttttctacttcgccgttttatcgtctcaattccacgattctaacattcttcttaccttcgattttcatggaattaggatctgattcacgccatttttaagcacatttgggcccgaagatttcgcggtacacatccatgttttctcagagtaacttattcgctttatgttgatcttatctgcgagcttttttattcgattgcgatgcagaaagggagaggagcgatgccattgatgctacggaagctgaggtattctattgaaagtaaaaccgcaagaataaattggaattatcatttggtatcgtaactccttcactagatactggtgtatgactgtaacagctatgatcttctgatttcaaagattcaaaatgttcaaaaaagggaggaagattactatttctgatgctaaattatgcatttgcaatatgtgcaggttgctctgggaacaaccaagaagaacagacttgcttctggttcgtttatacactgttgcttagtttgtcatgttaattggtagatgagacatgaatatttatggtttattggttcttgtagcaaacgcaaatgctttaaaactcagctgtgaacttctcaagagttttgtctcaggtcaagttttgcattttagaaactacttagttttctctttaagtcatgttgtatctataagctatcttaaggattttatcggcattggcagaggctgtgcagcgcgctgctataatcgctgaagctgagggaatggaaaagattgaagctactcatttagagaggattcttccccagcttcttctggacttttaaggtatgattgaaaatagcacatgcttgtccctgcatctttctttttatccttatgaactaatgaaagtgaaatctcttttcttttgcttctctgtctaaaaatacataaacgcttagatcatggtatgtgttcttgtagtgatatgttatttgatcttttcttttgtagacatatgtgaagattataacagggattattccacacaagttattctgaagatcatactactggtttgtttattataggctaggctaatgtggtaatatatggttcatacttcatatagaacgaaatagatatatttgactttattctggatatatgctctgtgtgcttcagtaacacaccaaaatactctgaaatgtaagaataaatcttagccatcatcgatcttctgctcttagagattttcccttccttgatcgtagaacgttgacctaaagcagaaaagcgagatgtaggaatcttcttacggtatgaaacagcaatttctttagcctgaagatctgcagaaacagcaagcagaatataagagctagtctaaactgaggaaaagataatatttcctcagtttaaactagattctcccgccaggaaaaaacttcttcaaaccgtgagtgatgatgactcttcgaatgatgactcttctaatctttacgacaaaatcgtgacatctgtcttttgtaaaaaacgttacaatggtggttactatatatgtagtagaggttctgtcttcttatctttataatctctaggcaaactcacaaaa

SEQ ID NO: 7580 - DNA, 3000 bp, Unknown
  misc_feature (1)..( 3000): cDNA_ID_2995898_gDNA_ID_1621153_Annot_ID_173320 3000 nt of promoter + ATG
ctacctgattattagtttaagttgttccttgttactattggaagcctacagatgaatggctaaatgccgatgaagaagatatttaatagtatgcacaacatgcgcatgttatcactcacctccagagcagcttgatcctgaggcgtgccattgagagttgtttcaaactctttgagcctttgctgcaaaatgaaaaaaaatcgagatgtttactacgtatcttactttattcagattatcaaagttcatgaacgaaatcttcatgatcagcccctaatattacctgaagcgtggctttctcttcttctgaaatttgatttttaactactgttgtgttcttagttggactatcactgaaaagtggtaaaaacattgttagaactgacaccggctaaattacatgacaacatgacttggtatgacaaaaatgtgaaattacggaaaccaacccagctgatcctaagaacatatgatgtcatcagaatctttacacaaacaattacaaactggaataaaaagaaggaaaatgacaaacagtaacatggtgtaaatgacacagttatgacttggacttcacttaacgcaccttcccgtgggaagaaagtcaccaagagcaaaaaccaaaccaaatacaacaacagctatgccaactccaacctgtcatggcatgggcccaagttttgtcatgttatgtatgagtagcttataggcctcaagtggttttagaacaaaataaaaaataaacacttgcaagatgttatgtatgcgtaccttagtaccaagaccaattgttttctggtcagacttgactggtgcatcatagtcaattggaccaaattctttaactacttctgtctttttctgctcaagagctgacctgattcatcaaaagagcagaggtcacagaaataacattccgatcagtgggaggacaatgatcttgactatgtctagggggtgagggaagtggaaagcaagacaagtgatgaacaaatcaagaaaaaaaaagaatcaaactttcataggaagatcatgtcgttgtgggtataatgagaaagtcaagtgtgattgtcagaggaataatcctattgtaacctatatatctctaaagccaatcttcatgctagaatcataaaacataggtaccttctgatgttttccagccgttcatcgaagtctatatcaaaagatcgaccagattttccttcaaactgagtattcagaccaggtgcctctgcaaacaaatgcaggagtttcttgagcaaacctttcaattgaaaccaactttttgagataaactgaagaatgcaaaaatgaagttatgttcgagacaccatgaaggagagcagcaacatctgttacgtacaatatgctttaaaatcaaattatacttacttctgggtacagaaacagactgtttagaagatgatttcctgcagcaaagaagtccatatgaaaatataacaacagcaatttaaaattctaaatgctttaaacaaacacaaaaactatttatacctttgctgcaatgccgggtctttctcttcctgtgatgcgatttcacatttttgtctcagtactttgaatcaacaaaattaagttgaacaaagaagaatttggaatcaaaccttttttgagccgaagccacgcttagggttagaatccgagcaacgtattcgaaataggagaagcttcgagttaaatgaaacggaggtcgtcgccgctagtgtcatcaacatcctctgtttgtattgtcctaaccaaaacagagaattttctaagaaagtttcaaagaaataatgagaagtaacggctacgaagagaaattcgtccgccggagattgacgatgaaaggtgagctccgtgatcgggccggtaagataacgttagtggttcttcttcttcttcactttgcagattgtctattatatgggccgaatggcaaaacataattttgggctaggcccatataatattcaaatgttaatattccaaaattgatgggtatttttgataatttaactcgatctatataatttaacaaacgaggatgattttaagtttttaactttttaagtgagaatagtgattaagtgtcaacgactcattggataggatgtgtcataaaattagtattgaaccactgaggagtgaaaataaaattaaaggtagaaaaattaatttaggaaaaaaatattcggaaagttctgtgaaaagtcttcggatttagaacggagacagcgagaggatagagcgcttcttcggctacaacaagctttcgctaatggcggtttccttctgatcactctcaccggagccgtcatcttctctgttttaccgatttttagggtttgtttccggataaactcttcgtatgctttttttttttcgttggattcgtttctggaaacgtatccatttcctgtctagagatcatgtgaatttctcttagaacagaactcagatctaaattaaagtaacggtgcttgattcattaaactcggaatgcaaagtcccttgcgttttattcactgaaatcttagtcgattagatcttgaggtctgtttgttaatcgcacttttctggggaattgatcgtagaagcaattacgctcatgggaaatgatgaaagttatagctaaactttactgtagaaccttactctgattatatttcatttaaaaatgctatttggttggtaaagagaaacatcacaacttttcatacttttctatttttttcagaaattttgattgtggtggaaacttgttgtggcaactctactgagaaagtttgaagaagctggaatcaaagatatagctagagttaagagggttcatactaacttgtgctcgttttgtgatgtgctgttgttaacgtttggaggaaaaagttgtagtgtattaaaattcagcgtccgagttctggggcggagttgccccatagcattgactttacgcctctacacatagtccgaagggctaattcagctcaaaacatg

SEQ ID NO: 7581 - DNA, 3000 bp, Unknown
  misc_feature (1)..( 3000): cDNA_ID_1818245_gDNA_ID_1621153_Annot_ID_56932 3000 nt of promoter + ATG
ttgaaacccataaagctgtcgacaaaacgcaagaatgtgttgtggtcatacgagaatgtgttgcggacatggaaatcacaataactcaagttgaatccaggtacatacttccagagatttctccatctactagataacacgctactcttaactacatctttcgtgggaagatagaagagtacctgacatagcaatgtttctggcaagttgcttatccagtcaacttcacgcgagcctttggcacgaacacgtttctcaccggctccatccatgaactatcaaatggaaaagaaatccgtaaaagcttgtaatagaggaagtatcgatcgacagttcctatattttgtctaccagttccacattcttcggcggccgttcagacttcagagtttcactctgttccttatccggttcggatcaattcggtttactgatccgattagtctttggtatcatgattagttaatacgacagcatttgtaattttaacttgtaagtcaagtgattgggcttgtaataatgggctaatggggttagaccaaaccgtttggtcgtttttgtgccttgacaatcaaggtctcatataaaatcttcaaatttacaagttccttcccactttctttcagaacataacttataaataataaaatggacagaacatagtcattacaaccaacaaacacatgattgtcttccaagatacgaaacatgaaaatcatcacaaacgatgaagaaaacatatacttaacatcaaccaagtacccaacaactacgaggttcaaaaacaacaactttgcatgaggtagagagtcttggaattgtaaggagttctttgagaatgacagattctgatttctctctggaactattcaagcacagattcagtttcttgaggattggtgaattctccaaaatgtaactaactactttcattccccttgcctctcctgtgattggcctctctatcttaacatactcgagagttgtgaagaaacaccgaggtatggataaaactctatctccgtcctcttttgaggaatccttaaattcctgcaggtataaaccaaataggaaaaacacaagttaagcatatgatagttcaccattagcattatataaaagagattaaagtttcttgtttaattaaagtaaaataatcctaaccacgacaagagatttaacatttgggcagctctggagaaaggtggacaacattttcaaggtgtggtcttcgaagtctatgtgcaaggaggataggttacgaaataagggtagttcacaccccaaatcatgtataacctgcaaagaaaagttgggtgattatgtttcttaagcaccaaaacaacgaattcagcaaaccaaaaaaacttaagcgcaaatacaaaggttacctcaagagtatgcgaagagatgaacaattttttgacactagagatctcggcgagaaaatcttgaatcatttttctctttggccgatcatttggatgcggtagctcttccatattaaatataatattgatcttcgcctccacaagagaacccgaattcttcattttgaattttgcagttgaatgatcactgatgttcagatactcaagcttaggagcatcaattgcaacttctaattcatcccaaccgtcagaacagttgccaatatgtttgaagctcagtagagaccgagaactaacacgtaaaacatttatatcatcaacggaactcctgcttataatcaagctttcaagagctgaacagcttgagatgatcttttccaaaaccaaagcattggaaaacttaactatatcaagctcaataactttgaccaaaggcaaagatataaccttaggattaggcaagatcacattacagagctttaaagacaccaagctctcgcatgtgtaaacggatggaggtatctggacttcctcattcccccaagtgtagtccaaaacgtcgagaactttaagtttttggtcgacgacaatgttgatccaccgcttgacattagaaatagtgcgctcttcttcatcacaatcgtaccttaacctaaaactttggaagcaagactctctgtctaaagccagaaacctatcaacaaaactcacgaaagcattatagtctagaaattgattgtactccacgttcaaaccaggtacatatctccagagatttctccatcttttggataagacactactcttaaccacatccttcgtggggatattcaacattatctgacatattaaggattctggtaagttgctcagcctatcctcttcgcttcttcttgcacgtttctcatctcctcctgtatccatgttaatctgcatcacagatgtcaaatcagatagaaatactcaacatttgatagaaaaatttcgctagaatcatacaaaatatctattgaattacacaaggaacctaaggaaataaatctgtacctgcgatgtcgcgaagcagcatgaagaaatcaaatatgaaggctcctgaagaagtatgatatatagagagacgaatcctcgtggaattcaccggcccaagggttttcgtaacgcttgttttttctaactgttccactccactagtggctaataaccagagtggcgcacaatagaataaccgacttgtgtcattagtcaaagaagcgcataatagaacaattaactcgtgcctctgtgggtcccatattttaattataggcgcgtcccttaacttttttgtactatgtcaatgggctgaaagcccacaacttaatttaggctgcggcaattgttactgcgtaaaaggctatacataatgggcctaagcccatatgtatagaaggtgggataaaataattacactcccgccgaggctcttcccttgtcccgcctctctcgctcaaacacttttgactagagaaatcggaagaacaaaaatttcccgataatcttccccaactttttttgttacgatctttgcttagatttcgtctggaataattcgataggcgaggaaattatg

SEQ ID NO: 7582 - DNA, 3000 bp, Unknown
  misc_feature (1)..( 3000): cDNA_ID_1818242_gDNA_ID_1621153_Annot_ID_56933 3000 nt of promoter + ATG
aacgccctacaagaccatgtatgagtatttataccacagagcatcaagtaatcatgaaatttgtctcaaacacaaaactttgaaacattttcacatgatcaacgagatcaagtacaaaaaacatattcagccaaagaaacaagctctcaacgttgattcatggtcttgaaaagctgaaccataaaacaggttaactatcctagctaggattgggataaaacataagaattatatcccaattgacatgctcacccacatgccatatagcttgagaaaataaatttaatactcacttcgaagggtagtctttaaccaaattgcacgccattagatagagctcatttgaattaccaagttccatggcagcggccaaatgtaccagcgtacacttcagatgaaaaggatctttctcaaggagtctgtcaaataagaccaaaagagaccacactgctagaatcattcaagtttcatattgctcagaatttagaatcagcagtaatatacacagcattctcaagtttcttacgccgcggttagttcaaaacacttctgatattcacagcattgatggtagtactcagctttacaggccaacagatcagtgttattagccaatgtgatcatagatgagccagagacactaccactagtctcattctcaagcttcttaaacttgagttctactgtgctctctttgtcatactggacacgaagaactagtaagtaccaagaagaaaagaaaagatgcttacaaaaggaaatcgacagaacagagaatcagcaagcaaattcgaaatataagtgccacataactattgacacattggatcagacactttactcaatagataatgtttaccttcttaatcaagcatgaatagaaagaagagagccatccgtcttctggactaaattgtagtgaagaaagcagactcgattctgaattttatataattgaagtctcagtaaccttctagtcatgtaaacgactggaccatgaaacaaataagacgaaaaataaaaagcaacaagaatgcataaactataactcaccttcttcagatgtaagcatatggctctcaataaggcattccaaagcctgaaaggatagattatagaaatcacgtccatgtcagttttctgatatctacagaggtacatcaggttttcactactatacaataaattaaaagaattttatcttcccacattagctctgcaacttcccatagtaagtaaaaaataacatgcacaaattgactagggcgctagaagtacctcatagcacagaggatcagccttgatagcagctttgtacctgcaaacaaaccgaaatgatgagttaaatagctatgaagttcaagattcccacacaacactcaatcctaatagatggatcagccaacatacacacaagttcacaatatttcctactagcacttgagtaaatcttatacacatgctaagttcatgtaacaccactaaatcaataagatcactctctcacaatcatcaaaatgcagatgaacaaatgatccctgaacaagaaagataggtgaaagaaggctcactaaccattgtcgagcctgagaccggttttgtaaggctccgtatgcttttcctcttagaaagcatatcgccgatgatatctgcaaaagtaaatcaccatatatcagttcagctactatcctaaccaagtagtagtcaaccagttaatgtaattccaacagtttcgctaacaaaccttccagaatcgagaagataatactacctagatctctattatacatttaaaagtcgtgaaaaaacttacattaatctctcggtcctctccatctttatcaaaatctatcacgttcccgtctttagcatcatacacaattccatcatcatcaaccttcgcatcaccaagcatcaatagacactgatcccattccttcaattcctcctgagaacacatagaaattaattaccgataaaccctaaaaccctcaaatcaagagaaacaatctgagattcctaaaccagtcccaatcaaaacaagtgaaatagatagtggaattcggaattacgaggcactttgcggcgaggtaacggaatcgaagatctcggaggacaatcttagaagcgttaagaaggtgaaaagcgcgacggtaatggcggccgaggaaaagagcttgagcttgcatatatatgtcagatgggtcattggtaagagctgctactttgtcggcgaagaagatggccgacgagtacaaatgcttactgacgcagtctcgaaccacgcctcggatcttctcaatttcttcttccctcataatttcctcgcctatcgaattattccagacgaaatctaagcaaagatcgtaacaaaaaaagttggggaagattatcgggaaatttttgttcttccgatttctctagtcaaaagtgtttgagcgagagaggcgggacaagggaagagcctcggcgggagtgtaattattttatcccaccttctatacatatgggcttaggcccattatgtatagccttttacgcagtaacaattgccgcagcctaaattaagttgtgggctttcagcccattgacatagtacaaaaaagttaagggacgcgcctataattaaaatatgggacccacagaggcacgagttaattgttctattatgcgcttctttgactaatgacacaagtcggttattctattgtgcgccactctggttattagccactagtggagtggaacagttagaaaaaacaagcgttacgaaaacccttgggccggtgaattccacgaggattcgtctctctatatatcatacttcttcaggagccttcatatttgatttcttcatgctgcttcgcgacatcgcaggtacagatttatttccttaggttccttgtgtaattcaatagatattttgtatgattctagcgaaatttttctatcaaatgttgagtatttctatctgatttgacatctgtgatgcagattaac

SEQ ID NO: 7583 - DNA, 3000 bp, Unknown
  misc_feature (1)..( 3000): cDNA_ID_2146892_gDNA_ID_1621153_Annot_ID_56934 3000 nt of promoter + ATG
gtgaaatagatagtggaattcggaattacgaggcactttgcggcgaggtaacggaatcgaagatctcggaggacaatcttagaagcgttaagaaggtgaaaagcgcgacggtaatggcggccgaggaaaagagcttgagcttgcatatatatgtcagatgggtcattggtaagagctgctactttgtcggcgaagaagatggccgacgagtacaaatgcttactgacgcagtctcgaaccacgcctcggatcttctcaatttcttcttccctcataatttcctcgcctatcgaattattccagacgaaatctaagcaaagatcgtaacaaaaaaagttggggaagattatcgggaaatttttgttcttccgatttctctagtcaaaagtgtttgagcgagagaggcgggacaagggaagagcctcggcgggagtgtaattattttatcccaccttctatacatatgggcttaggcccattatgtatagccttttacgcagtaacaattgccgcagcctaaattaagttgtgggctttcagcccattgacatagtacaaaaaagttaagggacgcgcctataattaaaatatgggacccacagaggcacgagttaattgttctattatgcgcttctttgactaatgacacaagtcggttattctattgtgcgccactctggttattagccactagtggagtggaacagttagaaaaaacaagcgttacgaaaacccttgggccggtgaattccacgaggattcgtctctctatatatcatacttcttcaggagccttcatatttgatttcttcatgctgcttcgcgacatcgcaggtacagatttatttccttaggttccttgtgtaattcaatagatattttgtatgattctagcgaaatttttctatcaaatgttgagtatttctatctgatttgacatctgtgatgcagattaacatggatacaggaggagatgagaaacgtgcaagaagaagcgaagaggataggctgagcaacttaccagaatccttaatatgtcagataatgttgaatatccccacgaaggatgtggttaagagtagtgtcttatccaaaagatggagaaatctctggagatatgtacctggtttgaacgtggagtacaatcaatttctagactataatgctttcgtgagttttgttgataggtttctggctttagacagagagtcttgcttccaaagttttaggttaaggtacgattgtgatgaagaagagcgcactatttctaatgtcaagcggtggatcaacattgtcgtcgaccaaaaacttaaagttctcgacgttttggactacacttgggggaatgaggaagtccagatacctccatccgtttacacatgcgagagcttggtgtctttaaagctctgtaatgtgatcttgcctaatcctaaggttatatctttgcctttggtcaaagttattgagcttgatatagttaagttttccaatgctttggttttggaaaagatcatctcaagctgttcagctcttgaaagcttgattataagcaggagttccgttgatgatataaatgttttacgtgttagttctcggtctctactgagcttcaaacatattggcaactgttctgacggttgggatgaattagaagttgcaattgatgctcctaagcttgagtatctgaacatcagtgatcattcaactgcaaaattcaaaatgaagaattcgggttctcttgtggaggcgaagatcaatattatatttaatatggaagagctaccgcatccaaatgatcggccaaagagaaaaatgattcaagattttctcgccgagatctctagtgtcaaaaaattgttcatctcttcgcatactcttgaggtaacctttgtatttgcgcttaagtttttttggtttgctgaattcgttgttttggtgcttaagaaacataatcacccaacttttctttgcaggttatacatgatttggggtgtgaactacccttatttcgtaacctatcctccttgcacatagacttcgaagaccacaccttgaaaatgttgtccacctttctccagagctgcccaaatgttaaatctcttgtcgtggttaggattattttactttaattaaacaagaaactttaatctcttttatataatgctaatggtgaactatcatatgcttaacttgtgtttttcctatttggtttatacctgcaggaatttaaggattcctcaaaagaggacggagatagagttttatccatacctcggtgtttcttcacaactctcgagtatgttaagatagagaggccaatcacaggagaggcaaggggaatgaaagtagttagttacattttggagaattcaccaatcctcaagaaactgaatctgtgcttgaatagttccagagagaaatcagaatctgtcattctcaaagaactccttacaattccaagactctctacctcatgcaaagttgttgtttttgaacctcgtagttgttgggtacttggttgatgttaagtatatgttttcttcatcgtttgtgatgattttcatgtttcgtatcttggaagacaatcatgtgtttgttggttgtaatgactatgttctgtccattttattatttataagttatgttctgaaagaaagtgggaaggaacttgtaaatttgaagattttatatgagaccttgattgtcaaggcacaaaaacgaccaaacggtttggtctaaccccattagcccattattacaagcccaatcacttgacttacaagttaaaattacaaatgctgtcgtattaactaatcatgataccaaagactaatcggatcagtaaaccgaattgatccgaaccggataaggaacagagtgaaactctgaagtctgaacggccgccgaagaatgtggaactggtagacaaaatataggaactgtcgatcgatacttcctctattacaagcttttacggatttcttttccatttgatagttc

SEQ ID NO: 7584 - DNA, 3000 bp, Unknown
  misc_feature (1)..( 3000): cDNA_ID_1818231_gDNA_ID_1621153_Annot_ID_56936 3000 nt of promoter + ATG
attggataagcgatttgccagaagcattgctatgtatagagctgtcaaatggtccgtccaaagaccattgggcgtgtacgtacggacagttttttttatgggccaagttggacggtccataatggacaatggtccgaaaatgtccatgcccaataaagaccatgtccatatgggcaagtccatggtcagcccattttattattgttattattgataaatcaaaaatcatgattttaaagaaaaatttaaaaattttatttttccaaaaaaattgtaaaaatcggagacttgcatttttccgacaaaacagtaaaattgtgtttttcttaccaatacaataaaatcacgattttggcggaaaaattatggaattgcgttttcccgccaaaaccgtaaaattagagaattgcgtttttccgtgaaaaccgtaaaattagagaattgcgtttttccgtcaaaattataaaatcggagaattgtatttttcccgtcaaaaccgtaaaatcgaaaatttgcgtattccaaaaaattgtggaatactattttctttcaaaaccgtaaataatttaataagaaataatttattaaaatttaaaattttcataaaaatagaaacttataatgtaaaatatataatttgaaaattatttagttgtaattgtaattaaaattataaaaatatgattaaaatgaagacatatctattgactcaattcatgtccatgagcaacccattgtccatacggtcaagcccatattgtctatggacaaaactgataatatgcccaattagaccatttttttttgtctggaatatagttcgcccatatgcatttggactgggcaagcccatgggcgtcctgcccaattgacagctctagctatgtaaggtacttctgaatcttcccactaaggatgtggttaggactagtgttttttctaagagatggaaaaatctctggaaacggtacctggattagacttaagtggcgaggatatcgaaatgtactaccaatacgtgagatttgtggatagatttctgagatttaataggaactatcagatagaatattttaagttaagctaccctggtgatgggagttctgagcgtgaagttgatctgctcaagcggtggatcgatactgtcattcagctgaaggttaaagatttagatttttttgactattcatgggaatgggggtttgataactttcagctaccttcaaccatttacatttgtgagagcttggtatccttaaagctatctactgttaccctgcctagtgtcaagtctgtttctttaccttttctcagagttctcaagctaggtgcagttaagttcgccgaccatttggatttagaaacactcatctcaggctgcactgctctcgaaaccttagctataagattctttgatcgcgtccaagttttacaagtgtcttctcagtctctactgagcttcactcatgttgcgcccaagcttgtctttactcatgctgtgcgaaagcctttggctgaaaaagatctatcaattgtaattgatgctcccaggcttgagtatctgaaactcagtgatcatcagacttcaagtttcataataaaaaatcctggttcccttgttgcggtggatattgatattaacttgtcttccggcttcgattcgaggaatatgattcgtgattttcttgttgggatctctagcgtcaaaaatatgaccatctcttccattattcttaaggtaacctatgttgaattggatatttgaatgcttaactttatcttataagttttttcctcatatttctttttattcttgcagatcatctatgattacttaagatgtgaaccactacctccccattccgtaatctatatttcttgcatgttgagttctacgactacaggtttaaaatgttgccaacctttcttgagatctgcccaaatctaaaatcgcttatattggtaaggatttttcattgacccttgttataatgcaaatcgtgaaaatatcataaacgcaacttgttttggttcacttgattgtacttgcagaaatctactgaagaactggggatcaaagaaagtagtatgttttccggacctcaagatttcttaccatctctcgagtatgttgagatgaaaatgccattgaagaaagggttgctgctggagatcaggatgctagtgggttactttcttgagaaagcaacaatccttaagaaactaaccctatgcttggatgattacagaaagagaaaagaatctctcattcccagaatccttgccattccaagaatttctacctcttgcgaagttgtggttctctgatccttgtagtcgttgatgccgccgattaactaacacaaaagtttgatttttttgataactttatttatttgaactctgtttctttcttctttcattatcgttttcatgattatcgtagcttaattctttttagagaagtttatcaatgtaaacacgcgattctcttaggtggtactttgccaaatatatatgttattgctttcctcctcatttgtcgtgttgctttatttttataaatattgtacagtacagaggcttggaaaaataatagcaggttcagaggctaaagaaattgtaaatttggggatcataatgaaaaaatattatagttgacgaaacttgcacgaccaaaacccaacaggcccattgtgagcccaattatgtgaggcctataaaatattacatctataaggacgcctgctaatcaaccactacagtgacactgtcacggccacggccagacgagtagagactagagagacaattagacgaagcagatactttggccggaaaattagacggcgatttttctcacactgttctcattcttcaggtactcgctctctctttctttctatctatttgattcatcgttccaagttgattcttcatccgaaaatagttttacaggaatttttttccgatttgatgtttgtttactaggtagagtag

SEQ ID NO: 7585 - DNA, 3000 bp, Unknown
  misc_feature (1)..( 3000): cDNA_ID_1818223_gDNA_ID_1621153_Annot_ID_56938 3000 nt of promoter + ATG
cgaagattcaggaactctttcttaggttgaattagcttgagtttagcttcgaattttatctttgatctagctaaagaaacagagagttttcagaggaagaagaaacagagagttttcagaggaagaagaaacagagagtagtgatgacatcagggacgagaatgccgacatggagggaaagagagaacaacaagagaagagaaagacgacggagagcaatcgcagctaagatcttcaccggattaagaatgtacggtaattacgagcttccgaagcattgcgacaacaacgaagtgcttaaagcactctgtaacgaagctggttggatcgtcgaacctgatggaactacttaccgcaaggtttgtctctcgaatccggatcttagttttgttctctacgcttcaagtacatgaaagttttgaattttggatacaaaatcattcagtttttgttaaattactgattgcatctaacatgcgccggagccgatcggtcgcgtgaatgctaacgtgttcctgatatacctctccgcgtaggttagctagccttagcttagaggagcgttagtcaaatgttagattctttatgtgtgactttttattatgcgtttctctaaaaaaagattctttctctctctgtttcatggtgtgtgtgtgtgactaattcacttgttgtccaggtcgagtctattctcagatgatactcaccacaaaaaaagaaagtagcatagatctcaataaaaactgataaaaataatgtcctcttgcacagaattcaaagtgtacgttttgatctgtagattttttgggaaagcaagttggcacttttgcttttatgtctcaagtctttttactcaaacttcgagaatcgagtccaatgatagataatctgtcggttcaagaatccttgacctgatcactgtctctttcacttgttttcacaatgatagaatcaaaactagttctacttgtaacttccttgtcattattaacagagtaatttcttggtaattcatgtaattagaaggattacgtcacattgatcatgtttgtttgatatgttttcagggatgtagtagacctgtagagcgtatggagataggtggtggttcagcaaccgctagtccttgctcttcctatcagccaagtccctgtgcttcttataatcctagtccaggctcctccaacttcatgagtcctgcttcatcctcatttgctaatcttacctctggtgatggccaatctctcatcccatggctaaaacacctctcaacaacatcatcctcatcagcttcttcatcatcaagactccctaattacctctatatccctggaggctccataagcgctcctgtaactcctcctttaagctctccaacagctcgtaccccgagaatgaacactgattggcagcaactcaacaactccttctttgtctcctcaacaccgccaagtcccacgcgtcagatcatccctgactctgaatggttctcagggattcaactagcacaaagtgttccagcttcaccaacgtttagcctcgtctcacaaaacccatttggattcaaagaagaagcagcctctgctgctggaggcggaggagggtcaaggatgtggacaccaggtcaaagcggaacctgctcccctgctattcctcctggtgctgaccagacagcagatgttccaatgtctgaagccgtggctcctccagagtttgcttttgggagtaatacaaacgggctagtgaaagcatgggaaggagagaggatacacgaggagagtggttcagatgatcttgaactcactcttggaaactcaagcaccaggtaattccaaagccacatgtacattttcaaacccggttgaaccaaaaccgttcttgatatgttgctccaaattttatttaaattgttctcttcccatgtaatgctcaaagttaaaacacagcttataatattcgtttatctgtccccgaccgtaatcttttcttcctaatattgtacccttagcttgtgattgaattctatcactgcctatgtttcactgtctcgtttcgtaaccttcccggtttaacagctaacgtaaaaccccggtttgagtggttataattagacggtttatgttaacacttatagtcaacgaaggaaattatgttattgttttatagcattatcatggttattagtcaacaaaaaacgcttcaacacgacgaaataaggaaggtttttgcagtgacagaggagtctctgtttataacggctagagattccatattctgacatgggctcgattttgttcgtctttggtccttacgactttttttttgtaattcacaaaggaaggtggatgacgaaagtgtatccatattcgctataatcatcacatggaagacaacacaaagcttaggtcgtggtcaatgcacgtacgtataactgagagatggtcacatgctatccattagcattctgccacgtgtaatttataaataaattattgagtttatccctaccagtttattgatcaccagtaaaaaaaaacttttattcagtaaaccatttccatttgagaacaaaattcaaaatgtaaacattcagtaaaactgttcacaaaaaaaaaaaaaaaaaaaacattcagtaaaaatattttaattcagtaaatattatgttgtcatattgttacgcaagaggtcaccaccaattggaagactctgaatcgagtgaaattaaacgtaagaatgtatatatcctgcgtctaaattaataagttttacgaaaagagaaagaaatttttttctagtccaattaaccaaaagagaaagagatctttttcttgactattgactattctcaacaaaaggtctttattaatttcccaaattatagatatttagcaatttacgtaaattttacactcatgcgaatacgtgtattaattctataaatgcaaaacttagtccttaatatatatcacattacatcgtctcttctaattacaaaaaatg

SEQ ID NO: 7586 - DNA, 3000 bp, Unknown
  misc_feature (1)..( 3000): cDNA_ID_1818219_gDNA_ID_1621153_Annot_ID_56939 3000 nt of promoter + ATG
aggaaacgaagtctagctatgaaaccgttgcatcgaattttgtcatagatatgataatttccggttcgcacatcagaaccggccctgtatgcaagtagcttgaggttctgttataatttgttgaagggagagaactttgaagctaatggggaagataatggaatgggcagcaagatctgatcatttgggaggaattccaaggaatactgtgataatggctgttagtgcatttgcaaaagcagtagcaaatctttgcaataaaagctcagttcacaatgcagatactcttatgaatcttgtccagtcaagaccacctggtgttcctctcatcactgttagtaatcacatgtcgacgttagttaatattaaaaccttaatagtatgatcctttcttcatgtcatctctttccactcatttgtgtttttgatgttgatttatcttctttgttgtgtaatcagtttggatgatccagtaatgtggggggcatttaagggtctcctttccttagatccagaattggctcggtgggttcttgctgcagaggatatatgtttcaggaaccctatattctcctacattttccgcactggtatgtcactttttttctttgttgcttcttctcttgggaaagactgtaatcagtgatttgttcttgttttgtatggatttggacttgtatcacaactttttttagtagatttggtggattgccttcttaacaaaataggattttctcatgatgcatgttagtgatttcttttgagcaggaaaatgtatacctataactagaggtggtggaatctaccaagaaaacatgaatgaagctctccagcgattaaaagatggatcttgggtatgttatcttgcacctttaaactaattgtacttagatcttttcagacctctgacctttggatttaaccatgactagtagctgcataccttcccagagggaaaggtgtttcaagatgatgttcctataagacgacttaaatggggaactgcaagcctcatcgcccgttccccagttaccccaatcgttttgccaataattcaccgtggttttgaggaggtaactcgtccagttcccttctaagtctgcttaactcaataatcgtttaaacttcgatagctaaatgtctgcgggaaagagaaaaagccatgaattatgtatccattttccaaacttcgaatttctgcttgatagtattattatgtcttcattcgaaggtcacttacccacattgttgtaacggcttagatgatgccggagaactacaataatggacgaagaccactggtaccgttgccgaacaaacaccttaaagttgtggttggtgaaccaattgagtttgatgttccaatgatggttgagactgctgtcttggactcccgccatgtaacccctcctcttcaagaagtgaaatggcctgtcctcacttctgctggccaagtgctagacgaaactgctcagagacacctctacatagctctgtccgagaagattcaatcctccttggaaacattgagactcttagccaagcggttgtgacttccgccgggaaacttcatatcaaaatccggttcacaacttttaaagttccggtttagattcgccatggtaatcaaatattatctttattcaatttcctgaagctgagaaaaaattatataactatgaaaatttaataactcgcattttaaattattttatcgactaggatatatagcaacccgcaataatgtatgttgttgaaatgttatatcttatcaatatcttatgattatagcaagatttcagtgaaaaaccttaacaaaaaaaagatttcagtgaaaacttttttttttttttcagtgaaaacttaaaaagcgacaataatcgaatataagcatcaacaaaatataatacaagaccgttatttgtgtgatgtctgtaacgctgatgatctggccagttctgtctttctgctgatgatgttggacagaaacagcattaaacgaccagtttgaacagagagagaaggttctttctgataagagagacaacgtgggtggcaaacagacgcggcggccacgtgagcctattgagccaccggtgcggcgagtggtgcttacgcgaatgcaaaaaaatcagttaatgggccctacagggtcacgccggggacgcactatcacgtgaaaaggaaacttcccaaggtcagccaaaacggtttcgtggcattttggtaaatcagatcacgttttaggggtaaacgctagctcttgcacgtggtaatggtgctcgatgtatggcaaattggtaaattatggctgaatcgcggggtaatggtgtatgctcccacgtgctaggtccggaggacatgcgtgacctcatgtagtggcaatttcgtaaatatagggtcaaatctcgggtataaaggtagtttcaataatttgttttattttggcttctttcactatgaaagtaataactcctcttctctggcacgagagagttcatgattagcttaagctccttcatcttcttctccaattcccgggttttttcttcttcctccgataaccggaaaattcacctctatcgaatttcccaagcatcttgatccaccaagttcatcttaaaatttcttctctttttctcaattgaagaaggtgaagcagccaacaagttactgcaactgtttccacgatttttgcttttttcaagattctcgccgtcgggagttttctcggtgagatcatttcgctccgacggaaaattcaagttgcatatctgatcggagattgaaaagtgttggttcacgcagtatcgattcgtttgtttttgatgccagatctgatatattacttcaccgaagattcaggaactctttcttaggttgaattagcttgagtttagcttcgaattttatctttgatctagctaaagaaacagagagttttcagaggaagaagaaacagagagttttcagaggaagaagaaacagagagtagtgatg

SEQ ID NO: 7587 - DNA, 3000 bp, Unknown
  misc_feature (1)..( 3000): cDNA_ID_1818215_gDNA_ID_1621153_Annot_ID_56940 3000 nt of promoter + ATG
gcgacgattctcctccctagtcaaaccggatttgatatttctcggagtccggtatgctctgctccggatccgaacctaaattacagaccggttattggtattctgagccatcctggcgacggtgcgtcaggtcgtttgagcaatgctacagacgcgtcctccattgcggcttcgtatgtgaaattagctgagtctggtggagcacgtgtgatcccactcatctttaacgagcctgaagaaattctctttcaggttactctcattttgctcagccgattctgtaatctgttctagcttaagaatttgattgcttccaaaattgatttacatttggaactgcagaagctagaattggtcaacggtgtgatactaactggtggttgggctaaagaaggattgtattttgaaatcgtcaagaaaatcttcaatgtaagctcaactttttttcctggttgatttatataattcctatacaatgcttttttttgttgatatctctatgatatcctctcagaaagttttggaaagaaatgatgctggagagcattttcctatatacgctatttgcctcggatttgagctcttgacaatgatcataagccaggtgaccctttcttcttgcttatcatatgtgtttgctaagctgtaaagttaagccataccagatgttgtgtagtttaacaccatttgaaaatttctaatatgtggccttgtaaacagaacagagacatttttgaaaaaatggatgcaagaaattctgcatcaagtcttcagttcgttgaaaatgttaatatccaaggaaccatattccaaaggtaatccagcttttcatgaggatgtgtatatacagataccaaaaatattagtcaaatatttcatatgtaatttgtaatgtctcatagtgcagatttcctccagagctgttgaaaaaactcggtacagattgtctggttatgcagaatcatcgggttagtagtattagtaaccagtactttgtctttacagttaatactatggaatatagttttcaccatttttgttgctaaacatacttatacattcaattcaatactcatagttttgttgacctctgcagttaagcaacttttcttgccacttctttgatttcttgttcttgaatggttattatcatcggttctctctgctttctgatatgaattgtccttatttccagtttggtatctcaccacaaagctttgaaggaaatattgctctgtctaatttctttaaaattgtcacaacatgcgttgatgacaacggcaaggtatttttatgtccccaagaatacctaaaaagattcaatagcctgtgaccttatagaccaaatctattaaaacatatatccaggtttatgtttcaacagttcaatcaacaaaatatccagtgaccggcttccagtggcatcctgaggtatatatacagtcacaagttaactttacgtctctcatttagtctttcacgcctaggcattgtcattgtggtccactgcggtatcctatcatctattaaagaaaatctctgtactatactctgcagaaaaatgcattcgagtggggatcatctaaaattccacactctgaggacgcgatccaggtgactcagcacgccgcaaatcatctagtcaggttagttctctatccatttttttgaaataattgataagagagtgcaccaactctgattgctacattagaatcagtataactgagagttggttagatcatgaagtactcatggatcgtgtttgaatgtgatgcagtgaagctaggaagtcactgaacagaccagagtctaagaaagtgctgagcaatctcatttacaactataagcctacttactgtggatacgcagggtaaagccactctgacaatctttacataattctctcttcttcgtcttcttcttttttcttctaagttttaacgattcttaggatcgaataaaatggtggattttgcaggattggttacgacgaggtttacatcttcacacaacaacgatcccttctctaataactataacctctcctgtgtatcctctcgtgtgtatagtgaaatatgtaccttcgactctgttattatctgtgaacttgttgtaactttgaacgtcagcctatggcttgtgtttgacattaaactagataatgtacgcttttctatctttagtctaattcataaaacaaaacaaaaagcttatatatgtttactcactattaataagataatgaatctatgttttgttacataaaactttgtcatttaatataaaatatgtgatctgtctgtttcatgacattttataagattcgagttctgtttttcattcaattggtaacctgttcttctagaatttacagtttctttacatgttatagttgttacataaaatgatcattacaagaatatatttgttgggcttagttaaatatttaatatatgggcccataatatatctatatgttgggctccacaaaatccctatggcctgataacaaattgaatggtcttcattgccaaccgacagacagagtctgactagcaaaacttcccggtttattattccttaaaccgaaatataccagccaaattcgactgttcttcatcgatttgcactgtgttgtttctctctcgatgaattcctcccaagcaagcttcttcgacttccctctaacaccaatcgtctggtctcgtttctaattgtaagtcttcttccttctctaagttttgtttcagtgtcaatgtagatcttcttaggtggaatcaagtaaaagagattgataaaccctaattgttccgttctatcgttaaaactttcctagattagtcggggttaggaaacgaagtctagctatgaaaccgttgcatcgaattttgtcatagatatgataatttccggttcgcacatcagaaccggccctgtatgcaagtagcttgaggttctgttataatttgttgaagggagagaactttgaagctaatg

SEQ ID NO: 7588 - DNA, 3000 bp, Unknown
  misc_feature (1)..( 3000): cDNA_ID_1841684_gDNA_ID_1621153_Annot_ID_173353 3000 nt of promoter + ATG
aatcttgcaggaggggttacgacgaggtttacatttttacacaaccaagatcccgtttctaagaactttactcgtcgtcttgtgtgtttgtttggaactcttatttacatttagggagccggattgtcttgcatgatttcccttgttgattttatctctttggaattacatttcaaaagatacaaactgtgtttgattcgtctttctagcaaataacatttgacttttgagattgattaccaaaacagcaaaaccttaactttgtaaatgagtaatattaacgaagctttactgcattgaaatttaacaatcacttagcttatttgaaaaaaaatattttatagaatgaaaacattagttaaaataaaataaaatcataaacaaaaacatattaaaaaatatgatccaaagataattaaaacaataagtttacatactaaaaatatttgtaacaaaaaccataaaaattaatctaaagattaaatttacttgcgtgaaaagcgattaaactaataacacctcttatggacttgtaggatggagggatgcttagataaaaataagtttacataattaaattatttgtaacataaaccattagaaaaaatttaagagctaaatttactttcatgaaaaacggttaaactaataatacctcttacagacgggatgcttaggtcttttgttttcaacacttaaattttttaattaaaagtattttatataataaaaactttagttaaaatataagtttacttaatagaattatttgtaacaaaaagcataaaaattagtcaaaaggttaaatttacttgcgttaaaagtggttgaactaataacacctcttacggacccgtaggatgggacgggatgcttagtccggtttgttttcaatgcattgaaatttaattcttagattttttgaaaacgaaaatattttatataagaaaaaactagttaaaaaaataagtttctataataaaaatatttataacaaaaatcataaaaaataatctaagagttaaatttacttgcgtgaaaagcgcttgaactaataacacctcttacggacccgtatgattggacgggatgcttagtccggatgttttcaatgcattgaaattcaacacttagatttttttttgaaaacgaaaataatttatataagaaaaactctagttaaaaaataagtttacataataaaaatatttgtaacaaaaaccataaaaaataatctaaaagttaaatttacttgcgtgaaaagtggttgaactataacacctcttacggacctgtaggatgggacgggatgcttagtccggtttattttcaatgcattgaaattcaacacttaggatttttgaaaaccaaaatattttatataagaaaaactctagttaaaaaaataagtttacataataaaattatttataacaaaaaccataaaaaataatctaagagttaaatctacttgcgtgaaaagcggttgaactaataacacctcttacgaacccgtaggatgggacgggatgctcaatccggttgttttcaatgcattgaaatttaacacttttaaaaccaaaatatatctataataaaacgtttaattaaaataaaaaaaacttttgctatcgtaaaaagagaaaaataaaaattttgaggtaaaactaaataaaaaatcaagaggctgaatccctaaattccaaattgatgaacaaaaataacattcacctaaatccctaaattcccaaattccaaatccctattagtagagaagaggctaaagccctaaattccaaaattccaaaattctaaaattccaaatcctaaattccaaacaagaggctaaattcctaaattccaaattgatgaacaataacattcgtcgaaaagacataccagtgaacgaaacattagatcggagcattcacgtgttatcaaacagacagaagaaagctataccaatttctgatcgagatcggagcattcacgtgttgtcaaacagtcaaaagaactctatacatgaagaacaaagaagatactaagtcccagcaaatcaaaatccaattttaaaatcaatttaaagtaacaaaaatctattaccattcgtccttacttgcttaaacccgagaagaatcactccatacaagtctgtgacacgcaaaaatcagaaaaacagagtcacacaacaatgaaaagagaatcgatgaaccctagaagaccctaatgtatggaattacaaatcatcgatgacagaatgaaacagaaatagatacaattgaaagagagagaacgactataactaagtaacctgatcgtagatagatggctctctcaggttgagattggtgatcctttagtcgatcggaatcatacgtgtgatgaaagaatgaagacgaaaaacaacaagggtaagagattgtagtttgcaaacaatcttaatatgggggagaaactctcgtctccgtatatgtaaataacaggagcgtggataaaaaaaatggaaatcactaacggctacttacgaaaaaatggaaattaagtagttgttaatcttaataaactacttaagaaaaatgggaaaataataattgtaaccgactttaattaatttacaatgacgcttttgcccttccatcgttgacgtcattgttacttcttcttctctcctccatttaaaaaacgcaagcttgaaaatggaaattgttttacgacgccaacgggcataggtgatggcacggacccgttttaatgacaaatgttggactgggctcagtcaaagcccaatataaagttaaaccactctgagaggcgcgagtgggctcagttaatgacaaacgttttttttttctgttttatataatttttaaatgatggtggacgttggggatgatgtcacttgacaagacagatcctgcagaatgattgatatgaaaacaaaaaagctaaaatcgtgaacaatccaccattggagacgtgccatcttcatcctctgagatg

SEQ ID NO: 7589 - DNA, 3000 bp, Unknown; identical to SEQ ID NO: 7585
  misc_feature (1)..( 3000): cDNA_ID_1818223_gDNA_ID_1621153_Annot_ID_173349 3000 nt of promoter + ATG

SEQ ID NO: 7590 - DNA, 3000 bp, Unknown; identical to SEQ ID NO: 7582
  misc_feature (1)..( 3000): cDNA_ID_2146892_gDNA_ID_1621153_Annot_ID_173343 3000 nt of promoter + ATG

SEQ ID NO: 7591 - DNA, 3000 bp, Unknown; identical to SEQ ID NO: 7581
  misc_feature (1)..( 3000): cDNA_ID_3050839_gDNA_ID_1621153_Annot_ID_173342 3000 nt of promoter + ATG

SEQ ID NO: 7592 - DNA, 3000 bp, Unknown
  misc_feature (1)..( 3000): cDNA_ID_1027414_gDNA_ID_1621153_Annot_ID_173328 3000 nt of promoter + ATG
ctcgtcactttagcaggtgtatattaatttatcaatgctattcggtgtaaagtgaagtgaaacaaacttgtataataatttgaaacaacttgtatgataatctatcgattcttaacaggtataaagtgataattttcattttagtcaatattaattatacttgttttgtacaaagtaacatgtttcttgtataaagcgagtcaatattaattatacttgttttgtcagttttcaactatagttttttatttatttctgtagcaccacagcaacattagttggaattggaattttgaaagggtacgtgagcactttgatataatgtggaccaatttttaattacgagccaccggaattatgctattggtcgtcccgttggatttttgttttaattgtttattcgacgcatgtgatgtgagcatagagatagcctatttgatataatattttaagtacattatttcatataccgtttcattgatttttttgaaattactctgaaccaatctgtttgccttatatcaatccattttcggaaaatcgccactccttccaaactgaggaccatacaacgttataccaacggatccgataagctgcgttatctacacttggttattttaaaattaattaacgttttaatgagtttgcgaaatatggatgcgaaacagatcctcattttcattttcttcagttgctatgttccaatttttagttttctgagtttgatcaccaatttttttgagaagttgttaaagtatttgtttccttttatgattaatctcaatccaccttttttttgtctttgatatattagatcactgttaaaggtgtgcgacctgcaacagagtggtcttttcccgatcaagttaacatttaataacaacgtacaaaatgtatgacataaaaaagtgttttgactaacgactaacagcgatacgactaacagtggttcaacttgtgcttggcttcgactaacagacgcttcgacgaaatgtgaagtaaaaacaataattgttcaagtaatattcatacttcgcctaaaacggtttttatataagctttttttaaataaagtgtgatttttgcacttgcctttaaatgcggaattgcggaagtgttttcaagtgttacgaataactatgttttgactaaaatgttaggagtaatttgcctgactagtttaggagtacgtgttcgtgatttaatattgtgttcaacagtataactaatgtacttcactaagtatgctttgtttagaagtatgcttggaaatatatgtttcgacttttaagtaaattgatctagtgttttacgtgtgttcggatttagatataagttttttgagtaagtgcttcgactaaattttggctaaagggattttgttgaattaattaagtgttaatgtaattttaaagacgtaagaaaatacacatttattagtcgtgtgtgtatcttgttaaatgtgtttttttttggttgaatggttcagtgctacgactttgactattttttgttgaaaataatttggtgtttactaagtatgtttcaactattttaattttttagttgtgagttttaattaaaagttccgcatcatatctttttttaagaaaatattttttagttactgagtgttttactactaaatgatatagtgtttatgagtgtgttattaaagtagaattaaaaagtttacactagaaagtgtttcgagtgatgagtatttcgactaaaaagtgcttcaattattattgatagtagttgatttttggaaaggattgaaaactaacctggcggaaattgcaattcatgtttatgctttagctctctaagtagtggatattgttgttcgcttgttgaagctttgtcctcctcatcagaattaatgatccctcgcaaaaaatattatatcttgattaaaaacattattaggactattatcaaataaataataacgaaaataaaagattcatggtttaaattaaggcattgcaccgtattcatttgtcaacatataagttttaaacgaagtatcaacaatacgaataacatagaaatcaaaatccaacatgggtcaaaacaaagtactaagagccaagaagagtaattccgactaaaaacacccaaacaatacaacaagaaagaaactggaaattaaagtacatagagacagaaaggtaatgtacaaaggttttacatagacacagttttcgcttttcaccgtaaagtaaagtacaaagtaactcaccgatgattggctgagttttgccgccgaagatgaagagagaatcagacaacaagagacaaaaagagaataggtttctatctacatgtcttggtttggattagataatttaggagtaacgaggactgtgttgtgtgtattactatatatagacaagttttctttaccgttgggtaaaatcactaacggatagttttcgaattctcagcttttgacgtcatagttaccgttctgacatcctcaacggctaactcacagtgaacctactacctagttcgctactttaaagtcgtattattcttgatgggctttcgagatcggcccaacccaatgaaatgtttaaagttttacaagtccaatataaaatgacaagcttaatggataaactggatttggttaaggtccattataataaatatgggcctcacatataaatggctttgatggaccaataagcccggaaatctgagaaaatctatgtaatattcgaaaactgttgggaaaaatcaataaataagtagaactttagggagggttagcaataaacaaaggttgcgggaaaatacgtaaaataaaagctaatatattatttgattcgtccagagttgaattttaaagatagagaaaggaaatcgaattaaaatcttcgtcagattcgagagacgacgacgacgaacttgttgttctcgattatcatcagcagctcccttcaaaaaccctaactctctgagctcgatcgacaagtgataatg

SEQ ID NO: 7593 - DNA, 3000 bp, Unknown; identical to SEQ ID NO: 7576
  misc_feature (1)..( 3000): cDNA_ID_1818275_gDNA_ID_1621153_Annot_ID_173327 3000 nt of promoter + ATG

SEQ ID NO: 7594 - DNA, 3000 bp, Unknown
  misc_feature (1)..( 3000): cDNA_ID_3434836_gDNA_ID_1621153_Annot_ID_173324 3000 nt of promoter + ATG
tattcagcgattgtgattcctggaattcacattaaaaaaaaaaaaaaaaaatgagcataggcaatgggattcatcaataactattaaatctgtgtgcctgaacattacctgtgtaaattgaggcttcacgagcagccacaggcatgttagaggtgttagcaacaagtgtggtacgtttcatgacagattcctcacggccatcaggcaacgtcattgtcaattgtgggaagtccataagaacctaatttatgagaaacaatcagatcaaatgtccgatttgtatgaacaatatgcaaatttagaatgagaagagatatacctcagccatttcatttcctctctctccacaaccaacatacacaacagcatcagagttggagtactatgtaaataagaaaaagttagctttggaaattcaatctatccagtaattaaatggaacaaaaccagagagtgtcacaaggtaccttggaaagtgcctgactgataacagttttcccacagccaaaagcaccaggaatggcacaggttccaccaagaacagaagggaaaagggcatcaagaacacgctgacaacaggaaaagaaagcaatcagcaacacatgtattcaaatgactatcaccactgtaagaagaattaatcgagtaatcacctgccccgtaagtagaggagtatcggcagcaagctttgatgcaactggcctaggcgtacgtacaggccagctctgacatatatcaaccaaaccaatttaacagagtgaaccaaatagcttaaaatttacgtttgcaagtaggaagattaaagatacatgcaaacctgaagcatggtgtaagatttcttgatcccctggaattcaagctctatcacggtatcctgagaaatgaaaatcaccgacaaacaattattagcaacaagccaaacatgatctacaacaggaagtgattaccaattgatcaagttagccatatattaactcaaacgttgaattcaaagaaatcaaggaagaaaaagtttgaaacgtatttattcataactgtttgagggaaacttaaagtcaaaccttaagcgaatattgaccagctggagcaatgtaagtgatcttccccatggcatccggaggaagggcaacgaggtgattcatcaaagtgttctcaaagacagtctgcattccaaagtttaatttgactttcagaaaaaactattcccagtgtaaacaagggaaacaccacggtaactgtgtaaatagattcccttgtcaaaagcagattaaagaggagaccaataaacttacagcatacaagtcaccaccagttattgtgtctccctcgactgcaaacaaaacgaattcaattgaccatcaagattaaaaccaaatgaacacttccatagacaggcatatggagtaaaccacattaccaaatttattgggctggaactcccaaagacaatctttgtcaagagctggaacagacacaccccgaggaatgtacacatcaccggatattcttgcaatagtcttcaaaggcctctgtgacatttaaagaaatgaaaccaaagaatcgtaagaagccacataaaacgaatcataaaagtaaaaaaaatcatgtctagcaagattataaatccaactgaacctgaattccatcaaagatatttcccaatattcctggcccgagctccacagaaagtggctgtagtaaattcaggacaaattatatgttagctgcagatgaacaacactagaaaaaaccaagataaataactcgcgaaccttgtgtgttcgaagaacgggatcattaactgtcaatccagctgtttcctcgtaaactgatcaaaaggaagttgccaaatatcagttaagatatcttacttcgacagaggtcacataagatgccgtaaagtaaattacactaggaagcacaatagaagaaacaaaccttggatggtggcagaatctccttcaagacggatgatttcaccaatcaaattatcatgaccaacacgcactaactcatacatagcagcaccggccataccatcggcaacaacaacaggacctgaaacctgcatcccataaaagaaaatgtcaaatcactgagaactatcagatcagatcagaaattcaaagacgaggttactgaaccaacgcggaatcaaccgattcaatcactgataactatcagatcaaatctagctatcccaccaatcttacctggtaagcagatcaactatttcatctatccatcaccaaaaactaacatcgcaaaacagaaaaaaaaacaaattgaaaccagatcgaacgaaacaggataataccttacgaacgtaaccatactcgctctccttctcatcgtcctcgaaggtcgtaagctttcctccgtaaaacgccggcattttctcagcaatcagagattcaaaaactcaaatccgatcggccaaaaaaatcaaaattcacctcctagaaaatgccgagatccgatcaaacaacaacaacaacaaatcagaaatcgccaaaatcagacaactcttaaggtttttcaaagagagcgatacaataaatcagaaagaaacaaaaaggatcagagagagagggatagagatctcctaaccagtgaacagacaggaagagtggtcacaagaagaagaagagagaggtggatgcacgtagatagatattgaaagagttggagaagttttgatctgattgacgaaatcgtggagtgatccggtacatgactacacacgatacgcgcgtagatctggactttgtcgttaatagccacgtgacagtttatttattgggctttataatatatacttacggcccaataagtgggtccgtttagtcaacaaagacatgcggcttgagaatctctctctctctctgatcaagccggaaaattcacaaaagtgatcagttttgttttctcggggaaattttctgaaagtgaagaaagggaaagcaagttttttttgaagtggggagagagatgggagaa

SEQ ID NO: 7595 - DNA, 3000 bp, Unknown; identical to SEQ ID NO: 7575
  misc_feature (1)..( 3000): cDNA_ID_3050853_gDNA_ID_1621153_Annot_ID_173323 3000 nt of promoter + ATG

SEQ ID NO: 7596 - DNA, 3000 bp, Unknown
  misc_feature (1)..( 3000): cDNA_ID_2993732_gDNA_ID_1621153_Annot_ID_173321 3000 nt of promoter + ATG
attgtaaaaagaatgaaaggaacaagacaatcaatggttatgtgtgacaacattaccgcgccaaatgttataacagctaatataattgtcagagaatatcctttctgaagtacagccattggatcctctaccggagatttcacactagcatcacgtgttcccttgattgatagaataccaattgaggatataatcaagtcaaaagaatgaacaactagaggaaaaaggataaagcctgatggatctgcataatagagaaagatttgagtaagtatcaagcatgaacaagaggtttaataggatgtttatcagcgcatatctaacaaccactgctagaaatgggtaatgttattgaaattttttgactgcagccaagtgtagcttgctgtcatgaaaagtagtcttccttcaattttcacacaatgcatagcaggttcgtacaaggtgcttcaaacaataactctatacaacttatgtcgactttttaaatcctaacaagtaataatgtaccctcaaatcctcaaggagtgaccaaaacatgcaataaagcgtagattattctgtatacagaatgtaatttacgagcttgaactctctatgcaactcttcctaagtttgcatttcagattataaaatcctagcagttcatttaattttctcggtatgagtcaggaactcacaccataagttatatatttgcatataccagaagtaactttaaagagagatggtgcaccttcaattttgcacttcttagccattgttccacctagtatcattgcactgatgatttctgcagctatactttcaaataaatcagcacctctagcagcacagtcccccacattgtctccaacctacaagaagatgaaaatggctttaaatgcctaaatgacgaaaacacaagcaaacccttgtagagtgatatatgccccaaacaaggatgtcacgtttgggaatcacagaatcaagaaagtaagaaacaaaaagaacaaagatcaaataccaaatcagcaataacagcaggatttcgaggatcatcctcgggaattccctgctcaactttcccaacgagatctgccccaacatcagctcccttagtatatattccaccacccaactgagcaaataaggcaacaaacgaagcaccaaaaccatatccgacaagaagaagaggtactgtaagagaaacagaaaattcaatcaataaatcttacaagtttaatagctccactatcgcccatgcaaatgcaaattctggtcaataaatcaagagaattacatatagggttcactgaaaatcttagaactgtattggtaccccacctcaatcaagattaatacaagtcatgacatatttaagaaaatactgctcatgtctgaaaatgatcctttgaaaagataacaataactttttgaaactcagtacaatgattatagaatatacacacaagacgaaaatgaatatttttcataaaaaaaaaagagcagaagacttacggtcagtaacattcattgagcctggtgaacccacgcccaaccacacataaaatgtagaatagaggatggcgataccaatcacagccataccaacaacaaccagggctgaaaacccaccagcacgaacggctatctgcattatatctgccacttagtatttggaaacgtgtacatgacatgttaccaaaatagctaaactaaagaagaacctgcaatgcttctctcgcagatcgtctggcagcactggagacccgcacattagcacgaactgacacccacattccaacatatccagcaatacctgagcatagagcccccaaaagaaatgcagcaacagtaatataagcagacatcgccctgcagcaaaatagtaatatggctaagcttcattcacaacaattcaaaagataaaataaatcttgtgaatgtaatcatgtatcagcaccttcctaaaccagcagcctcttgctggggagttaagctacggaatagatatatgcaaagaatcacaaaagctagcaaaatggccatcttggatatagtgctatactgcgttctgaaaaaaccttcagctccatcacgtatagcatctgatatctataagtaagagaattacctcacaaattagaattacaaatttttgatgagaacaaagaaggaaaaatgtcaacatcatgactaacaccacataatctgagtgagcttacctcaaccatctctggaggtccttcatctttcgctaaaacccacttggttagatatattgacaaaaggaagctgatgatgcatactgtgaagacgaacacgatgatgggagaagtacttgcccccatgtaaaagattgctccgaagcagaaaagcagaattatcgaaaggacacggacatttaatttcctaataatccggaatatctgccaaaaaacaactaaactttatacaatttcaaagaaaatgaaaacgagatgctcaagaaactaagatgctaaacgaaatagaaggaaactagttataatacgcatctcagtgatctgatgcaagcaaaaagaaaagcactcaagaaagagaggaataaaagttgtaccagtggactataggttttactacgcatgttgggaaaagccctaggcctgtcattgaaagacatcaaactggcctgctcaacatcttcatccatcatcatgttttgagctgaattagcccttcggactatgtgtagaggcgtaaagtcaatgctatggggcaactccgccccagaactcggacgctgaattttaatacactacaactttttcctccaaacgttaacaacagcacatcacaaaacgagcacaagttagtatgaaccctcttaactctagctatatctttgattccagcttcttcaaactttctcagtagagttgccacaacaagtttccaccacaatcaaaatttctgaaaaaaatagaaaagtatgaaaagttgtgatgtttctctttaccaaccaaatagcatttttaa

SEQ ID NO: 7597 - DNA, 3000 bp, Unknown; identical to SEQ ID NO: 7588
  misc_feature (1)..( 3000): cDNA_ID_1841684_gDNA_ID_1621153_Annot_ID_56942 3000 nt of promoter + ATG

SEQ ID NO: 7598 - DNA, 3000 bp, Unknown
  misc_feature (1)..( 3000): cDNA_ID_1818376_gDNA_ID_1621154_Annot_ID_56944 3000 nt of promoter + ATG
tgtaatttagtgattttatatgtggtgtcacaatccggtattatgtgtatatatataattaatactttagtcgttaaacaaaaagctggaatagctcagatggctagagcgtgtggctgttaaccacaaggtcggaggttcaagccctccttctagcgattccttttcttttctctttatagggctctatttttagcgaatgggcttccaaccaatattgggccttgtgattaagccaatacatatcaatgcgacaatgcctaagattgatagataacgagtacaaagacttcacttagcggttctgaagcatacgggtggtgtcccgcgtgttgcttcttgatatttccatggacgtctcttctccatcaacgtacgctctctagctctgtttgcctcacgcttagatgattcattcctgctgaatcttggacatcatttcttgagtctgccagcatctggaagtaggcatgaggtccccaacctgaaagcaaacaatccatatagagatcagtgttccttaatatctatgaaacaaagtgactttatcttgaagacaagaggttcctcagtcacacaccgtctggatcgtatggaggagggaaaaattgcagataacaaaatgtggccacagtcaatcctggacattgcaagaaagatgtgtgtctgtcatcagctttgtttctcacgtaattttgaattcatgagttaaaaaagacaaaaacaaacaaacctatgatagctcctccaaaaacatcttgccagtgatgccaatagtcatcaactctggatacaccaaccaatgctgcaaccagtagaggtaaaatcacaatgcagagctttgcaacatgccctctctggtcaaacaccctgattttcccagacaagtataacgatagaaatcctagaccagcaaacgaccctgcaggttacatgactaaagtctgacggtctgcaactgtattactctaatagcacaacaggcccaaatataaacactcacaagatgtgtggccgctggggaagctcttgtgtccctctttgaccacatccttagctccagtacatagaacattcttcgtgacattgtgaaagatctagaatttcagaaattcaaccagtcagagtttatccaaggttttataagagtaagcaaggagatgtgtgctgcttacccctataccgtcagggaaacaacgccaaaagaaatcaggacgaggtcgaccaacagcgtcctttatagcatcggttatgacaccggttataagtacagagaacaaaagccctgaagaagacccaagagaacacacctcaaaatcaagagctacagagaattcgaaacatgaaacacaattggaagaagaaagaggtacctagtattgcatgatgcaggtcataaacatcatttctaatgaagtagtaaacacaaatgacagcaaaaggtagcacaacagctatcaactgtcataaaaaaaaaaacacttgtaaagaccacgtccaagatttacatgttgcataaaagaaatcaggaaaatccaaaatgtattaccgggacagcccagaaaggaattgtgttgtcctgcagagggtatctgagatcagtgagcatatcttctccaacaaaacgatgaaagggttcgatgacattaagaacaatttcaatgactattagcagcagaagaatgagccagtcatgcatgtggaacctcgcgactgttactccatgggatcttattgtatgagcacccaaatgaatttcaggcatgattaatctagaatttcacaagagaagctgttaatggacgaaaataaagttcaaaactggggtttttgctgaaagctgccaaattagaaaacaaagggaacttggtcgagctcaaaaagagcttttcaagttacaagcttggcctataacaattccagatgcacaatggccacaaacaagaatcactaaattccactataacctgtgtctcaatactcatcagtgatcaataggagagaagacgatgagagtgtacctttaccgttaaagatgtggagatgatgagctgaaagtccgacgtcggaaacgctcgtgaaagcgtctctacactctatgtgtcgcgcgaattggggcactgtattaaagcgggaaacggaaaatctctatagtttttctccgggagatttcaaaggaaggaaagataaagttttttgttcgtccaataaagaaaaagcaacctcctctctctttagctttatgtttttgtctgtcagaaataacagagactactctgtttaatattttaatctgttaaaaatcagttgttcaaaaatatcaggaaagaaatcaactatataaaattgtaaaagaaaacatcaaaactaaccacaaaaaatattatatttaattgaaagtttttatttttggtttcttttttaaattcaattttagatcaatatttcctaaatttagtgagataagaaaagtactaaatgtacaaataatatgatgattagatcaaatctgactttatatttctcactaactcgcttagtatattagtaaatttaatttaaataattaagatgatagcttattatattaacatttttagctatttagttagatacattataaatttagtttcattatcagtgatatataatctggttttgttgatatttttttgagataacacatcttaaattccaaatcaagatgattggacaaaatttgctttacactaataccttccttgtcttcaacgcacaaccaaaggccagagaaacaaaaaaaaaaactctcactgtaaatttgggcttttgcaatatcactggcccaaaatatttgcggtcaaaataagaaagtcacgtcttcgtcaatcatcaacatcactggtcgtctctccacgtgtaccggaaaatgaatgaagatccttaaaaacacgccggagtgaaaccgagccaccattgtttttttccaaatctgccagagtccgtaccatgtccaccatg

SEQ ID NO: 7599 - DNA, 3000 bp, Unknown
  misc_feature (1)..( 3000): cDNA_ID_1818372_gDNA_ID_1621154_Annot_ID_56947 3000 nt of promoter + ATG
tagttggtggttaatgtagcattttgaaaatactgtttgcaagttatattccttggatttgcaagttaagaacatactgttttgactctttctttgagagagattgtaaaacatttgatatcaattctgatatttttgagctttgactaagaaaacataagtatctttaattatcttaataaagaacaaaaaatgtgtccaagctctaggggttggttgtattagcaacaaggagcatgtggtggatcagtcatatagaaaccataattaaagtcgtccggacggatcagaaacaagaatggaccactcttccttacttgtcttcatatgctaacacttatacttgagactgactattttgaggttgtcctcctcatattatttctagatgtagaccacacccctctctctcctcctcttaatttacctaagtttgcttgtggtgaaacagttaattgataggcttattggttacaatcgtcataagtatatgttgaaagtccttaggagttgtatgaactttactacgaaagcattatcacactattattggtgtcaactatcgatacgatattaatgtagtggtaatgctgtaatgctttttattctgccaatcattactacttgaatgatttcgaatatcatcgaatcgaaattcttaatcacgctctctatctcatcattatctttgaccctaatcattattagtagtatctctctatttatcacacacgcttattcttctgtttaatttacctgtgttttactctcacttttaatccaagaaaactatccacttttcactgttggtttcagaatcccattgcttattatttagttattattactaatgaaaaggttaaggaggaggggtaagtaatgttgtgacaagtgacaagtggtgtctccatctgcatggtcttcttgtaggaatgagctgtttatctttgtttgtattccagtttcaaactttataatactatttcgttagtgctttttaattgtattcgcagttatgtgaattttaatcaagagctagctgacctgaccgtatgcttattatagttagggtccattctctacaactacaactgtacatttataataagcatgctagtagatttattgtgacgatttcaagcacatagaagagtctatatcatcacttcacttgttaggcctctctttaatttcatattatatgacacttttttcattcaatgaaaagaataaaataaaattaattgtttgatactcctaattagggatgttattctctgcttctcctttgtacttttgggaatatctgtcaaatcaattacttaaatgagaatattaataaatttggcatttgatgtgctttatttggctgcaattaaacaacaatcatatgagttattgagtatcattccaaccccataaatgttagcctttttaaatggagtatatattactaccgtttttttgttcgtaacgcatattacaaccgctttaatcagagaaattatttaaagacgaatctggtgaaacatgaattaattttgtcaaatagaatatgtgaatagtatttctgtttatgttaaattaggcaataacattacatatatacttaatcctttatctgaaaacactagatttatgataaatacgaaaggtaacactggttagcgtatggaaccatcaaattttgactaaatgttttctaacactatgagtgaccaaaacatttccttttacaaattaaaatttgtattagtcatcctgcatacatttctttttccccaaacattttcaattttggaatttttttatatatatgtaaattacatttgaacaggtctaatttgaatggttaatacgcggttcaaataaagttggcaagtaattaacaaacgaatccacatcaaatttcaattactgtatgtaccaaaaccacatttataccaaaccgcatcataaaataaaataaaaattcttaaggcctgttttgtagattttgtaagagtttttggtttttgttttttaaaaacttattttcataccaatcaagattttaaaattttggtttccctacaatttagtaaaactattttattgtaattttccattcatgattttagttttttagtttttgtaaaatttaggaaatctagtttttgttcaatcaacgttatttttctcaaaaaccaaaaaccattttttggagattttttgaacaaaaaatataataacaaaaatctaaaactaaaatctaaaattcagaaactaaaatctaaactcaaaaactaaattaaaaatcagggcctaaattttgacataatatggatagatgatgatagtgagaccaaaccacataatattgcatattttgatgtcaccatttgatagcctataaaaaggagaagaagcaaagggtagttctggaaaaaaagggaatcgtgggggaaagaaagcagagtcgttttcagatcgtgaatagaagcagcagcagaagccgtatctatccctctctctctctctctctctctctctctctctctctctctactttgaccgttcctcttctttttattcatcaacatcatcgagctttctactacttggattcctacttcttcttcttcttcctctgattctctcccattccaatcaatctctagggttcttcttcaggtatctcaaatctcctctcttttctttttattgctaaccattttcatttactttggcttatttttaagtttaatcttcttctgatattgcgtctgcttttttacctctgcaaagacagaacctttctctgtctctctctgcttgtaccttgtaccttttctctctgtatacactccattgtctgccttttctcgtctctcttctcttacagtttttattcattaatttctctcgaggatgctcctcaggcccctctttatctcatctcccagctaaagtttctctttttgtttttaatcagcaatacttcagaagctggttttggcc

SEQ ID NO: 7600 - DNA, 3000 bp, Unknown
  misc_feature (1)..( 3000): cDNA_ID_1818369_gDNA_ID_1621154_Annot_ID_56948 3000 nt of promoter + ATG
ttttacttagttgggctagtggagctcttgatcctgacagcactacatctgatgatcttgtcacttctgtcaaaaggttctctttttccttctgcccacatcatgtttttttttcttttttcatttgattccatcaattaacactagtctactatgtttatgttccttttctaggggagtgtgggctatgatcgctgtctttcttgcttactctttgctccaggccccttcaacgtttgtttaccatctcagctgttttattaatttgctttctcttttataatgtagattgtggttgttggtgatacttgtgatgtgtctttaatcaagtaatttgctttatgcagggttctaatcaggccccatcctgcaatctggcgcttagttcatggaatggccgtcatttacttagttgcacttacttttttgctctttcaggttcacttttttttcctccctagatccttcttacttgcctatgcctgtgatttatatatggattcttgttttaagtgagcaaactctaatagttacattattcatgctcccagagacgtgatgatgcacggcagttcatgaagtttctccaccctgaccttggaataggtaagagtttcggagaggaatgctgtttattcgaggagctaccacatcaatgattgaccatcttattgagtttgctcatgttgcagaacttcctgagaaatcatacggtgctgattgccgtatatatgtgcctgatcacccaacaaacaggtttaagaatctttatgtagggtatcttctcaacaactcccctttaccttaaccaaccttcatatcacctaaaggcttatgctttgattaaaatttatcaggacacagtatttgatgagtttttcttggctcacatctttggttggtgggggaaagcaattctgatccggaaccagccgcttctttgggtgctttcaattggttttgagttattggaggttggtctttgtcttcgttttcttatattacaggttccaatttgatatatacaaaaatatcgcttcgcctgtgtcaccgaaaagttatatttatgttctccaggttacttttcggcatatgttaccaaatttcaacgagtgctggtgggacagtattgttcttgatatcttgatatgcaactggtttggtatgattcttaagctaccttgctattctatatgtagtgcttttaaacatgttatggataacagcttttcttgttttaatcatggtaggtatctgggcaggaatgtatacagttcgatattttgatggaaaaacatatgagtgggttggcattagccgccagcctaacattattggcaaagtaggtttgttcaaccttgagagtgcatacacatggtcctagccgttgtacatccaatgagaattttgtatattttttcaggtgaaaaggacactggggcagttcacaccagctcactgggacaaagacgagtggcatccgctgcagggaccttggcgttttattcaagtactcactctttgcatcatattcttgacagtggagctgaacacattctttctcaagtttagcctgtggatcccccctcgaaacccagtgattctctataggctgatcttgtggtggctcatagcgataccaacaacacgggagtacaattcatatcttcaagacaggtaaagctatagccactgcgatattggttggagttagtttggaaagagttttgtatataacttgtgtagttttggttgttcacagaaaacctgtgaaaaaggtgggagcattctgttggctgtcactggggatatgcatagtagaacttctcatctgcatcaagtttggaagtggtaggtggttccttacacatgctctgccttagttatttatggttacagttacatagtgtggagagtgtaaacttggttgtatggttatgatacgaacaggattgtacccaacagaaatgccattgtgggtagtgacactatggggaagtgtgggacttggacttgtggccttcttgctgtcttggacatggaagatccagaagatcctcgcgcaaaagagacgttaagcgcatcattattgttgcagcagagacgagagagaaatagaggtgagacagtgaaatgccattgtggtttttttttgtaaatagggagaagaaggaacgatgtaaatgcaattttctttagggatagtgtgtgatattcaacatttacgaagattccatcaattctttcatgcatcaaaagttctttcatctttgttctgccccctcaatctgacaaaacatgttggtttgaatgtcaattttttgttaccattcacacattcaagttttcaacagttcaaaaaaagaagaagaagttattgagccattgtttcttctggtttttgagatgattgttttgtgctgccaactcttacatgacattaacaacattattgtgcttttactgccattaactccattaccaccattcaatttttctgtctttaattattggttccagttttgttattctggtctattattttgtattatcatcattctatcaaacagattatttgttttgttgaaggaaatgaaaaaaagaagaagaaagaatcaaatatgataaattgaggataatattaagattgtgtgacctgccgtgccgcccaacaacatgtcacatggtatcttaggtttgcaaattcgtaatttgacatcttcgacgacaattttgactatctatctaatcttaacatcactcttccatcatcacttcctattttattccaactttcttaaagaagccaaaaaaaggatgatgtcagaagttaaggaatattctgacaaggataggatgcccttaagggaatctagagtcttgaatgggcttttagaattccaagaagctagggaatctcgagtctttaatgggcttttaaagtttcaagaatcaaaggcccaaattgcatatttgtagcccgtcggaaacgcaatgaaa

SEQ ID NO: 7601 - DNA, 3000 bp, Unknown
  misc_feature (1)..( 3000): cDNA_ID_1818367_gDNA_ID_1621154_Annot_ID_56949 3000 nt of promoter + ATG
ggctgtcactggggatatgcatagtagaacttctcatctgcatcaagtttggaagtggtaggtggttccttacacatgctctgccttagttatttatggttacagttacatagtgtggagagtgtaaacttggttgtatggttatgatacgaacaggattgtacccaacagaaatgccattgtgggtagtgacactatggggaagtgtgggacttggacttgtggccttcttgctgtcttggacatggaagatccagaagatcctcgcgcaaaagagacgttaagcgcatcattattgttgcagcagagacgagagagaaatagaggtgagacagtgaaatgccattgtggtttttttttgtaaatagggagaagaaggaacgatgtaaatgcaattttctttagggatagtgtgtgatattcaacatttacgaagattccatcaattctttcatgcatcaaaagttctttcatctttgttctgccccctcaatctgacaaaacatgttggtttgaatgtcaattttttgttaccattcacacattcaagttttcaacagttcaaaaaaagaagaagaagttattgagccattgtttcttctggtttttgagatgattgttttgtgctgccaactcttacatgacattaacaacattattgtgcttttactgccattaactccattaccaccattcaatttttctgtctttaattattggttccagttttgttattctggtctattattttgtattatcatcattctatcaaacagattatttgttttgttgaaggaaatgaaaaaaagaagaagaaagaatcaaatatgataaattgaggataatattaagattgtgtgacctgccgtgccgcccaacaacatgtcacatggtatcttaggtttgcaaattcgtaatttgacatcttcgacgacaattttgactatctatctaatcttaacatcactcttccatcatcacttcctattttattccaactttcttaaagaagccaaaaaaaggatgatgtcagaagttaaggaatattctgacaaggataggatgcccttaagggaatctagagtcttgaatgggcttttagaattccaagaagctagggaatctcgagtctttaatgggcttttaaagtttcaagaatcaaaggcccaaattgcatatttgtagcccgtcggaaacgcaatgaaaatgatgaatctgaagactgactcaaacaacatctctgtagggttcttcttccttgcttcttcgagtctcgatctcctctctcaatctcaggtaacgccaaaatcctctttttattcatgggatcttttataccaaattcgatttcttcattttgagatctgtgaatatcatcgtcccacgaaccaatcgaatctgttgttgtctgacattaattttcatttctatctcttgcagtcttcagcttccaattgactttcaacatgtaagcttattccttaaactcgataccttcttaccaatctccaatctccaatcatgttgtgtagatggatctctaacatatgtagaccctttagtattcgtgtctgaatctctagactggaatcattttttttttttattgtggctctatagttgtgtaggggtcggtctatgattagatccgattctattcatttttctggcttatgttttcgcatcatataatcagagctttatcttgtaaggaagagtgataaaactagataattatgttctttctagttttgctcgtaaagacgattcttgtatgtcatcattcacacgggagtagtttatatatctagccattgatgttgcatcctcgatgcctgtggtttttctgaatatttcagggcagatgatgaagttgttgatccaaagaagtaccttgaggaatcttgcaaaccaaaatgtgtgaagccacttctcgaatatcaggtgaaactggttgatgttgtgactaattatgaattgtgttataagttttgacacagtgccatgttttgtgaagatcattgtttgactgatacaaggcttgtttgtggttctcaggcatgtgtcaagagaatccaaggtgatgattctggccacaagcattgcactggccagtattttgactactggcaatgcattgacaaatgtgtaagttacttgaattatgttattttgctgtttcatcatatgatatcttctaaagtttgatactgagatgaaattggattttggatcttcaggttgcaccaaagctgtttgcgaaactaaaatgaaaagaggtgaagctggagactctattgtcttgagtttgctacatgtggtttaaaattgatgtataaaatgcagtggatgttgaacttttttttactgcaaaccagattgccaaatggctctgcttcttggttttgtttccatcgcaagtttgcgcttactacatttttttgctacttgagtaattgcatggcctaataacaagatatgttgtgcctttctttggtccaattgtcgtagacaatgcgtcaaacaaatcattaggcttgaagtttcaataaagagagattttcaagcctctgctattaggtggcctggtactatggccattgattaggatttcttagagcttgccaaagtttatgatcggactaactctgaagcttattggtcttaaaaagataactatctaatgatggcggctacaagaagatattttcttttaaaaaattttgaaggtgaaagaaggttgaatagtcttatggtgaaatcacatgtgactggaatgaagtgaagaactgtttagtggagtgtgtgatgcatgcagcagccacttttgaaggacagcttggactttagagtgagagtgagatgtatggcccgcggcggctgcattagactgaatcttatccttgacactctacagcaattatgtagattctcccatttgaccctctatttaagggttagcaagtgtaataccagtccatacaataccattacatagcc

SEQ ID NO: 7602 - DNA, 3000 bp, Unknown
  misc_feature (1)..( 3000): cDNA_ID_1818363_gDNA_ID_1621154_Annot_ID_56950 3000 nt of promoter + ATG
ccattgagattatctgtatcatgaactgaatgataaccacggcagccataggagccgcaaagcagataagcctcttgagttctgcggtgaaagatccgtcttgcagatctctccatgtcactttctcaattctgtctaccggatcattggtggttctctccgcgtcttgcatggcttgtgagagagagtttgaaagttgaaacggaaagtggtgagtgataatcgtgaagtactactgtctgctttttggtgcttggttatgtgtaattccttaccaagggaatctatagtgtagtgccacttggcaaaattccaaaaccatgaatgaaatatatacgttaaatttggctcaacggtagggagtgttcattgataatgtactcttacgttttttaatatgcatattgcttgtcacttttcttccacaattctgtcttttaattacatgatttggtgttttttctttgaaagacgagctagcaaaattaaatgaagagggaatgcaattttcgaagtatcacaacaagtggtcggaaagtagatagaatgatattttgatcatccacgtggcaaaacattgtaacggaaggaaattaggtgcatagcaaaaaaaaataacacaatcgtgccaccgaaccaatcgggccgcccttttctaccgccggctaaatttgacggtcacatatagagccccaaaaactctccaccatgtccactcttcctttcgcgccttctgtcacccatgcgcactttagccactccctctcccccatgtttatcctgcgccatctccctcttacacgccatctccgtttatcccgaaataaccgcgtcgcttccgttgtatccgccgccgccgttcgccaggacgcttccctctggactccagctcctctctctctaatcgaatcagctgcagaatcgcttttccacatctcaatcgacatttcaaacgctccggatctcgtagcttcgtacacgagacccggtcagtatctccagatccgtgttcctgatgttgagaagccttcttttatggcaatcgcttctcctccttccttggcgtcttctcgtggtgctttcgaattcttggtcaagagcatcgctggttctaccgcggagattctctgcgggttgaagaaaggagagaccgttgagcttagctctgtgatgggtaatggtttcaatatcgatctgattgatcctcctgaggaatatcccaccgttttgattttcgccactggatctggaattaggtgagagctttttccattttctctcctaccttgttggattgctgaagttgtcttttttacttcatgtattcaatgatccaagtgtggtctagtttaaaggtttcagtgcagagcattagctagatacaaagctttcaaactcaagtatcttgaatctagtttagttactcattttgcggtgaatcctctgtgatgccgggttcaattgcttttttgtggaccttttttgtgaactccagtatgatttcaatctatccaaaggtgccatggaccaattttgtggctatttttttactgtgatgatgttgtaatactgaaatagagtttcatgtatgaaaggtcaatgtttttatgactttggtgatcgatcagatctgttgtttatgccaagtaaaggtgtttctttcaatcatctattgttctaggcctggtcaatcaaaaatgtttagtgatggtgatgtgaattaagtaactgtcttcaatttggaatgtaatctcacatgttcttatctctgcagccccatccgctcactaatcgaatcaggatttggcgctgatagaagatctgacgtaagactctattacggggctaggaacctgaataggatggcttaccaggtttggttctttctctcagttgttttgcaattcatgatgtcagtagatataaatgtgtgtgcttgaattataaaaatcttttgatgataagcgtaaagcctatctctcgctctcattttgatctacagaagaatcatcttggaaacgctcttgattttgtaggaaaagtttaaagagtgggaatcagcgggtgtcaaagttgtgccggtattatcacagccagatgatgggtggaaaggggaaactggatatgtgcaggtgagattgagaaacgtgctccttagtcaagtctgctgtaactcaatgtggatcaaactaatatatacataatgtgttgtataggctgcttttgcaagggctaaacagctatcagctcccaaggccacgggagcggtgctgtgcggacagaaacaaatggctgaggtatgcactgtttttgtttatgagaacctaaatgctttagaagatgtgtatctttatcattgtttcgatttgtattgttgcaggagataacttcaatgcttgtagctgatggagtctcaaatgacaagctgctcaaaaacttttgacagatatagttcttgtattatcgtataattttactgtttcttcacatcattattcttttgatacgaaagtcctcttcaaggcctctctaattcataaacacacagaattttgtagtcccttaaaaattaatactactgtgttgattgtcaccacaacattcttttttgattagtgatcatgttaatgtccatgctctatatactttgcatatttcttctactttcaatagaaaatttctacatataccaagaagatttataccaaaaaatattgtgaattagacatgtttctaattaggaaaagttccacaaaataaatcaccatcgttgccacatttaattaacgcggaaaaaagcttaaaagccattgatcgactgtattaaccactaaattagactgcacgccgttttcatagaagatcacaggacttggtgtcgttctcacgatccttcacgatcatcttctcttagtcaataaggatccatcaaggaaaccaaaaatcgaagaaaattagaaaaatcggaagagcgatcgaagaggattttgaaccgccatg

SEQ ID NO: 7603 - DNA, 3000 bp, Unknown
  misc_feature (1)..( 3000): cDNA_ID_1818359_gDNA_ID_1621154_Annot_ID_56951 3000 nt of promoter + ATG
acgttgttggtggttatatttttctagtgatagtaatatatgtgtgatcctgtcattattacttgtggagacacttgtgaaggtctgtgtcgagaaacattttcagtgattgaaaactctagctccaagactcagaagcagctcccacatctatttcctgactcgcaactactgtgttacaggtataagcgagctggtatcagcagaattggatcactacatcattttctgtccaaggtatttctgaactaccagaataatgcttcatcgaaataacgattgctgagggctgctaatattacaaaagaaaagaccaattattcacggcaaccactagtccagcagtaacatataacgatttggctgctacaaaaatggtaaaataggaggaacatctgtgtccctgtaatcttagatgggaagttctgactctgtaagttctgattcatgggccacagccattcgctccctcgcttcacgggcctagagttcaaaatgcatccaattgaacatcgatatgtttattccaaaatagaaacatgtcatgaaagacaaaaagcaaaggaaaggacctgggttttccagtttgtgcagcctgtgacaagagccagcagaagagtctgcagaactgcaccggctagtattccaatccaaaggccaacacctttcagatgaacccagaaggctaaagatgctgcaatgggtatcccccagagatagaaagctccgaagtttatgtaagcccctatatgctgccacccgcatccgcttgcaacaccttccaaccatcaaacgagggttagaagaatggcagaaaagagtacaacatgaacaggcatgacaacttggagctgtatattcgacactagcttatgtttgagaaacgaaatgggaaaaaatctcgaacctgagagaaccccttgtaaactgtccagtatgatagaaatagagaccaacggagccatctttgcaacatattcgatggttttcttgtcactgctgaaaacatggccgaaaacatgcctgccggctaatagagacatactcaccatcaatgcatccattactgcaagagacattgccgcatagaccacaatatgtgctgctcgagagtttccagctcctaactcatttgagattcttgtgctgcacaatgtacttgcttatgaacatgaaaccataacagaaagtatacttcagcatttatgtactggatagtggtgacaaaagctctaaccttgctgcagccgcgatcgctagtggtattgaataagttattgaaagtgtttcgaaactgtccgtagtatgaataacattatgattttgcaaattcaagattgtgacaggaaatggaaagatgcaaggatgagtaccagatagagagcacagaagtctccagctgtgggttgggtaacagaccagaaagtaatattatgagttcatatgaccaccactccaggctgcaacccatatataaaagagtttctaacaaaaaatgtggaggcaatgagaagtgaaaaaggaacagagaaaagtgatgtaccaaagcatagccgcagaaggaagagcatatttgataaactctctaacgccctcgaatatctccatggtaagcggcgcgcgtgtctcagaacaggcagaggagtagtacatgaaagatccaaggaaaatggcatagagccagtatgacaagctgagagccaaggctcctccaatatgaccaagccctgacttataaaccaaaagccagcagagaggaacgtggatacaaaacacaacagaagaggtgacgaggagaggtgtgatcaagctctggtttttgaagtagcgaatgagcggctgaagaacggcgtaagcgaacagtcctgggatgagccaagcggcatatctaccagcttcgtgagcaatagcagggtcttggccaaggatcacaataagctttcccatgttgaaccataggagagagagagggagacacactaaagtaagacagaacatagctgtgtaagcctgaacacctagtttccgatatagcttagctccataagcttgaccactcaaagtatctaaggcacatgacaatcctatctatcatcaaaaagtaacaagaaagtgaggagaggatgcaatttccatggttctggtagctagtaacagagataagtgcgtcaatttagaggaaagaaggaaaaggaaaacaaacaatgaagctgaagccagtgacgttacagaaggagactgcgaaggaagcgctagcgagggagagtctaccgaggtgacccaccatcaccattgagattatctgtatcatgaactgaatgataaccacggcagccataggagccgcaaagcagataagcctcttgagttctgcggtgaaagatccgtcttgcagatctctccatgtcactttctcaattctgtctaccggatcattggtggttctctccgcgtcttgcatggcttgtgagagagagtttgaaagttgaaacggaaagtggtgagtgataatcgtgaagtactactgtctgctttttggtgcttggttatgtgtaattccttaccaagggaatctatagtgtagtgccacttggcaaaattccaaaaccatgaatgaaatatatacgttaaatttggctcaacggtagggagtgttcattgataatgtactcttacgttttttaatatgcatattgcttgtcacttttcttccacaattctgtcttttaattacatgatttggtgttttttctttgaaagacgagctagcaaaattaaatgaagagggaatgcaattttcgaagtatcacaacaagtggtcggaaagtagatagaatgatattttgatcatccacgtggcaaaacattgtaacggaaggaaattaggtgcatagcaaaaaaaaataacacaatcgtgccaccgaaccaatcgggccgcccttttctaccgccggctaaatttgacggtcacatatagagccccaaaaactctccaccatg

SEQ ID NO: 7604 - DNA, 3000 bp, Unknown
  misc_feature (1)..( 3000): cDNA_ID_1818355_gDNA_ID_1621154_Annot_ID_56952 3000 nt of promoter + ATG
gttctatatcggatcggagctgcttcaaggtctcgagatcgtcgtctataagctgagcctcgcgctcagagtaggtgaaagtaacgtagttgcggagaggacggtagagatcaacggagctcgtcttcttctcatgaatggcgagcatcagattagagagcgaagaagaagccatggcggttcaaaatcctcttcgatcgctcttccgatttttctaattttcttcgatttttggtttccttgatggatccttattgactaagagaagatgatcgtgaaggatcgtgagaacgacaccaagtcctgtgatcttctatgaaaacggcgtgcagtctaatttagtggttaatacagtcgatcaatggcttttaagcttttttccgcgttaattaaatgtggcaacgatggtgatttattttgtggaacttttcctaattagaaacatgtctaattcacaatattttttggtataaatcttcttggtatatgtagaaattttctattgaaagtagaagaaatatgcaaagtatatagagcatggacattaacatgatcactaatcaaaaaagaatgttgtggtgacaatcaacacagtagtattaatttttaagggactacaaaattctgtgtgtttatgaattagagaggccttgaagaggactttcgtatcaaaagaataatgatgtgaagaaacagtaaaattatacgataatacaagaactatatctgtcaaaagtttttgagcagcttgtcatttgagactccatcagctacaagcattgaagttatctcctgcaacaatacaaatcgaaacaatgataaagatacacatcttctaaagcatttaggttctcataaacaaaaacagtgcatacctcagccatttgtttctgtccgcacagcaccgctcccgtggccttgggagctgatagctgtttagcccttgcaaaagcagcctatacaacacattatgtatatattagtttgatccacattgagttacagcagacttgactaaggagcacgtttctcaatctcacctgcacatatccagtttcccctttccacccatcatctggctgtgataataccggcacaactttgacacccgctgattcccactctttaaacttttcctacaaaatcaagagcgtttccaagatgattcttctgtagatcaaaatgagagcgagagataggctttacgcttatcatcaaaagatttttataattcaagcacacacatttatatctactgacatcatgaattgcaaaacaactgagagaaagaaccaaacctggtaagccatcctattcaggttcctagccccgtaatagagtcttacgtcagatcttctatcagcgccaaatcctgattcgattagtgagcggatggggctgcagagataagaacatgtgagattacattccaaattgaagacagttacttaattcacatcaccatcactaaacatttttgattgaccaggcctagaacaatagatgattgaaagaaacacctttacttggcataaacaacagatctgatcgatcaccaaagtcataaaaacattgacctttcatacatgaaactctatttcagtattacaacatcatcacagtaaaaaaatagccacaaaattggtccatggcacctttggatagattgaaatcatactggagttcacaaaaaaggtccacaaaaaagcaattgaacccggcatcacagaggattcaccgcaaaatgagtaactaaactagattcaagatacttgagtttgaaagctttgtatctagctaatgctctgcactgaaacctttaaactagaccacacttggatcattgaatacatgaagtaaaaaagacaacttcagcaatccaacaaggtaggagagaaaatggaaaaagctctcacctaattccagatccagtggcgaaaatcaaaacggtgggatattcctcaggaggatcaatcagatcgatattgaaaccattacccatcacagagctaagctcaacggtctctcctttcttcaacccgcagagaatctccgcggtagaaccagcgatgctcttgaccaagaattcgaaagcaccacgagaagacgccaaggaaggaggagaagcgattgccataaaagaaggcttctcaacatcaggaacacggatctggagatactgaccgggtctcgtgtacgaagctacgagatccggagcgtttgaaatgtcgattgagatgtggaaaagcgattctgcagctgattcgattagagagagaggagctggagtccagagggaagcgtcctggcgaacggcggcggcggatacaacggaagcgacgcggttatttcgggataaacggagatggcgtgtaagagggagatggcgcaggataaacatgggggagagggagtggctaaagtgcgcatgggtgacagaaggcgcgaaaggaagagtggacatggtggagagtttttggggctctatatgtgaccgtcaaatttagccggcggtagaaaagggcggcccgattggttcggtggcacgattgtgttatttttttttgctatgcacctaatttccttccgttacaatgttttgccacgtggatgatcaaaatatcattctatctactttccgaccacttgttgtgatacttcgaaaattgcattccctcttcatttaattttgctagctcgtctttcaaagaaaaaacaccaaatcatgtaattaaaagacagaattgtggaagaaaagtgacaagcaatatgcatattaaaaaacgtaagagtacattatcaatgaacactccctaccgttgagccaaatttaacgtatatatttcattcatggttttggaattttgccaagtggcactacactatagattcccttggtaaggaattacacataaccaagcaccaaaaagcagacagtagtacttcacgattatcactcaccactttccgtttcaactttcaaactctctctcacaagcc

SEQ ID NO: 7605 - DNA, 3000 bp, Unknown; identical to SEQ ID NO: 7599
  misc_feature (1)..( 3000): cDNA_ID_3050972_gDNA_ID_1621154_Annot_ID_173373 3000 nt of promoter + ATG

SEQ ID NO: 7606 - DNA, 3000 bp, Unknown
  misc_feature (1)..( 3000): cDNA_ID_1818343_gDNA_ID_1621154_Annot_ID_56955 3000 nt of promoter + ATG
tctatgccattttccttggatctttcatgtactactcctctgcctgttctgagacacgtgcgccgctctccatggagatattcgatggcattggagagttcttcaaatatgctcttccttctgcggctatgatttggtacttcacttttctctgtgccttttcacttctcaaagcctccacactaaaaattatgttgtgtgttgcagcctagagtggtggtcttatgaacttataatattactctctggtctcttacccaacccacaactggagacttctgtgctctctgtctggtactcctccttgcatcgatcaatttcttcttgttacaattttgaatttgcaagaacataatgttattcacactgtggcagtcttcagacaatttcaacaatgtattcgataccactagcaatcgcggctgcagcaaggttagagctttagtcacactatgcagtacataaatactgaagcatattttctgctcatgacaaggaatcatatggtttcatattcataagcggatgtttatttcttgtgcagcacaagaatctcaaatgaattaggtgctggaaactctcgagcagcacatatcgtggtctatgcggcaatgtctcttgcagttattgatgcattgatagttagtatgtctctactaatcggcaggaatcttttcgggcacattttcagcagtgacaaggaaactatcgactatgttgcaaagatggctccattggtctctatttctctcatgcttgacgctttacaaggggtcctctcaggtctgagacttgttcttctttctttactcacacacaagttcttgtcggatattgtttactcttttcctccacatagtgcaaagacacttcatgttctgtgttttgtcctgtgtcaaaagctatcccaaaaatatactcttttctaccacgcctaattgtcttttgatggtttgcaggtattgcaaggggatgcggatggcaacatataggagcttacataaacttaggagctttctatctctgggggatacccattgctgcatctttagccttctggattcatctgaaaggtgttggcctttggattggaatccaagccggtgccgttctgcaaacgcttctgcttgctcttgtcacgggctgtacaaactgggaaagccaggtcctacttctttttcgttcttttcttcttcatgactagtttctcttgtgaaataaacatacagatcttgaattggatgcatgtttgaactgtaggccgataaagcgaggaatcgaatggctttggcctatggaacataaggcgctgcagaacagcacttacagaatcagatctccgcgtctgaagatatagggacctgatgatccttcggttttaccattttgttagtagtcaaattgctgtactgtatgttacttttggactagtggtagccgcaagtaatattgcatggttttccaaaaaggagccttttctctgttctcaacaacaaagaataatgaacagattcactggactgtgagcttgaccatacaagcagagaccaagaagtggtggtattgatggagctgctacaaccaccacatatctccaaattgacagcatctgatttcctgtcactagtcccacttctcacaagagtaactgaattactcgaacctgttaaagttatcaaaccaattttaatgatcaatcttggggcaaggctttaaaaggcaccctcagtgtcaattagaaacataacatagagtttctactgagtcttggggcaagagctgtccatcagtgatacattcctcaatacagacatgttcataagtctgtccagaagcaaaaaatgattacctactctccatgggcttatatagttaatagaactaaactttgatagttgacaccaaatgcatgaacacgatcttcattagaaccttgaccagtgagggaacatggtgttggacactaagagtcatatatcatccaaaattccacttcagaatagaatggagtattttctcatgaggtatgacaaataattgattccttccggttgtcttctcccacacgtgccttgtgaatgagttctttaaagcacgttgctgtcactgcaagttgtcaaatttcgtcaactgttgcaaccgtgcaatcatccgatcaccaacttccttctctgatatggatcaagcaacaatgtccaaatctgaacaaatcacatatcaaaattagaattgcaacaaggaactaccagagaccaatttataaattcagaagcaaatatacacgagggcataattaatcaaactggctgcaagagacttataaaccctgaacagttgctaatatcgcatggaggacattgttgctagctcaactgggtctcagatgatgtctgtttcagtaaaaagtaacacataactgcattttatcaatggccataacacacaactttaacaaagcatagagaacaagaccataaaaacataaattacatcaaagaacaagaacagaaatctaaaaacaaagcaagaaggagcgatcacacttcaaataaaccaatgaggtagtggacaaagccctcacctaattccagatcaaaccggcggagatgacgggtgaggggaagtcagcgcaggataaacatgggagggagagagatagtggctaaattccacatgggtgacagagggcgccaaagtatgacttacttggagtgatttggatagaaaatggtgacacgtggacactcaagatatcatttttatctttttcccaaccacttgtgagctgtgtaggagagaagtaatgaacatataagcaaaaacaaatgttgttacaaaaacaagtccccaccacatttactactactagtttgacaaacataaacacatttcccttattaacatttcttgttaaccacacaaagttaataagtaacccaagtttatacagttttaaaacattctctctatctccctccggctaggctgtagctgttcgcc

SEQ ID NO: 7607 - DNA, 3000 bp, Unknown
  misc_feature (1)..( 3000): cDNA_ID_1818335_gDNA_ID_1621154_Annot_ID_56958 3000 nt of promoter + ATG
aaacatgaccatcacagtagagtgcttgatcctctctttcctgctcattaaccaccccaactttcatttttaagttcaaatttcttttgttaaatgttccatccttcataattagatcaaagtcagccttacttggaaacatagaagcaggtctccaacgttcactctcccacactctgatggttctacaggaatagaccgctcacgcactgatgttttgacgtttacccactcatcgtgtcggttgtcgaacccagaaaaccgtacacgcacttcctgttgcagacactcttagttgcaaacaaatcatccattaaacaaaagagaaaaagcttaccagttcaccagtgcgaagaactctataagtaaggaacgaagacacgtcatacctgaaagaccagaattccagcaaataagcacagatataaaacacaaacgtatattacaagtccaaaaattaggctttatatgaataacgttctttcttaagttcacactgaataggtaagggcattcctcgttgagttaacaatcaacagagagttcacatttcaggttcttacttaggccacttaacaaagtcatatgctagcagtagtccaagagttaaagcaaaaatagaaacatgatattcaatgcaaggaaacgttcttaccacgcgtagtcccgcgctgatttagcctcaaaagccagatcagctaaatcagaggccttgcctgtgtatgaaaatgttcataggcgttataaggcgttaactaaaagaatcaaatatggcacacaagaaaaggaaaaccttttcgtgtttgaacaaaggtagaattcccaacaaaggtagcatttgaggcatttgaagcataagaactgggattagataagtcatgaatctgcaaagggggagatggcaaagttttggattttggttggctttgatgcttcagcttctcctggaaccaaatctgtacctgaaaacattttgattcaaaaaaaaaagttatttctactctatttgcattttttaccagttagctctatgaagaaaaaagagacgcacctgtttccaggttatagaggatttgccattccgattcacagaacaactataagagaaaatggaagaagacataaagattttttagatactgtgcatgaaaatcaataatcctactattcctataaatccacaaaatgcttgtgtctcgattctctaacaaacacattcacatgatcaaattctcgtaaaattcagaataaagtacctaaaagtagaggcaacagtttgacagaaatctttgtggagagattggtcaccgagctccttatacagattctccatgtctacaatcttcgaataagaagagcaataagatcacaaagcatgaatctctaatctaagaaaacgaatgatagaaagcatagataacctcagacaaggtaaactcggtgaaatagtgagaggaatcatcggaagcagccattatcgagcgcacaaggaagaagaagaagaagtgaaaaggatcttgagctaatttgctactacactgatgccttcagagttcagtgagctttagtgggttaatgggcctaaaatggataataataatataaatgggcttaaactcactaatttattacccatatgcttgttttttggaccgtctattattttattttaaccacactcatataactgtactattatttaatatttataaatgactttgaaacaatcgagacaggatgagggaacccgtccgcggggaatcttccaagtcatatgagctggtggtgcgtggtggagtgtttattaatattcatgattactgacattattaatcaaatactatcatagcatgtataagtatataatttaatcacagctaatcctcactaaggctctaccttcttttgttggcgacaacccaggcccttatttctccaatacaagattcgttactaaacatatcaaatatacattattgtaattagttagttaattacacgtgctttaaagcattttaaacgcacaaatttgaaaatgatggcaaaggccctgattgattttgaccgagacacaaacacgcaaacatagaaaatttaatcagggatttgtactcggttacatagctgtcattctgtgttacgtattaattacggtatttaactaatcacgcacgcagtagatatactataactttacttgattaacaaagctaatagcatccataaattggggtcaagatgtttgaactcataacgagttactttgacatttgtagattgtgtgtagttggtacgaggtctactagtaagtcataaccaaatataactaatcgtagtagactaattcaatttcttacataagtcccaaattttctatacctgttctgcactaatcactcctctcattcttatcaccattggtccattgccatctcttgaatccgtcaatcttttattaatttaaaaaggccacctgctctattgttgacaatagaaggtgaggaaaaacaaaaccaatcaagccaaaaaaagacaacctgtctacatcattaagcaccaaccttatacaaacgtataaatcgaatttttaactcgtgtatgattgactaggcatccttcattttccacatgggccatcctgttaaaagatgtttcattattgcatggattactataataatcacaagaatttaaaaggcacaatcaagtggtgcttttctttatagttttcattggagattgtgataaaataacagagagcaccagagggggagcttgcactcgtcattgtcccttactcttttctctctcaatgctgcagaggcactgacaaacacaccatctttgcttatctctttctctgttttcttcaacgaaatttacatatcatccgtttcttctactcacatatggatcctatcagtctaatagtctaaaagaaagaagaagaagcacttaacttaatagaaacaggatcaagattcataagatctaaagatg

SEQ ID NO: 7608 - DNA, 3000 bp, Unknown
  misc_feature (1)..( 3000): cDNA_ID_1818332_gDNA_ID_1621154_Annot_ID_56959 3000 nt of promoter + ATG
aaagaactctagaatatggtctctaggtccctggtacacaatctgtccctccgacaataagattatatcatcgaatagatcaaacgtctcaggagcaggctggagaagagatataagaactgtggcttctgtgaggtgaacaatctgttgcaagcatttcacgatttggaaagtcgtggagctgtcaagtccggtggatatctcatccatgaacagagtcttagtaggtccaacgatcatctcaccagttgtcacacgcttcttctgacctcctgaaatacctctcatcatgtcatctccaactatagtgtccttgcaaatgtcaagccctagaatctgtttcatagaacaataacatctatctcaacatatgaacactatataatcgtttaatcaagacaattatgtatttaaggttgagagggactcactttgagagtataatcagtgataagactactcttgacgccttgagcagcagaggccttcatgaacaaatcaacatcagcttctggaaaaatcccagcgtccttttctcttcttgccaactcatttaaaagatctgcatcaataacaagtaagattactcaatcgaccaacaaaaacaaaatcgatagttagtttgacaaaaagtctaagattataccgtaacgggtaccaactccttgacacctagcagagaaatcaagagtctccttaacagtcatgataccaacatgaagatcgttctgactaatgtaagcagatgttttaatgggaacaaactcattgaggcgataaccattataggttacctccccagagacgtcaagagacttgtcgagtttaccggcaagagccaacaaaagcgtggtcttcccggaagacggaggacccaacaaaagtgtcatccttgaaggtttgacgataccagaaacatctttgagaatagtaagttgtgctttcttggcaagcctaattccgatcatgcctagagcagcttctcccatgtttctcaccgcgttaagaagcgaaggaagagatctatcaccggtgtaacagtcagctttcacagtcaagtggtcgtacctcacttctactgtcggaagttggatcccaactctgtcgattctgtttcttagctttgtcaagatccgttcgttgtcctgctctgcgactttgaagaccatgtcgatgaacttctgacgttcttcgccgtcaagcttcgtgacgtcaactgctttgttgaggatttggttaccgtagacgtcgtcttcgcctaattcaggcatgagacttgtgcggagacggttgtaggtagggagtttctcgatggaagcccatttgagagcttcttcgtcttcgttgacagatttggttcgtctagagcttgtattgaatatgtcttccatgtttctgcttgctttgcttacactacgacttatggtttgccgcatactcccacctctgctcatagcatgagctggatcgtaatccatctttagatcttatgaatcttgatcctgtttctattaagttaagtgcttcttcttctttcttttagactattagactgataggatccatatgtgagtagaagaaacggatgatatgtaaatttcgttgaagaaaacagagaaagagataagcaaagatggtgtgtttgtcagtgcctctgcagcattgagagagaaaagagtaagggacaatgacgagtgcaagctccccctctggtgctctctgttattttatcacaatctccaatgaaaactataaagaaaagcaccacttgattgtgccttttaaattcttgtgattattatagtaatccatgcaataatgaaacatcttttaacaggatggcccatgtggaaaatgaaggatgcctagtcaatcatacacgagttaaaaattcgatttatacgtttgtataaggttggtgcttaatgatgtagacaggttgtctttttttggcttgattggttttgtttttcctcaccttctattgtcaacaatagagcaggtggcctttttaaattaataaaagattgacggattcaagagatggcaatggaccaatggtgataagaatgagaggagtgattagtgcagaacaggtatagaaaatttgggacttatgtaagaaattgaattagtctactacgattagttatatttggttatgacttactagtagacctcgtaccaactacacacaatctacaaatgtcaaagtaactcgttatgagttcaaacatcttgaccccaatttatggatgctattagctttgttaatcaagtaaagttatagtatatctactgcgtgcgtgattagttaaataccgtaattaatacgtaacacagaatgacagctatgtaaccgagtacaaatccctgattaaattttctatgtttgcgtgtttgtgtctcggtcaaaatcaatcagggcctttgccatcattttcaaatttgtgcgtttaaaatgctttaaagcacgtgtaattaactaactaattacaataatgtatatttgatatgtttagtaacgaatcttgtattggagaaataagggcctgggttgtcgccaacaaaagaaggtagagccttagtgaggattagctgtgattaaattatatacttatacatgctatgatagtatttgattaataatgtcagtaatcatgaatattaataaacactccaccacgcaccaccagctcatatgacttggaagattccccgcggacgggttccctcatcctgtctcgattgtttcaaagtcatttataaatattaaataatagtacagttatatgagtgtggttaaaataaaataatagacggtccaaaaaacaagcatatgggtaataaattagtgagtttaagcccatttatattattattatccattttaggcccattaacccactaaagctcactgaactctgaaggcatcagtgtagtagcaaattagctcaagatccttttcacttcttcttcttcttccttgtgcgctcgata

SEQ ID NO: 7609 - DNA, 3000 bp, Unknown
  misc_feature (1)..( 3000): cDNA_ID_1818328_gDNA_ID_1621154_Annot_ID_56962 3000 nt of promoter + ATG
cataaagcactgtctccccaaattcatcctccagcttactgtagatctctttgtcagtttttccagctcctatctcattacggatcagctacaaaactcaggtgtattagaagagtagacagcaaaactatcttcaacttaatctttggaagaaaaaacggagtaaaggacacacctgtctaaggagaatagcgatatctgcctgcgagtcttcaatggactgacttccacactcagtgcagcgaacattgtggctaatgtttctggcccgagcgtccagcatctgagccttcttcctctcttcgtctgttttctccattgcgctgacaatttcatgatatgagtattgtgagttttcacacaggcatttcgtcgaacactttgtgggcaacagaggctcagagacccaaaacgtaaggaacgtaaattaagttatgaagggagaacctgggtggagaggaagcaagagaactccgagaaaccgcttagttcgttcaacgtggagctcaaaaatgaaacctttcgcttgggaaattactccgtttactagtaaaaagtaaacacccaatcgtcctccagcaataatagcgccgatccttctcgacagagccgtttagagaagatgccggtggatcttcggcgggtgaacaaatcggatccgaatgtgaaatcgaaaaggcgcgtgaaagagcgtgcgactgagagtgtgtccgaagacgtttcgcgcgtatacagtgctcgtgggcataataaacatgggcccttcaaatatataatttgtttgaaattgtaataaacatgggccttgtaactgatagaactatattctatcagtaactgcataaaactcactaagagaagaccaacactctttggagtccaaatgaccaaaacaaattgagaagagaaatatgagatgaaccaaaacaatgaaacatagaatagcgtcaggaaggaacaatgttacagaaacaattaaaagaaaaaaacacattctacaataggagaaagtgagggtgaaacaaaagcaccacactgaatactcatactattagctgaattagtgttggtgatgggtctgctcttcttcttcatcacccgtttattttacttggggtctggagtcatgggtgaataaaggctagagggggcagagccccatggtgccgatcattgatgactcactgtctttctaaatcattttgctatgaaggcagcctcaattctgatattatggaactaggcaagtgggcattatctgtgatgaccaataaagcatgacataataaagcatgacatgttagacaagaagaattgcagtgtaatatttagttatttacattcatccagacatatcataacttctaaattgcacaatctttgcctttctgctaaagagcaaactcaacaacagagagaagccaatctttctcttttcagtgttctgtatatgaattacacaaaagctactaacaccaaatgtttaatctgtatatgaattcgtttgacagaaggagagctgagcagtcactaacaagtaacaacaaactatacaattcaatttgggatttgattctgcaagacctaatagagacatggctactacttgccaacgatagcatttcgccctgctttcttcttgcatttgaaactgaatagcaaaaagagaatcaacggttcgtgaaataggcgcagaaaaagcaaatcgcaagagagaagctactttattggcccaaatcctatttcatccagttttgtgtcttacaggcgatacataagctttgccaccattgccaatggagacaaagttcagacatttaagcaccgcacaatcaacagaagcaacgcaaacggatttgtaagctgtaaaagtctaatactttttatttatatacacgagggaagaacacttctgacaatgtgaggactctcagacaaatccttcaaccaagatcggtttcatctcctcttcttcatcttcatcactctgatccttcttctcactgcttctctcaataccttcaacatctagatccttcaaaccatcaacgcagctcttcccttcttctccttcgccagccaccaccaaatctccggcctgtttcgattcagccaacttctcaatgccttttccagctaaacacggcccagtatccctttcattgtctcctccaacgataatcttgtctgcagtttccggaataggatccgctaaacaaccgtcttcctcctcgtggtcgaatatcgacgctgcgcgagacttcacggcgttagcggctttgcgaaatgcttcctgaatagattccggcggcagagcacaatcctcgagaccggcgtctgcaagtgccggcgggaggatcgtatcgagcaagccaactctttctttcgtagcctccatagatgcagagagattcagagctctcttccctgaaatgtgaatgaaccctaaattggataattaaatcctttttccgaggaaaaggcggtgataagggtattccagtcattatacttcattgttggatctaaattacaaaatagcccagtgttttagtgagcccaaggttcgacacctagcgagatcatatggacttgattgattgcccagtgttttgttaataaaaataaaccattaatgaaatgctaacaacaacgaagagagagaattaaaagatcctcctaccgtattcccgggaacattcgccggagaaacgtacggaatcaacaaccttccccgggaaagaatccattaccgccgattctatcaattcgtataccgtatttgactacccagccattgattctctctccctctcttcccttttcattgtttctaaaccagctcatctttcctgatccggacgtttttcgaagatcgggtcctaattccccgggaatgggtccttaagttctggaagaaatccgtccgctctgtctggtaatttcattgaaggacggattaagcaagcgtgtgtgagatcagaaaagacggattcaact

SEQ ID NO: 7610 - DNA, 3000 bp, Unknown
  misc_feature (1)..( 3000): cDNA_ID_3439461_gDNA_ID_1621154_Annot_ID_56964 3000 nt of promoter + ATG
cagtaggtagacccgcacaaaggtgattaaagggacaacatataaaaacacaaataagacggaaattcagcaaccaatacgcacgatatctaattcttaattctttgaaatgcttacaaccaagaacttctgaaaactagcatccacaaagttcatcgagaaggggaaggagctagcttaccatgtcatctccggatttctaacaccatcttcagactggacatatcctggataagccattccaaaagtcggaaccccaccatgctgaccaccaaattgcataactgcatttcaatttgaatttaattagaaagtaatgcaataatctccccaagctggtacaacaggactccgaaaatagtatatatgaacaaccaggcctaggtggctcggcgtcaatagctttcaatttcaccaccatgcatgatttgaaactgaaaattctttcaactcatccattttacaaagaaaagcgtcatccaaaaaacttaccaggcagaaaagtagggaaattagaattgtcagcagatgtcaaactttctggccgccccatcatttgggatccactatacataaaagagctgcttccaccaggcctgagagtcccttttcctttagcaatcaatgcagctgtttccgatgaagattctatttcatcaggaggataccgatttcttgataagctagttttctggggagaggaagacaatgatctaacaacagcagagtgctgatcaaaaccctggccggaaggtctttggccagtgccttttgaatctccattgagttgcattggtgatgaaaatctgtcaccttgactatgagattgcgggtaaaacgtgttcccagcagcaggtgcacctctaccttgactagtggactgaagagtcttggcagtccaaactggtgaataaccggattttgtattcctatacttcttcccagaaggcgtgacactttcatttgtgtggagtctttccatactaacttgtataccatgtaccacattactggacggcgctgaaggataaaatggaggagaagcggaactcaaacttgacacagctacattctttttggcatgggcaccttgattctcagttttagcaggggcagttggtgaacgccgtgaatcgaggtgtggcattttctcacgagagttttgagacccattagaatttcgtaacctacaaattcagtacacaagtacattataatagagaaaacccttcactcaactaggggattttttttttaagaactcactgtttgctttgctcagaatgtgcttgattttcattcctcaggggagtgtcggatttcctgggtcctctccctcgtgagacagctttaggaacataaatttgctgtccactactggttaatgtgttagaactgctccctctagcgtatccacgcccttgtcccctaccccgaccatgacctctgaatcggcctctagacatcctctgctgtgtatcaaatgcagtttaagaaagaaaggaaaaagataagagacggaaagtgcataaatacaacaaagctaacatatgtcacatgtacatgttatagcaattaagagataagaggaatctaaaattattctaaaaaccatagacagaagctttacatcagaatgtttttccccagtattcatctcttcaaatttgtcatgtccccattttctttcctctccagagccccactgtcttctcccaccacgcattcgcctacgaaagcaagataaagaactatatcaatcgacagatagaaggtagagaggaagagctatattcagaaaaaatcatatttcccaatagtatgaactaagcaatccccaatgcagctactcaaacccctcatgcttgataaaattgcaagataataagaggtcaataactccaccttagagtcaattatctctcctctaaatacaatttcatcctaagttaatacctactttgaaaaatccaacccttgcataataaggttgagttgatacttgatagcttatagtgacagattttgaagcagaattgattgagaaagctgtgaaaaacaaacacagtaaagagagtaaacctgtttccgccagcagacatttcctgaaacctatcatcatgcatataaaaagctccaccagtgggaacagcagcttgtaacttctccttttcattttcttcctctccattcatatcaccagcctccttcaccacaccactcttatcattatcgattcctccaccactttcctcctcatcatcctcataactatcctccccatcttcgtcattatcatacttcacagtaccaacttcttcatcagataggtcagaatcaaccacagccctctgatttttcacatctctaacagcatcatcatcatcactatcgtcatcactcgcttctctcctcctcgtcgccaaggagcggttcagctcctcgggatcactctcatattccgcttcagatgtcgccatgaaattctctctagaaacctgaaaaaaaggagagtggtactcgtaaatccaaaacctagatgaagaagaaattcaattgagaaatcgaaagagtcgctcaagcgctccgtactaatcgactatgtagaagaaagctcgcgcatacctataaaccctatctgagctcgagaggcgttcttcagcgattttgggggtttccaatgaaatcgaatggagccagaccttttgttaactgttaattaatcgattttattttgttatttcgcgcattaaatataacgactgtgacctaggttgacccaaataaaggtatttaacgggcccaaaaagaaatttgtaggccttttaatgggccatacactttcagagcccatttaataggttgcgttgttactacgaactcattataaatatgaaccgtagccccaatcagagagattcgataccgtctgcaactctcagctactttttccccaattttgagctcaacatcgaaccctagctcaacgaaccaatcatg

SEQ ID NO: 7611 - DNA, 3000 bp, Unknown
  misc_feature (1)..( 3000): cDNA_ID_1818324_gDNA_ID_1621154_Annot_ID_56965 3000 nt of promoter + ATG
ctggttctgatattacctcgagtcaactggcatacagtatatataatatgagtagtgagtggtggtggcaatgataagtaggggaccaattttgaacactgcttatcaatgtgatgacgattgcttacctataaaagtggacaacacaatcaacaagatgacaccttcttaaagtctgacactatcagcttgcttcttcaactactacatgccactaaatcaatgttaggtttccttttgagatccctagtgacataaatatggttatcttctcaaaaaaatgagcagcaagaaagatgatgaaacctacatcaaaatcaattcagagagttggtcgtttcttaaagaagactcttgggagcatcaagtccactatctgctctagtgattacaaaaacttacctaacgacactcctctcttgagcccttactcctgcagccgccgctgtccagaagattcccaaacccaaaccaaagaaagctacaccgttatctgttgtgacacggctgtggcagatacaacacaccagaagagtctcaacaaccaacataaaaagaaaccgaagaaagtcgctgagccattcgaggatgcaaagaaaagaggtgacgcgttggcgcaaaagatgaaagatctcaatatggtggatctgagagacgtggatcacgcattggatgtaagggaagcgcttcgatgctattcaagcatcagaagtcctgtgtatcttgacattgttgacaatttcttcacagacatgtattacgagttctctgatcctcgtacctctgctaagatcaacggttcaaggagaaaggcaggctccttcaggctttaaagttcctctggatcagctttgctttcacgggctatctgtagttctttcatctatagagtatgcacttcttaagaacagtgttaaccattacacacaccgctttggtaaaatcacctgtcaccaccctcagtttctacctcatcttgtagagtcaagttacgctcctattctcaactactatcaatgcaacatattttccacttcaagttatgacaacttacagtttataatactatatctgaagatagagatgtgacaccctactactcgattcttgacaaaatgattttagggtagataccacttttctttttcatgaaaaaatggagaaagcaaacatatgtatggagaagcgaagttactcttctcgaattatgataaaaagttacatcaacacaggattatctgtttttttcacttgataaatttgcattttaaaacacacttcatggataaaacggatcatttcttgccactcttcttaagtccagaacctccaaaggatcccttctgcgatgccttggctctaagctctttaagggcctgttttatcattttcattcaaaacaaaacaggtcaggctttcggtaacaaatgatcactgtacttctcatgcgaaagaaaggctaatgagtctttcacacaattgggtggaaaaaaagtagactaaacatcctaacatgggcaaatggtcactatttcatcaaagtaagaagaaactagtccatatcatctcaaaagaatctgtaatgaatacccctaaactaacaaataattaatagaaatgacccatctagttgtagtcaccagctataaagtcataattagagtcagcttgattagtagaccaaactgacaaagtggaacatattaatgcacaacctttacaaaacctttacaaacctatgtatctaaacagaagctctcttgtgaagatacaatctttgattcgtattttatagctttccattgaaagaggagcccaaacatataagtttaactagatgcatttttccaatcacaaaacttcatatgaacaaaaagagaaaacaagtcagagcatcaaagtgggaactcaccttttcctcatctttcttcttctgaatgttagctaagtcagtctgcattgataccaaatcaacatttcagcaattagagaatgtctaagagtcattaatacacaaatagtatgcaaacaaaatcaagtgaagaagtcaagactgtgcccttaaaaacactggatcaaaattcgaacttgcgtataaatcattgaatccgagcaaaattaatgatttatgagtcactgaatgttaacaaattttaagaattcaagttagttggacaatcaaaaccagatccagagcaaaagcatcgtttgattcgaggtctaaagctaacaatataagccgatttagctgaaggcaaatcaacagaaaatccaactcttaaaagaaaaaagaaacagtagagtcacctcgtcgtattccttcttatcagctttaggctgcttcaaaggtttcgcctttcctcctgtttaaaaccaaaataagatgagcagatcgtaaacgatgtctctaatcactttattcggtgaacgaatcaccaactcaaatctctgtataacagcaacgtaccttgcttggaagacatgattggttcgttgagctagggttcgatgttgagctcaaaattggggaaaaagtagctgagagttgcagacggtatcgaatctctctgattggggctacggttcatatttataatgagttcgtagtaacaacgcaacctattaaatgggctctgaaagtgtatggcccattaaaaggcctacaaatttctttttgggcccgttaaatacctttatttgggtcaacctaggtcacagtcgttatatttaatgcgcgaaataacaaaataaaatcgattaattaacagttaacaaaaggtctggctccattcgatttcattggaaacccccaaaatcgctgaagaacgcctctcgagctcagatagggtttataggtatgcgcgagctttcttctacatagtcgattagtacggagcgcttgagcgactctttcgatttctcaattgaatttcttcttcatctaggttttggatttacgagtaccactctcctttttttcaggtttctagagagaatttc

SEQ ID NO: 7612 - DNA, 3000 bp, Unknown
  misc_feature (1)..( 3000): cDNA_ID_1818320_gDNA_ID_1621154_Annot_ID_56966 3000 nt of promoter + ATG
cttcagtgtctctagcttcgacaccattcatgctgattgtctcgctatgtttctatcccaaaagcagaaaattttggacattattggagagattcctgggggagttaatcttacagtagacttgtggtcatcaaagcaatcagtggcttacgcttttgtggcaggacactttgttgataaagactggaatttgactcaccgccttctaaatgttgttgttgtggcttctcctgattctgattttgcgttaaaccagcctataacagcttgcttatccgactggaacttggagggaaagatttcgagcatcgctgtcagccaatcattagtaaataaaacctccatcgacaatctcagaggtttcttgtctttcaggaaccagcatgtgttgaatggtcagttgttgatggggagatgctatgctcgcatcttaagcagtatggcgcaagatgcactcacagctgagcggcttcaagaacccataaagaaagtccgagatagcatcaagtatatccaaaccaacgaggcttgcggagacagatttgatgaactgaagagacggtttccatccccttcgctttacaaagatcttcttattgacaaccaaacgagatgggacacaagttacaatatgttgttggctgcctgtgaacacagacaagtgttttctagtttggaaacctgccatcctgactacaaaatatcattatctcctgaggaatggaaaaagattgagagtctttgctcatgcttgaaggtacttgtcgaagcgggtaatgcattgactgggccaaacctgttgacagcaaacgatttgtaccatgagatgacaaagcttcagctagatctgagccacgctgccccgggtgaagacccggatgtcagaaacctagcaaaatcattgagggaaaaattcgaccagtactggagaggatgcttccttgtgttggcagttgcagtggtcatggatcctcggttcaaaatgcagctcattaagtttacgttcaataagtcgtatggtgaagatgcagagaaatggaccaagtctgtcgaagatgcagtccatgatctgtaccttaactacagtgaacagaacctgttggatgcttatgtggatcatggcttttcggaaatagaggtggctcaggaatctcacttccatcaagacatggctgaagctgccaatacagggaatggacaatcatatgatgagacaagtccacaagtagaggaaaccacaaacatggttgaagctgccaatacagggaatggacaatcatatgatgagacaagtccacaagtagaggaaaccacatacatggctgaagctgccaatacagggaatggacaatcaggtgatgagacaagtccacaagtagagaaaaccacagacatggctgaagctaccaatacagggaatggacaatcaggtgatgagacaagtccacaagtagaggaaaccacagagtcacatcaacatgagagacagcttaaggcagagaagcagaatgtggtagggatttgggagggagtgagtgaagagagtcagctaacagaagaggaccaacaacgtggtgatgattctcaagcacacgcaatggtagaggaagaccacacaacatttccggtagacgtgcttctcgaggaagggtctaccctcatcacaataggagagtcattgtcagacttcgagatgtacatgacagatatgaatacggagctggatcaatacttggaagaaaatttgattccgaggtcagaagactttaacgttctgagctggtggagggtcaacaacaccaactacccaactctctcaaagatggctgtggatcttctctcggtccccttcagcaccgtctctcctgattccgtattcgacacagaggtgaagcagatggacaattacaggacatctcttcctggtgaaaccttggaggctctcttgtgcaccaaggactggttaaaaaatggaactttatgaaaaattgaaaaggttccaattctttctggtttttttttagcttagtgtaatcatcattaaacagtattgaaattagttaataaaaaactttcacattactaagaaggcttgtttgtgtctcctaatctctcaaatctcaattttgtcccacgcacgcttggtactctctacaaagggaatacttgagggaggaattaaagtgtaaaatgaaagcttggggatctaattataatatcattgttcctacactcatttagatggattctgaatcaataataggtgaacaggtgggtataatatctgtggtgttgacatcattttacaattgatcaatttcaaaaatttggtgtacaactttttaaaggtttaacgttgtaagtatcgtaagaaggagaaagggagtgttataactcgtgctcatcatgtgtatagagacattaagtaggtgtggtttgttaaaaaaaagacaattgacttcgagtgggtgaccactaaaagcacactgcagtgagcagacgattcgaaccgttgattgttattaaaagaagcgtaaacaaacaaaacggagtcggacaaagaggtcagtgtccccaccaccactctcatagttgccacgtgggcgaatctgaaccatcacctcgtctcggtcgaattgcatgagactgtgattggagtattgttattaaaactttaatgtgaacatcaaaatcacatgtaacgttctaataagagatagagatagaaaaaagagatttggcgttagcgacaaggagaggccaggattggttataaatctcaaaaccaaagtgttaaccccatccaaaacccttatcctttttttctttttgttatatatcttctcttcacctttctttctcaaggctcaagattcttgattgctctgctgctccaaggtacctacctacctctgtctggattgactcactttttattactctttagatagtgatctcttattgtatatgtgtgtgtaattggatgaagggggatcaatg

SEQ ID NO: 7613 - DNA, 3000 bp, Unknown
  misc_feature (1)..( 3000): cDNA_ID_1818288_gDNA_ID_1621154_Annot_ID_173419 3000 nt of promoter + ATG
tatctctcacgtagcacactgagcaaaaacccagagagcaaggggatataggaaggaggagatagagagacgataaggtgactcgctctgggtagagaggagaagagagttgtttattagacagtgggagtgatataatatctgcaatgggaggattttggcattgaggacaaaaaaccctaacagggcggctcttaccgtctaattatgttcgaagctgataatccttgtaattaataaaattgaattggtctgaatattctgaagatttttgtaatgacgttcacatatttcgtcaaaatggacttaatgattagtattaaaaaaagattagaattcgtgcattgggtactttgatatattatgcaacttgagtaaactttcctcattataaatgtatttttgttgagaattaaggcatgtattattcctctaaagacaacgattttatatgaataaaaatctctactggcgtgcatcattctcttcctctactttatttactagaattattgagacaaaagaaaatatattaatatatgagaacttttgtgtttagtagacttaaaccagcatatttgatttgcagaaatgtatgttgaccccaaaaaacaagaaaatcatgagcatatatatgtattactaactttaaatcagtttgatttcaatcatacttagcaaatatggcaagaagatgtctagtcattttcgaaatcctagtaattaattagtatgagtatatctaaaatccaccggtaacgtatcaaaatttgattttctattataaattgatggggtattagtttagcatagtgattactgaattttaatttgattttcaatcttgccatgcatttatttcttttaaaaaaaagaagaagaagattagtcctaagtaaactcagctcaggaaacaaagagagatctacaaagcaaatgaatcgataagttgttgatgaaaacgagggagggctttgataaacgtgttaccaacttgggaaatggctccaatggagtgttgttgggggactgtgaagatccccttcatcttttccctcaatcagaaaaactccaaaacaacaacaaaatagtggggctcattcattttgatgaattgcgtcttataaagctccacgtcgcattaaaatcagcgatatgtcagattcagaagaatacagaggtctagtagtaataactcacgtgaagcccagcctccttcataaattttaacatattgggctttctattataaacccaatacgaagcccataacgttttccttcgcggcccatacttttatttaatggacttatataatttataaatagggttccaaaacttcagattcttccaaaaactatgttggcgaaatcatccattttcaaacaaattgttggcgaaatgatacaatatacattcaattaccagaaagtttttgctttggcttgttgttgggtccctctaaaaacggaacagtttagataattagataaagagatttgaaaattgggtgtgattttgatatccgtaatatgtattaattttctaacgatggtcgtgtaaacatgtcatcatacgactttattatggctttttgggaccatgtggttattaatagataaaatttttgttgtgcccttactatgtttctttattccccgaatttcctttgttaactacaactacaaaatacaaatcaacagtattagtaaagttacttatcttgcaccaaaatttaccgttttcacattaaaaatatttacggttggaaatgaaaatgagatggcattaggtcctaaatggaaatattaattattaccgtcttttccgtcgacttatatatacatgtcttatattaggaaattaggtaatatattcggatatttgcggtattattttctatactcgctttattaccagcttaactaaagtggacaatgaatgtttttttttttttttttttggcatcacgatgaacaatggtcaatgaatggatctatctatcatacaatgtggagaataaaaagtgaggtcaaagtttcgttaattacaaataactaatttcttaatgctgtatttcatgctcaattagtcaatttgaataaagtgcgaaaactctttcggcctcgaatatataatgtttaatacacttaaaacaaggggtagaattgtccaaagaaaagattttgacagcagaccgagcagagacggctcagagtcagaccaagttgtcaagtttttctatattacgttttgttgttgtgtaatgtgtactactaatttcttttctttatgaattcgtaaacaagagaaattaaaatacagtaatcactaatcactgtctattacgagactgaacaaattaaatgcatgtttaattgagtaaattatatttagtcaactaatatagtaattcttaaaacactgaggagtagtacttacttccttatatgtttttttaaaacataaagttaaaataaaataacacgacgtgcaatattaatgtaattaaaaaagaatggttgaagaaagcaaacaaacaaaaaaaagaacagaagaaaacggaagtttttgtttctggagagaaaaccaaaaagttcattttgtttttctctatttcgtctttcctgcgattctgaatatcactcttcttcaatctctttgtcagaatcgtagcattggcttgtgagctttgatccttctttctttttttcttcccgtttgtgaaaaaagagagactagtatttatcatcgttgtcaccgccgatctgtcgtcggcagatggcaaaaccattacttttacctccaattaataacccggattcgttggattgttggacgtctctgtttcttctatctagtgtttcaactccggcatagaaaggatctgatttggttaatctcagagccctttttgtagacacattgtaaaatttgaattggtgaggaggagttagagccgtccgattggggtttgacccgattgaagcggagaggatg

SEQ ID NO: 7614 - DNA, 3000 bp, Unknown
  misc_feature (1)..( 3000): cDNA_ID_1818292_gDNA_ID_1621154_Annot_ID_173418 3000 nt of promoter + ATG
caaactacatgtatatatttagtcaatcttgaaatttaaaaaaatgcctttgctaagaataaaaattatggttaggtgaagttctcacgtaaaactattcaatcctcacgcgattgaggagtgactgaccaaagtttatttctataggggcaatttaataactattgtaaactttcaacgtaaaaattaattactttgaagttatggggcaatatcatcaatagtaataaatataagcccttactcgtaaaatacaaaaggtttatttgttttctgaattgagagcgtgtaactactaccatcgtcgtctccgcgagttcttctctgcgtttaagccatagataacaaaccaaactaaaaaaaaaaagtttctccttttatcattccttctcttcccttgtataggtgtgatcctcttcaaggggatttctctggcgggtcatacattcgcaccgatcaaagtcggattggtctttcttaacgcaatcttgacccgattcaaaaaatttctggtatcctttttaagaaatgaaattaattgattccttgtcttccaaacgagtaaatcgactaattgattagattttgttcattagggtttgttagtgaatagataagaagataaatgggagctccgttagtgtgccacgggcattctcgtcccgtcgtcgatgtggcttatagtccggtgactccagatgggttctttctcattagcgccagcaaaggtatgatcttcgatcgatttgtatttgactatctatgatctttacttggaactgtgcctattttggattatgatttgcatagcgaatgtgctttgacgaatttgattttgctgccttttattatatatcgtctgaagtttgatttgtggctgatctaatggagaaattaggatgataagttgcatacattgttgaactctagctgaggtttctttgacttttgatatttcagattcgaatccgatgttgaggaatggagagactggtgactggattgggacttttgaaggacataagggagcagtttggagttgcagccttgataaaaatgctattcgtgctgcctcagcttctgctgatttcactgcgtatgttcttcttctttcttgttgcgttttcaagtcttttactttaccatttagtcttgcaatttcagtatcctccggtgatgggttgtttgcttaaagttataagttatggggaaactatgttcctagagaaaaatggttaagtgagaatagattaatgggatttaacactatttctttgttttcatgacacatttcaggaaaatatggaatgcattgacaggagatgaattgcactcctttgaacacaagcacattgttcgtgcatgtgccttttctgaggtaaactgtagtttcttcccaagcaaagagtgatttgatcctgttgccaagttttctggtttaaggatataatggtgggattcactaagattacttgtagcatttgagggtctataatcgttggtgtcatttgtgttactattgtggtcttaatgcataactatttatattctaggacactcaccgtttactcactggtggaatggagaaaatacttcggatattcgatttgaatcggccagacgcacctccaaaagaagtcgggaattcccctggttcaattagaactgtcgaatggcttcatagtgataatacaatcttaagctcttgcacagataccggtgacattaggtatgccaccacgtcgttccttgggtttagactcagtcctttagtattcctggtttcattgttcttttgtgtatgtcctctgtaggttatgggacataagaagtgacaagattgttcatacattagaaacaaagtccccagttactagtgctgaagtaagtcaggatgggcgatacatcactactgctgatggatctagtgttaagttttgggacgctaaaaagtaagttaaaaatatagaaatgcatcctcagttacagttttatcgtttttctttgatggttgagctttttctcctgctctcctagttttggattgctgaagagctatgacatgccttgcaatgttgaatcggcatcgttggaaccgaaacacggtaacactttcattgctggaggagaagatatgtgggtgcacaggtttgatttccagactggagaagagattggtaagtttcttttaaaaaagaatgaagttttcattttaggaacctgtgtgtatcctttaaagccaatgtggtgaatgtagggtgtaacaagggtcatcacgggccagtgcactgcgtgaggtatgcgccaggaggggagtcatacacctcaggctcagaagacggaacggtcagaatatgggtggtgggttcggtaaaccatcctgaggagagcaatctaagcggccacgtgaagcttgtggcagaggaggttgtgcgtaaagctgaaagtctccgtatcagtgagaaagccgcagaagctaaatgaaacaccatcgttagcttatgatatcacatagattcatagttgtttttgcatcattataagatgtgacaaaggggttttgccttttaaaagtctctcagaccgaataaaacgaaataatcttcaactatacttgagtgaatagtgaatctaatccaaattttgacaagaaactttacaacggtatcaaaaatatctttaaacaactgtatgtcataaatagttgcaagttttgaaagcccagttgaaactagaggggcccagaaattaagcaaacatcaaatagtcaaatacaaagaaagtgtgaaagttaaaaccctaaacccttaatttgagctctctgctctcctggttttagttttcctctatttcgtgctcaattcgcttgttctccagttccactctgtaaggatctgttacttttctgtaatcctctcaaaattcaatgcttttgcttactgggtctgatctttgcaagtgaaatgcatgacatttcgtccaaaatcagaccttgcaaaa

SEQ ID NO: 7615 - DNA, 3000 bp, Unknown
  misc_feature (1)..( 3000): cDNA_ID_1441174_gDNA_ID_1621154_Annot_ID_173417 3000 nt of promoter + ATG
tcaaaatatcaaaactttgttctatgtttgtgtcagatagtgattatgtaagagtgaaaccagtatttaagtacccgaaaccagaacggagaccagcgacccagtcttccttgtaacacaaggctcttcctctaagatctgctactatacctctgaatagcctcttcgagctatccactctttcttcctccatatccagaatccctcaaagactccagaactcgtcgcctctggtctactctttatatgacctaaaccacaaaaacaggaagctatatattatgtatgacatctagcaatgactttaaatctagcattttgctgactacatttaatacaaaataatcttcatattatatttttctaaatttgtgacgattccagtctttttccacctctcaatagaaaaagaagcttatagctgttttatcttttgttacttactagtaatgtcaattttctatgcttttatatgaataagaaaacgcaatgtgcccaactcaaatagagaaacatcacaaagcacataaaacaaagcaaaacgtaatgcaaaatttcttcttatgacaaagatctaagtctcctcgtctcctctctcataaagtgaaatttgaaattgcatatgcacccaaaaaaaaaaaaaaaaaaaaagaatccaactttttcaataaaatccattaattaatatccgtcgtatattgaatctacacctttttcatagttttgacaacgaaattagcagtaacaaatcctttcacatctcacaaaaacataatcagacaaaagaaaggattaaacaaaatcagacaaaggagttaacatgcaataactcggaaatttgaggcgtaaggaggagcaaactaccggcgacgaaagagaaaaggagaatagccggagccgagaagtaactgtgtagcgatttatagggtttaggaagatttataggccaaagacgaggcaacgttagcaaatggagagacagggcccatttatacacgtattatgttgggcctacatccacatgtcagtaatcgagtgggtgattctgacatctgtgatcttgacgctttaacactctgtctgttcttttcgtataagaaagtgacatatatatagagaggaacaattcatctaaattaaataatttattattgaaaattttaacttaatatagtttttttgtataatgttgtttcctttagtcttcattttttcttaagttatttccattttaaaaaacataccaatatgttatattctttgcttaaattgctttaacctgtatctagaaaatgtaatcttccatattgttaatttcataaataaaataaatttttttgcaagttattggaaaacgaagttaaaaattaatgctgcaccaagtttgtgaaattttaaaattacttgtagttggagtgggtgtagatgtttatgtgtagaaataggcatgcacacacaatttaatatagtcctagttacttatacaaaaaattcactgctgacgtgatcagtaatgcactcatatatgcatatatcactccacgtcaatggcacttgcccgtgcaaatgcctttattgtgccagaatcttcgaccggtcaaattgcgtgtgtgtgtatatatcgaaatatatgttatcaaaagagtttgaactttgaacccatatctaatacctgagtaaagttttagcattctattcaaagataacatgtagtacatactaaacaaactatatgtatcggttgttatcaggaataataagaattgtataatgcaatatataattaagtggtacttatgattaatacatacacatggatggtagatcgggatttgaaaaaccaattaaaatctagctttgaaaaggactcgagattctaaacgccgtaccaagaaagttcagattattatttcatgatgaatcattgagtcaaacacttaagcatcatatttttaatttcatagtttatacgttatccacatatataatattaattccgtcgacgacagtatttatatcagaattaggacaaactacatgtatatatttagtcaatcttgaaatttaaaaaaatgcctttgctaagaataaaaattatggttaggtgaagttctcacgtaaaactattcaatcctcacgcgattgaggagtgactgaccaaagtttatttctataggggcaatttaataactattgtaaactttcaacgtaaaaattaattactttgaagttatggggcaatatcatcaatagtaataaatataagcccttactcgtaaaatacaaaaggtttatttgttttctgaattgagagcgtgtaactactaccatcgtcgtctccgcgagttcttctctgcgtttaagccatagataacaaaccaaactaaaaaaaaaaagtttctccttttatcattccttctcttcccttgtataggtgtgatcctcttcaaggggatttctctggcgggtcatacattcgcaccgatcaaagtcggattggtctttcttaacgcaatcttgacccgattcaaaaaatttctggtatcctttttaagaaatgaaattaattgattccttgtcttccaaacgagtaaatcgactaattgattagattttgttcattagggtttgttagtgaatagataagaagataaatgggagctccgttagtgtgccacgggcattctcgtcccgtcgtcgatgtggcttatagtccggtgactccagatgggttctttctcattagcgccagcaaaggtatgatcttcgatcgatttgtatttgactatctatgatctttacttggaactgtgcctattttggattatgatttgcatagcgaatgtgctttgacgaatttgattttgctgccttttattatatatcgtctgaagtttgatttgtggctgatctaatggagaaattaggatgataagttgcatacattgttgaactctagctgaggtttctttgacttttgatatttcagattcgaatccg

SEQ ID NO: 7616 - DNA, 3000 bp, Unknown
  misc_feature (1)..( 3000): cDNA_ID_1818304_gDNA_ID_1621154_Annot_ID_173412 3000 nt of promoter + ATG
aactacagaactctattgcctgcactgagatcgttgcagaaggcgatcaccagagcccatcaggatctggcagatatgtgttcttccaatgagtacacgcttcgctacttgtgttctgttccaaacaatcattgattatgttttctgcattatgtatcaccggaaattttcatcttcctttttcggttaaacaaattttgagattttgatatatgagtttctaacatctgaatacaaaatggagcaaagaaattaaacagtttgcaggcaaccataaaaagtacgaagaatgtgaataatttgatttaagcagagatttttgaataggcaaaagatgatcctagctatgaagacttcactaacagaagctaacatacaaacaatattaaatttatgcctagaacaagaactgatgtcgctacaagaacattacattatgataaaaatcaagagacatcaaaacttttggaagaattcctcatagactctggcactcagaatcttcatggcgtccatctgggatacatgggggcatggaactccagacggggtatgtgagccgggtaattgtcggtgcttgcacggctctccatggacgcaccaagaaacagattatgcaccaacgcatcaaagttgagatcaatcatgggatgacgatatggaagctgatggagagaagtcgccaacaatctctgttctgcatcccatctctgacgagcgttgagcatttcaatgtactccgcctctctctccaactgctcccacatgtgttgctcccaagggtctaactttggcggtgtaaaaccaggatgctcagttttcaagtgatttttcagctgcgcataggtccctgagaaatcgcacttgtcaacagtacaacacctcggtctagcattcatgaatctccgagcacaagtcgacttcatagtcccctgaacctctcctctgcagtagggacaatgtagagtcttgccactacaacggcttgagctgttgcttctgcggtactgcttgaaacaattggagtgacgagcgcttgtatcacacatgtaagcacgacatcctttggagaaagaagagcattgcaagaggacagcattgtgaggaggctccatacaaatcacacacctcacatcctcccattcactaacactctctaactcaacaggtgacgacgacgcctcgacttctttttgtttcttgttcctgcaagagcgaagcgggtatggcgatactctatttctgttgctagaaaccggcattttccctctttccttgtgcatcccacacactgaaatcaatagaaacgagtgttaattcacacaacaaaataacacagatgaatatgaaagccaaagaatccataatccattacatccgaatagatacaacccaaatgttaaacaaagatcaaggaaacagaacaaggacgagctcaaatcagtctatattgtacggtattcgagcatgaacataatcccactgaaaactacattctcagcagatgataatcaaacaagaaagagacaatttttttttaatttattgataaaataaattgaaactattaacttatcggaaacagttctaggggttctcaatcatcggatcaacgcataaacattcgattcatcaggagatttcaaacgacgaaacagatcaattcgattgcaattcgataattatcgccaaagaaaagaaaaacaaattcaaacgcgaccagaaatttctgatcacgaccacaaaaaccgcaaaacgacagaacatcatcggagggatcgagagagacccaaggagtaaatcaaatcacagccataagaagagaaaaagaaaacggaagctattaaatacctctggccggagaaaattaaaagaggcttttctttctttctttgagagagagagaaaagtaaagagagactcctcgtaaagagtttcgtatgaaacggtgaagatggatgcgcgtgcgtgaatgtgagattgtccgggtggtcatggttgggtttttataggcgtcgagagcacaagatatgtcttttcaaacatgaccattataccccttcttacatcttttttgtaataagtccacccctctctctactttcctttcccaatttaaaccacatttgtctttttgactttcttttgctctttcctttatttgtttttccttttaaacggcttccaaagttttttttgccaacacttatacgtgtccttggcagaaaaatacaaataactggatatcattctttttttttccttcaatagagatgattactcatattttgtttctctgtaaaaaccaaataaattgtaatgttaacttttggctttttcaggtttatattctttctaaatttttaacaaaattttcaattttcttatgcccaaagatatgcttctctaatctctgtattctaagaaaataaaagtttatcttccttaataagtggactgaaagaaagaaaatatgtattttttttttagctgtcatatctatgtatatacatattgtatttttcttctttttgatgcatgtatatacatattatctattccatttacgtgcaattacttttctagcaaataaaagaggtaaaaacacataccacaatcctaatcccaaatcttgccagttgccactattatgcagtcaagtccaaggtattagaggccgtgtcaatatcaacgacagccttccaactataatatttcaatctttttcttagtaaaacaagtataattattgaggaaataaaatatgaagaagatattggaacagattacacgagcccaactattgggttaagtcggcccaacaaataaaaaaaagcgtttcggttcacccaatttagacccgacccgtcgtagcttttagttgttgtgtgaactgtcaagttgttgcggctagaagtagaagaagaagaaccctaactaaacccaacgccggcctctctttctctctctccccgcttctctcgtcgatcgctgaccatg

SEQ ID NO: 7617 - DNA, 3000 bp, Unknown
  misc_feature (1)..( 3000): cDNA_ID_3050909_gDNA_ID_1621154_Annot_ID_173410 3000 nt of promoter + ATG
aatattataacttgaagacagaagatattagtacaattaaagacagctattctacaaatggtaatgtgatgttatgcttactccggacaagacacggtgtcgtagccgtttaatgcggcggtgaaacggccctccccctcggcgggtccagtaagtatataatttgagatacgaatattaatattaaatcaaaacatcacatcagagccgtctaattccaatcaaagcagattgatttatcttttcttggtcacgatccgccgccttctctgccagattcgaaaccctagaggattagtcagtgagccatcggaagggacttgaacgttgtttgatttttctcaaaatgttttatactgaaatcacttaatcagataattcgccaagaaggaagaagaatcaccaaatcggaaagtttgattttgtacagaaatgggaaattgtccgaaaacaaagaaagacagataatttacaaataaccagagtctgttgatcaaatcgaaaaatcaaatttaaagttttttataacaaagaacacacacatacaaaaaagaagaagaagaaagatgaaagacagtgtatactattttttcctcatgaatattattaatcctgacgcctacctcgatctacgtttcggcggccttttcctcggattaactttcttccccggcggattctttccaaacgcagagcaacaaccgcatgacgaaattctcggagacggcgggtccactgccggagaaactcttccggttgttctatgatgtcgttgagctcctccaccgttagatcgactcctctctattcctcctggtgctcctccaccggttttaatcggtctaagcttgtctttctcatcgattggtttgacctgttcagagctttccgacataggcttaggttgttcgtcgcgttgactttcgtctttctgctcgttgtttcccgatttgttgagttcggcgatgagacgatcgtcaaacactataccggaagatccctgacggcggaaagagattgttgatctttgaagaccctccatggatctatctctctctctgttgatgagctaaaagaagggcaaaactaggaaaagtgagtttaggccttataagtgattaatcaatcattgtgtttcagacttggtttccttttatttctgtcctcattattttttcatggggtcggtccactatttattgtttatttttatgatgatgcttccagtttctatttatttctttgtaacaacaatcatcggaaattaatgtaagcggattaacgatatcattcaaccggattattcaaacattaattgtaataaaaaaaaaaaagtaaaaaccattactgttattgatgattaaggcagagaattacatgttaattttttgtttgttttcacatctttaatcggattctcaacaccacataggcacataagtcctcttatatccatatttgttattttattccaaacttttggtttctttaaactcaaaaggggtaagactttttgtaattactattgttttatcagcaaattgcaaggattagataatagattagaaatgaacaggagaattgacttataggacacactaatttaatatttccttcttccccatttcggtaaaccaaatagactatttccttcttccccatttcggtaaaccaaatctattaggtgaggatgttattaaaatgccaaatctctctttataaaaacttgaaaggaaaaacaatacaaagtggtgaaagtgagtcaaagtaattcggttaccaatttgtattcaaagtcaacatcattgtactataatatggtataacttttgttcaataattcaccttcttatatcgtctgtttcttctcaggatcaccactaactaaaacatacgcatgtggtgggtttagcaaaactgtattctttggattaaagtaatgtgcataacacaaattaataaccccgtctgagttggcacaactcaccaatgttgaagattgagataaagaatttgggcccaatcgccgaatagaagtctatattcattactctcaggcccatccataaatacaattgtcaaaaagaaaataaaaaattggtggtccagctgggaacgagccagcaggccatggtgaatctgagtggcgtcgagctgtgatccgtccactgctgagagcgggaggtgatcgctgctctgtgaaaccagcctcacgcattgccctccactgcaagaaccgcctgagccaagccttcgcttaacacacacggatcactctcagcttggactgggcagcccggaacaatgccacaacagatccgacccgtgggccgagccagtgttccaccaacttattgtccccacacgggtcacaagcccacgttactgagctcgacgtacaagtattgatttaatttcatatataaagtaaaacattttgaggtatgtaaccgatgtgggacaaaatacaagtttgggcttcccagatcccacatttggtggaacacatatataaagagtctcttcgttgattagcttcccagatcccacatttcaggtaaaaacatcgtctgggctctttgccattttagcgaatgtggaaaggtgtggtttttttttgctctgctatggattttttttttcaaatcagggtttctctgttgaagtcatatcaggagcttgacatttgtttgtttgggaattagaagctagatacgtatattatatagcatcgtacatatcaaattttggtgtgtgttctaattgaatctgtacttgtttgtgtgttagtgggaggagctcttctcagaccttaagactattgctttagtggaatgcttctcgtaaatgtataagtgaggaaagaaactccattcgtatctatctactaccctaagccgtttatgcattttctgtccatcagaagatcaacacctgtttctggaggattccattgatttaagggattagatggatgatggaccatgtgggattcagtag

SEQ ID NO: 7618 - DNA, 3000 bp, Unknown
  misc_feature (1)..( 3000): cDNA_ID_1010722_gDNA_ID_1621154_Annot_ID_173406 3000 nt of promoter + ATG
tgaaaccaaactaacagcatttttggggtatataagtaacagagaggttgttgtgcaggtcggtttatatcgtgtacacaatgctaggggatgttagcatcttccttgttggcaaagacgagtatgatgaacttgcttgtaagcctaacctactatttctaaaataactgatctctgtttcattcagagtttgattctttgttgtgttttttctcgtggtgcagtggcagaaaccatctatatcataacagcggctgtgaaagacgtatgtggaaagccgcctacagagcgagtgtttttggataaatatggaaggatttgcttgtgccttgatgaaatcgtttggaacggacttctggagaacaccgacaaagacaggatcaagcgactcatcagattgaaacctccttctgaagtttgatatgctccaaccaaccacacattcttcttctactcattttaagagctttctcattctccaccgattgttgtttgttgaatcacttctctatatcacatattcaactatcaactactgctgttgttcgatcagtccatcttgtagtgttgttttttaaatcttcagtttttagtgttacataacaaagaacaaatttctatccaaaggcttttccctgcggtctaactttggtgagttgttcaaagacctcaaaaattgattcgtgttcttatggcagtatgccagtatatcaactcaatatccagagactttccttttaccgtggaaaagaagaccaggtaatcccgccatggttgcttgctggtagagattaagatgaagatgaaggttgaactctctcgaacaaatagttatacaatagaagatagaatgtgtcttgaaattttgaagtggaacctcctgcatagcttgtgtgtctacaaaataagcactttccatttgtttgttaaacgcactggagctgtctgcgtctggactatgttaatgttagttgaaacaaaactatttaaatcaaatttgcaaatgagggaaagaaggttaaaaagctttatcaaatcttgagtttgatcatcggcccttcgacaggagaaaaggctagctatagatacaaaagtaatactaagcataaactaaagagtaaatttaaaacgtgctggtgggtgtatagtcgaagtaagtgaccaatctacactcactgaaaattttaatatcaaaatttaaagctaattcagcatattataaaattatggagtgcgaaactataaaatgaaatcataaaagatcatgcgagattaggtggaacttagcaatcatcctaaattacaaaaactcgatcaatgtgagttgatgtatactgtcatacgactaatagattataaaaagaaaaaagacctaaagcatttttattggaagtctcgtaacaatgtaaaaaaataatcatacaactaatttattagaattccataaaagagtttttagtttgagatatccataaaaaaaattatcttcttaattaaaacactgatatatatatgtactctttttaagtgttttctatttattatttttacaaattataaagtaaaatgatatgaatatcagttaaagagtttatatgtttttttttttggtttcattttaaatcataatataaattatctatttattaacctccattatgcataactctaaagatatattagaattattttaattagtattaattaaggtaactacaaaatatttgatatgtttagaacaaattaatacaatgaatatttttaagatgtaatttgatgaaaattaataaaatattaatataatattaatgaaaattttaagattaaataatattaaaatagtagtatcttaattaaggagatactatggatatcacaccaataggcatgctctaacatatttttttccttttcggaggattctttttatatatatatataaacaaataattaaatagcatcccaatatatacataaacaaagtttaaatcgttttagctatgcctgatttttttataactttttaagaattagataaataataaagcaacatgtctaaatactattctaaaaatatatcaattgttaattgggacagcccaatttgcactggacacggcaacaaatgaccaaattctatacacaaaaacaacaaacgagtaacgtttaaaaatgctgacgtgtcccaatatgatcttacctttgatatcgtttttaaggaaaagttgtgattgtctgagtcagcttgtatgagttcctacgtgttgaactaatcctgacactacctgagggaggtaatcacaacatttttcatatataaccgccccaatttcactgatttcaccttttccttttaccaatcacatcatcccaattatttacgtacttagcttgactagttgtcgttcattacaaccatcttaggtttcttataatcattcctgttacgtagtaaagaactattttacgtaatagataagattagatatcagttgaaattattgactatatagacatcctaattttatttccattgttaaatttgttaatatatctaactatcaaaacctaaatcgacgtgtcacactcaaacttataaagactaaacctattacaagaaataagatcttataggccgaatttgtttggtacgttgatgatccaaatataaataatagtttttctttttctttttaattatgaaaggttaaaaattcataaaaaaaattacccatatttgcttaagacgctagcttttctataaatacagcatagccatgtgtaattgatcatcagataagttccgtggttatcccattaaccttctttctacacaacacaaaactatatataaagatcatacatgtaataacgtcctgcaactattacaatcattctcgcttgaattaacgtggacgtcattgtttttggattgttaatcaaaggcggcgttacttttttttaatataattgtttctttaggatctttgtctctggaaa

SEQ ID NO: 7619 - DNA, 3000 bp, Unknown
  misc_feature (1)..( 3000): cDNA_ID_2108547_gDNA_ID_1621154_Annot_ID_173404 3000 nt of promoter + ATG
gactctgaagtcttgtttcttcattattctttacctcttccacttcagatgttttctcttttgcatcctcaggtttgactaccagagaaggggaatatctcaagaactcacccgacatcaaaacttcatcaggttttaaattactgtgacgagacccttgagcgtttgactttctatagccatcaattttcagactaaacaaagactcatttgatatttcgctccaatccacatccccattcttactaaacaccgatgcagggattctcccgggatcgtaattcgctataccattattcatcaagtgaactggtcgtaacctagaaggcggagatggagctggttgcatcctgagatgagtcaaaccagatatttcagagccttgagaagaagaagaaggctgcatcctgacatgagtcacacctgatatgtcagagcctttagaagaagaagcatttgaaagttcccaattctgctgactcgtatcctcagaagatgctttggactcttttgtacttctctctacggcatcatcccatgaaacagaggaagacattgaagaaaaagacagagatgatgatgttaggaagatttccctcgcaggtcttgtaatcattctgttaccactcatactcacatataaagctcttatcagttcacttttccggttgttaatctttcaaaacatttcgcagtgattcacggattcgattccatggctgataaactatgaaagcaattaatttttcttacatgaacagatgatgttctagtcccaccgatactacaacttcggtgaaagctggatccttgaagccattagcacaagcaatatccactcttttgcatccaagcacagtgccaagataatttggacaagactaatcaaagatgaatccaatattgcataattcttggtgtcttgtgaattcgacctattggagacggaaacatgtcattttcattcggttcttaaggaactagaaaatgaaaaacaaaacaatttatggagaagttttgaaagtgaacacaaaacaaacatctttgaatttagtaaatttgaacgaatggccgttgatcagagttgaatacagaagaaggaaacggtttcttgtggagaaatttaaggtggcatttgctggcatttgatcacttctatttcggggttgactgttcttcgcgccgttgctgtaaaacctaacttctttacattcattgtggacatcagtatggcccaataaaggcccattttgaaataatcgggctatttggtccacacatgaggacacgtgcatacgtaagagagtaccagaaaaggagattcataaacccgttaaattcgcggttaggaaacttttgccttttggttgaaacatcgttggcctcttgcaagttaattttcttattctatcgactatttcggacattcaatcacgtgattttcgtgtttgaaaagatcaacaattttttttttcgttaaaatatctggcatttaaataaacactatacgtaaattttagcagtatgaaattaactaggctgatggattcgaaaaataatacaataaaaccaaaaagaaaagaaaaacatgtattccaaattacaggagtactatcatcaatcattcaatctttaagtagctacaaaagtctacaacaaaaataaagagaaacaaaataataatttaaaggctagataattgaaaggaatagtgatatgcaagttccaaacacaagtatgaacaagagttaatggaagagactataattatgaaatatcggtcatggactcagggaagtggggaccctatgataacaagccaccaccaaattagcacctcaaaaacaaaaatgtataaaccatattatattgtatattaaatataagcatacattaggttaaagatgtttgctcaaaaattaaaagcaaatagatatgagattgacacctaaacagccttaatctggacccaatctgacagttagggcttaggctatgggtacgacaatcaactagatatgtggacaaaacattctactaattacacaatatacatgtacatggaccaccttttaatttttattttttttgtccttttactttttaacttgtacatgcatgttgtcaatgtctaattatataatcacttttcccctctatgtatgttgttttatacattgcatgtgttatatttgatcgcgagtgaacaaccacttttctcagcgcttattacgtgttttctttttgcggcaaatcattttacgattgattaatcctattcaaattcactacttaaacttactcccactgaacaaagtcccaactaaagcttataaattgtataatgtttacattaagtcttggggattggattgacaatgatgattttggccgatggttagtgctggttgttaaccaacatgatagtataatataaaatgaaacattaatatggactgatgttcggtcttaattaccactccactcttagatataaaattttgcagttaatggtgaacgcaaatttgcttatacgtacgtacgaagctgtatacaaatataagtaagcatcaaattaaacagagagagagaggcgtagtacttacgtagctatatgatgtggacgattgattaggatgtacgtatgctaaaaacaatatacacggccatgtgatacttgtaccacttgcgcatctctacatatatacgatccaacctttggaatttatattgtttacctttataataaccatccttcacattagcaatcaatctacaccaacaactacaactaaattctatctctctctctataataaactagcgagcgaggacgtcaaatgtaataagagtaagaacaagtacaccttttcatccaccaaaatttaacctatgtatataaatatacaacattaccatttaccaaacatccatcttacatatattactcatcatcaagttcctactttctctctgacaaacatcacagagtaagtaaga

SEQ ID NO: 7620 - DNA, 3000 bp, Unknown
  misc_feature (1)..( 3000): cDNA_ID_3050916_gDNA_ID_1621154_Annot_ID_173403 3000 nt of promoter + ATG
cattgtggacgaagctgaaatatcggttttgccctcggaagtttctccggtgttgttgttgttgaggggaaagttggttttggcgttgcggccgctcattaaaacggcggcctcgtcgtatgctcttgctgcctcctctgcggtctcgaacgtccctagccaaatcctccgtttcctttttattttgaaagatcatcacgcatgtcaaaattaataattaagcatggtgaatatatatatatatatatatatagtagaatttttaagcaataacttattgatatttacgtatctagatgttaaaatgattttatgtgttagctaagaagaggaaaacaacaaaggaagataaaccagaaatgagttagctacgatcatgtatatatatgtatgtgtggttgtgtactttaatggatcagagagaggaaataaatgaacaacgcagagaaaaaggaaagaaagaagaaaggtacaagagaggatgacgaatctcagcgacccaagaaccccaatggcgttgcctgacacctctgaacttcttcgtctgtaccattcttacttactctgtgatgtttgtcagagagaaagtaggaacttgatgatgagtaatatatgtaagatggatgtttggtaaatggtaatgttgtatatttatatacataggttaaattttggtggatgaaaaggtgtacttgttcttactcttattacatttgacgtcctcgctcgctagtttattatagagagagagatagaatttagttgtagttgttggtgtagattgattgctaatgtgaaggatggttattataaaggtaaacaatataaattccaaaggttggatcgtatatatgtagagatgcgcaagtggtacaagtatcacatggccgtgtatattgtttttagcatacgtacatcctaatcaatcgtccacatcatatagctacgtaagtactacgcctctctctctctgtttaatttgatgcttacttatatttgtatacagcttcgtacgtacgtataagcaaatttgcgttcaccattaactgcaaaattttatatctaagagtggagtggtaattaagaccgaacatcagtccatattaatgtttcattttatattatactatcatgttggttaacaaccagcactaaccatcggccaaaatcatcattgtcaatccaatccccaagacttaatgtaaacattatacaatttataagctttagttgggactttgttcagtgggagtaagtttaagtagtgaatttgaataggattaatcaatcgtaaaatgatttgccgcaaaaagaaaacacgtaataagcgctgagaaaagtggttgttcactcgcgatcaaatataacacatgcaatgtataaaacaacatacatagaggggaaaagtgattatataattagacattgacaacatgcatgtacaagttaaaaagtaaaaggacaaaaaaaataaaaattaaaaggtggtccatgtacatgtatattgtgtaattagtagaatgttttgtccacatatctagttgattgtcgtacccatagcctaagccctaactgtcagattgggtccagattaaggctgtttaggtgtcaatctcatatctatttgcttttaatttttgagcaaacatctttaacctaatgtatgcttatatttaatatacaatataatatggtttatacatttttgtttttgaggtgctaatttggtggtggcttgttatcatagggtccccacttccctgagtccatgaccgatatttcataattatagtctcttccattaactcttgttcatacttgtgtttggaacttgcatatcactattcctttcaattatctagcctttaaattattattttgtttctctttatttttgttgtagacttttgtagctacttaaagattgaatgattgatgatagtactcctgtaatttggaatacatgtttttcttttctttttggttttattgtattatttttcgaatccatcagcctagttaatttcatactgctaaaatttacgtatagtgtttatttaaatgccagatattttaacgaaaaaaaaaattgttgatcttttcaaacacgaaaatcacgtgattgaatgtccgaaatagtcgatagaataagaaaattaacttgcaagaggccaacgatgtttcaaccaaaaggcaaaagtttcctaaccgcgaatttaacgggtttatgaatctccttttctggtactctcttacgtatgcacgtgtcctcatgtgtggaccaaatagcccgattatttcaaaatgggcctttattgggccatactgatgtccacaatgaatgtaaagaagttaggttttacagcaacggcgcgaagaacagtcaaccccgaaatagaagtgatcaaatgccagcaaatgccaccttaaatttctccacaagaaaccgtttccttcttctgtattcaactctgatcaacggccattcgttcaaatttactaaattcaaagatgtttgttttgtgttcactttcaaaacttctccataaattgttttgtttttcattttctagttccttaagaaccgaatgaaaatgacatgtttccgtctccaataggtcgaattcacaagacaccaagaattatgcaatattggattcatctttgattagtcttgtccaaattatcttggcactgtgcttggatgcaaaagagtggatattgcttgtgctaatggcttcaaggatccagctttcaccgaagttgtagtatcggtgggactagaacatcatctgttcatgtaagaaaaattaattgctttcatagtttatcagccatggaatcgaatccgtgaatcactgcgaaatgttttgaaagattaacaaccggaaaagtgaactgataagagctttatatgtgagtatgagtggtaacagaatgattacaagacctgcgagggaaatcttcctaacatcatcatctctgtctttttcttcaatg

SEQ ID NO: 7621 - DNA, 3000 bp, Unknown
  misc_feature (1)..( 3000): cDNA_ID_1714522_gDNA_ID_1621154_Annot_ID_173398 3000 nt of promoter + ATG
tgatgcagatgctgaagcagataagggaaaagaatccaaagaatatgatgagaagacgacagaagctgaggcgaataaggaaaatgacactcaagaatctgatgagaagaagacagaagctgcagcaaataaggagaacgaaacccaagagtctgatgtcaagaagaccgaagctgcagtagcagaggagaagagtaacgacatgaaggcagaagacacaaacagaagcttggaggcgaatcaagttcaacagcagcagggagctgcagcttccgtgagctgttaaaacctatatcgttctgtacagagcacagagcgtgaagagtttgttgtgatttcaggtgtagcattaacattatgagtggttgttgtatgtgttggtagaactaatgtctctctatgttgtagttcagtccattatcatttgacgtttgtatctttgtacctttgtactttgttgtattattaatattaggcatttagactgtcctttgtctcatacttagacgagtgatgcaaagtgaatgaatcctaacacccaagtcccaaagcagaagattgcatggtaaagattaaaaagttaaaaacaaagtgagctttttgattacaaaagagtagatcttacaaagtagaacattacataataagataaaagaggtaaaaacacagagagctcgttgattacgaaagagtagatcttagggagcgtatgatatcagtgagggagacgactccttgaagcagaccctgttgatccatcacccatactctgtgcactcctctggtcaccactttctctatagcttcctccatagtcgactccacaccgcaactcaccacctccctctccttccccgaagttttctcggtgaactccagagctgtgagtggcagccacgtttgcaactccggtaggcgacatcctttcaaatcagttgctgaaaacgtacctatcacttttctatgtctcccctgcaatctcaaaaaacacaaaatgagtaaacattatatattaaccaaagtatatatgtaaaatgaagcctacattgactagctgcagatgatcctcttgtgctatatcaggtgcatgaacgatggggacagcgttgagcagagcacccttcataacgttgatggcattggaaacagtggttctctctgtgatggcgtaaacggaatcattaacagctccgagatcagagatggagcgtgagagaacagttttgaggtcatcaaagtgatggtctttaaggaaacgcaagagatccatctgagtaagcatcttgtaagcagaggcagactcaatcaactcaactcctgcaatagtgttattgctctctatgctgctctccactggcactaaagctcgatggatccctttgctaaacacttccatgcactctaacacgctggtattaggattcagtgtccagagactgagtccttcgaggcaatgaccgatgatggatgacacctgtgaactcatcttgcgatcaagatcagagagattggaatcttcaccggcgatatgagcaagtatgtcaagcatcgtgagaatcccgatatagtgttttcttacaactccagtttgtttgtctgattccatgatcatggaaccaccggctccgatccagtggcctggaggtgcagccactgggagggctgagatggagttagccaccaatgtgttcattgcgtgggaaagtgtagccgtgtatggtacctcgacgagccgtcggtttctgaccgttagatctttggccgtgacattgatcagacggctgtgatcttctttgctcttctcttcttgcatagtgttctactactgttgtcgtagcttgaacttgttgctttgagaacctttttaagtgtcgatcttggctcgaaatttgatgtgaatggatcaggacgccgtgtgatgatgatctagaagcacgtggcaatcgatacttgctaatgacatgcaacacgtggcatttttcattgggccttagctaacggcccagtagtatgtttaatgacccaaataacccttcgtctctgctttgtttttatttcttaaaatcagtatctccctcgcgtccgcaaatgaaacgacctgagaatccaagaacgtaggaaagaaatcagtgctgaagaagaaacacgaagatgacgagaatggaagttgcgcgactgtgagtatctttctttcgtctttcattttcttcgctgcattactctgcctcaatgagcttgatcgttcgagatttggtcgacttctgtttggagattctgtgtgttctatgattcgatatcttggatttagagttttcttttccatttattataaggagaacttcggattaatccttcctcagttacgcttgattagtagttcggtttctttctgagattgcggatgtgaattgatgcaaaacattacctctttttgatgattttcataatggatagggatgcattttaggatttgagtgtgcaatgagattacaagagttggttcttgtgaaaatcagcttagttttcttatggttaattgggtttgtcttcctgcaacgtagtgaagagaatggatttgaagaaccaaacaatggggaagaactttcctgggatgatctggagagagaagctgctagtaatatatcatctaaaagatctcatgctgagagatctcaccaacacgaatcttttacaaaaggtatctgcaaaaagattatttcttaaagtaatgttttcgagttattgtagatggtgaaacttttgcttaatctatggcaatgttatctgttttgtcatcttgatgatgtgagtgatgttacaaagcataatatctgtgattgatcaggtgacgaactttctggagacttgtacgaactgtggaggcaagaacagaacagcattgcggcaaggctagacaaagagctaaaatccaggtgggaactcgatgaactgattgaagaacagctgagcagataccagtcccattacgacaattccatg

SEQ ID NO: 7622 - DNA, 3000 bp, Unknown; identical to SEQ ID NO: 7612
  misc_feature (1)..( 3000): cDNA_ID_2172472_gDNA_ID_1621154_Annot_ID_173396 3000 nt of promoter + ATG

SEQ ID NO: 7623 - DNA, 3000 bp, Unknown; identical to SEQ ID NO: 7610
  misc_feature (1)..( 3000): cDNA_ID_3050931_gDNA_ID_1621154_Annot_ID_173394 3000 nt of promoter + ATG

SEQ ID NO: 7624 - DNA, 3000 bp, Unknown; identical to SEQ ID NO: 7609
  misc_feature (1)..( 3000): cDNA_ID_3050935_gDNA_ID_1621154_Annot_ID_173391 3000 nt of promoter + ATG

SEQ ID NO: 7625 - DNA, 3000 bp, Unknown; identical to SEQ ID NO: 7608
  misc_feature (1)..( 3000): cDNA_ID_1818332_gDNA_ID_1621154_Annot_ID_173388 3000 nt of promoter + ATG

SEQ ID NO: 7626 - DNA, 3000 bp, Unknown; identical to SEQ ID NO: 7603
  misc_feature (1)..( 3000): cDNA_ID_1818359_gDNA_ID_1621154_Annot_ID_173377 3000 nt of promoter + ATG

SEQ ID NO: 7627 - DNA, 3000 bp, Unknown; identical to SEQ ID NO: 7602
  misc_feature (1)..( 3000): cDNA_ID_2172437_gDNA_ID_1621154_Annot_ID_173376 3000 nt of promoter + ATG

SEQ ID NO: 7628 - DNA, 3000 bp, Unknown; identical to SEQ ID NO: 7601
  misc_feature (1)..( 3000): cDNA_ID_1818367_gDNA_ID_1621154_Annot_ID_173375 3000 nt of promoter + ATG

SEQ ID NO: 7629 - DNA, 3000 bp, Unknown
  misc_feature (1)..( 3000): cDNA_ID_2996323_gDNA_ID_1621154_Annot_ID_56968 3000 nt of promoter + ATG
agtgatggtctttaaggaaacgcaagagatccatctgagtaagcatcttgtaagcagaggcagactcaatcaactcaactcctgcaatagtgttattgctctctatgctgctctccactggcactaaagctcgatggatccctttgctaaacacttccatgcactctaacacgctggtattaggattcagtgtccagagactgagtccttcgaggcaatgaccgatgatggatgacacctgtgaactcatcttgcgatcaagatcagagagattggaatcttcaccggcgatatgagcaagtatgtcaagcatcgtgagaatcccgatatagtgttttcttacaactccagtttgtttgtctgattccatgatcatggaaccaccggctccgatccagtggcctggaggtgcagccactgggagggctgagatggagttagccaccaatgtgttcattgcgtgggaaagtgtagccgtgtatggtacctcgacgagccgtcggtttctgaccgttagatctttggccgtgacattgatcagacggctgtgatcttctttgctcttctcttcttgcatagtgttctactactgttgtcgtagcttgaacttgttgctttgagaacctttttaagtgtcgatcttggctcgaaatttgatgtgaatggatcaggacgccgtgtgatgatgatctagaagcacgtggcaatcgatacttgctaatgacatgcaacacgtggcatttttcattgggccttagctaacggcccagtagtatgtttaatgacccaaataacccttcgtctctgctttgtttttatttcttaaaatcagtatctccctcgcgtccgcaaatgaaacgacctgagaatccaagaacgtaggaaagaaatcagtgctgaagaagaaacacgaagatgacgagaatggaagttgcgcgactgtgagtatctttctttcgtctttcattttcttcgctgcattactctgcctcaatgagcttgatcgttcgagatttggtcgacttctgtttggagattctgtgtgttctatgattcgatatcttggatttagagttttcttttccatttattataaggagaacttcggattaatccttcctcagttacgcttgattagtagttcggtttctttctgagattgcggatgtgaattgatgcaaaacattacctctttttgatgattttcataatggatagggatgcattttaggatttgagtgtgcaatgagattacaagagttggttcttgtgaaaatcagcttagttttcttatggttaattgggtttgtcttcctgcaacgtagtgaagagaatggatttgaagaaccaaacaatggggaagaactttcctgggatgatctggagagagaagctgctagtaatatatcatctaaaagatctcatgctgagagatctcaccaacacgaatcttttacaaaaggtatctgcaaaaagattatttcttaaagtaatgttttcgagttattgtagatggtgaaacttttgcttaatctatggcaatgttatctgttttgtcatcttgatgatgtgagtgatgttacaaagcataatatctgtgattgatcaggtgacgaactttctggagacttgtacgaactgtggaggcaagaacagaacagcattgcggcaaggctagacaaagagctaaaatccaggtgggaactcgatgaactgattgaagaacagctgagcagataccagtcccattacgacaattccatggtttcaactttcttaaaggatgtctctaacctcgtcttacccacgtggataccacctcatgagctagctgctgtggcctggcttggagactggcgtcccacctccattcttgaccttgtccgcattctggcagctcaaaacccctccttctctctgtctgagtcgagtttacgcgtgctctctcagcttttacgtgagatacgcatcgaagaggccgttattgatgaggaatatgcagaaattcaggccaccggtgtcttgtacctccctttttccccgctctgcaatactcggttgcatgaagaagctctgcgttctgtgcaggagctgtttgggaacatacataaagtcatctcaaaggcacaacgactcaggtttgctttcctccccatcataaataaaagagaattgttgagaatgaacagaaacaaatagctgacaccagatagtgtgtgtggttaatgatgtcttagttttgttgagtgaagtgaaagctttgatcagcattatgagagaaagttgttatgattggcaggtataaagtgttggagctggtgatgaagaagctgctgaatcaaacggatacagccgagtttgtggtcgcatttgcagggattcaagacgccatacaccagtttggagagcagaagaagctaagaaagatttacccagcagttccttcacctctgaagggatcaggatcatctagttgagagctttgtagaagcaaagcaagtcccagtttcatagtaaaactaaatgctgtgatgtgggatctgcctgcttggaactaatgcctcttcatcaacccatacatgtttaggatgtacatgtttagctatcaccgtcctctggattcattgctattgtacgtacgttgtaagtcataacaaagatattgacaatgataaaaccaattcttgtatacaagtttttcaggctcttcttaacacttaacatgcaaatttgggtcatcatcagttgtatatgaaagaatatgtagagtttcatatatttccaaaaacgttagagaactattaacatgtgacccattgggcctgttttacacctttaggtccatttaagttgacgtgctccaactcgtaacctccgattaatgccacatgttctctcccgcctgaatcatgtcaatctcccacaaaagatctttgataaaaagaattgagccctaattccttgatgtttgttgaatcgcacagcagataaaaaaaaatg

SEQ ID NO: 7630 - DNA, 3000 bp, Unknown
  misc_feature (1)..( 3000): cDNA_ID_1008152_gDNA_ID_1621154_Annot_ID_56972 3000 nt of promoter + ATG
cgaaaatcacgtgattgaatgtccgaaatagtcgatagaataagaaaattaacttgcaagaggccaacgatgtttcaaccaaaaggcaaaagtttcctaaccgcgaatttaacgggtttatgaatctccttttctggtactctcttacgtatgcacgtgtcctcatgtgtggaccaaatagcccgattatttcaaaatgggcctttattgggccatactgatgtccacaatgaatgtaaagaagttaggttttacagcaacggcgcgaagaacagtcaaccccgaaatagaagtgatcaaatgccagcaaatgccaccttaaatttctccacaagaaaccgtttccttcttctgtattcaactctgatcaacggccattcgttcaaatttactaaattcaaagatgtttgttttgtgttcactttcaaaacttctccataaattgttttgtttttcattttctagttccttaagaaccgaatgaaaatgacatgtttccgtctccaataggtcgaattcacaagacaccaagaattatgcaatattggattcatctttgattagtcttgtccaaattatcttggcactgtgcttggatgcaaaagagtggatattgcttgtgctaatggcttcaaggatccagctttcaccgaagttgtagtatcggtgggactagaacatcatctgttcatgtaagaaaaattaattgctttcatagtttatcagccatggaatcgaatccgtgaatcactgcgaaatgttttgaaagattaacaaccggaaaagtgaactgataagagctttatatgtgagtatgagtggtaacagaatgattacaagacctgcgagggaaatcttcctaacatcatcatctctgtctttttcttcaatgtcttcctctgtttcatgggatgatgccgtagagagaagtacaaaagagtccaaagcatcttctgaggatacgagtcagcagaattgggaactttcaaatgcttcttcttctaaaggctctgacatatcaggtgtgactcatgtcaggatgcagccttcttcttcttctcaaggctctgaaatatctggtttgactcatctcaggatgcaaccagctccatctccgccttctaggttacgaccagttcacttgatgaataatggtatagcgaattacgatcccgggagaatccctgcatcggtgtttagtaagaatggggatgtggattggagcgaaatatcaaatgagtctttgtttagtctgaaaattgatggctatagaaagtcaaacgctcaagggtctcgtcacagtaatttaaaacctgatgaagttttgatgtcgggtgagttcttgagatattccccttctctggtagtcaaacctgaggatgcaaaagagaaaacatctgaagtggaagaggtaaagaataatgaagaaacaagacttcagagtcacaatcatcgagagaaatacccgtcatttccagatgtcccattgagtagtatccccaacaacttctattgcttatacgcgccgcggacaaaacctgtgtctttttcccttcctgtgggtgagaaaaagagtatgaagagaaagaagagaagaaagaacaagaagaagaagaataaaaaggagaagaagaagaagaagtgttgcacttgcatgtggacttggttgtgctcagtattttcaaagtgagtgtgtgacttgcgttgctctacaaatggagaaagtgtggctgctgctgcaagcaaacaatgtttttgtaatcatgagagttatgtattgacatttaaacaactatctttatttgcatccttaatgcttaatgtattcttacgctaatggttaacagttttcttctatgctttgattccagactattatttatttcattatagaaaatgataatgtattacgaatacaagctgtatgggaaaaatatgatgagtggggttgattataagacaatggattggagaggcatggaagatgcacaattattttgacttttaataataagctcataccaaacacactatctatatacattatacacattcgtcaattatcaagttgttcgaattattacaagttctttgatttggttgattaaaattacaataataccctcaatgccaagagatccgtataacggctgggggatgaataataacttctctggtcatcgaaacaaaggcaaatcatttcaaagcgaaaggaaaaggagaaacgtaaagagggcaaagcccttcttcttcttgttcgagaaggagctgcagcctcagataaggattcttttgatgcccagttgataaaggaagcgactttattttaaccaacgagattttatcatcaggtaagcaaagctgtttgattcgttgattcttttgtatatattgaatatgtttttgttcgctgttgattggtttcttctttggcttttatctataatagggttggttaattggtttgttatttgacaaggatcattgatcaccctcttgagaacatctcgagctttcccagatctatctgagctcctgggtttataaatcgcttccttcacatatcgatggggtgcgtttcttcttccgatttctgtttttgactttatgcagaatgttttggtatttgattgatttggatttgagattctgtttgatgggctttgttcctgcgttatgtgctgcttgggattcatgttcatgatagataaaccctaattttattgctggggaatggtgtttataaggttgttttatgcagatgagatagctatctctgaaagttttatagaaaaatgttttgctaaggaaataaggatgttttttgggcaatgatcaaaagttatggttttgtaacagagcagtggctgcgtgggttgctacagagaacacagatcaactgccgccagtctgaaggatccaccttccaattccattgctcgaccgtgtaagaaaccgagtgtctctgaagatttctggtcaacaagcacagttgatatg

SEQ ID NO: 7631 - DNA, 3000 bp, Unknown; identical to SEQ ID NO: 7619
  misc_feature (1)..( 3000): cDNA_ID_2108547_gDNA_ID_1621154_Annot_ID_56974 3000 nt of promoter + ATG

SEQ ID NO: 7632 - DNA, 3000 bp, Unknown; identical to SEQ ID NO: 7618
  misc_feature (1)..( 3000): cDNA_ID_1010722_gDNA_ID_1621154_Annot_ID_56976 3000 nt of promoter + ATG

SEQ ID NO: 7633 - DNA, 3000 bp, Unknown
  misc_feature (1)..( 3000): cDNA_ID_1818309_gDNA_ID_1621154_Annot_ID_56979 3000 nt of promoter + ATG
cgactcctctctattcctcctggtgctcctccaccggttttaatcggtctaagcttgtctttctcatcgattggtttgacctgttcagagctttccgacataggcttaggttgttcgtcgcgttgactttcgtctttctgctcgttgtttcccgatttgttgagttcggcgatgagacgatcgtcaaacactataccggaagatccctgacggcggaaagagattgttgatctttgaagaccctccatggatctatctctctctctgttgatgagctaaaagaagggcaaaactaggaaaagtgagtttaggccttataagtgattaatcaatcattgtgtttcagacttggtttccttttatttctgtcctcattattttttcatggggtcggtccactatttattgtttatttttatgatgatgcttccagtttctatttatttctttgtaacaacaatcatcggaaattaatgtaagcggattaacgatatcattcaaccggattattcaaacattaattgtaataaaaaaaaaaaagtaaaaaccattactgttattgatgattaaggcagagaattacatgttaattttttgtttgttttcacatctttaatcggattctcaacaccacataggcacataagtcctcttatatccatatttgttattttattccaaacttttggtttctttaaactcaaaaggggtaagactttttgtaattactattgttttatcagcaaattgcaaggattagataatagattagaaatgaacaggagaattgacttataggacacactaatttaatatttccttcttccccatttcggtaaaccaaatagactatttccttcttccccatttcggtaaaccaaatctattaggtgaggatgttattaaaatgccaaatctctctttataaaaacttgaaaggaaaaacaatacaaagtggtgaaagtgagtcaaagtaattcggttaccaatttgtattcaaagtcaacatcattgtactataatatggtataacttttgttcaataattcaccttcttatatcgtctgtttcttctcaggatcaccactaactaaaacatacgcatgtggtgggtttagcaaaactgtattctttggattaaagtaatgtgcataacacaaattaataaccccgtctgagttggcacaactcaccaatgttgaagattgagataaagaatttgggcccaatcgccgaatagaagtctatattcattactctcaggcccatccataaatacaattgtcaaaaagaaaataaaaaattggtggtccagctgggaacgagccagcaggccatggtgaatctgagtggcgtcgagctgtgatccgtccactgctgagagcgggaggtgatcgctgctctgtgaaaccagcctcacgcattgccctccactgcaagaaccgcctgagccaagccttcgcttaacacacacggatcactctcagcttggactgggcagcccggaacaatgccacaacagatccgacccgtgggccgagccagtgttccaccaacttattgtccccacacgggtcacaagcccacgttactgagctcgacgtacaagtattgatttaatttcatatataaagtaaaacattttgaggtatgtaaccgatgtgggacaaaatacaagtttgggcttcccagatcccacatttggtggaacacatatataaagagtctcttcgttgattagcttcccagatcccacatttcaggtaaaaacatcgtctgggctctttgccattttagcgaatgtggaaaggtgtggtttttttttgctctgctatggattttttttttcaaatcagggtttctctgttgaagtcatatcaggagcttgacatttgtttgtttgggaattagaagctagatacgtatattatatagcatcgtacatatcaaattttggtgtgtgttctaattgaatctgtacttgtttgtgtgttagtgggaggagctcttctcagaccttaagactattgctttagtggaatgcttctcgtaaatgtataagtgaggaaagaaactccattcgtatctatctactaccctaagccgtttatgcattttctgtccatcagaagatcaacacctgtttctggaggattccattgatttaagggattagatggatgatggaccatgtgggattcagtagatgacaagaacacaaaggaatccacctaacagagacaacccacatgttgcaggaaatacatataataatatcacaagaaacggaaaaagaagcagacagagacacctcttcttgaatttaacgccttacattgtggtatcttccatcttctttactgcctcatggtgaaatccagtgcatatatgattatttatctgaggcgaagattccttacttcatcttgatgcgactactactggtccaactttcattggatcggttgatttgaggccgttgttcttacattttggtgtcccacctgttcttttagtactgttttcctttttgtttctggcaatcagaaaacataaaggcaatcagtcatccttctcaataacatacaaagatttggttttcaagagaatcttctatagaaagctagacgtttacttctgtcttattaaggagaagtactggttctttcatttatatcttggctggtttgggaattgcatccaaatttcttgcagtgggtgtcagcctggagctgcagaaaagtgagttgatgttagagattgtaggatcttactccaaaaagccagaaaaggtccttgcgactctctaacttgaaagttgtttcctttttttgaatctgagctggttttggaattttggtgtcaagatttggaatttgaatctgtagtaagattcaggtttagtgggggagggaacaagttggaagcttttgctagttttgtcaaaggtgtcactaaagtactaactatcagaaaacattttcagccagaagcttggtg

SEQ ID NO: 7634 - DNA, 3000 bp, Unknown; identical to SEQ ID NO: 7616
  misc_feature (1)..( 3000): cDNA_ID_1818304_gDNA_ID_1621154_Annot_ID_56981 3000 nt of promoter + ATG

SEQ ID NO: 7635 - DNA, 3000 bp, Unknown
  misc_feature (1)..( 3000): cDNA_ID_1818296_gDNA_ID_1621154_Annot_ID_56984 3000 nt of promoter + ATG
aaattgcaagactaaatggtaaagtaaaagacttgaaaacgcaacaagaaagaagaagaacatacgcagtgaaatcagcagaagctgaggcagcacgaatagcatttttatcaaggctgcaactccaaactgctcccttatgtccttcaaaagtcccaatccagtcaccagtctctccattcctcaacatcggattcgaatctgaaatatcaaaagtcaaagaaacctcagctagagttcaacaatgtatgcaacttatcatcctaatttctccattagatcagccacaaatcaaacttcagacgatatataataaaaggcagcaaaatcaaattcgtcaaagcacattcgctatgcaaatcataatccaaaataggcacagttccaagtaaagatcatagatagtcaaatacaaatcgatcgaagatcatacctttgctggcgctaatgagaaagaacccatctggagtcaccggactataagccacatcgacgacgggacgagaatgcccgtggcacactaacggagctcccatttatcttcttatctattcactaacaaaccctaatgaacaaaatctaatcaattagtcgatttactcgtttggaagacaaggaatcaattaatttcatttcttaaaaaggataccagaaattttttgaatcgggtcaagattgcgttaagaaagaccaatccgactttgatcggtgcgaatgtatgacccgccagagaaatccccttgaagaggatcacacctatacaagggaagagaaggaatgataaaaggagaaactttttttttttagtttggtttgttatctatggcttaaacgcagagaagaactcgcggagacgacgatggtagtagttacacgctctcaattcagaaaacaaataaaccttttgtattttacgagtaagggcttatatttattactattgatgatattgccccataacttcaaagtaattaatttttacgttgaaagtttacaatagttattaaattgcccctatagaaataaactttggtcagtcactcctcaatcgcgtgaggattgaatagttttacgtgagaacttcacctaaccataatttttattcttagcaaaggcatttttttaaatttcaagattgactaaatatatacatgtagtttgtcctaattctgatataaatactgtcgtcgacggaattaatattatatatgtggataacgtataaactatgaaattaaaaatatgatgcttaagtgtttgactcaatgattcatcatgaaataataatctgaactttcttggtacggcgtttagaatctcgagtccttttcaaagctagattttaattggtttttcaaatcccgatctaccatccatgtgtatgtattaatcataagtaccacttaattatatattgcattatacaattcttattattcctgataacaaccgatacatatagtttgtttagtatgtactacatgttatctttgaatagaatgctaaaactttactcaggtattagatatgggttcaaagttcaaactcttttgataacatatatttcgatatatacacacacacgcaatttgaccggtcgaagattctggcacaataaaggcatttgcacgggcaagtgccattgacgtggagtgatatatgcatatatgagtgcattactgatcacgtcagcagtgaattttttgtataagtaactaggactatattaaattgtgtgtgcatgcctatttctacacataaacatctacacccactccaactacaagtaattttaaaatttcacaaacttggtgcagcattaatttttaacttcgttttccaataacttgcaaaaaaatttattttatttatgaaattaacaatatggaagattacattttctagatacaggttaaagcaatttaagcaaagaatataacatattggtatgttttttaaaatggaaataacttaagaaaaaatgaagactaaaggaaacaacattatacaaaaaaactatattaagttaaaattttcaataataaattatttaatttagatgaattgttcctctctatatatatgtcactttcttatacgaaaagaacagacagagtgttaaagcgtcaagatcacagatgtcagaatcacccactcgattactgacatgtggatgtaggcccaacataatacgtgtataaatgggccctgtctctccatttgctaacgttgcctcgtctttggcctataaatcttcctaaaccctataaatcgctacacagttacttctcggctccggctattctccttttctctttcgtcgccggtagtttgctcctccttacgcctcaaatttccgagttattgcatgttaactcctttgtctgattttgtttaatcctttcttttgtctgattatgtttttgtgagatgtgaaaggatttgttactgctaatttcgttgtcaaaactatgaaaaaggtgtagattcaatatacgacggatattaattaatggattttattgaaaaagttggattctttttttttttttttttttttgggtgcatatgcaatttcaaatttcactttatgagagaggagacgaggagacttagatctttgtcataagaagaaattttgcattacgttttgctttgttttatgtgctttgtgatgtttctctatttgagttgggcacattgcgttttcttattcatataaaagcatagaaaattgacattactagtaagtaacaaaagataaaacagctataagcttctttttctattgagaggtggaaaaagactggaatcgtcacaaatttagaaaaatataatatgaagattattttgtattaaatgtagtcagcaaaatgctagatttaaagtcattgctagatgtcatacataatatatagcttcctgtttttgtggtttaggtcatataaagagtagaccagaggcgacgagttctggagtctttgagggattctggatatg

SEQ ID NO: 7636 - DNA, 3000 bp, Unknown; identical to SEQ ID NO: 7614
  misc_feature (1)..( 3000): cDNA_ID_1818292_gDNA_ID_1621154_Annot_ID_56986 3000 nt of promoter + ATG

SEQ ID NO: 7637 - DNA, 3000 bp, Unknown; identical to SEQ ID NO: 7613
  misc_feature (1)..( 3000): cDNA_ID_1818288_gDNA_ID_1621154_Annot_ID_56987 3000 nt of promoter + ATG

SEQ ID NO: 7638 - DNA, 2388 bp, Unknown
  misc_feature (1)..( 2388): cDNA_ID_1818467_gDNA_ID_1621155_Annot_ID_56989 3000 nt of promoter + ATG
gaattctcttgcttactcttgcctgactctatatggatatatctcttcacttactctgtgttaaggtgttaacttagatagcgattttagaacagctgtattgtttgctagagctaatgcaggctctgttcgtctcataaaatccatttaaattggcatttgagcaggggcaccaattctgtgaatggtcgttttgcactcttgaattttagacaatcggtctcactttctttatctcgtgtcctaatcacaggtatttcctgcaccagcagatcgagagaggataaaatcatgtctatccgagctaggcgagttaagcagcacgttcaagcagttactcaactcaggcatggaacagctagtagcaaccgtaacaccaagaatccgtccggttctagacaccgtggctaccataagctacgagttaacagaaaccgagtacgcagagaatgaggtgaacgacccttgggtccaaagacttctccactcagtcgaaacaaatgccgcgtggctccaaccactaatgacatccaacaactacgactcgtttctgcatctcataattgatttcatagttaagagactcgaagtcataatgatgcagaaacggtttagccagcttggtgggcttcagcttgatcgagacacaagggctttggttagccatttctcgggtatgactcaaagaacagtgagagataagtttgctcggttaacgcagatggcgacgatactgaacttggaaaaggtctcagagattttggacttttggggagaaaactcaggacccatgacttggagactcacaccagctgaggttagacgggttttgggtctccgggtcgagttcaaacccgaatcaattgctgctctcaagttgtgatgttacttcttttctttattatgtcatctacacaactcgaaccaattctttcgaaatctgattggttcctcaaatattttaattgaatgaaaacttaaattaaaaatcaaacggtaaaaaagttaataagtgaaaacaaaacccaaaaactgcatttatttcatttacccttctaatgaatttaagcagtaagagaaagacagtcacaattacaaatatcacaactaacaagtagttaatatatatatatgtctatgtttctagataaggaacgttctatatttgtttgattcatagaaatagaagctcgtatgagaccgaaagatatcaatttaattatctacatatacatttttgcagctattttgtgaaataaattctgtagttgagacttatttacaatggctgatactagattttaatgtttgtttttgataattagaaaaaaaatcttcgaattaaatatttgacatttaacaatcttctctaaatctctccacattaactacacgattagttactaaaataaaacttccaaaatatttaatatcatttaattactacaaaattatcatttttgatattggtttctccatgactataacaactcgattataatcatcaaaacgcaaagatatttgataacatttaattactacaaaattacaaaatatttagacaataattcataaacgtatcataaataagatcaacattaataaaataaatagtttttttacgggacggattggcggaacaggtttggcatgacgatacttaataacaattgtaaactataaaataaaaatattttatgtatagattcaatttgcaaacttttatgtatagtaactttaataaataaattgttcccgcagtgtactgcgggttcaaatctagtaatatactccctctgtttcatattagttgtagtttaaggttacacacaaattaagaaatcataaaaatctcatttaatatacctcttttatataaaaacttcatttattataaccaattcaaccaataaaaaaatagatgattaaatataattggttaaaaaatattaaatacatttattatttgcatagaaagttgaaaacaacacttaaattgaaaaaaaaaaaaaccgttaaactacatttatatagaaacagagggagtagtaatttgaaaagaataataataataaatgttaaagtatttctttgagttgagaatttaggtcgatttttacgaacatatgctcaaatgtgacgtataaataaatgcgtatcaatattgatgctttgttcaattaccaaaaaaaaaaaaaagatgttttgttcgattcgataaatgttgggggcaaaacagagagatgagcaaaacatgggatcccgataaataaataaagacaactcttgtccttgtataaatagacttgcatcttcaagatatatatgtacaagtctctttacacctaacaagacacagtactaaatcatttgcagcttcttacaatg

SEQ ID NO: 7639 - DNA, 3000 bp, Unknown
  misc_feature (1)..( 3000): cDNA_ID_1818455_gDNA_ID_1621155_Annot_ID_56992 3000 nt of promoter + ATG
tattgcaaatacttaagaaaaacactcatgtttatcatacacttggatgagtactccaatctcaaaagcagagtaaatatcaagggaagaggcctttgaggtcctcacagctgtcagcttgtcgttcttcttgaaacggataagacttaaagttcataaacacattgaattacacaaagaagacacaaaaagttcctatatattgcaagacaaactctacttgcactctagctctcgttgctttggctttggctttagctttatttgcttcacgtttagccttgtaaggtatgatactgaagcttggaagtaatctgtgagaaatgtctgccaaattctacatgtttcggcataatcatccacaatctgataaattgttatgtagaatgaagacaatctccttggaaaactctgaaccatccctaaaccacttcaatcacaattcccaaattactgtatttattgggcaaaccaaaaacacaacttctcgagcattagttatagatgagagttgtaaaagcaattgcgatcaatatatcatcagctgattttcaacggttcagattaaaatttacaaaatttccttcttcttctttttttcttttttttttgagattcaagcccaaccaaattattaaacccgtttatggtttaagaaggcccatatggaagataatatcatataactaaggatacttagttttgttaactatattgatttttctcagtgcttcaaaagttgttacaaatccaatgctaattttgggcatgtctcttgagtcttgactaatcaattttttcttttaaaaaagaaaacagtaaactaattataggttgttgtgtcctgacaactctcagccttaataacttaagattcgcatcatcaaattattaagaattactcgaagagtagacttttagctgttttgaatttcaagatttgaaggatgattcaaatcgataaatgaggacacctacatttatgtaacgttgtccacgtctatgacaaataattttggactatgtgcaatgcatgattgttgggctgtatgtctaatttacagcattaatttttcgtaagactaaagtcttgattacttgtcaatcatgctgtaactttattgtaaaatttacagtctaaattttttttctttttaaggttatagtcgagtaaattctcaaagctctaatttttttactgtaaaaattttaattcaataaataaattctagaaattaaaattatcaacaaaaatatataataaaaacaaagatatgttctaaaaaaatgataattatcaaacctaaaaaaaaaagattataaataaatatcatatgaagaggtcaaagtacaagacgatgaccaaatgattgattctaggcaatatatggaaggaattcgagatgatattacaataaatttatgaaataattataggtaaaattatatttattttatcaataattcataaggttttattttatttttatatcatcataatatatttatttaaattagtaatacaaggtattttatttactataaaaatatattttattacaagtattatatttacaaatctatttttataaatatttaaaatcaaaaacttacagtaataaaagttacaggtatagccaacacaggtacatcaaaaattttacagcaaaaattctatagttacaacccaaccaatcatccacttaacttgtggaaaatttgtataaatttaaataacatctgagtaattagttttttatttgtttgatcaaatattattacggcactaaaatacctctaaacttttctagtccgaataaattctcatccacatccaccttttattctcatttttacattcattccgaaaaatcattactttctaaaaagaaaaaacgttcataaattctctaaacactcgtgcatcaacataaatccaccattttcttctatgaatatttccaaattcgaatttgaattatcgagctaataaaagctagcatgttagtatgttacaatctccggttatttgtaaagaagtaaaaagttccgagtcatatattaaatcgtgacatcctttatatatatatatatatatatatatatatatatatatatatatatatatatataagtcgtttaattcatgataattcgtgattcgcatcaaattagtagaatatgtattagaagtctaaatctcttagctgtttgcatgggaccatttttaaaaatatattatcaatttagaaaatttcaaaggcaaaggcgccgacgaccacgtctactacaactaaattatataagaattagcttgtgggacatttgtttaagttcaactactgtatttgaatcgttataaaaaaagtctcgagatcatccaatccataattaattattatattctgaatctgactctgattaatcttattatggtaaattgcaataatgtctccgaattctctttaatattcttttagcccaagcttctgaatgagacaagattgaccttacgttaaactgaggctaacacaaccgtaacaaatagttttttttttttttttgttgttgtttaattcgtattcttttagattatagtcgaaatgaaagtataatcgccggatccagttccaagccagtagaattcagcgcaacgattaaacaaattcatccactaggaaactaattcgtccacaaatctctagatgcgtaggctattaggtcggtttatatgtgttttggtttggagttatggaaaaaaagaataggtgatatttacaaagtttaattgacgtgtgtttatgtaagaaagaagggtgtcctttgttatttaagataggtgatggttcattttgcaaataactcttaacactggctattatattgggattacagaggcatatatcaacgtcttccatcttcacttggagtcttggagatctcatcaaacaaattagcaaacccttttgattcattgacttgtacacgatcaaaaaaatg

SEQ ID NO: 7640 - DNA, 3000 bp, Unknown
  misc_feature (1)..( 3000): cDNA_ID_1818450_gDNA_ID_1621155_Annot_ID_56994 3000 nt of promoter + ATG
cctgtgtgtatttctgtcatggccattttacaattcactgcttgtttgcatatgttgttaccagacaatataatctcccgcttttttatggctatagcttccagatggagacctccgggagaagattgagaaacttgcttcttctctaaagtttcctttgaagaagctgtttgttgtcgatggatctacaaggtcaagccatagcaatgtgagaagcttgagatctcttcctacctactttactctagtttaccattagaagcttacgtatcttgttacatcatacaggcttacatgtatggtttctttaagaacaaaaggattgttctttatgatacgttgattcagcaggtactgtgactcttgatgcttcaaacgagctatactcacatttctgtttctggttctgaaacataacataatcttctattgtgcagtgcaagaatgaggatgaaattgtggcggttattgcacacgagcttggacattggaaactgaatcacactacatactcgttcattgcagttcaagtgaggctcaaccgacagttcaaaaacttactcacatctacatttcacttaagaaatcatgtcttatgaccctctctcaatgttttgcttgcagatccttgccttcttacaatttggaggatacactcttgtcagaaactccactgatctcttcaggagtttcggatttgatacacagcctgttctcattggtttgatcatatttcaggtttgttatttttgccttttgacactaatctaatgaatcaaggatggattaagaaaaaaaaactctaaacctttggttatatctcctgtctgattatcacagcacactgtaataccactgcaacatctagtaagctttggcctgaacctcgttagtcgagcgtttgagtttcaggtaccatcttacaatccctcaagatccaaccatagtttctttattgcaatggcagcctcatctactaatctgagttaacgttccttttgcaggctgatgcttttgctgtgaagcttggctatgcaaaagatcttcgtcctgctctagtgaaactacaggtcagagaagataacaacagaacacaaactgttacctcaatttgtgtcacacacttaaatggattttttgttgggattttgcaggaagagaacttatcagcaatgaacactgatccattgtactcagcttatcactactcacatcctcctcttgttgaaaggcttcgagccattgatggagaagacaagaagacagattaagtccgcttaactcgtctcttgtacgggttgatgtcttttaggtgacaggtcgaaacaaaacaaaaaaaagtgtaaaaccatataggcagaggcctcttttgtttgttttttacttttacagtgggttttgcctagttactactagtttttgagtttcttaaaagtggaatcactcgcacggttcgatatgatcatttctgattcgtcttcttttattaaaatgaggagaatctaacgtatatgaatcattcttgttttgaaagtgatataggttatgattggtgttactaccacatgttagaaaatcgtgtaaaagtagtactaaattgaacatgggattcagcgatacagaattattgaacaaggcagaattgtttttatgagaatgatacatttcttgctatgatggtgcaataatgggtttctcttttcgcccaaaccttatccttttttctttatcatattctcataattacattaccctttaaagcatcccttctaaattctggattagtctgtataatatcattcattagttcaccggtttataaaaatcagaaagtttataagtttcaaaattttgctttggtgaaaagatcattcatatggttccaatttccaaaccattaatttaaattttagctcatagttgtatctcttcgtctcgatatggacaagggatcccaaagtacattataaatataaaaactatgggcatgggtcttttgacgcatacaaatttaaaacaacttaagctttagcctttgttctacctaatttagtaaattattagtataaactataaaggatctattatattatttaatacaagaatgaagaaaactatattatctactatattcgctctttcttttttttgtcaaaatggaatgctgatctggccactctacataactttcatctagcctctcatccttatctagataaacaaaatatgtggccctttgataggaaaaaatttcattcaaaaaatgcaaaggcagaataatttaattttacaaacgaatgttattaatgcagtctatagtctcttcggtataataaaagtgattccttttctccaaaaactattttgaatgatattaaagctcttaaatagcaatacactaaaaacgtagcttcattaatcaaaactcggatctaaatgtgtacttagtgaatgatattagtagagaatcatatccccaacaccgttatctctccgtcatctcatcgtttgtttttattacaaacaaaccccctcgggatcacgtaggtcccactatttttcctcttaactaaaagggtaataccgtcatttaccacacctctcgccgtcactaacacggagagagaaagaatcagacagctcatcccaagcacacacactcatatcagaaaatacacagacacaacacaacactgagagagagcttttcttttaaattccttcaatttttttttgttgttgtaaagaataataatttattcgattgaatttgtttattcgtgtctttgtttttactcaatcccctgtttccggttctgttcgattcttctctgtctctgttttgtttttcgtcattttgcctaaagccacatgcaacagtgattaactgaatttttattatccatatccattttgattcgccggaaagtttattcttttccggcgacaaatgcgaaagattcgaaaacccattttaaccaaatcaattctatgacgatg

SEQ ID NO: 7641 - DNA, 3000 bp, Unknown
  misc_feature (1)..( 3000): cDNA_ID_3439322_gDNA_ID_1621155_Annot_ID_56996 3000 nt of promoter + ATG
aaataacaaacctgaaatatgatcaaaccaatgagaacaggctgtgtatcaaatccgaaactcctgaagagatcagtggagtttctgacaagagtgtatcctccaaattgtaagaaggcaaggatctgcaagcaaaacattgagagagggtcataagacatgatttcttaagtgaaatgtagatgtgagtaagtttttgaactgtcggttgagcctcacttgaactgcaatgaacgagtatgtagtgtgattcagtttccaatgtccaagctcgtgtgcaataaccgccacaatttcatcctcattcttgcactgcacaatagaagattatgttatgtttcagaaccagaaacagaaatgtgagtatagctcgtttgaagcatcaagagtcacagtacctgctgaatcaacgtatcataaagaacaatccttttgttcttaaagaaaccatacatgtaagcctgtatgatgtaacaagatacgtaagcttctaatggtaaactagagtaaagtaggtaggaagagatctcaagcttctcacattgctatggcttgaccttgtagatccatcgacaacaaacagcttcttcaaaggaaactttagagaagaagcaagtttctcaatcttctcccggaggtctccatctggaagctatagccataaaaaagcgggagattatattgtctggtaacaacatatgcaaacaagcagtgaattgtaaaatggccatgacagaaatacacacaggagtgaacttgttgaagagcggtgctatcaagaccgggtatatagtcatcatcactagagacaggataaacatgaatgcccacagatagatggcaagataaggacctcctttctggaaaaagatagaaacttcatgctcagagaagcaaattttaaatttttaacacgaaaactaaaaactttgaagctcacactcaatggagaatagtcatccatgtgaaaaactcagaaataagatgaatccagaatcatcaaacctggactatgaaaattatcgcagcaacaatgggtgggcctagtatgacagagaggaatgttcctttgatcatgtccctaatgaacatccatattgtttgctgtcaacagaatttagaagcaaatttaatccacatctctgataaaaaaacgtaagtcacaaggtagtgttggaaatacgacatactttgttgaacccatgccgagactcgatcacgaaagttgagtacaaagaaaatggcaaatcagtgatctgcatcagaatataaaagaaatattattatcttaagaaaatagatattttgatgctaaacgtataggactatatgaaggggtttatttggaacacctgtgaccatgtcataacaccagccaagaatgaaagagtatgcagtatttcattctctggatcaaggcccaacctcggtaaaacagctccagacatctaaggtaaaaatgaaaactttacaattgtaatgtaacaactctatattcaaaatgagatactgtataccgaaaccagatatgtaccttccaaaaccaaggcaagatcccaaagaacaaaattgcagagtccataagtatagttacaaactcatgaacaaagtgaaaatagctgcatatattaaagttctcagtgatgatatcccctggcaattataaaaaactaaaatgatataaatatgatcaagacgaaaccttttgtcaagactgtatgctcgtgatttctcaaacttctcttggctaattacaccaaccaaggttttcgggagagttggaagcttgagagcagtgagttgcctcagatccaaatacgtctcaaaaatgtacatcactatcataaaacctgtaagaaaaagaataaaacagaagatgaaatacgaatctactctaaatgccacaacaacagatactccatcactgaaaattcaataacatcatctacttttttgatcaaccagatataaaaagatctcttgtgctgactactgatggaaacattggagcactgaaagagttttgatgcaacattcacatacggttccacaacacaaaacccatttcaaaaaactccagaaaactctagttgcagtcacgaacataataataccctgacaagaaaacccaaaacctcaagctgtatgacttgaacaaagaaaaatttcaagattctcaatttccaatcgggaatgaggaaaaaaaagactccgacttttcttcccaaatcctagattttggttaacagagaagctccgtacattctaaaaccgaggaagagatgatgaaatcacataagctcaaatcaaatcaaacgcacgagtaagacaagaaactagtaggagtaataaaacctcagatcaaggtacgcactattagaaaagaacaaaatttagaaacgagaagcagagacgatggtatatgaaacaaacgagtcatggaatctcaacacacacaacacagaaagcaaaacccaaacaaaaacgaaatacgatgagtgaaacaggatagtaaaatgtctcagaaaaaggttttgaagcttacccacgacggtttccatgaaaggaatcgccatggctgagaaaagagtgacctgaaccgcgatgaaagcagaagcaaatcgaagaaagcagaagcaaatcgaagaaagcagaggaacgacaaaagagaggtttttcgtttttgactcttctcaggtcggtgtggatatgtaaaacaacaaaaacacgggtacgggttataccttagaagcccaaatagtaaacgggctgagatttaggcccatatgaaacaacccctatattttatctaaaatctctaagtataatagtatattatcaaatattggggccttagttgaaatattatgttttaaaggggctaaacggaaaactccttatcctcaaactgtcaacaaattacgaaggtgccattgggtttaatcaacaacgaacgccgagagctctcacttcacactttatccacttggagcttcgaca

SEQ ID NO: 7642 - DNA, 3000 bp, Unknown
  misc_feature (1)..( 3000): cDNA_ID_1818442_gDNA_ID_1621155_Annot_ID_56997 3000 nt of promoter + ATG
ctagattttggttaacagagaagctccgtacattctaaaaccgaggaagagatgatgaaatcacataagctcaaatcaaatcaaacgcacgagtaagacaagaaactagtaggagtaataaaacctcagatcaaggtacgcactattagaaaagaacaaaatttagaaacgagaagcagagacgatggtatatgaaacaaacgagtcatggaatctcaacacacacaacacagaaagcaaaacccaaacaaaaacgaaatacgatgagtgaaacaggatagtaaaatgtctcagaaaaaggttttgaagcttacccacgacggtttccatgaaaggaatcgccatggctgagaaaagagtgacctgaaccgcgatgaaagcagaagcaaatcgaagaaagcagaagcaaatcgaagaaagcagaggaacgacaaaagagaggtttttcgtttttgactcttctcaggtcggtgtggatatgtaaaacaacaaaaacacgggtacgggttataccttagaagcccaaatagtaaacgggctgagatttaggcccatatgaaacaacccctatattttatctaaaatctctaagtataatagtatattatcaaatattggggccttagttgaaatattatgttttaaaggggctaaacggaaaactccttatcctcaaactgtcaacaaattacgaaggtgccattgggtttaatcaacaacgaacgccgagagctctcacttcacactttatccacttggagcttcgacaatggcgtctccttcgcttctgcagtcttccgcttcttcgtttcacggacgtttctcaccattagcggctccatcctccgcacgaatgctctctccgccgctcagaaacgtggtgaaagtctcggcgtctggaactgtactggtcgagaaatctgaagccgagaaaactcaacgcctcaaaaccgcttacctcgagaggattatccctgcgctcaaagaagagttcaagtacgttaatattcaccaggtaaccccaaatccttcccctctgagctcaaacctagtttttgttctgttgcgattgattgaagtctaattctcagtgaattcgaattttttgagcgaatgttaaacctaatttgcttttaatgataagtttgaattgatttcttctagaaaatgtagtgaagaagcctagatttaagattgttgtgttgataaaatcgtgctgttgggatgtgccatttacaaatgtgaatgtgaatttgtcaatctcatcattgttgtatatctgcttggacatcttctctaccaggttccaaaggtacagaagattgtagtgaattgtggtattggagatgcggcgcagaacgacaagggtttggaggctgcgatgaaggatatcgcgcttatcacagggcagaaacctattaagacacgagctagagcttccattgctactttcaagatcagggaagatcaacctcttgggattgctgtcactctcagaggagatgtgagctatatttctcttgactaatcaaactttccttttgagttatttatgtattaacattttgtgattttgactgttgtgacaggtaatgtactccttcttggatcgtcttatcaacttagcccttccgagaactcgagatttccaaggtgtgagtcccagtagctttgatgggaacggaaactacagtattggtgtgaaagaccaaggtgtattccctgaaatcaggttagttctattgtatctaccctcaaaatcaaaactactaacttgttatccgctggttcaacaagatcaagcatggtttctctttagtcccactctttgtttacaaccgagcaactaaactctatgttggttggttggtttattacactctaggtttgatgccgttggaaaaacgagaggaatggatgtatgcatcagcacaacggctaaaagcgatcaagaaggacagaaactattggctctaatgggaatgcctttcagggaaggaggtggtggcagcacaggcgcgatagtgcggaagaagaaactaaagtctcatcactttgatgctaaaggaaaaggaaagagatgatgaacatagctgcctattgtatgtatcgtcttctgtaaccaaccatttcatgtttcagaaaaaccatctccttttgtaatgctttatgagtcaatttgaaaataatatcagggatcttgttgttatggtaaaaatttatcaaggtttttctgtaatttattgaaagttttgtggattatacaaaatgtagcgcgtgagtgaacgtgaaaagctagcgcgtggatttgtcaattttaccttcccctttgagagaaatcgctcttctttgtaagacttggtttcgatcttctctttttcatcatcaatcgatcaaaacaaacagcaacagcaaaattatctttctgcagatcgaaaccctaattggtttctccgttctccttttgttcttctagaatcggcgactcttacttttttttctttctaattatccttttctgatggattctggaatccatgtaattccccattagcgctaaaaaccctagctgtcgaagaccttagattactgcagaaatgttataatctgttttcatcttttcccgatttgaggtttttatttattttggttgggtgagagaatccgatacgagagattaaagccttgtgagtttaggatgagctagttttctttggctttgagctgtaatttctcttctctgaaatctttcactgtacatatagctagatcctgatgaagttgcgtggtggtgaatcgtggtttaagttttgctagttgagatattattggtggttactgtaatatcgaagaatcatatttcacggtatttactatagacaactactgtagagttacttgattaaggcgttaagaagagatactggtgttttttggcctcaatcagctaagatttttgtgcattgtatgatgagtatagcaaatgaacaacaatttgcc

SEQ ID NO: 7643 - DNA, 3000 bp, Unknown
  misc_feature (1)..( 3000): cDNA_ID_1818432_gDNA_ID_1621155_Annot_ID_57000 3000 nt of promoter + ATG
caagaatcaacggctataaagatgtccgcgtggagacgatctcgaggacggagaagctctcacgttttggctagtaactactaatttttgtttatcactaatccactatttaaatagtagtattaatcttcattctttaactacaagtgtttactagccccaacaaaaagttacattgtcgaaaatttagcgattagtttttccgaaatagtgttctatctgaagacaaccttgagaggacgagccacttgttttagttccaagcttgaatctcttaccacttcctgagcttgcattggttttctatgcacagatatcaacacattaggcaaggtagtggaaattaatgagaggagaaactgaagaagaatgtaaaactcacagaaatttggggtttagatctcagcactttgattctaccacctttaccatcaggtccaatagagatgagatcatcttttcttggaacagaacctcctagtgatggagttgcttcgtttctctctccatgtttgctccatctaccaaggtttctatttgttccacttgactgccaaatgtttccactacctgcattggacaatcttcaatctactactacactcaagaacttgaattcatgatgtacaacaaaagtaccattgctgtaaggtgacactgatgatgtcgggtcttttctgatgttgaactttatatccttcaccatggaattatcacctttctcttcaatattagtattccaatctctaatgccagaagtgttggtttcaggaacataatcatcatctacatctataaccgagtctgttctgctaacgaaggagtcttctcttccccttaagcatgatccttgaatggtaaagccatccttttcttctaatttaccaggtggtgtggagattttctccactttgttgtctgatgaaagcattctgaaagaagacatgctctcgattgcaggctcggaaacttctgtgtaactgcatttctttgaaacgtttatgtcccgtagagctctgttctctctctcttcagttatcaactcaagttccctcattcgtttctggtcatagaataaacataataagagccagatatagaagacacaaagaagatcgagataaacaccaaaacacacacctttagtttttctatcttttccaaagctttttcaagtttctcagaagatcgtgcttcgcctcttcccagctgattgcacttggctagcaattccttataactcctgtcagagtaagaaagattgttttttattagagacttcataaaagaaaattcaaagacctaagagaaaagaaacgcaatgttcaatcctcctttcctcaaattcttgaccatacctacttatgaaatttcgtaatttcagtttaacaagttgttgttacgaatgaactaaggtaaatcaccatttcataagtcactgaaggtcaaattaatcttttttaatcggattacactgctgtagacatgacaaatgggaaataatgaaccaagttcactaagtcaatgaccaaaatgagagcagggaaggagtgacaactaagtgctaagcacctacctatatcaaataaccaaaactaagtgaagccatgtgaactgagtggaactaatctatgtgacaaacctattccgaataaccaaggacttgactagtgtgtctattgtatctttcgtcttcgcgttattccccaacaaggccaacttcagtacatcatcttcctccaagcttaaatcagaaaccctggatgcaaaacaagatattagactcagaaaaggtttaaccatacgagtgaatgattaaattagaacctgaagacactaaaagagcaatatgaaagatgttatcttacaatttaagcgatgcgagctccttggcaagagccacagttctctcctgtagcttaacacactgtgagttaagctggatacattcctgtaacaaacaaacacactaagaaactcaacacaaaattctgcctgtgaagcaaaaaggatctaaaatctaaggatgttgtatagtttaaacaaacctcagattttaacttaagcaaatgctgagtcgttgatatttcttgaagagcctcccaccttttcactttatcctccttcaattgctcattgcattgatgcaactgagacacacacaaacaaaaacaaaaaaaaaaaaaatcacataaccttatcttatcttataaaccattctaatcaaacgaaatgaacaaaattaaccttatcagagacttcaacattctcctttttcttcgcctccagagccgaagtaagattctgtaccttcccttcaagccgcttcacttctcctctcaacaaaaccggatcttcttcgattccaacaaccttatccgaggcaatcgaatcggtttgattcccagaagactgaaagtaaagtcgacaaggatcctttagagagcacttctgcttacaaatcggacaatttcgcttgttcgtactcgggcaatactcaaaccattgctgcaaactagggtttccgaaagaaatcgattaaacacataaatctataaaatttcggagataataaacttcattagagaattgattttgccgtactaaccaaagttcgtgaaagacatggccacaagcggagattgattgcagattctcaaccaccggtttaagatcttcgtagcagattgaacaaattgcattccccgccgcgttttcttcggccatagctatctctccggcaatcaccgactagtcagtttccgacacagtcaccattttcttctcgagaaaatcaaaaggcaaatatcagagagcaaacacatggcgcggataaaaagttgaaatttcaatggtaagcgcgaaaatctggggaaggatagcacgtgtaagtcacgtgagataaaaacataaacaaccagtggcttgtattaggcccaacgtttttaccctataggtccattaaagcccaaatcagctattgatcagtggtcaaacaca

SEQ ID NO: 7644 - DNA, 3000 bp, Unknown
  misc_feature (1)..( 3000): cDNA_ID_1807381_gDNA_ID_1621155_Annot_ID_57002 3000 nt of promoter + ATG
ccattaaagcccaatccagatataaaggaaagcacttgtaaaaagtcacgtgagaataacattttcaaccacagtggcttgtattggcccaacgtttttttcactaacggcccaaaaagcccaaatcagctattgattagtggaggagtactcatttattaattcctcctactaattggggtttaccaacttaacagaaaaaatgcatcagttgtgtgagttgtcgaacaatcaaagtgatttaccaacaaaatataaataaaagtaatcattaacttgattagatataaaattaaaaaaaaatcggttagtcaaacacaatgtttaaattaatgttgacttaactcgtttttagtaatattgtatgtatctttataataataaaagaatgcttgggtttgggtccacgcgtttttgtgatacaatgcctcgtgcaggccacttggagctaaatattttttttgctaaaaaaactcgtcctcgaaggtttcacgtggctcatgcacccctgactgggtcaggagaatcttgaccgttggatcaaagttgaagcatttataatagctttgaccgtccgatgaatgactacaaagattgtgattcgttataagccgtacgattgactaacacaaagaggaatcaacatcacgaggcgagagataatggtaacaacggcataaaagcatttttctcgacagctgtagcaaactccacgtcatcttatcttactcgccgtgtgaaccgttgattttatgaaaatttgtcaaccttttttactcgcggagatcacgcgctcccctcgtttggcacgtgtgtcacactctgcttcactcgtaaaattctttttccttttcttctttcttattgttcaccatataaattattttgaaccaattttttttttacaatacaaattgtttttaaatttctatacaaattatatattatttttatatttatgattattacataataattagttaaattttttcaaaataaatattcttaaatctgcgtgtttttagttaaaataatttatattgtgaaacggaaagaataatattttttccgaaaataaaatgtttagtaaatttgtgtgtttatttcaaaaattatgttattgtttttcttttttttaaatgagttgtagaatgggaagaactaaataaacacactactcatattattattttttataacattacctacatgtgctttgctgttgctattctcaaaaggtaatgaatggtacaatagtatcccatgtttagagtatgtggcagagtgatcaacactatggtgctaagtgacaatcactatctttctatctacatactttttatattgcatttaagcacattttttggaaaaatataaaatggaatacatatgtgttatccatgaatggttctttttttataaacatcagttgttagattgactattttgtaatgtcgaaagctcacaacaaattaaacttttattcttatcccttaacattataattttttttgtctaaattaatcttgacaacttccaattccataatcgttggtgtaaaaagatttaagaattgtttacttcatcttgtgcgcatcgataaaaagtgggcactagtacgaaagtatggtttcccactatttaaaatcaaatcaaaggatccctaaaagcgcgtgtgagagacgcgtggaaatgtccaaaggagtgtgaggttgacaaaagatgaattaagagattattcaaagcctttgacattttatcaaagtcaaccaaatacaagaaaccggaaaccataagtggttttagtcactaggcgacaaagacaggataagcatcgagataccttcttcaagcacatacttttctctctttctagaattgcccaaaaaagccaaagagactattcctctctctatatatatatagaatataaaatattctaatatacgtattatataatcggcatatacacgtattgtgattccgacagtgctcatctttttccaagtgtgttcatacttatttgcttttaaaacaagatacagagatatgtttaatttagtaatgtctaaacaattgctatcactaaaaggaaaatatgtcaaataaacactaacatttagtaaaattgtaacgataggttggcacaataatggcatcggtttatagaggacgattcctattagtttgctaattacaacatctagtattagttttgtgcaatcgtcacatgtccttcttcatttcctgttttatatacaaaaattattcagtatgtttacaccatccgtacacaaattttatttttagttaaatatattttatagtcacaagttgtgtgactcaacaaaatattttcaggtctttttttgtaattcataaattcatgtctattaatattttcaactaataaactaatttttgcgagataaactttgaatggttacagcgatccaagcggacaaaccatctacaaaccgaaccgctttttatttatcattcacaatctatagttcgtaatgaagcagaaccaaaaaaacaaataaatttgatgcggattgactttaaactaagtttgcagcggtttgttctctgtcctaaaaaatagtatagattggaccgttgacggattagttcgcactaaccacaacatatccgtctcaaaaaatagtatagactgtactgctgacggattattccggattaaccacaatatccattcaaaacaataagttgatatgtggaataattacaatgtaacaaaaagagagaagaaaacaaaattgtatattatactgtatttgaatcataaataataatttaataaaatctttcctccatttttttcaaccctttttttattttcgtccatcttcagtctctttataaacatatctctctacccttcaaaagtcagcgctctcttttgtctcctctgcttttttctcttctctcctcagagattcgaagctttttgtctcccctgagtaaccaaattca

SEQ ID NO: 7645 - DNA, 3000 bp, Unknown
  misc_feature (1)..( 3000): cDNA_ID_1818420_gDNA_ID_1621155_Annot_ID_57004 3000 nt of promoter + ATG
ataccactcaagacgtgtaagatgcaaaaacttcttttcagattgcactgcagtctactcttttttattctcaggcccaaggacaggttttggttgggaaaagtacagttgttgacgaggatgcaatatcgagtggcgtggctgaaaatgagttagcagtagatgaaatctacacttgtgaggcaagcttttctatgaaaaagaaaaaacctataattgttgttataatcttgtttatgatgtttgtctctgacttgtttagatttgcaccggttgagtctctcgagctcgccaaaccctgtttcccatctccaagttactttatgttgtgtgttctacaaaatcgttgagaataattcattggattctatagtttgagactgaactctgatcttttgaatctcctggaacttaatggtttcgatgcaaaagattgaggcctctattcttcaaagcctaatccttgagtcccctatggcagcgcttatattattttgtgtatttccatgctactctgtagattccactttcttgtttgatgatcaagatttctgctttgatttcaggaattacttaacagatctggtgcaagaactttggaaccaaggacgatgacgaaagagagcactaaagttgatctatagttttcactttcctagtacagtactgtgtgagtgtgagtggattgatgatgtacagcagctgacattttccctctgtaatttctctaatatacagcagctgatatttccactataaattatgggatgtgtatcaatatggaaatatattaagataaatactttattaaaaggttttgatttataagctttctcattacttgctgctaaatttattagtttcctccttgaattcagcaacttttcttgggtttagccttgtaccatcgtggcatttcctataaacttcagaaatctccatgtgcattctactacgcttgtgctttaagtatgttgaatactattagataatttcccaaggattatattaattccactaatccctaggttagctgcaagatgaagttaaagttcacaactttatctctgcaactagattttgagtattttgcttctcatttcagatcttctctaagaaaagacaaaagaagatggtgttagcttgtgttcttgttgattttgtctgagcttgagggatggggaagacgaatgtattatcgaagatcagagctttcaatggcgtcaatagacccatctatgtgttggcaggtttggcttttcttatctcagtagctacattagctaagttcaactacatcactccactacgcttctctgatcggttctgtaactatcatggaagctttgacggcgacaactacaacatcggaagccaaatgagaaagacaatcgaaaccgccatttttaaaatccaccaagaaatggatgatctcaaggctttagaagctaattcttctactcctccatcctctgtttcatcagcttcaggatccatgtttaggcatgtagcttttcttgcggatgttctttcgctagttcagtcggttcatatggaattgccttcgttcgaagagagatccgtagcagatcatccgttgaagcagcagaaaggtgaccctggtgagcattttatgagagaagagataaagaagtacataaagatcaaacctaaccggctcgggaagcagaatttcatgggagctaacggaacattcacctcgatcgggcacgcttgttttgcgatgaagaaagatctagaagagtatatggactatgatgttggagaaatctgcaatgatgattggagattagctcagaagcttatggttcatggatgcgatccgttgcctagaagacggtgcttctcccgtggcccgcagttataccacaaaccgtttccaatcaacgagtctttatggaagcttccggataatcggaatgtgagatggggacagtataagtgcaagaactttgcttgcctagcaagcaacacaacagcacgaaaagggttctttaaatgcactgattgcttcaacctcacgcaccacgaatctccgagatggcttaaccgaggcgaaatcgatcctgagacgaaccaaactgcggatttctcgatagctgaagtactcgagattaaaccgggagagattagaatcggactggatttcagcattggcactggaactttcgcagcaagaatgagagaacagaacgtcacgattgtatcagcaacaatcaaccttggcgctccattcaacgagatgatcgctctgcgcggtttagtcccgttgtacttaaccgtgaaccaacggttaccgttcttcgacagcacgcttgatatgattcacacgacgaggtttctcgatggatggattgatctaatacttcttgatttcgtgctgtttgattgggacagggttttaaggccaggtggattgttgtggatcgatggtttcttttgtctgaaagaagatgtgagtgattacatggaagcgtttaaagcgttgaggtataggaaacataagtgggttgtggtacctaagaaagataaagatgataaagaagttttcttctctgctgtgttagagaaacctccaagaccctttagatgattgatcattgcatagtctctgtctttactattatctttgtaatcatattcttaaaacaaaacagaatgtcaaaataaactgagttatattttagttatatgttccaatttgcttgtataaattcagactaagaatttcaccaaaagtgttatatgtttgacatttatgtttgtaatccattgtgatcaatatgatacgacgtagtaatgtaactctctgagcgagaaagagggttctccattttgttgttaacaacaaaagcaatctccactaggttcgggatgaacgaaccaacaggctcggaccgtggaacgcgcggtatataaacaactttgcctctttgttcatcgattccgttacatcggctcattggaggaaatcggaga

SEQ ID NO: 7646 - DNA, 3000 bp, Unknown
  misc_feature (1)..( 3000): cDNA_ID_1818416_gDNA_ID_1621155_Annot_ID_57005 3000 nt of promoter + ATG
tgatcgtatgcgccgttagctatccttacttgccgtttctcaacaattggttgattagtgtttctagacagaagcatcaggatcaagttctcgtcatcgctgaggattacgctactctctacaaagttaacgagaaatggcctggtcacgccgttctcattcctccggcgctcgattctcagaccgctcacaaattcggttctcaggtataatacatctacacagagttttcatcttctcgatccaattttatctctagcttccagttcatgaaatctagctgaaaaatggctttgaaatctgagaatccatacttagttttgatcagtgattcacttatcttgaatgttcgttgattagcttgtttagtccctgaggtttcggttttaagctgtgttttggctgatcacatgaataacaaaagatagtgaacttgtggttaatatatatgcttaagagcttctattgcaatggaatcgattgtttaaactaacttctcgtatgcatatcttgaatgttcgttgattagcttgtttagtccctgaggtttcggttttgagctgtgtttttgtacatccatggctgatcttatgaataacaaaagatagtgaacttgtggatctagtagcagcagccatttttcccctgtttctgtatgtgatactatatatgctaagagcttgtattacaatggaatcgattgtttaaactaatttcttgtatagggattcttcaatttcacagcacggaggccgcaacatctcttggaaattttggagttaggttacaatgttatgtacaacgatgttgatatggtttggttgcaagatccgtttcagtatttagagggaaagcacgatgcttacttcatggatgatatgactgcagtatgtatatttttttctcagacatcttcttcattgatggtatttggattagtgtacttattattgtcttgattatgttgtcagattaagcctttggatcactctcatgatttaccacctccgggtaaaaaaggaaggacttatatttgtagctgtatgattttcttgcgtcccactaatggcgcaaaacttctcatgaagaaatggatcgaggagcttgaaacgcaaccttggtccagagctaagaaagcaaatgatcagcctggttttaactgggcacttaacaaaacagctaatcaggtatgttctttcttcctagttccacagtaaaacagtaacttctcttctctgtaaattggtctcaataagtagttactacacaattggtgaattcaatgaaattctagcgtaaaatctcaaaagactgaagcttttgctacgccgagagaggttccgctttatctaaccgtagctactcaagcttttaatcaactctgtaatctacttatgaatgtttagttacgataagcttttttggcacacacatggctgatcttatgaataacaaaagatagtgaacttgtggatgtagtagtagcagccatttttaccctgtttctgtatgtaataatatatatgttaagagcttgtattgcaatggaatcgattgtttaaactattttcagaggaattttatgacatcaaagtttaaaatctcaaaagactgaaccttttagtactcactcctacgaatgttgtttcaattcgagaggtaatttgatttggtttgaattcattcttcaactctttttgtattatctctgttctacaggtggatatgtacttgctttcgcaggcagctttcccaacaggaggattgtatttcaagaacaaaacatgggttaaagaaacaaagggaaaacatgcgataatccacaataactacatagtcggttttgagaagaagatcaaacgtttccgtgactttaatctatggctagtcgatgatcatgcttccgagtctcctttagggaaattagagtaaattccaatggcagaaaaagattttttgtcgctccatctttcttcttgttattggaatattcaggctgcagaaaggaagaaagatccatcgagtaaattcttttacattttttgggggtctttaaagtcatgtgaagaggtgttgttattggctaattcaatacgagttgagttgaatttggtaatgtagactactagaattggtattgggtctgaaatttcttaaataatcgaaacaaatactgacagctagcatatgaatacgagggtccacaagagtattaaacatatttattttgaattatagttgggtgttatttccacactttataacatgtgactaattttacaatctaatagaccttttggaggatgctgcttatgtaagatttaccgtaaatgataaacataaattaaatacgctctttgacgtcccattgtttggtcacacacactctagacttttcattcattcgtgtgttactcaaatctatttattcccagatctgatatatatatttattgcaattactaaatcccaatttccataaataatgatttctatgtaactcgttccataaattaaattatgcgtctaagttgtaacatataataaaaggataatatatttttcagtcacaccaaaaaaaaaattgataagaaagaaaaaaaaagagtgaaaattagaaagacagagaagcaaagattcttgctccctgcgaatccgcagctgcttcgaaacgcaaatccgatttgtagtctcctttgattcttccattgacgatacagcttctctttctctcttctctctgcttactttgctttttactaagctcacaagaatctacgcatctgtactgttattatgctgatgctctctacttaatcatcaccaccgcacgcagttcgagatttctggaattttctgtgtcggatgcgtttgagattcatcgaatctacttggttatagattggaaatttaggtggggatttgagttgcttagcttgtggtaggttacattttcttgtttgagattcagtgaatctctccagagttgcatgtatagaa

SEQ ID NO: 7647 - DNA, 3000 bp, Unknown
  misc_feature (1)..( 3000): cDNA_ID_1818408_gDNA_ID_1621155_Annot_ID_57007 3000 nt of promoter + ATG
ctaattacgtcctaccagaaataacaaaatcatcatcttttataaaaaaatcaatcactctctcttgtcttcttcatcttctctgtttgtgccttcctctttatcagaaattgcagcttgtacgaaaacaggtaaatcttcatatacgtagagcaatcaaatttttagttttaaggttttttattaagttcataaatttatgattttgctatgatctatttagggtttaaattatggcaaagtttacgagattgataacagccatggagctgagagccacggtggagaatcgaattcgatactctacaaaacacattaaacacttgccacctggctcaatcactgagtttgattggaaggattactgtcccgttggtttcgggtacgtacgtaataacatagtttcatgttttaaggtaaaaaaaagaagagaattggtttttgtaatgttttttttgttgttgtttgtagacttattcaagaacttgagggtatagatcatgatgattacttgctatccatttgcactgatgagactctcaagaagatttcttctgggaaaattggaaatgtctttcatatttccaatgataaccgttttctcatcaagattcttcgaaaatccgaaattaaggtaccccaaaatcatcttaacacaatctacttttaattttttcaagtgtgtatatatgttccatattgagtctttcattgaaaacaatcttgtgaaggtgacactagagatgcttccacgttactacagacatattaattatcacagatcatcactattcacaaggatttttggtgctcattctgtgaagcctcttggaggtgttaaggtgacaaggattatatatatataccactccattattagagtttgatcagccactaattagttacttttttggggatacagacatattttgctgtgatgtcaaacatgctacattcaacgatctttgtgaacaagctctatgatcttaaaggttctccgaaaggtcgatctaacaagaaaattgaagtgagaaacaccactgttttgaaggacatcgatttcgatttctgtttctacgttgatcctttggcgagacaacgcatcatcaagtactatcccacccccacccctctttctttctaccatcttgattctagttactcaacaatttattaaacacaaaaggggtcatctcattacaggcaaacaaagctagattgcgagcttttggaagaagaaggtataatggattatagcttattggttggtttacaatctaaaggctcatgtcaaggtaatgtttcttctctcttcttaggagtgcaactatttgcatatcgactttgaacttttctgatcataataataaatcactcttaacaggttcacttgatggattgaacccggtttacggtagcttcgcacctccaagtaaaaaatccttaccaacattcttcattcttttgttttatgttcttatataccaagtcttcaacataaatgtctaccgattaaatttttcaggctcgttcaaaagcaatagcacaaagtcgatgaagacggcttctagttctcctgatagatcttctgtagcaatgtattcatgctctcccgatagaggtaacaatgtaactttttaatctaattaatcatagtacttaacaaaaattacaatttttataaacttattgtcttactaacagattcagtcgaaaacgaaatgtcaatgactatacaatcagtgacaagcaatagcgcaagctcagaaacaaatatattagccacaacactcagtgacctctttcacaataggtaaagcattatcctactcctatataacaacattgctagaaatttcacatcaaaaaaaatatatatatatatctaacttttcttgtttcagctcaaatatcaattttgggatgaagattccagcgagggcacggcgagtgacgagagaaaccggagaagaagaatggtacaatgttgttttgtatatagggatagtagacacatttcaagactatggtatgaagaaacgcatagaacattgttacaaatccattcaatataactcaaactcaatctcaaccgtccatcctaagatctactcttctagattccaagactttgtctccaacatcttcctacctcacgacgatgatctctcttcgaaatattgagttgtttgttatttttgatttccaagtggaattattagagtgttaagaggtacacttcttacgacccaagttggtgttggtgtttgttgtccaaaaaatcctctcttttctgacttcattgttgatcgatcaacaaaatgtagagaaaaacatgaactattaatacacatatatcaaaaatataaaatacagaaaaagacaaaacccaaaataaaaaaaacccaacattgttcttggttcaacacaaaagaaaaaaccaatcaaaccaagtcaaccctttaattaaaactttcagttggaacatatatatctctgtttactttgttttgttaatcacaaagcagcatttagaacacttacagagattagtcttgtatgtctacattgttactctctttagatctcttagagattaggtttagccagttcaacgtttttctccttaatctctaaataattcttctgttacaacattacaacatatttaatatcttattatccttaacctaacaacttttatactaaacaaaacaaagccatttctatttgggctttacttatcttatggcccaattgacttttcttctttcttctttttcacgacgcttcttcttcctcctcgtacaacgggcttcttcttcctccattacttactcaagtatcttttctcttcatcatcttctcatctttctcttcaagtttctcttgtatgatattaagcaattaatagattccaacatagtcatgtttctgcgtttgattattgttcttggaagtataatctgaattggaaatctcttttattgcaggtttaag

SEQ ID NO: 7648 - DNA, 3000 bp, Unknown
  misc_feature (1)..( 3000): cDNA_ID_2999922_gDNA_ID_1621155_Annot_ID_57009 3000 nt of promoter + ATG
aaaaattgagaaatctagatagacataaatgaatcatttaaatttcattagcataaccaaacaacttatatattttattcatgttttttactttcattcttttatttgtattaaatgtttcagttactacaatatattattacatttaacaaactaagtaccgaccaataactaagagcaatgaagtgctaaaacgacaaacagtttactcatgcgtaagataaacgtgaagaagttcaaaacgaaacaaacttgacaaaaaatgaacaactttgaatgtaactgtacacagagccagaaactacaaaagtaaaaaatcatggtatattcgaagatgaaggaagatcttcatgatattccaaacatggctgagttctaaccatcgtcgccgccggcattctactccgaccaatccaaacatttccgatcgtttcactcttctccgactctctttccatatctcttaacctctttttcctcactaacttcaccgaaacaatgatcaccacaactacaataaccgaaactccaatcccggttaaaacaatccaccaccaattcctccgaaccaacaccggttcgtgtttcggtttgactttctcctggtttaggacaacaagtgcgtaatgcccatgagaattcgtagtggcacactcgtaattccgtatcgtattgctgatgttcaacaacaaaccattatctccaaagacgatgcatttgacttttgagcgatcacgagaagcgtgaggatcgaatttgatcaagattggcttgtctctcttgatcgaaaggttcaattttttgagatcattcgtgttggtcgcgtcataaccggtgaatccaataaccggagaaacaaatgagtaattatcagctaaccggaagtaaaccgatgaagagttatcaccgaaactctcaaagacaaaagctattcttttagcgtacggcgacgttttaaccatcggaggaatcaaaacaccactaaagtttgttccttttctccagaatatactgttacggaccgtaacaaccgatgctttgatgtcggaaagatttgacggaagtgaaacatcgtacaacgagcctgtgtgtcttcttgtagtcgcacgagccgcgtatgaacggatcagatcgtccaaatctgaaatgttgttgatgcaatgaaccatcgtttgtagattagagatgatgcagaagacgaagacgatgatgatgagaccaagctttgtagatcccattgccaagagaaaatcaagaacgacgatgatgaagaagaccaaaatgagttttggtgatcttcatcaagattagtaatataaaaaaaagaagctatgatatgattttgattaaaggatatgaatagaattgtgatccagatagataagaatcaaagtggaagaagcatgattgagatttggagacatgattgagattgagattgaggttgtgatgagggaatataattaagcacatatacacactcaaaaggaagtaagaggacatataataaaaatgtaacagctgcatgaaatatggatttgatgaatgtgtatggttgattaaataactattatatagaaaaaaaagagaccgtactttgatattcaaacttgtaagaaaaaaggggagagaaagttgggtttgagctgtattaatggtggatgctttttttttgacccaaaattatattgaagttggagtttatttttttttctaatcaaaattttgtaatggaggtgataagaaaaaagaagatgtcggctatgattatatgccgatgacgtaacgatcatgcaatttctttggttttagtattcttacgattcacatgtaatatgattataagaaaatattgaatttttgttcaaccattctgtcaatttagtgataaaattaaaatagctgtaaaataataatactattaccacattgaaaatttatttttttcttcatattttaaaattctcatctttaatatctcatcgtggactattttgatgtgcgaacattttttttttttttttcgggtaaaaatgaacaatattttttatgaaatcgtacataaaaccattcattttttctttaaatacagtcgaaaattagattgtcattgcaaatgagtaaactatcagttttactataaaaaatgtatgtatatttattttgaattgaaatgttaatgcaccaacaacattaatataaaccattatactattatgttgtaaacttgtgattattgtatctcacatctatggactcaaataattttaaattctggtggaaaaattagatagcgaactctttgttttttcatgccaactcatcctagatgaatacgtatgttgattatattaatcatacaaaaactaccaaataagattaaataaaacttttataatatcaactattttgttatattaacaagagaaatggagttttggttagtagttgaaagcgccagcgaagtattagggtggaagagctgtaccatcactcaattttagtgggtttgttatttatttctctctttttgccacatttcttttatcaaaaagaagtttcgttttttcattcacttatacaaaacataatttagagttagatatttaaagttcattgttcgaatttctctttttagttaatctcgtattgtcctcgtaactgtcttatagtttggttagaaacaaaaatcaaaggtttgcattcatttgccattttttcctcacctagaaaaagacaagagttatcaaaaaaacaagatgggcttttagtgacccatataatagatgggcctaaaaccccacagaatgcgagcattctataaacaccactgagttggatttctaaagataagaggagcgaccaataagagcgcgaggagcttccacgtgttactacacgaatcttgtttagtaaaaagcgcagctgcaaaaaaaatcgagtagagaagaagtaggcagacaaagaagaagaagaagaagttctcggcgtgcttcaatg

SEQ ID NO: 7649 - DNA, 3000 bp, Unknown
  misc_feature (1)..( 3000): cDNA_ID_1808490_gDNA_ID_1621155_Annot_ID_57012 3000 nt of promoter + ATG
aatatcaataatattttcagatattattataataaccaaaaatacccaaatattattataatacaattaaaaagtaaataaaaataggaaaatatcactttatatgctcagaagactgaaaaattaggtgtaggaattgtggactatttcaacagtaaaagaactaatgaagttactttattattcttctgtatttttcttttttttaattaaagtctcatatattgttttgttactaaatattttcattgttatcatcaggttaacctcgttaacaattattagtaaatattatgtataaattatccgttacagtaaacattattcatgtatcgaatatcttaacgttttcatataaatattattctgttatataatatattagcatgttatcattctatatatcatgtagttataattattatcatgttaattatataaaaaagtctaatttccttttattgtgctgaatatacataaataaaaaattctgatttacaattttaaatcgataaatatgttttaacaaataatttataaacttatcgcgatatcatagtttttaaaacattaaacaaataattatatacttatcatccgaatattacaattatttttattcaatagcatttttgtaattaatttttttaaaaaaaattttttggtttatatattatttatctttcatacttacctaaataactaatatttatatataaattctttattttttcatcatcctcccagcatatcgattaatatagtccataaaaatacgtcaagtttaatgcttccatgttagaagacgtgctctcaaaacttcttcttttgtttgttttctaattcacaacttgaatctaaaagaaacctggatcctaaacgttgaaaaatattaacctcgtaaacgaagacttgaaagatatatggggagtgttatatgatcacatagtgtaggtcgccttctgactatttttgtggtttatacaaaaagctacgtacagctgtaaagtcttctactctgtgtctctgtctatcatttaaagatggatttatagatagtccactttccaacaccaatcagatttgacaaaaatattaacattgcatttttgggataactatcgttgacttttttactacctattttatcggttagttattagactaaggaaacacagagtttaattgacagaacttctgagctgtttaggcccgtaattctttccctaattgataaaagggccctatttgtttaggtgcataacaggcttcattatatgggcttagaacggcccgatttgtttacatgaagacttttacattttaataatttgaacttgatcatgtaagtgagtatgagtaatgagctggtgaactttttttatgtgtgatctacataattatcacatagaataatagccataaggctttcggtatttgattcttatcaactgtggtccgacatctacttttatacacacccacttgtttttttgttaaaggcttttttctttgttttgaaagtaatgatagtgtatataactaaacataaaaactcgatattgatttgttgttttgagtatggaccctccaaaacatgaaaagacaagaaacaagattgatggcatagttgcaattttcttatacattatatgatgggtctgattggtaaccaaaaggtatacaagatttttagctgttagatttatcggaatagtgcaaagctgttagaaggaactatacaaagaaattattaaaaaaaggtgagtataaaacttttaataacacttttgataaagtttttgtgattggtaactttcaaagttatacaaagctatactattattattgtggttatcattcaaacccgatatcatcttggaaaaagttaaaatctctctccgctatacttaacaaaaataatttttttgggaaaattattttatctttttgtcgttccttccatattaagcccaacaatatttagataaaaatatagatagaactaatttacagtctgtgaagtatgtagtgtgaaagtatttcaactttttttatgatcccaaaattgatgtggttacgaaaacttactagtattacaaagactggaagaagtaaccaaacaaatggatcatactgaccaaacgggatcaagcactaacacagttgtaccattatcacgtggcgtacatatatggagagagtatatcttacgcacttagtaacgcgcgttagataacacctgatggtaccacatcataagaaaactttgcaaacaaatccttaaactaacaattgtttctgcatacaccccttgacttaaaattcttaacttttttttctacactaacttctttaacaattgaataacgagagtgtcgaaattcgagtgtacaacattttaaaactgtttttttttgtttttaaatccttaacctcttaaatataatatcaagtgtataattgtttaaatctttaaccttttaagaacttaaaagataggtgacgttgaacataattaaatatcactaaaaagaaaaaatcacaaatgcggctactaatcgccacacactcaacttcaccgctgacgtgcagatttttaatcaaatgaagaataatttcgcacatttcgaagtaaaagggctattttacaaaacatgattaagtcaaggggttggtttgcaaatatttcacaacagaaatgtgccattaaaacggcgtcgttatgattcaggcttaatcagtaggttgtgtcttttggcttttatcatcgccgccgggacacaacacaaagaggggcttagatttgtgctttcgagaagtgctttgatctctcttctccattttcacttctaatcggagatttctcttagggttttgttattcgttgagagatcgaattaaaaacttgtgaagaaatctctagggatcgtaatcgttgttggtgtggggtattacactgattccggtttgaacctgaatcgtatctatcaatcgatg

SEQ ID NO: 7650 - DNA, 3000 bp, Unknown
  misc_feature (1)..( 3000): cDNA_ID_1818392_gDNA_ID_1621155_Annot_ID_57013 3000 nt of promoter + ATG
gctttgtataactttgaaagttaccaatcacaaaaactttatcaaaagtgttattaaaagttttatactcacctttttttaataatttctttgtatagttccttctaacagctttgcactattccgataaatctaacagctaaaaatcttgtataccttttggttaccaatcagacccatcatataatgtataagaaaattgcaactatgccatcaatcttgtttcttgtcttttcatgttttggagggtccatactcaaaacaacaaatcaatatcgagtttttatgtttagttatatacactatcattactttcaaaacaaagaaaaaagcctttaacaaaaaaacaagtgggtgtgtataaaagtagatgtcggaccacagttgataagaatcaaataccgaaagccttatggctattattctatgtgataattatgtagatcacacataaaaaaagttcaccagctcattactcatactcacttacatgatcaagttcaaattattaaaatgtaaaagtcttcatgtaaacaaatcgggccgttctaagcccatataatgaagcctgttatgcacctaaacaaatagggcccttttatcaattagggaaagaattacgggcctaaacagctcagaagttctgtcaattaaactctgtgtttccttagtctaataactaaccgataaaataggtagtaaaaaagtcaacgatagttatcccaaaaatgcaatgttaatatttttgtcaaatctgattggtgttggaaagtggactatctataaatccatctttaaatgatagacagagacacagagtagaagactttacagctgtacgtagctttttgtataaaccacaaaaatagtcagaaggcgacctacactatgtgatcatataacactccccatatatctttcaagtcttcgtttacgaggttaatatttttcaacgtttaggatccaggtttcttttagattcaagttgtgaattagaaaacaaacaaaagaagaagttttgagagcacgtcttctaacatggaagcattaaacttgacgtatttttatggactatattaatcgatatgctgggaggatgatgaaaaaataaagaatttatatataaatattagttatttaggtaagtatgaaagataaataatatataaaccaaaaaattttttttaaaaaaattaattacaaaaatgctattgaataaaaataattgtaatattcggatgataagtatataattatttgtttaatgttttaaaaactatgatatcgcgataagtttataaattatttgttaaaacatatttatcgatttaaaattgtaaatcagaattttttatttatgtatattcagcacaataaaaggaaattagacttttttatataattaacatgataataattataactacatgatatatagaatgataacatgctaatatattatataacagaataatatttatatgaaaacgttaagatattcgatacatgaataatgtttactgtaacggataatttatacataatatttactaataattgttaacgaggttaacctgatgataacaatgaaaatatttagtaacaaaacaatatatgagactttaattaaaaaaaagaaaaatacagaagaataataaagtaacttcattagttcttttactgttgaaatagtccacaattcctacacctaatttttcagtcttctgagcatataaagtgatattttcctatttttatttactttttaattgtattataataatatttgggtatttttggttattataataatatctgaaaatattattgatatttttggttatttttatatttttactaaaacaaccgaaccgatccgaatccgaaccaaaatcgaaccaagtttttagaatatctgaatggttctcaacctcttcatatccgaatagatttgatatccaaaaaagaaccaaacagatagggatacccgaatgaccagacctagtattattgatataaaaaaggttgctcaatgtataatttcatttgactagctggtctgttttcgtacaaacacactcacaaaagtacgaaaataggaagtcgtcttagttttagaaaataactattgctgcttattggcatatattgaaaaatcaaatactactagtaatcgtaagttctaaatttgaatgtttttttcccgagtaattgaattgttcttagtaattaagttcacaaatttggaaaattgcgatatctgagaacgtattaatttacctgtcggtaaacagtcacactcatgtttctagatttcgtatattttagtaataatttggttagtctccttatctgcgagtcaacgagacccggtccgctcaaccgtactacagtctaaattctagtttcacgcgcttacttacattacatacgcgctcatctcttctttactcaaaagttttaaaaaacgaatatcaaatcaacgctaacaaagtttgattttttgcttccatcttcttcccctccttaagttttcaaatctattcatcaaattttcttttgtctttcccttaagattcccgggaaagccaaggaaaaacgctagaagaaaattaacataataatgttaattgttgcttaaaccttccagctcaagtttggtagtaagtaagcagacatttaatcccccaagaagcaattgaagaagacttttaattcttctgaattttctttccaaaaacccctttttagaaaattggttgcatcatagagattggttcatttattcccaccggagaagatcatcaaattcgtcttctcacctatatcgccgacgacattcttcacggttcgtttgatttctacctgttggttcttcgttttatctgaattcaatcggagatatatgtttttgagttcgaatttgataaaaaatcgaaacttttttgatttgaatcgcagttggaaaaaaacaaagcaaaaccctagaaatagtggctg

SEQ ID NO: 7651 - DNA, 3000 bp, Unknown
  misc_feature (1)..( 3000): cDNA_ID_2999909_gDNA_ID_1621155_Annot_ID_57014 3000 nt of promoter + ATG
tcaagttgattattggaatggtgtcatcaaattgatgaagaaatggttgacttacttgttgttgttgcagccatttattgaagagtttagccatccaatgctggataactgcgctgcaggaaacacagacgtgtttgtgaatggaagagagcttcacaagagagatttcgagttacttgtgggtcgtggtctgcctagagacaagaaccgttcttacattgttgatatatcaggaagaatccttgatcaagattcaggagaagaacttcacagccttggcaaattagccccaacgtaagcagattcacacaaatgatttttattcttttgagattttgagatcacctaagattctaaagttttagtgtgttaaacttgaaacaggattgagaaagtgaagcatggatttggtatgagagttccaagatcattagcttcatgaaaactccccctagtaacaactacacaaccaaaatatgattctgcttcttgtttccatcttcatattatttatttgttaaacacaactgtaaagtgttttttacatcttgattttgatttttggtattctttttaaaatatctttggggaaatgtctgtatgttttttattgcgaccagaaccggtttaggggttatagactgtatacaaaccgggttctctcggtacaaggtttgtgctttgtattatttccatttttttatggaatgatattagtttgctcttaatgacttttttttttatctcttttattgctcttttgtaagttgtaacagaagcttcatcgataacatggtttactcctcctaattccttattatctctggtttaactaaatcgtttatttaaaccggttttggtttgtaggtttctttcatgtcagcaacaatatatgtaggtcattcgaccatactcaacaattcaattaaacaatgttctcctagctgatctttctttcttcatgattagcttctaggcttgatttgccctttcctcgagttctaggtgaattatggattgggattatctatctatcggttagttatccggtttcatctttctttccactaaaatgttcatattgtctgctaattcctctcttggctgatggactagtttttgcacgtttctgaagtgggtccttcctaaaatacaagacaacagattataacttactcatgggcccaatatcaatatcaatatcaaacaagaaagagaatctgttcttaacaggcctcgtggtccgttcgtttagttttcatgtttcaatatttcttagaaaaatacaaaattagagtaagaacaaaaagatactaactagtagcgagcatgagaaaaacgagtaagcagaagttgtccactaataataaaattgtgaggaatcaagaaattctcaatacaaaaaaattttagcaatgaagaaataaaataaaatattattagcaataattggagtcactagaatgtttcatatctctttatatactaacactagtgttagttcattcacgcaaatgttaaaaaccaattctaccattgttaaacttataccaaatatttaaactagttacctgcatcattctaataactaataagtctcatgaattcacaaacatagcaatgttttgaataacccaatatatcatcaaaaagtgtggtgcttccgtgtttgctaagttccaagattcaagagaaaggttgatattgttgtaacgaaaggctgtggagatacaagtataccacctaagttgagataaaaggtgtgaggaccaaaagcagggcatgtgcttcttcacataaattaaaagaaaaaaactcaagttattactaatatgtgattaataaacacaaggacaatgagaccatctgggctggtccaacatatttttggattcctcaagcaaagttgaaaaaaaaaaacttttctgaattttttaatcagaatttcactatcaaaagtcataattgtaaaaaacaaatcctgaaatattctttattccatttccaatatatattgctgtcacaaagaaatctacaaaaatatttgttataacttaaaagaatgcccaacaatttagcctataatcatatatgcttcttggacaaaaaaaaatcttggaacaacaatgctaattaaatttttctttttttttttcttacacagagctaattaactttttcttttttgttgactgtggttaacataattccagggtgatggtatattcaatgtcgcagtatattcaatgttgcatggtgtgtgaatagttgtactataatattccctcttttcatttttatttgatattttaggaaaaatacacatattaaaaaaaatatattaaaattgatattaaatatattatttttttgtgttttacaattttttattattttaaaccaatgattgaactattaaaatttacaatttattaataataactaataaatattgaatagaaaatttacaaaatcaatctttttaaaacaaatatttttccaaaaaaatcaaataaaaaggaacagaaaaaatataatatgacagttcgaaagtataattcaaatctgtaattgttacggttttgttattcttctttcttgtcgttgtttgtgacaaaattgtaatcaaatatattgtatatctcacaatggtgtgactttttaataccatatttttttgtaacgattgtatcactacaatttactacttgtcacaaattcatgacaatagtttttactgttacaaatatgtttctattgagacaaaatattttgtatcaataaaattactttttctgcagtaattaataaatagactgtctgaaattcacaaaattattattcctgcatttaataaaagtaaaaaagggtaacaaaacatcactttcatggtcacaaagatcctaaaagttaatctcaaacctaaccatctcattctcacgagtccaactataaaatcattgaatagcttccaccaaattcactgtgctctcttcttca

SEQ ID NO: 7652 - DNA, 3000 bp, Unknown; identical to SEQ ID NO: 7648
  misc_feature (1)..( 3000): cDNA_ID_2124274_gDNA_ID_1621155_Annot_ID_173474 3000 nt of promoter + ATG

SEQ ID NO: 7653 - DNA, 3000 bp, Unknown
  misc_feature (1)..( 3000): cDNA_ID_3051036_gDNA_ID_1621155_Annot_ID_173471 3000 nt of promoter + ATG
atggatgatgtcgatgcatcatcacgtcttccgcttttcaacaatccgtactatcgcgatgctcttggtgactttggagctttttttgcaatctcaaacaagattgatcggttacacaagaattcatggattgggtttcagtcctggagagcgactgccaggaaggtaaacaactttttcttataaaatccttcatcctttgtatagtagaatgctaaaattaccctgtgatgtaatgtgggactttgaaacaggaatctttatccaagattgctgaagacgcattacttaatgctatacaaacacgaaaacacggagatgccttatatttttgggttcgcatggacaaagatcccagaaatcctctgcagaaacccttttggtcgttctgtgatgccataaatgctgggaattgcaggtagaaacactagagattttaaatcataattttataataatgtttgagactttggtcatttacctgactctttgcaatttatgggcttggatcaaggtttgcttacaacgaaactttgaagaaaatgtacagtatcaagaacttggactcattgccaccaatgcccgaggatggggatacatggtctgtgatgcagagctgggcattgccaacaagatccttcttagagtttgtcatgttctcaaggtacttgtttaccacattacccattgattgtctcagtcttagcctctttggagaaagaagagtgcttaagagtgtgttttcccatctgtttgtaggatgtttgtggattcactagatgcacagatatatgaagagcatcatcgaacaaaccgttgctatctgagtttaaccaaagtaagaaactcattccttcatctgcgaaagttcatgtgtttttagatctaaatcagatcagtccacttgggtttggatttatgtgttcaatttctcacaggacaagcattgctattcgcgggtactagagcttctggtgaacgtatgggcttaccacagtgcaagacgcattgtctacatagatcctgagactggtttgatgcaagagcaacacaaacagaagaaccggcgagggaaaatgtgggtgaagtggttcgattacacaactctgaaaacaatggacgaagatctagctgaagaagccgactcagaccgtcgtgtgggtcactggctatggccatggactggcgagatcgtgtggcgcggtacattagagaaagagaagcaaaagaagaatttagagaaagaggagaagaagaagaagagtcgagataagctgagtagaatgagaagtagaagtggtcgtcagaaagtgatcggaaaatatgtaaaaccaccgcctgagaacgaaactgttaccggaaattccactttgttaaatgtagtagacgcataaaagaaaacaaattaaaattgcttctttttttgttaggtcactaatttgtttcattcattgtttttggaaagattactgtataaaaggtctcaagtctcattcattcactctccctctctcttctcacctctcttcgatttaaccgacggcttaaattctccggcggtggagcttcactgtgaacaacaaagaaagagagaagatggaggagacgcaagttcttgagatcaatctcatctctgcgcaaggacttaaagaaccgacgggaaagctccggcgattgcagacttacgcatccgtctgggttgattcttccagcaaactccggactcgaattgatcggatcggctctgagaatccgatctggaacgacaaattcgttttccaggtatcgccggagtttctatctagcgaaacttctggtgtttcaatcgagatctacgccgttggttacttgcgagatcatctgatcggaactgttcgcttcctcgtgagtaacttcctcccaaccgccgccgtgaaagttccatctctcgtcgcgcttcagatccgtcgtccttctggaaagtttcacggcgttcttaacatcgcggctatggtgatggatgcttctgaacttccagctgatttcttcaagtcggttcaagagatccgtcggagtcggaaaatgagaaagtctagatctgcggttagttcgtcggagaacggttccgctgacgacggtgagagttcgaaagagaattcggtttgcggatcggttaatttctccgacgacggtactgactcgacggcgtcttctccgatgccgtctcctctcagagactggaacgctgttcgaaatttggcgggaaagaatcacgtgcgatcgtcatcggacggcggaggattgatgtgctgtttcttgatgaaatcgtcgggcatgttaccaccaagaagaaaaatgacggacggctgagatctgttgtcttgaatttccaacggttcagatgttcctttggttttctaaaccatcgatcttcgtcacgtgcatctctgtcaacggttcaggtctccttatcccttacgtcgtcgtttaggcagttttggcggttatgagtgttagttaacaaacagtttggaatttctttagttctagttgctcaaaacattatattcaataattgttgtttcgtttttgaacaattaaaaaatctttttgatatgaaatagtaataattcgtagatcacagaaaaaaagtgtagtaaaaattatgtaaaaagtgaaaaaaaaaaaaacgcgggaagtcgtttatgaagttttgaggagataattgttagtttaacggctggattagttaaaaccactaattacgtcctaccagaaataacaaaatcatcatcttttataaaaaaatcaatcactctctcttgtcttcttcatcttctctgtttgtgccttcctctttatcagaaattgcagcttgtacgaaaacaggtaaatcttcatatacgtagagcaatcaaatttttagttttaaggttttttattaagttcataaatttatgattttgctatgatctatttagggtttaaattatggcaaagtttacgagattgataacagcc

SEQ ID NO: 7654 - DNA, 3000 bp, Unknown; identical to SEQ ID NO: 7646
  misc_feature (1)..( 3000): cDNA_ID_3051042_gDNA_ID_1621155_Annot_ID_173468 3000 nt of promoter + ATG

SEQ ID NO: 7655 - DNA, 3000 bp, Unknown; identical to SEQ ID NO: 7645
  misc_feature (1)..( 3000): cDNA_ID_3051048_gDNA_ID_1621155_Annot_ID_173466 3000 nt of promoter + ATG

SEQ ID NO: 7656 - DNA, 3000 bp, Unknown; identical to SEQ ID NO: 7644
  misc_feature (1)..( 3000): cDNA_ID_1807381_gDNA_ID_1621155_Annot_ID_173463 3000 nt of promoter + ATG

SEQ ID NO: 7657 - DNA, 3000 bp, Unknown
  misc_feature (1)..( 3000): cDNA_ID_3051057_gDNA_ID_1621155_Annot_ID_173460 3000 nt of promoter + ATG
aatttggggtttagatctcagcactttgattctaccacctttaccatcaggtccaatagagatgagatcatcttttcttggaacagaacctcctagtgatggagttgcttcgtttctctctccatgtttgctccatctaccaaggtttctatttgttccacttgactgccaaatgtttccactacctgcattggacaatcttcaatctactactacactcaagaacttgaattcatgatgtacaacaaaagtaccattgctgtaaggtgacactgatgatgtcgggtcttttctgatgttgaactttatatccttcaccatggaattatcacctttctcttcaatattagtattccaatctctaatgccagaagtgttggtttcaggaacataatcatcatctacatctataaccgagtctgttctgctaacgaaggagtcttctcttccccttaagcatgatccttgaatggtaaagccatccttttcttctaatttaccaggtggtgtggagattttctccactttgttgtctgatgaaagcattctgaaagaagacatgctctcgattgcaggctcggaaacttctgtgtaactgcatttctttgaaacgtttatgtcccgtagagctctgttctctctctcttcagttatcaactcaagttccctcattcgtttctggtcatagaataaacataataagagccagatatagaagacacaaagaagatcgagataaacaccaaaacacacacctttagtttttctatcttttccaaagctttttcaagtttctcagaagatcgtgcttcgcctcttcccagctgattgcacttggctagcaattccttataactcctgtcagagtaagaaagattgttttttattagagacttcataaaagaaaattcaaagacctaagagaaaagaaacgcaatgttcaatcctcctttcctcaaattcttgaccatacctacttatgaaatttcgtaatttcagtttaacaagttgttgttacgaatgaactaaggtaaatcaccatttcataagtcactgaaggtcaaattaatcttttttaatcggattacactgctgtagacatgacaaatgggaaataatgaaccaagttcactaagtcaatgaccaaaatgagagcagggaaggagtgacaactaagtgctaagcacctacctatatcaaataaccaaaactaagtgaagccatgtgaactgagtggaactaatctatgtgacaaacctattccgaataaccaaggacttgactagtgtgtctattgtatctttcgtcttcgcgttattccccaacaaggccaacttcagtacatcatcttcctccaagcttaaatcagaaaccctggatgcaaaacaagatattagactcagaaaaggtttaaccatacgagtgaatgattaaattagaacctgaagacactaaaagagcaatatgaaagatgttatcttacaatttaagcgatgcgagctccttggcaagagccacagttctctcctgtagcttaacacactgtgagttaagctggatacattcctgtaacaaacaaacacactaagaaactcaacacaaaattctgcctgtgaagcaaaaaggatctaaaatctaaggatgttgtatagtttaaacaaacctcagattttaacttaagcaaatgctgagtcgttgatatttcttgaagagcctcccaccttttcactttatcctccttcaattgctcattgcattgatgcaactgagacacacacaaacaaaaacaaaaaaaaaaaaaatcacataaccttatcttatcttataaaccattctaatcaaacgaaatgaacaaaattaaccttatcagagacttcaacattctcctttttcttcgcctccagagccgaagtaagattctgtaccttcccttcaagccgcttcacttctcctctcaacaaaaccggatcttcttcgattccaacaaccttatccgaggcaatcgaatcggtttgattcccagaagactgaaagtaaagtcgacaaggatcctttagagagcacttctgcttacaaatcggacaatttcgcttgttcgtactcgggcaatactcaaaccattgctgcaaactagggtttccgaaagaaatcgattaaacacataaatctataaaatttcggagataataaacttcattagagaattgattttgccgtactaaccaaagttcgtgaaagacatggccacaagcggagattgattgcagattctcaaccaccggtttaagatcttcgtagcagattgaacaaattgcattccccgccgcgttttcttcggccatagctatctctccggcaatcaccgactagtcagtttccgacacagtcaccattttcttctcgagaaaatcaaaaggcaaatatcagagagcaaacacatggcgcggataaaaagttgaaatttcaatggtaagcgcgaaaatctggggaaggatagcacgtgtaagtcacgtgagataaaaacataaacaaccagtggcttgtattaggcccaacgtttttaccctataggtccattaaagcccaaatcagctattgatcagtggtcaaacacaatgtttaaattaatgttgacttaactcgtttttagtaatactagtacatcttttcgcatgcactaattaactcactctcgagagtagcgttcgtgagtctcgaggtttctcactattttttcttccgcagcgtcaccgactcagatttggtggtgctaggtcaccgtgttcttcacggcgttcgggagaatgtcttagttaccccagcttctccctaaggaaactccactactgttcaaaatccctttcctacacatctgtagttaaatgtcacataatctgttgaattacttgaggcttaaggtgtaaatgttatttttccttggcagagacctaaggtttatgtgtgtcttccagtttaaattatgtgtgggtgactcagaga

SEQ ID NO: 7658 - DNA, 3000 bp, Unknown; identical to SEQ ID NO: 7641
  misc_feature (1)..( 3000): cDNA_ID_3439322_gDNA_ID_1621155_Annot_ID_173456 3000 nt of promoter + ATG

SEQ ID NO: 7659 - DNA, 3000 bp, Unknown
  misc_feature (1)..( 3000): cDNA_ID_1387628_gDNA_ID_1621155_Annot_ID_173455 3000 nt of
tcaaataaagagtgtacaaatcaagacatgtcactccaacatgatcaaacacatttacacagtttctagaaatccaaactaaaaaaaaaactatcggatagagtctcacagcaacagtgcttcatcaaattcaccaggcagatttggcagcttcttgcaaacgtctttctcgctcaaggatataagaaacttcctcgtgtatgtaattcttggtttcctgaaaacaattgcaactgcagctgagaaatgtacaataagcagcaaaacagagacatggattttacaaaaaacagaaaaaacatacttttccgaatcatcattggtttcgacaagttgatccatggcaaattgttgttcatttgctatactcatcatacaatgcacaaaaatcttagctgattgaggccaaaaaacaccagtatctcttcttaacgccttaatcaagtaactctacagtagttgtctatagtaaataccgtgaaatatgattcttcgatattacagtaaccaccaataatatctcaactagcaaaacttaaaccacgattcaccaccacgcaacttcatcaggatctagctatatgtacagtgaaagatttcagagaagagaaattacagctcaaagccaaagaaaactagctcatcctaaactcacaaggctttaatctctcgtatcggattctctcacccaaccaaaataaataaaaacctcaaatcgggaaaagatgaaaacagattataacatttctgcagtaatctaaggtcttcgacagctagggtttttagcgctaatggggaattacatggattccagaatccatcagaaaaggataattagaaagaaaaaaaagtaagagtcgccgattctagaagaacaaaaggagaacggagaaaccaattagggtttcgatctgcagaaagataattttgctgttgctgtttgttttgatcgattgatgatgaaaaagagaagatcgaaaccaagtcttacaaagaagagcgatttctctcaaaggggaaggtaaaattgacaaatccacgcgctagcttttcacgttcactcacgcgctacattttgtataatccacaaaactttcaataaattacagaaaaaccttgataaatttttaccataacaacaagatccctgatattattttcaaattgactcataaagcattacaaaaggagatggtttttctgaaacatgaaatggttggttacagaagacgatacatacaataggcagctatgttcatcatctctttccttttcctttagcatcaaagtgatgagactttagtttcttcttccgcactatcgcgcctgtgctgccaccacctccttccctgaaaggcattcccattagagccaatagtttctgtccttcttgatcgcttttagccgttgtgctgatgcatacatccattcctctcgtttttccaacggcatcaaacctagagtgtaataaaccaaccaaccaacatagagtttagttgctcggttgtaaacaaagagtgggactaaagagaaaccatgcttgatcttgttgaaccagcggataacaagttagtagttttgattttgagggtagatacaatagaactaacctgatttcagggaatacaccttggtctttcacaccaatactgtagtttccgttcccatcaaagctactgggactcacaccttggaaatctcgagttctcggaagggctaagttgataagacgatccaagaaggagtacattacctgtcacaacagtcaaaatcacaaaatgttaatacataaataactcaaaaggaaagtttgattagtcaagagaaatatagctcacatctcctctgagagtgacagcaatcccaagaggttgatcttccctgatcttgaaagtagcaatggaagctctagctcgtgtcttaataggtttctgccctgtgataagcgcgatatccttcatcgcagcctccaaacccttgtcgttctgcgccgcatctccaataccacaattcactacaatcttctgtacctttggaacctggtagagaagatgtccaagcagatatacaacaatgatgagattgacaaattcacattcacatttgtaaatggcacatcccaacagcacgattttatcaacacaacaatcttaaatctaggcttcttcactacattttctagaagaaatcaattcaaacttatcattaaaagcaaattaggtttaacattcgctcaaaaaattcgaattcactgagaattagacttcaatcaatcgcaacagaacaaaaactaggtttgagctcagaggggaaggatttggggttacctggtgaatattaacgtacttgaactcttctttgagcgcagggataatcctctcgaggtaagcggttttgaggcgttgagttttctcggcttcagatttctcgaccagtacagttccagacgccgagactttcaccacgtttctgagcggcggagagagcattcgtgcggaggatggagccgctaatggtgagaaacgtccgtgaaacgaagaagcggaagactgcagaagcgaaggagacgccattgtcgaagctccaagtggataaagtgtgaagtgagagctctcggcgttcgttgttgattaaacccaatggcaccttcgtaatttgttgacagtttgaggataaggagttttccgtttagcccctttaaaacataatatttcaactaaggccccaatatttgataatatactattatacttagagattttagataaaatataggggttgtttcatatgggcctaaatctcagcccgtttactatttgggcttctaaggtataacccgtacccgtgtttttgttgttttacatatccacaccgacctgagaagagtcaaaaacgaaaaacctctcttttgtcgttcctctgctttcttcgatttgcttctgctttcttcgatttgcttctgctttcatcgcggttcaggtcactcttttctcagccatg

SEQ ID NO: 7660 - DNA, 3000 bp, Unknown
  misc_feature (1)..( 3000): cDNA_ID_3051024_gDNA_ID_1621155_Annot_ID_173485 3000 nt of promoter + ATG
tgaatctgtctcccttctgcaaaaccttccttattgctacaaacttgcaaaagcttaaccattgtgctatcataagctttagcaccagaaaactgcatctctctgaaaagttccacagccttttcccaattcccactccgcaagtttaccattacgatctcgttccatgcaagatcatctcttttaggcatttcatcgaataacttgttagcaaaacccaaactcacacatcttccataaaaacccatcgacgcagaaaccactcgtgtgtctgaattatcaagccctctcttgatcaaaccaccatggatagttaaacccagaaaccgatacattagaacagcacaaattctcaaaaccatagcgagaactacttcatcaaaatttactcctttgttctgtagctgaacaaattcctctaagaccctatacttttctactccgaaattctcagccttttccaaaaaatccctccatgaaacttgattccgagggaaccccatgaagaacacagtactagcatatccaaattcttgaaattcaaggtaacgagtgatcaagctcttagcgatgaactccaattcgaatcgatcgaataacttcatcatccgagcatgagtagctttaacagaaaccagatttttgcatccatttagcttcttcaacggataaaaatcccaacttggagacgacggttccagagatattgagaatggtatagattcaaacgactcatgtttgatttccagagaagaacaagaaaatgaatggttacctagatatcttcgctgcgagtgatgaagaaacaaggagctgtaacaatggcggtaagttgaagagaagttctccattttattcacttcacagtttccggataagaggacactatccgttttattggtattttcactacgatctcagaaacgcagcgttttatatgtttgaagaagattcactagcagaagatagcaaattactcatctaaacactacaaaaagttgagaaagattcaacatcattctcaagtgttcttacaacaaaagcagcaacttacataagcttgagctattagtgttcatcttcaagaatgatacaagacaagtaaacattttttcatgaaactaatctgtgatagtttaccatttttcccttggagtaccatcagggaacacaggagtaagtactttctcttctttctttctaggactacttgattttctacttgaaggacttaatccaatcttcacgctatcttcttcttcgtcttcatcatcatcatcaaagttaggaggcacatcttcctctccttcgtcatctgtccaatcgccatcatcatcattgccaccatcttcaccttccaagtaaccatcaacatcagaccattcttcagcatcactttcttcttcttcctcctcaccatctgcatcgcttccatcgatctctacctctcttccttcttcgtctttcctgggtcctcctctccttgggaaccttggtacagaaacaagtgcacgcatcttctctttcacaagagttaaaggatctttatctatcaattcagagttcctgtaagcttctcttaagaacaccgagtctctttcacctttcaaagacacgtagaagagatcagggtgcctaataagcattcccctcagttgttgtgagaatctgaattcctcacggaaatgagtcaagtgatccaccagcgttcttttctcagtcgttaagctcaaaagctcatgaataaccccacaagcatgcttttctttctcgagtgttcccgacctcaagtgggagaaatccttgtaaggagatatatactgcatgtcacggaactgagatatcttcctcgtctcactctttgaaagattgagaccccttggaagcttaaccctgttgaacttaggtggtctatcaataatcaaattcctttcttctgactctctagtcctattatcatcctcagataactcagcagctgacactgcaagctcaggatcccagtgagtcaactctaaagccggacctctaggcgtaggaaccacacggaaatattgcgggtaacgctgacaaatcgtgtcgcggaactctaacggaagccctaaatcagtcttcaaatgggaaatcttctccaacaatatccgcttatcaatagacatcatcaccagtttcctcagcttaacaaccagtacatcttcaagctcattcctaatcctcatttcgtcaaggtacaacctttcagcctctgatgtcatcttaaatctcaaagaataagctccttcttcaactatctcaaacacaccaggatatttcctaagcagagctataaaccgacgacgtttcttcaaacccaaatctctcctgtacttacccaaacccctaagagacatcatcctatcaggttgactcacaagaatcttcctaatgttcaacactaacttaagtttcttatccctttgaacaacgctatcgaaagtaagctctttccttctcttcacagcagctctcacaggctcaacaacaacacgagttttcctagaagtactccaaaacccatacttgttccccaaaatcaaaccttcccccataaactgagacctcgcagctcgaattgtggacatgggcaaaccggatttgaccgaaagcttggttttttcattgaatggagagttacaagagacaaacaaaggtttatgtgcagaaagcagaagcttgggctccatttctgagactccaagcctgtaaattgataactcctaataagtattctccgacgaaaaattgattccaggaaataaaaaaatcttaccttatcccttcggttcaatctagtaagaggttctgcagaagaatctgtttctggtcgcgaagatttggattggggtttaacgataaaagtcataaaaccctcttcttttttccagaatgatgtgtccatctctctgatatcctcttattggtctttaacgtaatatttgaccagaagcaggggtaaatatg

SEQ ID NO: 7661 - DNA, 3000 bp, Unknown; identical to SEQ ID NO: 7651
  misc_feature (1)..( 3000): cDNA_ID_2999909_gDNA_ID_1621155_Annot_ID_173482 3000 nt of promoter + ATG

SEQ ID NO: 7662 - DNA, 3000 bp, Unknown; identical to SEQ ID NO: 7649
  misc_feature (1)..( 3000): cDNA_ID_1808490_gDNA_ID_1621155_Annot_ID_173480 3000 nt of promoter + ATG

SEQ ID NO: 7663 - DNA, 3000 bp, Unknown
  misc_feature (1)..( 3000): cDNA_ID_2105259_gDNA_ID_1621155_Annot_ID_173477 3000 nt of promoter + ATG
cctagttcagagcagagaggacgagtccataccccagttgtattaccatcactaccattgctagagccatcattctcggagctagttgatatcaaaaccacgttagattctatatatctaagtatctattgaataagaaagagttgaggctagtttgacaaacctctgagaactcctatgttcactgctgctatgttcagcactcccaactttgttattgcttattgacattgcaagtccatcgaactctttcagctttttcatgaacccatgatctgagtttccagctgaattagctggtgcatcaatggtcaaaggggttgtaacctgcaaacattctcatacattcatatccaatatccatcatactgcacatttcacacagaaacatcacaagacaattgacttactccagatgctgattgagaaacaggaccttgtggttgtgagccctggtaaagtaaagtaggaaaacacaaatcagtaaatctggtcttttcaactatttgttgatataaagtaaccactaaaaggaagggaggattaccatttgaacaccaggatgagcataaactccaccaggagggcaaaatggtggatatggtgctccataaggagccatcattggctacaacaacaaagaaagatcaaactcaatccaaagtaacagatatacattcaacaagtttaatataagtaccgatggagacgcccacatataaggcggtggagcatgaccaggcgccaaatttgagttgtaatattgaggtataccaactctaggcccataatatgcctacaaatatcatgagaaacaagctaaaatcactcaggctaataaaacacaattcacacagcagaaacaaaacaaggtcaaagaaaaatcacctgcatagcagcccagtcatgatgatacacatgaacattactctgctcctgtatatatacaaagtaaaacaacaacaacaatcaaactttgactaaacacaaatctgttactaaaccaatcagtttccattgattccattacttacaggagcagcagcttgcgatggcttatcagagttgttagtggggtttccttcttcgttgctacccattgctcaatgcagagtaatgacacagtaactttataaacaaaaaaatgatcagatcttttagcagttcctctgtaaagcataaatctaaaagaacagtattcaattacacctagatctcgcaattgtggacatcaaactataaatataacagagatccgagtaactataaagtatagcaccactgaatctaccagtaaaagattcaaagtcgagttttttcctctgtcaaaagttcaaaactatcaccaactagtagagttacacaattcaatctacctttaactttcctagtaattttcttcactcaatacacactttctcgagaaaacagagcgttcatatataatcactcagatattcattgaagaaaataacgaaaaccaaaatccaaaaacgtaccttgagtctcagggaaaacaattcgaattgaacccacaaaagaaaaaaaaacaaattcgcttctctctcttagtcggagagaatggtttctctctctagaaccagagttcggtaaaagaagagagaggaaggagaagagaagaaaaagaagagagacacaacggagcgccaagaggctgatgaacacgtcaccgtacacgtgtcatgatcttgaagggtttgcaaagggaacgcatatgctgagctggcaaccctagatctgcgctggacattttaaatatctgacttaaataatgattggtacacgtagtcataatcgccaccgttcatcttgagatctctacgtagacttgacgtgctgctgattttattccttttaaataatgaaaatacagaattaaactataatgtataattcatttgagatccacagatgacgaaacgtggactaccaaatcaagcatatttgtttttaccatttaatcgacggctaatattgatttcatctacggtaaaatatatctttttttaaccagaaaaaggttagagtggtccccactgtaggatctactgacttgtgtcggccgttagtggttttataaagctgacgtgtcccactgaataaggaataccgttgtggtccctacggacaacgtgggattcgacgccagctcattttttaattttttcttgaaatcttttttaaaattttagacgatgactcaatcttcgccacgtaggatccacccaataaaaaagggttaacaaaatcttatctttaatgctaaattagttgagattaatccatgttgtttaaatccgaaatgatgcatataatcttgtttcttataatcattaagatttagactgaagatctaattccaatttaagagagtcactaaaaaaagaatgaattcaatttcagacaaatccgacaaggtcaaggtgacgtgttcttgatgccaattctagtgggagccacttgacgcgtgcagttagactcccggtccaagacataaatttacgttaataccctcctttattgggttattattgggccgtagttgaattattagacccaacctttttatcctgttcttgattggcacatactttgcaaaaagttaacaaaataacttttattgcaaggcattacaagagaaatgtcaaatttggttgttgcatacatgacatcttattcatatccaatccataaattgatgtgttgttattcaaactggtcttttgatgtattgttagacatatctcatatatattgaacccttggaatcaatataatagattgggctttatttatcttttattgggcttaaagggaattgttggactaaaaaaaccattaaggctataacacactaattacacgtacaatgagagtgagagtcacggacgggatgattacaagaatcatatagcaccaaatatctcatcctcactctcacatacaaacacacattttgttcacacagagatagacatg

SEQ ID NO: 7664 - DNA, 3000 bp, Unknown; identical to SEQ ID NO: 7639
  misc_feature (1)..( 3000): cDNA_ID_3089439_gDNA_ID_1621155_Annot_ID_173451 3000 nt of promoter + ATG

SEQ ID NO: 7665 - DNA, 3000 bp, Unknown; identical to SEQ ID NO: 7660
  misc_feature (1)..( 3000): cDNA_ID_1818384_gDNA_ID_1621155_Annot_ID_57016 3000 nt of promoter + ATG

SEQ ID NO: 7666 - DNA, 3000 bp, Unknown
  misc_feature (1)..( 3000): cDNA_ID_1818380_gDNA_ID_1621155_Annot_ID_57017 3000 nt of promoter + ATG
gttcagaacctgagacagaacaaatggaacagccaatgcagcaactccaccggcaataaccaaaggattgtctgtgacaaaattggatatcccttcaatcagaccatccgaatcaaaagatgaagaagtggtcatagattgttgcagagcttcctcgtacgtcagggatttagcaggagctgttgcactgcttagaacagaagttagaagagccaatccaccattgaatctcttcaagaagctttcttgggagattggtctctgtgattttggtggaaagaggttagggagcgagaaaggctttcgtggttctgatcttttctcggataacaccgacatagggctaaaagttgcggttttcagagcttccatgactctctctctctcagattctccttctacaccaagaattgtccactccgtatcatcaaacttttcccaacgattaaagatgatgaagaagaagtggaagaaaagtgtcaaggacaagagcattgagccgtttctagagagctgacgtggactgtgtaatcaatcctagccaccgcttgcttgacacgtggaatattcggatgagatacctcttgatcatgttttggtgtagaggactaaagcatagtgacttacttagtccgaaattgcatgtcaaatgtgtggccagagaatattgaagatgcttcaagagaagcctctgcatatttaccaaaatgtcctttatctagaacacaaagaacagagactagactagatacaaaaggttcctcagcatttgatttaagtgaacaaagaggatcaagtataacattaagaaaacataacatgatgcaatgtatggaacttacaatagatcaaagaaataatctaaaccttgtccgatttcccagattgaaatgccgattccccagagacgagcattctcaagccgtagaaggattgacatcaatgtaggatagaaaacagcatgcttgatgttcttatcatctctatacatgaaaagatgttcgccgctctctttatcccaacggaaagttggcttgtgtttctggagtaatgcgaggtaatcccttccggtgattgctcctccacctcctgaatcttgcgcaaaagaaaacagtttatgtcagttggttttgaaagaaaggcgggaagagaacaagttgcttatataagcttggatgctttatatacctccagagattacaaaatcgttgccgtaaaagttgataccaagaagaaccttcctggctatgtttgagtctatgttgttggatgacccaagcaggagcttgagagttaaatctatccacttgacaggagcattggggccagggttctggggatttgagaaatcataggtcataagagagaacccatcaaccgaatctttcaagaattgaagatcttctggcccaaaatcgtacatttggagcttctctgaacgaggcggaccaacgacatacatgaactgcatatgttgctggttgtttcttggtgagctcgttgagtgaagagcgtctccaagttgttttacgaatttcagtgcctagaagatttataaaaaagcttgctgacatgatgcattatgtggaaaaaaaatcgcagcggcctggaagagattacagggcataccattttccgcaaatcagggtcatgcaaaacgccataagctgcccaccttgaccaagactctaacacgataccattgtattccatttccctagagttcaaggcaaacatgatgacaaggtaagtgttaaaattcacaagctctaatgtaaagaaattcatccttttcagagcatgaaatatacaggaattgtagagctttgggagacccttacttgcactctgtgacaataagactgatagctttctctcttagtttttttttgttaagcatctccccaggaattgcttctagaacaactcttggtaatatctacataaaaggggaaaaaagtccagacaatcaaagaaggaaaaacaagttaaacatcagcattttccgggtaccgatctctggccaattcagagaaggaagaaaaataggtgtgctggttaaactaccagtgcattgcctcttgaccgaagctcttgaatccatcccttatcagcattatgtctcccttccaaaaccaatccagacccttggctaccagaaacagaaaccaaaaatgtcactactattttgtggaaaccatgagataattgcaggaacttagaactcattaacaaatgtatacaatatacctcttcaggtcgtaccataccggcgataaatgtgtaaactttgagttgaatatctttgccatatcatagcctttagagttcctacacagcatttttagcatatgaatccaatccctactgccctcagtgacaacaatttgtatattttcaatatctcaaatctaaaaatgttccaaagaaaccaaccatggagtaatgtaagctaacactggataatcatagtgcctagttgaattctctgaagccttggaatgttcctgaaacaaattcaaaccaaatttaatgaaaattcatcctaaagttttcagcttttcttctttgaattgcaacattgacccaaaactatggaactcacagtgaggatttcttggaaattaatatcagttttaacgattcccttttgacgtattgatgattccgtttggatgactcgatcagcgaatttgactttgtacacagcaatcgaaacggcgggaatcacaatgaagaagattacgaaaatggtgatgagtctccgatctgaatcttgttgtacgacttgacacagtgactcgtatccgtcgttccgccgtttcaaactctccgccgccgatgaacgtcgcctcctcgccatcgagtttctcaccagtgaaacagagaacgaaacaacatcgttagaactaggagatttttggaatgatgttaattccatatttacccctgcttctggtcaaatattacgttaaagaccaataagaggatatcagagag

SEQ ID NO: 7667 - DNA, 3000 bp, Unknown
  misc_feature (1)..( 3000): cDNA_ID_1818541_gDNA_ID_1621156_Annot_ID_57018 3000 nt of promoter + ATG
cttcaatctcacagtaagtctcttatgcatttaaatatactcacccattaggaatgcgttgaaataaactcactggtcctcttccttcctcagttatcaaatttcgctgtgatgtgggattcactgtttggctgggtatcatcgtcctctctggcatacatatatgggaaggaagaatctgctcatgaggagttcttattggttaacgggaaggagtacccccggaggattatcatggtagatgggctttcctcagagatcaagcagacaattgctgggtgccttgccagagctttaccgagagtcgtcactcatctcaggctgccaatagcgatatccgagttagaaaagggactggtacgtttccaatattttttcttctcattagtctgttatcgtcggtctacttataaaccaaatagcccatcctagtcaaattagtgattggtcccgtctatctttgtaaaatgtagcaagtactcctagaacgaaaccttagtatataagtatggaatcatatttgaaattataaactctttaaaagttcctcatgagaatcttgtctcaaacttacgctgggaagcttatatatagtttctcagtgatattggttgtgttttgttgttgagcagggaagcttgttggagacaatgtcgttgacaggagcagttccatcatttagggtaaaagaatggctagtgattgttcttcttttcttggatgcgttgtctgtatcacgtatccctcggattgcaccttatatatccaacagagacaaggtttgttccagtcaacttgaacataataaatggcgaactctaactgaatttaatctgttgataaatgttggtgaaaaatatcagattttggaaggaagtggaattggaaatgaagagtatgagacaatgaaggatatcctgttaccacttggccgtgttcctcagtttgctacccgaagcggggcgtagacaaaacccgggtttaaggtttattggtagaagaaagaaatcaacttaagatatatgaaaatagaggagtctataattttgaagccattgttttgaatgtatgaaagatcttgaagtcatgcttggcttgctttttacttggaacaaagatttgtcgcatttcgatatatgataaatgggtcagagacgttgagttgttccttttatgaaatttcttataagttagtaagttaatgagtttgaattgaaatgtcaaattttctttgactaagacatgttttcgtctaagattttgattctagactgtgtgtttctatgcatgcgagaagaaatttatgattgactaagtaatatcttaatccgtaccttttgtcgaaaaaaaatagtaataattcctagccagaatctcttgtttgttatataatacttgtttcaacatttaattcacatctactagtgtttataaatgaaatgtacatggaataaaataaagaattgtcaccataatgttttttcctaactataaattaaatgtagtagggataaaatccaataattggggatgaattattgagataggttactactttagatagggagggtctctcacctcaccttataataaaaaaagtggtcgttgattattttcttttttgtttcctctccgacacgtttgacccaacggcccattttcagcttctggtctccttcgtatattctttaggtatacaaattttaaaagtcaaaattaccctcacttattcttcttctaaataaattcctatactaattagatgtttttaactacaagaaaaattcaaagaaacatatggtggttttaatgtaccaatcacattaaaataatgggtttgattggtaacaattttaaaaaactgtacaaaattttctaaaacatacagttttaatatttaccgatcacaaaaactttattaaaaacgttacaaacagttttattctcaatttattttactaatttttcgtacagctaaagtttacagctccaactaacagctaaaacacttttagttaccaataatcctaataaataagttctttatgcattattttctatgacccttatctcttttggtttgttgtgttgggaagaaaatataaaagtttgaatggtcaaatctcaaaaagaggacaaaaactaaaaccaatgtaactttactaacttcgacgagtcccattattttttctttttcactttcaaagaaattatccatttgcctatcaatgatttaattttttttccccaccctaccaaaaaaaaaaaatgatttaattttttttcttttacaatatagtaataataaaattgtcttcacgagaagccagctatatagagagagatgattatagacgaatcacaaaataatataaagtaaaaatatttcataattcgtctctcaccggaaaaataaataaagttagagagagagattcataatcatcaaacccacaaatccttttttttttttttgttaaaacccacaaatccttactcgtacggatctctctctctttaatatcctaattcttctcttcatcgatctgagatttttacgttttcatcggtacgtcttaaagatctctctctttcttcatcccttcttctgggttttagcttcagatctgcttcaccatgaattttaatttaacccatcattttaaaatcgacagattctctcttctctaccaaactctaatttggttttaatgtttgggtcttttaaattttgcaactttttttgggcttatcattattttttttgttcccgttaaaaaaaaactttccttttcgtaattttagtgttctaaattgttttttacttatttgaagtgttcaattgttaagcttgaaagaattgtgttttgttcctttattgaaattgaatttgtgtgttttgttattagtaaagcaacaaactttactcattggattttaatctctgttgttatttgttgcaggcttgaaagtttgaagagttttgtagcctgaaaaatg

SEQ ID NO: 7668 - DNA, 3000 bp, Unknown
  misc_feature (1)..( 3000): cDNA_ID_1807165_gDNA_ID_1621156_Annot_ID_57019 3000 nt of promoter + ATG
atcctcttgacataactcatcctcccgcttcctttttcccctctttattgccaacgcttcctgattgcgaacagtctgctccataatttcatcacttggatgaagtacatccgagtacctctggtaactttcattgtctggtatgtcgcccgtagcattctcaaaaatggggatgggattgaacaactcattagtatccatctctccacggtacatgctgtatgcacccccacctcttgataatcagcataatcatccatggcgttgtgatcccgatcaatgtcactaagaacttcagcatcctctgcatcctctggtgcattcacgactggaataatttcctctgcatcactattcttctcttcagggcctatttcacgaatgaccatagcttggtttggaggaccctgctgtggcatgtcatcatcatcttcatcccccgagtcatgatcacctccaccattgaggattaggcaagcacctgaatcgtgagttagcatgccgcatacctcacagaagcctcaaagcctttcataacggaaccttaacagagtattgacgccttcctgaaattggaagttgcgttgaaatcgaagaggattgtcaacattccaattgatctgaacctgcacaaattccactcttgctactgcctcaacatcgtaatccacatccatgacatcacctatcgcacgcccaatcgcttcaattacatcacggctgagaaattggtatggtatgcccctgatttggatccagaaaggaatggtgttgagcggaggagcatttgccattggagtccatcgttgtaagatcaacatacggtcattgaaagcccccgggcctcgacgaaccaccatctccaaggattcttcagaggggaagatgaattggaattgatttccaggaattaggcggccatgaacaagtcccgattgaccccatacacgaggcattgaggcaacaatggagcgcaggttttgtcttcttggcatcacaggcctgcccaacaaaatgaatcgattgtccaccgctgcctgagccaccatcgcctccggaatcgttactgatgcatcatcaacacccagattgatgtcttgaacaacccgtatcagattatcagccattttcagaagtgttaagtagaagcgaaaaggatatagaagagtaagagggattgtcgaaattgcttgtggattgaatggatatccagattttccattatatagaaggaagggattcataaccgccaaaggagcatcgcgttgggatcgagggatcaacgtggagatacccgctaggatagtggctttctaacgacccacttcgccggcgaaatcgagaacaaccgtcacccaagtgacgagtaaccgcttaaaagcatttgtagtcgccattcttcacgtcttttgtttaatttattaatatatttttcttttttttcacctatttctaattttattcacatgaaaattcataaataaagaactactcctttttgttcaaaataaaataagataactactccttaaatttatctagatgtcatgaaatttagtaatttacaaaagactgaaaaaaacccacgcatagagctatcaagcgagccagaagtcttcgggctcagcccaaatagtaccatatcagagcgggattggacatcatttgttaggcctataaaatagcggaccttgcagacatgctcaatcgagttgtaggttttaacgggttttgttaatggatttgcggaccggtctgcagactacaaatatttaataaaaataaatctaaaatattaataaataaacacttttatataatttttaaaataaaaatataaaaaatgtgatagtgtaatgaaatataatatataaaattataagatttacaataataataataataataaaaaattcaaatttcataattgttaatttaaattttagttacttataaaaataaaagataaacttgcgggccggcctgctaacctgttgacgatagcagagcggatctaaacatattatttttgcgtgtagtcctaacggaccgatccgttgcgatcttacaaaaataagtgcccattgtagatcggtccaagtagacacgagccggcttacttgacacctctacccaggcacaaaacggcctaggttgttgtctttttgtctcgaactttgagctagagactagtgagtagcgaggttttagactttccgaacccaaaaccctacttataatattccgaacctaaagaccactctactttctccacgttttcttctcactttgtcttttatgtcgacattgtcccttaaacacatccacttctgcgcaatccaaccaataacctaatttaaattcgattttttttcttcttattataaagttgaaccatatttttgggtactttatcaatccaataactagaaattcggaagggaaagacgtaataactcataatcctttttatgacaaaaaacaataaattctcaaaacccataattagtggaaaaattaataaaatcaagtagtagtaattatttacttttctaatttccagatgtatctgtctttctcacaatcagataagccaaaaattaattgaccactgcgtgttagcttcctttacgtgtttctttcctttctctctcctctgtcacgcaagaacaataaatactatgatcacttgattttctccgacgaaattttccccagaaacaacaacagttcgagcaacaaaaccctgaactctatgtttctgttaaactcgtaaagtctcaatctttacgatttgttcttaaaaattctttcatttaaagttcttaaattggtcaacagtgtttatttttcctccaagtttgttaataatttaagatttccccacatgcattgaatatttgtcttttcttcttctttcttccatttcaaagttgtgagatttgattcgatgcttatgcagattcacaattttatgagaaattggacaaaaccctgatg

SEQ ID NO: 7669 - DNA, 3000 bp, Unknown
  misc_feature (1)..( 3000): cDNA_ID_1818533_gDNA_ID_1621156_Annot_ID_57021 3000 nt of promoter + ATG
tgtgacgacatcaacagactacttgcacaatactggtggagtaatggtccggataagcgctcaatgcactggttgtcatggaagagaatggcattgccaaaacaggaagggggcctaggttttcgagacatagaaagcttcaatatggctatgttaggtaaacaagcctggcgaatccttcaatcaccaaatagtcttctctcacgactacttagaggaaggtactttgcatcaacttctctcttaaatgcagaaacaggcacaaaaccatcctttatctagagatcaattttggaaggacgagatttgcttaaaaagggactgagggttctaataggtgaaggaaaggaaacaaacatctggatagataattggttaccaacgcatccccaaagagccccacgatgtcttgaaggaatcactccaaacgtatcgcatgtgaatcagttaattgagtcacgaccaaagagatggaacagatcacttgtcgaaaacctgtttcatgaggaggatgctaggctaatacttcaactccgtctaactagtcagccatcaccagatttgcttggttggaattatatggatgatggtgtctatacagttaaatcgggttactggctagctactcatctgcctaataacaatccggaatttgacccccctccaggagaaacaaaacagaaggaagcgatatggaagatgaagacaacaccaaaatcaaacatttcctgtggagagctctcacaaaaactttggcgacaggctctattcttacttcacgaagaataacaaatgaccctcaatgcaagcgatgttgtgcagcggaagaaactagagaacatctcttctttggatgtatttatgcccaagccgtgtggagagccacgcatgttagcagaccggaatttttcaacccaaatctttcctttgaagcgaagctcaagatacttatccaaattcataacgataagatgaatgatcctttaagaagacaactaccattgttgacactatggagaatatggaagagccgcaaccttttagtttatcaacgacgaagtagtacgtgggaacaagatgcacacaaggcaaccactgatgcttttgattggattccaagacaaaattctcggcgagatactcgaacacaattgaatcatggctgtcctgaggatggatagcgcaaaccagaatggggttacaagaaatgtaattatgatgcaagctacaaacaaaatggggtagaggtgaatgtaggctggatattgcgagatgaagaaggttactacaatgaagcttcccacaacaaagctcagacgtgcagtacaattctagaagctgaattacaagcattactcatggcgatgcaacacatgtggataaaagggcaccggaaaataatatttgaaagcgataacagtcaaatcccaaaacttctcaaaagtgaaataaacaacttcggtcttcataatcttatacaggaaataagagtatggcaacagaagtacacgagcgtgaagatacaatggactgcgagatcaagcaataaggcaacggattgtctagcgagaactcggagacccaatgatctttcatttgtcaattacttccatgtaccaaactttcttgtagacatccttcacgaggattacacttcatctatctaataaaagaagttgctgttaaaaaaaaaaagttagagataggtaaagtgaatttcatattttttggatagtatttttgaattgcttcattttcgagattaacaagcttcttctttttttaacaaccccagagtttcatcaactttcaagcaacagaaacacatgattaaaaaattaataacatcaaataaagcatattttaaaaattaaacttttcatcatatagattcttagaatgtgattgtggagccacgttggatctccagggttagatataaatgaaactgtctatgccgtgtgacagcccttgcaactattcaattcaaagttgaccatacatgaaactatttcaagcaaacgacgcccaacatcaagtattcaagttgttgatattgtctaaaagattcaccatatataaaagccaacttcatggaatcgaaattgtagcggtacaacagttactagatcaccactttatgacaagcacactcttgacatattaatcaaacttggccaagatgatcccgagctaaccacacaccacccacacatctaatatttgactgttcatgccacacttatattgaccttgagaaaaatgaagagtatatcgactcggttaacaaaacttcaacaagacaatttcttataaaaaaataatcatagactgataaatttctcaaaacacttttcaatttaaacaatttcataatatgtgtatgttgacatttctaatacatgaatagattgatgctcattgaactttattgaaatgtaaagaagagataaatgtgaaagattttatgttgtcttcaagaacaaaataagtttcaattatgttttataaaatgttgaatgtggctgttcaaaaaagtagccttgattacattaatcaaagtcttacacaatataacataagcttacacggacttctctaatgaataatgattataacttgggtttaggatcctcttttccacctagaggcttttatattgttctacaatttaattttttttaaaaaaaaaaaaaacaggagcaaaataagatagtgtgtatgtaacataatttattgttgttgtaagacattacaaataaaaaaaatatgattgcattgaagaaaacaatatcaaatgacaaatacatagaaacaaaataataattaagtaaggcaccgagagtagaaattaaaaaaagcttataaaacaaaggaatctcggtcacctctcaccaactccaatgctcacttatacagaagctgagaagcagaaccgcttttatataatcgcactcactcagagaaacagagaagacgatagatagagaaaaaaaaaaa

SEQ ID NO: 7670 - DNA, 3000 bp, Unknown
  misc_feature (1)..( 3000): cDNA_ID_1818523_gDNA_ID_1621156_Annot_ID_57024 3000 nt of promoter + ATG
tcaaaccctaatattttcatatttatcatacatgcccacacacatctaactttaaacttatgtaattagatttccatttttcaaataatatttatatttattttagcctaaatttagattttatgtacataaggcacaagcaaatttatcttgttaacttattaaaataaaacaatagagtagccgttcgattaggcctaaattcaatatatcaaaacattcaatcaattgaataacattttggtttggtataattaagaagcaagtttagatccaaaaatacagtctctattaaataggaaaactaccataatctttttaaggaaactaataattcatccctcaccataattatactaattaacttgccattctccttcgcctcctcttctagtcttcttatgattatttttcttcctcatcttgttttttttttttcagacaaaaacctagatagctaaacatgccttgtttgttcatcttcatagctttgcttctaagttcttgtattggaacgttgaaagcccttgatcagacttgtggcaacaaagtcgtgaacacaatcgtcgtcgaccaagccggttcaggtaagttccgtactgttcaagctgccattgattcggttggtgaattgaattctctatggatcaaaatcaaagtaaaacgaggtgtttacgtgtaagtaaataccaactctctactgtttttctttttccaattttagaactcagcgttcttgaccacaattttctagcatttgatttgtttcgaatgtaaaatattactgtcgttggtgtagaaataatgacctagtagcacttgacttcatcttaggcctctccacaattctacatttatactcaaataatttttctagtttcttcgttgttttggagagaattaaagcatagttgatatcattaaatcttgaattcgtgatgttctggttcatagaattctagaaccgtaattaatctaatttacaacgatttcgatggatttgcaattgttaattttcttaatagtaagattaacattaatagtaacatattgttttgtatgataatgaatgtataaaacagagagaaggtgataataccatataataaaccgtgcataatagtagaaggagagggacaaagagtcaccaccatcacgtataatggtcatgcagccactgacgtcagctcaactttcacttcatatccatcccatattgtcgtccgaaacttatcaatcatggtacgtaacggaacggaccaacatatcttttgacttatatactatattttgttacgtaacaatataattttgataatgataacattttatatgtttttgtggcagaacacttataatcgtttgactagtctaactaaagcaaacggtatgagttgggatataaagccagcggttgcgatttcggtttatggcgataaatcagcgttttacaactgtgatttcttggggttgcaagatacagtgtgggataatcttggcagacatcacttcaaaaattgttacatcgaaggtgctatcgatttcatttttggaagtggccaatctgtttacgaggtatgtatacttaatatctctctctattacgtacacttcgattttcaatggcaaaacacgaaaactgtacttgatcactatttacacaaagactgttacattcacagtacaaacacacttttataaaatctttgtttcaaaacgccctagaaaggagctaggcacagccacaccctgtactaaaatcagctttttgttctagaaaaagtaacatttcagtcattcaaataatagaaacaaacttggttaaaaccttgtttgtagcatgttttttcctagaacaaaactaaacatgtgacttgactagctaggaggactgattttttgtaagtcaacaagttgattttgagacaccaacgattaagatctatgtgaaacatgcatgaatcgtataaaatgtttgacaggactgtcatataaacgcaacggcaggagcattggcatcaaaagtgtcgtttgggtacataacggctcaaggaagaagtagcgattcggacccaagtgggttcgtgttcctacgaggtagtgtttcagggagcaccagtgtctatcttggacgagcctatggtccattcagtcgagtgatattcatccaaaccgatctctcttccgtcgtgcaccctgagggttggtactcttggcactatggtggatacgagtaagcacatctctaactataatatatcatatataccattatcaaactatatgtgataatgatgtttttttttgtgtgttaggatgagtttcacgtatgcagaagttgagtgtaaaggagcaggatcggatatgtcacgaagagttccttggattgataaacttcattctttttacactaaacaacaattctctatctctaatttcattgaccaagatcaatggatctctaatattcctcgtttttaaataaatcactttctcttttgttagattctagttgttttatgtaatttgtatttttcctttcttgttgaatattattgtctctttgaagtttgaactatgaagactttttattttcttaccttgtattcaaaccaaactgaaccgactatatatgtatgttttctcgtttcgattctggtacatttcgatcgctctttttatatgacttcggttttcatttcaattcggttcatctattacccgagtaaaccaaattgttattattattggttcattcattcattgtatttcaaattttgattctttatatttagtactctgccaattttcatcaaaattgcactaaaacaaaaacaaaaaaattagccaaattgtaaacgaatttgaaccaatatttggtaaaactgaaccgcaattccattcccagaattataccgaaccgttataaatacggttcaaagttcaatctcttcaactaaaaccgaacttttatctattcgaaccgaaccaacagaccca

SEQ ID NO: 7671 - DNA, 3000 bp, Unknown
  misc_feature (1)..( 3000): cDNA_ID_1818519_gDNA_ID_1621156_Annot_ID_57025 3000 nt of promoter + ATG
ctttttggtcaagcattcaacattttctacattttttgtaaagcagatcaatcttgttcttggttttaggtattgtctgaggaagagcagactgtaattgcagccactcctgctcaccctgaaggattatatggttagagctctctcactagttcattatcatattagaggccatggttatatcacttatggcatttcccatcatgatgacattttacttgtttttgatcagtcttatatgcaagttgtttggttggaaatttggttgagcaactttggaattttgcttggccgtccgccattgcaatgctatatccgagcttactacctgtggcagtcatggggtttgtcactaaattggcgataattgctggaggccctgtggttggaaagtttatggattatagtccgagagttcctacatatatctcgttgaatgtcattcaggtaaacttttcaaaaaacactgaatgaaaacatcacacatgactttgtggttactttccttcaacttttgtcacctgacattggaattaagtgtccatgtcataaacttattttatgtctacatgtttaggcagccgctcaagtgctatctgcaggaatgataattcatgcatacacggttccttccacatcggcgtcatcaattcttctgcagccttggttttttgcattgttattcgcaggggccattgacagtctatgtggaatagcatctggagtcgccattgaacgtgattgggttgtattggtatgctttctttgtgatgccatagaatacctgtttttataagaagataaaccgactgaagtaattaatttatcatttggtagttggccggcataaacagaccaatcgctcttgctcaagcaaatgctgttctccacagaatagatctgctttgcgaggtatagtaattttctctatggaatctatgtactttatgccctttgaacttttgaactccagtaattcatcaattgacataattgtaaccttaaatagatagctgggacgatgttatttggcattctcctatccaaatatgaccctgtgacctgcttaaagtttgctgccacactaatggtgggttctttgccaaccatggtaagtagcacctataaacttgtggttattcttctttcgtccaagctaaataagggaaacacaaagctgctgtgttgtacgaggctgaactatgtgtaatagaatcattcctgtttcctatgtttcaagtttcgaattcttttttcttcaattaaaaaggcagtctttctcgtttaggttttggataattggagcttagcctagatggagtattattagttcttttaactagataaataagctgtcatcaacattggagtgatactgttctgcttcagatcctagaagcaattccacttgcgctttaccaatttatatgggacttcttaccatcttgcacttctaatagaagaaatctgttttcttcagacagctcttatatggctgaccaacaagttctcctctggagttctggaccgtcctaaatgctccttgaacagctgttctgctgaaggatctcgtactaataccgacagtatttgtaaggaaaccttttactttatactacttggatacgcataatttatgatttgagcatgtagtagacatcacaaaataccatttgctttgttcatcagttgatattggcatggaaactatcaagctcggatggaaagaatatattcaacagccagttcttcctgctagcctcgcatatgtccttctctactttaacatcgtcctcaccccaggcagcttgatgactgcatttctaacacaacgatgtatgctacttcgactcggtcccttacttttctttagtgcttggatgaaaatcgtaattaatcttgcgagagtctttgtgctattacctattactctttcaaattagtcaccaatctgtcttttttcaacaggtgtgaatccatcagttattggtggtttcagtggattatgcgctgttatgggcgtcgccgcaaccttcttatcagcaaacttggtcaaacgagttggcattttaaaggtgaaatgttttcccgccatttgttatcttgagcttgtattgcgttcaagctgattaatgttattgcgtttgcgttttaaaacgatgcaggcgggtgcagtaggattgtttttccaagcttcactccttgccgttgctgttgctgtgtattgtagctcttctctatcccataaaagcccactcttcttcttcttgtccatgatcgtaagttgtttcttcactctctctctcgaccagtaatatgcggttttggtgttgactaaaaggtaacaaacaaatgcaggtattatcaaggctaggtcacatgtcttacggcgttgtgggagctcaaatacttcaaaccggcattccatcatccaaggctaatctcatcggcgcaacggagatctcagtggcaagtctagctgaatcgcttatgctcggagtagccatagcggcgaatgacgcttcccatttcgggtttctcgcggttctgtctcttttatcagttgttgcggcctcattgatattctgcagattgctgagaaatcccactgatgaacaaagacgactcttctccttcgaccctctctcaaattgatttggagcttttacattgaaatatttgtatagtagtttcactttcagtgtataaattctttatataaagtaaagaaaaaaattgactttggtgtgaaaaattcaagaagtattccacttccaccattactactctaaacaaaaagtactaaactggctaaaccttagttatttttctaaaccgagaattaacgagataatttaacaatcgatttcaaaaaccagcaaaccgaaatcacccaatttttggtcggtttggttcgattttgttttctttcacccctgacgaagaaaaaaaaaaccctagtcacactcagataacataaacctttgacaacaaattttg

SEQ ID NO: 7672 - DNA, 1943 bp, Unknown
  misc_feature (1)..( 1943): cDNA_ID_3051118_gDNA_ID_1621156_Annot_ID_173538 3000 nt of promoter + ATG
cttaatcattattttgaaatttgtaatgacttatgttctcttgttttcatgtctcagtggattccacaagactcgctgtctgctcctatatcttcagcggtgtacgcatgcaacagccagctgatctacaccactttccgcgatggtaacattggagtatttgacgcggacagtctcagattaagatgtcgtatctctccatccgcctacttgcctcaagggtaagtttatccaacatttcatcagattcttatttctaaatcactgtactttgtaaggtttggtacatgaatctgtataatagacttaaattgacttctgaaacatgagaaattggtatattttcataagccaaaatagttataaactcttctcattgattctctttgctttcacaggaatcaaggcttgtctcctcttgttgtggcggctcacccgcaagacccaaaccagtttgcggtaggtttgaatgacgggtcagtgaagatgatggaaccgacagagggtgaaggcaagtgggggatgattccaccctctgaagctatcaattcaccatccaccacaagcaaccaaactccagaacagttacaaagatgaacaaaccagaatggcttcctcataatccatcaatgtaactaatctcgattatttataggcagtgtcattagatcttcaaatgtagccttagtttcaagatttcaagatttcaagatattgaaaattggtaagaaataaagtttgtataaactacctgcaaatctctaatgagtgaatcaacaagaaactgaaactacactaggactaatactgacgaaaaccgatcaaccgtcatggctcgggtaggagaattccgtcaccatcatactgcaaaaccccgttcattggtttgcatctttcacccattagtattctcttcttgcacagctcctcttcttccattccttcacttaagcttcttcttcggtttcttctcctcttcaatctttgccctaagatgagtgtcttcagtcgaattcttgcgctttcccagaaactccccttcttctgaattgggttttgcttgagtttaacaaacacggtctcatcgccctcagaaccatctctctgttctctgttttcacctgaaagtgttttcttgcggttgaagacaccggaaatcacagaagtcatcttcttaactcgaaaaaccattctccgtctgatgaaatctctcttcatgttctcttctttctttatcttcttgcccatatcggcctctttcttgtgcctcctcgttatctctgatggtttaggtagtttgatcttgatcgttccttgttccattgaaaccctaaacttctacgacgttgacacagacgagtcttggcgagtctttgctcgtctcagggatgattttagagtttgatgaagatagtgatatcgtcatatgattcgatgaaaatggtaaagagagagttagtggtgtttgtggagagagtcgtgggtttgatttaactacacttcttctagtggtacagtacgttgacttgtgagaaaataaaaatcaatcacccattaaaccggccccgttttagccaatttgctttaaagcatctaaaccggtctaatcaaacgacttaaccaactaacacagttctccgtttcagaaaaccctaatttatcgttccttgtggtataagattgtaagaggaagattcatcgataacatggtttactcctctcagttcctcatatctctggtttagttaaatcgtttcggtaacccggttttggatgttgatttattttaagaatcaatcaaaaatcttcttaaacctcaatttctctctcgattcatcatcatcttcatcaccatcaaaattctcagttctccgggttggttcttcttccttcgtaaccagctcctaggctttgatttgatttacaaagatacaaaataaatg

SEQ ID NO: 7673 - DNA, 3000 bp, Unknown
  misc_feature (1)..( 3000): cDNA_ID_3051122_gDNA_ID_1621156_Annot_ID_173537 3000 nt of promoter + ATG
tttgttcagagaatatgaaagagtagtgtgtacattttgcctattgcctcaaacacttctttgagccggatattaatagtgagaactatattattttttagtatgtgcattttgtttttgtaaccaagatgtttcgagttttgggttggagaccataacatgttaattagtcttttctccgctaacaaaactcgaacttgataccttgaggcgcactttgtttggaagctccactcgaacttgagaacttaatagaccattttctttcaagcattgtgtcatccaattgatttttaaagatccagcaatcgttttaaagtgttggaaataccaaaatttacaatccaaggaactataatcttactagtattgatctaaaactataaataattatatagtcaattagatagacacttagttgctatcacaacattcgctgttatgttaccacaacaatctattcaaggccaaagtgtttacgtcgggagagacagtagaccttgtttactattcttaatgttccattcccaaagataaagtagacacttgaggaccctttccaaagccctaaacaaatcaaaagtgttttccaagtacatcaaatcattatcatcttaacctcttttgtcgtcttgtgtccaatctttaataattatgctaagcattgttattatctatttatgtatatcgtaactaagtaacacccttagatatctaaacagagataaacatgtcattagtgaaagtgatgtttggtctgtgtctcctactaattaggaagcaaatgaaatgatttcttccacttagcaatttaattaacttgattaaattctcccccaaaagagctaataactgcctcaacttaaaactatgcacttaagggtcttaattgttacaaaattagtaataaacggtcccatttcggatgcaataatccatttattattaagatccattgaattggaccactaaaacgtatacatacacacacacataatcataaatatatcaaaagaaactatctatctaagcaaagctatacttttacaggttggtgtgttcactgtgtttggcaaaaagggtcatgttcatttttaaaagttggtacttagatttctgtattttcaatgtcaataaagagacattcttgattttttttcttctaaaagatatgataataatacatgcaatgtagatattattatccccactagctaaaatcttataacagcatatttatagatcatggaaaataattcaatatttttgtctatttatgggggagatgacatgtagttaaatagtgcaaaactaattttagtgtaaaagttgaaagaagagaagaaaaaagtggaggttcagaaattgatgtgtgctttttatgaactgaaaactttatgtgcctaatcctcactttagccagcatgtttctgggctgccttttttagtgggccatttgatttcggcccgagtatttattttaatgtaatccttaatctaaaccattgattttataattagccacgtcgatcgaaaatacgcgcctattttttctttcctatggttaggatccgaagcttgggtttgaatatatttttatactagttttcaaaaactactgaaatatgcatgcccaaagttataaatgactgcaaaaattttgttatatcaaagtttcacccaataataagttatgtatagtaataaataggatgaaatcattaaaaagattttatgatataaaatgagataaatttgtggaatctacaaatcatgcatgtacttatattttatagatggataggggatactaatgtttgtgatatgcagagagttaattctcagctatagaattataaatgttttagattggattttgtaatcatgtttttttcaagtattaacattaattaaggataatataaatgtaacaacataaatttaacttcttcatatgcactaataattgtattgaatcattatttaatgtcaatatgttacgaagtaaaagttattgggaaaaaatcgactagtagattcatacattggaaaacaggtattatgcgaatgtgactacgaaacaaacttatagtttggaaacagtggattgatttgatgaaaaaatatatataaatcccgtatgcgaagtatataaatttattagaatttatatacttcacataagttagtttgaaattctcctaaatgataaaagtatgtattcaaaaatatttatatagttttaatgtccatgtttcataatccgattagtcagtacctaatgatcaaaatttattgaaaatattttattgaaatcacacactactctacacaaatattcttaggatccattacataaatggaaaatagttgtaacttttatagaataaaagaaaaagataaattattttattccactcattaatataaaatagtttatggaatattttttccttacaatatcctcagctgtgttgttaatagaataagtatccatatttgtccagattttcagcataaatggtataaaatacttctcaatattttatttccctaacatttactcctcttattgtataatcatttgcacccttacatatatttttatccaacctaatcaaaattttctcttctctgatccataaaactatacaaaaaaaaatagtaattaagagattaaaactatactaaaattttccttcttttaaattttgttttgtttttaagtttataaggacaaattacacatattgccacgaacggtaacaaagaaaaggaaacgaacctgggacgtttggagtcaggttcggagcgtatttcgccatctttcttcttctcccctaaattttatcttttagagagagaaaaaaagtgagagccgagaaagtgagggaaaattttcatttcaaaacaccttttcttcttcttcttcttcgtcttcttctccctttataaacaccgcaattttctctgcatctcataatttcaccagaatctcag

SEQ ID NO: 7674 - DNA, 3000 bp, Unknown
  misc_feature (1)..( 3000): cDNA_ID_2124179_gDNA_ID_1621156_Annot_ID_173535 3000 nt of promoter + ATG
cttgaacgaactcgctctgtttcaacttttctctgtgatcctctgctgaaagagactgcttctcaacattcctgtataagacagatcaagacaagaaccatcataacaaactctgcaatttgcatttctacaacaacaacaaaaaaaacactcagatcacaagagcttttaggttattggtaaaacaagggatcaactaaattccattaaggctcataaaaactaaggatgagtaatatgcgatgacttaacaagaatgatcaagaaatcaatgaggatatcatccagaagtgtaatccaaatgagaatgtggaagcatacctttcaggcaaactctgattcaatgttttcttggcagaacttgtgtctgcacatagacttgactcagaaatgaaaaagtcatcagccattggtgaaatgaatgaagacagtaaaggatcagcagctatactggcagaagaagaggatacagcacgtgatgttccttcaaataggctctgaaaatttccatcaggaaactctctcttcaagatcgatagcatggattgagccccgcctcttcttgatttccttttccgcgtcacgtaatattttgttaaggaatgtaactgttagagataaaatctttattatgatagtagaaaagatagaacaataaagcaacaagagtataaactcaatagaatcctccaaagctctcaattgcttggttaggtttcacaaacaaaacctaacccttacttctaacagaacataaataaaagactctaggaaaagtaaatcctaaactatttcctaaatcataaatcaggaagtattcatatcattaacacaactcattggaagaatcagataagtacatgatcgttaaaaatataactggtagagagagcaaaaaggatatcttgaacatatttgcatgttgtagggttatatgagcaatcatatcagagctcactttcaccgcacaaatgggacatacctacaagattaacaatgtcaaaacgcagaattgaaaacaaatcttgctattgtagcaataaacaagtgtcctagagttgatttcttctctgaggaacactgagtggcaattccaaatactatttcgacgcatttcattaggttactttcactttctttatatccaagaccagtaactactaaacatagaacagtgctcttaccaagaatgatatgatgaaacaataaatagattttgattcaaaacgagagaaaggtaacattgaggaaatatctaccccattttttgcatccataggatgatcttcatcaatgtgacagcatagagagacgatatcaaaatagtctgaacagaacgggcaagcatactcctccctgaagtcatcttctccttctatctcctcaaaccccaagaaattgtctgcgtttttcaaaaatgaagaaactagtcaaacacggccaagagaacattcgaaaatgtgacaactacaaaacaaaagcctagaaaataaaatgacaactacaaaacaaaagcctagaaaataaaatgggaaatactaaaaacgcgttccattctcgaagttccaatacaaatgggtttcagaagaaacatcaaagatatctaaataaacgaatggaaactagtagatcataaaaccttccctggcaaagacgtctaagtttgagatgaaactaaagcttttaaaaacgtttttaccaacaagaagttttgtatttacttgtaagtcaaacaagaatcatcaagattccagcttttgacattaagttcataccaaaacctagaaacaaaacacacacgcttaatcaatccctaaagcctcacattagtaaaatgcctcaaaagacagaatttatttcctccattttccttaaattcaatatcagcaaaacaaacatttgaacaatcaccatttcaaatattcagaacaagacacaatcaatgtcttgtcccattttgttcggaaaaccagaacagtaacaaaaatgtcaatctcttacagtcaatctcgatccttgatcaattcaaaagaaaacaaatttgaggtctaaatatcattgatatttttgcaatagaatcaagattaaatttaagacaaaaccaatcaaatctcaaattaagaaagaacaaatccaagttataatttttatcaaactcaccagatcgagacaagaaatcgagctgatatcttcttgaagccgatgcgagacgatcactccaagaatcagaatccattttttctacgaagattattacaaatcgaaaccaaagaatccactttttcaacaacaacaacaaaaaatcaaataaattccaagaatccgaattgatcttgagtccggataaaacaaaaacagagatattccgattcaagaatcaaaagattccgacgaaatgcaaagacgaagacgacgacgacgattttgcgtcttttttttctggaattcgtctttttatcttctttttttattatggtttttaattctttggatatagagagagagagagagtgaaagacatagaagagatgagttctattacatgtattaaattgttttttaacagcccgcacgaatgcatgccgtttaaaccttttacccgccgtgtttttcccttttggaatatcaaaacgtcatgctgttagtacgacgcttacgtgtcgaaatattattggtttgtatttggtaagctggtgaaacaggacaaagttagccgcgcaactgttttttaacttttttttttactgtttccaaagttttaagttttggggaaatagtgaaaagtgaaaacctcaatttgcaaatctgagagtttactttcctcatcggaaaaagttttgatctcgccgctctccgagcacttccttgtcggagtcccaatttttgtgttcggttttattctcggtcgatgatgaagccgcgattgtgttcagatcggagctgatttcgaatttggatgtgaaattgagattctagggatttcaaattttgacgatcatg

SEQ ID NO: 7675 - DNA, 3000 bp, Unknown
  misc_feature (1)..( 3000): cDNA_ID_1818501_gDNA_ID_1621156_Annot_ID_173526 3000 nt of promoter + ATG
tttttagtttttttgaattaaaaccttccaaactattgttattataaaattttaaaaccttccaaactattgttattaatattttcaaattttaatgctttacaaaatgtcattatttttgttattaatatatgaaaaagaaataaaaatattttgaatgtttttgttcatcaataccgatcaacactggtcaaccctatatttagacggttggcataccgagataaggtttgaaaaatttctcaaaaaaattataagaagatgaatctctaatctcaaatgtttgtttacatagaaatttactttctcaaaaaaatataaaaaataaagtataaaaaaataattaaatctattggatgttctaccaaaatatagaaaatagaaaataaaaaaataataagaaataaatctagttgtcgagggttggaccgatcaatcccaacatatgtgtctttatttgtttcgacatgtgaagattggaccgatcgatccatgcacttctcgtatcaattagtccatgagcttccgggatattcaacgtcgacatctgggatttggaccgatcagttcaagtcttgaatcaaccgatcttttaagtctttagggaaaaatgaattttaaagtacaaaatttagacccatcagactaatgtttggatcgaccggtcttttaaccctttctttttctctcatttattcttaacccgaacagatatgaaacctttcaaatcaacattacttagaatttgtaaaagactcgaaacataaaaaaaaaaaaaattagaaaagactgacgttagcacgacaaacacatcaaaaagaccaaagacaccaaaaatacaatatatcaacattccttctatatatgtgaaatgttacattttttgtgtggacaataaagttaccgtgtaatcaacaaaagaaagtaaacccaaaagatatctgggaactgtgcacaaacaagtgtctatttttggcaataacattaacaaacacatacatttacaatattagaaagtggtcgacaaaatactaaacggtggtcgaccgtcgacagaaacaaaaagaattgcgaaatggtaacactaattatttgtgcaatagttatgatttctataaggcttatgaaaactgagatatatgagaaagtggagcccgaaaacccattttgtggttcccaaaatacatggaaaataactattacgatttggcatattagacctttgcactgtttactataaagtttttttgccttcttctataactgaaaagtttatacctttgtatttgtatttccatctcccaatttgctctacatatctctctatctatagctgtttggacggactattattcacttattattattatttatttcattttaaaatttaacacaaattttattaagaatattatcttatattgaaagttgaataaaatcttaatatatacctcttattaacacaaactatatatctctttattgattgtgaattggttttgaattaaaaatccacaatctaatatagtattaaagtccaatttgcacatattcaattcaatttacattggtctgacctaatattaactcgtcaatccatatccgaacatatcaaaatcaataggttgaaaaaccatcatctcaaaaaacgttttagaaaattatttttcacattacaaattaaataatatatatatatatataatataattatttttactaattattaattaatttgagttggaaacgtacaatttaataaattctttatttcataaaaacactatactttaaatagatatcatatacgaaacagactatactattagcagagtatatcatttaattttcaaaacaaacaataatttggcataaactaaattttctttacgtaaaatggtccatacttgatctatatagtactacggattgggatttatgatctaatccataacggttttgtccatcgtggccattcaaatctcatatctatatttggattattaatttgcagaagaaatttataatttactgaaacctacaaacaattaattcgagacaacaaaataaaataaaaagggaataatacattaattaataattttggcagaggtggtggagtgagaaactgggaaaattcaaaacactctgtttctctctctcctctcactcttcgttctcttctctcgtcacatcaatccacactgtgaagtatctgtttttttttttttttagtttttcaagttctctgctgctactattggtctgtcttctctacctaaatcccaaatcccaaatcccaaatctagtatcatctaaccttacttcgtcctcttttgatttaacctctttctctgatctgacccatttctcaagaatctctctttcttcttaattcattggtgttttaaccttttcatcgattccaattctcaattgttgtctgtttgaggaacacaagacccccccttcccctagtgttgctcgcttctagggctagatcttctgggaacgcgaaagtttaggtctttaatcgattttgtgcgtaaacagtccgcagcatttctgggtttttgttcccgttgctacattttgttggtaacgtgtcgaattcgagaatttgattggtttcttcacaagggtctctggagttaacccaaaattggaatgagctcataagttaaagttgaggtctttgtaacctttaggtaaatttgggttcatgtgtgatctgatttctttgaatttcttaaaccgattcaagttttggtctttcacagctctcttctgtattatcctgtggtggtggtctcttctgaatgtgaattcaaattaacctgtcttaatctccatttagttcagctagaagttgggttaatttattgaggtttatgcaatttttggtccggtttgttttggaatcaagattatttttcgctgcatcttgcagtccaggacagtgattcagtgattgtgttatctgtagatgaactaaaaatg

SEQ ID NO: 7676 - DNA, 3000 bp, Unknown
  misc_feature (1)..( 3000): cDNA_ID_3051076_gDNA_ID_1621156_Annot_ID_173518 3000 nt of promoter + ATG
gaagtttaaaataataatataatttatttaacattaatttaatgagagaacattgtatttagcatgtattaatttgttttttaaagtcatttactatgggtaataatactcattaaaaaggccattgaagtttaaaataacaatataatttatttaacattaatttaattgaataaaattgcatttatcgttgtaatatagtgttttcattcattcgttacatcaaattaaaaattttgggcttataagacttaatttttgaatacttatgttatattctaagaatcttaacgcacacgttgaatacttatgttatattctaagaattttaacgcacacgtgtcacgtttattgttcagttgttgacatgtatcagatattttgtaattttttccaaaatgaaataggaaactaaaaaataaaacatatttacatattcaaatttatatgtcaacatctacaatatttaacttataattttcttaactagaaaggaaactaataataatataaagtgtataaaattaaattgtatttgtattgcaaaatcaaattgtatttgtattgcaaaatcaaattgtatttgaattttatacgatcaaattaaattttatttgtattattataaagtatatatttaaattatactacaaaatcaaatttgtaagattgaaatttggtttaagaaaatattaaattaaatattaaaagtatatcagttactatttaaactttaaatatcgtcaataagatggagtgtatagaattaaaaggcattttattatggggaaatatatagttaaaatgggtagtaaaattgaatgtgtatgattaaattttatttaatacataaattactaagttaaatattagaaaaagtgtgtggatctctatttactatatcaaattaaaatattatttataaatattttaataattttttaatattttatatccagctatttaggtcggccttatctggtatgtatatattgtaaaaactataaatttatcatgtacgatctttttgaaaaataatattggattttagagacaaacgaattatattttcaacagaaatcctgatttagttaaaaaaaagagaccaaaaacccctaatgtcgattgggaaaaaactgacctacatgatacatgataatcaacactacatattttttctttcgtcttttgaaaattggtttttaaaagaaagatgcaaattcaataataatttgtttgtggttttaatagtattagaaaaagcatattcttttaagttttgcgtacactgttggttcaagtccattagttacatttttttatattacattttttttttagttaactttgttactagatcttatgatacaaagctgaattttaaaaattcaatgacttttctaatgaatttaaatatatttcaatgattttttttaattatataaaaaattacattatttaaatatgcattaggccaccaaaattaaaaaatcggtcatgcaagaaagtctacatcaatgagtacgtcttgcgtctgatccccaactttccttctatatatggtaacaacaaaaatcgatggaatctttagacctaatatccaccaccggcaaatggcaagtggtcaaattagcctcaaatctcaacccgatgaaacctaccgtcaatgtgccacaaggtcattatgggttccaacatatattttgtcaacaagaaaggcatgggctgcaaagtgttggacttggacacaacaacacttaaaatggagagaaattatgatgcagctatgaaaaacaatgattatgccacctccctgtgttataaacaagcgtttatatatatttatatatattgttatattcttaattttggtatgaaaatgtgttattttttcaaatcacccaaaaaaacattccatcagaaaaataaagaaggctaatggaaaaaacacaaacaattggaacaaatccaaaggatgtcatcaataagccatatccaccatgtaaaatgtatacaatggaataactaaaacacaaatccaaaaaattaaactttaaataaaaaaaaactgattagaatctaggttaaaatttagtttttgatcaaggtatgaagaatgtatctcttcttcacaactttatcatcttcgtatagatcacatttaaactttcaaagtaaaaacataaagaaatttacaagatttggataacttcgaagccaacttttaatgagttcagaacctaaaaattgtgggaaggacaacaaccaaattgttagcctttggacattaatcgatggagcatcgattagcctctggacattaatcgatggagcattctgacacaagacaggactatagcctagttctgctttttctagtgagaaaagaaaagaaaaaaacattaaaatctgtgacatctcacgtgctctctctctctcttctatctctaattgtagtttgtatccaaatccacgcgcctttttccactctctgtctccacttttctttctagattaatcaaattctttgaaaccagtttctcacttcgcctctctcttcagatccgtcctctgtagctctgtatgtctcttctaatctctcctctcttacggtttctcgagattcttgtgttctgtttactcaattaccttggaaattaagctaaattttttgttagggtttgttttagaaatcgggtaaggcacatttgtgtttgatcttgttcctctgtctccaaaagcattgattcatacccagtttcgttaggttttgatgtttgaaccttaacatttgaattttgaatttcaaaaagtatagatgaggtctggtttctaagttcccccactcagaaagtaatgatttttttggtacttttcctttgtttgtcttggtttagtaactttttgtcttttagggtttacaaaagattgaagctttatgttctcttcttttgattttccaacacttatctcttgttctgtgaagggttgcagagaaca

SEQ ID NO: 7677 - DNA, 3000 bp, Unknown
  misc_feature (1)..( 3000): cDNA_ID_3051084_gDNA_ID_1621156_Annot_ID_173514 3000 nt of promoter + ATG
cctcctcttctagtcttcttatgattatttttcttcctcatcttgttttttttttttcagacaaaaacctagatagctaaacatgccttgtttgttcatcttcatagctttgcttctaagttcttgtattggaacgttgaaagcccttgatcagacttgtggcaacaaagtcgtgaacacaatcgtcgtcgaccaagccggttcaggtaagttccgtactgttcaagctgccattgattcggttggtgaattgaattctctatggatcaaaatcaaagtaaaacgaggtgtttacgtgtaagtaaataccaactctctactgtttttctttttccaattttagaactcagcgttcttgaccacaattttctagcatttgatttgtttcgaatgtaaaatattactgtcgttggtgtagaaataatgacctagtagcacttgacttcatcttaggcctctccacaattctacatttatactcaaataatttttctagtttcttcgttgttttggagagaattaaagcatagttgatatcattaaatcttgaattcgtgatgttctggttcatagaattctagaaccgtaattaatctaatttacaacgatttcgatggatttgcaattgttaattttcttaatagtaagattaacattaatagtaacatattgttttgtatgataatgaatgtataaaacagagagaaggtgataataccatataataaaccgtgcataatagtagaaggagagggacaaagagtcaccaccatcacgtataatggtcatgcagccactgacgtcagctcaactttcacttcatatccatcccatattgtcgtccgaaacttatcaatcatggtacgtaacggaacggaccaacatatcttttgacttatatactatattttgttacgtaacaatataattttgataatgataacattttatatgtttttgtggcagaacacttataatcgtttgactagtctaactaaagcaaacggtatgagttgggatataaagccagcggttgcgatttcggtttatggcgataaatcagcgttttacaactgtgatttcttggggttgcaagatacagtgtgggataatcttggcagacatcacttcaaaaattgttacatcgaaggtgctatcgatttcatttttggaagtggccaatctgtttacgaggtatgtatacttaatatctctctctattacgtacacttcgattttcaatggcaaaacacgaaaactgtacttgatcactatttacacaaagactgttacattcacagtacaaacacacttttataaaatctttgtttcaaaacgccctagaaaggagctaggcacagccacaccctgtactaaaatcagctttttgttctagaaaaagtaacatttcagtcattcaaataatagaaacaaacttggttaaaaccttgtttgtagcatgttttttcctagaacaaaactaaacatgtgacttgactagctaggaggactgattttttgtaagtcaacaagttgattttgagacaccaacgattaagatctatgtgaaacatgcatgaatcgtataaaatgtttgacaggactgtcatataaacgcaacggcaggagcattggcatcaaaagtgtcgtttgggtacataacggctcaaggaagaagtagcgattcggacccaagtgggttcgtgttcctacgaggtagtgtttcagggagcaccagtgtctatcttggacgagcctatggtccattcagtcgagtgatattcatccaaaccgatctctcttccgtcgtgcaccctgagggttggtactcttggcactatggtggatacgagtaagcacatctctaactataatatatcatatataccattatcaaactatatgtgataatgatgtttttttttgtgtgttaggatgagtttcacgtatgcagaagttgagtgtaaaggagcaggatcggatatgtcacgaagagttccttggattgataaacttcattctttttacactaaacaacaattctctatctctaatttcattgaccaagatcaatggatctctaatattcctcgtttttaaataaatcactttctcttttgttagattctagttgttttatgtaatttgtatttttcctttcttgttgaatattattgtctctttgaagtttgaactatgaagactttttattttcttaccttgtattcaaaccaaactgaaccgactatatatgtatgttttctcgtttcgattctggtacatttcgatcgctctttttatatgacttcggttttcatttcaattcggttcatctattacccgagtaaaccaaattgttattattattggttcattcattcattgtatttcaaattttgattctttatatttagtactctgccaattttcatcaaaattgcactaaaacaaaaacaaaaaaattagccaaattgtaaacgaatttgaaccaatatttggtaaaactgaaccgcaattccattcccagaattataccgaaccgttataaatacggttcaaagttcaatctcttcaactaaaaccgaacttttatctattcgaaccgaaccaacagacccaatggccatggatgatatggttagccaggtggctatggattactggttacaaataaatctacgtggcttaatctcccttacacaaaactctctgtgccttttcttccccacttgagctaattcgcttaaacggcgtgcttcgcgacgaaccgccacagataaggttcttctttttttttccaatatctctggattttttttcccctcgttgaagaaaatctagtggtgattaagccataggggaaacaaaacccagagagacgagtttgctagattttttttttttttggaggctgcatgagtttggagaagaaggcgagtagtacaaattacaactccagaaaggagaagaggagaatcaatttatagaatggttgtttca

SEQ ID NO: 7678 - DNA, 3000 bp, Unknown; identical to SEQ ID NO: 7669
  misc_feature (1)..( 3000): cDNA_ID_2124101_gDNA_ID_1621156_Annot_ID_173507 3000 nt of promoter + ATG

SEQ ID NO: 7679 - DNA, 3000 bp, Unknown; identical to SEQ ID NO: 7667
  misc_feature (1)..( 3000): cDNA_ID_3051091_gDNA_ID_1621156_Annot_ID_173501 3000 nt of promoter + ATG

SEQ ID NO: 7680 - DNA, 3000 bp, Unknown; identical to SEQ ID NO: 7676
  misc_feature (1)..( 3000): cDNA_ID_1818515_gDNA_ID_1621156_Annot_ID_57026 3000 nt of promoter + ATG

SEQ ID NO: 7681 - DNA, 3000 bp, Unknown
  misc_feature (1)..( 3000): cDNA_ID_1818511_gDNA_ID_1621156_Annot_ID_57027 3000 nt of promoter + ATG
tgaactaaagtttgtttggtctcttctgagtgtttagcattatctataaagtttatttaattcttcttaattttcgtacaggtcttccctgacacacttcttgatgcacttctaaaagcaatgctgcatccaaatgtggaaacccgtgtaggagcgcatgaaatattctctgtaattctcttgcaaagttctggtcaatctcaggctggacttgcatcagtgagagcttctggctatcttaatgaatcaagaaactggaggagtgatacaacctctgcgttcacatctgtcactgctcgtttagacaagctcaggaaggagaaggatggcgtcaagattgagaagaatggttacaataatactcacgaggatcttaagaactacaaatcgtccccaaagtttcacaagttgaattccataattgataggactgctgggtttatcaatctagctgatatggtaacatttttccttgcttacaattggatgttgtgtgctaaaggaccatcatatgtttatgcaattgtctgatactgtttggtgatgcagttaccatcgatgatgaagtttacggaagatcaaatcgggcaactgttatctgcattttggatacaatcagcacttcctgatatcttaccttcaaacattgaagctattgctcattcttttagcttggtgcttctgtccttgcgactaaaggtcaacataaaagtttctcctcttttctggctctcttaatatttctctttcatagaggaagttttcactttcatgacgctatacttaaagcttctcatgattattttaattacagaatcctgatgacgggcttgttgttcgagccttccagcttctcttctcattgaggactctttcgttggaccttaataacggtactgattgatgaaactctcttaaactgatcaaagtttaagaaatcgcttatgtgcagtcaaactttctctttttcaggcacattaccctcagtttgcaagcggttgatccttgctttatccacaagtatgctgatgttcgctgccaaaatatatcagattcctcatatttgtgaaatgttgaaggcccaacttcctggtgatgtgagttcccaatgtgttgtttcagttattacttttattttatccatggagattgtgtatcacttgattatatactcaaaattttcaggtggatccttatcttttcattggagatgacttacaacttcacgtaagaccacaggcaaatatgaaagattttgggtcctcaagcgatagccagatggctacttcaatgctgtttgagatgcgaagcaaagtagaactgtccaacactattataaccgatattgtcgcaaaaaatctacctaaactttcgaaggtaaatcttatattttctgtttcttagtgaacaataccttttaagccccaatgttcgattctcttgtactgatttgattttatgtactctcttgttaagctcgaggaagctgatgtgaagatgcaaatcttggagcaatttacacctgatgatgcttttatgtttggatcaaggccaaacattgaacctcaaccaaaccaaagtatctctaaggaatcgctgtccttcgatgaggtaaactattctctgaagttccatattccattgggattttgataatattcagaactgttaacacttatgtttctttattacaggacatacctgccggttcaatggttgaggacgaagtgacgagtgaactctctgtgcgtttccccccaagaggatctccctcaccatctattcctcaagttatcagcattggacagctcatggaatctgtaagcatagaccacattcgacataaagaagaaactggctgatatatatatttgtgtcttcttataattggtttgtgatatgttatctaggcgcttgaggtcgctggtcaagtggttgggtcatctgtctctacttctccgcttccttatgacacaatgactaaccgctgtgaaacctttgggactggtactagagagaagctctcaaggtggttggccactgagaaccgtcagatgaatgggctctatggaaattcacttgaggaatcatctgcacttgagaaggtacgtaacagctgagttggtaaacacattagaactacaaactgttaaaatctgctatggtccttagtaatagtgagaaagatcataactttgtgataccaaatgggctggttaagagaaaggtagaaactttatcatacgaggcttacacgttgagacacgttgttacaggtagtagaagatgggaacatctatgggagagaatctggaatgttgcaggattcatggtccatgatgagactacctccagctagtccctttgacaatttcctcaaagcagcaggagctggaagatgattcaactaacttgatcatatcaatctctgtagaaagtgtgtaatcttgttgttcttattggatttgtagagaactaacttatctagggccaatcacgatgcttctcgtagtaatctagaatcagtagtaagtaatgcttgtttcgttaggacaagaatctctgttagtgttgtcgttataatcagtagagaaccaatgctatctagatttgtatcaaattctcttcattacctttaaacgcatcatcaaaacaaaatcgaagataaagttcacaactttaaaggccacatcttttactaatggcggtgaagcaaacggctttagttggccggaccggtttggttttctgataaccggaaaattcaatgaaccgactccaaaacgacgtcgtgttattgtgaaggcaaaatggtgttgttctctctgctgcctttaaaattggggttttgcttcgtcggggtttatgaagggctttgatactaatcttcgtctacaggcttcttctccagaattctccaatggtttcttgcctaaaaggcaaaactttataaaactcaatcgcagaaattgttaccccagatcttctttctctcccacc

SEQ ID NO: 7682 - DNA, 3000 bp, Unknown; identical to SEQ ID NO: 7675
  misc_feature (1)..( 3000): cDNA_ID_1818501_gDNA_ID_1621156_Annot_ID_57031 3000 nt of promoter + ATG

SEQ ID NO: 7683 - DNA, 3000 bp, Unknown
  misc_feature (1)..( 3000): cDNA_ID_1818493_gDNA_ID_1621156_Annot_ID_57034 3000 nt of promoter + ATG
aacgatcttgctcaaattatgaaggatctttctgcacttgtgatagatcaggttaaacttatttaatcccatattctctttgtctagcttttgagtcttcttcctttcgaaaaacaaactcaaagcaacccgtttaattgcagggtacaatagttgatcggatagactataatatcgaaaacgtcgctactactgttgaagatggtctcaaacaactacagaaggtaaaaatagtgttctctcttcaacattaatgtccaactatttgtttgtcccaattctaaatgaagtggatcgcataaaaaaacttcacaggcagagcgaacgcagagacatggaggtatggtgaagtgcgcatccgtgcttgtcatcctctgtttcatcatgctgctactcttaatcctcaaggaaatattcttgtgatcggatactataatccctggttagatcaataagaaaagttcgatccttaactatttcattctttagccccgaacatcgcatgttttccttcagggcttttggtttcaacttctttgcatttaacaatactaagatcctttgcagagtagttagtacgtaatattattgtgtagaagaagaccatagatagtcagaggtcgatgtctgaggagttgagagatctgtgcaccaacgccaaaatactctcttcacgctaaagtcaagtgttcttttaaaatgtataagattccagtcatagttgttggaacttgtttttgacaaaatggttttgaccattgtaacttgtggattttccggtgaagacgttcattggagtgaccagatttcgggcaagatggaatcgtagctgcgagcactacatggtggagtattcaaatgtgaaaacgagtttgtttgaaatcttttactttccggttattgtatcttcgcataaattacaaattctcaacattctagttcttttaaaaacatatatcatttacaaatgtataaatatttttcacttgaaacaatgaaaactttatacacgtttttgtgatgagttaatatgaattaaattacatctcaagttctcaactctagtttgaaattggtcatgccaaatagcctaattgaacttgtattgttattgtgtcattatcatggttcaaacccatattataatcatactgttgacaaaaattataattttaatattaaatttgtgttattatttttgtagataattagctggagggtttttaaaagaaaaatataaaaaaaaaattaaataatgattatatcagcgcttaaaaaagatagtattatcctggatagcacattattttttttatctgtttctaatgattctttaaattacctttaaatataataaattacatatctaagaattttttaaaatttatgataatattttatcttttttaaatgtagcatgtatataataaatttaaaacttatattatatatagtgcttcaataaaatccttgaacatgtataaccaaaaaaaaacctcaaacaacatgtgcatggatgtttaccaattatcatttaaaatatagttatcttatttacaatggatgtttaccaattattggttatatatttatttacaaaaataaaatgaaaaaaagtagttgatggttttagtctttttttcgcaatagggataattttattgtttaagtcaaatattacatggattatgaaataccccagaacaaaaaagctacagaaacatattaggcccaactaaagcccaacagagaaaccgtctatggaagaagaaatattatcttttgtctctatccaaagccacgtgtcttctgctggagagaaaccaatacacgtactggatgagaatccaaagttttcccgacttcatccttcgccgtcaaacatcgactccggtgaagattcaacgtcgattaacaaatcaaacatggaatcttatgggttttcaccggtaaaaataatcgaagccctaattagagaaacaacagctcaaggtaatgttaatatgcaacggaaatcacttttttttccaactcaaatctctgatttgtttcctgcaattctaaactcaaaaagaaaaacaggttagataataagtaacaaaaagcgaaaaccgctctatcattatcaccaacacatctcaaatgagatttattgaaagcaaagctaatttatgaaaaaacaaaaagcagcaaaagaacgctgacggcatagccgaccatcatcactgtgaaagctgaatgataccggacaagagctggccaacaccggaaagaactggtaattgccagacgataatccctatcagagaagacggtagccggaaaaaaattcggacggcaaagtgagtttgaggtttctctctctctgaaagaatttagaaagagaagagagagaaaaaactttggtacttaattaattatttaagtaattaattgatgattttagtttgtcttggaaacatacttaaaaccaaaaaaatatggaaatggattgtaatttgtcttggaaacatacttaaaaccactcaaaaaactagatttcctgtttttttttggagaaatgtttttgaaaaaccacaatcatttaaggccttgtagttttattgccaatggagtatgagttactatcaaaaattgaaaaacaagtgaaattcatatcctttttagtcttagctgtataattttctgcatggccggatctagttagtacctaatataagttaaactatacaaagttatagttaagattacttcattaattatattaaaagaggattagtactttagtagataacccataaacgaaagctaagtagttgaatttgcatgtgtacgtatatggagtataaagcagtatgtactatttatttatttagtgcatagtctttttactttcttaaatcacacttccctctcaactccgtaactcccacagatataataatttattttattttcatatcttagaattaaatttgttctctgaagataattctgatg

SEQ ID NO: 7684 - DNA, 3000 bp, Unknown; identical to SEQ ID NO: 7674
  misc_feature (1)..( 3000): cDNA_ID_1818489_gDNA_ID_1621156_Annot_ID_57035 3000 nt of promoter + ATG

SEQ ID NO: 7685 - DNA, 3000 bp, Unknown; identical to SEQ ID NO: 7673
  misc_feature (1)..( 3000): cDNA_ID_1818481_gDNA_ID_1621156_Annot_ID_57037 3000 nt of promoter + ATG

SEQ ID NO: 7686 - DNA, 267 bp, Unknown
  misc_feature (1)..( 267): cDNA_ID_1818618_gDNA_ID_1621157_Annot_ID_57041 3000 nt of promoter + ATG
gaattcatccctagatgtcagaatctaagcaatggagctactgttgaggtaagtaacttgtcaaatattttgtatgaaaactgaaagacaaaaattggaaaaatgaaaactttgttggtgagttgttcaggtgatggagagtagaccaagagcagatatctatatcaacttgcctgcattgagaaagctagattcaatgcttatggtaacatatattatccgaaaaatgtatatgactattctcggtctgattatgaatcatacatg

SEQ ID NO: 7687 - DNA, 3000 bp, Unknown
  misc_feature (1)..( 3000): cDNA_ID_1818614_gDNA_ID_1621157_Annot_ID_57042 3000 nt of promoter + ATG
aagacgacaattttttttatttgtttaacatgaatctaaattatacttgagactatagaaacaaatagaatttatacaagaaaaatgtacttaccaaaaaaaaaaatatatatccaagaaaaatgttgaaacaattactacatactttgaagattgatctaagcaaatattgatcggatcatagtaatgaattcgaaatctaagaccatacaaaacatgccataggaagagctttaaaaatccaaaaagaataaaaatctgaaaaatcccaaaaaaggaaataaaaatggattcacaagacgaaacccttgttgcatagcatagcatccaccatcatgtcaaaactagtctaataaataaaatactattttacccatttagcccctaggagcttaggcaagagaacgcaaggacagaatcggaaatataaaccagaaaaggttaagattttcttaccagaacagtgtgtgttagatcgaaattcgatcgatcaatcgcaaaaaaaagagagtttgttgttgttgttgcttctctgcttctattcgattattcttcttctatttagtctttgtttggtgtttgttctcttccttcttcttctttcctcagagcacacgataactattttcacatcccaaactacggaatcacaaaaatctgcagataaaggaattgtttttacacagcagagagagagagcattcgttgtcctcattacaccaaaaaagtgcacaagagaagagattgaaaaagaaaagagtcaaactttaacaaagcccaagactcttctttgcttcttcttcttctgggccttgttatttattgcttcttcttcctctctgaatctctctcgcgctctagatttcccctttattggaaaaccctcaatttctataaagttccaagctttggttctgttttcgtttaccaaatctctcccttgattcgtcgaatctcgtggttcttcgagtttctctcatcagggtcgaggtcgaattcgcggaatttcctgtcaaaaccctaactttgattcgactccggattgtggggtcatctcgagctcctattggttagttttcgatttgaaaccctagcttttatttattttatcgtacggattaatatttgtttgcgtagttcgatttggtatatttgatgatcatggtgattgttttctagctcagaaaaggatttagttttagcagatttttgtttgcttctatctggatttgttcttctctggtatgtatgtagcttgacgcagtgtgttttcaactgggaataaatacttccttcttcgataaagcatctaactttaattcagattctgttttgtgtatagaaatattgttcatgatgattatttgtatgtactagaattgtacttccacgctttcatgttttctagtttggttgcttgattagggttggcttatatttactcaagatacttatcatgcaaagctcagaatttcactttaagtgatgtatgttatagataaagtttcaggctaaatatttgaagagaatgtggaacgtattaggcgatttgaactatatgactgttagagtaagcgtaatgagctcttttgagcagctgatctgtgatatgattacagacaactaaatttcataggaatatatgagaattaaagccgagtttcaaaacttctattgcacacacaatattgagactatatgtaactttagtgttttcttcttcttattcagtgtaaattcaacaccaggggtacttttatgtttcagggtttacttccatcaatggggttgcgctgtcgccagtgctaagttttatgctgtaaggagatattgaaaataaaagtggaagtccatgaaaaagtttcttatggtgctagactgtggattggtgcttagagtttattgtggtatgttgatgtcagaaccagtatgctggatatagttgggagaaatgcaaaggtatcatgctgccaactgcactagtgcagtcaacaatagtgctataggtggtgcatccgcgagggactcaggacgagctgattcctcttcgattggaaactattcactaaactccaggcatgttgatagaaagaagtacttacatagttattttatatgttgatacatttgaagacgtttgaatactttctttactgcaggagaccaccaccgttgacaccctacaagttgaagtgtgaaaaggacggtctgaattcccggtaattcctctttcaccttatccctagtttaggtattcgataaacacaatatagatgattttaaattttgctgttttagatttgtagcttgggatttcattcttttatctccgataggctaagtccttggagtacttgttaatggatgaagttggcactcttttccatttttgatttacttccctagatgatttatactttttctctattgcagattagggccgcctgattttcatcctccaacatcaaattctcccgaagagaatctgaccaaagagtatgttcaatttggatacaaggaaactgttgatggacttaaggtgcgatcaactgaatttagcagctatgcttttaatttttttgtagtatcgtagttaattatcattgacatgtttgcaattaaaataaatatcttagatcttattttggaccatgcctatagtattttcctatagatgctcagcagtaaaataagaatagtttcttactgaggctgaatgttcattgtagcttgataggttgtaatgatgatttcttcaatgtagtcatataagatgcttacaactcagaaagtctacattattataagtttcatcttttccgatgttagagtttttaattccttattccactagttttcgcgcattatcttgtaattgaggttctgaacctttggcctttacaggaatccgaagaaattatattgtcccaggtccatactttctcaaagcctgttgtccataagtgcaaagaggtacggtactagaaattatagacaatg

SEQ ID NO: 7688 - DNA, 3000 bp, Unknown
  misc_feature (1)..( 3000): cDNA_ID_1818610_gDNA_ID_1621157_Annot_ID_57043 3000 nt of promoter + ATG
ccttgtgctcaaatttttgttttcagaaaatttaaagtgttagttacaaacttttaaaattttggacccttattgcaaaaatatcaaaaaatttagatcttaaaaccttgttaaaattagaaaaaaatggtggatccagtgctttagcactgcctctaagccgagcctgcttatacatatatgcagagaattttgcactatttgaaacgcaccgcattgtacagttcggtcaccattaaattgtaaatgatataaattgtgataataatacggtttagatgcttagaaactccacgttaagggaaaaattgcttacagtgtcactaacttcgtcagtggtttgtacccaaaaaaaaaaacaattcctcagtgggagagagtttatgtcgtcaatatctatttgtcggtcgataagtgccaacctcaaaaaacaatgacacgtttgtatcaatttctgaatcttaatttatactataaaatagtgtatacgtttgtacgcgtgctattgatagataagtggtaactatgtgtgttttgtgtatgtaaatgtataactatggtcccgtccctgactgaattaagttgcttaaagaaaactcaactcaagtaactgagcatggtcaagatctattcgattaaattttgatatatataccaaatggtttcgacttttgctaattgctatgccacatgaatcagacaatgctagctaattatttctgttgtaccataaagtgcttggctttatcagtaaaccccacataacaacattttgcttaacggaaactttaagtacgagttctaacattcaattatgctctgtttgattagattcaaacaaataaatagtttcttgatattgtaaagttctatttgtgtatttaatatcatatataagttttttttgcgattcaaactcgagttaagatagagacgattgacgtgacgttacaatatatgcacacgagtcacaacaaaatattatatctataatcgacggttgaaacaagaactctagctaatgttttggttacactcggttttcggacatggtttagaaaagcacaactcttccttaagagaatgacaaaacgtcgtcgttaactttagattaatgacttggtcaatgaaaacaatcgcatttggtgtaataatctcaaatactacgtgttctccatattccataaccagccaagcaaaagcaccaatgaccaattacgtctctcctctttggccgcgcccactcaattcttataatttatctatttgcaccctctttctctaaaaagttacaatttgacccctatagtttcactttcacttattcttataatttatctatttgcacctttttcctctaaacgttacaatttgacccctatattttcacttttattcatacaagcccattttgtttttctctctgctttcatgctcgcagacaacaatcctcgtcactgccatgtctcaaattcagagctttgagagatcaattatttaccggtgaggctaatgatgaaggctgttgaaaaaatctctgcaaaatacttttcttccatgtaaagcttctaactttttctctctctctctctctctctcctctgttgtttctgtagagaggaatagaagatgatgggcccattttccaactgtgattgttctctttatatttctttctcctgtggaggctagcaaaggccacgacgttgtggttgtcaaattggcataaagttttccacttttttactctgattttttctcccatttctctctcactttttctttgcctttgcccaattcagagaactaatggctttgtcggtcatcgatagataaacaaaatttaatctttatctctctctttctcttgtttgtcaaaagatgcccaccaacacagaaatgaggaaaaaaagatctcttttttatttgaatgttgaacagtaagaagaaggtttattctattctattgggttgggttgttcatcaactttggaaatttaaagatgcattttttatgatccttttttctccgcctttgttgttgatttgatcgtgtatgattacggaagcttgggggggtttttatcagacagaacctggaaaagttgtcagatgaaacaatgtggcttggagattggatcatcaacttttcctctgttttcaactttataagctatcattttgcttaatcttcttcattctcttctctcggccttggctttgaagaaatctcaattttcttcttcttcttcttctaccgttttgtccggcgatcagagctggttcaggagaaaccttaagtcttggtatcaaaagaaagaaagttttggaatttacctctgctgctgcaacttgcaacactttttttatatatattggatttttctatggctttgctcaaacgtaagcaaagcagatgaaatctagctacaatcgctgttgcccttgtatgaagtttggaatttaaggaattcaggagaatctaagaggtactttcttgtactttcctcttctgtctttttccaatagggaaaggtatcttatttgctccattagtctgtatctctcaggctttgtgttctcttagttctccttaatctttgccttattagttgaacaagtaagcaaattataaaaggagtttgctttagggaactggtagaggatcctttacttcttacttgttatcttaatttatttctcaagaattccattgcagtgtttaggaaggctaattctttcttctctttttaagtactcctaagcgtggaaattttttggtcttgttctcttgttgtttgttactcaaggatctgagattgttgtccataagtagaatttaccggagttgtaatttctatatctgaaactcattattgtaccgttgtgtgtggtgtgtcttatagtttgctgcttaatagttttcttgttcttcttcagcatttctaaaggggcaacgttatagaaggttaggaaggagcatttgtatagaaagtcatg

SEQ ID NO: 7689 - DNA, 3000 bp, Unknown
  misc_feature (1)..( 3000): cDNA_ID_2996391_gDNA_ID_1621157_Annot_ID_57044 3000 nt of promoter + ATG
aatgtgtgggtttaaaataaaaaatggcctataattaatctagtgtctgactttgttctatgtataactttttttacattcatagacccttgtttctattcttaaaaaactttatatgataaaacatgcaatgatcatatcatacgtcttatccaaccagaatacaagagtcttgacatcattctcaatggtttttctaagcgaacctgaagtacacacatcaatacacgcctcatatcacaaaaaaggatgttattttgacaattatatcgtaacacatgttaccatctatgcatgccttcaaacatcaaagtcaattgaaggaaacacacctctcagttgtcggtgacttcccggatcatgtaaagatgactttttgaaaaccaagaacatcattgcccactccaaagctgttacctctcattccaaactcgatcgtaatcgccatattcaagaaatacgtacttggagatcatgcacaaggctttttaaaaatagaccgaactttactagttactatctaccaatcaggttatgaaagtaggcaaaaggggaagggtcaaggcccatgagacatattttccaaatagacactaaaaatgagccagatttttcaacaacacatttggtttaagggctcaaaaaatatttgtcaacacccagttttaaaacaaaagaaaatagtaaattacaggcccaaatgtttttgttgccctatagatattagtatttcttaaccagtcgctgataattattgatgaatagttgagagacgataaagattgagctgtcaggaatacaaatcaaacatgatattgttcgtttacattattactcaacgaacattcacgtttccaaattctgatatcttttctaatatttctccacatgtagcatatcattagttactgtttaaaaatgagtaccaaaaacgtgaaattattacaataacgtataaatgttaaatatttcgagcaatcaatacttgtcaagactcattgttagtaatgcatcactataattcattctttttttgtcttggtcaaacatgtatgaagcgagcagagtctatgaatgtcatattatagacatacgtatgcggctttggtcgggaccggcccaataaaacaatacacatgttcaacgggttcttccacgtgtcaaacttatgttggctggacggtatgtgactgtgcattgtggttacgtttccaaaatgaatacgtaagaacttttcctaaattatgtcttttgcacaatactgtaagtctgtaactatggtactaaacattataatatcgaattggaaacatttacatttgagaattttagtgtttgttggcaacgaagcatgtgagatcacagagaagcaatactcatctctgagctgttcaaacagttttacatgtcagcacccaaatatagtcactatattcaaaaacaaaattatttacttgcattcaatgctagccttttttattcggtccacaacaaattataaatatttgtatataagaaaaatcagagacctgattttgtaatgcgtggcttgtcaatttcaagcaacacagaaaaaagctaactaagcaaaaaacaaaaaaaaataacaagtggctggttgatagaatgtatctttcatcagtacataacactgtttttttgtcaacgtaaaacagatttttataacttttgtttgccctcaacttttttcattacattttctggaatatcgcatggttgaataattaaaagttaaaaatgatttttatgaagcacggcattatactatatagtcagtcccaacgaaaatgactttacataaagctgtcaattttttctccaacggtcagataattgtttcgttgaatagtcagttttttttttactattttactattgggctttattgggctcttacaattttatcgatttttgtttaccgtccagaaagtggaccctgtgggaagaggaaaagaaaaaaaaagggtcaggttttttgtctttatacgagagcacatcggtacgttccagaacaaccctctctagtctcctccatcattatctttatttaatagtaaccctagtacaaattaccaaactattcaacattaacataattattcaacattcaccatcatgaataataactagttgagaaaaacgtaactagactagtttgatctgtcaacataaaaagagaaaaaagaatttcgtgactagtaaagtttaagaccattcacaaatgatcattgaaattattagttctaaactcttagtttggttatctatttggttttgattcgtatctatttggttattcggttttttggttttaaagtttagtattcattcgactattttgaaattttggttcgtttttttttttttttttgaaatttaatatccattcgattattttgcttttaatatttttaaatatttcaattattttttgatattttttgaatattgttactatttaatatatatttttaaatatttttaattactaagtatagaaataactaatatttttgaaaataaaattatattttggatattttagatcatctaaaatattttagttaggtactaattcatttttggttattttgattataaaatttaatatctattcaacaatttttaaattgttgattcaattcggttctgtttttttttttcatttaggtttagtacatttggttcagtttatttgactctcagtttatttgcctaagccttgaaattaggtgttaactattggttattctagttgaaatttgaaataaagaaaaaactatacgttatactattttattttcttagcaataactaaaaataaatgtttggaaacgttaggcaattttattatattctatcgttgttctctataaatgaagtctcgaccacacacttggtagctacacacgagaaagaaaaagctcacaactttaacctttctggagagagaagaacaaaagagggagagggagagaa

SEQ ID NO: 7690 - DNA, 3000 bp, Unknown
  misc_feature (1)..( 3000): cDNA_ID_1818599_gDNA_ID_1621157_Annot_ID_57049 3000 nt of promoter + ATG
gaagaggccaacctcgccaatgcccatgaacgcccgcactacaagcaaaaaaggaagaccaagtctagcagcaataggtgtcataatagtggcaaaggaccaccagacaacaccaaaacctaaaacaaccttcccgccaaacttatctgcccatatacctcccagaatctatgtccaagagaagatgagctaaagttagaataaatataccctctctttcgagttctataaaagatcagattctacagagagtgatagtattagacctgacctgagtaagtaaatagccccagaagaaagaggactgaattaagccaacagttgcactactccagttatattcttgtgacatgggaagaattgcaatgctcatgttcacctgccacaagcatctctcattaagtaatatatatcttacttcttcagataagtagagaaaataagcaagatatacaacttacacggtccatattgcaaagaagaaaagacgaaaagcataacaagacgatcacccagcgtctaggaaactgctgccaccatggagatgcgttctgtagatttccttcaactaaaatagcttcagctgagccatcagccgatggcacaactccttccgtgatatctgactcctctgatttgtagtaagcacgagatctgttgatcttgatactgttcctaaacctaattacactgtccattcttggttgaaggaaacatccaaaacttcttctcatgtgtcccgattcatgatgtaaactagcttgcagaggttgatgattacggcacaacaatgctacaaagattaagaaaatgcttaagcacaaattgcataatatagctaggtagagaggtataaaagataccgatatataccatttggaaaaagcttggaaacctctgcaccactttttccaagtctctgacaaccattgcctacaaagtaaagcaatcttagcaaatttggaagcaatgcacacattagtgatatcgttcgctacacagaagcaagctacgctcaagcctaatcactaacataatccgataaacaactaaaaagccctaacagattcaaaaagaggagggggatagatatacctgagccgatgaaggaaccgaagttccgatttgaaatcaagccaccgagggccatgttgcttctcagaacaaaaatgtcaagggaagaaggagaagaagaagagagaaggattcaagcttcttccatagaagcggagtaaacgaaggaacctttggataaagccgagagagagactgagagacgctgaagcgggaaaatccctctctattggggaaggaaggaagaggaaaggggggtcgatatagtgacacgtggcacatcatcttctactcgttggaacctccgttctgttctcatttcatgaatctacccccacgttgcaaagaggaaacatgggtactattggttaatggcaggggtattattggaagttattgtggaaaatatctgagccgttaccgccgaagatgacgtcacctttagagaaatagagagagctgacaaaagaaaaaggtaggttggttaatatattgggcttacaatctcatttgtatttttgatgggcttaaaaataaaattgtcttctacatttttttgtttccatttgttcaaagttccaactgctgaaaagtgaaaacaaagagacatttattgctaaagtgcagcccataaaataactaaaatactaaaattaagcactaaaattgtacaacaatgtcattagtttttactaaaatcttgaggatttgtcattttgaacacttaaaactgtatgtatatataaaatgtttttgcaaaatatgtactttaaaccaaatactaaattttaaaaacaaatctaaccgactatatccacgtattaactggtatctattattaactaaaaatggcaaattcacaaactatatggaaaattgcaaaatcaacaaatgtcactttcaaaagtggctttctcataattgattctttttataaaaaaaaaaaatgagacatatattaatatatataacaactttggtgactataagctcttagagtaaaacaaagtcactatattaaattttgagaagaaaaataatcctggaaaccttaatgttttatgatacaattttacacatagatatataattacatactttgaccagacacatattttttaaaaaaaaatctccagtcagtggctatttgataaagccactaaaaattcttgaccaattttgtggccactatattgcttatagtataaatcattcacaatttggatcataggttttattcatcaattttgtccaaaaaaaaacttaaaattttgtcaaaaaactatagtataaaataggttttgtcaaaaaaacttaaaattatgctatttgtgaaaatttctcttttatctatttttaaattactttgttaattaatagtgctatattcttaattcttgtataaaaatgtgttattcttgcaaatcaccctctaatttttctgatatattttccaaaataaaataactcttcatcttcctcactcactctctctctactccactcttcatcaagcgttgagtcatcgccgtgttgttccttttccttccctctctagcgtaagctccagatttcttctattctctgttttcacagtgaaatctctcgtttaatgaattttttcgattcccctatgcatttcgtgatttaacgcctttactcacttgttacttaaaaatatatttttgatttcgctaggttccttatcatgcatgcgtcactctcttagctcaattttgtaaatgctgtatcactttcgtctcttttgctttatccagtgtcaattttgttttgtttgttaagttgttgcctagggtttctcttgctcgtgggattgcctagaaattgagtctcttttgggccttattttgttcttcttctctgtttttgtaacattctttttctccaggtaaagcaggtacgatg

SEQ ID NO: 7691 - DNA, 3000 bp, Unknown
  misc_feature (1)..( 3000): cDNA_ID_1818595_gDNA_ID_1621157_Annot_ID_57050 3000 nt of promoter + ATG
gagaggtactcacctattggaccttgagattgaaagtcgtctgcacgtgcacaccaaccataagcctttgactctgaatctccactcctctcagtccactcttttttgcaggacccttgggtctcaaattccttttcaagctctgtggcagcagcaaacccactccagtcactgtcaaacttagcaataaccccaacaatcgaatcttgttcgacccaaaaggcattcacttcaacaggcttgaatttggaaagggtctgcagccaatatactgaatcaagtagaagctccttgtcatccgtttctttcaaagggttaacaacaatccccatccatggccagacatagacgttatgaggatttggttcagtctcgtctaacagaggaggaacaaccggagggcgtggaagaggttctgcataaccagcaagatcattctctaaaaacttagctaaagcaagatgattagacttctgtaaagcacttctggtggcagaacctttggaaacaccagtagcatgtgcatgcaactccttgtacttgtaatcttgcttcttcttgcctacacaaaaggggcatctgagccgtccattcaccttcaccttgtagtaagtctcactgcgtaaaaggtggtagggtgttttagaatactcctcaatctctgactcgctgatctcagactcttcatcagaaatgtccatcgtacctgctttacctggagaaaaagaatgttacaaaaacagagaagaagaacaaaataaggcccaaaagagactcaatttctaggcaatcccacgagcaagagaaaccctaggcaacaacttaacaaacaaaacaaaattgacactggataaagcaaaagagacgaaagtgatacagcatttacaaaattgagctaagagagtgacgcatgcatgataaggaacctagcgaaatcaaaaatatatttttaagtaacaagtgagtaaaggcgttaaatcacgaaatgcataggggaatcgaaaaaattcattaaacgagagatttcactgtgaaaacagagaatagaagaaatctggagcttacgctagagagggaaggaaaaggaacaacacggcgatgactcaacgcttgatgaagagtggagtagagagagagtgagtgaggaagatgaagagttattttattttggaaaatatatcagaaaaattagagggtgatttgcaagaataacacatttttatacaagaattaagaatatagcactattaattaacaaagtaatttaaaaatagataaaagagaaattttcacaaatagcataattttaagtttttttgacaaaacctattttatactatagttttttgacaaaattttaagtttttttttggacaaaattgatgaataaaacctatgatccaaattgtgaatgatttatactataagcaatatagtggccacaaaattggtcaagaatttttagtggctttatcaaatagccactgactggagatttttttttaaaaaatatgtgtctggtcaaagtatgtaattatatatctatgtgtaaaattgtatcataaaacattaaggtttccaggattatttttcttctcaaaatttaatatagtgactttgttttactctaagagcttatagtcaccaaagttgttatatatattaatatatgtctcattttttttttttataaaaagaatcaattatgagaaagccacttttgaaagtgacatttgttgattttgcaattttccatatagtttgtgaatttgccatttttagttaataatagataccagttaatacgtggatatagtcggttagatttgtttttaaaatttagtatttggtttaaagtacatattttgcaaaaacattttatatatacatacagttttaagtgttcaaaatgacaaatcctcaagattttagtaaaaactaatgacattgttgtacaattttagtgcttaattttagtattttagttattttatgggctgcactttagcaataaatgtctctttgttttcacttttcagcagttggaactttgaacaaatggaaacaaaaaaatgtagaagacaattttatttttaagcccatcaaaaatacaaatgagattgtaagcccaatatattaaccaacctacctttttcttttgtcagctctctctatttctctaaaggtgacgtcatcttcggcggtaacggctcagatattttccacaataacttccaataatacccctgccattaaccaatagtacccatgtttcctctttgcaacgtgggggtagattcatgaaatgagaacagaacggaggttccaacgagtagaagatgatgtgccacgtgtcactatatcgacccccctttcctcttccttccttccccaatagagagggattttcccgcttcagcgtctctcagtctctctctcggctttatccaaaggttccttcgtttactccgcttctatggaagaagcttgaatccttctctcttcttcttctccttcttcccttgacatttttgttctgagaagcaacatggccctcggtggcttgatttcaaatcggaacttcggttccttcatcggctcaggtatatctatccccctcctctttttgaatctgttagggctttttagttgtttatcggattatgttagtgattaggcttgagcgtagcttgcttctgtgtagcgaacgatatcactaatgtgtgcattgcttccaaatttgctaagattgctttactttgtaggcaatggttgtcagagacttggaaaaagtggtgcagaggtttccaagctttttccaaatggtatatatcggtatcttttatacctctctacctagctatattatgcaatttgtgcttaagcattttcttaatctttgtagcattgttgtgccgtaatcatcaacctctgcaagctagtttacatcatgaatcgggacacatgagaagaagttttggatgtttccttcaaccaaga

SEQ ID NO: 7692 - DNA, 3000 bp, Unknown
  misc_feature (1)..( 3000): cDNA_ID_1818591_gDNA_ID_1621157_Annot_ID_57051 3000 nt of promoter + ATG
aagaaaaagaatcaaattcctccatatcgttctgtatcgcctccatgtacgtaaagaaagttggtcactcttacggaaagacaccatttttaccaggtctgagcaatttataaggaaagctatttttcacttgccttgtactctattaaatactagggatgattcagcatccgcaaacagtaaatgagaaaccgcatgacttgcatttaccacctttatactaattattaacttatctatttatgctttctgaatattagcaatcagcacttttgtgcatagtacatataaatatgaggagagaggatcttcttgtcgtaggccgcattggggagtaattaagcctcttgattgaccgttaagtagcgccatatgttagactgatgtgatacaccacatcatccattgtatttatgtctcccaacaatccatttttcataataaactctcgataaaatttgattcaatctgatcataagcctttcatgttagtttttataaccataaactttcttttgtatgacgaatttgttcagagaccataaaacatctcttgcgttataagaatattatctaaaatcaatggtctttcgataaagactaattgtgtttctaaaacaaaatttatttttctattttctatttatttaattttccttctcatttttagttgtttttataatatactaagcgaggtagtataaatctagaatcctgaaccagcagtcaaatatcactatttaaagctaactatttaggtttaataataccttaggatattattaccatttacgtaaaaaagtttgaacctggaaaacatatatatctacgtagagtaccgaatattctaaaccatttaaaatattttataatgatcaaccatgattgaaatcaagtagaaaaacttgaacaatgatcttctagttcattttagttgtttcacttaaaaaggatttaaaaagagagtcaacattgcgttttaaatgcattttgaggtttggcaaaccatctacaagctatctgacatctacagactacgtacagttgtgttccatttgttacaattacaacaatcagcttgtttgtttttggcaaattaagagtcatgagtgtgtatacgaaattactttttggtggtctgaatttatgaatgcagttacactaacccttcttcaaaaataaaaatgaatgcggttatactaaactatcaaatatatctactagcaaatatgaaactacattcagtaacagtgatctctctttttggatacaagatgaaacattgttctcttctcatgctctaaatagaaaatactctacgaaatgaaaatgtatgtcatcttataagaactatacatttttactccgatggttaattctttgaaggattctcgacagtttagaagtctgcaaaaaatataatctcataagaaaaaaattctaagtctcttgatacaatgcatatagaaactgacaaataatcgaagaaattgtacttgagcccattacgactattgaaaattctgattttggatgaattcagcggaaactacaaatttaagagtactttatgtgtataatatgaagcctatatatatagaattactaatgtaataaaataagaaccggtgaaaagggggacaagatcacaaggttttcgcattcagtgcctttacagagttatatatttgatgatgttattgcttacttgcctaatagtactatactactatatatatctaaggtaacacatgtatatatatgtcacatagacattactagtatatattatgtacttctatcatatatttatgatattgcagttgcagcgtacacaagtcagctccttttgacttttacatctcatgaatgcattgccatgacatctaatcttactcgagatttgtgcatgcacattattcacttttgtcttttgcaatttttgttattgtaaaaaaaggaaaaacaaatgtaaaagagagagagaccagaaaggtctaactaaacctaaagagtcaatgaaatgtgtttctttcttgtgggattaatcaattcactctttaacacttctttataccattgaagaaattagatgaaagagtcacgagttgcttaccaaatccctcacaagaattgagaactgataaaccaaattgagaagattaaatatcacgtctccttttgatctctattataattaatcgaaaataaaaataagagttttcaacaaaacgtgatcattggtttacgatcacttgcaaagtcaaacctaaaacgtagcattagtacactaaccttaaatactaattatatcatgcaaaccctaatgtcattacctaactatacatgtgtaatgtgttcaacagatcttcttaacccacattagatcaatattaaacaataaaaagattcttatatattctactacttacttcttcttattcccatccatatttttctgtgcctttaggttctcaactaatctcatttaatttagctagcacacagagaaacacacacgtatataaataatatgataacacacaaaaagactcatatatataaataattagagtcattaaatgtggattcatcattaaatgaaacaactcttcttctctgtacaatttctcttcacaccttcaccaaattctttgacttcaaaaatcttataaaatttatatatctccaaaaccataaaaccaaaacgagttttcacaaataaattacttagttgaaatttcaaatctcattcaattagggtacactctctcaacaatccacattaatgagggttgctgcttctgatggctagcagtaacagttttatcgcctccacttcttaatgccatctttttcctcttccctctccttctctatatatattttctgactctgcaaaaccttaattcatccatctctcaaacaccatttttggaaacaccatttcatattccttaaacttttccattttagtatcatttcatattcattgatatg

SEQ ID NO: 7693 - DNA, 3000 bp, Unknown
  misc_feature (1)..( 3000): cDNA_ID_1818587_gDNA_ID_1621157_Annot_ID_57052 3000 nt of promoter + ATG
tcttcttcttctcctcttccttcttccaccaccatctgtacaaagcaaagttatcatcaaaggaaaccaaaccattctgagtttcaaagctattttccggcttggtttcttcagcaccaccaatggttcctccaattggtacttgggtatctcttacgcttctatgccaactcccacccacgtttgggtcgccaatcgaatccgacccgtttcggatcctgactcttccactctcgagctcacctccaccggatacctaatcgtcagtaacctccgtgacggcgtcgtttggcagacggataacaaacaacccggaaccgatttccggttctctgaaaccgggaatctgattttgatcaacgacgacggttctccggtttggcagagctttgacaatccgactgacacgtggcttccggggatgaatgtcaccggtctaacagctatgacttcgtggcggagtctcttcgatccttcgccggggttttactctctgagactgagtccaagcttcaacgagttccagcttgtttacaaaggaaccacaccgtattggtccaccggaaattggaccggagaagccttcgtcggcgttccggaaatgaccattccttacatctacaggttccatttcgttaacccttacactcccacggcgtcgttttggtacatcgtcccaccgttggactccgtttccgagccacggctgacgcggttcatggtcggcgccaacggccagctgaagcagtacacttgggatccacagacgcagagctggaacatgttctggttgcagccggaggatccttgccgcgtttacaatctctgtggtcaattagggttttgtagcagcgaattgctcaagccctgtgcttgcatccgcggtttccggcctaggaacgacgccgcgtggagatctgatgattacagcgacggatgccgccgtgaaaacggtgattccggcgaaaagagtgatacttttgaagccgttggtgatctacgctacgatggtgatgtgaagatgtcacggttgcaggtaagcaagagctcttgcgccaaaacttgcttaggaaactcttcttgtgttggtttttatcataaggagaagtctaatctctgcaaaattttactcgagtcgccgaataatctgaagaattcgagctcgtggactggagttagtgaagatgtattgtatatcagagaaccaaagaaagggaattcaaagggaaacatctctaagtctataattatattgtgcagcgttgttgggtcaatctcagttcttgggtttacattgttagtgccattgattctgttgaagaggagtcgaaagaggaagaagactaggaaacaagacgaagatgggtttgctgtgttgaatcttaaggtattttctttcaaggagcttcaatcagctaccaatgggttctcggataaggtcggacacggcggttttggggcggtgtttaagggaacattaccgggttcttctacattcgtggctgtgaaacgcttagaaagacctggaagcggggagagtgagttccgggcagaggtatgcaccattgggaacattcaacatgtcaatctcgttaggcttagaggtttctgttcagagaatcttcataggcttcttgtctatgattacatgccacaaggatccttgagttcctatctgtctagaacaagccccaaattgctaagctgggagacccgtttcaggatcgcgttaggtactgccaaagggatcgcgtacttgcatgaaggatgcagggactgtattatacactgtgatatcaaaccggagaacattcttttggacagtgattacaacgccaaagtgtctgattttggcttggctaagctccttggacgtgacttcagcagagttctagccacgatgagagggacatggggctacgtggctcccgaatggatatctggtttgcccatcacgacaaaagctgatgtgtatagctttggaatgacattgctcgagctgatcggtggtagaagaaatgtcattgttaatagcgatacactgggagagaaagagacagaaccagagaaatggtatttagagaatgtcttttacttggaatcaattgtaagagagaaaaaaacatatacattgaatcaatgaatcccttttcaggttctttccgccatgggcagcgcgtgagatcatacaaggcaatgtggactctgtggttgactctagactcaacggagaatataacactgaagaggtgacgaggatggcaacggtggcgatatggtgcatacaagacaatgaagagataaggccagcaatgggaacggtagtgaagatgcttgaaggagttgtggaggtgacggttcctccaccgcctaaattaatacaagctcttgtctccggcgattcataccgaggagtgagcggcacaagctgtagtgaaggccatggctgttcggatctcaatacaggtttgtctagccctggctcacggtcgtcttttggtagaccttctccttgatcaattttgtaaggtgatttggtcaaaaccagccttaaatgttttaagtgttgctctctaagagggtttaattagtttaaactgtatttgttggttgtatgatatttgacttaatcgacattaacagttaaaaccatggattatgtctttcttcttagtttgaaagttcttgtcactttgataatcttctaatggcatatatgtaaattcttacagaatgtattgtatgagaatcattacgtgattgaatcaataaacccatgtcgatactttaaactatatgaacggtcacaataaacccatgttctctcttcttctactccacggctaaccttaatcttaggcaaaccagaaacacaaattacaagaacaaacataaaaaagaatctcttgtcttgtctgctttcaatcctcatgtctctaatcctccccaagtagagaaatataaaaacttagacaaatattgccacaaccggtgaaaatg

SEQ ID NO: 7694 - DNA, 3000 bp, Unknown
  misc_feature (1)..( 3000): cDNA_ID_1818583_gDNA_ID_1621157_Annot_ID_57053 3000 nt of promoter + ATG
ctgtgtgtcgaaaccctccgtcgccagcatttattcttctcacttttcttcaccggagaatcacgacaacatcaaattctccggcgacatctcaggttatcttcgtttactgctctcatcggttaattattccatctctttttttgtttcccggagtcggctttcgtgtactttttgtttttggtcttttcggcttcttcaattttagggttcgcgtactgtttagtgttgtttagtttctgatttagatgtgcttactgtgttcatgttgtcgtctattcttatgagaagatcttatggtagagttacatatcaatgatgttaccaattttgaaggttattgtgttgtgtttgattaaaattggctcaagtgtgaaatgcttttgctcgcgtcactgttttcattgcaacttgactgaatcctagaggttgttttagaatatagattcaagtttcagctattgatgggacattacaacagagcataaggaacattcccatacctttgtgtttcttatggataactttggcatcagatcaactttttcttttgtcattttgcttattaacactgtaataatcacttgttattgggatttctcaagtctgctttgattaatcttgtttcgtaatgttcttctcactattcactcttcccatacctttgtgtttcttatggatgactttgccatcagaccaacttttcttttgtcattttgcttactaacactgtaataatcactttttttttattggggtttcttaagagtacttttgattaatcttgttgcattcaagtaatcgttgttcagttcactcttttcctgcagtggcagtgcatctgtaaaatgcttcaaggactgttgttcgctactcttgcttaattattactatagctggtgaaaatgggaggttgctgtagttcttcgaggaagtcacatcttgttggaacacctgtttactattatgtcagtaatccttttcaccatcttgcatttgtgttgctttgcactactgactatctatagattatgattttagttaaaacaaatcgggacaagagcatgattttagaatctcaacaatttcttgtaacaatctcgcttgagtggtcgatagtagactactagaggtcgtgagtgagctgtgtttgaaaaatgtcttctgaattatctacagttatttgattgtgacactctacaaagtttctatttattaaaagtttgttacgcagtgtccagaatcttttgaagagcttgtcccttcaggaacccgtgctggtgtgggatcagcattcaccacaggcctcttggttgatataggtttggagacatctatacctgacaccttttgtgctcctgctcctcttccatatgatttgcttttggggcgaccacaatgcacagattctgagtccatcaaaggaaggatgagtggaagcagttttgaaacgctagcgacgtgtgaagatcttggggaatcagactgtaaaactctagccagctcagtcattctttcaccgaggaaatcagatttctcgaaacatcaaggattgaagatattggttgatgaagaggaggactgttgtcctatttgctttgaaggtaagaaatcaagaccgttgaataaaaagaactctttaactcttgtttttatgagagagctaaacagagtcgtggattgcactatgcagattatgatgttgagaatccaagactaacgacaaagtgtgagcacgaatttcacctctcttgtcttctggagtggattgaaagaagcgatagatgcccaatatgtgataaggtgtgtttcccgcttgagctttctttggcagatcgattgtcttgatgatcaaagaattgcactttactgttgggaattcgtagttagatcaaccattgatggttgcgtaattagggtaaataagtgcacaatttggcaactaactaacattctgtcttctttaacacaggaagttgtgtttgatgatcgcttgaactagcatcattactatcccctggcttgaaagtttgaaggtgtggcgctttgtttggttagtctactacataattagcatacatctattttgtttcttcctcacacactttaagtgttgggtctccacatttccacttagttttgtcgtattggttatgttcgttttgcccttgtgcgatcatatagatatacataacaattgtaaatattacctagcttcttgttcgttcgtttgtgatctccggggtgtgatagagaagaaaggaccaccatttcagtattttgattgtttgcatcttcaaaatcatgtccactcttgtcttgatccatgattctatcttagcaatattggttaatgccctgatctgggaatcataataagcatgattttgtttgtttgtttggttaaagaaagagagagattctattagatatggatatagtataattccatagtctaaagagaaactgaatattccaaatagtaaattgatccacatgcgactagtcttgtcgtgtgtaagatattaaaaagaaaatgattctttgattaacaccttttgtctgctgcataaagtaattaattagaaataattaagaaaaaggttaggaatcatttaagaagaagagaaaaaagatgtcatggctttgacttctagccacttatgtctgccactgccacctccctcttctcaattcctattctgcccttctctttcttttagttcctatcctgccggtgttgatgaatgagggttaatatagtaactttggcgttaggaactatagttccaaaacctttttctgaatgaatttactttttggaggtatgaagtcacagcttttacagattttatcttgcaaaaattctctccacatttcaaacgtctaatagttaaagagagcttttgttttttctttcccatgtctatcagtatcaccaccgagaaaatatcatcaacaccaccaaccaaacattaacccacccgagagtacccaatg

SEQ ID NO: 7695 - DNA, 3000 bp, Unknown
  misc_feature (1)..( 3000): cDNA_ID_1818579_gDNA_ID_1621157_Annot_ID_57054 3000 nt of promoter + ATG
ataactgtagataattcagaagacatttttcaaacacagctcactcacgacctctagtagtctactatcgaccactcaagcgagattgttacaagaaattgttgagattctaaaatcatgctcttgtcccgatttgttttaactaaaatcataatctatagatagtcagtagtgcaaagcaacacaaatgcaagatggtgaaaaggattactgacataatagtaaacaggtgttccaacaagatgtgacttcctcgaagaactacagcaacctcccattttcaccagctatagtaataattaagcaagagtagcgaacaacagtccttgaagcattttacagatgcactgccactgcaggaaaagagtgaactgaacaacgattacttgaatgcaacaagattaatcaaaagtactcttaagaaaccccaataaaaaaaaagtgattattacagtgttagtaagcaaaatgacaaaagaaaagttggtctgatggcaaagtcatccataagaaacacaaaggtatgggaagagtgaatagtgagaagaacattacgaaacaagattaatcaaagcagacttgagaaatcccaataacaagtgattattacagtgttaataagcaaaatgacaaaagaaaaagttgatctgatgccaaagttatccataagaaacacaaaggtatgggaatgttccttatgctctgttgtaatgtcccatcaatagctgaaacttgaatctatattctaaaacaacctctaggattcagtcaagttgcaatgaaaacagtgacgcgagcaaaagcatttcacacttgagccaattttaatcaaacacaacacaataaccttcaaaattggtaacatcattgatatgtaactctaccataagatcttctcataagaatagacgacaacatgaacacagtaagcacatctaaatcagaaactaaacaacactaaacagtacgcgaaccctaaaattgaagaagccgaaaagaccaaaaacaaaaagtacacgaaagccgactccgggaaacaaaaaaagagatggaataattaaccgatgagagcagtaaacgaagataacctgagatgtcgccggagaatttgatgttgtcgtgattctccggtgaagaaaagtgagaagaataaatgctggcgacggagggtttcgacacacagagctccttttctctagtcgaataacctcatcatagtaagtaattatactgtaatcctactttactttatttagtttgcctaattattctcaaatctcattaaataccttttaaatagtacgacgtcggttaaggatacgggctaatcattgggcttttgttttctgaaacatgggctataaacattttagaccatggtccattctacagaaggtcaaaccctctgtcgctatcagaggctattgaatattttgctggtaaggtctcaattctcatcatccttcacctgcctatgaatcttccttgttaaccgtaacctaatattgattgacttctaatcaaagtaatttaatctaccattttattatttcctctaatctaagcctttttcatataaaatgtatctaatagtaactttataagaaaaatattatacctttttcttggtatctttgttgtaaaaaaaaatacaaattaaatgcgagttcgattattgcattaatagagatagacccatctggcatttaatatggtggcggcggaataatcgctaacaagatattagttgaaaattttcaaatcattcggatagattacgtctggcattgaactaattatcctctataaattcaataatgacagaatttagtagatgttctaaatactaaaattatttaataatcttacatatgcaattttccatgtacgtgctgttttggagcgtttaaaccgaattaaagtactactgtaaataaattgaatcgaatttaccgaaccaaaattgaagaaaaaaaaaattaaatcgaaccgaaccaaaaattggaaactagtcgaataaatattaaattctataaccgaaatatctgaaataaaaccgaataaatacaaaccaaaatattttgggtaaaatatctaaagtataaatatatttttaaaagtgttaattatttctagactaaataactaaaaatacttgaaaatataaataaaatagtaaaaatatttggaaatatctaaaaatatttaaaaatattcaaaataaccgaaatattttaaatgaaataaccgaatggatactaaattttaaaatcgaaaccgaacagaactttcaaataaccgaatggatactaaactttaaaaccgaaaaaatcgataacggaatggataactgaacgccgagaactactattatatacaaagtatttagttattcaataaaatttgaaaccaatcgttttttttcaaaattaataattatcgaatttaaatctaaggaataaaaaagcttattacaaatcattagacaaaatgtaataaaaaaaaaggaaattatacacattaattatcttagcttgtcgagtttaaattttgttaatcagagaacgtcaagttgtacagctggcgtcaataaatacccaaaacagtcgtctttttcaacggagaagaaaaagttgaaaaaattgtaaagtcagtctctccgactcttccttccttccgtgttcaccattgctacacgttctccacgaactttccgatgcccagtcgtcggagacatagctacaccgtcggatctcctgcaaccacatcttccaattacagtaacactactttcaccgatcgttccttcccgacaacccctgcccgtacatccaccgacacaaccacctccatcgctcgtcgcatctccggtatcttcatcaactgcttcactcctcccgattccgtttcctccaactacatcgacaattcaaagtcctcttccggtatagtttgatcagtaattcttagattttagacttttagtggaaacagttgatg

SEQ ID NO: 7696 - DNA, 3000 bp, Unknown
  misc_feature (1)..( 3000): cDNA_ID_1818575_gDNA_ID_1621157_Annot_ID_57055 3000 nt of promoter + ATG
tgggagattgtaatgacactgctcaaaggtaattatccatttggttcttcactccactttcgactattgtctgcttccttcgttagtttcggtgtttttttctagggttttactcgtatttttgataatcgggtaatttaatttcgcccgaatccaaatgccgggcgacccggttataatttttcaattatcttattttcgattatcgtctaggtttaatagctccgtgagtagtaatcaaagtctagtctccgtagagaagcttaatctcaatgcggcggaggaggataagtacgctatatcgccggaagttgaagacccaatggatcagagcgatgactatgacaagaaatccgaagctcttgagcctaattcgccggtcaaaacttccggtgatgatgaaaaagtggttgtaacaattccgacggcgcctaaacgtggacggccacgtggttcgggaaagaaagtttccgctccggcattgaagaatccgtacgagttttactattactctggtttcgggccacggtgggggagaaaaagaggcggctccgacgacgagaagatggttataaacgatagtaaaaagagtagaagtagcgctagtagcagtagtgacgaagacggtcataaaacggcggcgtttggaggtgggagtgtgagtttcgacgagtttgattttgtggatgaggattatgacgtaatggaacaagatcaaggaagtgatcatgggaggaagaaaaagaatgagaagatgataatgatgaagaagacgatgaagaaaggaaggaagcccgtaaaggaaaggtctttgaaatccctcatgtgaaatattttatggcttttaagggtatttccgtctttttctacttgttgttattgtctggttttgttggtacgggggtttggtctgtttgtttagtttgggaacatttgtaggaagattttctacatctctgttgtatttgttagatgactgttttagttgttctttaaattgtttttttcatagactctgatgttgtctacacagatttaaagagtcttgaacaattttcaaatcaccatcggttaaacctaattgtatacatgtttcgaatcctatcctaaattgttaagttaaaagtaaatatgagggtcttttaagagtttaacaaaagatatagctttacatagaacaatttaaaatatagaaggttttaggagcgtctcaattttcaaatttaaatttatatcgattaattgaacatgtacattatatgattacaatctatcaaatgtataaaaatattacaaaagataataccttttaattttatttcagagatacaaataaaatgatataagagtacactgttttgcggagtatcataatctgaattaattttaataattcaaaatatcttttaatatatatatttatcattatataaaaaatctcaaaaaatattttctgatttaatattactaatacatgataacaagtaacaacatgcatcatattagaaaaataatatactcgcaaaaactttaaacctaaatttttttgtcctaaagaaacacttttatccctcaattttgtttatatgatgatgttggagcttgtggatctcctaatctctcagagatttgctctgattttgtgcgaagtttgttttttatatgatgatgatgttggttgtcggattaattcctccacaaaaacacttaacattcccaatttctcttttcttcatctttattttctccgattaatttttctgtaattttggggattttgtgaggttcattttgtgtttgaattgatttgatctattttaattttgaatatgtatggcaaatctatttttttttttaatttcaatctgaaaccagagaagaaattatcttaagtagagtacgagttataggtttccataagattgtgatttattcgttttcaccaaccactaaaagaaagagacaaaaaacacgttgcattagttttgttggcgtctttagcattttcaatgtagtctatattatacattggttcagcttgaaaatttgcaaccttgataattaatattgggattccctataattactggttcgcatatctcactcgacaactcgtatttaacataattatagcaacaaatcaccacaaaatatactgaatttagaagattttccataaaattcaataacatctatacattttttttgccgatcaatgcaggtttacaaacttcagttaattatgttagttaacatttttaagttttaacaattttctatattaagatctttatgaaaaggaaaaagaaaaaatgaaaataaaaatatgtataactcaatcattataatatagagaatagagaaattaatgtcattgttagtctcattatgttagcttccaaataaattaagaaaaaaatccttaattctaaaataaaataaataattagaattaaaaaaaaaatcaaatataagaagaagttttctaaaaaattaacaaaaagttagtaataaacaaccgagagcgagttttcattcattaactcgctcttggttgcttattcaagatttatttgaatggatggtacgaatgtaacatgtgcagtaaatattagatttaatgtcttagtgagcattttgcaataaaaatctgtggatttcatgtttattacaaacagtttcttataaaacatttccttcattattcattaagaaaattaattaagagcacaaacatttccttgttcgtttgccctagacaaggcaataaatcatatcctagagaagcgtaatcgatcattcgattttctttacctaagcgtacaattgaatgttttcttatattatttcttccgttcctttgtcttattattccttaagtctatgttcttacttacgttcactctttttttcttggttactcggacagattccaagtttcttattctacaagataaatgaatcttggttaaaatcaaacgtggaggttgtgaagaaatg

SEQ ID NO: 7697 - DNA, 3000 bp, Unknown
  misc_feature (1)..( 3000): cDNA_ID_1808340_gDNA_ID_1621157_Annot_ID_57056 3000 nt of promoter + ATG
ttcatgcaagaaaaagccttggtttcatattcataaatcataatacaatataattaattaattggaccttttatttttatactttattcaaagttagtctaatacttttacgccacatatattctaaatcttgagtaattaaaatgaatgaatatagcaatgatctacatgtgatttagctatctctatattaaattgaatataatgtgaattttttttttgtctattggtagcctaatctggaatataagatttccaaataaaatctcagaaaataaagctctataaatttacaagtcaattagctatctctattttaataattgaatatcatatgcttttgcttcaaaggcatgtttttcaacaatgtgaacatctcttttcaccttttctttatttcattgtccttgtccgtcaccaaccaatcatacacttttttcccattgacatgttcttctatgattggtttctttccatcacagtcagtatctttatctctttgacgtacgtttcaatcttcttctctaaatcccgccctcgcgttccacgctaacacctaattctaatatatacaaatcatataaatagccatttttatatcctctcgtaacttttccttctttctttctccaaatttgatcgtaaaaaagattcctatcttcttcaccattcttttcttgaaaaagaatcatgggcttatcttatagcggcgccggagttattatcgccggagttatcttgaatgattttatcaaatcagttcgttcttttcttgatattcgtcgtttgtttggttcggcatcttcagggagcactatcatcgacaagattccgatggacgatatgcttccggcaacaaagttcgaggatatatcatcaagggttaatccgccggagagctgccggatatgccaagatgagttcgacggcggtgacgaagtccggtgtttgaggaattgcgtacatgtttatcacaagacgtgtattgaccgttggatccaagacgataagatgacgtgtcctttgtgtaggaccccgatcgttcctgatttctatttttttcgtttgtaaattagaaaagctaaatgtttcattaatcagattttttttcagcaaatagatatcaatcgttcactaataaaaactaattttttgtctagtttatttatttagttacttcccataattcatttccgtttaaaaattatggttatcatagtcctggacgttcggttatccattcgatttcggttatattcattcagttatcggtttgttgttctaaaggtattcattcagtttggtttcgattctttcggttttcagatatttttttgattattttcaagtatttttattattttatatatattctcaagtatttttaattatttactttagaaataactaatacttttaaaattttgattgatgtttcggatattttcggtttgtatcaattcggtttcggttatttcagttatagaatttagtatgcattcgattagtttccaattttcggttcggtacggttcattatttttgcttcgatttcagtttgatatattcggttcagaatatttgttcagacttagttgataattgagaactctttctcgaaacgtttaaatattaaaagatcacaaaatgggataaacaactacaagaaaattttgccttaatcgacgtcacatgtaaacaaaagaactaaatcggattcaatgttgggcctttcttgaagcccacatgctatttgggtcaaaagcgccaagacccaagacatatctcttaaaatctttgaactttttgagttttgatcacataagaatttacgataagatttactcaccacgagaacacacacgtggcagtttcactgattaaataacacatttggtgtattcactaatatcaaataaatgacgtcatttcacgcttctaatttatttcctaatgtacatttagtgataaaaccctacatacgtgttagagatacggccccgtgcacctactcaaaatagtaaagtcaaagaacgaccgtcagattctatgtctccctcctcagcttataatcaaatcgtggccgttgattctcttttgactcagaacgagcattaacggtgacctttttatccgacttcaccaccatcgttgccgccgcattcgatcgatcactaatcacaattctccagctcaagtgggacattcgtgttcgccactctctcgcctgtcacgcgtgtctctcacgctccacattttttttaatccccttaatcacacgatcttaaggtgtctgatttcactaaaaacatcggaggcaaaaaatgaaaaatcccatgtgcatgctcagtcaaactcacccctcacgtgacacattgcctctatcacgtgatagacgagtaccatttctagatacaactaagattcatatagatcctttaggatttatttttttacagtgttgtatgtttaaattgaacacatttatgccgttgacaaaatttaaaagtaaatatgaggttgacttttgatttataacagattcgtagtatagaatatttacaattgattgaccaacaaaaatgagcaaagatgttaccgtgggtcgattctttacctgggaacttaaatttggtaaaaattagcggcagcttttcttttttaattatgcctactactacatcagaggggtattatagggaactagagtaaaacctaaggacatttccgaccaatgaaaaaaacatggaaaatataagaagggctgagaaaagcaaacaaaaaaaaagttttaataaaccagagaaaaaaaagaaccctcctatcgagttctgtgagatctgcttcaaaagaaaaaaaaactggtggagaagaagaggtgaatcgagttataagcttacgtggtgatgtaaaatatttatatattgagcattttatacatcttcttcttacttgtgtttggtttcttttgggccaaagtattgttttgggtaaaaaatg

SEQ ID NO: 7698 - DNA, 3000 bp, Unknown
  misc_feature (1)..( 3000): cDNA_ID_1818571_gDNA_ID_1621157_Annot_ID_57057 3000 nt of promoter + ATG
caagtcatcgatctgcagtgggatcttggatgctattgctcgccactgagcacgtgacttattcacaatcacctatatatgttattatacttcagggtcagattcaaacaaatgagataattaaatcattgcgagtgttaactcagtgtggcattatgaaagctagagcattagcttctgcaatatgaagatgaatagtgagaaacagataaactaacctgactcgaaaacagtgaattgggtaccaaaaccggaaatttttctgcattcaacaaagatgttgtcgtaagtcccatttcaataacttgaccttctacggatccagcctgcaaagtggggacaaggaagacactatatcttgagaaaaatatgagtgagaactgccaatatatttgcttgctctatgaaactaaataaaagaagagagcagaaaagaaaaaaaggttcaactaactttgatagtatcacccatagagaaaggccgcgagaattgcattgacagaccactcagcacattaccaaggatatctctggcagcaaatgcggtggctacccctgaaaacgcaaatcaaaattggtatgttatgagcaaatactatagaatcagtaggatatctaaaaatgttagcaacccctgaaaaagataagactatatgcttgtgatggcctctagaggcctttattttctgttgaatcctagcaattagcattataggctgagcaaaacgactaatatgaaatggagaacattagacagacctccaactccaccaactgtcaagatagattgaacagctacaccacatgcttcagcagaagccatcaaaccgatagcgaaaagaccaacagatgatactttgtctaaagtcaataccttctccctatcaagcccaccaaaactcttagccgacaacattcgggtaatcacattggtcttccaccgatataggaaccacacaagtgagagaataaccgctcccttcacagtcggggaaaagtattgagctgctatagttgttggcgccaccattgcagcactgcagcatatcacattcatcaagtctatctattttctacaacatacatgtcaaaggaataaagctagagagactcacatttgtgcaaaagcaatgaaggtcaccaagtaacgagcaggatcctctaaagctccccaaaagcttttctcataaggaacatcttcgttagagaagccaacgggaagcagtttagcggaactttgcatagcataagtgtgaaaccttctaagaatcctaggcatcacaacccaagcaaataaagtaccagtcatagtgagactaacaggaactataacatctttaagataagggttagagtcaaggaactgctgaacatgagggatcatctcatcagagacatctttagtcttctttgcagtctcagtaacagcatcgacactagtctgcaacacatctttagctttctcaacccaatcattcccattcccattcccatcaccagagccagtaacaccagaggctacaatacttccgaaatcatcagatttggagctgaaagctcgtgcgtacgaagaatggcctaagtaattgaaaggcttagcatcattatgcaggcgtatgttcgatgaaaaggagatcatcgaaggagaagcttttggtccatcaagaaggtttccgcaagtaaaggccctggcatgagagtttaggagaccagaacacgattttgcagtggcatgaggttttattgatctttgaattgacttgagaagcgataacctaactccggccattgatctacaaatcaaaatcaaaaatcaggatttagaagtcttaatcacattcttaaccaattgaagaagaacacagtgttcactaattaagagcttgctagagtttcgataatggcggaccagatcaaaaattgaagtcaatggaatgtgaagagatcatagaacttgtatattacctggagagacttgaaggtagctagattcttagccaaaattctcgctgagagataaagaaagaattctaaattttgcttggcaaagagggaaagaagatgaagaagaagaagagacaggtttatttcgtcaactctgcttcttattcggtaacatcgacgtcgttttagtcaccttcaacttctgggccttttgggcctaatgattcaaatttgttgggcttaatgcaagtttgattaatttggtgcaaaaccttattaagaaacacacacacacaaagttgtgaatttgtgaatttacttaactacgtacatatatataatcattaattaatcacggtgtttgtcaaatatatatggttacaaattcaatatgttttggacaaaataatatgtgcctaaatctgcttataaatgacaaaatatatacaaccactaaaaatagaagagatatttatcatgaattgtactccaataaaaaaggtattgactttagacaaagtatcatcctaagatggagtattttgcaaatacttggctacaataaaaaaaactgatagatttgtgtgaaaaacgctattttcagttattaattactgtaatcattaatgttgaaatgtcgttttccatcttatggttttattcttgtggagaattaatgttccaaaaacagctttgactctaataaattgggaaatataaaaaggagatttctttctaaatccaaaattttttttaactaaataagattattttagacatcatcaaaatatatcttgtcttaaatttgagttaagttgtcttaattaaatttctcggagtagtgtaataattttcatatgtaaattaacaattgacagcatcgagacaaaccttgcctttttggcattagataatacagattataattgtaattaaaaaaaaataaacttggtttcatttcttaataaaaagccttcaatctcaccaacaccaccactgtcacaactcacaaagcaaaaaaaaaactagtcttcttctatgtcaatcagagccatg

SEQ ID NO: 7699 - DNA, 3000 bp, Unknown
  misc_feature (1)..( 3000): cDNA_ID_1818567_gDNA_ID_1621157_Annot_ID_57058 3000 nt of promoter + ATG
tttcaaaaagcaagtcctctttgtgaagttaacaagaagcaaactatttatcagaataagcaacaatttcgtcatttgcacaagctgccacattgatcaccattgtccccttggtcgttgttggcactaatttacaacaatctctccgtggagcctacaaaaacatttgacaatttctcgtgaacaataatagaagactaaagagttctgaatagtaaattaacagcaaaaattatgtaccttgctccacctatccggagtaggctttttgtagacaaatatctgattgatctcggaaggatccgcgattccccattcacatttaggataccattcgtcgtgcctcaagtattggctaatcgtcgttgtatcagaagaagaagagttactaaacgcatgagagaaataaaacacacgaggacgctgacaatccgtccatgttaccggacgtgtgttgaatgcaagattagtgaaatcgctacgtaagtgccaatcattaaaagtgcgagtaggcacttccatcatccttgctggcatatacgtacgcgtgatttgaactgtgtatccccacgagattgacattgtccactgatgactcttatcatagcataccgattgttggacaagactcgctgaatcgagtttcgctgggatcattagcttctttaatgcgttgactcggtttgtttttgggaatataggatccactacgtctaggtgatggattgatactattggtgcttgtggatggacagataatagccctaagagattcccgtatacatcaaactgttataaaccataccataaaattaataatcagtaagtgaagtaacaagagtcaatgacaaatgaatctaatcacggattttaagttttactatttcacatttactttgtgtttttccggctgatttttctcggtaataacaaaactaacctgatggaatccaacttctttagtgagaggaacaccaagctcagccatacaagcatgaatccgatcatcggatccgtacaaatcggagtatctctcgatacaccgatcttgcatcttctccaaaaccttggctaatggataacttatagcaaaccctcctccaccgtacgccattccataagaaaactgatgaagattctgcaaatgactctcggacggagctccgatgtaataaaactgtttatgatcgtactttctcaaaaccctaacaagattttccgtgaaaaacacggtatcgtcgtcacccatcacaacccacctcacgtttctctccgcttccgttccgtttaacatcctcaccgtctcggacacgattctcgtgatcctgatcgctgatctgtgaccgttacggtaacggtacttgaaactcgacgtgtcggaagagattctgatctgaggcaaagctgatgaagaagaaacggtgtcgttgatgggtttgtcgagccaaacggcgccgttcatgactccgttaggtttccaccatgttttcacgtattctctacgatgcttccatagatctgaagacgcggcgattccgaagactatgtgtttgagctccgtttgttcctcaggtgtttgacccgacccgagacggataacgggtacgaggagagaattgggggatttagaaggtgaatatgggtttagaaaagagatgaaactgaatgagtataagagatatgagacgaagatcaagaagacgacgatggctgtgaaggaacatggagatgaagaagaagaataaaagggtttattagatttgtcgtaagaaagtgttttttgatctcccatggctctgattgacatagaagaagactagttttttttttgctttgtgagttgtgacagtggtggtgttggtgagattgaaggctttttattaagaaatgaaaccaagtttatttttttttaattacaattataatctgtattatctaatgccaaaaaggcaaggtttgtctcgatgctgtcaattgttaatttacatatgaaaattattacactactccgagaaatttaattaagacaacttaactcaaatttaagacaagatatattttgatgatgtctaaaataatcttatttagttaaaaaaaattttggatttagaaagaaatctcctttttatatttcccaatttattagagtcaaagctgtttttggaacattaattctccacaagaataaaaccataagatggaaaacgacatttcaacattaatgattacagtaattaataactgaaaatagcgtttttcacacaaatctatcagttttttttattgtagccaagtatttgcaaaatactccatcttaggatgatactttgtctaaagtcaataccttttttattggagtacaattcatgataaatatctcttctatttttagtggttgtatatattttgtcatttataagcagatttaggcacatattattttgtccaaaacatattgaatttgtaaccatatatatttgacaaacaccgtgattaattaatgattatatatatgtacgtagttaagtaaattcacaaattcacaactttgtgtgtgtgtgtttcttaataaggttttgcaccaaattaatcaaacttgcattaagcccaacaaatttgaatcattaggcccaaaaggcccagaagttgaaggtgactaaaacgacgtcgatgttaccgaataagaagcagagttgacgaaataaacctgtctcttcttcttcttcatcttctttccctctttgccaagcaaaatttagaattctttctttatctctcagcgagaattttggctaagaatctagctaccttcaagtctctccaggtaatatacaagttctatgatctcttcacattccattgacttcaatttttgatctggtccgccattatcgaaactctagcaagctcttaattagtgaacactgtgttcttcttcaattggttaagaatgtgattaagacttctaaatcctgatttttgattttgatttgtagatca

SEQ ID NO: 7700 - DNA, 3000 bp, Unknown
  misc_feature (1)..( 3000): cDNA_ID_1818559_gDNA_ID_1621157_Annot_ID_57060 3000 nt of promoter + ATG
caactgattttaaataacaaaaatcttaaatataaatcttaaaacaaaaaaaaaatacaaaaatgatattttgataacatgagcattatatgcacatatatcaactgattttaaataaccaaaattttaaatatagatattaaataaaaaataaaaataaatgaatgatgttttggtaataggaggattacatgcatgagtcaactgttgtttaattaacataaatcttaactatagatattaaatgaaaaatgaaaatacataaatgatgttttggtaataggaggactacatgcacgagtcaactgttgtttaaataacataaatcttaaatatagatattaaatgaaaatacatgaatgttgttttggtaataagaggactacatgcacgagtcaactattgtttaaataacataaatcttaattataaatattaaaataaaaaataaatacatgaatggtgtcttggtatcaggagcactacataggcaagtcaactgattttaaataacaaaaattttaaatataaatcttaaaacaaaaaaatacaaaaatgatattttggtaaatggaccactatatgcacatatatcaactgattttaaataacaaaaattttaaatatagatattaaataaaaaataaaaatacatgaatgatgttttggtaataagaggactacatgcatgagtcaactattgtttaactaacataaatcttaattatatattaaatgaaaatacatgaatgttgttttggtaataagaggactacatgcacgagtcaactattgttttaaaaacataaatcttaattataaatattaaaataaaaaataaaatacatgaatggtgacttggtatcaagagcactacataggcaagtcaactgattttaaataacaaaaatctttaatctcttaaaacaaaaaaaaatacaaaaattatattttggtaacaggagcactatatgcacatatatcaactaattttaaaataacaaaatttttaaatatagatattaaataaaaaatgaaaatacatgaataatattttggtaataggagtacttcatgcacaagtcaactgttgtttaaataacataaatcttagttataaatattaaataaaaaataaaatacataaatggtgtcttggtaacaggaacactacataaacatgtcaactgattttaaataacaaaatcttaaaataaatattaaaataaaaatgataatacatgaatagtgtcttggtaataggaggaatacatagaaagatacactgattttaaataataaaatatgaaataaaaatacataaatgatgtattggtaacataagcactacatgcacatgtcaactgattttaaataacaaaaatgttatgttaaaacaaaaataaaaatacatgaatgatgtcttggtaagagaaggactgcatgcatagatcaactgtttttaaataacagaaatcttaactctaaatattaaaacaaaaaggaaaatacagaaataatgtcttgataataggagcactatatgcaaaggtaaacatgtattttttctgcttccctcccattcaaagccttaatcaatgaagttttggctaaaagaatgatctttgaccgatggagtattgtgtcgcttgatgtgatctttttacattagaattgtggtcatttgtctcagggaaaagaggagctatacaatataacaagaggtccttcttgaggtggtgaagatcataaagaagcacggttacgttccttttgtaatattccttggatctcgaaatcgagtacaagttcctatcatgctaatggcggagatggatgaaggcattttacattgtaatctgttcatttaatttggattgctttcattgtttcatttgtttgacatacatagacactaatagttgaggattatgtatttacaacaataaagtgttccactacacaaggtacaatcgatatatatatagtgttaactctcatttgtgtatatatgcatatcagtttgtaggtgttactatgatagtagtacatttattaatttataaaaatttatacgtaaaatacaatattaattttttaaaaagaaaaattttaatttagtttttctttatgttttattgtttgtatattctgttagatttttttttattactttttttattttttctctgtaagatattgtgcatgtatacgacgttaacgtgagacttaatccaattttttattacacaaatcttaacaatgatttttcatataaaaaaagttacaaaaccaaatatgacggatcaaatacgcaaagagttatgtgaatacaaaagagatcacaccaactatactctagaaagagttgcaattatgacttgaacaaaagtttcatataaaattagtctttgaatgtatgctaaagatttatgattattaattttatgatattactggtaccatatttttacatagggatttcaaaaaaaatattatcttattatcttatcgattttggttaatttttacattaccccgatttgagaccgacaaaatttattaatttatcgtgtaatatgttttgttcaaataccttttaatatctatttaataataaaaaaatattcaatcagaaatggataatatataatataattatttacttaaaatatatcagcaatgaatcttaaaatgtagaaaaaactaaattttaatttattatataaaaaaggtagataaaatattttatactattaagtgactaaaatgatagatttttgcaagagcaaaattgtactattgatgaatattaaacagtagaaaaaaagatgaaagtgtttgttttgttatgaatgttgagaaaagtatggccaagtgttactcatcctattttgcttttctttttctctcgggtttcactttttaaaggtcgtgaagattgggaatcactgctctgcatgcgccctagaatcagcaagtctaaagcaagcaataagc

SEQ ID NO: 7701 - DNA, 3000 bp, Unknown
  misc_feature (1)..( 3000): cDNA_ID_1818556_gDNA_ID_1621157_Annot_ID_57061 3000 nt of promoter + ATG
tttgcttttgttttctttagagagaaacaagaacacgtttaagagcatgatgtcttgataataaaacttgggtgattctcttacaagatacaaacacacatacttattatagttttacttgaaacacttacacacacaagcatgctcttaaacgcataattaactctgatttcttgcaagctactctactacatattgggactctaacaacaagcatgctcataaacacaatttatgtttctttttatttcctcacctactttgcagtttcaagatgcagaatctcttaatttttttattatagacataataacttctgtgaaagattgtaactaaatgtatatgttttattttggttgcatttggtacttgagaaagaggaactagtgtcaccagaataactcaaactgcacgtaattatcataaacaataaatatacaatttacaaacatcatttcagaatccattttgtttaatgaggttgaacctatcaccatataagctatttagaactcttgttgaatatgtttgtgaatccattctattgtgtgtttctttgttttgtaataactctggtcatgagttttgagtagagagacattaaaaaaagaagcacatttacaaaatcctaaaagttcattacaaccatcgaccaaaaggtttgttagacaacttatcttaatcttgttatagctaattctcacacgagaatccaaaagactaaaaatccataaacgtagatagaaagataaaccctaagatagataacaaaagagggcattacatccttagattaaccctatacaatccctaagatagcttcttcttcttcttcttcttagttggtttgagcaagcaccgaagtcacatccttcaaaacatccatctccgccaacaacaactcacatttcttagcgtccacaaccttcatcttctcttgaatcttcttcttagtctccagagacaccttgctccacttcttcttcacagaatactcatccaaaccgagattcgcgataaccggaacaagaaaagactcctcaaaccactccgaatctgctccaagaatcacttgctcatcttctataaccaaaggtttctccaccttcttctccttgctattagccttacccttaacaagaatagattcatctttcttcacaggagattcaacgttcataccatcagatccccaaatcaaaacagccaaacccaaacatttcttatcatgattcgattcaccacttttgttcttccggttaacaaaatacttattctttaatcttctaatcttgtcaaagaactggacatgactaacatcaaagcttatagatttcttggcgatatcaaaaaacgcattcttatgatcccaaggacttgtacctgtctcagctttgaaatcaatcactgcctgtagaagagagatctcatcttcttcactccatactctctgaggattcgcctttttgttatcgtcctctttcttaactcttttgacatgcatgtcccttgaggtgcttccttcaccagctcgcttcttccctgacttcaccgccggtgattcagcagcaccttctttcttcttccgcctggttaagacgaatgactgcttctctgagtcatcagaagaatctgtcttagaattcacagcggcggaaggagattttagggttttagaggaaggaactgtgacaggatctttgggtttgctttcttcagaagaagacttaaagatctcttcagaagaactctcaacttcgcttgaagaagcggttgctggactttccaaaggagccattggattttcttctttcagattctcgggtatgagtaccaagtgggaactgaagggacaattttagggtttgtgagttgcgagactttttatttttttacactgtaacatctcttatatttaagaaacaattaaagtaaataaagctcaacaacaaaaactaattaagcccaacaaaataaataaaccatcatccttatatgtaacactgtaacatgggaaaaaaaaacaattttttgcccaaatgtataagaaatttgtataacaaaattcatactagattttcttgttgtaattcttggtatacaaaatgaaaggtttctttgttgtaaaacaaaaatatatgtactaaaagtaattttacaaagtcgctttatatttttacatttagaaagatcatttgatcaagtgggaaacctttattgaaattaacaaagtggaaaagattgtaagtagtgaaatttagtgtcatctatagacaaaaaaaatgtaaattagaatttaggaatatgaattcggttaggattagtcgattaggtttattgagtaaactcaataaaaattactgtagtaatacttcagtactcggttcggtttatagttaccgaactgaaaccaaacgattattctaatttaattgaagttaccaatttttatcttaagtttaattaaaattattgaaaaatatgaactctctcttacagtaaaccgacctgaaattggtttttggttccaatttgacaccaatattttatcttgaaccaaatcgaaatttatgctattaaaattgaaccgagccgaactttactttcggtctacttcggttcaagaaatttcaatccaatacatatgaattctgaaagtcctgaaccgaaccagagtgtttaaccacaataaaagtctcttcaatggtctcttcttgagtatatcaatggtctctcatagtttcaacaacaccaataaactgtcatcttcaagttggagtttattacactcgttccttcaagaaactgtaccgtcgactttcagatttagccatttaggacttctcaagattttgaaaatggcgcatcaacatttcttcaagcctcttcttcctggcttccacgcctccttggtactctctttctcgctctttcccttcttctatctctgtctatgtctctctgagaagctaaagatgagtctggttttgtatttgcatg

SEQ ID NO: 7702 - DNA, 3000 bp, Unknown
  misc_feature (1)..( 3000): cDNA_ID_1818549_gDNA_ID_1621157_Annot_ID_57063 3000 nt of promoter + ATG
tcattcgtcttaaccaggcggaagaagaaagaaggtgctgctgaatcaccggcggtgaagtcagggaagaagcgagctggtgaaggaagcacctcaagggacatgcatgtcaaaagagttaagaaagaggacgataacaaaaaggcgaatcctcagagagtatggagtgaagaagatgagatctctcttctacaggcagtgattgatttcaaagctgagacaggtacaagtccttgggatcataagaatgcgttttttgatatcgccaagaaatctataagctttgatgttagtcatgtccagttctttgacaagattagaagattaaagaataagtattttgttaaccggaagaacaaaagtggtgaatcgaatcatgataagaaatgtttgggtttggctgttttgatttggggatctgatggtatgaacgttgaatctcctgtgaagaaagatgaatctattcttgttaagggtaaggctaatagcaaggagaagaaggtggagaaacctttggttatagaagatgagcaagtgattcttggagcagattcggagtggtttgaggagtcttttcttgttccggttatcgcgaatctcggtttggatgagtattctgtgaagaagaagtggagcaaggtgtctctggagactaagaagaagattcaagagaagatgaaggttgtggacgctaagaaatgtgagttgttgttggcggagatggatgttttgaaggatgtgacttcggtgcttgctcaaaccaactaagaagaagaagaagaagaagctatcttagggattgtatagggttaatctaaggatgtaatgccctcttttgttatctatcttagggtttatctttctatctacgtttatggatttttagtcttttggattctcgtgtgagaattagctataacaagattaagataagttgtctaacaaaccttttggtcgatggttgtaatgaacttttaggattttgtaaatgtgcttctttttttaatgtctctctactcaaaactcatgaccagagttattacaaaacaaagaaacacacaatagaatggattcacaaacatattcaacaagagttctaaatagcttatatggtgataggttcaacctcattaaacaaaatggattctgaaatgatgtttgtaaattgtatatttattgtttatgataattacgtgcagtttgagttattctggtgacactagttcctctttctcaagtaccaaatgcaaccaaaataaaacatatacatttagttacaatctttcacagaagttattatgtctataataaaaaaattaagagattctgcatcttgaaactgcaaagtaggtgaggaaataaaaagaaacataaattgtgtttatgagcatgcttgttgttagagtcccaatatgtagtagagtagcttgcaagaaatcagagttaattatgcgtttaagagcatgcttgtgtgtgtaagtgtttcaagtaaaactataataagtatgtgtgtttgtatcttgtaagagaatcacccaagttttattatcaagacatcatgctcttaaacgtgttcttgtttctctctaaagaaaacaaaagcaaaacagagtgacaagagagtgagagtgctgacctcaaaagaatgttggaagaggtagtttgagagtgaaagtgtgattttcaacagatatcttcctcacgtagaagaagttgaatggttaatatcaatattgttatgtataaccaagaaagctatagaattgcactatgatattgtgaagctgcagaaaaataaacaacagtaaagtacatacttgaacaagaaaatgaactttgttagtccgcgtacttgtcttaactcttatgcaggggtagccaagcaatatgaaacatttagtgtggcccattttttttttttcaaattctttaacaaaaattatttacaaaatggccccaattttattgattttaacgataattggccctaaattttaaaacctttcaaaataatcttggattttttgtttttttgtatgttgcccataaaaccgtcaggtcttaggtaaaacatctataaattaatattcaataaattaataaactttataaattaataaattcattcaatcccgagttgaaaccagtgtaagaattgatacaaatcgataaattaataaaataataactttttgtgaaaatcatatgtaaatatttggtcccatcaatattataaattcactaatttatatatatatatatatagatatatactaaaatatgaatatagtattcaatttgtattaattctttgtagaatttaattctaatatttttactaaatcgaaaaatttagttttggtttttaaacttgataattgtttaataattgtaattggtttcaaaaatattattgattataagaaaagaaaaaaaataccttttttgattgaatattataagaaattacataatttgtaaaatttctttataaattaatatctcttcaaattaataaattttatcaatcttaaaattattaatttatagagattttacctaatatgcatttttaactaaaagtcataatgttatatattttatttatatttagagaataatatatatattaaaaaaaaaaaaaaaaaaggttgacaagtggaaatatgtgaccggcaatagtaagttaagttgaccaaaaccaaaaccaataaaatcaaaatcgagagactctttcttcccccaagcgaagaagcgatgatcaaaattttacaacggttcctccattttcagcgaaggtaagtctcacctaattccttggaactaagctccgctgtgatccgaatgtacttatatatctctctcttctgatcaattcgcaaaccgccattgttgcttttttgaaatttcgcttctgatgaagaaatgttgatcggagaaaacgttgaagacgtttgaatttctttatgaattagtcagttgtggtgttagttagttacg

SEQ ID NO: 7703 - DNA, 3000 bp, Unknown
  misc_feature (1)..( 3000): cDNA_ID_3051169_gDNA_ID_1621157_Annot_ID_173590 3000 nt of promoter + ATG
ttcagttcccacttggtactcatacccgagaatctgaaagaagaaaatccaatggctcctttggaaagtccagcaaccgcttcttcaagcgaagttgagagttcttctgaagagatctttaagtcttcttctgaagaaagcaaacccaaagatcctgtcacagttccttcctctaaaaccctaaaatctccttccgccgctgtgaattctaagacagattcttctgatgactcagagaagcagtcattcgtcttaaccaggcggaagaagaaagaaggtgctgctgaatcaccggcggtgaagtcagggaagaagcgagctggtgaaggaagcacctcaagggacatgcatgtcaaaagagttaagaaagaggacgataacaaaaaggcgaatcctcagagagtatggagtgaagaagatgagatctctcttctacaggcagtgattgatttcaaagctgagacaggtacaagtccttgggatcataagaatgcgttttttgatatcgccaagaaatctataagctttgatgttagtcatgtccagttctttgacaagattagaagattaaagaataagtattttgttaaccggaagaacaaaagtggtgaatcgaatcatgataagaaatgtttgggtttggctgttttgatttggggatctgatggtatgaacgttgaatctcctgtgaagaaagatgaatctattcttgttaagggtaaggctaatagcaaggagaagaaggtggagaaacctttggttatagaagatgagcaagtgattcttggagcagattcggagtggtttgaggagtcttttcttgttccggttatcgcgaatctcggtttggatgagtattctgtgaagaagaagtggagcaaggtgtctctggagactaagaagaagattcaagagaagatgaaggttgtggacgctaagaaatgtgagttgttgttggcggagatggatgttttgaaggatgtgacttcggtgcttgctcaaaccaactaagaagaagaagaagaagaagctatcttagggattgtatagggttaatctaaggatgtaatgccctcttttgttatctatcttagggtttatctttctatctacgtttatggatttttagtcttttggattctcgtgtgagaattagctataacaagattaagataagttgtctaacaaaccttttggtcgatggttgtaatgaacttttaggattttgtaaatgtgcttctttttttaatgtctctctactcaaaactcatgaccagagttattacaaaacaaagaaacacacaatagaatggattcacaaacatattcaacaagagttctaaatagcttatatggtgataggttcaacctcattaaacaaaatggattctgaaatgatgtttgtaaattgtatatttattgtttatgataattacgtgcagtttgagttattctggtgacactagttcctctttctcaagtaccaaatgcaaccaaaataaaacatatacatttagttacaatctttcacagaagttattatgtctataataaaaaaattaagagattctgcatcttgaaactgcaaagtaggtgaggaaataaaaagaaacataaattgtgtttatgagcatgcttgttgttagagtcccaatatgtagtagagtagcttgcaagaaatcagagttaattatgcgtttaagagcatgcttgtgtgtgtaagtgtttcaagtaaaactataataagtatgtgtgtttgtatcttgtaagagaatcacccaagttttattatcaagacatcatgctcttaaacgtgttcttgtttctctctaaagaaaacaaaagcaaaacagagtgacaagagagtgagagtgctgacctcaaaagaatgttggaagaggtagtttgagagtgaaagtgtgattttcaacagatatcttcctcacgtagaagaagttgaatggttaatatcaatattgttatgtataaccaagaaagctatagaattgcactatgatattgtgaagctgcagaaaaataaacaacagtaaagtacatacttgaacaagaaaatgaactttgttagtccgcgtacttgtcttaactcttatgcaggggtagccaagcaatatgaaacatttagtgtggcccattttttttttttcaaattctttaacaaaaattatttacaaaatggccccaattttattgattttaacgataattggccctaaattttaaaacctttcaaaataatcttggattttttgtttttttgtatgttgcccataaaaccgtcaggtcttaggtaaaacatctataaattaatattcaataaattaataaactttataaattaataaattcattcaatcccgagttgaaaccagtgtaagaattgatacaaatcgataaattaataaaataataactttttgtgaaaatcatatgtaaatatttggtcccatcaatattataaattcactaatttatatatatatatatatagatatatactaaaatatgaatatagtattcaatttgtattaattctttgtagaatttaattctaatatttttactaaatcgaaaaatttagttttggtttttaaacttgataattgtttaataattgtaattggtttcaaaaatattattgattataagaaaagaaaaaaaataccttttttgattgaatattataagaaattacataatttgtaaaatttctttataaattaatatctcttcaaattaataaattttatcaatcttaaaattattaatttatagagattttacctaatatgcatttttaactaaaagtcataatgttatatattttatttatatttagagaataatatatatattaaaaaaaaaaaaaaaaaaggttgacaagtggaaatatgtgaccggcaatagtaagttaagttgaccaaaaccaaaaccaataaaatcaaaatcgagagactctttcttcccccaagcgaagaagcg

SEQ ID NO: 7704 - DNA, 3000 bp, Unknown
  misc_feature (1)..( 3000): cDNA_ID_2038555_gDNA_ID_1621157_Annot_ID_173587 3000 nt of promoter + ATG
tatacataacaatattgatattaaccattcaacttcttctacgtgaggaagatatctgttgaaaatcacactttcactctcaaactacctcttccaacattcttttgaggtcagcactctcactctcttgtcactctgttttgcttttgttttctttagagagaaacaagaacacgtttaagagcatgatgtcttgataataaaacttgggtgattctcttacaagatacaaacacacatacttattatagttttacttgaaacacttacacacacaagcatgctcttaaacgcataattaactctgatttcttgcaagctactctactacatattgggactctaacaacaagcatgctcataaacacaatttatgtttctttttatttcctcacctactttgcagtttcaagatgcagaatctcttaatttttttattatagacataataacttctgtgaaagattgtaactaaatgtatatgttttattttggttgcatttggtacttgagaaagaggaactagtgtcaccagaataactcaaactgcacgtaattatcataaacaataaatatacaatttacaaacatcatttcagaatccattttgtttaatgaggttgaacctatcaccatataagctatttagaactcttgttgaatatgtttgtgaatccattctattgtgtgtttctttgttttgtaataactctggtcatgagttttgagtagagagacattaaaaaaagaagcacatttacaaaatcctaaaagttcattacaaccatcgaccaaaaggtttgttagacaacttatcttaatcttgttatagctaattctcacacgagaatccaaaagactaaaaatccataaacgtagatagaaagataaaccctaagatagataacaaaagagggcattacatccttagattaaccctatacaatccctaagatagcttcttcttcttcttcttcttagttggtttgagcaagcaccgaagtcacatccttcaaaacatccatctccgccaacaacaactcacatttcttagcgtccacaaccttcatcttctcttgaatcttcttcttagtctccagagacaccttgctccacttcttcttcacagaatactcatccaaaccgagattcgcgataaccggaacaagaaaagactcctcaaaccactccgaatctgctccaagaatcacttgctcatcttctataaccaaaggtttctccaccttcttctccttgctattagccttacccttaacaagaatagattcatctttcttcacaggagattcaacgttcataccatcagatccccaaatcaaaacagccaaacccaaacatttcttatcatgattcgattcaccacttttgttcttccggttaacaaaatacttattctttaatcttctaatcttgtcaaagaactggacatgactaacatcaaagcttatagatttcttggcgatatcaaaaaacgcattcttatgatcccaaggacttgtacctgtctcagctttgaaatcaatcactgcctgtagaagagagatctcatcttcttcactccatactctctgaggattcgcctttttgttatcgtcctctttcttaactcttttgacatgcatgtcccttgaggtgcttccttcaccagctcgcttcttccctgacttcaccgccggtgattcagcagcaccttctttcttcttccgcctggttaagacgaatgactgcttctctgagtcatcagaagaatctgtcttagaattcacagcggcggaaggagattttagggttttagaggaaggaactgtgacaggatctttgggtttgctttcttcagaagaagacttaaagatctcttcagaagaactctcaacttcgcttgaagaagcggttgctggactttccaaaggagccattggattttcttctttcagattctcgggtatgagtaccaagtgggaactgaagggacaattttagggtttgtgagttgcgagactttttatttttttacactgtaacatctcttatatttaagaaacaattaaagtaaataaagctcaacaacaaaaactaattaagcccaacaaaataaataaaccatcatccttatatgtaacactgtaacatgggaaaaaaaaacaattttttgcccaaatgtataagaaatttgtataacaaaattcatactagattttcttgttgtaattcttggtatacaaaatgaaaggtttctttgttgtaaaacaaaaatatatgtactaaaagtaattttacaaagtcgctttatatttttacatttagaaagatcatttgatcaagtgggaaacctttattgaaattaacaaagtggaaaagattgtaagtagtgaaatttagtgtcatctatagacaaaaaaaatgtaaattagaatttaggaatatgaattcggttaggattagtcgattaggtttattgagtaaactcaataaaaattactgtagtaatacttcagtactcggttcggtttatagttaccgaactgaaaccaaacgattattctaatttaattgaagttaccaatttttatcttaagtttaattaaaattattgaaaaatatgaactctctcttacagtaaaccgacctgaaattggtttttggttccaatttgacaccaatattttatcttgaaccaaatcgaaatttatgctattaaaattgaaccgagccgaactttactttcggtctacttcggttcaagaaatttcaatccaatacatatgaattctgaaagtcctgaaccgaaccagagtgtttaaccacaataaaagtctcttcaatggtctcttcttgagtatatcaatggtctctcatagtttcaacaacaccaataaactgtcatcttcaagttggagtttattacactcgttccttcaagaaactgtaccgtcgactttcagatttagccatttaggacttctcaagattttgaaaatg

SEQ ID NO: 7705 - DNA, 3000 bp, Unknown; identical to SEQ ID NO: 7697
  misc_feature (1)..( 3000): cDNA_ID_1808340_gDNA_ID_1621157_Annot_ID_173577 3000 nt of promoter + ATG

SEQ ID NO: 7706 - DNA, 3000 bp, Unknown
  misc_feature (1)..( 3000): cDNA_ID_3051180_gDNA_ID_1621157_Annot_ID_173575 3000 nt of promoter + ATG
ttcattaactcgctcttggttgcttattcaagatttatttgaatggatggtacgaatgtaacatgtgcagtaaatattagatttaatgtcttagtgagcattttgcaataaaaatctgtggatttcatgtttattacaaacagtttcttataaaacatttccttcattattcattaagaaaattaattaagagcacaaacatttccttgttcgtttgccctagacaaggcaataaatcatatcctagagaagcgtaatcgatcattcgattttctttacctaagcgtacaattgaatgttttcttatattatttcttccgttcctttgtcttattattccttaagtctatgttcttacttacgttcactctttttttcttggttactcggacagattccaagtttcttattctacaagataaatgaatcttggttaaaatcaaacgtggaggttgtgaagaaatggacaagacaagtcagttgcctgatgaattgctggtgaaggtattatcatttcttccaacaaaagatgctgtaagaacgagtcttttatcgatgcgatggaagtctctttggatgtggctgccgaaactggagtacgattttaggcattattcagtttcggaaggccaagggttagctagatttattactttgagtctactaggacataaagctccggccattgaaagcttgagtctcaagcttaggtatggagcaattggatcaattaaacctgaagatatctatctctgggtttcacttgcagttcatgatagcaacgtccgtgagttaagtctcaagctttgtacttttgcggagcgtccaactaaattgcccaaaagcttatataaatgcaaatcgattgtgatcttgaaactgaaagacgagattctcgttgatgttcctcgtaaggtatgtctcccctccttgaaaacattgttccttggacgtgtgacttactcggatgaagattctcttcaccgacttctctccaactgccctgttcttgaggatctagttgtggaacgagatagaattgacaatttggggaaattgagtgtggttgtcaagtccttgcagagactaaccctaaagatgtcttgtccttgtcatcttgatgggattatgatgaatactccttctttgaagtatttgaaagtcactgatgaaaggcaagagagtgatagtgataatgagagtgatagtgatagtcctcgatacttctacgattttgaagatatgcctaagttggaggaggcagattttgtattgacattccaaaatatcaaaaagttctttaaatttgtcacatctattaagcgtctttcgttatgcttgggagtctacaccgaagaggtaatctgtttccatcaatctatcaaacttatttttgaacaatattcttgaagttgaatcttttgtcatcttatgcagtctttatatcatgagggtcttgtcttcaaccagcttgaacaattgaagatatgttcatgtgattcagattggtcaattttactttctcggttactcgaaagttctcccaatttacgagagctcgaggcttacgtgatagaagtaagtttcttcgttagagacatattccattggttcaatttactatattgtttaagccaaacttctcatgtttgatcacaggatcatccagataggcgtgtggatctaccaaatcagtggggcaatcagctgaattgtgttcctaaatgtttgttgtcgagtctcgaaacgttcaagtggagtgagatgtatggattgctgcagaaccagatggatgtggctaaatatatcttgagaaatgctcgatgcttaaagtctgcgacaatcttttttccgacaacctatgctaaagaaacaagagatgagatgatcgaggagttgtcactttcttttcaaggtccagagacatgccaagtcttcttccattgaggatgtgaatcataaggattcaaacttgcatttccatagacactaccctccatattacaatggttttttatttgcagcaacttgatctaaacttaaggtgttttttttgtctttgttttttttgtatactttatctttgagcatactatttttcttgagacattggctttatctttttctgagatcttaacaaataaccgaactttgaagagacaagacatgacatgaacttttatttgcagcaacttgatcataacacaagactcaaacacaagactcaaacacaagactcttcagcttatagatcataaagtagatcaatagcacaaaaagatatcaattagaagatcagtcaacaatatagatgttgtagaaatttgcatcctaataaagttcattacaaagaaatgacccaagtttcccacacatatccgcatcaaaaaaacaagtgccataacattgcattaagattcatattcatattaccaaacagagcacttgcacacatacatcaacacaaaaccggcaagaacatcataggaacactcatttgaaaaaacccaaggaatagattcgactatgtaaacacaaacaagtatctaggaaaatcaaaaacataagtaatagaagaatatgttaccttcaaagaagaacgagattttctcagcgctctcaaacccgggttctcaaacccgaaccggaccggaaccggaccattacccatttaacccgacggtttacccataagccgagccctaattttttcaaagaaaagggccctaaacttttcgtcttctcgcttcccttcctctatctcgtcttctcgcttcccttactctatcccatagaaaaaccctgaatttggtttggccaatgatgtcaaaactcttcattgatacttaagaaagttttctccattgttcttcttatggtctcattcacatttggtaagtctcttcaacgattttggttttgtgagcacttacttcttcttacaagaattacatgtctttgttcaggttgtaactgttgatctgtttctgtcacaaaatg

SEQ ID NO: 7707 - DNA, 3000 bp, Unknown
  misc_feature (1)..( 3000): cDNA_ID_3087818_gDNA_ID_1621157_Annot_ID_173573 3000 nt of promoter + ATG
tcacacgtcgctagcgtttcaaaactgcttccactcatccttcctttgatggactcagaatctgtgcattgtggtcgccccaaaagcaaatcatatggaagaggagcaggagcacaaaaggtgtcaggtatagatgtctccaaacctatatcaaccaagaggcctgtggtgaatgctgatcccacaccagcacgggttcctgaagggacaagctcttcaaaagattctggacactgcgtaacaaacttttaataaatagaaactttgtagagtgtcacaatcaaataactgtagataattcagaagacatttttcaaacacagctcactcacgacctctagtagtctactatcgaccactcaagcgagattgttacaagaaattgttgagattctaaaatcatgctcttgtcccgatttgttttaactaaaatcataatctatagatagtcagtagtgcaaagcaacacaaatgcaagatggtgaaaaggattactgacataatagtaaacaggtgttccaacaagatgtgacttcctcgaagaactacagcaacctcccattttcaccagctatagtaataattaagcaagagtagcgaacaacagtccttgaagcattttacagatgcactgccactgcaggaaaagagtgaactgaacaacgattacttgaatgcaacaagattaatcaaaagtactcttaagaaaccccaataaaaaaaaagtgattattacagtgttagtaagcaaaatgacaaaagaaaagttggtctgatggcaaagtcatccataagaaacacaaaggtatgggaagagtgaatagtgagaagaacattacgaaacaagattaatcaaagcagacttgagaaatcccaataacaagtgattattacagtgttaataagcaaaatgacaaaagaaaaagttgatctgatgccaaagttatccataagaaacacaaaggtatgggaatgttccttatgctctgttgtaatgtcccatcaatagctgaaacttgaatctatattctaaaacaacctctaggattcagtcaagttgcaatgaaaacagtgacgcgagcaaaagcatttcacacttgagccaattttaatcaaacacaacacaataaccttcaaaattggtaacatcattgatatgtaactctaccataagatcttctcataagaatagacgacaacatgaacacagtaagcacatctaaatcagaaactaaacaacactaaacagtacgcgaaccctaaaattgaagaagccgaaaagaccaaaaacaaaaagtacacgaaagccgactccgggaaacaaaaaaagagatggaataattaaccgatgagagcagtaaacgaagataacctgagatgtcgccggagaatttgatgttgtcgtgattctccggtgaagaaaagtgagaagaataaatgctggcgacggagggtttcgacacacagagctccttttctctagtcgaataacctcatcatagtaagtaattatactgtaatcctactttactttatttagtttgcctaattattctcaaatctcattaaataccttttaaatagtacgacgtcggttaaggatacgggctaatcattgggcttttgttttctgaaacatgggctataaacattttagaccatggtccattctacagaaggtcaaaccctctgtcgctatcagaggctattgaatattttgctggtaaggtctcaattctcatcatccttcacctgcctatgaatcttccttgttaaccgtaacctaatattgattgacttctaatcaaagtaatttaatctaccattttattatttcctctaatctaagcctttttcatataaaatgtatctaatagtaactttataagaaaaatattatacctttttcttggtatctttgttgtaaaaaaaaatacaaattaaatgcgagttcgattattgcattaatagagatagacccatctggcatttaatatggtggcggcggaataatcgctaacaagatattagttgaaaattttcaaatcattcggatagattacgtctggcattgaactaattatcctctataaattcaataatgacagaatttagtagatgttctaaatactaaaattatttaataatcttacatatgcaattttccatgtacgtgctgttttggagcgtttaaaccgaattaaagtactactgtaaataaattgaatcgaatttaccgaaccaaaattgaagaaaaaaaaaattaaatcgaaccgaaccaaaaattggaaactagtcgaataaatattaaattctataaccgaaatatctgaaataaaaccgaataaatacaaaccaaaatattttgggtaaaatatctaaagtataaatatatttttaaaagtgttaattatttctagactaaataactaaaaatacttgaaaatataaataaaatagtaaaaatatttggaaatatctaaaaatatttaaaaatattcaaaataaccgaaatattttaaatgaaataaccgaatggatactaaattttaaaatcgaaaccgaacagaactttcaaataaccgaatggatactaaactttaaaaccgaaaaaatcgataacggaatggataactgaacgccgagaactactattatatacaaagtatttagttattcaataaaatttgaaaccaatcgttttttttcaaaattaataattatcgaatttaaatctaaggaataaaaaagcttattacaaatcattagacaaaatgtaataaaaaaaaaggaaattatacacattaattatcttagcttgtcgagtttaaattttgttaatcagagaacgtcaagttgtacagctggcgtcaataaatacccaaaacagtcgtctttttcaacggagaagaaaaagttgaaaaaattgtaaagtcagtctctccgactcttccttccttccgtgttcaccattgctacacgttctccacgaactttccg

SEQ ID NO: 7708 - DNA, 3000 bp, Unknown; identical to SEQ ID NO: 7693
  misc_feature (1)..( 3000): cDNA_ID_3087810_gDNA_ID_1621157_Annot_ID_173568 3000 nt of promoter + ATG

SEQ ID NO: 7709 - DNA, 3000 bp, Unknown; identical to SEQ ID NO: 7692
  misc_feature (1)..( 3000): cDNA_ID_1818591_gDNA_ID_1621157_Annot_ID_173564 3000 nt of promoter + ATG

SEQ ID NO: 7710 - DNA, 3000 bp, Unknown
  misc_feature (1)..( 3000): cDNA_ID_3045007_gDNA_ID_1621157_Annot_ID_173563 3000 nt of promoter + ATG
tcaagcttttgcctctccagttcagttagtgcttcatgtttttccaattgtttggcccgagactccaagtcccgcatcttacgatccagttcatttcttagcttctctttatcatataggattctctggatatggcgaagtgacatctgctgcatcttctttgtttctgagaggagataaagtacaaaaaatagtcagataccctaaatgctatatgagtcggaaacatatcagtgtgtgagtaaataccttcagcaaaagcttggtgcaagttttttttctcatctaggaccctttgcagtgacattgccgtcctgttgtaactgtgttgggccttgttcagatcttcgtttgtcatatcaatcatatttgaaagtacgtccagaagagtgtttctatcctgcacattgttttgcaaaatatctgaaactgttcttagcgttccctccttggagaggtactcacctattggaccttgagattgaaagtcgtctgcacgtgcacaccaaccataagcctttgactctgaatctccactcctctcagtccactcttttttgcaggacccttgggtctcaaattccttttcaagctctgtggcagcagcaaacccactccagtcactgtcaaacttagcaataaccccaacaatcgaatcttgttcgacccaaaaggcattcacttcaacaggcttgaatttggaaagggtctgcagccaatatactgaatcaagtagaagctccttgtcatccgtttctttcaaagggttaacaacaatccccatccatggccagacatagacgttatgaggatttggttcagtctcgtctaacagaggaggaacaaccggagggcgtggaagaggttctgcataaccagcaagatcattctctaaaaacttagctaaagcaagatgattagacttctgtaaagcacttctggtggcagaacctttggaaacaccagtagcatgtgcatgcaactccttgtacttgtaatcttgcttcttcttgcctacacaaaaggggcatctgagccgtccattcaccttcaccttgtagtaagtctcactgcgtaaaaggtggtagggtgttttagaatactcctcaatctctgactcgctgatctcagactcttcatcagaaatgtccatcgtacctgctttacctggagaaaaagaatgttacaaaaacagagaagaagaacaaaataaggcccaaaagagactcaatttctaggcaatcccacgagcaagagaaaccctaggcaacaacttaacaaacaaaacaaaattgacactggataaagcaaaagagacgaaagtgatacagcatttacaaaattgagctaagagagtgacgcatgcatgataaggaacctagcgaaatcaaaaatatatttttaagtaacaagtgagtaaaggcgttaaatcacgaaatgcataggggaatcgaaaaaattcattaaacgagagatttcactgtgaaaacagagaatagaagaaatctggagcttacgctagagagggaaggaaaaggaacaacacggcgatgactcaacgcttgatgaagagtggagtagagagagagtgagtgaggaagatgaagagttattttattttggaaaatatatcagaaaaattagagggtgatttgcaagaataacacatttttatacaagaattaagaatatagcactattaattaacaaagtaatttaaaaatagataaaagagaaattttcacaaatagcataattttaagtttttttgacaaaacctattttatactatagttttttgacaaaattttaagtttttttttggacaaaattgatgaataaaacctatgatccaaattgtgaatgatttatactataagcaatatagtggccacaaaattggtcaagaatttttagtggctttatcaaatagccactgactggagatttttttttaaaaaatatgtgtctggtcaaagtatgtaattatatatctatgtgtaaaattgtatcataaaacattaaggtttccaggattatttttcttctcaaaatttaatatagtgactttgttttactctaagagcttatagtcaccaaagttgttatatatattaatatatgtctcattttttttttttataaaaagaatcaattatgagaaagccacttttgaaagtgacatttgttgattttgcaattttccatatagtttgtgaatttgccatttttagttaataatagataccagttaatacgtggatatagtcggttagatttgtttttaaaatttagtatttggtttaaagtacatattttgcaaaaacattttatatatacatacagttttaagtgttcaaaatgacaaatcctcaagattttagtaaaaactaatgacattgttgtacaattttagtgcttaattttagtattttagttattttatgggctgcactttagcaataaatgtctctttgttttcacttttcagcagttggaactttgaacaaatggaaacaaaaaaatgtagaagacaattttatttttaagcccatcaaaaatacaaatgagattgtaagcccaatatattaaccaacctacctttttcttttgtcagctctctctatttctctaaaggtgacgtcatcttcggcggtaacggctcagatattttccacaataacttccaataatacccctgccattaaccaatagtacccatgtttcctctttgcaacgtgggggtagattcatgaaatgagaacagaacggaggttccaacgagtagaagatgatgtgccacgtgtcactatatcgacccccctttcctcttccttccttccccaatagagagggattttcccgcttcagcgtctctcagtctctctctcggctttatccaaaggttccttcgtttactccgcttctatggaagaagcttgaatccttctctcttcttcttctccttcttcccttgacatttttgttctgagaagcaac

SEQ ID NO: 7711 - DNA, 3000 bp, Unknown; identical to SEQ ID NO: 7690
  misc_feature (1)..( 3000): cDNA_ID_2038493_gDNA_ID_1621157_Annot_ID_173562 3000 nt of promoter + ATG

SEQ ID NO: 7712 - DNA, 3000 bp, Unknown; identical to SEQ ID NO: 7689
  misc_feature (1)..( 3000): cDNA_ID_3609923_gDNA_ID_1621157_Annot_ID_173556 3000 nt of promoter + ATG

SEQ ID NO: 7713 - DNA, 3000 bp, Unknown; identical to SEQ ID NO: 7688
  misc_feature (1)..( 3000): cDNA_ID_3051209_gDNA_ID_1621157_Annot_ID_173553 3000 nt of promoter + ATG

SEQ ID NO: 7714 - DNA, 820 bp, Unknown
  misc_feature (1)..( 820): cDNA_ID_2187203_gDNA_ID_1621158_Annot_ID_57065 3000 nt of promoter + ATG
accgtacctcttcgtcttcagataacataaactccacttgttcttgagctgatgttttcagctcatcaacaagctcaggagagttctttagtgtatcaatggacatggcgaaatgaagagctgacaagaagacattctttgtattgagggatacatcaatgacatcgtcctgcatttttcgatgttttaactgcgaattcatcaaatcaagaaacatattttaagtagattatcaataaatcctaaatccaatcaaaagacttaaaacttttctataatcaacaactctaactacataaacaacaaaccaataagaacacaattaccaaatttgtaactgaaatttccttacgttcatcgatttcaagaaccctaattagcatttcatagctctgttttcgtcaatctaatcacattttacagagtaattaacaaaacaaacaaaacagagaaaaatacttactttttccccaaaattttcttcctttaagttaaacaacaatggaggatgataataaacaacattgctttgaatgaagagtgaagaagaaagattgaaactttagcaatccaatggggatcttcacacgctgatttggtttaactaaaccgaatcgaatttggttgataataaaacgacgtcgtataactgaaggatattacggtaatttaagtcaaggccatcgtcattgtcattgaatagatcaaaccattttactaaagaacacagttttctagattctctagagagataagagtgagagaagagaagagaagatccaaaagcgtgggaaaatcgaattagggttttctgaaaatg

SEQ ID NO: 7715 - DNA, 3000 bp, Unknown
  misc_feature (1)..( 3000): cDNA_ID_1818665_gDNA_ID_1621158_Annot_ID_57067 3000 nt of promoter + ATG
tatgtcagtgaaggagctgcatttattggaacatctagagattttaaccatagatattgtgtcaactatggttttggagcaaatgattgacgctggcactttgatgaattgtatgcaagaggtatctattcgttgtctcatttatgaccaagaacaagacacaaagttacgtctgccaactatggatagccttcgtagtctgaccatgtggaactgtgaaatttcagagatagagatagagaggttaacatggaacacaaatccaacaagtccatgtttcttcaacctctcccaagtcattattcatgtttgttctagtctcaaggatttgacttggctattgtttgctccgaacattacttatctcatgattgagcagttggagcagctacaagaattaattagtcacgcaaaagccaccggtgttactgaggaggagcagcaacaactgcataagattattcctttccagaaattacaaattctacacttgtctagtttacctgagctaaagagcatctattggatttctctgtcttttccatgcctaagtggaatctacgtggaaagatgtccaaagctgagaaaacttccattggattctaaaactggtaccgttggaaagaagtttgtcctacaatacaaagaaacagaatggatcgagagtgttgaatggaaggatgaagccactaaactccatttcttaccatcaaccaaactggtgtatatcctctcctagctccattctctctctgtttgatcaaaacaaataatataaataatgtattagcactaacgaaatcttttctttgtcagttgatttagctctttggttactcctaagacagcctgtaggccgtaggacaagccggtttttcaagaaccatatcagacgacacaaactgtcttacactatgaacatcaagcaaatgtaaccaactttctgttttctttcctaccactggattgtattttatatttcctctcccaccgtctcttttgttctgcaacttttctttatctttcctatttttttcaaacaagatcttccctatttattacagtcaaatctttaagtgatccaacatcaattttcttccaaaaatttaaaaatctatcccggcctgcaatttctttcactatgttaagtcttatgacaagtatctataaaacaccacgtttaaaactactgtttaagaaaatatacaaatcaagtcaactattaagacatgtaaacataattgaaagtttaaaactatcaaatcacatgtgatcccagattcttcacatggtagctaggcctaggctcaccttctaatagaagtagcaaatggaatttatcaattatgtgatctcagatcccatacatattattattataggatctcgaagataaagtaaacagagagaggtaacaaacataagaaaaaatctattagatttagttggtgaccaaatgatgttagtcaacaagtggttatcaatttgcttaacacatttttttcttgtaaactgcaaaatttgcacaaactaatttcttgaccactccggtttaagaagattggtttgagtctttgtctctctgagaaataaacaagaaaaggacatgaaaggtattcgatctgccaacgtgacattgtgagaatgggtaatataaattccaaataagattctctcttaatttggattatcctcctccatatgtaatataatttggaatctcgtgattgcttttttttttctatttgtaaggtttcatttagaaacagaaataatttgcatcccaacttagatactactaaccttatatgggcttatttggtagataggcaaaacttttacaaaaagttgtaaataaattatttgtcttacatgctttaaataaatattaaattgtatgttatcgaatagatgataaatttgttaaaaacttaaaatcgtcacaaagcccattgttataaaatttaaaatatatatttcttccaacttagggggtgttattggttccaaattataaggaattttgatgatttcaatcaaatcctagaaagtaaagaaatgaaagattttaaacgattgttagagagtattttataatcttgttgattagtttttcataatcttgtaaagtttctctaacaatctctttattttgataatacttttcatgactttccatgactttattttgtgaagaaaaatgtagaaagtcatgaaccaataacataataatttaaatcattaacaatcattaacaatcaaagattcttttgttttaattgaataacacaaaacttttaatgactttataagagtatgaatctaataaccaaaatttatgaagattttagattactttttacaaatcttaaatgaataacacaaaaatttaacatacttttaaaaaatcttgattgaataacaatagattttacataacagtttaaatcactaaaacttttttaaaatcataaacgaataacacccccttagtaaacatatatacatatgaggaaagaaagatatattaaattaagactctgcatgggtagctttaatatttgtttcaacaacgaatacaaaccaaccataagattagagatgatagaccaataacccttaaaaatatgaaatatcgttttgtccttttacccttttagttataatagaaaagacatgaaatagtgtatagctaaatttttgtaagactttgatgttaaaagaaattttatgtagacaagaaaattatcttagcaaaacgaaagtaataagtttgaaggaggatacaaatgtttataattgaatgaaaatctattgaaaacaaaactactttaatgtcaaaaattaaataagaagtaaatatacaatagacagttgttggatattattatttcaaatgggccaactcttcaagacgtgaagaagactagaagatagctttgtcagattcacatctccccaaaaaaaaaacagagcaagaagaagaagaagaagacaacc

SEQ ID NO: 7716 - DNA, 3000 bp, Unknown
  misc_feature (1)..( 3000): cDNA_ID_1818661_gDNA_ID_1621158_Annot_ID_57068 3000 nt of promoter + ATG
aaaaagaatataaaattacaaaaatatctttactaaaatttactaacaatttaaaaacatttctatttaaaacaaaaattagcttctttttttgttgtcgatatcaaaaaaattggttcacggtttttttttctttttcacgaattatattgatactagataaggcccgcctaaataggcgggtgtatgatataaatttatttaaatattaacagtaatatttaaactttatatagtaaatagtaatcaacacactttttctaatatttaatgtagtaatttttgtattacataaaattttaatcatacacattcaattttacttatattttaactatctatttcatcataataaactattttgttatttataatataaaaactacattcggacactctgtgaaaacgacatcccgtttgtatcctctaacaatgtcggacttacaactgttggacaaacatcaaataaatataaaccgagcagtaattaaaacgcatagtttgctaatccatttactatgcgattagctttactatacacatgagtaactcggactatgcagtccctatacactccatcttattaatgatatttgaattttaaatagtaacgtaactctcatactttttcagtatgtaattttgtatttttttaaaccaaatttcaatcttacaaattcgattttgcaatacaatttaaatacctattttatcataataaaatatataatttaatgatatacactccatcttattgttagtttttttatataatttaattatatacactccatcttattgttagttttacattttagataagaaaattgtaagttaaatatttagatataaatatattaattagtatatataaatatcttttttttttagtttcctattttcttttaggaaaaagtaaaaaaaaatcaaaaacatgtcaaaatctaagatcgttcaaataaccacgtgtcatgatctcgtgagttagtaactttcaaaactgtactttatataataagatttgaatttcaaatagtaacgtaactctcatactttttcagtatgtaatttagtatttctttaaaccaaatttcaatcttacaaattcgattttgcaatacaatttaaatacctattttaccataataaaatatataatttaatgatatacactccatcttgttgttagttttttatataatttaattatatacactccatcttattgttagttttacattttagttaagaaaattgtaagttaaatatttagatataaacatattaattagtatatataaatatctttgttttttagtttcctattttcttttaggaaaaagtaaaaaaaaaatcaaacatatgtcaaaatctaagatcgtttaaataaccacgtgtcatgatctcgtgagttagtaactttcaaaactgtactttatataataagattagattggaaacgttacaatacacatgagaaaataaaagtttaaacttcaagaagacaccatgctcgacccataacctacgacaagataaggaaggaattttccgataatacattgtaaaaaccaaacaaatcttgtctcgagactaaacgaagctctcgaagctcaccataaagacttcccgcacaacaaattatgaagaggggcttcttcataacttatggcaataacaagatagtggaacttggccttctcaataaatgcttctttttcaatgagtgcctttgtcaagggtcttccggatgaaccgtaagataatcgagaaccacttagacgttttaacgccacaacgatcaataaattaagcaaaccatcatctgctacacgatgagagaaaactcaaatataatcaaagtgctcaaccccaaactaacaaagattaacttagtcgggaagagaagattagcccaaacaagggagacggaagtccaaacgagggagacaattaaacctaatcctctgatgttaccatatctcacagagacgaactgatcagagcaacaagtcgacacaaaagaggaatacatgagagacattggagataccgagatatcgaggaggcgatccaatgttgcacagatgcagctttgggagaaaagaaacgagccgtcaagagagaagcaaaagcctccaaagtccgtcaagactcagcgaagagaaccacccgacaaagacgacgttgtgactccactctgtgaccaccgaacaagaacgatgacccaagaacacccttgaccaacagatcctatagatctgagtaccaagacccaacctcattaaatctgccccacaacacccactattccaaaatgtagagcctcgatgcttccacaaacaaagaatacaaagacaagaaatgaaaaactatgcagagaaacaaagaaggtgactgacgctggtgctatttgagcctccacgcgctggtcactttgtgttaaagcaggaagacgagagaaaaaaatattattttaggtcaaccttgtcgatttttgcgatacttagagcttcgatttttagggttaacggttcacctctgctatattttttttatcagaattcaactccaacaaactaaatcactttccgtgataaagaaaagaaaagtgcaaaaatttggattttgttgatccaaaataaaatacaaagaactgaaatcttaaaatcatatactaaactagttgttatttgtaaatttcttataaccctttcttacatttttaaattaccctacatataactttttcttacatttttaaaatatcctacaattatctaactaaacacccaaaaatatttttaccgttttatgttatcaacttatcatcgtgtccgacaaaaaaaaaaaaacttatcatcgtgctcctttacatttttcgtgacctaaaactgctacgacatcgttttagtgacttacttgctaaaaccctttttaactttctttcaagctaaagacctgcacaaactctctctcgaattcttttgtttcgaagcc

SEQ ID NO: 7717 - DNA, 3000 bp, Unknown
  misc_feature (1)..( 3000): cDNA_ID_1818653_gDNA_ID_1621158_Annot_ID_57071 3000 nt of promoter + ATG
ccactatcttcggatagagcagagaagatcgcggctttatttcggacaagcaaaaaggttgtgatatggattacgactaagattgatgccacaaatgtaacttggagcaatttcttcacaatatatatatcgaaccttgagcgaaatctttcatgtaagagtttcttcacaatatatatatcgaaccttgagcgaaatctttcatgtaagagtttcttcattgacatggagaagaaagttgctatggtttttgataaagaaaaaggaaaaaaagtcgctcacaacattattaatatcattggagaggctggatgcgtgaggaaattggttcttaaagaatctggagacaaaagctgttggccacttgtgtgctcttatgttccaagtacagtgcaaatcaagcaacataatagaggcaaaaggcaaaaaaaagtgattaggaaaggcatcgacattgatatgagacatgataaacgtatcaaggttgattagtctcaatttacaaagtctatatagtttatatgtttttcacttacccgtttaacttttttcttcccatctattgttctatatggacaaaattttcatgttttaattttttaagttttacaaaaccgctgtgtgatctattaaatgactagttttgtcgtctgaaatatcacatccgtctccggcggtgtggttgatgcaagttgcaagtatagaagaatatgtgtacttgtctcttactctgcacttgatgagattgtgttgcggcttctgactacatgtatgtggtttattccttacattgtttcatgatttgaaagtaggttatggatgtgttatggtttgtacggctacactttcagacatacacaaaatattacgaattgatctcatggcacatcactccgtcttcgagtcacctctatgtgtatctagtagctttctcgttatgattgtttttcttcttggatcagttttggttgctcaatttaaccttttttctagagaacattcaactaggaatctcactatcataaaatcattaaaggttttgttagttgtagtatgttatggatattcacttgcctgtagagaacaaacattcaagttgcaaattgtgtatatgctttacttttgaaacttgcatgaaacttttgtcatggcgtgtcagtacatagagttgagtaatcatggctttgctatatttgccctgatctacgttgaagtttccatatagtatctttttttcctagtcaaaagttggtttttcactaataaaaatttatgcagatagagagaaaccaaactgcactaaacgagcttaaccatgcattagaagatagagatatatactcgatttggtatgttaaggaagcaaccaactttgaacccatatccatttttctaataaactacgtacatgagaatcctcgtagcaacatttatagaagagatacccaaaccatgtgtaacataattaattaaagtctaaagacagcattggaagagattacacacatgagtatccaaaacgaacaagctgtcactatccaaaacaaacttcaagtgagaaaagtaataaaacatgaactaaaagatagtttaagagattgttaaagcattttcttgcagagttaggttttctcctgatcccacattgtaattaatgatgttgtacatgtcctctaaaaatctgtttgctggcattcgaatctttgcagctatcttttcctacaaacaattgcctagttttctgataatgacggcagtgtgatcttaatgacacaatggacgccgtcacatttctagagtgctattagctagggaatggttattaactttctcaaactttgatcaaggaactatgttttgccttttcttttgatgtaagttgaaatgatacatattttctcacatatgggctaccaaatcttttcttatagttgtcgaacgtaactaaacatatgctgacacagttgtataaataattttacgattcacgtttctgaaaatgttagttagtattagcctatgataattaactatacttcgctttatgtaaatcaaaggccaacttttttgaatatctatatgtaagaataaattacagctattaataaatacgagatgtaacttaattcagaaatgttcacacacatatggaacaagaagatttatccctgaaatagtattcacagtttggatcttatacctttttatgtaaaagaaaagattcaaacaaaaatctttcttatacaaataagattcaatcaaacatatattcctggaagttttgaacataaaaaaatgatttacaaaaaaattctcctaatttattaaaactgaatatttaataacataaaatctcttataatttatgtatatacaaaacaaattccatgatattcatagaatctcataaggttagattcttattataaaaagtagacaatctctaataatttatgtgtcgtgatattaattagaaatctctaataactcaaataggatattaatctaaattcgttgacaaaaatagatagagaatcattgttattcaacgcccaaaaccaaagtcattagtcaatgtcactcgtgaaactatccaaagataagagtttatgggattcgctaatctattacattaaagccacgtgtcttaatcttagatgttcaatagacttgccacgtcacacattgtctctctcgtttctcaaatcgcgtttcttctggtggaggtcaaactttttgattagcaaataaaagtcacacaagccgaatccaaaaatgtaacaagaaaaacaaatcttcacaaggcaaaaaatccaaaattgagttttttttttcttcattttttacaatggtgtctcggtttcgtcttgctctagagtacttctaagtctctctgttcttacttcgatttcgatttttattctcttttttttttttttttgaagacggatttggttggtggtttttagggctgttttgggttcgagacgacgtaagaag

SEQ ID NO: 7718 - DNA, 3000 bp, Unknown
  misc_feature (1)..( 3000): cDNA_ID_1818649_gDNA_ID_1621158_Annot_ID_57072 3000 nt of promoter + ATG
gttatatctacgaactggaagtttgcattctttagcctctcagtccatgtctccagaagcttaccttcaggggcttcacgagcaatgtgtccaacaacttgtgaatcatttccatcaccccgggatagatcacggatggcacgaaatatggcatccatcagccctgttccatcatcacccttaggcttaacatgcatgataacatcaagcttcaactcatcatgtgcaggttttttcacaacttcaagtagagaagccttgttcctactacacaggaaatggatctgcttcttggtaaaaaccataattgtatctggaaactcatacccaagaagccaaatattcaacgctgaagatttcaggtaacgcagatcatcagaagcaggaggggtagcaatggcaagagcgtcggcagatccccataagtctgcactgtgcttcttccagtgttcatacaatgctcttgcacgtgagataaagtttttaacatctatggaataagtattcccagcttttggaggcactccactaggaggggctcgggcattaccattccgagagtctgccatctaaagagtccagcagcaacctatactgcgaagaaaaagtaaaataatactcagaaacaagaaagttttacataaacgagacagagagagattcacaagcctaaagctttcactaatcaggaaaaaaacaaaagactaatctttttatcaaaaattgaaaagaccaacaaaaccttatctcgtgaatgccaaataaagttcaacagtttttaaacaacgtcaatctccaaatgcgcaggacataatcatatacatataggtattggcaacaaaaacgtgaaaatgagaactaatatcgcaaaacattagactctatatatatcaaaaacgtgaaacaatgtcgagagatataaacttaacgaatccaaattgaaatctagggtttcatagccttcaaaataggtcaaaatttgcagtaaattacaccaaatttcagacccagaaagaaaaattagggtaaggaaaaaaaaaaccacttcgaaatagaatcaataaaatctcaaaattaaagcaaagacgcgaacggaagcttcgcacggcgaaaccctagaaatggaagaacaagaaaaaacaaaaatcaattacttgtctaacgcagcgaaatcaaaatggatcgagttaagaacatgattttaaacgaagaatcaaatcgaagaacacgaaaacgagatttaaacaagttgaatcgtagattaaaaacagtgagaaatcgaaaaagggggaagaacagaaaaatcaagcgaagagtttacccagatggttaacggaggaaaataacaaggtagctttacacaaaggcggttttggccgcgaaacaagaagaaaaacaaactccggcgaggctctcttcgagagagaatggggagagagtaagcgaaagttaccaaagaatggtttttctaccaaggcatttcctgagagtggaacatacttttattctgatgatggtgggcttcgcttactgttaaacaccgatttgtattgggcttaacatagtgactaataaaggcccatgtactatatttttgttttgccggtggcccatttactatatcgttgtcgattttgttatatatgaatgataaaaaataaacagcaaccgagctaattgaaccagaagaccaaaccaagtttatctcgaaattagaccgaaacttgtttacaactcgattggtttaaaactcaagagaaattaaaccgatttttagtgtgacaatacattatacatgcatggatatgtgatctcaaatttgtgctttagttttaagatttgagagagagagttttcaacttttgacctttggctataactacaaaattatctttgtaaatgtagtttacagtatataatgatgaggtacataaccatattataaagttaatgaagtaaatgattatcactttttttatttgcaaaatcacttaattgggaagtgatttctcaaaaaaagaaaaaatgctatgttattaaataaatgatgaatcattacattttatgtttgttttatactatatatctaagtatatactcttaccaaaaaaaaaattagtatataatgatttatcttatatgcggtttagaattgtttgaagctagatcaatgtacgcttaatgcctaacactgtttcagagcgatatcgccatatggttgatcctgtttcaatacctgtaattcaaaaaacaacacatttcagctaagaggcaatgcagagatagaaaaataaaggaacaatccctattgaggaacaattaccaatgtcgaaaacattcgagcagctaatttccttgtctttccagccaatatcttgctcaaacttagatctccaatgctctacaatgttcaaagaatgttacacgttagtagagaaacaataagctctcaaagctagctacgtacatggtttttggaatctttatttaccttgttctctttggcaaagcatcagaaattatgggagctttcatcattttctcttgttgtcattataccggcgactactccaatggctccagcatgccaatgactttgcttgtgtcgtattggaacatgtcgaattctcgactttcttatcatttatatctttgctgattattttgatatgatcaaacgacgacgttttagtgatatgattactctcatgttgtgaattctgattttcacaatgtgttgggttggtaggatttatattctcttaaattaatgtatcaagttctacttaaatttgtagtatccctagagaagactttttttttgtagtctctttctctgagttcatctagtgtttgtcttctattggcttaaacaaatgattggtcaagtcaacatcaaatacttgttcaaacgatgacattatattctataagtaaatgtaaagtttttatttcttgaagaaaaacaaagacttgtttcttcttgttcttgatataatg

SEQ ID NO: 7719 - DNA, 3000 bp, Unknown
  misc_feature (1)..( 3000): cDNA_ID_1818641_gDNA_ID_1621158_Annot_ID_57074 3000 nt of promoter + ATG
aacgacctcatcgtcatcttttctctcatggaagatgaccacaatagttacacttgagtttatatcttgtatatgtccatatatgagatacccaatacattgctcccttggcttagccgtccatgcacactgtcaaaatttagcaaatcttagatagaaatgtcactaaaagtgtacaattcaattgtttattaatcggtcatgctcatgtctcatgcaacacgtcttctttctttggtctcttactaatcaaacttatttaattgaatagaatgtgatgaaatattgccaataccacatcatggtgtgtatcatggttatgatcgggctggacaggatttcgaactttggtccctaaatgacgtctttaacagttttatcaacaaaaaaattaggtcatgatttttgcttctattagaatattatttcaaaaaatataactcttttacagtctttcttttgttttccgtataaagcgaaatgaatgatcggataacaaaacttatcttgagagttaattatcttttctttctctctagctctcaatagtcaataccctcatactaactagtaataacgatatataaaatcgagaaattatattttagatattcatctcaattttttgaaccacctcaacgttaaccaattcatttcaagtttgttccggcataccactcattgtttaacttgttccaattcgttgaactattatgttcagcttaacacgttaatatcaaataattaacagtttatgtagttgtaaatgtaaattaagattttatacattttatatatctgacattgtttaagcaaacatttttaccaaaagtgtatagcatatattggatgttgtcaagtttttttagcctagttcgaaccatctaatttttaccatcgaatttatatatctaaagccgaatccagtgtttctcatggtcgggtagaactgaaatttcgactttaactgacatctctaatgtcggccttatctacaaaaaaaaaagtattgatgtttggttctactatatatataagtatcaattgtggcataacatttttactattatctttttattttttttaaatcataataacggatcagagaggaaatcttcttgtgggttgtcctttttctctctctcaatagtgtcatagttgggctaattgacatttcttacattggctttatctacaacgaattaagtagtgatatgtttgattccacgggtggaaaaaaaaaaacagacctgaaattcgaccataaatccgacctgaagtactccataaatccgatcgagtacgagtcttttcctttgtcaatatgtttgatctagagagtcttggtacaaaaagcaagaaaaacaagtgaagatggtgataaaaacaaggtcgactgaagccaaatcgatgttagcgttatagtgtcgtagggttaggaattaggattttggccttaatttaaaagtaaatagaaaagaaaacaggggaaaaatgtatcttcctagtattgaacttggcaacttacggtattaataattaataagactgtaacattagagccaatgtttaactttgccaacttatttgtacaatagtatttttatatacattttggatagttttgttgggtaattttgggtattgggtaaaacctgaaccaaacccgaaccgaactccaagatgatgctatagaatatctaggggtcatgtattcctaaacccgaaacccaaaataccagaaccgaaccaacaaatacccgaatgcctagtctatttggttctattatatagaggtgtttattgtgtgacataacattttcacttcttccctttcatcttctcaagttcgaaatgacaacttcgagaggaaagcttctcttgtgagtaatatcatctctatttctctctcaaagtattttatagtctttttgagtcacatagtttgtacatgatttgaaggatcttgggaaaatcagaagatttagggattctaagacctatccacgattgtttaggtttttctctttcttttcgtaattttttctttgggttttcgtaatgatatatttcagtagttcactggattgatgtgtttatcttttgttaaattggatcggttgaatatgaatgagttattaaatttagtttcacaattttgggtgatgagagaatctaggtcactcgctcagaaaatttagggattttattacctatgcacgatgttttagttattcttgttttttttctctctctctttagtcgcaataacttctttggttttatgaacatgatgtcatattaaatgtagaatctataacatgatttattgatctgatgcatcttagtggagttcgtggccaatgacaacagtaaaacctctataaattattaatattgggagtaagaaaattgattaatttaaagaggtattaatttatcgataaattaataaaattgtacaacttttgtaaactcttacaaaactttgatataaaatgtagttttttttgtaatttcaagtagaaaacaattcttaagtttaaaaaacaatacaaatttttttttaattttgtaaaatactagaattgtacactaagttaataaaaattgaagaaaaaaattactacagtcatattttacatatgatatttataatatttattagtacaattattaatttatactattgatgggaccatatatttaaataagattttcaaaaaaaattattattattttattaatttattgatttgtatttataactttcactatgaaataataattagggtttcaaagactaatgttttttgagctttcttgaagcatcttgcaacaaatttaggactttcaagttgagacaatttttagtctcatgggtcatggctttgtatatatttcatgtcttacgctccaaaaacaaacccaaatataagttaatttgatgatcgaaatctatatatatgtaggtcaaacgaagatgtcagtaacaatggg

SEQ ID NO: 7720 - DNA, 3000 bp, Unknown
  misc_feature (1)..( 3000): cDNA_ID_1818637_gDNA_ID_1621158_Annot_ID_57075 3000 nt of promoter + ATG
atagtgaggaagagaggaagagaaggaagatgaaagcgtttgggaaatcgcgtcctggaagtagcggtgcaggcggtagtagcagcatgaagaacatgccaccatctaaacgcagcaggcaccggtgaaaacaaaataatcaagagtttgagttctgcttgcttatcattttagccttttgttctgcttatcttttgtatcatataaaaaaactgctttagattattatctatctattctatgcccttgggaaaataatgaagtcttaggtttcttgtcgttcttaataaaatttgtttcgacttaaattggcagaaaataccattgtggcatcctctaacggttggtcttgtaaataattaaagggtatgccataaaccaaaaggtaaaaatgaatacttaagttattaaagaaatcttggattcaccattattattatgagatacgaagatgttcccactattagtggtggtgagtttcctgtgggacaagcaatagaaaggtttccaatcgacgatgtctaagagacaaaacacatcaaagctcacaagctcattcacccatctccctgctgatgctgatcttgtcttcatcacccatgcatcaacttcaacttaattagcttatatacacaactctctctggtatatataagaagagtaatatattttggcagttgtttctcttgcatgtggttctttggagagttcctttagagtcattgaacgtatgagtacaaaggatgttgtgacatggacatggatgatttatgcatatggaatgtatagcgaaggtgagaaagctgttgaaaacttttgttgatatcgaaaaatcaggtcttgttcccgatggtgttgtcttcattttcatcatcaatgcttgcagccactctggcttgccttgcttcattgaacacatcaagaaagaatcctggatgtagctggaggattgaaatcggtaaaaaacaatctccttctagtctctcgtcattctcatactctgttttatgtgtatgcatgcccaaatcctttgtattggcttaagatgaaaatggagtcttgatgtgtatttcatcggagatgcttaaggaaatcagggagataagctttagtatatagttttcactgtataaatatctgtttaacatgttttcttcccgttacatataaaacattccttaaaaaaaaaaaaaaaattgggaatcgcataacaaactggaaaaaaagaaataataaaaaggaaacaaaataataaaaagtaaatccttttagaaaaacaaattcctttatttcaacatctataaatactactagcaaaacaattaaaccaacaaaaaaagaaaagcaaaacaattagtccatacgaagaagaaagaaaccctaagaatgaaagaagacggaatttgcttggagtgcaagaggccaacagaaaccgtggttaactacaagaacggagatacaatctgcattgagtgtggccatgtcatagagaataacatcatcgatgacctagacggtgcttcgaccaaccctaatctcaaatccggccatctccccactatcatcttcaaacttagcggaaaatcttcctcccttgcctcaaaattgcgccgaacacagaatgaaatgatcaaaaacaagcaggaagaagatgtaatcaagatagcctatgcggaaatcgagaggatgaccgaagcgctagggttaactttcggtatcagtaatacggcgtgcaagattctttcgaaactggataaaaagaacttacgcggagggaagagtttgagagggctttgcgcggcctctgtatcaagggcatgtcgccaagtgaatataccaaaaacattgaaagagatctcggcagtagccaacgtggatatgaaggagataaacaaagcggtgaagcttcttggagattctttcggtactatttgaatgatatggaaattcaatcacatgtaaaagactacggaaattaatcaataaaactatatatatattttttttgcataacctcgaatcagtcacatacaaagacttttaaagttgaaacataaatctgaaatgtaagttttcataacagtactgaatcatttttttttttggacatgaatgtaaacagtactaaatcttaaagtcaacataagtttcacatattcaatgatcaaataaaaaggaaaacggaaagatagctcatcttacctttaccatcatccatatttgcttatcatttcatcgaatctaagatgtcttaagacggtggttcaatccaaagactcataagagggcaaaggtctttctgcttttcaaatcttgatggttttggaagcggcttacgcggatagtacctgcctttatcaaacgagtaggatacacatgatctcttgcaacgtaaaccataaaactttgggaagtacacactgttccacatgccacaaacattcaatctcgtctctgaggagtacttacttgcaaagattgtcaggccgtcaagagtagcaccactcatctcctcccaatccgaggagacaagtttatacagcaacggtatctcgctgctacatgtaaacatgagaaagagctctcctttctatcaaacaacaagagactccttctcctacagagacttcaatccatcgcaacaacattgtttctgtttcagtttcagttaaaggagattcaggcccaaaagaaaaagagaagcccacgaagcccatcctttactcatcgaaactctgcaacaatcaaagcagaggaacatcacgcgagacaccgccgtcgacaaacataaacgtgcacaatcattttgatgttcttggaagcagcagcatttcatgcaactaggacacctgtcattagctattatgtaatcctcctctttatatagttctctgcttgtaatcgaattcactaaggaagaaatacacaattattttctctctgaagcttttgcttctactttcatggtatcagagcttaggactttgttcctaagccatg

SEQ ID NO: 7721 - DNA, 3000 bp, Unknown
  misc_feature (1)..( 3000): cDNA_ID_3051223_gDNA_ID_1621158_Annot_ID_173622 3000 nt of promoter + ATG
agttctctgcttgtaatcgaattcactaaggaagaaatacacaattattttctctctgaagcttttgcttctactttcactttctgctcagccaagtaaattctcttcctaagactaaaccattcttcattgtacatatgaatataagggcatatatgttcattccatgcttgatgactcattgtgcgggaagctagatcaaagtcaactaaaacacctcccgagctgaagcaatagaagtgaccattggcatagacaagattgctatgcatgtacggctcaaatccatgagagcaagaaaaatcttgagtaatccactcagttgctccaggaaagcaaatgcttatacgaatgataaatctcgtaaaaggtcttaacgctattaccgcacaagtacctgatgtaggtaccgaagagaaagcaacagcctgaaaggacaactcacactttggcaagtttataagctccctagtatacgggttgaggaagaacatgtccactaaactggatcttcgcataagcaaccatccgtctttcgagtaacaaacatcggttccaactaactcgggtaaattcagtgtgtaactcttccttcccaatggatcgaagagaatagtcacgccgtaatgtctcggaaagctgataacccatggatgcttctccacaacccgaactgattcagcggctttacgccatgctcggcagaccgcggatgcacgaatgttatcttttaaaccaagataagacattattatttccaaaaggcttgatgtaaggtcagcaatagtaagaacttcttcttcagcccattgttactaacatcttcgtttgaccttcataattaaagatttcgatcattaaattaactgaaataaatatatattgcttttggagccgtaagacatgaaataccacaaaaccatgagattgaaaattgtctcaaaccaagatgctacaagaaagccgagaaaacaataaaagttgtcccaaactcatcttagaaaccctaattgtttcatagtggaagttataattatttacgggaataattggccacgaactccacgaagatgcatcagatcaataaatcatgctatagattctacatttaatatggcatcttgttcataaaaccaaaaacctttgatagagatgggatagagagtattgagagagagatagagatgggataactcaccaaatgagctttcctctctgagttgccatttcgatttagagaagatgaaaggggagaattagatatcttatgtaacaatttgacacctctaaataaaaccaaatacggttggtcattcggatacttgttcgggtttggttctgatattttagattttcgggtatttggtttagagatccaggtagaggtgtaaaacgggccggtccgcaatgggtatttttttgttggactactaacaaaaaaatctatgtcaaggcccatctcatgggcttaacttttatattttaaaaataaacaaaataataaaataaatttaaaaattttaaattaataattttagatttaatataatctttaagatttacttttaaaaaaaaatatcattctataaattaaattgctttatattatcacatattattgtttcataattaagtaaaagatatttatttatctatattatatatttatttttgttaaacatttgtatcctgcggccgctccgccaatctatggacaaatccgctaaaacccacaatctatttgggcttgcccgttaggctttctattttatggacataaagcgatgtccaatcccaccctgccgtggtacaatataggctaatctcaaaggccgagttacataatactttgtttatttatatgtattaaaggattttttttgttacaaaataagtgttgttttcaactttagttaaaaaaagaaaaatagttaatatttcttgaccaattatgtttaccgtatatttttttattggttgaattggttataattaataaaatctttatataaaaagaggtgagttaaatgagatttttgtgattttttaattttttgtaaaatcttaaactacaactataaattaaaacatatggagtattatattaaaaactgctttagattatcatcaattatatgccctaggaaaataatgtcccattgaggattaggatctagtcgttcctgaaaaacacattgctgacttaatattggcagaaaataccattttgaaattatgagtgtgacacataaacccttcaattagctagaaactttatcgtcctgtatggaaaaatagcccatttagttgaggacatgactaacaaaattcatgtctcaatcagactaatcgatcattaactttatagattgcgcatgacggaagcaaaagaaacaaacaccttctcaaagtttgcaattttagcctcgtgaaactttatactctttcaaacgcaaactccctttttaaaagtgtacattcctaaaatagaatatctgcttttatgaatttttgcctccaataaacttgataattaattgatatctagccggcagctaaatctaaaatttctcaagacatcaatccaatttcatccttagttttccgggtacacattttttccacacaatctacgagagaccgctatttaatcttacatcaaaattatattattgcactagttaacaactgggatagtttaaagcaatggccagtgacaactgacttaatcctacctctttcactcctttttaagaaactttacaaccatttctccggtcattaagtcttgctagctacaacataattagacatttaacttttaaagatatcaatccatccttccttcaatatacctagtattctttccaattgttgtttgtgtaatgaggtatatttttttgtaaacatcattatcgacttaaataatattgcatagtgaatgtaaatagtgagaaaatttacgacaacaacttaacaaaaccaaaatgaatgtaaatg

SEQ ID NO: 7722 - DNA, 3000 bp, Unknown; identical to SEQ ID NO: 7717
  misc_feature (1)..( 3000): cDNA_ID_3051230_gDNA_ID_1621158_Annot_ID_173615 3000 nt of promoter + ATG

SEQ ID NO: 7723 - DNA, 3000 bp, Unknown; identical to SEQ ID NO: 7715
  misc_feature (1)..( 3000): cDNA_ID_2144327_gDNA_ID_1621158_Annot_ID_173609 3000 nt of promoter + ATG

SEQ ID NO: 7724 - DNA, 998 bp, Unknown
  misc_feature (1)..( 998): cDNA_ID_1818725_gDNA_ID_1621159_Annot_ID_57080 3000 nt of promoter + ATG
aagcttgttcagcggtttgtcaatgataaagacaatacactatcaaaacctgtgaaggtaagaaagagtttccgttatataggcgtatatgttatgaatattgttagattcatggcaatggttaataaccacataccaccatatagtttgcagctgggtatcaacgtagaggtgcggaggagacgaaaggaaagattcggaaagacgcttcagatgttctagttcaatgtccgttgctggaccgcattaaatgctttgaaactgtggcagctggagtgaaagacattgtaccagattcagttgtggatctcaaatctccagaggtagtgtgtatagatagaaaataattctatcttcgttgcatcatcgcgtttataaagtctgaaagattggagtaaaaatgtgcagttatgtgttctggtggaactgttaccgctctctagaatatcaagtggctcctttgtagctgctgtttcagtgcttccacatagactcgttagcacaaagccgaaactctgcatcaagcctctagtccctgaatccaaacacaaaaagggaccaaactgacaggtgcaaaggctgatcgctgcattcgattttcgagagccaaagatatcaatagaagttgtaatctctctgtttttgtttagatatgtcttttgctttcagtatctctaatggagttaacaacaatgtctgacctatgttattcaagagaacaaagataaacccatctccaccgctttttccctatgttcacaatgttacagtttgtaaggctaagctatggcaacttggaaatcaatcggttcaattcggtttttaaattaaaccaatcgatttataaacaaatgtcggtttaagcaaggttcggtttggtccacctctggtacgtggttttccaaatcgcgctctgaaacagtgttggcttcctggttccatcttcgcgacgccaagagcctgagattatcccagtggaaagaagagaaaccctaatg

SEQ ID NO: 7725 - DNA, 3000 bp, Unknown
  misc_feature (1)..( 3000): cDNA_ID_1818721_gDNA_ID_1621159_Annot_ID_57081 3000 nt of promoter + ATG
tatgtgaatgtggccgaggagatgccaaattttcaagaatctcctctttctacaacgctatttacaaacaaaagcaaacactagttttacatttacagtccatacttatcgactcgtaaaaaacaaaacaagaaaaatacaaaattatcatcttattcttaccttgtgtttgagttccctaattccaccaatactcctcactttaacgttatggaatccgtagaagagaaggaaaatgcaatcggttcaaccggcagaaaagaccggaccagaatgttgagtagtggaaacaatgggtccgacgattagagaagcaaacaaaaaccctcttcgacaaaatttaattcaacaaatactgtcatccatatcttttcttttcatgtacgtttgattatacacgtaaaagacttttgcgtggtgtaatgagatggaacacgtggcaagacagcatgcactcgcacatgtacttagtcagacagatttcgttgtctttgaactgtgctcgtgttttctcgcatttccgcacgtggtctcaagtcaaccattatccacttcaactcctacgattttgtttctatatcactacctccatacatataaccaaattttgaatgttactattagatcgtgttgtgaatcttgcattcaagcttcttggacttgcctctaacaattcactcttcatggattcctcccgtcgagttccattttcacgacatgatgataaaggaaaacatgttgacagataaactgaagagtaaatatatagttatattttggttttccaaagaaaataaaaattagtcaaatttttgtttttttctttgatgtgcagtgttagaatttcttccttccaaataacttaactcggaatattattgagaggctatagacaagcaaactagtgtcggccttccttgatgtttaaggtcccaatctagagcaatgaaaaacaagacaacttttttgagaaaaattcaatctgcctttataaatcgtcttttttggttacttggatctgttacgtttctacaatgaaccaaattaaacaactatggtgttttcattaagcaaactaaacaactacagctatataagtggagatatggaaaggggtcatgttcctacattccagaacaaaggatcatatctttattactgtgaaagaaatgacaattttttaaataaataaaatgtaatttcttcaattttgttttttgtaattttacaatgagtgcaacattttagtaaatgtttttatgctattatacaaatcaaacgagaatattaaaatgacatagtcacgaaatcaaatttattgagagtaagcttgataaatcaaatttagaactaaccaaatctttgactttcttatttgctctcacattcctgaacagttagatcaatcgtactctccaacttttctacgcacaaaatttaaaaatttgatagtttttcttttcattaaataaaagacgagaaacggttatatttgcctgagtagaaaccgccgataacaacaaagtggaaaatatggctagtttgtatttttaagtaatttctcgatttaatttacttaggacaaaaatgtatttatagagaaatcgtgcttttatttatttattgagaagattcttttttgttgttttgtaaatatttatttaacatttttattggtacagtgacttatgttttacaatataaaggatttataaaaataaaaattatttttctttgtctcttaaatatggatatacccaaatatcattttccataaaaattcggtgttatccaaatctcaaaaccctatttttcatagatgtttttgtttctcttataaattcatcactgaatctctcatgctcaccattaattctcagcaataaaaacaaagaatgaacgattcaatgaaagctccaaaattctttaaaaaccagctaaaactagcggaagcacattatcaaagaggtaatctaaaaggagccattgaaatcgtgaatgacttaacgtttggtcacccaaacacatcttcaaaccaccatgagatctcacagattctcctcgcctatcaaatcaacttgactagccaaaaagccagtttcacacactacgatatcttgagaatctcaaatccgttctgtagccatcagatgattcaaagaaagtacagagacatcttggttaagctctaccccgacacaaataaatctattgccgccaaatcagctttcgagattattaattatgcgtggaagatcttgtccgatcctgaaaaacgaaaagattacaatatcaaaaaaaggtttaagtgaagatgattcatgtctccagaagatcatgaaccacatcaaacagtgaggcaagggtttcatgtctttcttgggaattggaatacaaaacctatttgttcttcttctttttttaggttaattttatgattttattttattttatctaggtattaattccaagtaaacttgtgacagtttgaaagtgctaatggatatttttacaaactttttttgaatttatttaaatgcaaaatttacagttttgctgccataataattatgatttgataagaaaagttacgattctagtagagtttgcttttcgttggaataacgtgattatatttattttattttaatacaagataattacatataatgatataatatgttgcgaaaaaagtctctgattcttgggagaaaagattcgaaaagaaggaaggatccaacaaaatccgaaattattattaactgaaaaaacaaaaattttgcgccagcgtggcaatacttctctgtcaggaggaaggatccaacaaccaataaaactccgacccggatccgaacccgaaagcaccagacgactcgtcctccacgatcccaatttctccaatttcaattttgccaaagagcgagagagaaggaagaagatccagacgaagtggtttgccttcagggaacgagagagagaaagagattttaacaaacgatg

SEQ ID NO: 7726 - DNA, 998 bp, Unknown; identical to SEQ ID NO: 7724
  misc_feature (1)..( 998): cDNA_ID_2138588_gDNA_ID_1621159_Annot_ID_173636 3000 nt of promoter + ATG

SEQ ID NO: 7727 - DNA, 3000 bp, Unknown
  misc_feature (1)..( 3000): cDNA_ID_3051254_gDNA_ID_1621159_Annot_ID_173644 3000 nt of promoter + ATG
acaagagcagctagaaacacgacatcaaagctctttaagctctctgtcacgtccattatatcaacggtgtggaagaacatgcgttgagagatgtctggatcagaggaaaccagaagagaagcgagtgagttcgctgatgggtcgatgtcaaagttgtgaaagattgtgtctttgagatggaatgaagcaagaacgatggaagtgagaggaagaggaccagatccaatgaaagccacactctttgggacaaagccatttaggttttgttcgaggaggtcgaactcgagctttccgagtttcaaatagttgttgtaataagggaaaatgtttaaatgatgaagtgggttgtcttggtaagaggtcaagatcgaagagaaatggttttctaagtgaccttcggctagaccacaaatcttgatgagattaagtcgaatctcttggactctgtcacacatcttggtgacatcgatgttagggtttggtggtatgcatgtggaaacgagctgcttgaagagaatgttgacatcttcggatggttttagactctcaagctttgagatcttttcgtagagatcgcatattgtttgcaccaattgttcgtcttggcaacccatgtcgacactatgaggttattgatttttctctttctctttggagaataatcgtgtgttctcgggtggtgtgaactgtttggactggagggatggatatttattggcgtggggttggggatctacatcaactagaaaaagaatctaattattttaacatttcattattcaaatatactatataacgtacacttgcgtttttgtttctttttttgtttaactaattaagaatagatccttatatttaggttttgaagtaaaagatttatttaagtcaagatattagtttaatgtttacagtattggtttagtttctatgatttctgatttaggtttaaggttttagtttaggtttagagtgtatgttttcgattatagaaatttcattcctaattgctataaaatttacaatcattttcaaaattatcctggttatgaaaaatgacttgtgtgaacatggattagatccaaaaatgttataaattattggatatattgtattacactaagcaagatgtacagtaattgatggatgatatgaaacgtataatctccattaattgatggattacatgaaagctaaatgagataatttgtttgttttattccattcttctgtatataaaaaatgagataaggtttgaatgtgtccatgtagtacttcttccaactcgtatgagacaactacacaaaagtttgatgccttatcatttttctgtacgtagcatatgatgtaaacacataattacacagaaataaagagtccattactatattatggggcagttcaaaatatatagccaagagcttttagtcttttagaaagaaatgtgcatgacttgcgacaacacaaaaagtgtaactaaccacagtaattaaaaatatatatatggagtaactactaacctatataacaagttgcttgaccgaaaaacatacgtcctttgtctgtttccaaacatcaactttggaattaaattgtaagacttcctcacaaatatcaaactgagttttcaatattttttgaaaagaatatgcgaatttcagaagaagataatctcttcatggcgtgtgccttccacaaatttcttacggctctccttgttttcttttgatatgcttcatgaatctctcaaattcttcacgcaatcatatatattttcatatctagaaagaataataatttttttttttttatctcaatatagcttttaggaattctaggagagtagcatatatgggatatatacgttgacaaaaaaaacacgtatatgaaattggaatccatgtgagacgaatataaaagattggaagaagacacaaataataagaggtacttaaagatacacacacacacaacaacttgaaaggatcgatattcttttatgtaaatgacgcatcatatttatttcttatgcgaaaaaacatattcgaaacaaagaaaaaagaaaacatgtttgatctatgcatttttgcctcttctattaactccacggccaacttgattaattatatatgccaacaaaattcatacaacactattaatattcgtttgtttttctccttctcaatttcaacattaatttttaaagttttatgtttattttttgtggttgtcagtcaatggattccataatgtatatattattttcgtagagatgctaagatttttttttctcttctttttcttcctgtataaataagattgcgtgaagaacttgcggaatttcatgagtgagacaagaaaacaaggagagccataagaagtgtgtggaaggcacacgccaaaaaagatattatattctcagagaaatggacatattcttaatatttccaaaaattgaagtttcagtttgataattgtacgaaaacttacaaaaatttgtcaatgttaatgttttgaaacggatgaaagaaagtatatttagtcaagtaacctgttatagtcatgttcacttcactatcaactctatcttcttattggattgcattgtccatctcccagtttattcttcttctttttcaaaattaatttatttcctcatgttacattaacatctatctattgatttttttttttttgtaatgttaaatttatttatcaattaaagtaacaaaatatattactgaagatttaaatgattgttgccatttgccaaagctaaagagataggtctgttaaccaaaaaaaaaacattttaatgggccacatgtgtggaaaagcccatacactttaaaacaaaacgtctccccggtttgattcaatcttctctcttggtttttctggttcggtaacttaccccaaagtctagtccggtttaatctcccaaatcaattttattgaaaagaacatgtcatcgttctgagtttgggttttcgagctctaata

SEQ ID NO: 7728 - DNA, 3000 bp, Unknown
  misc_feature (1)..( 3000): cDNA_ID_2138612_gDNA_ID_1621159_Annot_ID_173658 3000 nt of promoter + ATG
cttggcaatactacgaatagagaaaccagagacaagtattggtaccttccagagaccgtcgttgaggtaatgcatgttgtcaactcctattcctttgttaatgctctttctgtgaacatacacaagaaaagtttagcgatgcgaaagaaattttatgagcaaacaggggaaacacggccaaaattgatcctggtgcaggtatgtgtatctaagggaagaaggaatatcaataaagtgacaaagatagggttacttggagaggcctggagccaagagactgtattttggctaagatacgaaagtatatcaaagcacatgtttgtattttcaaataaattccagcgaaaaattgacttacatgtcctttgctgacattttggtgaagcctattgctaaggcatgttgctttccttctgcatatatggcctaaacaaatacagattcatggtttaagatcagcatatacaaacaaaaatgcaacccagggaaatactgtttttattcataccactggcctttcagcctcgacttcttgatccagaacgcctcccggggatgtaagaccaggacacattatgtttgcaccagacagaacaaactttatggcacctctatcaacttgaaacctcttcattatatttgggtctgcaaaactccaaacattcagctgccaaatttttgacattcgtggctaattgaaaaaactccaagtttctttctatgtatcattcaagtatgtaaaagttagctgaacgtggtgttttcaagaatattttatactcttctggtaacagccaatgccaaaaccttctcactatgataagggtcagctaacccggaaaacataaaacaaaatatactaaacaaaaatcctggctaaccaatcatacgtggaccttttatatagttcactcgcatgaaaaaagccaaaggaacaacaacttacaggaaccaaaccccaggaagttctaaataactcagagaaaagtgtcggacatactattcaggtatatgcagtatttgaaccaggtaagttctactgcagaccacagtaagactaacaggtgtgaagaagagtgattgtatgaataaaacacccagatatgttatgttttgataacaagaccatatagcatggatggtgtgaaggaaaagtgatattacattgatgaagaagccgcagtgttggcatgtatggcccgtcacggatacagaagaagagggggacattgttgacaacaactagggtcagatggtttgggctgcacgagaaatatagtcaggaatactgtaagacatagatagtgggtaaaagaaaattcagaaaacaaaacaatgaatatgagtttgttaatttacagaccacttcactacgataagaggaatctttttgggaagtagatcctccatcactgattcaagtcccgggtactgcaacattaacataaacatatttatatctgacaaacttcacgaaatcataaaagtttaagaaggggaaaaagacaaatgaaacaacagacatacctcatcttggatactctggcggatcctacgttgaacagatgccttcacttggttttgtgatgaaatctcctccaaacaaaacctaaataaaaagtagtgaacataaataacaccttcatagacataatggtatatcaaatagatctaaagttgatagcagtagggaaaaataaactttatacaagattcactatgaatgtataagcatgtttcaggagatggataaacacaaactccatgatagtagagagtttagactggtcaaatcaagacacaaactttcctctatgacccacgactctttgtacagatttgataaatcaaatagtgacactatcaatatagaaaccaaaactttacaatagcaagatgttagcttttgagaactcaaaaccttctactttgaagaaaatataacaaccaatatgcccataccaaggctactctaagcaatcaaattaacaatgtggtcgacaacaagtagaagggagtgagttctcgatagttattagagtaagtggatactaaataaagagaccatcacattctttatcaactagtataaacaatgccgagatgttgaaaccactaattcttagattctacaatccgggtatgaaaaacagtttctatctaaataaaaaagtagagaaagaatctagaaagagacaaagatgcttacttcttaaacatgttcgaggtttattgaaaatgatcaccagcttctaactatggtatcttcttccctgcaagcgaacagtggaagatgattgataacggaaatatcggaacatcactcaacaaaccaaaaatttggacatcatatcgcaacaaattcaataggaaaaatactgaaattccaaaacagaaaaaccaaacggaacagagcaggaactcacggactgagagagaccgtggacggtgtcacggcggaaaatggtcttggacggagttactaatcggcgaattgagatttgagaggtggtagtagaggaaccgagagaatgtttctctcaaaaaaatccccaagtgtttccgatctagtgtctcttttgtccaaaaacgacagtgtttaggaaacctaggagaatgaatgacccgatggtccgaatccgattcgaaattggttcgaattgtaataactaacatacaatattccggtttgaatgataagaaaaaacacattcgatccggttagaacaatatattaacaggcccattaaaacatatgggccgatcttgatcaactgggctattcatcgttgatacatgcggccgcacaggattaaaatccagttccgttttataaaaggatactagtttccaaacgaacggtggttgtctcctttccagaacaatctaacgctttctcgaacatcttcttcttcttctttctcgaaattatttttccagtaatcaatttcttctcttctagatttttacaggaactaattttctgctctgaggtatcag

SEQ ID NO: 7729 - DNA, 3000 bp, Unknown
  misc_feature (1)..( 3000): cDNA_ID_3051250_gDNA_ID_1621159_Annot_ID_173646 3000 nt of promoter + ATG
agccaagccaaacgaatgatgatgatatatataacatcaacggtttttgaagagtaggtgcaaattctttttgtgtatcatcatgtaactctttgactctcagtttaaagtcaataaaatatatcgctgcctaattatatcaatgagcagttgaaatcaattcttgctagatttgtgttcaaacaaactatgttcttgttctcttcacgtagaatcacctctctacgctcttacaccataatcaaacattcaagttgttattcgactttggtttctgatggtaacatcttctcgattcaacactttcaatctcttatgcaaaaatatgaatcaaaccttaaaatcatccaccagctccattcacacttcaccacttctgggtttcttctccttcatcagaagcaaaactctgggaaactttttctattcaatcctctgcttcgatgctattctcttggcgaaacccctcttcatgcttacttcctctacgaccaactccaacgactccatttcttgtctgatcacaataagagtctgcctccttttgatagtttcacttacctctttctcctgaaagcgagttcgaatccgcggttcccatctttactactgggaattggactccacgggttgactctaaaactgggttttgaatctcatgtctacgtgcagacagctttggttggtatgtatcttgttggtggaaacatgattgatgctcacaaagtgtttgatgaaatgcctgagagaaatccggtaacttggaatgtgatgatcactggccttactaatttgggagatttcgaaaaagctctttgctttttggagaagatgccgaatcggacggtagtgtcttggaccactatcattgatgggtatgcacgagtagataaacccaaggaagctatactcttgttttcaagaatggttgcttgcgacgcaataaagcccaacgagataaccattctcgccattctcccagctgtttggaacttgggagacttaaagatgtgcggatcagttcatgcttatgttgggaaaagagggtttgttccatgtgatatccgtgtgactaactctctcatcgacgcttatgcaaaatgtgggtgtattcaaagcgcgttcaagtttttcatagagattccaaacggaaggaagaatcttgtatcgtggacaacgatgatctcggcgtttgcaattcacggaatgggaaaagaagcggtcagtatgtttaaagacatggaaagattaggattgaagccgaacagagtgaccatgatcagtgttttgaacgcttgcagccatggaggtttagcagaagaagagtttctagagtttttcaacacgatggtaaacgagtacaagatcacgccggatgtgaagcactatggatgtctagtagatatgttgagaagaaaaggaagattagaagaagcagagaagattgctttggagattccaatagaagaaaaagctgtggtttggagaatgctgcttggagcttgtagcgtttatgatgatgctgaattggctgagagggttactagaaagctaatggagctagagagaagccatggaggagactatgtgcttatgtccaacatcttttgtggtactggaagatttttagatgcgcagagatttcggaaacagatggatgttagaggagtagctaaacttccaggacattcacaagtaacatagcggagcatgtatatatttatgactccaatctttattgttttgatgataaacttcagaatttttgggagctctgttctgatcctcaatgttttgatcataaactcccaaaaggtgttttctattctgaatggttttattggattataaagaaacgcaaacctaatcaagaagaccaagttcataattcattgtcataataacttcacaagaaaaaaggaaaacatgagagcattgctgggtgcaagtttgatagataataaaagaaaaagcgatgagaatctgcaacaagggtttttgatgattcctcttctgaagacccaagcttatgaaatcttgttcatagaccactgggggttgcatgtgtttctgtgctgcgcttggattctcctgaagatgggtcagcaccgaatctgtgaggatgatctgtttcttgcatccccttttcctaaaccctaaatcctaaactcccaatcttcaatgagttttgatcataaactcctaaagtttggtgagctctctaatgaagtctcagttagctgagattacagtgacaaagatgtgtaaaatacaatggagctcaaatcattcaaagagattaaaaaagactaaatggatcaatgagtaacaagaacatgcataaaaatagttcattttttgaaaaaactttgcttcaatgggtgtcattatcaaatttgaatccaagtcagattttgagtagcttttacgctaatcttcttcacacaaaaaaaccatcaacacaaaaagatttataatttaaaattttatcggcccaaaatacacacatcaatcttcctctcggcccacgcttttagaatttttgtagatttaaaaattcagttggaatctaacggctgagatcacgtttaatccaacaaaccaagctatatatttactaaaacacccgagagatctgcttcttttgtttactctactctccacgagaagcacacttgttttttgtttatatcaccgcaccaaccgctaatatctttacacgtgtcaaatcttttgcttaaggctaattatgcacagccttctttctcccgttttatccaatactataacgacatgtcattctcaatgacaaatgtatctgacgtgtcggttacctattggattacgtggctgcagatttacacgacgtagcctaaaataaaatccatgagagcaaagctcacttgctagctcctctcctcgcggtatatataagctccaggtcttgtacatcttcatcatctgatctcggggaagctccgatctgagttttttttagca

SEQ ID NO: 7730 - DNA, 3000 bp, Unknown
  misc_feature (1)..( 3000): cDNA_ID_3051249_gDNA_ID_1621159_Annot_ID_173659 3000 nt of promoter + ATG
gtttctctcaaaaaaatccccaagtgtttccgatctagtgtctcttttgtccaaaaacgacagtgtttaggaaacctaggagaatgaatgacccgatggtccgaatccgattcgaaattggttcgaattgtaataactaacatacaatattccggtttgaatgataagaaaaaacacattcgatccggttagaacaatatattaacaggcccattaaaacatatgggccgatcttgatcaactgggctattcatcgttgatacatgcggccgcacaggattaaaatccagttccgttttataaaaggatactagtttccaaacgaacggtggttgtctcctttccagaacaatctaacgctttctcgaacatcttcttcttcttctttctcgaaattatttttccagtaatcaatttcttctcttctagatttttacaggaactaattttctgctctgaggtatcagatgagtagccgatggaatcgtacgatctacgttgggaatttgcctggagatattcgcaagtgtgaggttgaagatctcttctacaaggtttgaaaattcctcttttctctcgataaaaattgaattcattatgacttgtttgggttcataaatttgcaattctgtcttgctgagacaatttaaatcgactcttatgtatatttgtttcagtatggaccaattgtggacattgatttgaagattccaccgagacctcctggttatgcctttgtcgaggtatattgatcaagtacaaatttgtttttttcttcttcttgtaatagtataggctaatgactaagatagtttgttattggtggcagtttgaagatcctcgtgatgcagacgatgcaatttatggacgtgatggttatgattttgatgggtgtcgacttcgggttagtaaacgcatgatgaaagctagcttaattttctgtaatttcttgtaaaggtgttatctttgtgtgatgtttttaggttgagattgcacatggtggtcgtagattttcaccatcagttgataggtacagcagcagctacagtgcgagccgtgcaccttcaagacgctctgactaccgcggtttgtagagtcttctcgattgtgttatttggtgttgtgtaaaattttatatttgaaaactcatttttactacctaaacatgtagtgcttgtgaccggattaccgccttctgcttcgtggcaggaccttaaggtaagggacactatatagtctttttctctgaatgttggttctctatatcatgttttggatttatctcttttctgaaatgatgttatttgctatttacgggtgattaggatcacatgcgcaaagctggagatgtctgcttctctgaagttttccctgaccgtaaaggtgagttgacattcgatagtttggataagcttttgattgatgtgttagtaaattagtctttgtgaaggagaataggtgttaagcatctgaactgctaaactcacattcagtatttctttgtaggcatgtctggggttgtggattatagcaactatgatgatatgaagtacgcagtaagttttatatctttgcaacgcaaatgttcctggacttatgccttagactgcttttgtttcatagtataccgagctgaatttatcttcctggaggccagtgttggatctttgatgttcccttaaaatttttgatgtgacagataaggaaacttgatgccactgaatttcgaaatgctttctctagtgcttatatacgggtatgttgtattgctttctttgattttgttaagcataagtggatatggagtcatctctgaatttactgttcaggtgagggaatatgagtcgaggagtgtgagtcgaagcccagatgattctaaaagctatagaagcaggagtcggagccgtggtccaagctgtagctatagtagcaagagcaggaggtctttttttttttttttttttcataaacctaagacatataagggatttttattgtaacttatttatgaaattaactgacttctaaatgcaatgcagtgtgtcacctgctagatccatttccccgcgttcacggccccttagtcgttctcgctcgctatacagctctgtctcaaggtatgagtgttagatttgtatcattattatatatgtagttaccccttcatggatcacttgttcttgcatagtgaactccttactagctttattacttacaactaagcaccttttgttgcttccgtacacagttgaatttgtttgagtcttttttccctcatagtggactagtctattgtcacttgattttcttcctttgttgatgttttctatgtcatgcaaactccaatatgggtaaaggttacctccttgtttgggattaccagagttccttttcatttcttacacgtgaatgtgtttgttttttatgttttgagttcttgacagagatgctcccatcatatttagtccttttcctttctctttgtgtcgttctcttctggatgtttccttctgataaagctttacttcttaacttttttccagcgacggtgaatttattacgtatcaatcttcattatccgacttataatttaaagaacacttagctagatgtttcactttttgaaaatttatttctatcggaagggggaagatggatttctgaggcatgtcctcgatcatttaccgtgattacaattgtattgcgttgtttgttttctagatctggctcactgctacgagctggggattggatctagatgggtcatctagatggattcttggactggatttacaaagctggattagcatgaacttgaacttctgtttttacggtctggtctggtctggtactccgcgcgtatcagctgtaggatctgatcgcaaagttttggactatgattactctgattcctcaatatatttatctttttgacaatagtggattctgtgttgagttcttttctaggacagcatttaagctcccgggactagatgggag

SEQ ID NO: 7731 - DNA, 3000 bp, Unknown; identical to SEQ ID NO: 7725
  misc_feature (1)..( 3000): cDNA_ID_1818721_gDNA_ID_1621159_Annot_ID_173637 3000 nt of promoter + ATG

SEQ ID NO: 7732 - DNA, 3000 bp, Unknown; identical to SEQ ID NO: 7727
  misc_feature (1)..( 3000): cDNA_ID_1818714_gDNA_ID_1621159_Annot_ID_57085 3000 nt of promoter + ATG

SEQ ID NO: 7733 - DNA, 3000 bp, Unknown; identical to SEQ ID NO: 7729
  misc_feature (1)..( 3000): cDNA_ID_1818706_gDNA_ID_1621159_Annot_ID_57087 3000 nt of promoter + ATG

SEQ ID NO: 7734 - DNA, 3000 bp, Unknown
  misc_feature (1)..( 3000): cDNA_ID_1818702_gDNA_ID_1621159_Annot_ID_57089 3000 nt of promoter + ATG
taagggttcatttaaactcaaatgctgaagtaatcctttacttccaaaaggtttattggcgtctctatgtttagtggtttaacctattaaatagaaacatgtttgtaactaacctggtttttcttttatcttctctatcattaaatccatggtcacaccagtttgacacatttagtaatctatatcttttgttcacctttatttacacttttatatcatgttcatttggatgtaactgtagaactcgcaactttttgttttttatgcttgcattaacttacatgaaaatttagctctcttagacataataataaacaattagtgtgcctaaaataaactgattaccgcagacttcaaggatgacccagagctctacgtcttccccaagctgaaatatgttggactcgaattgtggcaggtaaataaatctttgtcactttgaatgaccttcgaagatatgctttattcccatgactctcatctaatacatgttactcttccaggtgaaatcaggatcattgttcgacaatgtcttgatctgcgatgacccagactatgccaagaagttggcagatgaaacatggggaaagctcaaggatgtaggtgtttaaaatacccaatttcataacacagtttttttttttttgtttctggttactgatcagaatatccaatctaatatcacattgcaggcggagaaagcagctttcgatgaggctgagaagaagaatgaggaagaggtaaatatctctcctaattatttagcttaattcatttgaatctctctaaaacaagtagtttggacttttgtggagtttctactgccaattatgtaattgttgtaaccaagttgggaatagataatctaagacggcattctcctttttctgtgttgatacaggaatccaaggacgcacctgcggaatctgatgtaagcacttgtgaaggatcaaattttttagagtcttgtttgtttctgtcaaggtcctaatattatatgtgatataaattccaggctgaagacgaaccagaggatgatgaaggaggagatgattccgattctgaatctaaggccgaggagaccaaatcagtagatagcgaggaaacctctgagaaagacgccaccgctcatgtatgctaccacaatatcacttggagaaatttcactcatccataattttgttgttttccttgagttgtggttaaaactgcgtgatttggttttgcaggatgagctataggtgaaaggttgaagatttgaagaccaaagttttcagtctctttattgttttatcgttttcttttgaagtattttagcatctagtttgtcggagatagaaacaagttttagcaaaactaaaagggggatacaatgtctgtcagatgctcattttagactttaaaaaaccatgaagaagttttgcagttgcttctctttctctactcttgtttctctgctaagccaatgtccgccaaaatcggattctggtgtattcgttcactgctccccaccctttgagaatttgttgttagtctcttgtcagtcaatacagaccaccaagtccataatccaacagtccaacgtccctgcaagttgattgatactagagtagtagtaatgtagaatgtctttcactttccaaacaatttccacattgtctatacacttatactgggttcacttccattgtgaagacagatgttgagataacaaaaattatatagagataattgtaccccaaccacagatgcttagaacgctagagaacgaatgcagtgcaatctttgttttaccttaaccttagacagcaatattttaattcatgatgtcattctcaaaagatgaagtcacaatctttatacaaaacagcgtcctagcatattgagatggtatttaagcccagaaaaagctgattgagaaccaaaaaaagaaaaacaattacgcaggccctattaagtaatgggcttggttttttggtaaagataatatatttagattatttcttttatttctattggtcttcgtaccttcacgcggatcagtgttagaaaagaatgaaatctgtccgtagaattgtattaatctacggttgctgtgatttcacgcggatcgtgatagaaacctcttatatccgttgattaaaaaccaatgaacgatccagatctaatcccgctgaaaaagaaaagcgaaatattttccctcccacttcttgtaatttccagacgataaatatccccttcctcaatcgaaacaaactatccagatctcaactttctctcatcttcaaattaaaatcaaacagtttcttaataacattttacttcatggctcgtaccaagcagacggctaggaaatcaaccggaggaaaggctccaaggaagcagctggcgacaaaagcggcgaggaaatctgctccggccaccggaggagtgaagaagccacacagattcagacccggaactgttgctttaagagaaatcaggaagtaccagaagagcactgagcttcttatccgtaaactccctttccagaggcttgtcagagagatcgctcaggacttcaaaaccgatcttcgtttccagagcagtgccgtcgccgctcttcaggaagctgctgaagcttacctcgtcggactcttcgaagacaccaatctctgcgccattcacgccaagagggtcacgatcatgcccaaggacatccagctcgcgagaagaatcagaggagaacgagcttagatctaagtattctggttactcttgtgttttgattagaaccataagattgtaaaatttcaagttaaatccaagggttataatattaattccaagcaattatcttttgttctatcaaagtattgactttttagttgactttattaatcactaattgtttggttaatttgtgctagttcacaactcattatagtctcacaaattaatcagctttgacgctgaaattgttgtgaagatcattgttaattagttgtgattcgatcgaag

SEQ ID NO: 7735 - DNA, 3000 bp, Unknown
  misc_feature (1)..( 3000): cDNA_ID_1818687_gDNA_ID_1621159_Annot_ID_57093 3000 nt of promoter + ATG
cctcttttttgcacaaccctaacgaggccaagattccatagaaccaatcgaataaaaacatgacgtcttcttcctgatatcggattataatccacacaacaaccaaaaaaatcaccagaacagaatcgggagacagagagagatgaagaacagaacagaaaaccaaaatcaaagtttcgtttcgttgatgaagatatagttgtatgttgtaacattagtgtatatatatgcaaacaaaaaaagaaattaaaaaacacgtgggtaatggggactggtaaattgatgcggagccttgtgattggtagtcatcatcgtcattcgatcaatatgaaccgtcggatcctagaacttgtcgttgcgatgttttttattacgttaaactttttaagattaaaggcttaataccacgtggcaaaaccttaatggccaggacccaggagagtttatttcctccacaagttattattatgagccgtctgaggaaagctacccacatttaattcaaacacataggatacattttttttattgttcaacagacatgatcaaagtgtatatacaatggagtatttaactttgaaacagaaataaaataacatgtaattactgtttcaacgcataaagaatcaaagtgcttacgaagacgagaaatattgtagttccggtgagaccacggtgtttgaagcagtcacccccgcttcctacagaatggccaccaccggtaccgccattaccatttccactgctgccacggccgccgctattagaagatcctctactgccccctttaccgctgttgccgcctcgaccactgctgccacctccaccaccaccacgacctcctccaccgccaccaccgctgcttcgaagctcccgctgccaaaccgggaaatctatcttacaacacgttttgttacctaagatggaattaggtttcagatggacggctgagacagaagtatttgtgattgaagcaacggcttggatatgcgcatgaatcgctagtaacaatagtaatacgtgaaccatacgtttcatgaatctgtgtatctccatactaatcttttcttttatgtttatttatcgctctaacccaaaaaggaaaaaatgagcttttgtgtagtacgatctctgtttatatttcatctggtcaacgtctaaaatctaacttcatttcctaggaaaaaagaaatggatgccactactagtctactatagagcaatattagcgaaatatttacgtttatgtaaggtgtcgagcctctcatttatcaaattttgaaaaattcctaaggaaaggccaactaactttttcttagctatgaacaggcccaacaactttgcttgggtcataggtcccacgaggaaaaaaaagaattttggatatggcctggctaaatctatctttatgtatttttgttatgttcaattttacgatcattacaagcacaaacattaacttaagtaggtctatttactatctttaatttctgtttcatttcgtttaatttctgaatgagtctagttacgttccattggtttcattttccaggcataatcaatacacaacattaagtgaccaaactaaactaacctattacaatgtctacctcttctcattccgttcacgacccgcaacacgcatcacagatcattttacaataatctacatcaggttaccaactggtgctaaactaattagtctcaagtttccaagcattatacgatatatagcaacatataacttcgtggtaatacgtgtctgtttttttcccaatatcgtgtgtattatatacaccattaaaatattatatcttcaccaatttttgaatgagttggtatcatgtactccatgaatgtatcacaaagcgaaaaaaaaagaattaatattattgaaaaaagtctacaagaaattgaagtatataattttcaatgaattggattatcaatagggtcacattcaaagatgtggttacaatcatcaaagcaaaacttttttcgtttgtatttctaaatatcttatttcttgttgactgaattatatatatctcgaaggaaaactaaaaataaattttcaagctgacttttattcagctggttataaaaccatcgaatcatgtttatattggctttcaaaacacctctacatacgcaagaaaaaatagttatacaaggtagttgtccaaccaagagtttcattataagcctttatttcttcatagaatttagagatccccagaatttattttcactttctaatttattataagggaagtaaaatagctctgcatagaattgcacatttctattggtatataactagctacacatgcaacttttcaaatttaaacataaattttaataagacaatggtattacttattagtacaaagagatacaaattctgtttagatcaactgggaattgtaatcgctaagaatttttgttaaaacatagtacaaatttatttattcccattataaaacctagtggatggttggaaactacataaacgggttataaattccgtagctatagaagttcgtacatattaaaatggagcaattaagaataataaacagaaaatgatttataatattgaaattgtccatctatagaaacccaggagactcgggggcctctgaatcatgcctcgctcttcttcttcgtttcctttttctgttgttttaatttcatacaaagaacaacaaaaaaacaaaaaaaaaacaaagagagggtcaaacattttttttgttctctctcaatttctttcattatattttctcttccttataaatctgagcaatgttccacatataagtgaatattcttgtatctatctacacagctttgattttctttgttcggttttggaaaaatctgtttcgagttaagaattctaaattttggttgtgagattctagtggtcgagatttggggtttgagaattttccaggtttcttgttgatcaagctaagagcattgaatcgtttcttgtca

SEQ ID NO: 7736 - DNA, 3000 bp, Unknown; identical to SEQ ID NO: 7728
  misc_feature (1)..( 3000): cDNA_ID_1818677_gDNA_ID_1621159_Annot_ID_57098 3000 nt of promoter + ATG

SEQ ID NO: 7737 - DNA, 3000 bp, Unknown
  misc_feature (1)..( 3000): cDNA_ID_1818841_gDNA_ID_1621160_Annot_ID_57100 3000 nt of promoter + ATG
tgtacatcttttaaaacccttttaaaatctcttgtaaatcttttaaaaccctattaaaattccttataaatattttagaacccttttaaaatcaattgtaaatcttttaaaacccttttaaaatcccttgtaaatctatttcccgtcaaaaaaaatttttttacgggaaaattatttttggtggaattttattttttgaaaaattttggcgggaaaattgtgacgagaaatttattttagaatattttaggcaaaaaaatattaatatttcattttgttaacctaaaacaatttccaaataggggtaaaatgatcattaaaaatttaaagagggtagaaatgaaaattgctaaaaaaaagggtagagttgaaaaggggcatcatgaaaagggcattagaaagaatttttcttttagtttaagaatagaacgatttaaaaaacaaaacaaaaaatcaaaaattttatattgaactcggagatgtcaaaactaaattttgttaatacgctaagatattttaaaataaaatgatgttgtacaaatacaatgcaatgatactactttttagtttataaataaacttacaaataaaaatttaaataattaatggttatattataaaaataaaattacatttacgttattcataaatttagacttatagattagcagtttcaatttaaaaatatattaaaaatattggtggtgttaaaatgcatatgtactatatgtttatattatttatttttcaattgaagaaacacaatacatttaactgaatatatgtactatatgtttatattatgagatatgttggaaaaacatacatttttcaaacataattatcgaactagtacagttcctattcataatttgagattttaccgggtccacctcttcgtctaatacacgaactgtgaaatagaaaaaaatggggtatatcttgtgtgatggaaattacgtataagggttaggtttttgattggtgagagatagaaagaaagagacagcgtgtgggagagagggtgtgtgggtcagatttttttatttttttttattttgcttttatttgttacctcatattcttctaatgtctcataattaaagtgttcgttaatgaattttgtttttctaaaatttaacaaatacataaaaatctatgtttttttctttatcatttgatatgcaatttgtttgataattttttaaaaaattatatcataaactattgtacataaaaatttgatgtatagatataaaccactgtacagatgtatctgtatagtgatgtacagatatatttgtacaccacatctgtacagtggtatctgtacagtggtgtacagatataagccatttacatatatagatacaaattaatatagatgaataaacaactatacaaataagtacaaaaattactctttgtctttgtgttattttttgtttctggtattttaacaaaatagttttcttattctctttattcaattgtatctgtacagtagtatctgtacagtggtgtacagatacatctgtacagatataaattactgtacagatataaggtatttacatatatggatataaattattatagatgaataaacaactgtacaaataagtacaaaaattactttttgtctttgtgttcttttttgtttctggtatttcaacaatatagtttttttattctctctattcaattggtttagagactagctaatatgcttatttattttccatggtttgtggttgtgagaggagaggttgtggttaaacacaaaataacgtgaatcgaatataaacaatgatattaccagcagtgacaaatatcacataaaaattgaatccgaacatagccagttagtatatacatgattcgaagccaactacaaatttctgaattagcaaccataataatgtatagatagaaatcaacctgcgactaaattattgattgacgagcagaaaacctaacttcaaagagagaaaaaaagaaatgcatagtaatatctgtacagtggtctatatctgtacagtagtctatacctgtacagtgctcagtaatataaaatttaaaaattattaaacaaaatgcatatcaaatgattgagaaaaaaacataaatttttatgtatatgatctattttggaaaaataaattttacaaacgagcattttaattcttaaaattgaagggaatgaaatataatatattaaaaaaaggaaaatataaaaaaaacggacccacactctagttctttcacacgctttctctctctccataaaacctctcttctattgttttagtgacatgaatgtaaatagatgattttataagtggcaaaaacgaactcaccataaagccaacagtaacatatatagtacaaacccaatattaaataggaaccgtactattttctaattattttcccaaaacgtactaattttcaaacaaactcttatattatctatagttttcttatttaaaaattcgaaatatttaattttagcaagtttagttaacaaaaataagtagtatatcgaaataataatgtttggcacgatgaatagtaaaattaaataaatgaaaaagctgagaataattgtatgcttaacatataaatatcagaaactcttttttaatatattgagtggatgataaaattaaaaatttaaagcctcaatgataataaattatagtcttctatcgaatatgtgagctacactatttaagtacaagtgccaacaaaatagaattatttagaatgcattgacctttgtaatgtattaaacttaatttccttttattttttaatatcaatatacagtatactatcaagttgacaaataaaaacaaaaaaaagacatgttctaaacagaatcatatttattttacatttatatactgtaatatctttcgtttaatgaaagactcaaaaacttttcttaaaggactcgaaacctccccctctctctttctctctctctcgttcgag

SEQ ID NO: 7738 - DNA, 3000 bp, Unknown
  misc_feature (1)..( 3000): cDNA_ID_1818736_gDNA_ID_1621160_Annot_ID_173696 3000 nt of promoter + ATG
ggagcaagtgagtgacatatatatacatcaattattcaattaatctttagggttttgatctatataatgttcagatgttctgaatcgtttttgatgtatgacatattttggtttttttttttgttggattttggttgccaggattttctcaatatgttctttgggaaggtctttaaaccggtatctccggtatacaacctgattttgtctgtgctttggcgccatccggggaaggttgacttggagagtgtcaaagttgttcactactgtccacctgtaagtactttttcttaagctccaaagatgggaaattaattggaatataatatatggtatatgaccaaaaaaaaaaaaaaatggtatataatatatggtatatgacttttattctgctgagcatataaaattgttagttttgggggaaatttagtatctctattactataaaatctatatatatacatcaatataaattaattttattccaaattaaaccttctttaaacagaaattaaagtattgtcctatatgggaatgcatttacatgaggatagttctgccaatgctttctcttgcattttaacatctattgattattattggtgaaactaaaatgaaagggatccaagccatggaggtacacaggagaagaacctaacatggacagagaagacgtcaaaatgttaattaagaaatggtgggatatctacaatgacgagtctcttgattttaaaccgaaaagccctgcagatttggaagcaaccgttttggaatcaacaattatagcttcggtaaccgaagcaccactttcctactctcctgctgcaccttctgccgcttgagaaatcggaaacgcaagtaccacaagaatgtatgtttgaatcaagttggtgtgtttttgatatattctcattttttgtatttgtttggtgtggtgaattttgtttcgtttttgttaaattactatttgccaactgcaaagaaatacttatttcaaattacaaataatctatttgtatttatgcttatatgttcaatcttgtataataaagtaatgttttctttaaaagagttatgatttgacaatctgatgtttcaatttcttgcagtaactttacttaattaatttcttaaaaaattagacacgttactggtttcaacacattataggctactgcttcaattagtaactatgatttagaaaaagaatgagaaagaatatataatctaatgcttgaaatagactacaaattttaatatattttttaattttgttgtaagtctagattatacattaatgccgtctacctaactaaatcacatgaatatttaaattgttaatcattgtctgttttattcacactaaatattttcttcttcttcttatctctctttttttttttttttttttttctagtaacagtataagggagagatagtaatcataaaaaattgaatacaaagaaagaaaaaaataaacaataagagcaccctcaataggggtttctaaacaagtttcttaacaaataataaaaattttatatgatttaaatattacataagtctcttaaatttgatgaaacctaagtaaattgtctcttaattaagagataattggttttagtttcaccaaatttaagagacccataattaaaaataatatttatctatacttacactttaattttgtttaagagatttatgattagaaattaccactgaggatgctctaaggtgctgacacaatgcgcaagaatcaatagtgtcacattatgaaattcaagttttgttgttttgttgagttaaatttatcaaattcaaggttatgtgtgctaacaagcataactggattcattggaagatatgggggcaaaatgataacaaagaatgcttcatgtcattttgtaaacagtttgattgaaaaaaatggttaacaaagaatgcatgcatacaagaacgaaagagcttaaaacttgaaagtaggcaattatttaacaatggggggaggggaggcataaacaactcaaacacgattcgtgggtttaaccaacctaaccctaactcttaggcccacgattatgatttttatatttttgaactcagaaattgagtttttcccatatatactgtgaactagtccgtcacatgttatcatcaaatgccccgaccatcccaaccaatgttcttcgtgggcctatcaacaaggtcagaaacgcgagtgaatgtatggtttatgtcagtaactgttattacaagtggtcgacaaaacacttccatgtcttgaatacgacaagacgtaggagaagcacttccatatctcttaatacgacaaggttatcagcaatgcggtggaacttgatttgaagtcaatgaaagcatttactgctcatatttgattcgatttgttgaataggcgtagaattttccattcaattaaactacacaagtaaattttttatttttctttaaaagtctttttttgtttgtttaaacagaaaattagtagtacagaaaatgaaatatttttctatacaacgaaaacacctctaagttttatatatagatttgaaaaaagttgttattattattttattttttggcatcgaaattatttctattctgggagagcgtttgtatttcaaattctattttttttggtcaaaacaaaacacctttagattacttttcagtttcttacattttagtttaacgcacagaaaaaaaaaaaatactattttctatccaatccggagaagactaaatgacaggtcagcaaaattcgtctctctttctttttaaaagaaaaattattgacgcaatcaatacagccaaacatcgctccatgaagaagaaaaaacaacaacaacaagtcagccatggagaaagagagaagaagtagatagatggtttagatccaaagtagttgatcgttgaaatttatttctatttaacgttgaaaaaagagaattttgcaaaaacccaaacaaaaaacccgccatg

SEQ ID NO: 7739 - DNA, 3000 bp, Unknown
  misc_feature (1)..( 3000): cDNA_ID_2992526_gDNA_ID_1621160_Annot_ID_173694 3000 nt of promoter + ATG
attgaaggttcttcttcttcctctctatctctactaggtaatctctaacctaatctctgaactctctttcatactttggattatgtttgattaattaataataaattaatagtgtagctttgtccgaaatatagggtttccgggagaagtcatggctagaaccgaagtctcagggaaagataggttaagcgatttaccgtgtcatttgctatgtcgcatcctctctaatctctctaccaaggaatcggttcgtactagcgttttgtcccctcgttggagtaatctctggtcgcttgtttctgttttggatttggatttccaagattttaaaggtgaacacgacatgggagaattcatagatagctttatggaatatcacgaagagttaggcttgaagttgaagagcttcaatatgttttatgatgctaatgagcacttgcatgagccatttgtgaggaggctaaataaagtggttaggcgtggagtttgtgatctgaatattcagaatatggtggatgttgatgtagcattagttaggatgcctccctcgctttattcatgtgctactttagtgaatttgattctctactgtgttgtctttgatcatccaagatcaaaatcggtttctttacctagtgtgaagaaaatgtattttgagggggtcaagtttgatggtgattctgttctggagactctcatatcgcatagtccggttcttgaggagttaaccgtgattccgcatccggaggattatttggaagtcatatgtgttcgttctcaatcactggagagctttagacttgagtctaagcgttttgagtgtgacaatcccaaagttgaaatcgattctccaagccttgagtttatgagtatctgtgataagaaacctgaaagccttaaaatacatagaattggtccttttgcggaggtaaccgttgatgttgagtttgatgttgaggatgatgatccattggagatatctaagatacgtaagtttctcgtcgggttatccacatttcacgaactgaccatctctgctcgaactctagaggtacacatatgattggtggattaaatataacattaagcttgtacaattttgtatatggtgttgacttactttttttttggctatacacagtccatccatgactactccaaggtgggaccattgcctccattctctaacttgtttggcttggatgcttcgttagtcgaatcttcttgggaagttttaccagcctttcttagttgctgcatgaatctagattcgctcgtcatagtgagtttcatttatttgtctatatttcacgtagttacattgagattcatatcccaagaaaacttatcaaaagttttatgttactaggaacttgactgtgttccagagatggaggagattaaactctcaccagtgcctcaatgtgtcttatcctctctcgactttcttcagttgaaggcaccatcgacaccaagtaaaatgaaacttgcgacatattttaggaagaagtgtacacgcttgacgaaaatgcttttaagtgggcagtaacatcatcaagaaaatgaaaaggattccaaagatatgctgaaaggtgtcaagttgttatgtgtataatgtcgtctctcctaaatcaagtttacctatcaacagttaattatcaaataatctattgtaagactttttagattttcttgttagacatggctttatgttttctagtttttttttatggatgttctttagtaaatttctatctcttaaaacaaaattgaaattctatgttgcaactatatgtaggattgattataaatttttatattctttcattgattcttactcgtaaactatattgcaatgagtaaacttaaaagtgaagtatcttggacttcatccatgttgttacgggttggattcaacgtcaaagtttcgttgaaagtttgttgctatagttttctatatatatatcacatgcattgtaattaggttgctatagtgtacaatacatgtaaaatatacaaaactatagcaacaaagttttagatacttaattgcttcctttaatctcaaaccatttggttgaatctatcaagtacacaggacatatgctcattcaaattgggtaactaagagcacccccaacgctggactctatgaaaatcccttaaaaacatacaaataataatattttaatcttattagggcttctgtataatttgaccaataataaaaacacatgtatataattttctcgagactgtcccttaaataaagaattttagggcctctctctcttcttacacttaccttttaattatttttcattctttttatcattagaaattttgttaagggaccaccgttggtggtcctctaatcacgcatggagtctagacgaaataagaaacgcattaataagacatatattattttttggtgaaagtataatgtagacaaaaaaaaaagataaagcttttgttttcttagacataacccaaagaacataccatatatatagcagaattagattaaaaacagtcagatcagaaaacaaaacaatctgaatagctaattgcacaaaaagctagggttttgttaaggattttccgagtttaataccgggaactgatcctcgtgaattgtcgagatagcgcttaatgttttgtaaatatttaatattaaccccaaatattcgattttgaccaatttataccccatcgagatatttctactgctgactttttagtgttttgtatttgacctcgtttgatggacgaaccggaatataattgtgttggttggtcaaccatttgtttttagcattttctggtctttaattaatcgctaagtaatctaattctggattaagaagaaaaaaaaacttcaaaagagacgcttttatacaacgctttgagcattacttggccctctcaaaagaatacacagaccagtcttcgtgtgctcgtaattggcgattctcaaattcgatctccgtacaaaca

SEQ ID NO: 7740 - DNA, 3000 bp, Unknown
  misc_feature (1)..( 3000): cDNA_ID_1818742_gDNA_ID_1621160_Annot_ID_173693 3000 nt of promoter + ATG
cttgattaaaatcacacgacttaagtttatgcgaactctttattttttataaagttaagttaacaaccctggtgattttagaattggtgaggaagatatgattagcaaattacaagattcttttttatgtgatatatatgtacttatgattcccaaaaaaggatgtgcttacgaccagctttttgccacatatggataaatctttggcaatatatatggctcgattggattttgagtttaatggcctttcatagattatgctaaaattggagtattttcaataggtttgatcactgacttaactgggtgctttacaaagagttatggtaaggcatactgtttatcaaaaaaaataaaattgtaaggcatacaacttcatacaagatatgaagatatcatatcgaggtagaaacaggatcgcgagtactatacaaagaattattagagaattcaacagatatatgttcaagataatacaaagtacgatagtgttaaaaataccttcaagtcttcaaccatttatacatcatgcgacagattattattatacaattccttagaagtataattaaaacaaaataaatagttgtattttagtgaaactagccatattgaattttgatccgttaattacagttctataacaatacgaaaattaaataattgtcaataattacaaaaatgatcaagatcaatggattacaaggattcaatgggaggacaaagccactaaagttactgttttatatttagctgtgctgcaatcatatgtcgatgaaactttaactttcattactaaaaattttcatctttactgggtttccacactaaatttgtttcttctttgcttgtctattccctcaaactaaatcatcatggtttgggtgggtcaaagattgcaacggctcttctctgtctatgcttaacccttaattagtgtacgctttgatgtcctttgagatggttcttacttcttagctattttgcttgtatacagttgttgaagctggtagaaaaaaacgaaagaaagagatctctattggcacttcttggcgggaaaataacaaatgcaaacatggaaatttgggtttgcctgatctagaaatacaaaacgaagatgtttttgtttgtttgttttttttcggaactttaaacaggaaaaaattgtatagatcatgaatcttacaatggtatatataatagaatattttgtttcatgaagcgatatgtgttttgttcctcgattatcatgtcttgctatggttcttatctatacactaatgaatgtttcttctctactaagtagtaattaagtgctatacgggagggtcgtttcgattattcgatatatagttatttcttttttcttagatacttattttgatttctatgatgcaaatagtagtataaatatgcattaatgcaattatcttcgctttcttcctttctaagacgaattgcttagcttctcgttattgtctttgagttgtttctctctctctctctctattttgcagcaacgtgaggctgtgtctttccatgagcaagtggtgaatcaattttctcagaggttatgtgtttggagaagttatattcacaacatctccaaaaatatgtatttaagaccatttcagggatatcaaattggtcaaaatttagaaaattgaaacttcaagaaactacattttaatatatatactttctctttaaccacgtaaccatttcctattcccattattcttataaaaatcgttccacatttctgtatgtccgttaatgattttatgcaatctaaaaaaaactatactattttatattgtgagttgttgttttattcaattaccaataatgtactatttagttgtttttaaaaaatggctaaatatgttaggcacaaaattaaagataccttctactatcatatttgccaaacacatatttcctttccttatcctctttaaaccattactcaaacacaccttattttgttcttatatattttgaatatccaaatttagtttttttcaaatatctctattgattattaccatatatgatttgttgaaatttatgtacatttaatgctttgatttttttaaatgcactttacatttctatataaaacattacatatatatatatatacatatattaaaatgtagtcatttgaaatattatacataaaattatttataagattggaaagcataaaattaaatattataaatgatcattcataaaattaaatagcataagatttacctagactagcaggcaattttacctagttttggttaaaacttacaatgtatctctctttcataaaaagtgtaattttgacacatttcacacattaaaaatgagttaaacatacaaatatacccttatttaatatacccctaattataccataatgatttaaatagaaaatttcttttagctttagacaagaggaaaatctgaaaactagttaaaatgtaaacgatattattttgtgaattgtgaaacggatagaattgaacaagagttgagaaaaaaaaacggatacaatttgagcttttattcttgaaagacaaagagttaacaaaaaaaaaatcaatcatgagtatttcaagtattcttttatattaacagtaaattaaatacatatcattatttcgattgacaataaagttcattaaatgtaattaaaaaaaaatcacaacgtttcgttttgtggtcaataaaatattgaagaaatttgaaagggcgctcacgacacgtttcgtatagcctctttttatttttcaacttattataaaaactgtcaaagaggaagaaaatctagcgagaagatctctggtcgtcaaattgaaggttcttcttcttcctctctatctctactaggtaatctctaacctaatctctgaactctctttcatactttggattatgtttgattaattaataataaattaatagtgtagctttgtccgaaatatagggtttccgggagaagtc

SEQ ID NO: 7741 - DNA, 3000 bp, Unknown
  misc_feature (1)..( 3000): cDNA_ID_1818746_gDNA_ID_1621160_Annot_ID_173692 3000 nt of promoter + ATG
ctaaaacgtttctttcatattttcatacttatatatttgtaagcaaatgtatatatatgtattttagttgtaaactagttagaatgcttagttcttttctagtagtattgattacatctggagtatattatcacagtcatttagtaaagttaagcatgtgttaggtttacataaattgatttttaaacaaaagtaaaaggttatataagtagaaaatcattatttgggtggtgaggatcatattacatccaaatgaaagtaaagtatgaaaattgatgcaacaaaaacataatttacacatactattgggatgttacaatattgattaagatagtgttagtaacattcatttaaaacattcatttagtgcataattatgttacttataattgattaaaaaaaaataaaaaaaaataaaaaaacaaattatgtaaaagaaatgagatgttaatataataaaaaataatctcattaaaattttattattagcaataatataattcaacttttattagataaattgtttttatcatacttcaaaattttaaatgtgttagtgagttttagaatgaaagtaaatttaaatgcatggagaatagaagtataaaactaaatttattcaattctatatgtaaaatttttaagaagaagattaaatttaaagtaagactttggtctctaagagcaaattactatattttttatttatctacttaaagaaaaaataaaaattattaaatccaactaaaatttataatagatgtcgttagaactagcttcctacatggagaaatctttggtaaaatttagctagaatggatttggagtttataatggctttaaagattatgagaaatttgattgtttgtcaataggtttataggtttgatcactgacttgtgcttacttaatcagcaaactcactcacctcactttgatcgtgaactcaagaccaaacaggcttcttggttaatattctcacacggataaagaaaagaattcttacagtaaattttgacacatattaagacaagatttttttttttgtttaaattgtttcctccatgtatagttcattcaattctgtacactttggaacatagtttggtttcagtatttgtaggcccaacttggacaacaaatactcaaagcttgaacaaccagtgctctagtgaaaccgtcccgaagatagtgagaccgttttctgttttcttgtctcggagactcggacaataaaattaattcattctggctacttatcaaagaagtcttattatagtatgtgatttttttattattttttattattatttttattttattttgtgtgtttaaacttcttatctagaagaattaagcatccaactgatagactaaattatatcttcatcttccttaaaattcactgtgacgagggcttaaagtcttggcgaggctctttctatttaaagtttttttctggtttgtcattgatttccatttgtttacatcaaatcaaaccaacagagttaattataaggagaaaaatatatgttaattaatggaatggaatcactgtttatttcaatatctatccaaaattttgaaataagaaaaatcattcaacattaaattttatatccactggtcttaaacaaagttctgtcaatacaaccatacattctataatctaattgactacatactaattgatatatatatatatatatatatcgtgatcttattatgaagtgattgccggatgttataggaaagttgcaacgtctaaaacatctcaatttggaaatgacgaagagtattgatgagatatcttcaattcaaacttttcgtccgatgctagcacaatagaggagctgcattaacgattggaactactagaaatctgaaacataatatgtcctaagttcaagaatttataaacgcaccttataacttataacttttagataaaatctaaacttcaggaaaactgcggactatctaactacaaaaagaacaatgagacaaatattttatctgggaaacaaatatgcaaacataacatttttggaatgctctaaaaaaactaattattatttttgaatataaggacacaattctctttttgaaacataaacgactgacaagttgagattgagttgccgacgacttgactatgattaaacgagtgtatggggttagctatcatgttagttttttcagggtttattgaagacatttatttctaactttaatggggattaaatagttattaaggtttagatttcgtgattaaaattcaaatttcacgatttacaataccaattaacatttcgaatgaagaggacaaacaacatttgttcagaggttaaacaccatgaagtttagttactatctcacttttattctttcaactttaatttatttttcctttaatttttcttgtttttcttataattttacatatgttgtacttatatttttgcttataaatctctagttaatatttaaaatagtttatattgtcagaacctgatttgttatatttgttttactcagtatctcactagttattttttaaactataaatatgtttagtgcaaaagagatattaatattggtctaaattcataaataagaaattttcatttacccatatatatatacgaattacccaaaagacagattgaaagacaagagttttcatttatgtaacaactgtagattaaaattcacattactattagtctatatatactaatatattataactaagattgaaatgccttggatatctttccttataaataatgttaattattttaatcaacaataaggtaaaaaaaaattcaaaacaaatagagataagatctctgttggccaatcgagtgttcttctttctcgttctcacctaatcttacacctaaaatctcacgtaatctctgaactctcttggtacttaggactatgattcatttcgtagcttagtttgtgtggaagttagggttttcgttagaagtc

SEQ ID NO: 7742 - DNA, 3000 bp, Unknown
  misc_feature (1)..( 3000): cDNA_ID_1818768_gDNA_ID_1621160_Annot_ID_173687 3000 nt of promoter + ATG
acctgaatcaagaccccgaccgcaacatcgaagacgacacagccttgacaatgttaacaatggtggtttacctctaccaagaagaacatatgttattctccggcccaataatccgactagtccactcggaaacataattgcgccaccaaatcaagcaccaccacggcatgtgaactcacatgattactttactggagcatcaagcttagagcagctgattgaacaactaacacaagacgataggcctggaccaccacctgcgtcagaacccaccattaattccctaccatctgtgaaaataacaccacaacatctaactaacgacatgtcccaatgcacagtgtgcatggaagaattcattgttggtggggacgcaacggaattaccatgtaaacatatttaccataaagattgtatagtcccgtggcttaggcttaacaattcttgccctatctgccgccgtgacctgccacttgtcaacaccgttgctgaatctcgagaaaggagcaatcctattagacaagacatgcctgaaagaaggcgtccaaggtggatgcaactcggtaacatttggccatttagagcaagataccaaagggttagtccagaagaaacagcaaaccagaatcctcgagataacaggagctaactctgaatattccatgggaaataaaaatcgtgactatctatatgtatagactctatgagacattgtctatttgaatgtgcatgtatatctcagaaataaactcaagcgaaacatatttaacgactagagaaagccctaccaagcccatagcgataagaaggacttgcatgctataacaaaaataattagtggaaaaagactgtaaccttgagtaaactaaacttctctctcaaatcttactgcagttctgtcttagtggtcttactgtaacatcctttagtttcttgaacccatccattaaagagggaaataaagttgcgaaataaagagagatcatcaagagtcaattggtcaccacgaaaattataaataacggtcgctactaacttaaaagcacatttattctctactctcttcctattcgcttcgtctccaagaaacaaacactcattcttgcgtttgatctttctttctctagatcccatatttttcttgatcaatttagtttcattatggaggaagatgcagcttttgatctactcaaagccgaactcttaaacgcagaagacgatgcaataatctcacgttatctgaagcgtatggtcgtcaacggagactcatggcctgatcacttcatcgaagacgcagacgtgttcaacaagaatccaaatgtggagttcgatgctgagagccctagcttcgtgatagttaaacctcgaacagaggcttgtggtaaaaccgatggatgtgaaactggttgctggaggatcatgggtcgtgataaaccgataaaatcgacggagactgtgaagattcaagggttcaagaagattctcaagttctgcctaaagaggaaacctagaggatacaagagaagttgggtaatggaagagtataggcttaccaataacttgaactggaagcaagatcatgtgatttgcaagattcggtttatgtttgaagctgaaatcagtttcttgctagccaagcatttctacactacatcagaatcacttcctcgaaatgagctgttgccagcttacggattcctttcatcagataagcaattggaggatgtatcttatccggtgacgataatgacttctgaaggaaacgattggcctagctacgttaccaacaatgtgtattgtctgcatccattggagctcgttgatcttcaagatcggatgtttaatgattacggaacctgcatcttcgctaacaagacttgtggtaaaaccgatagatgcattaatggtggttactggaaaattttgcaccgtgataggctgatcaagtcaaagtccgggatagttattggtttcaagaaggtgtttaagtttcatgaaacggagaaagaaagatacttctgtggtggagaagatgtgaaggtaacttggactctagaagagtataggcttagcgtgaagcagaataaattcttgtgcgttatcaagtttacttatgataactaagaatcttttctttggattttatgatcatcttagtatcttgaggacattctctttaaaacatatatcgatagtctttgtgtttatatttctctgttcaatatgatttagagactagtgtgcttttttctctctttcatgtggtttgtgattgtgagaggagaggcttttttgtcgctgcaatattttaaacccaaaataacactaatcgcatgtaaacaatcgatattagcagcaatcacaaacatcagagacaaattgagccttatgtaaccaaacatgtacatatgattcgacaacaacctacatgtttctgaatcagcaacccgaacaatctataaattaaatgaagatcaattaaattgacatgtttttttatctgctaagcagagattgttgttgtgttgatttctcgtgtatatgcacatgtagcctttttggttgccagagacttaagagagaaagaatattttcctctgttttaagaaatattcaaagaatgccatggactaggatataaaatgccatggtctaatatgatccgttttaacattatatttatacatatgtcaacgaaacaactatcatatattttaagctgatactaatttaagcagaccaggaaaaacaaaaaaaaaagtttataaattttttatccattatagcaaagtcaaaatatccgtggacgaagggtggtagcgaaataaagagacatcatcaagggtaaattggtcactacgtaaagatataatggtccccactaaagtttcaacatgagtctcacttcttcttcgctctccaagaaacaaaacactcgatcttgcgtttgatctttctctctctatagatctttttcttgatcgattttatctcattatg

SEQ ID NO: 7743 - DNA, 3000 bp, Unknown
  misc_feature (1)..( 3000): cDNA_ID_3051283_gDNA_ID_1621160_Annot_ID_173682 3000 nt of promoter + ATG
ctacgttaccaacgatgtgtaccgtttgcatccgttgacgcttgtggatcctcaagatgacaagtttaaagagttcggaacctgtatctttgctaacaggacaaagacttgtggtaaaaccgatgaatgtgatggtggtggttgctggaggatcgtagaaggtcatagagttatcaagtcaaaaggtaaggttcttggttacaggaggatttttcaattttcggaaaatgaggaaccaagaaatgtttgtgaaggagaagatccgaagaaaactgcttggttcatagaagagtataggcctgacgaaaataataagaaggataaagtgttatgcgttatcaagttcttaatcccactcaaccaaaggtaacaaggagattttactctggaagtcatactccgtagcacttcgatgtgttcttactgagactggtcacattagctgatagggtatatcaaaaaaaaaaaaaaattactctttgtctttattttttttttttgtttctagtatttcaacaatatagttttcttattctctctattaattgctttagagactagttaatattcttattttccatggtttgtggttgtgagatgagaggtttgtgattaaacacaaaataacgctaatcgaatataaacaatgatattaccagtaatgacaaacatcacacaaaaattaaaccccgcacgtaatcaatttcttttttaccaaaaaaaaaagtctatctttctcgattcgagagagaagctaaggcgaactactgatggagagataagatttaatagcatttttattggaagatctttcacaactaaaataattaaaaaaaatagaaatgaaaaaaaaagagaaaatttctcactttgcccatagactctgaattaatctaacaaactcattttgccagatatattaattctattggtgtgatttaatttagttatttcaaattttatttgaataataaaattgtaacaaaaacaatacattttattcatcaaagaccatttttgtagatcttaccgatgaggattgtctaagtggttaaatctatcaataactagactttctatcttttaaaatgagtttagttaataactagactctttttttttttttagaacaaaatatcttcaactatacatttcaattttcagagtctttaatcaatgaataacaatgaggaaaaacaatgaataagttttaagctaaaaaagaagaagaaaaaaaaaaagaaaaaagaaaagaaaaaataacgaatacatttaattttccaaaacaaatctaaatattcaaaatgtaagttaaactgatacttcaccatctacttatcaatcaaaatttccagtttatttagcttccaaatccggtaccatgacactctaaatctggacccgcagctggtatgtttatatcgatcgacaaagccttaatttagaaaattttagaatttataactcgtggagccgaccaatttttaatgaatttgccataataaaaagattagttttcgaataaaccaaatgaagaaagatgtggttacctgttgaacaagtgttccaattttcctacatgaatgcattggaccatccttttgtcacacacagcttggaccaatctttatttattcatttcaccaacattccaccgacatatctctctcgcgggaaagggcattttaaaaacatttagcaatttaggagcgatgctcaatatttatttattttttttttattttttttggatgtaaattcaaatataacacaataacggtactatcataaattactagcttacctatctgaattttcattttgttatttataaatataatggtatttcattatatgatatcaaacttaaaatatctaaataaatatgatttctcataatttatttaatctaaaaatgcgtatggaaataacacaaaatttgtttggataagatatcatctttttgtcaacaaattatattagttctagtaaaaatatatataatactaactctaaacgattcaaaaaattcaaaccaaaatagtagaacctgaaaaaataatatcatggtgctaatttatccattttaaagtatggaaaatacgtgaaaagtgaggaaacaagaaactcctaaatattttcgaaatcatccaagattccaagtgtgttgagaaagcaagtagctagttcacagcctgagagccaatccaaattttttttttttttttttgaacaacatagccaatccaaattcaagttcaatttataacttatatatggagctgaccaatttgagtcttggattaatccaaaggttccaaattttttttcttttttacaaatctatatatatggtcttcattacaaatttacattacgtattccaatttctgcggatagattttttcttacttcatacagaactaaatctaagaccatctccattggtagtctctcaagagagtttctcactactaaaataataaaaataataaaaagagaagagagagagtatagaaagtttctcaagtgagaaactatgagatattctctacaagccatcattacatttctctcctctcaattggttcaattttttcattaaaataaaaatttaatcatataataaaaatttagtaaaatactaatttgtttgtttgaaaaactttttgggtttctccttgatggagatgcccaaagatattttttacacttcatatagtactaattactaaatctaggataatatatttttcaaaccccaaaacaaaaatggatagtagtacactactatgcatatttgatatttctatttgtgggaagcgtaatattcatttcaacacgtggtaattcaaaagtggaccatctttctttttcatcctcacagaaataacactggaggggcaggtggtacagtgagcgagagactcgtaatttattaattctaagttctgacaagccaataatggaacgaaaagagagaaaaagtgtgaaaaaatg

SEQ ID NO: 7744 - DNA, 3000 bp, Unknown
  misc_feature (1)..( 3000): cDNA_ID_3051287_gDNA_ID_1621160_Annot_ID_173681 3000 nt of promoter + ATG
catctttctttttcatcctcacagaaataacactggaggggcaggtggtacagtgagcgagagactcgtaatttattaattctaagttctgacaagccaataatggaacgaaaagagagaaaaagtgtgaaaaaatggaaaagacttttgctctgattaccatttttcttgcttttgctttctccgggaaatgcagcgacgttttcagcagatgtgattttcctgagggattcgtctttggatcttccacttctgcttatcaggtttggaatcaatttattatcttgaatcttcgaacagaactgaaacaaaggttttaatatctgaaagtgggaaggagctgttgcggaagacggaaggaaacctagtgtctgggacagattttgtcactcacgtaagagctttcgtttttcaacatttaattattgttagtgtttgaacaaatattaatattaacattgcagataataaccaaggtaacggagatataacatgtgatgggtatcacaaatacaaggttctttctcttctctgctaatttactcttgctacattatgagttttttgttcatcaagcctgagtttattgtgactattcaggaagatgtgaagttgatggtggacactaacttagatgctttcagattctccatctcttggtctaggctaatacctagtaagtcttcattaatcttcagttttactcattaatcttagatcaagtttatgatcagttcttaattatctcattagatagaagaggccctgttaaccaaaagggtcttcagttctacaagaatcttatccaagaattagtaaaccatggtaagacctctcgtcatatccactcgatattctgcgcggtgttattattattaacttgactttaagtaaactaattactataggaattgaaccatatgttacactgcaccactttgatcatcctcaatatcttgaggacgaatatgaaggatggctcaaccacatgatcgtgtaggttaacaaaaagcggcattgtactttctttttacagattatgtagaaaaagatgatgtgaaatagtaaacaaaacttgttgttgtttttaccattgcagcgaagactttactgcttatgcagatgtttgcttcagagagtttggaaaccatgtcaaattctggaccacgatcaacgagggcaatatattctctattggaggttacaacgatggggattcaccgcctggtcgttgttccataccaggccaaaactgcttattagggaactcttccactgaaccatatattgtaggccataatttgttgcttgcgcacgcctctgtttcaagactatataagcaaaattacaaggtacatatagttttgcataacactattcttgaatgtgtgagttgatgacaagagaacaataacatactaaatagtacatacaatgtgcaggataagcagggaggttccataggctttagcatattgacgatagggtttagtccttccacaagctccaaagatgatgccattgcaactcaaagagccaacgatttcttcaacggctggtgagtcaagcacaaactgttccaaaagatatcctcataaaatgagaagaaataccaaatacactctttcaaactcaggatgcttgggcctcttatatatggagactatccggatacaatgaaaagaatcgtcggatcaagaatgcccgttttctcggaggaagaatcagaacaagtgaaaggctcatctgactatataggaatcaatcactatcttgcagcttctatcacaaacagcaaactgaaaccttctatttcaggaaaccctgatttctactcagacatgaacgtaattttgagttgtaggaatcaaactcaatctttttgactaacaaaaattagctctttactatttatctcgatattttttcttcgctaaccatctcgtcttcgctttactgcttgggagggacagtctttgcgaatttttcatcttctgaggtaagagtttctacggctaccaaattcttatacaaagttttaaaccaaatgagtgttcttagttattttttgttttgttttggataagtatgatgttgctccatgggctatagaagctgtcttgtagtatgtaaagcagagctatggcaatcctcctgtctacgttcttgagaatggtctctctctctctctcattctctctctatctctctctcgttttagtcagctaaattctcttgttaatgtcaacgaataggtcgaccgataaatcgagattcgcagttgaaagaaaaggacacaccaaggattgagttcttacaagcttacattggtggtgtgctgaaatccattaggtgagtaaagtttcttattgcatattttcgtcacttctcttgtcagtgtaataaagaaaaaaaacattactacatgtaggaatggatcagatacgagaggctactttgtatggtcacttatggatttatacgagattaaggggggatacgatgttggttatggattgtactctgtcaatttcagtgatcctcatcgcaaaagatctcccaaactctctgctcattggtattctgattttctcaagggcaaaaccgcttttcttggttctcaaggcatcacggaattgcagagcaacctctctccttactcctagtaatgaattgcaataatatattctgatgaatccgttgtcataatgagaagcgtaataaattcattcgaatattatttgttttcatttattttacaatcaaatattgataaccgaattgcttcttatttcaaaatggactgaaaacagtgcaaaaaaatcccaataatgtatgaaaaactcaaaactaaaggctttttttttgtaaaaacgctagagttatttatttcaacacgtgttacacactttaaataaatacagtggaccatatactttgtttcttcgtcacacaaatattatctctagtagcagtacaagagaaagagcattagaaatg

SEQ ID NO: 7745 - DNA, 3000 bp, Unknown
  misc_feature (1)..( 3000): cDNA_ID_1818803_gDNA_ID_1621160_Annot_ID_173678 3000 nt of promoter + ATG
ctatgcgatagttgcgaccggatgattcacagtcacgaggacgcggtgccgccgcattcgaggtgtaagctttgcgtaatctgcaagagaccttctcgccgttttctcattggcggctatcagtttaatttcccaccggttcatcctcctgcggcagaggggattccagttacgcccccaacagaactacctcaacaagatattaattatgattatctagatgatgttgatgatttttcttggtttggtaggtgaatagaaaatcgtcttctttagctttttatttatgtgtgtttcttagagttttcgttaggggtttaattcttggtgttataattgcttctggatttgaaaaagaaaagaagaagaaaaaaaaaacaatcagttggatttaatatgttagaagaaaataaaatgtcaaaactaactccaatttgttcgaggatggaagatatcatatcttgatgtatgtatatctcatcatttaactagaaactatctagaaaccacaattaccgaaaaaacataaaacaattttgctaaaatgttaagaacacaaattaatttgattaacaatcgatgcttaaggggtttataggaattaaataatatttttttttcaacaataaaattaaatttcactttgcgattttaattttatttaagaaagtcaagaaccaactccaatatttccggggatgtgattttctcaataaaatcgtctaattatcttgatttttgatgttgttgttgtactttacgtgaatatctcacaattagtaagcagagtagaagattttgattagtatgacgacaaaaaatagtacaaataaaatttacatgaccttttttgtgttaaaaaaagttacatgatgttctgcaagaaaatatgcttgtataataaataatttttattaatattttatttctgactattttcttcaataagagaaaacatagtcattttgtaaaaggaaagaacgaaataaaaatgcaaattcttcacgttttgttaaatagatctaatttagttcttatttaagaacttaatattacatctttaaaccaaagtaaaatatacaaatattgacaactatcggtctaattatttcaataagcaaagattatagaataatttcgttaagtgtatatatcgaagagaaaaaaacaaaggacaaatcggtcaattcactaatttgatataaacggtaccaacagatgacgaagcgcctctctatatatagagtaccttctttcccaagaaacactatcatcttcatattttacatcttccgtttcttgtttctctcccttcatcaatcatcatcagcattttccttaaatcttcttcttctaagagatcttagtttcactgaagaacgaagatgatgaagtcaagacgtgaacaatcaatcgaagaagcaatcgtcgcaaattatttgaagatgatgatcgataacgtaaacgtttggcctcgccacttcctccgaagcgaagacgtgtactgcaagaatccgtggacgcttttcgttactagagatcctataatcctacacttcggacgatacttcttcgttaatcggagtgtgaattcaggtttaaccgatggatgtgaatacggttgttggagaatcatcggtcgtgatagagtgatcaagtcggtgacgaccgggaagattctagggttaaagaaggtttataagttctgtgaaactgatcggaaaccgaaatcggtttttaagttcttggaaaaggagaagagaagagtaagagatagacgaatctgggcgatggaagagtataggtttgcaagtacgtggaaacaagattacgtgatctgcaagattcgacgtctgtatccacaaccatttgactacatgttggcccagcacattcgaggttactataaatgaatcactgatattctgatcctggatttgaacactcgattactgtttttggtgtcacgttattgaacccgttgtttgggaattttcatgtattctcattatccagtttcttgatttctctcattcatctttgttcaatctttttgtttgtttggggcaaatcgtctctgtacaatctttatgttactagaattgaaaagaaagattggtggaatcgttttaaaactgtggcatctttaagtgttatttttggttatgcaattgcgttgattttgtaaagaaatatttagatgtagggtgattggtcggtggatttgttatcgagttccaaatttggaattcttctaagattagatttctctatccaaaggcataattttcttttatacattgatactattgctaatttgctctcaaacatgattctcaattgacctaacaaaaaatatatatacagtactaaatgtagacattacctacgattaaataattttattgttgcgtttacacaaaaaaaaaattgttgttgctatcttaaatatactgcaatattccaaatttagtttgcgaaaaaaggagatatcacaaaatgataaataaatcaaagtgtaatcaaagacttcaaaaatagatttcattgtacatttgaaacataagcaaaaaatacattttcttgatatactcaactaaaattctacaatgtcttaactctcaataactgtttataatcttaagttaaatgcttctatttacaaaacgaaaacgataagtagaaaattccatcaaataatgaatcttcaaaaaaaatatacaccatgaaaaagtaaagaaagattcacaaataaaaaatggtttctgataagtctacaaaagtagctttaatatcacccatatcgaagttaaatttctattacgtacgaaatgcaatgtgtatattttgagtatatacaaaaatggttcatgtacttttatgaaaattgaaaactagctgggtgttatacaaaaaaaaaaaaaagagcaattttgtgtctaaatattaaagggataataaaaattcaattttgtgattggtcgtatgtcgacgacaatg

SEQ ID NO: 7746 - DNA, 3000 bp, Unknown
  misc_feature (1)..( 3000): cDNA_ID_2136020_gDNA_ID_1621160_Annot_ID_173677 3000 nt of promoter + ATG
tttaattactctttatctgtgtgtgtgtgtgtgtgtgtcaaagttacaatttctttcccttctttacgacaaaaatcttaagtaacttttgtttattgttacacgtgtcaataaattattggctcattattccattgtttcaaagtcaattttcattatacaagacaaataataggcagtcgggaaaatataattcatctatacttaataaagaaaattaatggtaatttgcttaattgaccaacaaactcttaatatattcaatttatttttatgatattattgtcttggtacttagtaatcattaatcaatatacttatttaagcaatcatccttgaaaacatgatgataaaataatatttttaatggatcaagatacttaaccagtttaatttataaaagaaagaaatttacttgttgatccactcaatttagccttgaaatctttggtggttgattagcctttgctttggaagtgacaaatctgattcaatttggggtgaagatggtgacgttggtgtggagtgaagtcggcggtgctgagctcctttgttaattctttcatatgtcatcttggaaggttgctagatcggaggttttgtccttctatcaccactttgaatattattttcatcgttgtaggcgatttggtgttcttagttgggctttacttctctttctcggctattcattctgtttttagtttgggactgagttcttggctaaagaattgtggtgtcgtttactgattttttgagaatggttgtggattgaagccttagttttaaggctttggttgggtctacaaatgtcctcgtgtaagaaatgagggtcctctttggcattttccccttcggatatcaagttttctccttgtacctttgctttctcgtcttctttggttgctggaaggtagtattagtttggttctttgctctactctatttgattatccgtcttcatttctgctgaggtagtggttgtgtgagctcggtttagcccttttctcgggctttctcttttgaaggcattctaatgatttggttttcttcaaggcttttgtttgtaacctttcttgtggtgaagagtttctagtagtgaattgctttggagtctttaattgttagtcatctccatgtcttagtgattgtcaagtttagtctcagtaatcttgttttgtactagttgataggtttttgtttactatgggtttgtccattttaatggttcatatataaaaataacactcttgtgacccaaaaaaaaaaacacatattctatcttaattgtttttttttaatgatatttaaaattttaatagtaaaccacacattttttctatatttagtgtttttacttttatctcaatttatttattctctcaatatatctttaaataacgtcagttatttttgttgtttactaaataattactactgtgtaacttaaactttaaatattagtgacgataaaaaagactttaaatattagtaacttatccttaacgttttactcaaacataattatacttaattctcattcatctttgtactattgagttttcccattataatctttatctatgcatcacaccatttatgtgttttgttgagatctatattttatagttatcttaacatagcaataggaaaaagagaaattttttgacaaatactaaaaaaacttatttggaaggtccccattttttataaatctgttatattatgaattatcttattatataataaataattaataattacgaatatataattaattttttgtgattcatgtatatagattcttttcggttaggaaattttctattttttgtttttaaatattttaacaaaaacttagatttgacacatgtcgatatctcatcaatgtagttgactcgtgcgtgatcacgttagttagcaactttaaaaaccctattttatataataagatgcaaacttgaataaaatggttctatttgagacttgtttttttgtacaaaattagaaagatccaaaattcaaactgatcaaaccgtacaaattagggtttttttgtcgtgtattacgtcattagaaaatattatttttaacaatgatgatcttatacatttgataagcaaatctaaactagggttttgaaatcctaaattaaagtaaatgtttcatgtacatgacacatacattttcaaaaaattagaaaaatccaaaactcaaaccgttctaatccaataaaattaagttttttttgtcgttagaaaatactatttctaatgatgatattacatttttcaagaaaattcaaactagggtttcatgacaatacacatgcatatctttaacactattggaaaaatctaaaacctcaaaccgatccaacaagataaaattaatttttttgtcgtgtctgttaaaaagtactattttcaatgatgatcttatatttttcaagtaaatccaaactagggtttcatgacaatatacatacatttcacaaaatcgaaaactcaaaccgctccaaccttataaaattaagtttttcttttgtcgtgtattaaatcgttagaaaatattatttttaatgataattttatatttttcacaagtaaatctgaactagtgttttaaaaatcctaaattaataatatttgagcaaaagtaaattcttgacaattacacatacccatacatttacacaagtaaataagttactcaaattgcaaaattaccaacatttacgaaataacaaaaaaaagggaaaaaatctctttcttttgtggattgcgaaaaagagtcaaacattttcacaagcaaataattgctcaagttacaaaattaccaaactttacgaaaacaaaaaatagaaaaaaatccttttgtttgtttgtttgtttgtgaggaagagactcttcaaaaaggggctgacagtgaagagattgtgagaacaaagacgacaaatgggcgattgagcgaagaagaaaccttcgttctctctcggaa

SEQ ID NO: 7747 - DNA, 3000 bp, Unknown
  misc_feature (1)..( 3000): cDNA_ID_1818829_gDNA_ID_1621160_Annot_ID_173671 3000 nt of promoter + ATG
cgaccaccccttcttttcttcggttcagaatcaggaacaggaagtggcttaggctgtcttgcaggaggaggttcttgccatttctcaatcttcttacggatctcctccctgaaagcttttccacttatccctaacggatcccctctagtagcatcaactcttgctgccaaagttgattttgcagccacgagcctgccagcgcgagcctgaagtccaggaggcgtgctttggtaaatctctgtctgctccagataacccacacgggactgagacgttgcagaagaaaacccagcaaggttcttcctcttgtggccaagaacttgaacattacacgcaggcattttagcaagtgctgacaaacctccagcagtccccatgagtttggctgcaacagcactcccaacaatagcagaaagattaggtgcaatagatcccatcttactttcaacaaactcaaggaccttcttccttgcggaatcaagatctaaagcccgatcacaagcctctaacaccttttgcaaaacatcctctggcagtgcactccctttcgtagttaaagcagtaactgaaacaaccatgataatagctgaaggaagaaggtcagcgagatcaacaagagccaaatccgtctcattcccaatcttcttcacaacacatgcatagtcaatagggtgatgaaccaacgactcaagctcttgaaacttaagcttgtacttgtctttgataaagttgtggacaataacgatttcattctcaatatcgaccgaaagctgattacaatccacaataagcttatactcaggatcatcttccaagacagttcctttctcagctccatcagaatctttcccaagagcctcctctactttatgcataatatcagcatatctctgactcttctgcagcttagaaacattatcgagatcatcatagttaagtgtctctaaatcagccatatccatatcaacatcttcttcttcctttccaacatcaccatcattctcgtcctgcatatgtataatcaaacaaactacaattacaatcatagctcctccaagtaaacagataatagtaatcaaaagtgttttaacactcaccaattctgcttcattgtcagataactcgtccaaatcagcaaggaaagaatcttcaagagttgcctataacaaatccaacatattgaaagttagtaaaacaagcttaagaataactcaaatctcggaaacaaagcaatatctatgatctcggaatccctaattttgaaattgaactttagagaagatgagtcaaatcaaaattaacacaatacgattacaataaacagagaatacaatcgccaataactgaaacaatgaagaaaatagagttaaagaaacgcttaccatatctctttctacttgggaggcaaaagcttcagtgattctcctacggataaaagaaaaatcgttgattcagaaaccctaatttatagagaaagcttgggatatacacaattgattagaggaggataatcaaaagttacctgaagaatcgaaggagaaatcaatcgattagattcgagaagaaaattgaagagcagcgagcgactagtgttttttccttaggaaggcgaagaggaatgttttcagttgaaaccttgtgtgctataaaaaagtcgagtttcgaagccggcaatatttgggccttttttaatgggccttctttgaaactaacactagtaaatgggcttctgcaaatttccgttttaaaatatcttactatacaatcttttgttgaaataattatatttctacaaaaggaagttactctttaggtttgcttcagttctattttatgtcacactagattttaatccgcggtacaccgcggggataattaattttttaatatatataaaaatttgcaaattgtatctatatataaaatatttttattttaaagtttacaattgttattaagtaacgtcctgccaaacccgtcccgtaaaagaaacctatttattttattaatgttgattttatttatgatatatttataaatcattgtataaatattttgtaattttgtagtaattaactgctatcaaatatttctgcggtttgatgcttataatcgaattgttatagtcatgaaaaaagcaatatcaaaaatgataattttgtagtgtttaaatgatattaaatattttggaagttttattttagtaactaattgtgtagttaatatggagagatttcgggaagatagttaaatgtcaaatatttaattcgaagatttactttctaattatcaaaaataattattaaatgtcagtggcagccactgtaaataagtcccaacttgaggatttatttcacaaagtggctgcaaaaatgtatatatagattaaaataattatacatatgtagcaaattttatattacaattacaaatcaacaattttttttgataaaacaaaattttcacccatcgaaaaaaaaaaattctctctttataatgtgtttcttgaaacaacaaaaaattaaactaaaatctattgtatatcaaataaaatagagtaaaatgtatctaaaaaaatggttgagacagagatccttgttctccattggggaaaatgttgctaccaaaaaagcaaagaaactaaaaagagtaaattttttcttgaataaagtaaatttccattatacataacaaaagaaagaaggaactaaaatacttttataggataaggatagataatcgaggaaaaaaaaaaaaaaatatagtgttttcattgggaacgttattaaagtagttcaaataattgtctgtttcttgacagtaactatgaacatgttacccgtgagatattgtcagagagtgaagtcacactcaaccaataacaatgaccaatccaatctcttctaatttttcctccaaccaaaattataatcctttcaagaaaacagagttgttagtttctctgcttcttctcgttttggaggattattctaaataatg

SEQ ID NO: 7748 - DNA, 3000 bp, Unknown
  misc_feature (1)..( 3000): cDNA_ID_2136000_gDNA_ID_1621160_Annot_ID_173670 3000 nt of promoter + ATG
gaaatatgggaaaatcttgccaaaaacatatacaaaactaagttctcaacaaactggtctactattttaacttctgtctctactacttggcgaaacagaacagagagttttcttgctagatacatcttccaggaaaccatacacaccatatggcatgagagaaatggtagaagacatggggaacgttcgaattcagcgactcatctaatccggtggctcgacaaacaaatgaggaatcaaatttccacaatcgcagcaagcggagactatcgatatgataaggctctccaactatagtttcaatcaagatcatgagcttttttacaaaaaattttctactctttcaatcatatgttgcacttgatgtataaacgtttatttactttttaaatataatttaacattaaattcaaaaaaaaaaaaaatattatgatttttgattggtaactggtaaccccatttaacttataaaatcacaaaaaaaatatttatgcatgacaacctttgccgagtcgcataatggttaaagttaagttaaaacatctattaaaatgattaagtgatagcattattcgtaagttacgagtatacgacaaatcatatttgatatgataacgttctttattattaattagcatcggtgccactttcttgtcaaatatatttatcttctctctttatcaatcataaaattaatgatatcttaaagtctttgataactgaccaaaacataaagattttttcttttgtttttgaattttgagcactatgtaaacatgatacattatgttatatatacaatatgtagtacaaaatatatttattaatgaaataaaattgtttgtgatttcattgatgaattcttaatttgttaaaaaaaatcatgtgaaattgaatatggttgatagtttgaatatgttgacacttgacattaataaatttgtatatatattattttatgaaaaatagatttgtacaatttaattagttatgaacttttgattgtttgttttactattttttttatcgacaacatatataatatgcaaatttgaatcatatgactatgatacatcgacggcattaacataaaccataacgctagaaatcttaaagtattctaatagcctaatttggtttttattagaattaaaaccctacataatcctggatgtgcgtaacgtagtagttgagctctattcttatacaccagtaaagtaaataaataaaaagaacagaaaatttcatgagcatgcagtagaaaaatcagtcgaatgttataaaaatagggttacagctaagttcgacgaggtgctatttcattggatatcacgaaacttgatcgtcaatatgttttctttttgtcttttttgtttttgggtcaacagatgtataaatgtatttgtatatagcttacatgaagaacacttggttagctaaaaagaaaagctaaaagaaacaaaagaggaggcagctaaaaaacgaaaaaagagccagcattatagatgagcctcttcgtgagcaagtgagtcgtttattgtaagatttgcctcttctaatttttttctttaaaaccttataattgtatttaaacaaatatcttcataagaaaaaatatcaaatagatatcaatgtacttttctttgaaataggatttcgctattaatccttattttaacattcatataactgaccaattatattggtatacagaaaaaaagaattgtatttgtttttttcacattttagtaaatctcatttttttctttctaaattatgattaatatgaaaattaaaatagaaagtgacatgtccttattttaactccttttatttcattcattggtttaatgttatttacctaaggatactaatcattggtttttgaaagataacaataaaaattcattccaaacatgtggtgcaattatatataattacaaagtggatagagtatagaactacaaaatggatagagtttagttataacaactaatttaaaaaagtgttcatttgatagagtctaaaatcaccacttacattgactaaccccaaaaatttgtcctaaacactaatcaatccgaagattataaaatgtcgacaaagaaaataaaataaaataggagtctatgagtcgatggaacttatccaactaaactttaataagaatgaaccaaactcaattttgtaataatatttaaaatacgtttttactctctcccagaatatcccatctctctgattccaattcctcctctctctctttcgtctctctacttcgaattgattgttttaaccgccggtgatcggagcaaactctctgacggtgaccgccggtgatcattttttgtgaacttcacttttggtaagcagctttgacttttgttcataatccttcacttttccttttcaattttgctttttcctctgatctgatcttagttattaagctgttgaatcgcatgatcctttcttctctgattgattatttctaatccttcatgggttttatgacgaatcgtgtcttagggattggttttttctgggttgggtttctaaatttgttggtctaagaacagtgaaattgttgtttcagtgatctcagattctacacttctagtgattgaactgttatggaaaattacaaaatatgtggctctgctttcatttaaattcaatcatcatcatctctgctacttgatgatcaggtcaccttctctgtgttttgtaatctccataacgtaagagtttgtttgatattgcaattttgaataagatgattagcatccaatccaatagctgatgttgaaacctaactctgtaaagactttaaatttgttttctctggctttgtgctcgttgaagggtaacctaaagatttgacctttttgatccaacacttctctttttgtactgtaggtgtataaagcatagttcgttgggaacttttttttacagctttggagtaactacctttcatggtttttggttccaacaatg

SEQ ID NO: 7749 - DNA, 3000 bp, Unknown; identical to SEQ ID NO: 7737
  misc_feature (1)..( 3000): cDNA_ID_1818841_gDNA_ID_1621160_Annot_ID_173668 3000 nt of promoter + ATG

SEQ ID NO: 7750 - DNA, 3000 bp, Unknown; identical to SEQ ID NO: 7748
  misc_feature (1)..( 3000): cDNA_ID_1818833_gDNA_ID_1621160_Annot_ID_57102 3000 nt of promoter + ATG

SEQ ID NO: 7751 - DNA, 3000 bp, Unknown; identical to SEQ ID NO: 7747
  misc_feature (1)..( 3000): cDNA_ID_1818829_gDNA_ID_1621160_Annot_ID_57103 3000 nt of promoter + ATG

SEQ ID NO: 7752 - DNA, 3000 bp, Unknown
  misc_feature (1)..( 3000): cDNA_ID_1818813_gDNA_ID_1621160_Annot_ID_57107 3000 nt of promoter + ATG
agagaataaataaattgagataaaagtaaaaacactaaatatagaaaaaatgtgtggtttactattaaaattttaaatatcattaaaaaaaaacaattaagatagaatatgtgtttttttttttgggtcacaagagtgttatttttatatatgaaccattaaaatggacaaacccatagtaaacaaaaacctatcaactagtacaaaacaagattactgagactaaacttgacaatcactaagacatggagatgactaacaattaaagactccaaagcaattcactactagaaactcttcaccacaagaaaggttacaaacaaaagccttgaagaaaaccaaatcattagaatgccttcaaaagagaaagcccgagaaaagggctaaaccgagctcacacaaccactacctcagcagaaatgaagacggataatcaaatagagtagagcaaagaaccaaactaatactaccttccagcaaccaaagaagacgagaaagcaaaggtacaaggagaaaacttgatatccgaaggggaaaatgccaaagaggaccctcatttcttacacgaggacatttgtagacccaaccaaagccttaaaactaaggcttcaatccacaaccattctcaaaaaatcagtaaacgacaccacaattctttagccaagaactcagtcccaaactaaaaacagaatgaatagccgagaaagagaagtaaagcccaactaagaacaccaaatcgcctacaacgatgaaaataatattcaaagtggtgatagaaggacaaaacctccgatctagcaaccttccaagatgacatatgaaagaattaacaaaggagctcagcaccgccgacttcactccacaccaacgtcaccatcttcaccccaaattgaatcagatttgtcacttccaaagcaaaggctaatcaaccaccaaagatttcaaggctaaattgagtggatcaacaagtaaatttctttcttttataaattaaactggttaagtatcttgatccattaaaaatattattttatcatcatgttttcaaggatgattgcttaaataagtatattgattaatgattactaagtaccaagacaataatatcataaaaataaattgaatatattaagagtttgttggtcaattaagcaaattaccattaattttctttattaagtatagatgaattatattttcccgactgcctattatttgtcttgtataatgaaaattgactttgaaacaatggaataatgagccaataatttattgacacgtgtaacaataaacaaaagttacttaagatttttgtcgtaaagaagggaaagaaattgtaactttgacacacacacacacacacacagataaagagtaattaaaattggagtttctgatttctagggcacaaaatctttagattcggtgaagtcattcattacttcattgccaaagcttgtaaccaaaactcccatggccgacgaatcttcttctccggccacgggggatcccaattcacagaaaccagaatccactactccgatttcaattcccaatccaaatcccaatccttcactaacaccaccgccgcctcaacaacattcgcaaccaccagtcgctcctctggttccacctggtccgccttatgctcctccggctcagattcctagctcgcttctccccaccaatctcccgccgccaccaccattccgtcccggtatgcagttcactcccgttgcgaattttcaaaaccctagctctggagttcctcctccaggatctatgcctcagtatcaaccgcagcctggtatgagacctttccagcctatggctaatggttatcccggaattcatggtgttgctcctcctggtgccatgcctcctcatggtgggttcttctatctcttaattttataagttcttactcttttttttgtttatgatgcactttaggctatatagtttattttcgtggcgttttttttcgttctgtgtatgttgaatgtgaatttgtgatgcttaaagtagtgaaggggaactatatatgtctatgtagttggattagattaaaggtttagagtaaaaagaagttttattgaaagaggaattagggagaaaactagaaacaggaacaccgatgaccgggtgttttctcctacagcgtcttgattgagttccctgagaatggttgcaaggcatcaaattttgggtagggactcacttctacgactccctcattttggtatgcgcaaattcgctttttgttcttcttattctcttaatttatttagttagtgtaacacatctttaaccaaaccgcttacctaaaggttcttgaaagatttgccccaatttatatgttaagttgagaattactgtagttttaagaacaaaactttgaacttgatgggttaatcaactgccagcagcaagcatttgtagcgactgagtgctccttggtcttgattttgaggtattgcaattctttcaaattacaccttccgttacatcttcgacatgtttcttttttctattcccttctgtggtcaagctgctaatggttgaaataaagctattatgatgggtaataatagtttttataagttctatatgggcatgaaatgatgggagtttcaatattactgaatctcaaattcaacagatgattatagattcttacctatttcaagttgccctgtgaggtatgactacttaatgtggtaataatgactacgatcctggtgctatcttctcaatgtgtccttcaggatctctgttcagctgggtggtatttgtactgcctctggtgtgcatatctaatttgctctagtttgtggtaacaatacaaaatgatttttatttactgcttcttgatactcttgatttatgccaatgcagttgttcagggtattccaatgtaaacatctactgatgaatttgtagagacttgtttttgtttatgcagggcttctccggtatccttctccatatccaacaatg

SEQ ID NO: 7753 - DNA, 3000 bp, Unknown; identical to SEQ ID NO: 7746
  misc_feature (1)..( 3000): cDNA_ID_1818807_gDNA_ID_1621160_Annot_ID_57109 3000 nt of promoter + ATG

SEQ ID NO: 7754 - DNA, 3000 bp, Unknown; identical to SEQ ID NO: 7745
  misc_feature (1)..( 3000): cDNA_ID_1818803_gDNA_ID_1621160_Annot_ID_57110 3000 nt of promoter + ATG

SEQ ID NO: 7755 - DNA, 3000 bp, Unknown
  misc_feature (1)..( 3000): cDNA_ID_1818791_gDNA_ID_1621160_Annot_ID_57113 3000 nt of promoter + ATG
ttctccgggaaatgcagcgacgttttcagcagatgtgattttcctgagggattcgtctttggatcttccacttctgcttatcaggtttggaatcaatttattatcttgaatcttcgaacagaactgaaacaaaggttttaatatctgaaagtgggaaggagctgttgcggaagacggaaggaaacctagtgtctgggacagattttgtcactcacgtaagagctttcgtttttcaacatttaattattgttagtgtttgaacaaatattaatattaacattgcagataataaccaaggtaacggagatataacatgtgatgggtatcacaaatacaaggttctttctcttctctgctaatttactcttgctacattatgagttttttgttcatcaagcctgagtttattgtgactattcaggaagatgtgaagttgatggtggacactaacttagatgctttcagattctccatctcttggtctaggctaatacctagtaagtcttcattaatcttcagttttactcattaatcttagatcaagtttatgatcagttcttaattatctcattagatagaagaggccctgttaaccaaaagggtcttcagttctacaagaatcttatccaagaattagtaaaccatggtaagacctctcgtcatatccactcgatattctgcgcggtgttattattattaacttgactttaagtaaactaattactataggaattgaaccatatgttacactgcaccactttgatcatcctcaatatcttgaggacgaatatgaaggatggctcaaccacatgatcgtgtaggttaacaaaaagcggcattgtactttctttttacagattatgtagaaaaagatgatgtgaaatagtaaacaaaacttgttgttgtttttaccattgcagcgaagactttactgcttatgcagatgtttgcttcagagagtttggaaaccatgtcaaattctggaccacgatcaacgagggcaatatattctctattggaggttacaacgatggggattcaccgcctggtcgttgttccataccaggccaaaactgcttattagggaactcttccactgaaccatatattgtaggccataatttgttgcttgcgcacgcctctgtttcaagactatataagcaaaattacaaggtacatatagttttgcataacactattcttgaatgtgtgagttgatgacaagagaacaataacatactaaatagtacatacaatgtgcaggataagcagggaggttccataggctttagcatattgacgatagggtttagtccttccacaagctccaaagatgatgccattgcaactcaaagagccaacgatttcttcaacggctggtgagtcaagcacaaactgttccaaaagatatcctcataaaatgagaagaaataccaaatacactctttcaaactcaggatgcttgggcctcttatatatggagactatccggatacaatgaaaagaatcgtcggatcaagaatgcccgttttctcggaggaagaatcagaacaagtgaaaggctcatctgactatataggaatcaatcactatcttgcagcttctatcacaaacagcaaactgaaaccttctatttcaggaaaccctgatttctactcagacatgaacgtaattttgagttgtaggaatcaaactcaatctttttgactaacaaaaattagctctttactatttatctcgatattttttcttcgctaaccatctcgtcttcgctttactgcttgggagggacagtctttgcgaatttttcatcttctgaggtaagagtttctacggctaccaaattcttatacaaagttttaaaccaaatgagtgttcttagttattttttgttttgttttggataagtatgatgttgctccatgggctatagaagctgtcttgtagtatgtaaagcagagctatggcaatcctcctgtctacgttcttgagaatggtctctctctctctctcattctctctctatctctctctcgttttagtcagctaaattctcttgttaatgtcaacgaataggtcgaccgataaatcgagattcgcagttgaaagaaaaggacacaccaaggattgagttcttacaagcttacattggtggtgtgctgaaatccattaggtgagtaaagtttcttattgcatattttcgtcacttctcttgtcagtgtaataaagaaaaaaaacattactacatgtaggaatggatcagatacgagaggctactttgtatggtcacttatggatttatacgagattaaggggggatacgatgttggttatggattgtactctgtcaatttcagtgatcctcatcgcaaaagatctcccaaactctctgctcattggtattctgattttctcaagggcaaaaccgcttttcttggttctcaaggcatcacggaattgcagagcaacctctctccttactcctagtaatgaattgcaataatatattctgatgaatccgttgtcataatgagaagcgtaataaattcattcgaatattatttgttttcatttattttacaatcaaatattgataaccgaattgcttcttatttcaaaatggactgaaaacagtgcaaaaaaatcccaataatgtatgaaaaactcaaaactaaaggctttttttttgtaaaaacgctagagttatttatttcaacacgtgttacacactttaaataaatacagtggaccatatactttgtttcttcgtcacacaaatattatctctagtagcagtacaagagaaagagcattagaaatggaacagttttttgctctgtttaccatttttctatcttttgctttccccgggagatgcagcgacgttttcagcagatctgatttccccgagggattcctcttcggagctggcacttctgcttatcaggtttggaatcaattcctaagctttttttttttttggaatttttgaaccaaatg

SEQ ID NO: 7756 - DNA, 3000 bp, Unknown; identical to SEQ ID NO: 7743
  misc_feature (1)..( 3000): cDNA_ID_1818787_gDNA_ID_1621160_Annot_ID_57114 3000 nt of promoter + ATG

SEQ ID NO: 7757 - DNA, 3000 bp, Unknown; identical to SEQ ID NO: 7742
  misc_feature (1)..( 3000): cDNA_ID_1818768_gDNA_ID_1621160_Annot_ID_57119 3000 nt of promoter + ATG

SEQ ID NO: 7758 - DNA, 3000 bp, Unknown; identical to SEQ ID NO: 7741
  misc_feature (1)..( 3000): cDNA_ID_1818746_gDNA_ID_1621160_Annot_ID_57125 3000 nt of promoter + ATG

SEQ ID NO: 7759 - DNA, 3000 bp, Unknown; identical to SEQ ID NO: 7740
  misc_feature (1)..( 3000): cDNA_ID_1818742_gDNA_ID_1621160_Annot_ID_57126 3000 nt of promoter + ATG

SEQ ID NO: 7760 - DNA, 3000 bp, Unknown; identical to SEQ ID NO: 7739
  misc_feature (1)..( 3000): cDNA_ID_2992526_gDNA_ID_1621160_Annot_ID_57127 3000 nt of promoter + ATG

SEQ ID NO: 7761 - DNA, 3000 bp, Unknown; identical to SEQ ID NO: 7738
  misc_feature (1)..( 3000): cDNA_ID_1818736_gDNA_ID_1621160_Annot_ID_57129 3000 nt of promoter + ATG

SEQ ID NO: 7762 - DNA, 3000 bp, Unknown
  misc_feature (1)..( 3000): cDNA_ID_1989617_gDNA_ID_1621161_Annot_ID_57853 3000 nt of promoter + ATG
agagagtggcatgggactgactaatgctcctaaatcacataggcatctgttgaaagccactgtacctaaaaagcatggtagagtgaatgaaccaggatcactaagcttcttaggaacgatcttcttctgtatgatagcactgcattcatgactcaatactaccatcccttgcacttcttgaattctctccacgatcaagtctttcaaaaacttgtgggtatctaggattagcgctagagcgtcaacaagaggtatccgcaactcaacctccttgatgttcttcgcaaacatagctctatacttatatgccaatgctttctagtgacagccaggaaatggaagctagggtttgtaaggaggaggaacaaagaccttttctttgtttttgacagcaactagtttcggagatgttattgggaagggtggtcgagtaacgtgatcgagtggctgctcgagtgactggttgagtgaccggtcgagttgtttgtcagcttgatcttattaagaccgaaatcctccccatcttgatctacactgtcctcagtgactgtcttaggttcctctcttgttggaagtgcttttccactgtgcagagtgatagcgtgagaatattcttttgcacatgcttttgtgggctaagaagaatcctttccagcttgtcattcagcgctttgatctcgttactgtgtttgtcatctgagtcagttgtgcctctgatggtcctgtcacagtcctcgttgtaatttccatctgactaagctaggttctcaaccaattcccagccttctacaatatctttattctggaaatttccattgctggcggtatccagaagcattctgatccgtggtaaaacacgtctgtataaagtgcggagcagagaggctttcttgaagccatggtgagggcattggttggtgtacccttgaaacgctcccatacttcacagaagcttacaccagtcttctgtgaaaaacaagaaaatctcatttctgagtcttgcatttctagcgttggagaagaactttgccagaaaagcattcttgcaatcatccctggtgctgattgagtcatggggtagattcttctcccaaatgtgtgctttgtctcccaaagagaatggaaacaaccggagcttgaatgcgtcgtcactgacaccattgatttttgttaggttacagagcctatcaaattcatccaagtggtcgagtggatcctctattggcagaccatgaaatttgttcccctgaatcttcgagatgagaccactcttaatctcgaagttgttgttaaggatagtaggaggtgcaattcctttcctctaacggtggtcccgtggtgcatctctagcaccaatgtttgcagggccattctttgttcgtcagccatttcgagtggttgctgaggtacaaggttgtctgtgtttctcctttctctgagctcgcgagctatgcggttgatgttatcgttgaaaagaaggttctggttgcctgttgatcgagtttgcatacagtagaggtgtacctggatcaagaagacaacaagaaaaacacacagtcagtacttaaagcaaaaattgaaaaagaacttgatctaagcaagtttgaaatctcaaatataacaaacaaacacccaattggcaatggcgccaaattgataataggtttttaagatcaattaatcctaaagcactatcatgtcattgtagtactgaaggttgtcaatccaaattggtgtgatgctagcaatcaagatgcaatcagagttcacagagtcaagcaaagcaataacaagttttggtgtgttctagcagtcctaagtgaacatgtaagaaacagaaattcaagcagaacagtaaaaacactcgaccaacacagctttttgccaagcactgagtgtggtcgagtgacaggtcgagtaacaccagaaaatgtaacagggatactcgactgcacagtctgttgctagacaactgggtggtcgagtatcaggtcgagtaacaggagaaaaatgcaaaaactgagcaacagggaaaaagatgcaataaacaacagtagagtaaacaaagaaatcaattggatgagaaatttccggggatggggtaattgagtagttttgttttctaagtttaaaggtgattgacatgctcactaaattatccgtagacaacaagttcggtaaccatatctaagtgccaccgcaaaagaaaccctaaagttaaaccagtcccagactcaatcaccattgacgagagctaacctaacaggcattacgaatcaacaaattaaagccaaaacgctccctgcaaccaataccttggtacagagccacgaatctctggagttagtggttcagacattagtgcacaaaaaaaaaaaaaaaaaaagtggttcagacattttatcgaacttcttttaggtgcataaatgtctgggctcaaattctagttgatcagaaagtaataggcattaagaacaactaatccagaagagatctataaatcaaactcaaccacctagcatattgagaattctaaactacttaacccatcctcagaagcctagtcactactcagacatcattgtagagaacataaacgatgataataatgaaaacatgatagcaacagagtaatagcaggctgataacaggatgaacaacttagtaaacaaaatcaaaagcaagtactaaatactgaatagattaagagaaatccgaattacaaaatgtcaagaacacagtgtttgcggaataaaacttcggttacaaaaatgtaaaatacatgctacttatagcaaaatattctgaaaccaccctaatactcaaaacgacacagtattgggacagattaagaacggcactcgacccaggtggtcgagtgaatggtcgagtgatgagctggagtcttcttttcttccttgtgctcgagtgtttggttgagtgcggaatggaaaagactctgaagctggtagtcgagtatgaagtcgagtgatagagatg

SEQ ID NO: 7763 - DNA, 3000 bp, Unknown
  misc_feature (1)..( 3000): cDNA_ID_1989617_gDNA_ID_1621161_Annot_ID_173707 3000 nt of promoter + ATG
attaaagccaaaacgctccctgcaaccaataccttggtacagagccacgaatctctggagttagtggttcagacattagtgcacaaaaaaaaaaaaaaaaaaagtggttcagacattttatcgaacttcttttaggtgcataaatgtctgggctcaaattctagttgatcagaaagtaataggcattaagaacaactaatccagaagagatctataaatcaaactcaaccacctagcatattgagaattctaaactacttaacccatcctcagaagcctagtcactactcagacatcattgtagagaacataaacgatgataataatgaaaacatgatagcaacagagtaatagcaggctgataacaggatgaacaacttagtaaacaaaatcaaaagcaagtactaaatactgaatagattaagagaaatccgaattacaaaatgtcaagaacacagtgtttgcggaataaaacttcggttacaaaaatgtaaaatacatgctacttatagcaaaatattctgaaaccaccctaatactcaaaacgacacagtattgggacagattaagaacggcactcgacccaggtggtcgagtgaatggtcgagtgatgagctggagtcttcttttcttccttgtgctcgagtgtttggttgagtgcggaatggaaaagactctgaagctggtagtcgagtatgaagtcgagtgatagagatggtggtactcgacttggtggtagagtggtcggtcgagtgtgtgatgatggtgagactcggcggtgcaatcgagtaagtgatcgagtggatgtgatggaggtactcgactagggggtcgagtggtgtgatcgagtgatggtcaggtggtggagacgatgatactcgaccatgtggtcgagtagtggtgcaaagtgacgaggccttctgctcgatagggggtcgagtggattgatacgatcagctccgcttcttccaattagctcgtcaatagctccaaatcacctgaaaacaacacaaatatgcaacatgcatgcaaaactatcctaaacatgcaaagtgatgacaaatgatgagaaatggtataaaacagtggtgatatgatgctaaagtgatgaaaaatggatgctcaaaacatgtaaaatgcacacttatcaatcacccacagacaagcaggtaggttgagatctctaacagggagataaaaacaattctggaaaagactgttgggattacacggaaagactggtctgcaaagctcgatgacgcattgtgggcttacatgacagctttcaagacacccattggtacaacttcttttaagcttctctatggaaaatcatgtcacctacctgttgagctcgagtacaaagctatgtggacggtaaaactcctgaactttgacataaaaaccgctgaggagaagcggttgatccaactccgtgaccttgatgagatccgtttagaagcttatgagagatctaaaatatacaaggagggaactaagctttttcatgacaagaaaatcatcaccaaagatttccaggttggtgatcaggtgctgctattcaactctcgcttgaaactcttcccaggaaagcttaagtctagatggtctggtcttttctgtatcactgaaattcgtccttatggagcagtcactctagctggtaagagtggagatttcacagtaaatgatcaaaggctcaagaaatacttagcagatcaaatccttccggaggtaacgtcggttcatctccaggaactttttgatgattaaaagagtaagggagtcaagttaatgacttaaaataagctaacttggaagaagtcccatgcctttctctgtacatattttctttgtgatttctgatgcgttttactagtgttttcaggagatagctgccaatgtttaagtgcaatggatccaatctcagtaattaactcgaccacatgctttggagatcgagtgtctctgtgaaatcgagtaaaaacaaggtttcatttgtcacttaatctaattggccacgtgctgatgagaatctgtagtcgagtgaaattgatgattcagatcctttatattcaaccatatactcgactaacagagacttacagaagattccaagttctcctgaggttttcccagtcaacaggaactaagcttaaagacaaaacaacagggcatggaccacacgcgttttgttcctgaagataagatggagagagaatcacagaatcattctctaccacaccttttgaattcgccctcactctccccaaaagtaaaatctactcgacccatctctcttcatctctccaccgacactcctatttctctacttcaacacaaatcgccatctctcacttgcccaaagagttactcgattcagaccatttcactcgatttcgtcgccatactcgaccaattcactctaccgttcaccgtcacttcgttctcgccacaacactcgaccgggaagagcaaagacacctgagcacaactcgccgtactcgaccacctctacgccgctgcagtcgagtgccacaatcgaattctgtagtcgagttcccaattcgagttccccatctcgttcaccgtcaaagcctcaagaactactcgagtacatcaacaggactcgaccacctcacaaccgtaaccaagtgcaccatctactcgaccatcgattcgtggttccgtccctgtaaatcttgttcagcgtcaactaacagtttactcgtccacttgatttcaccagctgaactcgacctcaacagatatactcgaccgtcgatttctgttctactcaattcaaatcgttaaagaagaactcgggaacagttcagtttactcgagtacaagattatactcgaccaattaggtccatttcattgcctggtatcattgagactaacctattaacatttgagttttgagttctcaatctttcgcaggagaatcatgagtaactatagtggcagttcttcaattgatcctgactataacatg

SEQ ID NO: 7764 - DNA, 3000 bp, Unknown
  misc_feature (1)..( 3000): cDNA_ID_1809501_gDNA_ID_1621162_Annot_ID_57133 3000 nt of promoter + ATG
cggaactccggagcaagatcttgacgagatccgtcaacatttccacgcacgcaaacgaggtgagcctcaccgtgtcctcgaagaaattcagaccggaggagattcttcttccggtgacggtggaggtaattccggtgggagtaataactacgagacgtttgacatcaacaagattttcgttgacgaaggtgaagaagagaaacccgacccgaataaaccttacactctcggacccaagatatcagattgggatgagcagagatctgattggttagctaagaaccctagcttccctaatttcatcggacctaacaagccacgtgttcttttggtgactggttcggcgccaaaaccatgtgagaatcctgtcggtgatcattacctcttgaaatcgatcaagaacaagatcgattactgtaggttacatgggatcgagatcttctacaacatggctcttctcgatgcagagatggctggtttttgggcaaagcttccattgattaggaagcttttgttgtcacatcctgagattgagtttctttggtggatggatagtgatgctatgtttacagatatggcttttgagcttccatgggagaggtataaagattacaatctggtgatgcatggatggaatgagatggtttatgatcagaagaattggattgggttgaatacagggagtttcttgcttaggaacaatcaatgggcacttgatttgcttgatacttgggctcccatgggtcctaaagggaagatccgtgaagaagcgggtaaggttttgacccgtgagctcaaggatagaccggtgttcgaagctgatgatcagtctgctatggtttatctgttggctactcagcgagacgcttggggcaataaggtacaaactgattttgactggtatataactatgaacttgattccatttcagcattggtttgatgtggaaaaaaaaaaaaactaaatttggaaacttgtggtttgcttgttgtggtttatcatgtctcttgaacatcaaaaataacaatgtgagttgctttttgtggtttatcatgtctcttgatcatcaaaaatgacaatgtgagttgcatcttgtggtttctgacatctgtgtaagggtctattattgaagtaaactcaaatctttgcttggtttggattttgttgagctactcatttgagccactgcattgttgttataggtgtacctagaaagtggatactatcttcacggttactgggggattcttgtggacagatatgaagaaatgatagaaaactaccacccgggtctaggagatcacagatggccattggtgactcactttgtcggttgcaaaccgtgtgggaaatttggtgattacccggtggaacggtgtctaaaacaaatggacagagcctttaactttggagataaccagattctgcaaatctatggtttcactcacaaatctttggctagtcgtaaagtcaagagagtgcggaacgagactagcaatccgttggagatgaaagacgagctcgggttgcttcatccggcgtttaaggcggttaaggtacaaaccaatcaagtttgaatcggttttgcgtttaggatttgtgttatgtttctcgctatatttatgtcttgtgtctttgcttgttgttgtactaagatggatgataaagtattgtgcagagacatcagttaattctttggttttactttgtctctacgtctagagttctattacgaaatcaaaatgttgtttttcttcctttttgttctttgtaatccattagaacttgagattttgtagcttcatggatcaataatctgtgttaattcaagaacttttttttaacctgatttcacattcaactaattatttacttttagtatgcaaaatgtgaaaaaatcacattgagttagtatagttctgagatcatattcacaagttttgtgtagtttaggagtttaattcgaaaaacaaaatttggcatgtggtcagattcttttgcagtatgggttgttgtatctgaaatctgaatgtctttaattgataataaaatcatgtatacgggctattattagggggaggccttataaaagcccatctgaaaactaaaatcacggcctaatatatggaatccgtgttatacaaaaatccaagataattcgtagataatggtgagaaaatcgtttgtggccaagcaatttcgggtagggaggatcaacaaagatacaaaaaagatttctttcttctttataaaacccaaatctcaaaatgttatctcgttttttattttaaatgttttattttattttgttgttgtgtggtttttttggtttttagtaaagagaagatataacaaaaccctaattctcatgagttcaaaaaccctagatttagtgagcccatcaaaacattttccattggggaagattttaacatttggagaattgtgcataataaaaacaaaatattaaacagtaaatactttccaaaaagtgactaaaatattctaaatttactcaacaaaaattgaaaattcttgacaaaaaaattactgttttttaaaatgatacaatgtttttcaaattttaaccacaaatgattattgtacttcttcctcaaataaaaaaagaaactctatatattttggcttgagccaatgaagcgacacagtttaaagcgtagcacaaaagagagccctcttggaaacttcaccaacatagaagcgagggtaattcggtaatttcatcatcatcctcaaaacacaaactgagaagataaaatcccaaggcaaagaagaaaaacgaagagtcattttttgttcgccgagtgaccttatctctcccaattctctcttcttcaaaagagagagagcagccaaattctcaatcataaaaaccttcacacaaaaaagggtaaattcctttaaaccctatctatctatcgctatctccttcctccacaagtttggcggagaaagagtctcagtagcaaagcggaaatg

SEQ ID NO: 7765 - DNA, 3000 bp, Unknown; identical to SEQ ID NO: 4992
  misc_feature (1)..( 3000): cDNA_ID_1809497_gDNA_ID_1621162_Annot_ID_57134 3000 nt of promoter + ATG

SEQ ID NO: 7766 - DNA, 3000 bp, Unknown
  misc_feature (1)..( 3000): cDNA_ID_1809493_gDNA_ID_1621162_Annot_ID_57135 3000 nt of promoter + ATG
tacacctataacaacaatgcagtggctcaaatgagtagctcaacaaaatccaaaccaagcaaagatttgagtttacttcaataatagacccttacacagatgtcagaaaccacaagatgcaactcacattgtcatttttgatgatcaagagacatgataaaccacaaaaagcaactcacattgttatttttgatgttcaagagacatgataaaccacaacaagcaaaccacaagtttccaaatttagtttttttttttttccacatcaaaccaatgctgaaatggaatcaagttcatagttatataccagtcaaaatcagtttgtaccttattgccccaagcgtctcgctgagtagccaacagataaaccatagcagactgatcatcagcttcgaacaccggtctatccttgagctcacgggtcaaaaccttacccgcttcttcacggatcttccctttaggacccatgggagcccaagtatcaagcaaatcaagtgcccattgattgttcctaagcaagaaactccctgtattcaacccaatccaattcttctgatcataaaccatctcattccatccatgcatcaccagattgtaatctttatacctctcccatggaagctcaaaagccatatctgtaaacatagcatcactatccatccaccaaagaaactcaatctcaggatgtgacaacaaaagcttcctaatcaatggaagctttgcccaaaaaccagccatctctgcatcgagaagagccatgttgtagaagatctcgatcccatgtaacctacagtaatcgatcttgttcttgatcgatttcaagaggtaatgatcaccgacaggattctcacatggttttggcgccgaaccagtcaccaaaagaacacgtggcttgttaggtccgatgaaattagggaagctagggttcttagctaaccaatcagatctctgctcatcccaatctgatatcttgggtccgagagtgtaaggtttattcgggtcgggtttctcttcttcaccttcgtcaacgaaaatcttgttgatgtcaaacgtctcgtagttattactcccaccggaattacctccaccgtcaccggaagaagaatctcctccggtctgaatttcttcgaggacacggtgaggctcacctcgtttgcgtgcgtggaaatgttgacggatctcgtcaagatcttgctccggagttccgaatttaccggcgccgattgtgctacgtaggacaacaacggtaagaagaagacagagaatcgttacctttaattggcgtaaagctctttggattctccggcaccggtaagctcctaaacacctctcaatcatcttctttcttcttacaagattctctgtaaaagatctgtgctttatgtgtttttaagagaagatctgagtttccattaatgtaagagattcgaatttgataataacactgttaattaccaaagttacttactacaacaagagaagagaagcgaggagagtttttgtgtttttggacacgacagttaagattgtctgatttcacttaattgtcggtggtagtgatgagttagtagcgttgttgacacgtggcgaagttctagagcgtatcatttgcgatcaattatcttgaccgttgatgcagttatagatctatctataaaaaactaaaaatctaacagcgttgaaaagtcaactcgttgttttttttgtacaaactcgtttgtttatttatatatagaaaactagttgaaaagaaaaaggagcataaatagcataatattttaacttgtttgatatagttaaatacttaaattactaattagaggttaggaagttacccaaatgacttttggaattcattatattgtgatatggtttataaaaaatgttttttttccctcatcatgaaaagataccattattagtattacataagtactagattttaacttacggtgtaccgcggaaacaatttatttttaaagttagtatatataaaaatatcatttattttattaatgttgatcttatttatgatatgtttatgaatcatttgtttaaatattttagtcgatgcgggacattgaaccacatatttttcgtcaattggttaatatattttcatttttaaaatttcgaatcacggaaaaaattttgatttttttttaaactctatatattatataatgatgttaaaaaattgtgatatattaaactttttaaaagtttaaatattgataacgttttattaagtttaaatatagaaataattatatttaaaaagttaatattttttaccttttaggtaatgacataataaatctaaaagcaaggatttagaagatttagatctttaattaaatattttcattcctaaataattaagcatgacattgtaaataagttcaaatacatgatttatttatttaaacaaaaacgtttagtaagaataatatttatttaaataaaaaactttgttttaaaatattgttaacaaatatgtttatgctaattttaagggattgatgtgaagtttgtttggattaaatttgattgataatgtgattgacaatttaaattaagaatgtaaagtaaaattaattagtttgaaaaaaagatttaatgctaatggcattattgtaaataacttcaaatctaggatttatttggtaaaatggctccaaaaatgtatatgtagattacataatgaaaaaaatatctcataaaatatcagaaatcactatttatcattacatcatgaaaattataaaacaatcaaaaatcattaaccactaattacattacgaaaaagtttatatcatgaaaaacatcaaaccagtctcttaagggtatgcttatctcctattatactcatctgttaggccccctaatgatgatgtgacccccttctccgttgaacgaattcagtctcttcatccttttaggtgtgactcctccttggctactcagttaacagctattcctagtgatgaagagatcact

SEQ ID NO: 7767 - DNA, 3000 bp, Unknown; identical to SEQ ID NO: 4992
  misc_feature (1)..( 3000): cDNA_ID_1809497_gDNA_ID_1621162_Annot_ID_173715 3000 nt of promoter + ATG

SEQ ID NO: 7768 - DNA, 3000 bp, Unknown
  misc_feature (1)..( 3000): cDNA_ID_1809489_gDNA_ID_1621162_Annot_ID_57136 3000 nt of promoter + ATG
ttgttctctctcatgtgtcaaactcgtttcatctacgtagcatcgagatttcagttaatcgaatctcctgttatcatggacatgttatataaaatggatatagatcagtaaaaaggtttccgaatggatatatttaaatggattcgttattatggacaccaaaaaattgtttgttgatttttctttcagtttgcagagacctccaccttcaaaaccttatggacatggaactttggtttctttacaaaacacggttaatcgaatctcctattattattgacatggtatatagaatggatacggatcagtagaaaggtttctgaatggatatatttaaatggacttgttattatagataccaaaaaattatttgttgatttttctttcagtttggagagacctccaccttcaagatcttatggacatggaactttggtttctatacgaaccacggttaatcgaatttcttgttattattgacatggtatatagattggatatggatcagtaaaaaggtttctgaatggatatatttaaatggacttgttattatggataccaaaattttttaccaaattcctgagataatcgagatcgaattgtttaagaaacttctcccatttatttgcagaatcgttatcaccaatttttagtgagccgccgtcataatcgataagaggaatcaaacctagaagttatggagacgtggagagagaaaggcactacaaatgtgagagagagaaagagagagagagagagatctttttttctattttgcgtaaggatcgtggaagagagaaaaaatatttaatttgtgttaaaattcaaaataaaagtagttgtttaagttaggggtaaaaatgtcttaaaaaaagtcaaataatggaaaaagtgtcctcaccctcataagtgcataaaaaagaataagattatctaaaagtgcctaaacgtgtcacatttttatatatctccgtctttttttcttcttttttgtaaaatgacttaattacccttagtttttagtcggtgaagtttagagatcttgtggtaatttggtctttgcattcaaaacgctgaatcataaaaacaaaatattatgctgttaatttgactcaaattttctttgttataaagtataatctttattattattttgttcaaaagctgaagcattttttagacaaagaaagtcataacttagtagatattcaatatttaaaaaatgacattatttcctagattttgtagttaatacatttctatagagttatatattatgaatttatataaagtttttttttaacacaatgaatattatatatatatataagttttatgtatttaagtttccttttgaaggaaatgaacatacacattgtaaccgacttaaattaaattacgaaaaggtcacgtgatgtggcatgcatggatgtatatagtcaaaaagactgattaagagactgaattcatgcgaacacgtgcccaatacaaaacaaacggttagacgaacggatactcccaaagtgtttctgttcatcgaacgaaacgtatgttgctcttgttgttgttgtgtagtagtagcgaactacccggttcggtatttttttttcttctttcaaaaatattctcaacgatttcatgttttttgttttgttttattcatgttcttggtcaaacattattgatttggtttcgataaacctattcttgaggattttattatatacctttgatcaaaatacaaatgggtgactttttctttacttcatttgcttcttttttggggtgttagaaaaaaacacttaaaaaaaaaaaaataggagtgataaaacagagtttgaccatagtgtttgcgtcattgtgagtgaaaatgaatgtggtaaagtaaaaaagatttgactactagttgggagtcaattactccagaaaaagcaagtagatgaagaatcttacctccttatctcttgtatacgtgcttgtggtatttgccccaagggggggagctacaatacctctcgcattctccttttgtacaattataaaaagtgaactgtctttccaaaaaaggaaattattattatattctctcaatgtgaaaattacaatagtttatccgacttgatttcacatattttaggttttaattgttaagtttagaataataacaataatgataaatttttgaaaaagaataactaaaaataataattgatgaaattcatttagtttattcattaatttaaatcagctataagtctttttgttaaattgctaatttttatgtgttttacatgtttgtgcttttccaatatctttttgtttgaaaactttaaaagtcaataaattactcaattttctaaaaacgacaaattaaatttgtcggatgcgttaattccaacgtgtaagtactttttgatttatagataacggaattaccattatatagatcacaaagacataaaaacaaaagtacaatgtttaatccagaattttctcgttgacgaagcgtgtattcattgattatgggatctaaattgtcgtgtgtgtttataatttttttaataattaaaattattataaagtcaatttacattgttaatatgcaaatatatcaatcaaaatacacacataaatatgtggatttaaattcggatattatagtgttcaaattttttaaaaatatggaatatcgatggtcaagttatttatatatttgacccgtaaaatgtacagtaattaatttaaacgcagagagacaataaaaattaaataaaaaaaagttttgcaggtttatgtttaatttataaattgaccatcccagtaatcatttacatgatatctctctgattcttcgatttctctttctctctctctcgctctatccttctcctatctctaatctcttgtcttctctctctttctctatcgggaaaccaagcggctcttctttggatcaaaggcgaagtcaaggcggagaaagaaaagagagggtcgtgagat

SEQ ID NO: 7769 - DNA, 3000 bp, Unknown
  misc_feature (1)..( 3000): cDNA_ID_3091633_gDNA_ID_1621162_Annot_ID_57137 3000 nt of promoter + ATG
ggtggaaatgtccctgctgctggttatgaaattagaccaatcgtgcaccttcttggtgaatcttcttcatttgatataaggggtagcatctccagattactggatgaacgaagggaagtgaaagaattcctcagagaatttgacctttcatcaactatatcgactagacgccaagcttttaaggatagtctgcgaggaggagtactcaatgctcaaaacatagatatttcttttgagaacttcccatattatttaaggtaagattgcttaatattatgttacatttgtattacacatcttgctttcgatggtttgatgatttatagccaaaaatatatctaaattgtctcagtgctacaacaaagggtgttttgatgatatcgatgtatgttcatatgaacggtggaagcaagtatgcaaattttgcaacagacttgactacagcctgtccccgtatcttactctctggaccatcaggtatttctactttttgctgagtccattcctctaaacaagtttacctttgtatatataaggtctgagattcctatatttcttaccatttgaaatatttttaggctctgagatatatcaggaaatgttggcaaaagcgcttgctaaacagtttggggccaaattgatgattgttgattctcttttgttgcctggggtaatcttcttttcccctttattttttttttcatcttttagttgacagacctaagtgatctagtagaatgaggtccatgaacaggatcttgataaatacatagatacataaatcttgatccaaaaagaaaaaatcctaatagtcgagaaccaatcaggagtgtttcagcttatattactactaatgtatatacacattccaatgttgttttatttattacaatatttattgcatcttgagcaagtggatattaactggtagtgttgactttttcgtcccaaatagcttatattactacctatcacagtgtccactcggacatcggacattatttttcagcaggctcctttataagtaataggtttgttcattccggtgaattcaatgattttgtactgtttctggatggtttcagggatcaccagccagggaagctgaatcctctaaagaaggttctaggcgtgaaaggctgtctatgcttgctaaaagagctgttcaggctgcacaagtattgcagcataagaaaccgacttcaagtgttgatgctgatataacaggtggctcaacattaagctctcaggctttgccaaaacaagaagtgtcaacagcaacttctaaaagttacacattcaaagcaggcatgatgtttttcttttcatctgactgttcaacttcttttgatgtaccactcctgttttgttgaacaagcatttttatcattttcaggtgacagagttaaatttgtaggtccttcggcttctgcaatttcttctcttcaaggccagcttaggtattgtttactgtttttaaaagtcttcacatctgctgtaaatgtgtgttgtattcacaactttgctcttactttttccctgctatgtaatataggggaccggccattggttcccagggaaaagtagcccttgcatttgaagacaactgtgcttcaaaaattgggattagattcgataggcctgtacaagatggcaatgatcttggtggcctctgcgaagaagaccatggttttttttgtgctggtaatcgcgggctgttttttttctttctaactttacttaacttaaaaagtgaactttattaatattattctttgtgtgcagctagctcacttcggttagaaggttcttctagcgatgatgctgataaactcgccgttaatgaaatctttgaggtagcttttactttaagttttgtgataactacttatggcttgtagctacaggatagtaacctcttgacccataccataggtcgcacttagtgagagtgaaggagggtcattaatattgtttctgaaagatattgagaaatctcttgtggggaacagtgatgtgtatgcaaccttgaaaagcaagcttgagactttaccggaaaatatagttgtcattgcctcgcagacccagttggacagccgaaaggagaaagtaggaaactttttcagtcttctctatttctgttttggtatcttttaagttggttttaatttgcttatctgtatagttaattagagatttgatggttctttttcagtcccatcctggaggtttcttgtttactaagtttggtggcaatcagacggcactactggatctagcatttccggtatgatgacctgacttatcttgaactattttccatttcttgaaatagttgtgtacctaaataattctatcctgatggtaaggttcaccaaagtcatcttagatttggtatcttattgatgaaatgatttttcctattatctgcaggataattttggtaaactgcacgatagaagcaaagaaacacctaaatcaatgaaacaaataactcgactatttcctaacaaaatcgccatccagttacctcaggttgttaccttcattcatgatttcttgtctgggataattttatttttcctttttcttatgctccgaagatgtaataggaagaagctttactctcggattggaaggagaaacttgaccgtgacacagagattttgaaggttcaggctaatataaccagcatccttgcagtgagtatcttctaatcatgcccttagtaatataagcgttccttgtttcttttcatttttttccttttgcttatttctttgtaatgatgcctgcaggtcctcgccaaaaacaaacttgactgccctgaccttggaacgttgtgcatcaaagatcaaacccttccatctgaaagtaggcctcgttcacttgctttttctttctttattttgtcctgataacccggttgtttgactaaccaaaaactatgtgttcataggtgttgaaaaagtggttggctgggctttcggtcaccatctt

SEQ ID NO: 7770 - DNA, 3000 bp, Unknown
  misc_feature (1)..( 3000): cDNA_ID_1809482_gDNA_ID_1621162_Annot_ID_57138 3000 nt of promoter + ATG
gctatacggatttatttgttagttgttactcctacataactgaaaccaaacatatatttgatgtttaatgcagcctacgaaaggtatactgttgtttggacctcctggtactggaaagacgatgctggcaaaagcagtagcaactgaggctggcgcaaatttcatcaatatctcaatgtccagcattacttcgaaggtaactctcataaagtgatatgatttccttttatgctttcttttaatgattgtacttgaccatttacactaaatgctttgcagtggtttggtgagggagagaagtacgttaaagctgtcttctccttagcgagcaagattgcgccaagtgtcatttttgttgatgaggtatgtttgaagatattaaaaagcgttctctgttctctcccacctttgaagccagtctttttatgtactttctcgatctgatgattgtggaaaatcattattcaggttgatagcatgttgggtagacgtgaaaatccaggggaacatgaagctatgcgtaagatgaagaacgagttcatggtaaactgggatggtttaagaacaaaggatagagaacgggttctggtactcgctgccaccaacagaccatttgacctagacgaagctgttattagacggcttccccggaggtaaaaccaccacttttccctctgttgtctgttagttgtgaagaatattgcaaccattgttgatcctctcctgcatactacttctgtgcagattgatggttaatcttccagatgcaacgaacagatcaaagatcttgagcgttattctagcaaaagaagaaatagcaccagacgtcgatttagaagctatagcaaatatgacagatgggtactcaggaagtgacttaaaggtctcgactttctataaccttccctctcaatctccttcccctgtaaaaaaactcacacacgtattcttttttggttgcagaatctgtgtgtgaccgcagcacattttccaatccgagaaatactggagaaagaaaagaaggtttggtttctgtttaatgcgattgcttctcgaatcctgaagtccatttacattactcgcataactcattctttttattattctggctgttgttttgactacaggagaaaactgcagctcaggctgagaaccgtcccacaccgccattgtatagctgcacagatgttcgttccctgacaatgaacgatttcaaggctgcccatgatcaggtaagtcaagacaaagaagccaatgagtttcacatatgtgataataactttgaaaagaaagctaaatgatcagaaacatgtaggtatgcgcaagtgtgtcttcagactcgtcgaacatgaacgaacttcagcaatggaacgagctgtatggtgaaggaggatcgaggaagaagacgtcgttgagctacttcatgtagaagagagacaaaagagagagggagggagatttgttcgtttttgatctctctcgtgttcggtttttttttttgaatctcattttggtcgtttaatttataaatttgtgtacagagagaaagggtgttgttcgttttgctgtctaattcattttctttctcaacataagatgaaaaaaacattcgctgtataatctaatacatgcgtatgtatatagaggctcggatcttttaaggataaggacataattctaaatcttcaaggtgtgtgctttgagagtctttagaaaactaaatagtgcattattataaacttatgatctgatatgtctatacgtctcgtaaccaaaaccagagtatcgaaactaaagataagaaaacgaaacgaaataaagcaatttaatttacttaccattgcacaaaggcaagaagtgtttggtgccaaatgacgggtataacattcgtctccttatgaaatctaaagaagtgagtggtaaccgcatcaatcgcccgatacgccattgcatatctcttctccagaataactttgatgaagaaactgcatccacacacacaaaaacagaatgcaaccaaataaagacacacaatacctatatgtgtaagtgtaaggttagcctgcgttttaccttgttcggccataaaaattccaactccgccaaacttagcaaagcagcactgcagttcataacattagcactgcgttttattcacgcttaataacattagagagacgtttagctattgaagctccatccttggaaagcaaggcatcaagtaacttgtcttcttcctcagtggccatatcctggtaattaagttggatctgaaactcttgagattgctcatcaacatcatcatcatcaatcaaatatcttccaatccatacactgccttcttaataaaggcagtcattgggattttctgacttctatttgctgctcataggctagcttaaggatcttcggcgttagtttcacaaatccatagaatttagaaaccctatcaattccaaaatctacaaaaaggttttaaaatttcccactcaccttcctgaggaggaggctacgacgcgaatagctttacgtttccacttaatcgccattggatatagtcaagaagtagagactatgtgagattgagggaacgcaatttagcatatgaagaagaaaccctacttgactttagccctaaaatctattacgtgacccaagcggctacttgtacatctgtcataacgggcagaatattttggtctaagcccaatgagctaatatgggctttaaatcttaagtccattaacatcaaattcaatttgttcaaacgcgaaacgcaaatcgcattgtgcagctgcgtcccagtgttgaaactcttcgaactcccaaaacgcaaaagcttcgtcttcttcttcatccttgtctcaccttcgattttggcggcaaaacataaaccctaagggttttctcactctctctctctcttctcacacacacagtcccagagtacggtggtgttgattcgattgaggagattcatctgtttatagggtttagcaa

SEQ ID NO: 7771 - DNA, 3000 bp, Unknown
  misc_feature (1)..( 3000): cDNA_ID_1838830_gDNA_ID_1621162_Annot_ID_57139 3000 nt of promoter + ATG
ttctcctggaacacaagctgataatgttgaaagacatgagagagtaagtaggctattgtagttaaaaaaatgtcttagtaggatgctaattgtttgtggctatttcttttgttagtttatctcctaaaattactgttattcaaccactatatcatctacaggaacatgaaaagcctataaggtttgaagaaccaacatcagataacacactcaccaagggggatgtggaaagggtttcagaggacaatccacggtgcagtcagccactgcgatctgtggccacagtgctggattccccagctcagtcaaccggtcctaaaatgttttccacattagaatttagtttccaaaacctcaggacaaggaggttagagaggctgtcgagattgcagtccacaggttatgtatctaaatgtatgaatacgccacagcctaaaaagtaagatttctttccttcttcttttgtgtagtgtgtttctatttgcatttagagaaatgggattctttaaaatgacaactacgtctacaggtgctttgccgctgcaacattagagttatctcaaccggatgatgaagagcgaaaagcaagggctttagctgcagctacttctgagctggaaaggctttttcgaaaagaggatttcaggagaatgcaggttgctatctttttgactaagcgagcaccgaaagattgatagattaaaaaaatttcattctactctatcctggctcggtcgagaaatatatttatctgttttttctgtgtgataggtactcgggcaattcaatcttgggttcatcattgcaaaattggagcgagatctgttcattgtggatcaggtgagtcttcatatatgcatgcttccagagcccttttttcctccttcgatttgtttagttattggttgagttgtggaaaatggaagtttctatcatttcagagttcttccctagtctgatttttgaagaaatggtatagactagtgattgaattttatggccagcatgcagctgatgagaaattcaacttcgaacatttagcaaggtcaactgtcctgaaccagcaacccttactccagtgagtttctttgtgagatcaatctagattcttgatttcattacactgctttcactttttcacatcaaattccccggcggcattcttttatgtcccatgttactttagctatacttgaaccagtagtaatacctcttttccactactctatatgttacccatatttatctatttttttcctaaactcaggcctttgaacttggaactctctccagaagaagaagtaactgtgttaatgcacatggatattatcaggtgaaggatcaccattacttcttttgtaacattttcttattcttgctatcggtttggagattcaataatgtaacaactttccagggaaaatggctttcttctagaggagaatccaagtgctcctcccggaaaacactttagactacgagccattccttatagcaagaatatcacctttggagtcgaaggtagtttttctgtacctctgctgcatcaaatgtcttttgcattacatgttaatatttactttattgttttgggcagatcttaaagacctgatctcaactctaggagataaccatggggaatgttcggttgctagtagctacaaaaccagcaaaacagattcgatttgtccatcacgagtccgtgcaatgctagcatcccgagcatgcagatcatctgtgatgatcggagatccactcagaaaaaacgaaatgcagaaggtaaccaatgcttaccctaagataaacaacaatgtcccttgatagctaacgatggaatccatctctattaaattcaacttgaattgtaaaacacattcttctgcatatgttaacgcttttgtcatttgggttttggtcagatagtagaacacttggcagatctcgaatctccttggaattgcccacacggacgaccaacaatgcgtcatcttgtggacttgacaactttactcacattacctgatgacgacaatgtcaatgatgatgatgatgatgatgcaaccatctcattggcatgaacactcaaaagtcttaacgtatttagatgtgagaatccttaagattaacattgaggaacactcggttataactacaatcgtaaatgtaaattgtcttagtctatatgatctttttggtcacaacaggtaatttcattttcctttgattacttctcgtgaaaaaacaaattaacagttgtggttttccattgatttcaaaaattatctcaaattttggctaaaaaaagaaaaagaaaagagagatgcttcagaatcagaagagaacagtccacttaaaagtcttaaaccctaaaatgaaatccttccatctaaaacgcagtaaacgtcaccgtttgattcttcgtgacccacctaactacgatacactagcttgtagaggataaatgctccgagccctataaacacaaactatgtggagctactaaaggagaagtctttctctctcgatcaagccaagtaaaaaaaaaatcctaatctttgcgtcaccgttcgtgtttcctcttctctctagggttctccttcaacagttttccagtaaacatgaggtaacaaataagaaatcctttttctcttctctctagggatctttacctaaactcttcccttcgataaatcgtgcttctcagattcatttcgtgcttttgttgctttgttcacttcaatttttcatttttactcatgggtttctctgggaatcttggtttcttttttcaatcggttgatttagtgctacgctttcattggattcctgatgactgctgaaaaaaattttagggttttaaattggggttagggtttattgtgttgggtaccggaatttctctgtacattatagccagcaattgtttctgaatatatctgcatcaatctcttcttgtttagacctgaatcttagagcagttggatttagggtttagggttt

SEQ ID NO: 7772 - DNA, 3000 bp, Unknown
  misc_feature (1)..( 3000): cDNA_ID_1809467_gDNA_ID_1621162_Annot_ID_57144 3000 nt of promoter + ATG
acaaagaattattggtctgacagaaaggagtttatcccacatcccaagtcctatacatggctcgaaatggattacggaaaagaggaaaatgattcaccggtgagtgttttggaatcctcacttctctttctcttcttactatttgttgtgtggtatgatccaagggatctgctggaatgaggtttttgagtgcatatctacttttctttttcccgtttaattgcaattatatattttttttctcttcgttcaaatgtgcactttactcagagttcacgattgttttttttctcaggtcaataatgatattccgagttcatcttccgaagttaaacctgaacaatcaaaactagatactcgggttgccaagttcatctctcttatatgtaatgtcagcatgatggcacagcatatgatggaaataggtttgagtctaactttgatcacttcattcaagtgagagcatccattggcagattaacagtgatttttatatgtcgatacattatctctttgttttggtgtcctattacctgcgtttgtacttcctatcttttgtcctatccatttgtttgccattttgctggtttctttacttcttgctgatttttcatacatcttctaaatttggaattgaaggatataacgctaacaaattgccactcggcaagataagcaagtccacaatttcaaaggtaaagatagtaaacagtctgtttggtctcatttccgtaaattatagtttggtgtgatttcagatgatataatctcctcttccacatgtctagggttatgaagtgctgaagagaatatcggaggtgattgatcggtatgatagaacgaggcttgaggaactgagtgggtatgtatctggttaattgctagacaatttttcgcatttagttgattatgtaactgtttcccataaagaaattagatttgaactagtctaactttgtttatcattgatgcagagagttctacacagtgatacctcatgattttggttttaagaaaatgagtaagttcatctgtgctaaggtttacgatatatataactaaacattcactaacatctgaattccgagctgtaacaggccagtttgttatagacactcctcaaaagttgaaacagaaaattgaaatggtaatttttcctactgtttccttacttgactagttttggtcttcagaaaagcaatggtttgtcgctacatgttttgtgtagtttttaatatatcgtttttttgtaaggttgaagcattaggtgagattgaactcgcaacaaagttgttgtccgtcgacccgggattgcaggtaattcagtcagtctatgtggtttgaaggcatgaaatcactccgtcgtatagttctctaagaatatgacattattttttgcaatggctgtaggatgatcctttatattatcactaccagcaacttaattgtggtttgacgccagtaggaaatgattcagaggagttctctatggtaaattttcggttttgtgaactttgaacaaatatctttgatactcgagcatctcaaacatgtctgtgttttaaaccttttggtgtttactccttaaaaccaaaatcaggttgctaattacatggagaacactcatgcaaagacgcattcgggatatacggttgagattgctcaactatttagagcttcgagagctgttgaagctgatcgattccaacaggtatgttatggtatttcgagcttgtcagtaccatacacattattctgatttctcgtttttggcattgtgagactttaatttttcttggcagttttcaagttcgaagaacaggatgctactctggcacggttcacgtctcactaactgggctggtattttatctcaaggtaacatgttactctttttcctcttagtaactactttttttcttctcctcttgggggattttcaattgcatagtaaaatgaacaactatgagacaccaagcaggtctgcgaatagctcctcctgaagcgcctgtaactggttacatgtttggaaaaggggtttactttgcggatatgttctccaagagtgcgaactattgctatgccaacactggcgctaatgatggcgttctgctcctctgcgaggtatactcgcttcttgtctctattcatatagaaaacaacaaaactactgtataactacaggacctctatagccattcaacataactatccttatgtttcctaacgataaaaacttctctaggttgctttgggagacatgaatgaacttctgtattcagattataacgcggataatctacccccgggaaagctaaggtatgaagataatctcattcatatttcacacaagttccttatctcaaaccgcaatgaattatgatttactatttttgtactgtaccttgatttgttatttgatggttgcagcacaaaaggtgtggggaaaacagcaccaaacccatcagaggctcaaacactagaagacggtgttgttgttccacttggcaaaccagtggaacgttcatgctccaaggtttttgtttttgtcttgcttcaacacacattcacaaaatctaactctctcaaatttcataaactgactttatataacttttgcaggggatgttgttgtacaacgaatatatagtctacaatgtggaacaaatcaagatgcgttatgtgatccaagtcaaattcaactacaagcactaaaacttatgtatattagcttttgaacatcaactaattatccaaaaatcagcgttttattgtatttctttcaaactccttcatctctgattttgcacggttcactcgtatattggtacgctaaaccgcaaaccatacccaattttatccggtttagttggtatgattgagaaattcttattctctgaaactcgattttattagtatttaagcgaaagagaagaaaccctacgaaaatctcaatcggaaactaaacggcaaaaaaaaaaaaaagcagaggcagccatg

SEQ ID NO: 7773 - DNA, 3000 bp, Unknown
  misc_feature (1)..( 3000): cDNA_ID_1809463_gDNA_ID_1621162_Annot_ID_57145 3000 nt of promoter + ATG
attctggcctttgagtcttttgacccataattagctttgctttttttatataattaaagtcaaaattggactttttttttttgtttaaatatagttagattttaaatgtgtgatttacaaggggaaattaatgttttatgtcaaacaaaaaaaatcaatgatttatttgaaaaatgcaaactttcagagttattatccaatatttttagttgaataatattttttctgttctttattatttaattttttagaaaaaaatttgtttcaaaaagttaatttttaaaaagtttttatgcattatttattagttattattgataatttgtaaactttaagataaataattgaatattattagtttaaagttataaaaaaatataaattacaaaaattaatatatttatgattagttttaatatatttttttaatctgtgtttttttttagaaaattaattataaatttaatacgatttaaataattcggttatattttgaaaattgtaaaattaaatcttagtaaaaccgttgaaaatttgtgtttcaacttattttccattactttctaattataacgtattacaaaaaaaaaattgtattatacgaacggttcaatgattgatgctcatctactataagtagacgtgtgtaaagtaggcaaagtgaggttcgaattataaaatgtgtttaagcatgtcaagatgccatttgttaaaagtttattgactaacttgcgtgtactagccgtccatctacaatacaaaaatatgttatagcctacaataaatgatagtatgaaaaattaaatagcactatgatattttgaggcggtggagtttctattgattggttatcgatgaccacttgcatcgtcaaatggttctttgattcgtggtttcggccccagcttcatactatcacgagactcgaccatcttgtttttttcttcttcttcttggtaaatggtttcacaacttggttcctctttctttcattttattttatatactatcatagcattttggttggatttctcgagatagtatattttttagttactatcattacataagtatattttaaaaaactaattatatgaattatgtagctaactagatagataatcgtataaccaattcatgttagtatagtatagtttaagtatgtattttgggattacaagtgtggttggcatcaagacaaggatggtgatagcctttctctgtaatttggtttaagaaaagtttttgcattttatgtataaacgtgttttttttttataatttaaaatttcaacaaaaaacaattttttttaataatgattgaccactatagacaatttaaatgataaaaaaaacccccaatttttcacaatgttttggagattagtctagattttttgtccaaattttccgattgtaagaattaagaagcaatgaacatttgtgttaagcttaatgatttgtactcacaatatcttttaaatttaaaattgttaaccaaaatatcctatatattgtacttgtaatagaaatataaactattaaaaacaacactttattcatataatataagttaaaacatatgttttttttagtatgttctaatcacacctattaaaaaaagttgaagctaaatgagccaaaaagaaaaataaagataggggatggggacaggctgtaatgttaggcggttggtatatgaactgagaacatgtctgttggttcggtccatctacaccactcaaccatttggctatgttttctttttggcttttgcatgttctctctacttttcttctttggtcaaaatctctatctcgtcttttacatggcttacccgaatgttagttgtcatgtaaatttggttatgaaaagatattttatataaactttatcgtatattaatatcgttatcatctaaccattttttaaaactaaactagaaccatccagttttacaagagtttttttttttttttttctaactaaataatatttgaagtgtacaatattaacaatatatgggccaaataatagtggaaaccaaatcgttagtcccactttatgatgggcctgttgattcttatgtcttcttcgtaagttgtgattatgcagattacgggctaataaacatgcatgtttagtttttactgtccaagtaacgaaattttatcttttgggttgttggcccatttcatatattccaaatgccaaatccagcccggctcgacacagcactgctcggctcaacactcgtatgcggttggtagccacttaagaccttggtttgattaacatgttacgaataatttgtgtccctttttcttcaaggagactaatctcttttaataaaaaagaattgtgtcattagtcaacacaagtcctataatccgtttacggtaatttgtatgcacgtccttggaaaagtgagtagtggcgtagcattacagccaaaaactatttgtatatttttcttttcgttaaacaaccagcaaaattttcagaaaaatgttcttaaattataaattagtagtacattttaaaacatagagattttttgtttcttttaatagaagagttaaacctatgtacaaaatttcaactccttttcaaagtatttgcctgttactagatttttaacctttttttttttatctttcatgattttctattgcttgccatcatcaatggtaggaaataaatactattttaaaaaggtcaggggtggatttaagaatcaatccaaaagtttggggtcttttggagattaaaaagttatatgggaaatatccacaaatatgaacgagaacttttgtcaaaaaaatttaaaataatttttcaaaaagccctaaagctttcaagggaagccatcgatgaagaagaaaacgaagaagaagactcttcaaatgctcgcgcgaactcacttctgacgaaaaccatacttcctcagtctcattccctttccgacgaactattctcctgaagaagaagacgaaaatg

SEQ ID NO: 7774 - DNA, 3000 bp, Unknown
  misc_feature (1)..( 3000): cDNA_ID_1809460_gDNA_ID_1621162_Annot_ID_57146 3000 nt of promoter + ATG
ggagttcgtcgactttgagcttgttcgccattttcgtcttcttcttcaggagaatagttcgtcggaaagggaatgagactgaggaagtatggttttcgtcagaagtgagttcgcgcgagcatttgaagagtcttcttcttcgttttcttcttcatcgatggcttcccttgaaagctttagggctttttgaaaaattattttaaatttttttgacaaaagttctcgttcatatttgtggatatttcccatataactttttaatctccaaaagaccccaaacttttggattgattcttaaatccacccctgacctttttaaaatagtatttatttcctaccattgatgatggcaagcaatagaaaatcatgaaagataaaaaaaaaaaggttaaaaatctagtaacaggcaaatactttgaaaaggagttgaaattttgtacataggtttaactcttctattaaaagaaacaaaaaatctctatgttttaaaatgtactactaatttataatttaagaacatttttctgaaaattttgctggttgtttaacgaaaagaaaaatatacaaatagtttttggctgtaatgctacgccactactcacttttccaaggacgtgcatacaaattaccgtaaacggattataggacttgtgttgactaatgacacaattcttttttattaaaagagattagtctccttgaagaaaaagggacacaaattattcgtaacatgttaatcaaaccaaggtcttaagtggctaccaaccgcatacgagtgttgagccgagcagtgctgtgtcgagccgggctggatttggcatttggaatatatgaaatgggccaacaacccaaaagataaaatttcgttacttggacagtaaaaactaaacatgcatgtttattagcccgtaatctgcataatcacaacttacgaagaagacataagaatcaacaggcccatcataaagtgggactaacgatttggtttccactattatttggcccatatattgttaatattgtacacttcaaatattatttagttagaaaaaaaaaaaaaaaaactcttgtaaaactggatggttctagtttagttttaaaaaatggttagatgataacgatattaatatacgataaagtttatataaaatatcttttcataaccaaatttacatgacaactaacattcgggtaagccatgtaaaagacgagatagagattttgaccaaagaagaaaagtagagagaacatgcaaaagccaaaaagaaaacatagccaaatggttgagtggtgtagatggaccgaaccaacagacatgttctcagttcatataccaaccgcctaacattacagcctgtccccatcccctatctttatttttctttttggctcatttagcttcaactttttttaataggtgtgattagaacatactaaaaaaaacatatgttttaacttatattatatgaataaagtgttgtttttaatagtttatatttctattacaagtacaatatataggatattttggttaacaattttaaatttaaaagatattgtgagtacaaatcattaagcttaacacaaatgttcattgcttcttaattcttacaatcggaaaatttggacaaaaaatctagactaatctccaaaacattgtgaaaaattgggggttttttttatcatttaaattgtctatagtggtcaatcattattaaaaaaaattgttttttgttgaaattttaaattataaaaaaaaaacacgtttatacataaaatgcaaaaacttttcttaaaccaaattacagagaaaggctatcaccatccttgtcttgatgccaaccacacttgtaatcccaaaatacatacttaaactatactatactaacatgaattggttatacgattatctatctagttagctacataattcatataattagttttttaaaatatacttatgtaatgatagtaactaaaaaatatactatctcgagaaatccaaccaaaatgctatgatagtatataaaataaaatgaaagaaagaggaaccaagttgtgaaaccatttaccaagaagaagaagaaaaaaacaagatggtcgagtctcgtgatagtatgaagctggggccgaaaccacgaatcaaagaaccatttgacgatgcaagtggtcatcgataaccaatcaatagaaactccaccgcctcaaaatatcatagtgctatttaatttttcatactatcatttattgtaggctataacatatttttgtattgtagatggacggctagtacacgcaagttagtcaataaacttttaacaaatggcatcttgacatgcttaaacacattttataattcgaacctcactttgcctactttacacacgtctacttatagtagatgagcatcaatcattgaaccgttcgtataatacaattttttttttgtaatacgttataattagaaagtaatggaaaataagttgaaacacaaattttcaacggttttactaagatttaattttacaattttcaaaatataaccgaattatttaaatcgtattaaatttataattaattttctaaaaaaaaacacagattaaaaaaatatattaaaactaatcataaatatattaatttttgtaatttatatttttttataactttaaactaataatattcaattatttatcttaaagtttacaaattatcaataataactaataaataatgcataaaaactttttaaaaattaactttttgaaacaaatttttttctaaaaaattaaataataaagaacagaaaaaatattattcaactaaaaatattggataataactctgaaagtttgcatttttcaaataaatcattgattttttttgtttgacataaaacattaatttccccttgtaaatcacacatttaaaatctaactatatttaaacaaaaaaaaaaagtccaattttgactttaattatataaaaaaagcaaagctaatt

SEQ ID NO: 7775 - DNA, 3000 bp, Unknown
  misc_feature (1)..( 3000): cDNA_ID_1809512_gDNA_ID_1621162_Annot_ID_173737 3000 nt of promoter + ATG
aatgcgttagttgagagtatctataaataattgaccctttttcattttaggataatgttttaatttaaataagttataccaatctaaaatcagcaaaaagaaaacaaaacatactataataaaattttcggaaacacaaataccatgaacatgcaagtgcaactaaacaaatgttttattatattaagttaacgtcacagtcaagtctttgggtcagaatccatcgttctcggacagtctgcgtttttaccgtttacgcattttccatagcattccatagtctttgggtcagaatccatcgttaccgtttacctatattaagtttactgtattctccaaccaacaccatattttattaaaaaaaaatttatttacatatattacaaaaccatattaaaaattaaatataaatatattacttttttgttaaaaaaaaataatatatatattacttttgtgatatataattttttataattctaaccaatagtattcaataaatttttgtgaagtttacaattctttaagaataactaataaatattgataaaagtactgtacttatctttttgaaacaacaaaattcctaaaaaaacaatactgtaacaaggagcagaaaagtattatattaaatcaaatactaacaaaataatagctagtatttgataactagtttgtttagtaatacaaacaaaaaaatgttaaatgaaatgcaaaactctttaccattttacgatttttgaaacaaactttttttttactataaaatacaatactgtaacaaaaacaaagggagtattatattgaatcaaaatacaaacaaaataatagctagtctttgataactagttagtaacacaaacaaaaaagtgtaaaaccaactgcaaaattctttacgattttaaatgcaacatcttaaggtggaccatgatggatgattcatgagtcttgactcttcttgaggctcaattatttgggcgtgttgaccaaaaaattgttccattgaaacaattttttctatatcctcatcaaatacatttttaaaatatgttgacaaaaaaaaaaagagaaaaatgcgtactataaatttatgagatctcagtctattaaacaaagaaaaatgttacatctccaactttacaaaaagctgattttatttcttctcatatttttctactggaaatgcaggtgtgttaatgataagtatgtgtagtaaaaattcaaacacaaaaatgatttatgataatgcattgtagattcacatattataaaggtgtaataattgaacaaattaggctcaatcctagtaacggaagcacttgctcttcgcaatgcccttaaaatggcagccgatcaatcggatatagcctctttcacggtattgttggactctcaagtcttgatctcacttatcaatgctaagaaatatctttcaaatctcaaagaaaatcatccatgatattgcttcgttttgtaattctttcgcttctatctctattgcttatgtcccaaagtcgtccaatactttagccgactccttagttaagtcagtccttgtggcttttacttcctcctcccctccaagaatgtaacactctctgtcttttagcaatgcaagttcggtttgaacaaaaacaaattatcacaaaatgccaaaaaatgaaagacaattaatttataattaggctcataagtcaaatagccaataacttgccccatacctaagatagttactttaggcgaaacgacggagaatttaaggacaattgactatagaaaagactctatattatactattcacagtgtcccaaatatatataaattgcctaacacattgccaccgtcgttgacaagttttcttagattcaaaatttagtacatagtatatattatataatttataaacctaagaaatgaaggaaggtggatcttaatatgtataattaatagaggcaagacatgaaggaagatggatctttaccaaaaacagctgggcagctttgaaaatgcaatgttcgatgataataatatctcaataacaaacaacgcgtttttatctcagaagactccaatatattgacttggaaccactaaaagtcgcattattattgttttgttatatatatatataatcccaaaaagtaaacaaacaaaaaataaaatacaaactattgcggaacaatacaatatatatatatatatatatgtaattcttattgattcaattttgaaagaaatttctttgtctatatattattttgatgtttttgtgtttaacctcatgaatagagagataattctccggcttggtaaacaaatacgttggattgtttttttacaaacaaaatctcaatatatttctaactttagccctacgaaccaaactacaggtcaataaacgacgtgaaatcaagctaaatggcaaattattagaattagtccgaataataaacaaattcgtctaaaattgtagaaaattttgggatctaagaatgagactacatcatttttttttatcaacaactacatcattttaaaccaaacttagaattgttaggtctcaaacttctaacaccgatttgctgcaaaaacaattatggatcggatcaagatatagagaggatttcacatttgacttctattgcttactcattccaaaagacggtttggtctagtttttgaaatttaaccaatcttgaaaatacggaatttgtaatgtactttacaaaaattgtatatgctaattataattttgtgatctcaaatattcatgtttatatgataagataagagataacatgaatgcattattatataataccatagaagatagaatgtatacagtctcaaaataacaaaatttaatacggacccacatcccaaacctctcccactctatatatttggtctctataaaacccactaaacctaaacttttccaaaatcataccaaaaaaacatttagtaacatcaaaatttacaaaaaacaaaaaaacatg

SEQ ID NO: 7776 - DNA, 3000 bp, Unknown
  misc_feature (1)..( 3000): cDNA_ID_1809460_gDNA_ID_1621162_Annot_ID_173732 3000 nt of promoter + ATG
ttatttcctaccattgatgatggcaagcaatagaaaatcatgaaagataaaaaaaaaaaggttaaaaatctagtaacaggcaaatactttgaaaaggagttgaaattttgtacataggtttaactcttctattaaaagaaacaaaaaatctctatgttttaaaatgtactactaatttataatttaagaacatttttctgaaaattttgctggttgtttaacgaaaagaaaaatatacaaatagtttttggctgtaatgctacgccactactcacttttccaaggacgtgcatacaaattaccgtaaacggattataggacttgtgttgactaatgacacaattcttttttattaaaagagattagtctccttgaagaaaaagggacacaaattattcgtaacatgttaatcaaaccaaggtcttaagtggctaccaaccgcatacgagtgttgagccgagcagtgctgtgtcgagccgggctggatttggcatttggaatatatgaaatgggccaacaacccaaaagataaaatttcgttacttggacagtaaaaactaaacatgcatgtttattagcccgtaatctgcataatcacaacttacgaagaagacataagaatcaacaggcccatcataaagtgggactaacgatttggtttccactattatttggcccatatattgttaatattgtacacttcaaatattatttagttagaaaaaaaaaaaaaaaaactcttgtaaaactggatggttctagtttagttttaaaaaatggttagatgataacgatattaatatacgataaagtttatataaaatatcttttcataaccaaatttacatgacaactaacattcgggtaagccatgtaaaagacgagatagagattttgaccaaagaagaaaagtagagagaacatgcaaaagccaaaaagaaaacatagccaaatggttgagtggtgtagatggaccgaaccaacagacatgttctcagttcatataccaaccgcctaacattacagcctgtccccatcccctatctttatttttctttttggctcatttagcttcaactttttttaataggtgtgattagaacatactaaaaaaaacatatgttttaacttatattatatgaataaagtgttgtttttaatagtttatatttctattacaagtacaatatataggatattttggttaacaattttaaatttaaaagatattgtgagtacaaatcattaagcttaacacaaatgttcattgcttcttaattcttacaatcggaaaatttggacaaaaaatctagactaatctccaaaacattgtgaaaaattgggggttttttttatcatttaaattgtctatagtggtcaatcattattaaaaaaaattgttttttgttgaaattttaaattataaaaaaaaaacacgtttatacataaaatgcaaaaacttttcttaaaccaaattacagagaaaggctatcaccatccttgtcttgatgccaaccacacttgtaatcccaaaatacatacttaaactatactatactaacatgaattggttatacgattatctatctagttagctacataattcatataattagttttttaaaatatacttatgtaatgatagtaactaaaaaatatactatctcgagaaatccaaccaaaatgctatgatagtatataaaataaaatgaaagaaagaggaaccaagttgtgaaaccatttaccaagaagaagaagaaaaaaacaagatggtcgagtctcgtgatagtatgaagctggggccgaaaccacgaatcaaagaaccatttgacgatgcaagtggtcatcgataaccaatcaatagaaactccaccgcctcaaaatatcatagtgctatttaatttttcatactatcatttattgtaggctataacatatttttgtattgtagatggacggctagtacacgcaagttagtcaataaacttttaacaaatggcatcttgacatgcttaaacacattttataattcgaacctcactttgcctactttacacacgtctacttatagtagatgagcatcaatcattgaaccgttcgtataatacaattttttttttgtaatacgttataattagaaagtaatggaaaataagttgaaacacaaattttcaacggttttactaagatttaattttacaattttcaaaatataaccgaattatttaaatcgtattaaatttataattaattttctaaaaaaaaacacagattaaaaaaatatattaaaactaatcataaatatattaatttttgtaatttatatttttttataactttaaactaataatattcaattatttatcttaaagtttacaaattatcaataataactaataaataatgcataaaaactttttaaaaattaactttttgaaacaaatttttttctaaaaaattaaataataaagaacagaaaaaatattattcaactaaaaatattggataataactctgaaagtttgcatttttcaaataaatcattgattttttttgtttgacataaaacattaatttccccttgtaaatcacacatttaaaatctaactatatttaaacaaaaaaaaaaagtccaattttgactttaattatataaaaaaagcaaagctaattatgggtcaaaagactcaaaggccagaattgacgcagccgtttatgagaagtgagaagacaatttcggagtcacttcctttatttcctctcttccttcactctctcctatataaaccttcctctcctcttcctctcttctcatctcttcaaaccattttcgaaagccttgagagagagaacacagacgataccaactttcttcaatctcgttgccgcagtataattatctcattcctcggatatatctctccttctgcggcggcgacaagaagctacaagaataaaaagtctgttttctctcttttcaagaaaccacttacttcgaaa

SEQ ID NO: 7777 - DNA, 3000 bp, Unknown; identical to SEQ ID NO: 7772
  misc_feature (1)..( 3000): cDNA_ID_3091656_gDNA_ID_1621162_Annot_ID_173730 3000 nt of promoter + ATG

SEQ ID NO: 7778 - DNA, 3000 bp, Unknown
  misc_feature (1)..( 3000): cDNA_ID_3046694_gDNA_ID_1621162_Annot_ID_173724 3000 nt of promoter + ATG
cgaagaaaggggaaggttctttatcagtccatgatgtaactcaccttgacaagacacctagcaaaggtttgcctcagttaaatgtgactgagaaagttactgatgcaagtaaagacttgagcagccgctctagctttgcccagtcaactttgaatacttttgttaccatgggaaaaagaaaacatgaaaacataagcaccatcctctctgaaacacctgtcctcagaaaccaaacttctagttatcgtgtggagaaaagcaaatttgaagttcgtgccttagcttcaaggtgtctcgtggaaggcgatcaacttgatgatatggtcatctcaaaggaagatatgacaccaagcgaaagagattctgaactaggcaatcggatttctcctggaacacaagctgataatgttgaaagacatgagagagtaagtaggctattgtagttaaaaaaatgtcttagtaggatgctaattgtttgtggctatttcttttgttagtttatctcctaaaattactgttattcaaccactatatcatctacaggaacatgaaaagcctataaggtttgaagaaccaacatcagataacacactcaccaagggggatgtggaaagggtttcagaggacaatccacggtgcagtcagccactgcgatctgtggccacagtgctggattccccagctcagtcaaccggtcctaaaatgttttccacattagaatttagtttccaaaacctcaggacaaggaggttagagaggctgtcgagattgcagtccacaggttatgtatctaaatgtatgaatacgccacagcctaaaaagtaagatttctttccttcttcttttgtgtagtgtgtttctatttgcatttagagaaatgggattctttaaaatgacaactacgtctacaggtgctttgccgctgcaacattagagttatctcaaccggatgatgaagagcgaaaagcaagggctttagctgcagctacttctgagctggaaaggctttttcgaaaagaggatttcaggagaatgcaggttgctatctttttgactaagcgagcaccgaaagattgatagattaaaaaaatttcattctactctatcctggctcggtcgagaaatatatttatctgttttttctgtgtgataggtactcgggcaattcaatcttgggttcatcattgcaaaattggagcgagatctgttcattgtggatcaggtgagtcttcatatatgcatgcttccagagcccttttttcctccttcgatttgtttagttattggttgagttgtggaaaatggaagtttctatcatttcagagttcttccctagtctgatttttgaagaaatggtatagactagtgattgaattttatggccagcatgcagctgatgagaaattcaacttcgaacatttagcaaggtcaactgtcctgaaccagcaacccttactccagtgagtttctttgtgagatcaatctagattcttgatttcattacactgctttcactttttcacatcaaattccccggcggcattcttttatgtcccatgttactttagctatacttgaaccagtagtaatacctcttttccactactctatatgttacccatatttatctatttttttcctaaactcaggcctttgaacttggaactctctccagaagaagaagtaactgtgttaatgcacatggatattatcaggtgaaggatcaccattacttcttttgtaacattttcttattcttgctatcggtttggagattcaataatgtaacaactttccagggaaaatggctttcttctagaggagaatccaagtgctcctcccggaaaacactttagactacgagccattccttatagcaagaatatcacctttggagtcgaaggtagtttttctgtacctctgctgcatcaaatgtcttttgcattacatgttaatatttactttattgttttgggcagatcttaaagacctgatctcaactctaggagataaccatggggaatgttcggttgctagtagctacaaaaccagcaaaacagattcgatttgtccatcacgagtccgtgcaatgctagcatcccgagcatgcagatcatctgtgatgatcggagatccactcagaaaaaacgaaatgcagaaggtaaccaatgcttaccctaagataaacaacaatgtcccttgatagctaacgatggaatccatctctattaaattcaacttgaattgtaaaacacattcttctgcatatgttaacgcttttgtcatttgggttttggtcagatagtagaacacttggcagatctcgaatctccttggaattgcccacacggacgaccaacaatgcgtcatcttgtggacttgacaactttactcacattacctgatgacgacaatgtcaatgatgatgatgatgatgatgcaaccatctcattggcatgaacactcaaaagtcttaacgtatttagatgtgagaatccttaagattaacattgaggaacactcggttataactacaatcgtaaatgtaaattgtcttagtctatatgatctttttggtcacaacaggtaatttcattttcctttgattacttctcgtgaaaaaacaaattaacagttgtggttttccattgatttcaaaaattatctcaaattttggctaaaaaaagaaaaagaaaagagagatgcttcagaatcagaagagaacagtccacttaaaagtcttaaaccctaaaatgaaatccttccatctaaaacgcagtaaacgtcaccgtttgattcttcgtgacccacctaactacgatacactagcttgtagaggataaatgctccgagccctataaacacaaactatgtggagctactaaaggagaagtctttctctctcgatcaagccaagtaaaaaaaaaatcctaatctttgcgtcaccgttcgtgtttcctcttctctctagggttctccttcaacagttttccagtaaac

SEQ ID NO: 7779 - DNA, 3000 bp, Unknown; identical to SEQ ID NO: 7770
  misc_feature (1)..( 3000): cDNA_ID_3091641_gDNA_ID_1621162_Annot_ID_173723 3000 nt of promoter + ATG

SEQ ID NO: 7780 - DNA, 3000 bp, Unknown; identical to SEQ ID NO: 7768
  misc_feature (1)..( 3000): cDNA_ID_3091633_gDNA_ID_1621162_Annot_ID_173721 3000 nt of promoter + ATG

SEQ ID NO: 7781 - DNA, 3000 bp, Unknown
  misc_feature (1)..( 3000): cDNA_ID_3046702_gDNA_ID_1621162_Annot_ID_173718 3000 nt of promoter + ATG
accacaagcacgtatacaagagataaggaggtaagattcttcatctacttgctttttctggagtaattgactcccaactagtagtcaaatcttttttactttaccacattcattttcactcacaatgacgcaaacactatggtcaaactctgttttatcactcctatttttttttttttaagtgtttttttctaacaccccaaaaaagaagcaaatgaagtaaagaaaaagtcacccatttgtattttgatcaaaggtatataataaaatcctcaagaataggtttatcgaaaccaaatcaataatgtttgaccaagaacatgaataaaacaaaacaaaaaacatgaaatcgttgagaatatttttgaaagaagaaaaaaaaataccgaaccgggtagttcgctactactacacaacaacaacaagagcaacatacgtttcgttcgatgaacagaaacactttgggagtatccgttcgtctaaccgtttgttttgtattgggcacgtgttcgcatgaattcagtctcttaatcagtctttttgactatatacatccatgcatgccacatcacgtgaccttttcgtaatttaatttaagtcggttacaatgtgtatgttcatttccttcaaaaggaaacttaaatacataaaacttatatatatatataatattcattgtgttaaaaaaaaactttatataaattcataatatataactctatagaaatgtattaactacaaaatctaggaaataatgtcattttttaaatattgaatatctactaagttatgactttctttgtctaaaaaatgcttcagcttttgaacaaaataataataaagattatactttataacaaagaaaatttgagtcaaattaacagcataatattttgtttttatgattcagcgttttgaatgcaaagaccaaattaccacaagatctctaaacttcaccgactaaaaactaagggtaattaagtcattttacaaaaaagaagaaaaaaagacggagatatataaaaatgtgacacgtttaggcacttttagataatcttattcttttttatgcacttatgagggtgaggacactttttccattatttgactttttttaagacatttttacccctaacttaaacaactacttttattttgaattttaacacaaattaaatattttttctctcttccacgatccttacgcaaaatagaaaaaaagatctctctctctctctctttctctctctcacatttgtagtgcctttctctctccacgtctccataacttctaggtttgattcctcttatcgattatgacggcggctcactaaaaattggtgataacgattctgcaaataaatgggagaagtttcttaaacaattcgatctcgattatctcaggaatttggtaaaaaattttggtatccataataacaagtccatttaaatatatccattcagaaacctttttactgatccatatccaatctatataccatgtcaataataacaagaaattcgattaaccgtggttcgtatagaaaccaaagttccatgtccataagatcttgaaggtggaggtctctccaaactgaaagaaaaatcaacaaataattttttggtatctataataacaagtccatttaaatatatccattcagaaacctttctactgatccgtatccattctatataccatgtcaataataataggagattcgattaaccgtgttttgtaaagaaaccaaagttccatgtccataaggttttgaaggtggaggtctctgcaaactgaaagaaaaatcaacaaacaattttttggtgtccataataacgaatccatttaaatatatccattcggaaacctttttactgatctatatccattttatataacatgtccatgataacaggagattcgattaactgaaatctcgatgctacgtagatgaaacgagtttgacacatgagagagaacaaaaatcaaatcaagccgccattgttgaagatgaagaagtttcttctcattttttacaaagatgaaaagagagagaggtgaagagagagagagatgaagagagagagagatgaagagagagagaaagagagaaaacgtgggttaagagaatattttagttaagagggtattttagtaaaaaaacatagagaaaatgcctaatcttttgaaagtgcctaaaaacggaaataattttaataaaatgtttaagagtgtaatattctctatataaaatcgtaaattttgtatttttaatcatcaattcataaatcttccaaattagaatggggacaatggttctaccatggcagggcttcatatccagggaagtgagcaacttatgtaactcaagaaggaacgagctgactcttggagggttagtgacattctttggtgagaaaattcccagtggtctcaaactcgagaaacagatcgcactcggaaaatgagtcgtcctcgtgggaaatgtaggcaccacacggtcagaagaagactcatcttatgaaggaaacctcgagctcaggcttagggaagctgatttcccaataggccaaaaccaaccgcatatgggagtgtctctaaaaaattcgaaagatgatttaacagtcacagccaatctacgacatcaagtctctgtgggaagacagacaaaggtaacaacttttgtaagtcttgacagcaagaggaccgggtgtttcactgtccgaacaaacagctcagatcagttgcagattgctgtcatggctctgcttctccttgccatgtgatgtcaacctacatgaagatttttcgatcagaggaaagaactgatattaatctttaggattaggttgttttaattacgttcttgccaaatttgatttgattttatggaattaattgtaaaagacttggggctatttatatgaaagtttcgtgattttcattgataagtaggtcgtcaaagaaatagagaagaagcccaaaaaaataaaataatg

SEQ ID NO: 7782 - DNA, 3000 bp, Unknown
  misc_feature (1)..( 3000): cDNA_ID_1809454_gDNA_ID_1621162_Annot_ID_57149 3000 nt of promoter + ATG
tatttgacttactataaagtttttgttctaaagtattactaatttattttttcaataataccacaatttttatataaaatctattcaaccaaaataaatttgaaataaatttaaaatataaaatttggatattctatttctaatttagggtatatatttcaaccatttaaaagaaattttgattcatttgaatattagtttatggtattatatttggtttctaattttcaatttagggtatatatttttactatttttctaaaaaattgactcaatttaatattaaattagtgtttgctcttaattttattttctattttatattttcattaaatttaattaaagtttatagtgttagtttgtgaaattttaaaaatattgtgttgattttggaagaaaacctttttggtgctatatttgtcaatagctctattttatattagtcataaaaaataaaataaaaatatctcaaatattttgactccaaaaatattaaattaatgacatttctttgttcattcacacctgagagtaaagaagtgagaaggagaagaaagaagcaatggagaagatagagcacacgacgatatctaccaatggtattaacatgcatgtggcttcgattggttcaggtccagtgatcctattcgtccatggctttcccgatctctggtactcatggcgtcaccagcttgtctctttcgctgccttaggttaccgcgcaatcgctccagatcttcgaggatacggcgattccgatgcgccgccgtctcgtgaatcttacaccatccttcatatcgtcggagacctcgtcggattactggattcgctcggtgttgatcgggttttcctcgtcggtcacgattggggagcaattgttgcgtggtggctttgtatgatcaggcctgatcgagtcaacgcgttggtcaacactagcgttgtgtttaatccgaggaatccttctgtgaaacctgttgatgcgtttagggctttgttcggcgatgattactacatttgcaggtttcaggtaatactttaaactcatgaacacttaattgaaatgaaaattagggtttggtgaagttctcagtggttgaaatcaaagacatacttagggtttattgatgattactgttcatgatttgatcacgttaatgatagattggttgattatgaacaagagttgtggcaaattgctttatagccaatgcttctttggtgtttagttatgagatcaagttattgaaccgatttgagatagatgtatatttaggcgattgctttttgccatgccttgatactgcttcaagaaagttgagctttttatgtgtaaatgtatacacaatgagaaatttcttagccactattagtttctgtttgtgtctatagaaacagagaccagccacctacctatacatagctgaacttagctcaggctctgactctgataatgcaagttgctattgatgattagaaaaaggcaattagtgcttactttaatatagtgcagtcaaagtcaaagtcatttactttatttgagttacttgctttaagtaaatgtagttggatcagtcttgtggtcttcaattgcttaagttggtcctactaaagattttgagtttcttttttctcaggagcctggagagatcgaagaggactttgctcaagttgatacaaaaaagttaataaccagatttttcacttcgcgtaacccacgtccaccttgcattccaaagtcagttggtttcagaggtttacctgatccaccttctttgcccgcttggctcaccgaacaagatgtcaggttctacggagacaagtttagccaaaaaggcttcaccggtgggctaaactactatcgcgccctgaacctgtaagtcttatgaattctagccacctattctacatcatacaatcatcttttcatggttaatcttggacttgaatcaatctggtcttatcctaacctgcagaagctgggaactaacagctccatggaccggtctacaaatcaaagtccctgtgaaattcatagtgggtgatctagacataacatacaatatccccggaacaaaggaatacatacatgaaggtggtttgaagaagcacgtaccttttctacaagaagtggtggtaatggaaggtgtaggtcacttcctccatcaagagaagcctgacgaggtcactgaccatatctatggcttcttcaagaaattcagaacccgcgaaaccgcatccttgtagtagttctccgtctgcacaatgtcaaattcaaggttgattaagcttgatcagggttacttactgtcttagagccctactatgtaatgttttcaaggatgctatctgtgtattgtgcttgtttaataatttagcaaaatataataatagaacaaataatttctcaaatgttggccatctccagttcaatatatccttaaacttttcttatgtccaaattaattttcaaaatgttgaattcctatggtttctagaaaacttcaattaagcatagatgattttttttaggtgaaattaatatcaaaaaactgaaatatatgtacaattttatcaaaaattataaatctactaaggacatttatacctaccaactgaataaattcaataaaatatataataccaatgttttttttttgtcaacagaattggtgtattaattttttggcagtggatattttcaacaaaatctaaagcgcgttcgaccacgcgcctgtgacgcgtaaaactcagtttgacaaatattcacaattaattgaagacgccagtcagaagaaaaaaccactacgcagcttgaaaagacaaacacaccctcgtcttcttccgtcgcaccgcttctacagcaatgtcattttagtcaaaccccaaaattcgagctccctttgaagaaaaaaccaccaaatcagtttcgttgtcccaaatccaaaattcctccttcttcttcgctgtaacgctttatacctaatcggagataaaacaatg

SEQ ID NO: 7783 - DNA, 3000 bp, Unknown; identical to SEQ ID NO: 7775
  misc_feature (1)..( 3000): cDNA_ID_1809512_gDNA_ID_1621162_Annot_ID_57151 3000 nt of promoter + ATG

SEQ ID NO: 7784 - DNA, 3000 bp, Unknown
  misc_feature (1)..( 3000): cDNA_ID_1828945_gDNA_ID_1621163_Annot_ID_57157 3000 nt of promoter + ATG
actgcaaaatctgtgatattttcgtccacaagaaatgtggcgagtcctccgaatatatcgagcatccatctcaccccaatcacactcttcagcttctaagtactagaggaaatagccatgactgtgatttatgtggaaagaacatcggggatctattctatcgttgtgagatctgtgacttcgacatggatctatactgtgccaagtatccaccaccagaggttattaacatttccaagacgcatcaccacaagctcaaccttctcaaggagctgatccagtttgactgtgatgctaagtgtggcactaatgattaatgggtttccatacaaatgttatgaatgcgatttattcttccacaaagattgcgtatggcatccgccagaggtaaatcacactttagaggtaaaccactcttaccactccttgcaccctcttaagcttcacactggtcaactaccgaattattctgaccgaaaatgtcgtctatgcgcaaaagaaattgaagttggattgttttatcattgttctttgtgtaatttcaccttggatatgtcttgtgttttaaatccaccacaacgatatctttggaatttgaaagctcatgaccaccaactcaccctgctcccaagtctccgttcttttttatgtagtgcttgcggtttgaatggcgaccgaagcccttacatatgtgttcaatgtgactttatgatccatcaagtctgtcttcatcttcctcgtgtcataaacattaatcggcatgatcaccgcgtctctcgaacttctgttcttggtgttgttaattcggtatgtggagtttgtcgccagaaggtggattggacttgtggaggtttttcttgtccgaggtgtcctggctatgccgctcattccctatgtgctactagagaagatgtgtggaacggaaaagaactcgaaggagtacccgaagaaatagaagatatagagccatatgtggtaatagatgacaatacaatacaacatttcagccacaaagagcattacctaagactccacgttaatagtgttctttgtgatgacaacaagcggtgcagcgcatgcacccatccaatctgtctccaatctttctacggttgtatggattgtgacttcattctccaccaaaactgcgctggatttcttagaatgaaatggcatgtgctacacaatgaacgtcttactctagttactaatgagactgaagtctttaagtgttatgcttgtgagagatggtccaatggtttcaggtaccagcaagggtataaatcattcgatgttcggtgcggttcaatttctgagccatttttccatccaagtcatcccgatcatcccttatattgcattttaccttacggaaaaatattctgcaatggttgttacaagttcaaatatggaatgctcgtgtgcgttgaatatgaatgtaatcatttaatatgcttcaattgcgctactctaccaccagtggtaaagcatagagttgacgatcatcctctctcactatgctatggtgaaaaggctagtggtatatgttggtgtgacatttgtgaagccaaagccgatccagagatatggttctacacgtgtaaagaccaacgtgctagtttacatacaagttgtgtgcttggagacttttcagggctcatgccgggaagcacactcaagagtgcgagcaattcatctgaggtgctgctcaacaatattgtatctcgtccattttgcagctttttagagctcatgccgggaagcacgctagagagtgcgggcaaatcagttgaggtggggctcaataaaagtacatctcgtccattttgcatctcgtgtaagttgcattgcatttttcctatcatcttgaaaagacttggaacctcagatgaatacttttgctctattctatgcatctgaaagcaagatgtctagggaatggggttctcttttagatttcttgtaccattataagttgatttccttaatgtattatttatctaagaatcttgcagttttagttcgatatgatctagctgtttcaaacgtgttatgcctttcgttttctattataaaacatcaccttagaaaatgaagaacacactactatcggtcttgtctgttcataaggtatatttaggttacattgtgcataaatgaagaaggatattgcttcataaaagctggagcagcaatctatctatataaaaggaagcaatatccttcttcattttattgtccatctagaagcaatatcctagaacaaacttcgattttggatgttcgttgattagctctgaccgttgactcggatcataagtttatgtagaccttaaggtttcggttttgagctgtgtttagtaaatccacggttgatcttacaaataacaatagatggtcaaattgtagatgttgtagtagtagtagccatttttctttaaaaacttttaaataacaaaactcattctcatcgtttaaaactaaaagacacaaatgaaaattattaatcaattttaaatttagttccaatacaatttttgaattttcggtaggcaaacataattttgttgagttgactccacattctaatttttttttttttttaagaaataacgtgaatttttcttgcgtgttaactcatcttaaaatcattgaaaagtaatactccaagttgaccttaatatacttggcgtcaaaattggcttcattgtgcaagttgttcttttttttttttgtcaaagaattgtgcaagttgtgatcttaataagttgattaggactggcaacttctgtcttatttaagattcattatcataagtgtaaagtaatgaagaagttcacgatagctaggtattatacaagtttaattaatttcgtgtgtgctacttaaagtgctacgaagaaactttgacttttctaatatatatttctctatcttgaatccgattcaagcttgtgaaagtctctctgcaaatcttgttgctctgttgctacaacaatg

SEQ ID NO: 7785 - DNA, 3000 bp, Unknown
  misc_feature (1)..( 3000): cDNA_ID_1809307_gDNA_ID_1621163_Annot_ID_57158 3000 nt of promoter + ATG
atgatgattctgttacacctgatcctaaagaggaagatgatatctcttattgttcactttgtgatttagaggtttgctttcttttcttcactagtatttacattagcaatcacttttatttaaaagctaggacttatttagacgtttctttgtgtgttttgcttaggttaaacgcagcagtaagcattgcaggacatgtaaccggtgtgtcgaagggtttgatcaccattgtagggtaaggttttgggggttctttccacctgaatcttacagtttctgagtttttgaaactgctaatctttgtgtgtatttggtgtattcagtggcttaataactgcgttgggaaaaagaattacacgacgtttatactcctgatggttttcgtcttgcttatggtgtgtgttgctctctcaactacttgaaacgtaaaccttaaaagttcttgttcattgaaacaatgatatagacttgcttttgttgcaacagctaataatagaaggtggaacagctcttgccgtatttgtcagatgttttgtggacaagaaaggaatggaaatggaattgaagagaaggctttatgtagagttccctcaatgggctcttgctacaatatctgtaaagtttcatatacatatgctgcttcctcatgacatctacgtagcttctttttgtttatgagtttatgatgttttgtcctcttacagattatcttggtcttgttcacggcttatggctcagccgccatggggcagcttttcctcttccatgtagttctcataagaaaggtaactcttacaggtgaatgaatttgatttagagttctttatttgacaagtagtatcaaacatttgcaggggatgagaacatatgactacatattagcgatgaaggaggagaatcaatttacagaagtggacccttttgatgaattagattcgtcttcagatgaaagctcagattttgattcgcctgaaagattaagaccaacgtttatctccaagtttatgtgcaggaaagcaaatgaggtgattcaacttctcatttctccttgtattgttgtcacttttaaggactctcaaagattatattttgtgttttaacagaatcagcagagactatccataaaaatagaaggagatgaacagtcaccttcttccacgctgatcaacaagaaaccggggtttcatgtaagcataaacccatggaaactgataacattaagcagtgaaaaggctctacaagcagctgagaaagcaaaggaaagactgaggaagacgaaaccagtttccgggactgaagaaaattcacttaagccacttccattagagaccaaattcggacttttgttagatcctgacaataacaacactgtgttgcaaccatcaacaactgcagcagtaaagcttcaggtttcacctggaagattctcaagcccacgaagaaggttctcaggctcttcatcttcaactgtgccttcgccgaagcaaaaatacagaactaactttgacttgaagctaactgaagtctctagggagctggaaagttacatctcaagacaggttttatgttctgtgataaaacaagatggaagtgaagcatcaccaagataaaaaaaaaaaaaaaaactgtatttttgggtgttgtgcattaactctgttacttactttctggttgtttgttctcagtctctgagaaatatttaagatctgcttaaacttttgcctcctcttgttcaactttataccgagtatatatataaatatgttcatcatgagatgcaaaaatgtggttatttattaaaattaaaaagtaggacataacactctactaatgaacgcataaagaaacgaatggaattttaaactaaaagtttcctaatgaagccataaacttagcatcttcttctgttgtgttttgtacaagtaataaactagcaatctctggatccatctcttgaaacaattcgttgtgagtagtggctgtttcacaaggttgctgctgttctgtggtttgattcatagtcatcaccggaacattgttttgttcctcaagttgttgttgagaagccaagtttccaaccacattgtgttgttgttgagtctccataggaacgactgaaagatcattgttttgatgatatggctgacagcaatgtcgttcatctatggcttgattcatcataactggaagctgtgaagagagatgtgtggcttgtccaataatcttgttttgttgttgctccattgagaagtgttgatcttgatgatccaatatgtattcttcttgaagctccattggaagttgtgagggatctgtgtcttctactaaaccttcaaaatcaatccaagtatggaccagaggttccaatccgctgatgctcccccatggcttgagccgagagtgaaggatcagtctcttgtctacaaaactggttctggttctcagccatgtttccataaccataattctgatgcacaaggttgctgcggttctttatgagtcaagtgtggtggctctttggtttggttcattgtcataaacagaacatcgtcttgttggtacgtctccataggaaccactgaaatatcattgttctgtccaagagactgatgatatagttgaccataatgctcctcctccatggcttgcttcatcttaactgcaagctgtgaagaattaaaaattatggatcatgccgattgtcacactaaagaataaaaaaattgactatttcttacaagttacaagtggttcattttaataatgattagtgatatatatattgtcacttgtcagtatcatactatcattattgttaatgaaatattataagagcatcgttgagatcaacggagaagacttttgacttttgacttttgagagagaaagaaacccgagatttcagatccaacctttttcttcttccaaatcttgaagtatatacttttttagattcaacctattttcttcttcttcaaaatcttgtagtttacgaccatg

SEQ ID NO: 7786 - DNA, 3000 bp, Unknown
  misc_feature (1)..( 3000): cDNA_ID_1809299_gDNA_ID_1621163_Annot_ID_57160 3000 nt of promoter + ATG
atgatgataaccaaattttttgaaatttccttctgtttcattctaaatttcgtttaagaatttttcacagtcaattggtaagagcaaatatattttgaaacgtggtcctggccaaatcaaggatgattacggcttgaaaatttgtattaatacacttttatcttataactaaaaaattaacatgataaagataaatttgaaatttcttttaaatatatgaatgaaatacaaaacatatttaaaaaagaataaaaacgaattattaaaactaacatttattgtgaaacagcaaaaaaagaatttatgcatactatcagaaataattttaaatgaattcatcaaacaaatgttttttttctttataagaatgtaaaatatcattataaaatgaaaagtttaagttattacatgacacataactttaaaaaaaagttgcatgccaaaaaaaggtaaaaaaaacatagaaacataaaccattcgaacctcattctcgttgatcaacaaaattttaaacaattaggctcttagtgcgaagatctaataaagtcaatctaaatactctcctaagtaaacatgagacaaataccaagagcagaaaaagaaacaagaacaaaaggtgaaagacgaaaagcgaagaacataaaaagaaataagaaaaaaaatgtgaaaggcgaaaagcaaagaggaagtcctttcgataatagcccgaaaaacaaatgaaatttctttttatgttctttgacatataattttgtagatacgtttcttttttgctagcacctttctctgaactggatggatacgatctcatatctcaccgatagcacgtttgaccctctctacttcactaacttatgcatgtttcatgtttggaacgaaagaaataacaacattcttctacaactacgtactttacacaattaaccaaccatctcagttataattataagacctcgatttaattttaccaaaagttattgtatttttagtgagtcttgttgtattaatgctctaagaaaaaagttttctccagaataaacaatcaaggagcaaatatttcagcgccaataaatatagtagcctttaggatggtccaaatctggtaaaatatatccttagctaaaatgttgatctaactaaagagatttatatgtcaatttccaaccaaaagatttaggccctgaatggatgctgattttcgattcagtttttggattttgattttagtttctagattttagattttagttttagatttttgttaatatatttttgttttaaaaacttcaaaaaattagtttttagtttttgagaaaaataacgttgatggagtaaaaactagattccctaaattttagaaaaactaaaaaactaaaatcatgaatggaaaattacaacaaaatagtttttcaaattgtagggaaaccaaaattttaaaatcttgattgttatgaaaataagtttttgaaaaacaaaatccaaaaactcttacaaaatctacaaaacattcaagaccttattcttctcaggtttatatcttaaacaaaacaaaatccaaaatgctatttaacaaaacaaacaaacaagttctcttttgaaattaattatttatatgatattaatttccaaataaaacctgaaaagttatcataatcagatatacatttttaatgtggaaaaatcacgtaataacattataaatatatatatgtaaactaatattgtgaaatctaagactctgtatatatagtactgactactgaacaagtatataaattttatgtttataattataaaacgaatcattaaagatatcaaatctgaatctcaaataactaacccaaaatcatgatatctatataaatatattcaaatgaccttgcacgacggtctacactgagcttgttgacgatgacagattcagaaattctgattattagtttagaaaaaaaaaactatagtattattattaactattttaaatttttaagaaaaaggcaaaataaatgacgagtttaagactttggtagttagctccggtttcaatgaatggtccaagttggagagattaggttctttttcttccctatgtgggtcccattcttccttgtgtgggtcccactctctttaacgtttcttcaccgtcctttagtgccaccgttatgccgtgccgtcaactccgttgacttcaggacaacgctgctcgtcttttactgagtctcactcacgtcgtctttctccgtcaactttcttactaacggccacttaacggaaatccgtcactgttaacaattaaattaattccgctcgacatttatcgccgatttacacgtcacttttttctatcttaccctggttatttaacacgtgtacatttatgacgctatatatcgaggaatttatccatctcaaggcattttctcaattatattctggctgcaagtatccaaattttataccagttctaaacaaaattagaaagaaaacaaaataacaataaagacatacttataatattgagatcaaatctgacatttaagaaccactcaagatcttcctattttaaaaggcaaaagaaagagtcagactgatacttatcataaataattttcaacatatatatcaaatgtttgagcacataaaatataaatatcaaatataaattttaaatgcaacgctgtaaattttcgttttatgtatgtcataagaattgattagataaaattggcattttcgcataatttacgtaattagtataaactaaatcattatgcaatttcggaaattaccaaccttctaatataatattcccaacagttgcttggtcatttatttgtatgtgtaacatttgacaaaagagtgatttctcgttgaaaatggaaacctttagctaagactttacacaacttatcctcataaatttagtctttatataaagggactctcttttttttctttttcttctctctatctctatctatctctctttgtctgcaaatg

SEQ ID NO: 7787 - DNA, 3000 bp, Unknown
  misc_feature (1)..( 3000): cDNA_ID_1809296_gDNA_ID_1621163_Annot_ID_57161 3000 nt of promoter + ATG
aggcatcaagtaataatacataagagggaatgatggatcaaacggtgttgatggtatcagtaagacatcggagaatgcaaccgagaccagctctctcagtgagtttctcgtgaatcttcaggcactgatcgcaggtgggtcggtccccagtagaaagtcctctgtacaagtacctgagaattttaagcaaaaacattctatcaaagagcacagacagcctgaggatagagctttccaattcatacatattacaaaacgcattacagcaaaaaaaaaaaaaaccaactttgcacttacttcatgagaatgtcgtaatattcgacatcaagagcattgagcattccgtcaatatccttaatggccattaaagctctgtgcacaactatccaattagccgactgcagttgagttttttttggctcagtaaatcaaaaaaaaaaaaaaagatggtttcggaaagagagagaccttgcaacgttcatcgcgagttttcggaggcgaaccttcaagagccgttttcaaagcttctacatgtttgtacctgcacacattaaaacaccgataagggattaaaccaaaaacaaaagaagactttagggtttagctccaaggtctgatattactgtttgagtaggctttcaatcttcctcgatttggtttcgatcctcgcgattattgcttctgcgttatcagcttcaacgaattctgccattcttcgattcgatctttctctccgatcagagatttcccctctttcccttctttaattgaaaaaatgagagagagagaggaaaacaactcaatcgccatttgaccatttcaaaagggaactgagtgccgtttgtcttggccttaaacggcacgtagtcttaaatgcttatgctgccactgaatgatggatgatggaagcttcattttttttttcattttttgtcaataggattttcatcgataggattcaagttgaaatacaagagccggcaagtacaaaccacttccggagacataagccgatgagtacaagaacactcccgaagccaaataccaaacaaggtaaacaaagggaacaaaatccaaacaaaccaattacactatattcattgaaatttcctcgatcaggttctagaaatccaaaaaagacttacaaatcctaagtcatagaaaattaaaacaaatctgagactaaaaaagacacacaaacgggttacaatacaagaatctccttttctttcttggtataacaattttttttttattataaatctctcttataaatttttaatagtaatatttgttggaccgaattttttatatttatactaatgaacttttctttacgattttgttaccattttggtatcatttttacgattttaatttattaacctccttaattaaaatcgcaacctattctattttattaacacaggtcaaaatatatttttttctgcgctcgaccctaatatgttaacaaaatggttgtttctgcccaaatctcattatatttgtatggatagacgaagagcattttgataatactcttttggaatgtttctttatcattctaattaggatcctacatcgaaagtatactataaatggagtaaacacactcatgactgctaagtgctaacactagtatatatggaacacaaccaatccaatcattacccattggttttaaattagaatctgatgaaacttaacattaactttctctaatcattaatgatattggtagtcttataacaaatatattgccaagattcggtctaagaccacttgatagaactatgtataaaacttcttttttttaactgccaaacctatataaagtggacgtgtaaactaaagcatggtgatcacttcacatcgcaccaatgtagtggatctaaacgtctctttgtgtaatcacgtggtcgaattaatggtcaatcatttagcaattaaccaaatttgaaataacatccgaaaaaagtcggtttagtgggaggagaagtgagaatgatgtttcatgaatgctcgttaggaactcttcgaaagacgataacctcggatggatgtttatggtgtcggcttctagtggttaaacataattagatcgtctactgaaaagttggagatgtggttgagaaactcgtaccctacatatggttactcgtctgctggtttaatcgttgggattgatcgtgtactagtctttcttaaaggccaagaattttgtcgtcgtagttaatatatgttggcgtacgttttactgtttttcttgagaaataattggatcttaagcttattaaaaaagtcgtcacgacttggtccaactcgtacatatcacaagttgctcggcgcttttcatgttagttagccaccgacctcgaactttgaaattttatattttttaacttcaaaaacaattctttgatagttttgttttcattgctaatatttctctcaatttttttttattgtttttatttttgtatagaatagtattcaaaatgaaactataattcagtatggaacactttctgttttatttaatatttacttcataatgaattatgtttcaaattttcaaagaatatatttatatttgaatttggttagtaccttccaaagaagcttaattccccacattaaaattcaacttggtcttcatattaacattattcaattgaattcagactgaaatggttcactttatctggtttgaaatatatgtcatgcattttccaaatcaagaatgaatcttcttgaaagaaaaaaaatgagaaaaaagaagaaggagaggaatgggtctcctaacaatgaaaaagagaataaacccttaaataattgcaactatataaaataaaaagtataaactccactaaaaaaagtcaaaacgtagaccaaaacaaaaacatgtaactaagtcgtccactactacatctctatgactctatataacaacaaagccaaaaccacatcttctcacacaaaacacaaaaaagaacaaat

SEQ ID NO: 7788 - DNA, 3000 bp, Unknown
  misc_feature (1)..( 3000): cDNA_ID_2992328_gDNA_ID_1621163_Annot_ID_57162 3000 nt of promoter + ATG
actcgacttgcagaaaataatatatatatgtatatatatatatacatatatatttaaacatagttattatttgtgttttggatataactgaacgcatccaaagcacttcggagcttgtgaatcgttataacatgcaaactattttgcagaatatgatttattattatattgtattgcaaatgatcttaattttttttttgtgcaaacaaatgatctatactagttttttttaaacgacattagcatctacaaaataactatcgtcattagccactgattgtaatattgttacaatataatttgtatagctgtaaactatttatgttgtcagttctagttttgatatatttactgtcgctaattctaacatgtttgcattcaaaaccgctgattaattgacattgttactatatagagcataaaacggtgcttcattggatgactattgactaatataccaaatgtgactatgtgagtttatgatttagttacataaatatacagatatgtttatctatttatttatagaaagtctttcaagaaatctacaaaaattaaagaaataaagagagtatgcctatctgtacgtcggtggctgtatattgtgaaaataattaatgtcgtatattattgcaagtacttagggatcagggctgagtctacgacaagatacgtatcaatgcacacgtccaaattttttttttttttgtgtacaaatggtcatggtctccagacggtgacattttaaaaaacattatttgattggtctttgtaatttttattttccaacctgtcttgtcatttcgactacgaaacgtacgattttttcaatcacgtttactaatatcatacaccgaaaataaacagttcacaaacgcatcttaattattcaaattcatgaatgttttatataatcgagtatcatatcaacatttatttgatattttgatgtcgtatgtatatcaatgttgttagctgtaaactgtccaatgaaaatccatttaatatttggacaaattattattagggaaattaatgtaatgtggagtattttatatgaaatgtgtattaatgacgacgaccttacttgatcccggaagtgtgtattaatttaatcgcggtgcatcgctgtccacacggttgggttcatgcgtacgtggtatttgctggcaagtggcagtgaagtttcttgtttgatactgtatgttccattcatgtctttccctagatgcatgtttcttctatttttatatattaatatttttttgtttttcttattatgttttctttccctttgtgaggagaataattgcgatacgattatttgttttaacagaaaaaagtgaagcgaaaaagatgattcgaagtttgaagtacgattaaaatttttctttttccggatccgagtttgatcttctttagaaacaaaaattatatttgtttagaaagtctgtcagttgggttttggcccaattgatttacctggtagtcagaaatgtaagtgacctgactacccttgacattagtcagaaaacattctaaactcgagataaacactgtggtagttctttagaaagaagtcgactctaaagtactttggcgtaaaacaaaaaaatttcccttgaaattatactttatttgtttgacataaatgtttcaaatataatcttcttttaatcaatgtagttaaatttttttgatagaagcacgtcagaatttcacactagtaatgtataagtggtaatcatcattgcctaaaacaatgattaattaaaattttagaattcgtcgtcgacaaagaatttttcttatgatgaaggttttgtgcataattatgaacggatccatttatttcactctaactaggaatagatgtttgatgggatacaagtgaacacgacacaaagtaacaaaaattcatttaacgtcacaaattattctcaatcgaatttcgaagtatcaagaaaaagggcaattaaaaacgtaatctcattatgtctttgaaatctaaattaaaagttgagtttattttaattattaatttcctttttgatgatgtaggggatgacaattgacaaccaatttgatttgaaagattaacataaatcattttgagcatacatatattgcttaaatcacacccgtttatctctaaaaacctccataatttatatcaggaaaataaatctagttattgatatcgccatcaaatatttttttcttaaattgtttttttttgttgttgttgaaaatttaattagaaagataagtggacaacgacgcgagacaaagacacaatctttagggccttgagtaaattagggacagcataaacacatgcactagtcctgtctttatttaattatgtggtgtttactctaatgacgtcgctttgattaaccaagtggtcataattaatatatcgatcgaattatataattatcataaatttgaataagcatgttgccttttattaaagaggtttaataaagtttggtaataatggactttgacttcaaactcgattctcatgtaattaattaatatttacatcaaaatttggtcactaatattaccaaattaatatactaaaatgttaattcgcaaataaaacactaattccaaataaagggtcattatgataaacacgtattgaacttgataaagcaaagcaaaaataatgggtttcaaggtttggttatatatgacaaaaaaaaaaaaaggtttggttatatatctattgggcctataaccatgttataacaaatttgggcctaactaaaataataaaataaacgtaatggtcctttttatatttgggtcaaacccaactctaaacccaaaccaaagaaaaagtatacggtacggtacacagacttatggtgtgtgtgattgcaggtgaatatttctcgtcgtcttctcctttcttctgaagaagattacccaatctgaaaaaaaccaagaagctgacaaaattccgaattctctgcgatttccatg

SEQ ID NO: 7789 - DNA, 3000 bp, Unknown
  misc_feature (1)..( 3000): cDNA_ID_1809290_gDNA_ID_1621163_Annot_ID_57163 3000 nt of promoter + ATG
tctctcatgagtagttttaaaatcgaaatagatcataataaaacagaagaaaaacaccagaaagccaaaacaaaaattatgcaaccagcctcgtcaaaacactgaagactcccgtgcaatacgctcttgaagccatgatagacatcctaacgccacatatgaagtaaagcgtatttcctttgtcacactataagcaatatctgtagcgaaagaatggctttcggtgaaaagagataaaaacttaactcgttcatcacatgtactacttgcaagattttatccagctttcagtgaagagagatggaaacttacttcacacatcacctcaaaatttctctattgaattattttatatggaggaacatttagtacaaatttaaaaaccaatagacactcaataacttcccataaagaaatcggtttggtatattactaaattatggacgttagaccgattcttatactgagcagtcatactaaattaaaattttagattggtttatattcattttttctaaaaagtgaatgaaaatcacattcagtactattaacaaaaaaatgtaaacaataatttacaaaatagaagcctacacgtgtagtctttaacttgggtttgagacagaaaaaggacctacaaggatgagtcgagatacgttatccaccaaagtcacagtgtatcacatgcctttgcctctgtccttctccgtttctccattcggctccacaattttcccattccctgatttgcgtctatggaaattactctacactaatgctgtttcctaccgttggatctataagctgagccgttagatctaactatttcttgtcaacatcagttgactgtaaaaactagactcaatgtgggcttgaaacatgctcttcatgtgataaatgtcctgattcctaaagagttttgtttctaatccatgtaaaaaatatacagtaatagtaataatattgcaaaacatatacaattgttgaaaaataccatgaataattcgtattattcttgttattgtaattataatggtacgtcgataattgatgttacattttatcgaagccgtctccaagacttggcttatattccatgaagattcctctctttttttttttttatgttgaaggccatggtttagactttagacaccgaatcttcttttattttactttttttttaatgataatggacaaaatattttaatataaaactttaaactaaacaaataagttgacatcaattcttcatattaatctagttattgacaatgtatgtctcttggtattttgaaacttgagagtcttccatctttactattttaaaattttagccggagtagtttgtacatgtaatggttttacaaaacatgatcaataactttataaaacaagcgtaatacggcgttcaaatttggtttctgcatgaaataaaataagtagattaaatagtgtttgaataaaataatactaatcttagttaactaagttttatacgacagttattcgtttgagtatgatatcataaaacaatgatatatttactcattttagatgttctaggtgtagtagttaattattgcaagtcaagtaatataaaagttaaagagagcaaaggtactaatagtatatgtttatgcacataagttgattaaatatatgtataaccaataatggctcggaatcattgtgtgttttatgcctggcacaatattatattggttcagacttagttaaacactcttttagaagtgattaaatattcagttgaatgaatataaaattgaattcttatgttttgttaactttaatcattggagcgaattattaattatatccttcctgattaaaaaataacttcctgtttacatatgggatatatgttacaaaaaaatacatatttagtgtcaatttttacaaataactttcaatcgtgataaagattttaacatatgaggtaaatccgtaaatgttttgttttccttacaatatagaaactcttctctttttgctaaaggaatattaattgatttaactgaacaactaaacttgttgtgactttaagtgattcatgaaactttcttattttcccatataaaatcgcagaatgttatacgttgagtaaatagactctttttgatcatgtcgaagaacttaatggctgtgaaaataattatgtagaagaattagacgcgacccacatttattgcaaatcataaatgcgaaatatacaagctgtggacaacgttctaaataaagatcaaacctcaaatttttataaaatacaatatatatattagatctatatagtacgatttatcccaaacaaaaggatagcgtgtggttcgcaaatcaaaccttgaagaagaaactaagctaataattttacttcaacaccaaaagaaaatataagttcacacagtcacatccttttcatagcttttaaagtattatctctacttttattcgttttcataagttactgaaaagtgtgacttttatatccatacttactatatcaaatatatgtgggattaatattcatttatagaaaatttaaatcgcaataactcaatatcagccattaaattttacattattatcgtaatttacatcaaattttgctataaaataaaatacaattatatcatatttctgttttagttgaattatatagtattattttatataaatgtatttcacttttcatacactaattacttattctacaatactaccaaacagaaccaaatttgtttttgactagagtaaacttcaacgtaccgaaacaaaaacccttttgtttatattccccaaatcctcctctccttttctcatcttctcacttcaaactctctctatctttctctctcacctcatattatgaactaaagatttctctgaaagctgacttcataaactttttctgaagaagaaacacacaaaaacgatcgatcttgaattgattctttgtagtattttatttacatatatatatag

SEQ ID NO: 7790 - DNA, 3000 bp, Unknown
  misc_feature (1)..( 3000): cDNA_ID_3090143_gDNA_ID_1621163_Annot_ID_173768 3000 nt of promoter + ATG
gttgattatatacatctgttgaaaccgagttgatcatggtaatattcatctccctcctgtttcttactttttgatattgaactcattcgaaaactcttctaattttctgatattgttgattatacagcctcacccggatgtcaagccaatggcatatgcaaacaatgattaaagatgttctctcttcctttaagcttatccagcaacagttattctcatgtagattcagtttttccctttttcaatttttttttgttttagaaacccacttaaggattccatcaatggtcaataaaattttcaaaaactctaaaaaatctctaaactactaaactatccaaatttattaataaaaaatacatagaaactttacttagaaactaatcattggatttgctattacttactaatctgtttattttacttaaaaacagattattttatcttcaaattagcttacgaatctgtttttttctctcctagaattaacaactgcgtttatgttgtgcgttatggttttataaattgttaggaattatgagttgaaaatttaatctttgtttaacctcttatgagtagtagtagtaatggtttaatttattactactactcgaagacccaaccgaatccgatccaaaaaacacgaaaaaccgaaccggacctgacccaaaaaaaccaatccgaatctaaacccgaaattttaaaatattccaacgcatcctacacttttaaacccgaaaaccggaaatccgaacccaaaaaacccgatccgaacttgaagtcttaaaatacccagacgggttttagatttctaaatccgtaaaaacccgaacccaaaaaatccaatccgaatacccaaacgcccatgcctagaatttataaaactattacagttaaatctaaatttatcttttactaatcgtgtgtgatcggttttataccaaattagaaaggaagttaagatttaaagttacactagtggctagaaattaaccatgtgtttgattgcatgtgtgtgatagatttccctaggcatgtaatctaaagtctaaacttcctcctccaattccgacttcggacctccttttcttaccactttcaaaattttccagatcttgttaggagctttatattagtatcttgttacaagctttctttaatattatcatcaaaaaggcataattacaatgccttgacaccatccatggagaatcaaacatcgttatccgaatccttaaaaagcaatacgaataaaggtcccatcgcgtacaacccacgggcctctctctatttcaacctcattaatcgtcttctccatcaccatgcatcatcatcattaggtctaatatcatgcgtccacaatacaaagacgtgaacgataaattagactcgacggccaagcacaaaaccaacagccatggcggtcgttatgataatccttacgtccacattactagtcccacatcagcttctgataagagtaagtctaaaaaatgattgttcgtgtcttaattatgcttatgataaatcttgattgatatatgatacatgtagggtcgaaggataaggttcttgaggtgttgaatcgctgtgggaagaaagtagaggacgctactcgcaaagcggaagcattagtcggaggtttaaaagaccaccgtacgtgagagtttatattttacacatgttgtcttcttaatcgatccctaaaacatttttttacatatggtctatgcatgaaaccgggcatgaacagtgaagtttagtcctagcataagtgatgcagcaatggctaggctttctcaaggcactaagatgatcgttgaaggaggaccagagagagtgtttcaacgagagtttggtgttttagctgtagagaaacttttagattcgtttgtttgctacatatcgactacttcgggaccagtgaccggagtgatatacatttccaacagaagaatcgctttttgtagcgactatgccattcgtcttccttcttctgccggtggaaacggtgttgcggcatattacaaggttagaccatgagtttcaaacaatattttttgtaatagaagtttggttcatacttaaaaaaaaagatctaagttggtattggtaacaagaattgaattgttctttgtgaaatagctgttttcattttgtaaaataagaaaataataatttggtttctaaagattagtgactatataatatattgagcaataataaaatttatatgtgatattgtattataatgttgtatattgataggtggtgatggagtgggagaagataagtagcattagttcatcaacgaacgtgttgaagccaagtgagagatacgtgcatatggtgacacgagatgggtttgagttttggttcatgggctttgtctcctacatcgatgctttcaattgtctcaacaaagctctcctcaattcccgttgtaatcatgccatgtaatcaaattctaattttcttatcaaaactacgaagactattttgatcagatctcataaaatatcaaaaaaaaaaattacaagtttaccaccaaaattatttatctgattcataactttgaccaaccaaaaaaatacaaaattgggataactgagttacacaggtaacttattgatgcttgttaaattgtcattgcgatttcgtaacaaagggtccaactccaatcccataaaaaattacgaacgatgtgtaatgactaatgacgcaacgtggcaatcatgtataccttcaacggcctagaattctgtagattgcatcaatcaacggctaagatcttcttttggctcttaacaaagtcattggctgattcagtttcccaagaaatgtctctgtcattgtgcagtagataagccactctctctctctttctctctttttgctattataaagaaaaagattcattctcccaccattgaggtttaacttatacaaacagatctttttgaaattggattcatctaagaagcagactctgttttcatg

SEQ ID NO: 7791 - DNA, 3000 bp, Unknown
  misc_feature (1)..( 3000): cDNA_ID_1809283_gDNA_ID_1621163_Annot_ID_173766 3000 nt of promoter + ATG
ttagatcgacgaatcgagagttcgcgaagcttcccggaggtaagtccgactaagtcggtggcggcaaccaaagcttttttccctgaagacgttattaaaccttcgagatctccatttctcgctctttgtaactccggtgactgattatagatctctttcgctacaagcgaaacaccattgacgagcctggtaaagctcttgctccacgaactcatcacgaagccgcgtgcaaagttactcttcttaatcgtggatttgactttcctctttttttttgttttccatttttgtcaatttggttttgaagaattttctcgagaaagtatataatgtgtgtgtttttgcgttagaccacgaagatcggagacgtcgacgaggaaccgaggtttacgtggggagccgataaccagaaactgctcctccaaggtttctagtttcggccggcccaattagcctattctttttttattgtcaccatataaggcccattgggctataaaggagttttacgagtagcttccttaaccatttgtgatgttttgttggattgctcccgtaacatgtagttttaattgtccaaatatatttcatcaatttatgatgtgtttttttgtgtgtgataagaatgtaatgttaataaggtttaggaaacgacatcagtaagatcctagatacattgtcccatgccgaaaaggtaaaaaatatggaagcatagacaatcgagaattagatcatcactacatctttaagccgtgaagctttagacaaagctatgaaatgaacgcgataaaaaaattcctctaagcaaaacatggcaagaaacaagagctataaaagaaaaagaaactttaaaatgattataaagcgaagcgaaaatcccttcaacgtgagccccaacctaagaaggagcgatgcaacatgagctaaaggcggcaggcaatgctgttttctaccaacatccccaatcagtagcatggacaaagcaacttcttatcctccaaaagtcatactaacatcttcagaacactatgaaacaatcctataacacctcaaccaaattgaagcttcagaagacatatactaacacctccaatactaacaatttatgatgttaatcaccaaaaaatattttaaagatatgtatgtattagtaatacagtatcaccaatctttggctggtctaactcaaacatttagagagagaccgaacttaaataagagagactaatggttgtaaataatgagattcatgagactagcaaatcttcatgtctaagttgaaaattatcggatccgtcatgtgaaatccaaaaataacgatacagttttgttttctcagataaagtgaaagtcaaaccaaaaaactatataattggctgctttacattaacagtagaaaaccaacaataattgaattttatgctgctactaccaatgttgtaatatgtataagcgttcattatttaaatttatatacaatggccgccaaaaaaaataaaaatatgcttaagtacaatgcatctccactcataaaaggtaacacgagaaagaaattatataatacgaacaaacaaaattgagacccctaagtaaatatgaaaatcatctttgaaactattaatcttctctaactaattttcttaacgtaaaagaggactttattttaactttcggtgatattactccaatcttagggtacgaacaaatattgttattaaaccatttcgaatataaaattggtcaagccactcagaattgtcaggatggtaggcaatatagtatattggattaattaaaaactataacacagtgattagttggcattaaactacaggtggtcatcattttgtctatacatataaaccaaattgtatttagtcttgagatcttcaaaaacatctgagagctttgacaaaaaaaaagacgaagagaaaaatgtccattagagctcaagaaattcaaacccttgaaggtatagtaactctcaatctctctcttttaagttttaacggtttatacttttaatccgttttacatcatttgttaagcttttgctaacctctctaagatcctgagatccaaaaacatacttaagattttgatccacctggtttatattccatctcttagaagttttatttgctttctagattagatcggtttgactatatcgatcatattatatttgatttataaactataagtataagacttctgtttaggtgaaaatcacaagtcctttagtgatattgttgaagatttcctcttgaagatcattagcacaagttaattcaaatccgttattgtttaaagatcatcaacctaaaacattgccaataagtttcctcaaaagttcatttggatctataattttagttttttttttgtcttttattttcataatgcaaatagagagtcaatgacaatttagtgaaagatatatagttaataactttaagtgggtgaataatattggcattttaaatttacataatttatagtggaagattcaattaatacgtcatattttaattttcttttgggggtattttcattatattaaaaacttttaaaaaagttttttttttattttaatttaagaattataaacttataatatataaagttacatccgaaaaagaagagaaatttattctaaattgtagaccgaaaatgtataaaaatacctttactttaacaaaaaaaaaaaaaaaaaaaaatacctttaaaaaatatctataaatacacagcacaaacaaaacttttaaatgtttccaatctaggaaaaaaaaatattttggtttcgacgtaaaaaagaataatattgtagatagaaaacattttgaaaagtttttaattatgaatatatttaattaaatccataatttatatattttaaatgggcccattttgactttaagaaaatataaggcccaaatagaaagcctatagctcaaagcaagcctgcttttagaccgctttccagatctagaagaaaca

SEQ ID NO: 7792 - DNA, 3000 bp, Unknown
  misc_feature (1)..( 3000): cDNA_ID_1809286_gDNA_ID_1621163_Annot_ID_173765 3000 nt of promoter + ATG
gaattgaatcgcggagaactgtcgccaaatcggcaggtgaaacatctacgagaagaagctagcagtgtcgaggaaggcgaaaaagaggttatcaggcgatattttttagtcggagagtgtgaattcgttaggccggaagtggtggctaacgcggcggcgcgtgggtggtgaaaggcggaagagaagtctaataagatcggagaagattgcattgtttcttctagatctggaaagcggtctaaaagcaggcttgctttgagctataggctttctatttgggccttatattttcttaaagtcaaaatgggcccatttaaaatatataaattatggatttaattaaatatattcataattaaaaacttttcaaaatgttttctatctacaatattattcttttttacgtcgaaaccaaaatatttttttttcctagattggaaacatttaaaagttttgtttgtgctgtgtatttatagatattttttaaaggtatttttttttttttttttttttgttaaagtaaaggtatttttatacattttcggtctacaatttagaataaatttctcttctttttcggatgtaactttatatattataagtttataattcttaaattaaaataaaaaaaaaacttttttaaaagtttttaatataatgaaaatacccccaaaagaaaattaaaatatgacgtattaattgaatcttccactataaattatgtaaatttaaaatgccaatattattcacccacttaaagttattaactatatatctttcactaaattgtcattgactctctatttgcattatgaaaataaaagacaaaaaaaaaactaaaattatagatccaaatgaacttttgaggaaacttattggcaatgttttaggttgatgatctttaaacaataacggatttgaattaacttgtgctaatgatcttcaagaggaaatcttcaacaatatcactaaaggacttgtgattttcacctaaacagaagtcttatacttatagtttataaatcaaatataatatgatcgatatagtcaaaccgatctaatctagaaagcaaataaaacttctaagagatggaatataaaccaggtggatcaaaatcttaagtatgtttttggatctcaggatcttagagaggttagcaaaagcttaacaaatgatgtaaaacggattaaaagtataaaccgttaaaacttaaaagagagagattgagagttactataccttcaagggtttgaatttcttgagctctaatggacatttttctcttcgtctttttttttgtcaaagctctcagatgtttttgaagatctcaagactaaatacaatttggtttatatgtatagacaaaatgatgaccacctgtagtttaatgccaactaatcactgtgttatagtttttaattaatccaatatactatattgcctaccatcctgacaattctgagtggcttgaccaattttatattcgaaatggtttaataacaatatttgttcgtaccctaagattggagtaatatcaccgaaagttaaaataaagtcctcttttacgttaagaaaattagttagagaagattaatagtttcaaagatgattttcatatttacttaggggtctcaattttgtttgttcgtattatataatttctttctcgtgttaccttttatgagtggagatgcattgtacttaagcatatttttattttttttggcggccattgtatataaatttaaataatgaacgcttatacatattacaacattggtagtagcagcataaaattcaattattgttggttttctactgttaatgtaaagcagccaattatatagttttttggtttgactttcactttatctgagaaaacaaaactgtatcgttatttttggatttcacatgacggatccgataattttcaacttagacatgaagatttgctagtctcatgaatctcattatttacaaccattagtctctcttatttaagttcggtctctctctaaatgtttgagttagaccagccaaagattggtgatactgtattactaatacatacatatctttaaaatattttttggtgattaacatcataaattgttagtattggaggtgttagtatatgtcttctgaagcttcaatttggttgaggtgttataggattgtttcatagtgttctgaagatgttagtatgacttttggaggataagaagttgctttgtccatgctactgattggggatgttggtagaaaacagcattgcctgccgcctttagctcatgttgcatcgctccttcttaggttggggctcacgttgaagggattttcgcttcgctttataatcattttaaagtttctttttcttttatagctcttgtttcttgccatgttttgcttagaggaatttttttatcgcgttcatttcatagctttgtctaaagcttcacggcttaaagatgtagtgatgatctaattctcgattgtctatgcttccatattttttaccttttcggcatgggacaatgtatctaggatcttactgatgtcgtttcctaaaccttattaacattacattcttatcacacacaaaaaaacacatcataaattgatgaaatatatttggacaattaaaactacatgttacgggagcaatccaacaaaacatcacaaatggttaaggaagctactcgtaaaactcctttatagcccaatgggccttatatggtgacaataaaaaaagaataggctaattgggccggccgaaactagaaaccttggaggagcagtttctggttatcggctccccacgtaaacctcggttcctcgtcgacgtctccgatcttcgtggtctaacgcaaaaacacacacattatatactttctcgagaaaattcttcaaaaccaaattgacaaaaatggaaaacaaaaaaaaagaggaaagtcaaatccacgattaagaagagtaactttgcacgcggcttcgtgatg

SEQ ID NO: 7793 - DNA, 3000 bp, Unknown; identical to SEQ ID NO: 7788
  misc_feature (1)..( 3000): cDNA_ID_3046534_gDNA_ID_1621163_Annot_ID_173762 3000 nt of promoter + ATG

SEQ ID NO: 7794 - DNA, 3000 bp, Unknown; identical to SEQ ID NO: 7786
  misc_feature (1)..( 3000): cDNA_ID_3090128_gDNA_ID_1621163_Annot_ID_173759 3000 nt of promoter + ATG

SEQ ID NO: 7795 - DNA, 3000 bp, Unknown
  misc_feature (1)..( 3000): cDNA_ID_2147341_gDNA_ID_1621163_Annot_ID_173758 3000 nt of promoter + ATG
taattaccgatactacggtatgattttgggtaaatttcaacgtctttttctttcaattttcttataaaactgacacatctttcttgcaaatttttgtttggcaaaaaggatgtacctcaagctggttcctcacaagctctagagaacagaagaccaaaggatatgaaccatgaaactccggccaccaccttgaaacgacggtctccagacgacgtggatggtcgtgatatgcaccgaggatcaccaaaaactcctcgaatagaccaaaacaagagtactaatcatgaagaacaacaaaaccctcatgatcaattaccctatagaaaagctagggtttccgttagagctagatctgatgccactacggtaactttctataagttactaatttttttgattcgtttaaccttacatatatatatgagttatgaaaattgaatcaatattaatatataatataggtaaatgacggatgtcaatggagaaaatacggtcagaaaatggcgaaagggaatccatgtcctcgcgcttattatcgttgcaccatggccgttggatgtcctgtccgtaaacaggttagtataactatatatatgagaaaatgttatcataattatagaaaaaaaaatttggtattagaattttgtattgattaacgtatatagtattggttcttttcgtcaacatgtagctttgaatataaaaattgacataataacaacactaatataaccgattatattacgtatcctttagaagtattgatttagagcaataccataaaaccttattaaagtccttcatacaacagatttagaaagttttaagaagagtatagaaaataattctaaatttagaaaggctttactaaatccctttctaacaaaatcttttacttatgaaaaaccaaaactagaatgcgacatatttattcttaaagaaaactttattgttttacgtaacaaaatgatttaaaatgtttatttgaatgtaaataggtccaacgatgcgcggaggatacaactatcttgacaacaacgtacgaaggaaaccataaccatcctcttcccccgtcagccacagccatggctgcaaccacctccgccgcagcagccatgctcttatcaggctcctcctccagcaacctccaccaaacactctctagcccctccgccacgtcatcatcatccttctaccataacttcccatacacctccacaatcgcaacactctctgcctcagctcctttccccaccataaccttagacctcaccaacccacctcgaccgctacaaccgccaccgcagtttctaagccagtatggtcccgccgcgtttttaccaaacgctaatcaaattaggtctatgaataataataaccagcagttattaatacctaatttgtttggcccacaagccccaccacgtgaaatggtcgattcagttagggctgcgattgcgatggatccgaacttcacggcggcacttgcggccgcgatctcaaacattatcggaggaggtaataacgacaacaataataatactgatattaatgataacaaggttgatgcaaaaagtggagggagtagtaacggagattcgccacagcttcctcagtcttgcaccactttctctacaaactaattttactaccattattatatgttatcttattatatattacacacacatattatacattatgcgtatcttaagtttttttttggtgtacattatatatgaatgatatggagatcactgagagagagagagagctattataggttttttttttacaggtttacacgattttggctatcgtttttttttcttctatgttaagaacgaggggtgtaggttttatttttcctacttcttatgaatcatactctgtatatgtatacatcttaaatatatattatgttaaaaaagaacatgcatgcctgtatgatatattaatatattacaatgtaactatataatatgactatatgagtaacattttttgttatatctactgaataagatatcatgagaggtatcaaatataacaacgacaaggatcagtactgtattagatttattgttcgtttcgcagttgtcaaagaccataacaatgattgttcgattttgtagttgttagctcaattattatatatatatatatatatatatatatatatatatatatatatatatatatatatatatatatatgaaacaattgtagtaactaagctgatttcttttagtattttaaattttaattagcgatgaatcagtgaaatttgttattgtcaaccacaactaaatcggtatgagtataacctaccacaagttactgtcaatgattactaaatatttataatttagttgttgatagttgttgccaatgattacaaagcgtacacgatattgtgtatatgaacaaaatacaaagaaactaaagaacaacaaggtcgctgatatataccaaatcgtcggtttaaccggctctgccagtgtatattttcctagtgacaattgtcacatatgtaaaatgtgttaaataaaacttgagaaaggaggccactttaacacaactacttcaacctttaacatctaaaatagaaaacgtggcccataaaatgcaaaggaggccgaattaggcccaataaacataaatgggccaatttaaattagtcacgttaaaagagctcaagaatcaccaaagagtaaagtagatccgagcgttacttcaaaatttgaaaacccgaccgttggtctctctcttcttctaatacaaacaaaaataaaaatcaaaacaactggaaaaaaataaattcagaaagtaaacacaaactttcattattaattattaatccctttgaataaaaccagtctctgtaaatctccgtagctgagaggagtgaccatggactcatgaagatattgattgatttagcagagatttcttcttccttgaagatctgaaaaatcaaagttttttcaagttacaatg

SEQ ID NO: 7796 - DNA, 3000 bp, Unknown; identical to SEQ ID NO: 7784
  misc_feature (1)..( 3000): cDNA_ID_1828945_gDNA_ID_1621163_Annot_ID_173755 3000 nt of promoter + ATG

SEQ ID NO: 7797 - DNA, 3000 bp, Unknown; identical to SEQ ID NO: 7792
  misc_feature (1)..( 3000): cDNA_ID_1809286_gDNA_ID_1621163_Annot_ID_57164 3000 nt of promoter + ATG

SEQ ID NO: 7798 - DNA, 3000 bp, Unknown; identical to SEQ ID NO: 7791
  misc_feature (1)..( 3000): cDNA_ID_1809283_gDNA_ID_1621163_Annot_ID_57165 3000 nt of promoter + ATG

SEQ ID NO: 7799 - DNA, 3000 bp, Unknown
  misc_feature (1)..( 3000): cDNA_ID_1809276_gDNA_ID_1621163_Annot_ID_57167 3000 nt of promoter + ATG
ctaaacttttagtcatttgaaaaaccaccataaaaaactttaatctcgataaaactacacgtactttcggatttgttgttaaaactatgtctccaattgaaccgaccagttaaccgataattatacacccggtttgaattacccaaaatttaaccgaacctaattcgattttgactctattttaacccaattttgacccaaaaaatatattctctagaagaagaatactatttatttatttacatttaattttgataaaaatactaaattaattaattttaccaaaattcttttataataaaaatatataccgcaaaataatataacaaaatagacaacaaattctttttataaatacaatggtgttatttatataaatgtatttggtatatactctaaatttaataattcaaaggtctttttctttcttaaaacacataatcatatatatatatatatatatatataaaaagaaaactcatcttgaatatataaaaagaaaactgaatctataaagaaaaattgatttataaataccataatatatactttgattgtggtgtttacggatatatttatataaaaataaatttggcatattttttgaatttcattatgtatataaagttcaaaggtcatatattatgattgcaagaaaaatgaatattttgttttaaaaaacgacatagctttaagtttataaaaaaatagaaatgattgccaaaaggaaaatgtatatgtttgtatattatcaaaattttataacaaaatgtaggctcaaaatataatgtggggtatattttgtcatattaaattttgttaaaattaagttataatttaatatttttaattgtttatcacaaataaaaattaataaaaatacttttacttcttaagaagacaatttatttacattttttgggtcaaaattgctaaaatagaatcaaaatcggattaattttggttaaattctgggtaagtcaaaccggatgaaaaattatcggttaactggtcggtttaattggaggcgtagttttaagaacaaatccgaaagtatgtgtagttttatcgagattaaagttttttatgatggttttttaagtggctaaaagtttagggtgaaaagttgagattccaactagtatagggctgaaaattcagtcaacccgttaattttatacgtactttgtttcttatacataatatatctgtaagcttatacgtactgtaccatggtactttaatttttctctttttggtaaagcacttatatttttctatttccctatagtgtagttaaaacagtataattcgattgtcaatcattttatttatttgaaaatacggaatttatcattgaaaaatagagagtggttggtccatgtgtgagtttatcaaatggaatcagcgcatcatccatgtgataagtacgtggacttaccattagatatgccatgatattagggtatctataatttatattacatgactgctaaattgataatgttacgtaaacgtacttatgtattataacgtttgacttcgaccatctttgaaatttcaaggttatatagtaggttgaagagccaaatagttatgtttataatattgattatcagtctgtgtctggaatatggatatcaagcaatctaaataaacttaaagaagttcattaaccttcatggaggaactacaaagagattttgatattttgttcggttgaagtagaatttagaagtcagtcctatacttagtcaactataaactgtaaaacagttaacttcaaataccaaatactcatagataatctagttatcatcagcgtaagttggcaacttgcaacgtaccacggaatttacgtaaatggaggagcacttatcagttgatttcgtacgttgtttttttaagataaatcgtacgttgaattttcaacaaaagctcattgataatatgatattcgaattctacattcattgccaattattaagacaacttgccatttggttatacatctatgtaataactcgtataccaaagaactattttatgtaatgataatactagctattctcacgagacgcgttataagttgtacttaaaaacaattgcatgtaatatatcacacaattacatgtaatatatcacacaattacatgttgagttttattaaaaatgttttatttaacatgatgcaaaacttaggtttatgtactgcgggacgactgtttctacacttgatatttatccaagttttctatttttaaccgatagttttatcgaagacaagaaaactatttgggttggttaaagtggttggaaatagtttttctttattcaaaaaaaaaaatggtttttaatgttgctacactagtcttagggtctgaatgatgattgtcgttttgcggtgcgggagaagtgcagtgcagttcaaatagtaacgaaaatacatagatacatatgtatatgtagagatcttgatactgttacagcactgttgcggtgcggttttgggtgcggtctatgtcaccattcatagccttcttcattttgttatgtacaattaacgccaatttacctgtaattaaaccactcattggctaaaaaactatatatatatataacttggttgacaagagaaataatataaaacttgggatagtgagaaaaagttataatatttgaaagaaactaaacacaactacctataagtcacatgcacttataggattaacttaattatcatatgcctgaaaactccgtatttttcgcacttcttacaatcattgaatcaatcatcaccaaatcatattattattttcaacgttttccgctaattccaagtcatatctaactaatttatgcatatatcttaatccaaacaagctctttgagttctactataaatagctgctaaagcctaagtcttatgcatccaacaatcttcaacttcttctctaatcaaaagttaaaacacctaagaaattgaaagaaaacaaaatg

SEQ ID NO: 7800 - DNA, 3000 bp, Unknown; identical to SEQ ID NO: 7790
  misc_feature (1)..( 3000): cDNA_ID_1841214_gDNA_ID_1621163_Annot_ID_57168 3000 nt of promoter + ATG

SEQ ID NO: 7801 - DNA, 3000 bp, Unknown; identical to SEQ ID NO: 5030
  misc_feature (1)..( 3000): cDNA_ID_3075380_gDNA_ID_1621164_Annot_ID_57174 3000 nt of promoter + ATG

SEQ ID NO: 7802 - DNA, 3000 bp, Unknown
  misc_feature (1)..( 3000): cDNA_ID_3594240_gDNA_ID_1621164_Annot_ID_57181 3000 nt of promoter + ATG
tatttctatagttgtttatgtatttataaaaaaataaataattgtatttacttaactttgtttacccacataaaagactttcgtgctatggaaaagggttaagactatttacgaacgagaagagatttattagtttatacgaacggaaagagattcacctgtattaacgtacgaaaatgaggatttagttgaactcttacaggaaaagagaataaaacagttttaacgaacagaaaagaagtttatatatattttttctgttatattaggttttccttatttgtgtacaagttaaatttttggaacaaagacaatgatcaaagttcataactgtatttttttttctattataaattcagaattagaataattgcaagaaaacttattacttctaaagttgtttctatatatataaaagaaaaaaaaaagaaaaaaataattgtatttatctgactatgtttacctacgtaaaagactttcgtgccacggaaaaggtttaagactatttacgaacgagaagagatttactagtttacatgaacgaaaagagatttacctgtattaacgtacgaaaatgaggatttagttgaattttcgcgggaaaagagagttaacggttttaacgaacagaaaatgagttacttgtaaaaaatacttagcatatgtttaagtgaaatttctagttaactatgagaaactgtttcacgccctttggaatatatatggcaacttgatcaatgtatatgaccaattttagctaagttatcaattttcttacttttttacacatatcatataagttacttgtaaagtacactattttttgatatgatcaattttaaaaagaaaaatattattatttaagtaagatatctaaatattaattttaatatcttttgataaataatttactataattagttaatagacattagtgatcataaatatattaccagattatgtaatacaattattaataagtatttttaccaaatattaattgaattttagcctaaatagttaatcaacattaatatttcattaacatggtaccaaattgcctaattataatgtcaatgtgtctgaattttaaatatattaccaaattatacattaaaatattaatattttgttatagtatttatttgaataaagaaatttagtattttcttcctataaaaggatgactaggagacaaatttttagatttttaaaataaaaggctgactcttccagaactaaatatagatatattatttattaattaaaggttactaaagtgaagtctaagtgatttggtttaagaatttttgtttagaatttacaattttcagtttagttttagataattttgttaattggatattgacattttgtttgtagccagaagttgttgtttttaaaagaaaagctttatttttgctacccaataatgatgagaagagattacataaacaaattaaaatcaatacatgatacgaactaatctagctaaacgatttactcaataacttcacccaattcgtttcgaaatctaagcaatatatccctcaaaaaatcataactaacataaccaacataagtgtttccaattttgagcgaatgagaacaaacttcttccctgacacttaactcttcgtaagatgattaaaataatatatgattattgcttcttcacacacacgatctctaaagcaatttacccattaaatctttatatctatatataaaaataagtttgatacattactatgctctttgatgggcaaaagtaaaaaaaaattgctttgattttgtagacgagttttgggcatgcaatttttatttacatcttttcaacaaaaacaattaaacaaaacaaaattttgcttagacattgtccatgttaaagttcaaaaattgtacgaaaagtaagcggtagaaaattttgctctatttaggtttatcgaagtaatctttctatttgttatatgttgtataatttatagtaatatgtttatttagttacaatcttttcgtaggttaactatattacttctaacttttgtatgtttaacagattttttatttacctctatcaaaaccctgcaaaacacacaatcaaactcgcaatactctactacatcgattaactaatccacgacacttattttcttttgtacttaaaagttaaaaatatattaacacgtcctatagtaaagcggtgtatgcctcgtccacggattctaaagtttacacatgttttaagtttaacaccttaaaaccatctaaactctactttttaaaagggttttatgcaaaaaaatcctcaaactcgtctatttttacaactttattcttcagatccaaaaaatgcaaaatatcatatgaatttcaaaataatacacaatatagatttttcgttactatcaaattttaaaattttgataaataatatattaaatcggaacctcgagatgaagagttcaagtatatctttaaaagttttaaaaacaaatgtatgtaatcgtgaaaacatttacaatatatataaaattgcaaaataggctattttagatttcataagattattttgtattttttaaaacaacaaactcaagtctacataattaatatattcaactcaaaactccaaactgaaagcttaagaagcccaacaattgtaagcccaattaaaaagcccagtaagtgaacgcgtaaacaaaaaaagtaaagactctcatggaacaatcaaaaacgccgaaacaatgcttcgtctccgattattccacgaaacaccgcgtttttgtttacatttcttctctttctctctctctcttctctcatatctctctcttcgccgtcaggttttgcccaaatttctcggtcttcttcactcccgcgagttttttttctcgggaaaattttccaattccaagctccattgaagccaagtaagaggtgcgattctcttcaattttgacttggaacttgtaaatagcgtatggatttgagctggtt

SEQ ID NO: 7803 - DNA, 3000 bp, Unknown
  misc_feature (1)..( 3000): cDNA_ID_1809334_gDNA_ID_1621164_Annot_ID_57182 3000 nt of promoter + ATG
gattttcaaacttttgaactgtcttaataatcttaaacgacatttgaagtgtctactttatgggattttatgagttaaaagtcagaatttgtgcaaacgcgcaggttcaagccctgtttaggatcggaaggggtactcttccggaagtacctgatacgttatcactagatgctcggcttttcatacttaagtgtcttaaagtgaacccggaagagcggccaactgcagctgaactgctgaaccatccatttgtgagaagacccttaccatccgtgggttcaggaggctcgggatcagcatctccccttctccgtagatgaggctaattttagtaaatttcctcaataggtgaagtatttagttgcttttttcatgaggatattatcagaatcaacaaaagctatatattcttctaacattgatgtcctaatgtacaaaagcaggcataacccgaagatttatgagagattagatcccagagaaactattgggagacacgagacatgattcttcgacacacacacacgtgcggtcgggttgcgcagcaagagccaaacttacttagtttctgtgtcattcgttggttatttgttgcaagttatgtgttgggcttgattttaaaactgaagagccttatttttctaggaattagaaatgtcgaccttggggtttttgggtgtataggttttgtttagttttttttgttaaattatagtgtatgtatgtctgtatctatatcatgtaatgtataattatagttggttcttatagttcctggcttgttgtaactgtgtacacacatcgatgggtttaagttctatttgtctcatattttaaagaaatctgctgctctaatcatctattaaaaagtatagtcaagatattttctataattcaggtcaaagccactttaattgaagtctatataattcaacttgtttttttttcttttacaatattgcccgttgaaaagttattggaaatgatggatttataaaaaaattcaaaagtgaccaaaaaaaaagataatcgaaagaattttggctttgaccattttcaacggggatctaaatgccaggaaaaaaaatacacaagatacctatacttgggattataccaagtttggagtacgactagatagaatatttgttagattcgctttgatccgttattctactcaatttaattataattttctaatcacctaattaattatttgaactactagttttaacattgaaaagagaaatataaaatattactatttttgataaaattttactatttttggattaaattttatatttttatatttttttaaaataaatatttaacaaatccgatatatgataattaaatggtttagattttaacggatattcaaaaccaccgaatatttggtctctctcaaagcaaatacaaaaaaaaaaaaataagtattctgataaagcaaatcgaatcacaaacaacaccaaaatcccggatatctgctctctgctcagccctaattcggaggctatactgtcaattctggatattgggtgctcacacaggttatacaaaacaagaatagtctccaagaggtttcatagccaagtctaaccctattttgactctttacgttatttctcgtgtctttttagtgtcttttcaggtattttatgcaataagacaatattggagataaggaaacattttgtagcaaaaactaacgaaaaggaagctaaggacgactttggttcaagaatcagcaacgagtgtcgaccgacacactcttggtgtcgatcgacactagtttcggcccagcaaaaaccctagacgctttcgagtttccagaagctcaactttgtcccagaagatttccctatttgcattattagtccctggacgtttttagggtctatatatattgtttttagacctaagtttcatttatcaagtcttttatcaagttctttgcaaaccctattgtaagagacataagctattcatccattgttattcagagtttcattcagatctatatacagtgaagagatcccttctttccccttctctattcattgtgtttatgcttttttatctcaattatgttgtttgtttcattcaatatgtctgagtaatctgcttgttaggaatagggtttctcattagggattcatatggtttagtatattgccccctttgctaagttatctgtagaattcttcatctttaattatacctaatgttatatctagagtaattaactagatcttgaatccagacaatagatatgtccgccataggtatttgtagttgaatctattatttgatcagtttggtctataggtgtgtaataagaatcggcctatttactaagatgaacaattgaactcgttaagaatgcatatttaggttgatagtctctcggcttctccggtcactattagctatagatatagggagtttcgcggcacgcccaccggttattccataattagagtttgagtttaagaatggttcgataacaacctagctttcattagatctactaaccaatagcttcctgagaataccctgttcctagctcttttcctaatcgtttacaacacaatcaatctgctgttttcttattttgttttcttaatatttcacacataccctgctagcttaatctcgatatttaactcactgtttgaacaaaagaactccttgaattcgatcctaaaatactgcaattgatctcttatttgagagagtagttctaggtaatttgaaccatatcaaatttggcgccgttgccgaagttcttgggaatcatcattgagtttagtttagagattttgtctagtttttacttctattttgttactcacgcgtttcttgttttcttcttttctgtgtttcaggtgtatgcctaggcaaacaaggagcacaaaacagaaggagcttatcaacttgtctgttctggacttgggaaaacttgaatgcaccaaacgaaaaactcagaaattagca

SEQ ID NO: 7804 - DNA, 3000 bp, Unknown
  misc_feature (1)..( 3000): cDNA_ID_3089051_gDNA_ID_1621164_Annot_ID_173808 3000 nt of promoter + ATG
tgatctaaccaaagttttttggaatctaatagcaataacaatctcaataaatgtttttgcatttctaaacggttgcattttttatcataacttttcgttaaaatatttaatgtttgttttacagtcgtgtttttttgtcgtatcttttcgttaatatatttatggttatttttggtggacagttatacttattcaactttagtcgtatcttttcgattctgaacggttacgtctttttatcgtaacttttcattaatattatttacgattacttttgcggttgtgtcttcttgtcgcatatttttgttaaaatattgcatattttgggaaaatttatgtaataattcaaatatttgaatatatttatataataattaaatacataaatactaggcctgggcattcggttcttctgttctatagcctcttaagatctacgagggaaccgaaaaagtttcggtttggttcagatacttagaaagaaagccgagaaattaccgaactctaatagataccggtttggttccggttattttacccaaaataccaaaaagaaaaaaaacgaaataaccaaatattcgattaacaaaattgtaaaatattaaaaaattaacaaaactctattgggttataggtttgttaaaaatgtagtgggcttagatgtagttttgtatagggttgaccaaatattttttggttagattttggatttccatagatattcggtttgttcagttatacataatattcaatggatagtgtgactgaaatccgttcgaggatatttagtattatctagaaccgaaccggattcctttttcggtttggcttggttcggttcttcggttccggtttttatgcctaagccgttctaacttctatggttaattgaagaatgtgaaatggtggttaatattcaagaaattttaggaagccgaagtactaaatttagatactgaagaaaagaagaagaagcataagaagaggcctaaatgcccagagaattaaacaaatgggcctttaacaatatttttaacaatcagatctcaaaaagctaaagccttaatatataaacaaacatcaatctctggccgtcaaaggttacatctatcgccgccgctgagaccgccacttaaggccgtctcctccgcaatctccgtaaccaaaaccaccggcatcgcctggtaagctcgattttgtaatcatttcgatctcatatgatgtcgatctgttaaatcttgcgaaatcgatctttgttttgttctgagatttagggtttcacgaatttgtgttctaggttttctggcttaatcatttctattgttttttgttcttattggttcttatgcttttggtgacacaaagatctcgactttttcttgactctctatgcgaatttgtcaaaagtcaaaactttgtaacagtttactctctttcgtgcttgtgtttatgtatgaacaatagcttcgctattgggattgtttatttcaccacacttgattaattatacatactattgaaaatgttatcaatcttggcgataaaaaccgtcattttcatgtgtcttagctctagtagcaccttttgtttagagatcctgagtttaaagaagcagtagctagcatctttggtatagtaaattgtttcactgacaaattgtatatcatttggttataactagattagtgaaatttaatggatgagattatgtagcattgttttaattttgtatggagagaactggtggtgggcttatttccaaaattttcctttgattaagtcaagaccctttattttgagaagtgagagagaggattgtctgagtattgtcgctttctcaaaatctttccggggctaagcagagaaaagctgatagttaagcttaggaatgtgatcttggtcttttaagaatcttgaaactagtgggtaacttggatccatcgaatttgttttccgtaggtgagtgttctttagcctatttctgagtctgaattatacagtgtagacatgaaaataggtttttatgtgatggactcttttgttttatggtttaatggatatgttgagttttgtttttcccatgagtctcttataaagttggaatttgattcatggaatcttggatccagattacttcgaatatataaatgaaagaacacttagatgtatcaaagggaacttaagcgtgtgtactgtttagtgtctcacaacttggaatttggattagcgctttcatgttttggagtttgatttatattcgtgatgtttggatttggatagtaccttggtccattgaactatgtatcataataatgctttggatatggatatcgttttgatgacttacttgataactgctcatacttaaaaaacatttgttctagaaatctagattctcgtctatgagtgtttatatgttgaattcatgtcgaagtcatagtttagagatctcattgagcatttccccttcggaagagtgaggagtcttgttttggggattctttttagggctagacctgtgaggaccttcattaattgagttcgttttattttgtacccaaatatgttttttcggcttatcccattggcattgaaaaagttattgtttacattaaaatgttatttttttctttcattgagattaccttgctagtcattggattttatcggttttaaacttttaatagctgaacaaaaggggttttattctaatgtttacttaacactagtctggtcataaacaagtataaattttgggtttaagttatacttcttttattggaaatacatatcaaattagggcgtttcatagatagttgatatattttcttcacttgcatgtagttatgttcggtattatcgagaacttactgtgtttgaagttcctcggcaggaaaatcctgtagagtttgagccaatgttgtcggtgtgaacctcaaaagttgtgggtgtttttcccgccgataaagctgctggcaagatgggttggggttgggtaga

SEQ ID NO: 7805 - DNA, 3000 bp, Unknown
  misc_feature (1)..( 3000): cDNA_ID_3046549_gDNA_ID_1621164_Annot_ID_173806 3000 nt of promoter + ATG
ttgtgtctctgggggatctatcaatacttcttggcaaaagggtcaacttctgcgacaaggatcgtttggctctgtgtatgaagccatttcagagtaagtcttactggttgcttatgtttgttgaacttaaatcaattacttagttttacgttatgcctttgctgatggatggttttgctgaatgtagagatggggacttctttgctgtcaaggaagtttcacttcttgatcagggaagtcaggcacaagaatgcatacaacaacttgagggggtatggaagtttcatatatgatcggcagtatatatctcattgatcagacaaaagtaggttgctaatccaccttaccttagccacatgttttcattttctacaggaaattgcactacttagtcagcttgagcatcagaatattctgcgatatcgtggcacagacaaggtatggccctggtgtccctttcttgttctcagttgcagttgcctaagcattttgttctgcaattaataacttatttcgttgtttgcaggacgggtcaaatttgtatatttttcttgagcttgtaacacaaggatcccttctagaactctaccgaagataccagattcgggactcgctaatctccttgtacacaaaacaaatccttgacggtttgaaatatcttcaccataaaggtttcattcacaggttagactagtaaactctcttgtcacagctgtaattcccaagcctctgatttcctgcacatcctaggttacttacttttctcatctgatgcgacaaagggacattaaatgtgcaactatattggtggacgccaatggcaccgtcaaacttgcagattttggattggcaaaggttcttttccaataatagatgtttatagcttttactctaacttaattacttggtccatcgtttatcccccttactcaatatatatgtcatttttttcatttaggtgtcaaagttaaacgacattaagtcccgcaaggaaactctattttggatggctccagaggtatacttcgggatccttcctcctgttttgattgttgtgaatacaatgacaaacatatcatatatcaatagcaatgatggatgttatactgttgcttatatatgttgttgcaaccgttgtgatatgggcttgatagcctcaaaaacccccgattatgtttccttcatagtttgattaaatttcctttatttctgtttataactgtaagtatgtttgtgtaattatacgtaacagatatatttgaattccttccactttcattgtagtttaggctatacttgatcaggttatatgttacagtttttcctaaatggaacataataatttgatcaggttattaaccggaaggataatgatggttacagaagtccagctgatatatggagcctcgggtgcactgtgctggaaatgtgtactggtcagatcccatactctgatctagaacccgtaagtcttcaggattttcaaacttttgaactgtcttataatcttaaacgacattgaagggtctacttaatgggattttatgagttaaaggtcagaatttgtgcaaacgcgcaggttgaagccctgtttaggatcagaaggggtacgcttccggaagtacctgatactttatcactagacgctcggcatttcatacttaagtgtctcaaattgaacccggaagagcgtccaactgcaactgagctactgaaccatccatttgtgagaaggcccttaccatcctcaggctcaggatcaacatctccgctaatccgtagatgaatctaattttattagattgcctccataggtgaagcctctagtttcgttttattgagaatatattaggatcaaacgctatattctaacattgatatcttaatgtatgagagcaggggtaaccagaaggtttatgagatattagaccccatagaaactttaggggagacacgagatatgattctttgatacatatgctgttttggttgcgcagcaagagctaaactttctcgagacatatcttcaggtagtttctgtctcattcattggttggttgttgtaagttgtgtcacttgtgtgtgttgagcttatatttaaaactgaagagccttggttaaattagagttttgggtgcataggtttgtttagttttgttaaattatagtatcatgtaatgtataagaagaaccttagttgatttagagtttcgggtgtataggcttgtttggttttgataaattatatagtgtatgcatgtaacccatatcatgtaatgtgtaattatagttggctcttatatagttcctgcttgttgcaactgtttacacatctcatgtctcgatggatttaatctccaatttttcttatatatatatctgaattatacatgcatacatacactataatttaacaaaactaaacttttcttttgggtgcaaaaacataacctatattcatctcttaattattttacgctgaagaaatctgctgtttcaattaaaaaagtatggtcaaaccaacattttctttgaaattttggtgaaagccactctcattgaagtgtatatatgattcaacttgtttcttacaatatttgccccgttgaaaacttttttgccatcgatgagtttctttaagggcaaagttcctttaagaaatgcttttagatttctttgtatacctatgaatttttaatcaagtgatgaagacacggagaaaaatcctaaattgatgctaaatattttatctgtggacttaaccaagtctcccacaaaaataatacaagaatctgcaacaatttttaaaattcagtattcaattattattcagatactattactagattgaaaattcaactcttgtcataagtcgtcgtcaacttcttttgtttgcttcttcctttttctctaacaggtgcagtgttactgccagttgtttggatatttccacttgtgtatttattctctctatctctttgacgtcgtctacagactaca

SEQ ID NO: 7806 - DNA, 3000 bp, Unknown; identical to SEQ ID NO: 7802
  misc_feature (1)..( 3000): cDNA_ID_3046557_gDNA_ID_1621164_Annot_ID_173801 3000 nt of promoter + ATG

SEQ ID NO: 7807 - DNA, 3000 bp, Unknown
  misc_feature (1)..( 3000): cDNA_ID_3046570_gDNA_ID_1621164_Annot_ID_173794 3000 nt of promoter + ATG
aaataattgaaatatccaaaaatatttaaagcaaaatactgaatggataaatttttaaaaccaaaagaaccgaaaccgaactttcaaaataaccaaatggatactaaactttagaaccaaaaaaaccaataaccgaatggatacaaaccaaaaccgaatggataaccgaacacccatgactattttgacaatgtatttctttacaaatttaagaaaattggcaatgaatataaactcattattggtaaagaatatttagttagattttcccatatctcttaataattaattgcattagcatatttggggatattttcttaaacaaaaagcaacattcattaaattttgctttcactttctaaaaaatcttggcatattaatacattgaacatgtcttcttataaatgaaccaaactaaaccaaaagatcctaatcaaaatcaaccaaacatgagcaaatcaatctttgttgtttgtatcactttattggttgttctatccccaactctaaatgctaaaatggtgacttacccgaatggtgatagacactgtgtaatggcccaaggccaagtgataagtgcatgcttgcaacaagccaacggactaccacatgcggattgttgctatgccataaacgatgtaaacagatatgtagagacaatctacggtcgtttagctctttgcaaatgtttccaggaaattctaaaagattctcgatttacaaaacttattggtatgcctgaaaaatgtgccattcctaatgctgtgccttttgaccccaaaacggattgtgacaggtttgtagaacatatttggcttaaaatgttttgaattatttgcactatctcgatagaactttaagattttctttgtaaataaagttctgagaaggttaaaaaattgatggttatgtaaaatttcattgattttaaaaagagaatattacgtgattagacacttttttgaaagttaattcctaattagccactttaaatggagaaggcactttagataaattattttacttatttaccctttaactatatttttttccatcggtcatctcttctctctccttttcccatctcttctctctttttttctttttttttcctcgctttatctaagaaaaaaacatttcccagaatatcttcaattccaaatctgcaattaatctccaaatccactctacgcgatggctttctcttctctctggactaattggagaatacgaggccttggtttctttaagattgtgatttattttgcaatttaaatatttgttttgacataaatttgagattcagttatctaagaaacttcttcttcttcaacaatggcggcttgatttgatttttgctctctctcatgtgtcaaactcgtttcatctatgtagcatcgagattccggttaatcgaatttcctgttattatggacatggtatacagaatggatatagagcagtaaaaatgtttctgaatggatatatttaaatggactcgttattatggacatcaaaacattgtttgttgatttttctttcggtttgcagagacctctaccttcaaaaccttatggacatggaactttggtttctttacaaaacacagttaatcgaatctcctgttattattgacatggtatatagaatggatatagatcagtagaaaggtttctgaatggatatatttaaatgaactcgttattatggacaccaaataattgtttgttgatttttctttcagttttgaagagacctccacttccaagaccttatggacatgaaattttggtttatttacaaactacggttaatcgaatctcctgttattatggacatggtatatagaatgaatatgaatcagtaaaaagttttctgaatggatatatttaaatggactctttattatggacaccacctctgagaccttatggacacaaaacttttaccaaattcctgagataatcgagatcgaattgtttaagaaacttctccaaaagttgtggagacgtggagagagagagagagagagagagagagagagagagagagagagagagagggagagagagagagagagagagagagagagagattgattttttatttacgtaaggatcgtggagagagaaaatatttaatttgtgttaaatttcaaaagaaaagtttaagggtaaaaatgtctttaaagaaatcaaataatagaaaaagtgccctctccctcataagtgcctcaaaaggaataaaattatttaaaagtgtctaaacgtgtcacattccattgtatatattggcataagaattagaaagagcttattcgtagaaagatgcattccagtttctattgcagcaacttcacagggtttatctctagccttaagcatcatgtaagtcgttttgtatttttcaaaagattgatttttgtttatatatatatatatataatgggggggggttgcgtattaggctaaagatatatcgtatgtaaatattatttacctaagatatgattctatcaagtatagaaaaccctttttctataaaatacttcttcactctgatgaataatacacatactttacaactagttcatagaagaagatgtttgggtgtggtttggttataataggctagaaatgaatatggtcttagttaagttctaagtagatttgctaaactagagtagttaaagagtgttatgttgttagtgtagagtagtgatgttaattgttattgttagagttccaatgtgtaagtgtagagtggcttgtgtaagatcaagctacaatctaggagtaaggtctaagtgagtctagtgtagcaagtgggtggagaaaatataactatatgtgtgtatgtgtgtgttatgttgtgttgttgtgtgagatcaaaagttattaacaatgtagacaattaaaagacaaaatcgtttcttgtgtttctctctaacaagaactacaagagagtgcaacaataagagagagacatagttaaagaatg

SEQ ID NO: 7808 - DNA, 3000 bp, Unknown
  misc_feature (1)..( 3000): cDNA_ID_3046577_gDNA_ID_1621164_Annot_ID_173791 3000 nt of promoter + ATG
attataactatataatttaaatttaaattatatatttttttattaatattgtttgttttgttttgtgttttagataatgtaattgtatcttaattgttatatctaggatttcacctttagtataccgtcttgtattactatcaacccaaacccgtcataccatctaatcatgttcaatgaaattaaacatatctaatggatttcacccgtggtatatcgtctcgtattactatcgacccaaacccgtcctaccatctaaccccgttcagtgaaattaaacattattttgttatttttgttttaataatactttaatataaaaatatataattcaaatcaatttaaaagttttctttcaaatggttatttaatttttataaagttcatatgatatattattataaacccatcctaccatcttatctcgttcggtgaaattaaacattttttttaataatacacttattaaaaaaattataattcaaatcaattcaaagttctttcaaataattatttaattttgtaagattttccatattataaatattgtaaacgttttccgttaaatattctaaaatgtttaataaattatagataactataatatttatcttttaataaagtataatattaataatgtgctaaactttctcttctttgaagtaattagaatttatgaaaatatattagataaggaaatgctagtaattaggaatattagtttattgataataattaatgctaatggcattccttgtaacttgtaagtgagttccaactctaggatttatttcacaaaatggctgcaaaaatgtatatgtagattgttcataaaagtatacaagtcattttcatgaaatcaaaacttataaaaatccacttcatgtttttttttgtttttttgaaatgttgggttaattttggaaacaaaaatcttttagtactatttttgtcaatcttcctacattttatcccaatttctatctaatgaatttttattaattgttttgggtattttggtaggcatatgcatagtacccgaacccgaggaaccaacccaaaattgacctgtaaactcgattcatatccaaacccgaaactttcaaatacccgaatgggtctaaacttcaaaactcaaaaaacccaaacctgaacccgacccgaataggtacctaaacatacctcaaatataagtatatattaataatatcttagttatatttatacttatacatacaaaatattctgatttttaagttattcttgtgtattgtcggttacttctggatatattcaaataaaactatatgagttggtttggtaattttttaaatttttaagtaatttgatagatttgcatacaaaatttttatattttaatatttaaattaattcaagcccgaacccgactagaaatctaaaaatatccgaacgggtcttaaattcaaaaatctcaaatgaataaaaaggattttaactagtatttataaatcatcgaatcaataatatataattttaattagaattttaagatcaatgattgaataacaatttttggttgaatttccaattcctaagctataaaccaataacccatcctaaatatttcaactaaaccgaaccgacaagaaatcgaaccaaaaaaattctggttcccttatcgatcataggaggcaggaaccaaaaaaacaaaaaaccgaatgaaaccgaataaccgaacgcccaacccttttgtacatacttaaaccgaccatattccatgtttcatgttacaaaaatagttaaaagattttacaactacagtagaaactctataaattaatactcgataaattaataaacacgataaattaataaattttgccggtcccaagtcgggccaatgtaaaaattaaccaaaatcgataagataataagataataatttttttgaaatccctatgtaaagttatagtcccactaatattataaattaataatcataaatcttaagtatatattttaagactaatttttatatgaattttttgttcaagctacaattacaattctttttaaaatacaactagtatgatatctgttgtactcacataactatttgcgtatttgatccgtcatagttgattttgtaaaatattttatttgagaaagcattgctaagatttgtgtaaagagaaactggattaagcttcatgtttacgtttacgttcacgttaatattgtaaatatacatacacaatatcttgccaaaaaataaattaaagaagtcaaataaaaataaaaatctaacataattatatatgcaaacaacaaagcatatagataattaaatctatatatacatttttacagccattttgtgaaataaattctggagttggaacttatttacaatgtctgccattagcttttaattattggtttttttttggcaaatatattaaaagcatatagataattaaatctatatatacatttttgcagctattttgtgaaataaatcttggagttcgaacttatttataatgcctgccattggcttttaatatatgttaataaacattttcaaaataatataatattgtattttacataaatatttctataaattaatatttattaacttatacgataaattaatatttattaacttatacgataaattaataaatattaatttataagataaattaatattattataaattaataaaattttatggtcctaacattatagagtttctactgaagaacaaaccgaaaagtaaaaaatatctaattctgtattaaaccagtaaaatttcgtaccgcagcgataccggtttactaatcaaacccgaaaaaaccactccgtatccgtaatcttcatctctcgctacgacacaccaactgtttaatttcccaatttgtcgccgactcttcgaccttaaatcaccggaatctttctctaggtcgccgtcaagcttctctccggagaatatggttttggaataaacgatg

SEQ ID NO: 7809 - DNA, 3000 bp, Unknown; identical to SEQ ID NO: 5030
  misc_feature (1)..( 3000): cDNA_ID_3075380_gDNA_ID_1621164_Annot_ID_173784 3000 nt of promoter + ATG

SEQ ID NO: 7810 - DNA, 3000 bp, Unknown
  misc_feature (1)..( 3000): cDNA_ID_1809330_gDNA_ID_1621164_Annot_ID_57183 3000 nt of promoter + ATG
atgcttgttttagaaggaagaagcctgtgcgttcttgtcaacgatttatatgccgttgcgcgattagagatgttggatattaagacattctaattttgttgtaagatttataaataattttaaaatataaattaattactagttaatgttcttccttgtatttcttttacagtattgaacatgtacaaaagtatgaaaagctaactagtattaccctaatctaataggaacatgtaattggaaactcaagttttcccgccaaatttttgccgtcaaaaaaatattttccgccaaacatttttcccgccaaattttttttttcgtaacaaattttttatcaaccaaaaaaatagttttaaaaatccttgtaaattttttttggcggaaaatagatttacaagggattttaaaagggttttaaaagatttataatgaattttaaaagggttttaaaacaattttaaaactcttttaaaacaattttaaaactcttttaaaacaattttaaacccctgtcaaaacaattttaaaccctttaaaaatctttaaaaaacctttgtaaatctattaaagtcttttaaaatcccttgtaaatcttttaaaactcttttaaaatcctttgtaaatcttttaaaacacttttaaaatcccttgtaaatattttaaaaccctttaaaaattccttgtaaatcttttaaagcccttttaaaatctcttttaaatctatttcccgccaaaaataattttggcgggaatttttggggggaattttttcgaaatttttttggcgtgaaaattttgtcgaaaaatttattttggaatattttaggtaaagaatattaatattttattttgttaacctaaaacaattttcaaataggggtaaaatggtcaattaaaatttaaagagggtagaaataaaaatggctaaaaaaaggtagagttgaaaaggggcatcgtgaaaagagcattagaaagaatttttaataaaattacacatattgtaaataaagttttttgtaaaaaattagttctgaacctataattaatattaaaagaaaatacaatttattttcattgataacttataaaaaacataatatatatacagtaaaacctctataaattattactcgataaattaataacctctataaattaataaattctttcggtcgcgagttggtaccagtctaaaaagtgacacaaatcgataaattaatcaaataataattttttgaaaatcctatataaacatatggtctcattaatatcataaattaataattatataaaaatatcaactatatatatatatgttataattatatataataactttaatgaaatataattttagtattgtttctttttgcttaaactcactttagttatttttaatttgattttagtaatttttactatatcaaaaactgttcgtgttgttttttaaacatgataattgattttatttgtaattagttctagaaaaatatttcaaataatgaatggaagcttatattttcataaaaaagtttttaaaaaacttatcaaattagaaaaatctctatataaattaataaatattaatttatcgataaattaatacttccataaattaatagaattttgcggtcccaacattatttatttattgaggttttactatatatatatccctatatattataaagaattttgatagatttaaaactttatttacaacccctgttagacgacaaagataggcttcacaaataggtagcaaatgaaaggttaaattggcatgtagcatatggaccgaaaatatgcgaataagtactaataaaaactgaggaatatcgaatattttcaaataagaaaccacaatgtcactttaaaaaatagtattttagctaatggcttttaattttgcgactaatttgcaatatctctatttttttaataaacaattaaccatttatatttttaaaatgggaacgatagaaaatgatacttatggtgattggttcaagctttgaaggctttaacttttttcttgtaaagtctttaaagattgagtttttaccaatcacacttttttattttaaataatttaaaagcttttaaagtctttcttataaatctgaactgtaacatataacaataaaattcacacaaagaactttataataaggtttttatatataatatacatcaaatgtaatatttgatattttttaatatctacatatacatttttgcagccactttgtgaaataaattctcaagttgagaattatttacagtggctgccactggcatttaataattatttttgataattagaaagtaaatcttcgaattaaatatttgacatttaactatttttccaaaatctctctacattaactacacgattagttactaaaataaaacttccaaaatatttaacatcatttaaaaattacaaaattatcatttttgatattgtttttttgtatgactataacaattcgattatacgcatcaacctacatagatatttgatagcagttaattaatacaaaattacaaaatatttagataatgattcataaacatatcataaataagatcaacattaataaaataaatagttttttttacggggcggattggcgagacgggtttggtagaacgttacttaataacaattgtaaactataaaataaaaatattttataaatagatacaatttgcaaacttttatatatactaacttaaaaaaaaaattgtccacgcggtataccgcggataaaaaactagtttttatatacataagtggattacttaagaaaaaaatgattaaaaggtactctttactctttactcctttagaagttacaacactatactggattacttaaaaacaaaaactttcatgaaaaagagaaaataataaaattgttgactggaaaataaaaatacaattaatataaagaaatctctctaacaactttaccaatcatcgtcgctcac

SEQ ID NO: 7811 - DNA, 3000 bp, Unknown; identical to SEQ ID NO: 7805
  misc_feature (1)..( 3000): cDNA_ID_1809326_gDNA_ID_1621164_Annot_ID_57184 3000 nt of promoter + ATG

SEQ ID NO: 7812 - DNA, 3000 bp, Unknown
  misc_feature (1)..( 3000): cDNA_ID_1809323_gDNA_ID_1621164_Annot_ID_57185 3000 nt of promoter + ATG
taccggtttggttccggttattttacccaaaataccaaaaagaaaaaaaacgaaataaccaaatattcgattaacaaaattgtaaaatattaaaaaattaacaaaactctattgggttataggtttgttaaaaatgtagtgggcttagatgtagttttgtatagggttgaccaaatattttttggttagattttggatttccatagatattcggtttgttcagttatacataatattcaatggatagtgtgactgaaatccgttcgaggatatttagtattatctagaaccgaaccggattcctttttcggtttggcttggttcggttcttcggttccggtttttatgcctaagccgttctaacttctatggttaattgaagaatgtgaaatggtggttaatattcaagaaattttaggaagccgaagtactaaatttagatactgaagaaaagaagaagaagcataagaagaggcctaaatgcccagagaattaaacaaatgggcctttaacaatatttttaacaatcagatctcaaaaagctaaagccttaatatataaacaaacatcaatctctggccgtcaaaggttacatctatcgccgccgctgagaccgccacttaaggccgtctcctccgcaatctccgtaaccaaaaccaccggcatcgcctggtaagctcgattttgtaatcatttcgatctcatatgatgtcgatctgttaaatcttgcgaaatcgatctttgttttgttctgagatttagggtttcacgaatttgtgttctaggttttctggcttaatcatttctattgttttttgttcttattggttcttatgcttttggtgacacaaagatctcgactttttcttgactctctatgcgaatttgtcaaaagtcaaaactttgtaacagtttactctctttcgtgcttgtgtttatgtatgaacaatagcttcgctattgggattgtttatttcaccacacttgattaattatacatactattgaaaatgttatcaatcttggcgataaaaaccgtcattttcatgtgtcttagctctagtagcaccttttgtttagagatcctgagtttaaagaagcagtagctagcatctttggtatagtaaattgtttcactgacaaattgtatatcatttggttataactagattagtgaaatttaatggatgagattatgtagcattgttttaattttgtatggagagaactggtggtgggcttatttccaaaattttcctttgattaagtcaagaccctttattttgagaagtgagagagaggattgtctgagtattgtcgctttctcaaaatctttccggggctaagcagagaaaagctgatagttaagcttaggaatgtgatcttggtcttttaagaatcttgaaactagtgggtaacttggatccatcgaatttgttttccgtaggtgagtgttctttagcctatttctgagtctgaattatacagtgtagacatgaaaataggtttttatgtgatggactcttttgttttatggtttaatggatatgttgagttttgtttttcccatgagtctcttataaagttggaatttgattcatggaatcttggatccagattacttcgaatatataaatgaaagaacacttagatgtatcaaagggaacttaagcgtgtgtactgtttagtgtctcacaacttggaatttggattagcgctttcatgttttggagtttgatttatattcgtgatgtttggatttggatagtaccttggtccattgaactatgtatcataataatgctttggatatggatatcgttttgatgacttacttgataactgctcatacttaaaaaacatttgttctagaaatctagattctcgtctatgagtgtttatatgttgaattcatgtcgaagtcatagtttagagatctcattgagcatttccccttcggaagagtgaggagtcttgttttggggattctttttagggctagacctgtgaggaccttcattaattgagttcgttttattttgtacccaaatatgttttttcggcttatcccattggcattgaaaaagttattgtttacattaaaatgttatttttttctttcattgagattaccttgctagtcattggattttatcggttttaaacttttaatagctgaacaaaaggggttttattctaatgtttacttaacactagtctggtcataaacaagtataaattttgggtttaagttatacttcttttattggaaatacatatcaaattagggcgtttcatagatagttgatatattttcttcacttgcatgtagttatgttcggtattatcgagaacttactgtgtttgaagttcctcggcaggaaaatcctgtagagtttgagccaatgttgtcggtgtgaacctcaaaagttgtgggtgtttttcccgccgataaagctgctggcaagatgggttggggttgggtagaatggtgtgtagggcaaggtaaggatgcttcacttacaaaagaatcatttagaaccgtttctttctttgggatctaaatgtgtttttttcggcttatcccattggctttgaaaaagttctctagtttgtttctttgtactaggagcattcttaccattctttaaacattgggcagtgaaagatattttcttggattagtattctgcttcttgtggtgttgtgtgacactcctagactatgttatttcctgttaacactgtctttgtaggacaggatgtgagaaatatgctgtttctgcaggataccctgaatttaccagtttaccggaatcatatcagaaacataaactcttatgttacaaaattgtaatggattagttgatgcgcattctgtgttttttcagttgtaaatttgcagaattgttgaatgttgattgctcgagaagagtcttgtgagtgaattctatttcttaatatatctgattatcgtttttgttgttgatttaattagcag

SEQ ID NO: 7813 - DNA, 3000 bp, Unknown
  misc_feature (1)..( 3000): cDNA_ID_4359805_gDNA_ID_1621165_Annot_ID_57187 3000 nt of promoter + ATG
aagggattgtaacagagttgcggacaaaaaaagtctcagaaaatatattcatgatccaatttacattcaacttttacacatgccaatatacctatcatacactagagtagccatgctatacatataaatttccagctgaatgaagagcataacatatgaacagaccaaatctagaatgttataatgacatggtagacaggattctttaacaaaaaaaaaagtacctggtaattcatgaaggtctcaatcagttccacagtctgatacgaaccaagaactgtagattgatacctgaacaaagaattaggcagatctaaatacattcacaagaaaaaatttaacaagtgaactcagactgatgtcattaaaaaacctaccagccaacagtgttgttgtcaacattaacctccctcagacatctcatcatctcaagctgataattagcaccatcagcttcaatttcttcatcatcatccctgacctgtcctcgtttaagatacaaattccagtaaatcacatgtacatcaatcatgaacaagctcttaaatcctcacaatgcgtgtaaaattcatcaacataccgggaaaggaaaacaattggtaacttcgaggacgctaccaacatcaagtccaagaagctgtccagtgacaagggtcggtgaaaactccttgcagtgtttgattatctttagtacagcctatcacaatagcaaacaaaattctcagcatcacaacttcctaccaaatgataatgggcaaattagcttcacctagagagtttttatttatcaaacaccatcggtcagcagaaaacgaggaaaaacacttaaaaccgtaaaatcagggaacactaagaaacgttaccagtccttcgatctgaacaactctaagcggaggagccaccgcctcatccttcgatatcgcctgcagaaacgacctagccactgcagaaataaaccacggaagaaacttagcacgacatatacagaaatcgtcaataaacagatgcaaatattaattctatgtcctagtgaagaacagagaggatgattatactgactggttgccattgaaatagtctccggtgatagtgaaagcttcctaggtcaaagaacttgaatctccgccgtgaaaccctaacgatgtgatatttttactgccggcggcggagatgagtaagagaaagaactttatgtgtttgatagggcttctcgaggatccgcagatttttttttcccttcaatttgggtgtagagaggaaaaaaaaaaagcgtttcgcagttaaaattgcaaaagagccctaaaatttgagattcttatagaatgatccctaaatgttttccgacctataataaggatggacccagcccatggacctataatgctattctcttgtaaaaggccaggaccataatattcctcaaaatattgaacatttaatttaatagcatgggcccattacactaaccaactagtcaaaacttagtaagaaaaaacaaacagtcatggagtcaactagaatccaaaacttttagaaactttccctccaaattccatccggtattagggtttaatcgaaaaagaggactaattcaaagtctaatctttagtaaccaactttaaaaagtctataagacatggtcatttcataagtccgtaagaaaatcaacaatgtcctaaataaacggcaaaaactagagaatcaccactggtatcaaaaaacgtaaaaccaaatatataaaacgtattaaatgtactatagtttattactcgaaagtcgaaaaccttgatgattcattgaaggtcaaagaagtcaacaataatattgatgccaaattaaatgactgcagtctctttgcgaggttggtgtttggactggtggaccgctggttaataattaactcagcctttacgtgaactcaattctcacctcttctttattacattttcatcacgcttaagctaagcaactaataaattcctaatttaataaacacttcaacatcctcgttttagagattgaataccaaccatgaatgttaacacatctttaactttcctctcaaacaaaaatccaacaatctatatcctcattgtataaataacatgaggtccatattaaaatacgattaaaaatattataaaaaccatgtgaagattcaacaagaaaaagaggtaggaaaaaaaagcagctcaataattggtagagagtgcaaagaggaaccagacaccaactgaataaaattgaaaaacaatgtctctccttactttaaataaatcatccctaaaattaattattcccaccatatttcttctgctccataccacacttcaccataaaatctctatataaattttctcagcagcagtaactaccttggccccaaaacctatctgtctctgaatcttggcaaagtaatagcaaccataacaataacgacaaaaatatacgtgaattatttttctctttctccttcgtctctccttcataaacccattattaattttttttataatactactattattcatgaatgcattgaagatgtcacagtgagaacaaaaaaaaagttttccaggcatggcttcacgtgatgacatcttcctcgaccaagaacttcgagaaaagatactcagaaagtgaagtgagagagagagaaaatgccggggaattttaatgcttcttcttctcttcttagtgctcactaccagaagatttctttccgccattaaagagcagagtagagcagagctctcactttcttcttcttcttcttcattttttacctttcccttttttgcttcgatcgagatgctttagcataatggggcagatctggaaagtgacttaataatagaaagtgatggctttgaggagattcatgggatgctttttatggaaactcgatttcgaactgtatcaatcatttctgtttcttttatgagctgaggaaaagagccactctttctgatttgattgattcatcattcatcgacaatg

SEQ ID NO: 7814 - DNA, 2247 bp, Unknown
  misc_feature (1)..( 2247): cDNA_ID_1394643_gDNA_ID_1621165_Annot_ID_57188 3000 nt of promoter + ATG
agttagctttgaaactaagaaccctaagttgatccaactggttcaaactcttctcgttaagtgagccggtgagattcaagtactcaagaacaagcttggagactcttccattcatacattctctaacaccttgccagttgcagagatctgttcctctccaagaaatcgaattagatggatcgattgaagatttcaagcttagtaaagcttcgacgtcgctagatctcgccggagtaaccaaacagaagaagactgtaaatgcaaagactacgaacgacaccgtactcgaagacgaagaagaagaagaagaagccattgtcgatgaatgatgaatcaatcaaatcagaaagagtggctcttttcctcagctcataaaagaaacagaaatgattgatacagttcgaaatcgagtttccataaaaagcatcccatgaatctcctcaaagccatcactttctattattaagtcactttccagatctgccccattatgctaaagcatctcgatcgaagcaaaaaagggaaaggtaaaaaatgaagaagaagaagaagaaagtgagagctctgctctactctgctctttaatggcggaaagaaatcttctggtagtgagcactaagaagagaagaagaagcattaaaattccccggcattttctctctctctcacttcactttctgagtatcttttctcgaagttcttggtcgaggaagatgtcatcacgtgaagccatgcctggaaaactttttttttgttctcactgtgacatcttcaatgcattcatgaataatagtagtattataaaaaaaattaataatgggtttatgaaggagagacgaaggagaaagagaaaaataattcacgtatatttttgtcgttattgttatggttgctattactttgccaagattcagagacagataggttttggggccaaggtagttactgctgctgagaaaatttatatagagattttatggtgaagtgtggtatggagcagaagaaatatggtgggaataattaattttagggatgatttatttaaagtaaggagagacattgtttttcaattttattcagttggtgtctggttcctctttgcactctctaccaattattgagctgcttttttttcctacctctttttcttgttgaatcttcacatggtttttataatatttttaatcgtattttaatatggacctcatgttatttatacaatgaggatatagattgttggatttttgtttgagaggaaagttaaagatgtgttaacattcatggttggtattcaatctctaaaacgaggatgttgaagtgtttattaaattaggaatttattagttgcttagcttaagcgtgatgaaaatgtaataaagaagaggtgagaattgagttcacgtaaaggctgagttaattattaaccagcggtccaccagtccaaacaccaacctcgcaaagagactgcagtcatttaatttggcatcaatattattgttgacttctttgaccttcaatgaatcatcaaggttttcgactttcgagtaataaactatagtacatttaatacgttttatatatttggttttacgttttttgataccagtggtgattctctagtttttgccgtttatttaggacattgttgattttcttacggacttatgaaatgaccatgtcttatagactttttaaagttggttactaaagattagactttgaattagtcctctttttcgattaaaccctaataccggatggaatttggagggaaagtttctaaaagttttggattctagttgactccatgactgtttgttttttcttactaagttttgactagttggttagtgtaatgggcccatgctattaaattaaatgttcaatattttgaggaatattatggtcctggccttttacaagagaatagcattataggtccatgggctgggtccatccttattataggtcggaaaacatttagggatcattctataagaatctcaaattttagggctcttttgcaattttaactgcgaaacgctttttttttttcctctctacacccaaattgaagggaaaaaaaaatctgcggatcctcgagaagccctatcaaacacataaagttctttctcttactcatctccgccgccggcagtaaaaatatcacatcgttagggtttcacggcggagattcaagttctttgacctaggaagctttcactatcaccggagactatttcaatg

SEQ ID NO: 7815 - DNA, 3000 bp, Unknown
  misc_feature (1)..( 3000): cDNA_ID_3046629_gDNA_ID_1621165_Annot_ID_57190 3000 nt of promoter + ATG
tacatagttatcaaaatcctaatcaaaagagtaaaaaatctaatttatagagattttattatagttgtagtgttagttccatcgctaaatcccttgaacgacaacgtttattatttcttcttcggacgattgtttgaagaaatttaaaaacgacatctttttattacttcctcttcgaaagattgtttaccaacaagaacaatggcggtttatcatctccttctctcgagcccaccttcgcttcttcttctccctccttctcctcgccgccctaacctcaccttaatccgccgtatcccagctcatcctcgcctcggaaactcgaccagcttgctttcttcttcgtcaccggtaattcggaaaattctggttcgtagcactctccgggaagaccaacccatcgcctctgactccgagagtagtcctactctactgatcggtgaagattctgctgcttttgaattagggaaacagaagcttgtttcctgggtttatttcggtgttgtccttggagttgttctctttatcctcaatgttgtttggatcgataattccaccggtttcggaaaatcattcatcgacgccgtctctaacatctccggctcaccggaggtatagatcaatttaacagtaactgaaccagtttcaatttcagttatttgattgttaaaaaccacttgtttttgcaggttgctatgttaatgcttatccttatatttgcaattgtacatagtggtttagctagtctaagggatataggagagaaacttataggtgaacgagcatttcgtgttttgtttgctggaatctctcttcctttagctatgagcaccattgtgagtactctctcttctaactctgcaatttttctcctgatcaatggtataaatacctgtttgatgtctcttatggtctatgcaatgccttgttcttctttcaggtttactttataaaccatagatatgatgggtcacagttatggcagcttcagggtgttcctggagtccatgaagctatttgggtcgctaattttgtatccttcttctttctctatccttcaaccttcaatcttctggaggtagcagctgttgacaaaccgaagatgcatctctgggagaccggcatcatgagaatcactcgacatcctcaggttttgaacatttccctaatgtgcctaaacatgaagacaatttccttcatttttgtgtttcaaaaatacagaaagattggatttttatgagccaaggtttattagtggctgtgttaatgagacccccaatcattgaatcaattatgggcaggtattggccattgacttaaatacacccattacatcagcacaatcaaatctcctcatccttctatgtttattacatcaatgcttgattactttacttgatattgcttttgatcttaaaattcttatccaattgcttcatcatgtgtttggaaaaacttgataatatatagaaagataggcattttagcttcagttttggtttgttctattctctcttcattatactggctttgttaatgagacttgattgttgcacctctctcctctgatcttctccagatggttggacaaatcgtttggtgtttagcacatactctctggatcggaaacacagtagctgcatcagcttctctcggtttgattgcacaccatttgtttggggcgtggaatggagacaggagattggcaaaaagatatggagaggattttgaaagcatcaagaagagaacaagtgtgattccatttgctgccattttcgaaggacggcaagttttacctgaggattactacaaagaatttgtcaggttgccatatcttgcaatcactgcgttaacggttggggcatattttgctcacccgctaatgcaaggtgcaagctttaggcttcattggtaaattatatgtcatgctttaggcttcattggtaaattatatgtcatttatgtttgtttgtttcctgcagtgttcataaagacttgttaaggaacaaatgtatacaaaaagccatattgtttgtgatacttgactcttcttcatttctcgattattttggctcaacactctgtaaccactatgtgtgagttcgatccaacaagtgggtttagattagtattaactaggaatgtttaatagtactgctaaatgaatatttaggtaaaactattttgtatataaattcccactcagatgtcatgggtcactctgacgcctaccactatactaatagaagtaaatttttcttttttcgatgtttagttacaatcggaaaatgaatctaaattttaactaatattaataatatgccaagatctccatccaaatctagattgatatctacatattgatgccttgatatctctaaactctaaagataaacttaaaggcaagtgattaattgttaactaaaattaaaaattaacaatacaattttaattcgctagttataaaaattttattaccaagaagaatatggaaaaaaaggaattggaggcaaaaaaaaaaaaaaaaaaaaaaaaagaggccaaaagaaaagaaagcaaaggagtatgaatacaacaaagaggttctgcaagaaacaaacaacacagccaattactactaaacaaacacactctctctttcattctttctctctctctctctctcgattttctcccattggagttcgcaattagctgccactctctgatcgatcttcttctcacatcacatcctttataatcttcagttctactgctcggaggtgtttgcttgcgttctctcttgtcggtcacatccctaattaccatcactgcccctgattaaagttttactctatcttctttgttgatgccaaatctgaggtgggtttctcatctttttattctttcagctgtgttttgtttcatttatttgtttctggatttgctaaaaccctaaatttgatatctttgggggcatcatcgtagctcaaatcagcttcaattatcaaatctccacga

SEQ ID NO: 7816 - DNA, 3000 bp, Unknown
  misc_feature (1)..( 3000): cDNA_ID_1809386_gDNA_ID_1621165_Annot_ID_57196 3000 nt of promoter + ATG
agaacagaagatgaacacgcttgaatcactagtgaaatacgcgagaggtctgaaacgaatggtgataaggattctccggatgaagagcaatcacagcagtgcagatgatttctgcgatgatatctgcaagttccggcacatgaacgagcatcttgttcatatagaatgaaataattttttgctgctaatcttattttcagccatttgatttctgtttctctttctggtcgctgagcatttcttatattgaactcttgagtaattgttgtttcctgattcatggttatgatgaacttatgacaattgttttttaaacgaaaaattatggacacatttcttaattagctttcttgttttcttaatctacattaataatatactagtagtgatctagcagaatataattacagtttatgataaagtttgtttttggagtatacttatgtatcaaagaagtattgtcctatgcttaaaaaagataaaagaagataatctccttaaaacaagataaacctcagattgcattacattaaaataaaacgagaaaacgcaaaacgcgcaccaccaacaatttcaaaaccaaaaaaacttgtctatatataacgtgattaactcctgcattgaaaaatgacctggtgataatttcttctcaattcaaatacataaataaatatcaataaaatggcgggccgcgacacattccagctgcgttttgcagcagtcgcggcatccgccgccgtattgatctttctcatggctggtcaagtcgcggagtcgcgtatgatcaatatctgctctcacaccgcgtatccatctttgtgccgacctctggtgaaacgtgtcacgagccctagaaaagccacgcaccgaaccatccaagctttggaggctaagacgaaactagctctagccgaaacagctaggttcaaaaacggtaaccaagcggtcagcacgtgttacgagacattgggcgacgcggtttacaatttggcaagcgcgagaaagagcataaggaaacgtgatgtgccggcgatgaacacgtatctaactgcggctgtgtctgattacggtgcatgtgtggacgggttcattgaaacacaacaggttaatgcgatccaaaatgcagtggttgacttgagaaaaattagcagcaattgcttggcgttgtctacattgattagatgatcgatttaagagaacaattgatttaatttttctcaaaacaaaaactaattaattgaagaaataaaaaatctcaagcaattaaaatttgggtttctttttgttgtttttgttttgagagagatgtttgttgttgatccatcattcgtatgtaacgccactgggtgtaactaattatatttgaatttcgtgtaattaataatcgctagtagattttttcatattcaacaatttgccgatagaaatgttttccattctcctttcttgaacccactttactttttcactatcaacaataagattaagttttgaccgaaaaataaaacaataagtgacaaagacaaacacaaactatagtaatgcacaactttttgttttgttaactactatcactaattcattattgatatggatatcattatgatgtttttagaaagtatatgtgtgattatgttttacttttcccaggatccataacaaaaaaatatctttgagaaaataatttggctatatcatatattggataaaaatattgccatttaaaatggtcttttaactctttttcttaaaatctgtatgtatattatagtttgatatgatcataaaagcattcaataatttttctttcatgcaaaactgatagatcttgctcaatgatcatgtttcaatgtctttaagtgttttaagaaagtgagaattgctttgatttggattgaaaaatattggaccataataaacacacataacattatacaaaattatcctttgcttctatatttaacatacattttgttttccacaatgtgtaaaactctctatagaagaaacaccacacaaaaacaccaaataaggtttagctaggatataattgacatgattgaacaagtgggcttgggatatatatcactacaagaatagaaagataaacaaaaatatcttctgcaattcgtggtttgtgaacacaagagaaaaaaaaaaaaaaacatgtcgaccaataaaaaaaagatacaagagaacgaagcataaaaatatcaaaacaaaaagacaaaaacaggaaaatagaaaaaagaaagaaaaattaaaaaaagctaaaatcaacggtgagaagattctgtatataataagaaaatatcacccaaataaaaaaaaaaggtggagtccacagataccgtccatcaacgtatcactgggctctctttctccgtgccgttcctcctacgtgctcgaataacgatgtgccacgtggtggaatcgaaggataaagtgtcgttttttacttcgattacacgtgagtgtatgtatgtgtgagtgagtgaagaagaacaaagagcgaagaaaccccccagcactcacttcatccataagatcattcaaattctgggatcttctctctttctctcattgtattcagtttcttcgtctcggttcgatcatcaggtatctttttcaattgaattttaccttcaatttcgattgctttcggtgtttttgttatttgattcaaattgcaaattttcttttgatagatattttcgttttgactataaaagacgattcttttcttcttagtgtatattgcacatgttccattcgcagaatgaagtaactgtttctctacaaagtgaaaataaaataaaaataacaagtgtggttctcttgtctaactctgtcagattcttctttttgagacaaatagtataacttgttccttttttttctcatctattgcaaaagcttcattgttttccttattatcttattatataatctctactttacttaacagatccggcaagtttgattcagtgacaagaaagc

SEQ ID NO: 7817 - DNA, 3000 bp, Unknown
  misc_feature (1)..( 3000): cDNA_ID_1809384_gDNA_ID_1621165_Annot_ID_57197 3000 nt of promoter + ATG
gttagctgccaaatgatacatgccatgccgcttcatccacctctttctttgatcttttctacatttcttcacaattttttagtttgtactaatttaatatttgtattggaatctcgcgaatggccttctctaaagccaaccaccaccacatcagtagttcagttaatagatatgcatatctacggacatttaaagctcacaaaatcaaatgtgtgtatgtttgtagatatcacaatgattcataaaaattacacaaccagtttgaccatatgatccaacaatgcaataatgcaaaatcacacaaccagcttgacctcaccatatgattcacaaccgatctcgtattcatagtatggcgtatatatgcatgcacaataaaaaattatcatatacgtgaaaaattgtgctatccacgataaatatatcgcaatgagtttgttttgacatttacgcaaaagtaaactaggattagaatgtataatcgattttggtgctcaatgcttaactaacaagtttaaggttgtttaattttttcttctctcttaagaatccactaatggtggaaatgtggaaggaagaatatggatttttttataatatgattaggatcttgaacctcacaagttatgcaacatatattatagatgctgaatctcaatttttgaaggtttacattgcatattatttacaagccatgacgacaagtatcaaatttatgtttgccacatattaaatttttaacatgcccatgtccaaatggttgtaactatgaagcagaaaacaatatacataccaataccatttgtaaatactagcatataactctgtacgtattcaaattacattatttctgttcttatcctgtataggttttaaatattgaaaaatataccatgcataatcaagggataggtaatgataattggtgggaataaattaaggatggcatgcatggatgggtccccaacataagcactcgagcatgcattgctaatactcagcctcgcgtgccaacactcccatgtccctaacacaaactacttagtaaattaaaatgatctaatctattatttacaattaattagtactaaactttgttatactcttccactaccacagttatactcttcacgtagttgttcatttatatgtatatttttcaagtagaagttaaaatcttatgaagatataatgctctcgaaaaaatgttgtaaaagaaaaagaaaaaagagagagagtagctgacagaaggaacatatagggaagagagtaaagagaaaaagcgaacttcaagaatcaacaataagaaaaagtaaattatttgcaaattcctctttttgtctcttaaaagatacaaaaaatgtttttttttttaaacacacagagaatgcaaactaacacaagataaaacaagaagaagaaacacagaattttgactgtcattatcataagaaacatagcaaccacaagactttcctttatatttggctatatacatttattcaaacaaacataatatgtttcaggctttgtattgctaattgggaacatttcccctcccccaactttttttttctcttttgaccaacttagcttatattaatttgatttcacttataactacatgttgcatacaatttttgcatattcttatctgctaataagtaaaactatgtgatagtcaagatagcatcaaacctacgggtccaaactaaggtttcaggtctaatattaggtatgggatccatctacactttttgttttttttactgagatagaatttacttattagcagatttcattttaggataaattccgataccaggtaaaatacaaacacaatttgaaaaggaatgattattgtttttaaagagattattcattaacacatgagacatttagactaaacaattactccacctctgttttagctagccatatctatataataggttctaataggtgatttaaggaggaagtgtgcatactcatattcttaagccatggaccaacaaagaaagagagaaaagcattgtagttagattttgcttagtcactttatgtcagtggtcttttatgattttgtcatttttatttcatttttggttcctctgtattcttggaggttaaaaaaaaaggaaaggcatgaatgatttcatcactatccaagccaagtacttataaaacacatataaacatttagactattactttaagacaccataattccataaaccccttttgaaactttctctcgtctctctctctctctttcttgttagcataaggccccaagaagacataagagtgttttcatgattctttatttgggttttgttatgaaaaaatttagcttctatagctttggaaatggtgagagcttgagaggattataaaaatcaagggtttttgtcttcttttgctcacttgctcattctttaatatcgagaaaacgttttgggctttgatgggaggtgtgttcgtgttgaggaaacccagaaacggcaataaatgccgtcgtttcgatcgatgcattacaatgagacaaacggaaacagagttgttctcagaagaaacaagaatgagaacaagagaaacaagacgaagaagaagaagcttcttcttagatatgatccttctgtttcgtacttgttcctccaacattcttttcctctctcttcttctcttgtcttcttctttttcctctgtcttgtccgagaatctctcacctagaaaccaaactctcaggccactcgatgagcttaataagctcaaagccattaatcaacatctcaggaagatcaataaaccttcaattaagacaattcatgtaagtttgaattagtattatcgtacgcgatcttctttttgcgttctttttcataaacacaatcttcttcttcctctgtctcagaaaaacaaaaaaaagcacttcctttctctgttcttgattctttatgctctgtttcaagaagtcgctctgttttttttttggtgtaa

SEQ ID NO: 7818 - DNA, 3000 bp, Unknown
  misc_feature (1)..( 3000): cDNA_ID_1809372_gDNA_ID_1621165_Annot_ID_173835 3000 nt of promoter + ATG
aaaccaaatcttttgaatctttttaacaaaaaaaaaaagaaaaaaaaaatctttgaatattataaactatgaaaatgatatcaaagtcatgaatagtttatggatgcatgtcttcgaaacaaaattacaaaatacatgaagtcgattcttataggattaatgttgatttgtttgacccgttgatattcattagaaatttaacgattttattctaattaatattatatatatgacatattaagaggtatagcacatatgtatatttttatataaaaaaaagtaattttgtttttaagatgatatatagacatatgttatttttttaacgtataatacaccttggtacaattttagaactaaaaaatttaaaattttaagttatatatatatatatattgttactttggttttgttttcaaaattgtataattatatttcgattgttaattatatgatttcatccgtagtatatataattccatattaatatcaactcaaacgcgtcctaccgtataaccccgtcatgtgaaattaaacatcattttgttatttttctaaaatttaaatatttatggtattgaaattaaaatatatatatatatatatatatattgatccaaactttataattgtattttaattgttatatataggatttcacccgtaatatatattgtctcatattaatatatatatatatattttaataaagtataactttttaaaagttttaaattttttgatatttaacttttaagaaactttaaatatttataatattttgaaatttttaaagattcagttctttaaaatagagattcagagtaaaccggataacatttttatttttggatgcctgataaatcaaacttccagttcattgttattcaaaattattttggttctttttataataagactctaaagcattgcccaatttcttaagtaatgtgggatctttcacacttacttttttctttatacatagagtaatatatgtctgtttacaaaaatttgaattacatcatatgcagaaaaaatctaatattttataaactatatatattttatataaaatcaaataaattagatataagaacaacaaaaagtgaaagaaaaagcatatatttatatttaatgtagatagagaaattttagaaaattcgtaattaattgattgtagttcaataatgataagatttaattaaggatttagacacatatttgttttagatagattttgtagaggctaaatatgtaatatagaaaagagttaatttaagtatttaatgcaaactaacaaattataaatttttagtaatagaatatttggttgaaatataactggtaaggacctaaatgttattagtaaatagttaagggatttttgaccaaaaagtctatcaaaaatgtatatgtagatataaaaatcatagaaaactctttaatgtataataacactatgacaatgccgcccattaacaaactcacggaaaaaaaaaaaactacttttctctattttctctcagtattgcttgcttcaagcatatttgtacttagtgtaaatacacgcccattaacaaacgtgaaccataatcttatccggtgaaatacatacgccaccaaatataataatatatcatgtggtcaaatcctgcaaaaaaactcatcaaagatattttgtgtattgtaaaatgattctatagtagtactaattaataggtaatatatactgttaactaatgtggacaattgtaaaacgacgacatagtcattgaaaacgaaatggagtatatctaatctggctgagagaagagttgatatgaaaagagagagcccgtgaacggatatacaaaatgagttttaaatgagaatagggaacccgaggaaacgcgtgacctaagctacgtaaattataaaaataacttatttttatattcatagggtgtgtttttatttacacaaatatatatagtatttgtatcaacttctatgtattaaatataaagagataaaaataccctttagatgcaagtaataaatggagtaacgagatggaaagagtcgttgagattcacacttcagttggcggtcctatttttgactttctaattatcaccggtcaacatattttgtagagattccatcgccgatgctcaagttttttgcaccctgtgaaaacatatatagaggtttttggtcggtgtttgccggcaacgacaaatatgtgatttcttagtttcttcaacaataaactcgtgtttgcctcttatctagctagaatgacctttgtttagtagttttctgaattgcagtttccctaaaccattatcttagtgcacatacataaattatggtgcaatatcattttggtaacgttactatttgttagatatttatttaacagaaaatgtcataatccttaaacacaaattcttatttaaatatgtaaacgttttctaaaacttatggcttcttctgatttattggatctaatatattggagcagccttttgtttaccattggaatactcaagctaagaataatattgttagcttgaaattttctacattctaatgtattctagtttcaactttcaactaacacatcatctttccacatagtaggcgcgtataccttcccaattttgtccctttaaaccggaaactaaccgaatttccctatccacattctaactaaaccgagacaaaccgtttcatttcgagcaagtcttgaacaaattagtttcagagtgctgctattcgtttttggtattcggacaaattaaacttgaaccgatggttagctacttagccaattaaaccgaaactatccaacatcttcataacgtgtctcatttgacagataggggcatttacgtcatttcggagtctccgccacatgtcagatttgttttataaacgaaaaaaattcggtatatttaatttgaagatatccgccggaaaattcgtaaatttgacccttcgtcttcggaaatg

SEQ ID NO: 7819 - DNA, 3000 bp, Unknown
  misc_feature (1)..( 3000): cDNA_ID_3046607_gDNA_ID_1621165_Annot_ID_173832 3000 nt of promoter + ATG
ttaatcaaaatatactgggctcaaatctaatttaaataagcccaataatatgttcatttgggccccaatagaaccacaattataccaaactaaactttgaagacagattattgggcttgggaatttgggcccaaatgaatatttttaatctgagcagagagcgactatggaaatataaattccgtacagcacgcttttcaaatttcattcgtaacagaaagacaacgaagaaaaaagaaaatttcgaaaaggagaaaaatatctttggaagatggcgggatctctaacagcatcaaaccgccgtagaaacgcggaggattcttcagaaatttaccggtggacgatcggttttgctcggtttgttcactatccatcttctccttctccgcatccagttctgaaacctctcggaaagagagagcagtatcattcgccccacggaacctggctgtcggcgtcttcttcgacggtttctctccacattgtcgacgaattgaaccgatccgatgtgattctatccgtcaaactcggccagaaagtccttgtgagttggatttttactctctctctctctctctttattatatatagttctatagatcggatgtttaggttggtgtttcgcgatggtttaagcttaatcaaattttgaaatcgggatctatacatttttgattaaacgtcatggtgtttaattgttcaatatctacaggaagaacactacatttcaaagctgaacttcacatggcctcagatgtcatgcgtttctgggtttccatctcgtggtagtcgagcgattttcgttacctatatggattctgctaaccaggcaagctcttaacacttgaatctcttttggattttatggaattaagatataaataagcttactatttacttactagtgatgaatttgatttactgttcatgagttagttgatacttcagatttgtgattgaaatcatgtggtttgtttgtgcttgttgttgttctccagatccagaaatttgctttaaggttttccacttgtgatgcagcgttggagtttgtggaagctcttaaggttagctattattgcaaagagtttccttattatatgttgatcagatggagacgatgtttcattaaccttgaattcagttttataagctattttcttcaaatcttgagccaaggattcctgtttttttctgtttgcaggagaagattaagggtttaaaggaagcttcgactcagaaccagaaaaataaaactaggtgtgatgtttctttccagtcagattacaacccttcagatgcgattatccccaggttagatcacattagagtgttgtgaatttgtactagttctctagtcaaaaatttagatattgtaaattcctttttgcagagccactcagaaagagccaaatatggttagacctcttaatagttatgttcctgaaatgctaccaagaattgtgtatgaagctcagtaccagaaaagtgaaactaggtccgaggtttctttccagtcagattacaacccttcaattgagattttccccaggttagatcacatttacagtgttgtgaatttatacaagtgcttgagccaaccatttagacatggtaaattcttctctgcagagccactgaggaagagccaaatatggttagattttttgatagttctgttcctgaagtgctaccaagacctgagtatgaagctggacaagccttatacccatcacaatccacgctaaatcaaatcccaagtcttcctccgagtttcacaaccttactctctggctgcttccccgactccactctaggtacatttttcattgtatctttacttatttggagtttgagacatatcaccctctttcacacatttcctctctattgaacctactactatagatgcaggccaaacaactgtgaagcagaatcctgatctaaagtcgcagatactggtacagtataaacaaacccgagtttcttttctctttcaacacatcaatacaattcaaatgatatctccaactttttgtttttggcagaagtacatggaagattcttcatttcaaggtgaacattctccccattacacacacacacaaacaatattgacccatatagattccaacttcacattcaagcttcaaacttcacttaataagtctttctaacaagtggttttctcgttatccagatatgctgcagaaagtagagagaattatcgacgaaattggaggtaactggattacctgatttatcataaacatatttactaggtatcaatcttattatccattttgagtcttttgttcatatattgcttaaaacaattgagattaaaaggagcaaaccaacattggtggaggacaaatgtagtttgtattttattttgtttcaactgcggacaaatgtatcaatttgctctattttcgtccaacaattagccgagaagatttttgatttgccttgagtttcaccttatggtgaaagcatgtgtttattagcttccacaatactcatatattatacgaagattttcttagattttgctatattacatttccttttcatttttgataaaaatgatatgaaaatttcgactgcctgcaatgatctgtaaacaggggaggtaggaatgagaccataatttttgaagtcacaatggttttggaaactaaattcaagaacttcctgttttgattttagggaatatgtttaataatttgcaaacagtgaaattcgagaacttccagtttcgaatttagagaatatggttataaactagatatatccgaaatgaatcgaaaataagatatttggaaatcaaccgaaatttctagctgtatattctctcgagtgaggtctttcctaattaaaatttctctatatccatatataaatagtatatactgattaagttttgtattacaaactagaacaattctacaaaacaagaaaaaaactcataacaaagtcctttgagacagccaaaacatg

SEQ ID NO: 7820 - DNA, 3000 bp, Unknown
  misc_feature (1)..( 3000): cDNA_ID_1809380_gDNA_ID_1621165_Annot_ID_173830 3000 nt of promoter + ATG
ttaaaactaaacaagctcgttgttggaaagaaaaagaatttcccaacgctaaggagctttgtttcgccaattgtccccctcttgaataatttttatggattctgtcatttcgaagcagatttttttaaaaaacgttgataaatctaaatatgtatgttgcatattcgatttaaggttttttatgacatttatttcgattttagtggattcctttacattaatgttacgatattcttattttctataatttaaattcactgaatatcaaccaattacatttctaaataaaaatatatattttataggtgttagataatccaattacagttgccaccaaaaaatatggaatttaaaactaaattacaagtatatgatatttaatttggatggggtttgttaggaaaagataaaataatttgcatagttttagtttttgagtcaaccaaatggatcaatagattaattgagaaaaagaaaagaaaaaagaaatcaatcataatgttttcgaattttttggaaagcttatacgatggaatcggagacgatgacgccgccgacgacgacgaagacaacaacaacgacgagaaaaccccgaaagcctcaacggaaagacacgatttctcgagaaacgccgttcgtttgtcaccggaagaggaggctcaagcgcgtggggttaaagatgatttgacggaacttggtcataccctcacgcgtcaatttcgtggtgtggctaactttctcgctccgttacctgatggatcttcttcttcttcctccgatctatcgaaccatcccaggtttaaccaatctcggtcttcagatcctggattgaatcaatcgcgttcttcagatcgggacgaatcgtgtgttggaagtgatacgccggagactggaattaggtttaggagctgggatttagaagaaaaattggcagaaggcaatgatccggaggatgaggaagaagaagaagaggaaacagatgaagaagaagaagaagaagaagagatcgctgcggttgctcttacagacgaagtgctagcatttgcgaggaacatagcaatgcatccagaaacttggttggattttcctcttgatcctgacgaagatcttgatggtaacgtatacattgagtcaagtctttcgctattagtcttcattgatttgacttataggcatatcaaaagtttgattatttcaacttttatctaatgtagatttggaaatgagtgatgctcaaagaggtcatgctttagctattgagcgtcttgctccgaggttagctgcattgagaatagagctttgtccatgtcatatgagtgttggttacttctggaaagtctattttgttcttcttctttcaaggctcaataaacacgatgctcatcttttgtcttctccacaggttaaaaaaacctgaatctcaatctcttcttgagtcaaaatgattctttgttgttgctgttgtttattcaacaaaatccttttgcttttgcaggtgatggaagctagagcattgtggatgaaagagcttcagaatcagacacattcttcaaaagaaagtagagatatgattcttgaggaagaagatattacaccatcaacttctaattactacaaccatgctcctcctgagtttctttctccaagaatatatgcttttgaacctccttcgattatgtatcgcgattttgaacacgggtttgaaaacgctcagttcatcgataaagctgttattgaggaaaaaccaatccagaagaacgacaaaaatagtgcaagccttagccaaacatctaaagatgttgttgatgatgatgatgatgattggccagaagaagaagattctgctaattcttgggctccaatgtttacagtgaatgaggatgatgtttctttcagtgatcttgaaggagacgacgatataagtagcttagcactcaagtctaagattacatcaaagggcacagaccaaaaaggaacatgaaacatcatctggcttgttgctttgccctgcctcacgagatcgaatcaatagaattgaacataagtactgtgtgctgagtcaaatcgtggaagtcttttgggtgagtttgattgttttgtggatttatgatgtttgctctcaaagagaaggaagaaagaaagaaaaaggttttgattgaaacatgtacagaagatttactttgacactgcaatttcattgtaatgttctctctcgccaaatgtaatgaaatattgaaaagcactatttcattcgcgtggaacttaaaagaaattgatagagaatggcgcaagtgaattcaagtgtaacaaactgttagaatcattattggattggaaaatcatatgggattttattgcttatgttgaggatttgtatgtatgaaaatgggaacaaccaggaggagctatcatcaattaacaaaataactcctatgacttaactaaaaaacaaatctatgttgaaatgtataacatttgtcaaaatgctagtactttgttaataattaaggggtgttattggtttgtgatttatatagagttttagtgatttaaaaatattatatagaatctgatgttattcaattcaaattttcattttttttttttaatttggtattattagtttaagatttataaaaattaatctaaaatcttcgtaagtaagattgcttccctaatacagagaaagaaagaaaaaccaagtaagattggtaatacgatgtcgtttcgcagaataatgcaaagctgaacccaatttaataagctgcacttttctttctttctcgagtctcccgtcgttttttatgtcagaaccaattcgtcaggtcgtgaataagtgactttatcgacgaaccaccactcagctgcagcaaatgatcgtttagctccggcgaagcgtaaaattcttcagatctctctggaattaataatccgtctgtttgatcgatctgattcggcaaatccttgagaaaacaaggagggaagaagaagaagaacatg

SEQ ID NO: 7821 - DNA, 3000 bp, Unknown
  misc_feature (1)..( 3000): cDNA_ID_2169259_gDNA_ID_1621165_Annot_ID_173826 3000 nt of promoter + ATG
ctggagatgccattgagaaactctatggaactgcacaggacattgaaggtgtgatcagagacgggaagctctatgtcgtccagacacgaccacaagtgtgatcaaattctctgaccacttcttaatgtgtacgttacgttttctgtccagtaaactccttatttgctctataagcaaagagtataatacagcataagcatatagtggattacaaaatgtgtagtacaaagacatttggcattaccattaagatataaataaaaaaactgtttattggagttggaagtttctccagcttttgcttcttgaagttgagtgcaactgaaaactgcttgtcgtttcactggtcgagcgatatgactacttagtgtttggcttttgtgaattagtgactcaactgtattcccaattcaaattagggtctaaattgtaataaaatatagataatgtttccttttttcctgaataattttcttttaagctttgacacacgaccgcaattgaaggcgattctttttttgtttctagattaagttagctgccaaatgatacatgccatgccgcttcatccacctctttctttgatcttttctacatttcttcacaattttttagtttgtactaatttaatatttgtattggaatctcgcgaatggccttctctaaagccaaccaccaccacatcagtagttcagttaatagatatgcatatctacggacatttaaagctcacaaaatcaaatgtgtgtatgtttgtagatatcacaatgattcataaaaattacacaaccagtttgaccatatgatccaacaatgcaataatgcaaaatcacacaaccagcttgacctcaccatatgattcacaaccgatctcgtattcatagtatggcgtatatatgcatgcacaataaaaaattatcatatacgtgaaaaattgtgctatccacgataaatatatcgcaatgagtttgttttgacatttacgcaaaagtaaactaggattagaatgtataatcgattttggtgctcaatgcttaactaacaagtttaaggttgtttaattttttcttctctcttaagaatccactaatggtggaaatgtggaaggaagaatatggatttttttataatatgattaggatcttgaacctcacaagttatgcaacatatattatagatgctgaatctcaatttttgaaggtttacattgcatattatttacaagccatgacgacaagtatcaaatttatgtttgccacatattaaatttttaacatgcccatgtccaaatggttgtaactatgaagcagaaaacaatatacataccaataccatttgtaaatactagcatataactctgtacgtattcaaattacattatttctgttcttatcctgtataggttttaaatattgaaaaatataccatgcataatcaagggataggtaatgataattggtgggaataaattaaggatggcatgcatggatgggtccccaacataagcactcgagcatgcattgctaatactcagcctcgcgtgccaacactcccatgtccctaacacaaactacttagtaaattaaaatgatctaatctattatttacaattaattagtactaaactttgttatactcttccactaccacagttatactcttcacgtagttgttcatttatatgtatatttttcaagtagaagttaaaatcttatgaagatataatgctctcgaaaaaatgttgtaaaagaaaaagaaaaaagagagagagtagctgacagaaggaacatatagggaagagagtaaagagaaaaagcgaacttcaagaatcaacaataagaaaaagtaaattatttgcaaattcctctttttgtctcttaaaagatacaaaaaatgtttttttttttaaacacacagagaatgcaaactaacacaagataaaacaagaagaagaaacacagaattttgactgtcattatcataagaaacatagcaaccacaagactttcctttatatttggctatatacatttattcaaacaaacataatatgtttcaggctttgtattgctaattgggaacatttcccctcccccaactttttttttctcttttgaccaacttagcttatattaatttgatttcacttataactacatgttgcatacaatttttgcatattcttatctgctaataagtaaaactatgtgatagtcaagatagcatcaaacctacgggtccaaactaaggtttcaggtctaatattaggtatgggatccatctacactttttgttttttttactgagatagaatttacttattagcagatttcattttaggataaattccgataccaggtaaaatacaaacacaatttgaaaaggaatgattattgtttttaaagagattattcattaacacatgagacatttagactaaacaattactccacctctgttttagctagccatatctatataataggttctaataggtgatttaaggaggaagtgtgcatactcatattcttaagccatggaccaacaaagaaagagagaaaagcattgtagttagattttgcttagtcactttatgtcagtggtcttttatgattttgtcatttttatttcatttttggttcctctgtattcttggaggttaaaaaaaaaggaaaggcatgaatgatttcatcactatccaagccaagtacttataaaacacatataaacatttagactattactttaagacaccataattccataaaccccttttgaaactttctctcgtctctctctctctctttcttgttagcataaggccccaagaagacataagagtgttttcatgattctttatttgggttttgttatgaaaaaatttagcttctatagctttggaaatggtgagagcttgagaggattataaaaatcaagggtttttgtcttcttttgctcacttgctcattctttaatatcgagaaaacgttttgggctttg

SEQ ID NO: 7822 - DNA, 3000 bp, Unknown; identical to SEQ ID NO: 7816
  misc_feature (1)..( 3000): cDNA_ID_2169255_gDNA_ID_1621165_Annot_ID_173825 3000 nt of promoter + ATG

SEQ ID NO: 7823 - DNA, 3000 bp, Unknown
  misc_feature (1)..( 3000): cDNA_ID_3046629_gDNA_ID_1621165_Annot_ID_173818 3000 nt of promoter + ATG
gctcgtaaatcagctggagaggagcctttaccagaagaggatccttcaaacccaatctttaaggcgatccctgaaccatctaggctagagagtttcctcatcacaaaccaagtctcaaacttctgtggccaaatcaatgggtatgttcctctttagtattgtttcaccatttttggagctttgaaagatacttaaaatgagtcgacctgttgttatgcagagtggctggccagaacttcagcaggctttacctgaccaaagcattgcacgacaactgattgcaaagactacccaagtttttgttttttgagtcagaaagtgaaagacttggtggtagaatggatcctatatttgtttttcgtggatgtttttgtttttatttttgttgttgtgaagtaatttaatttacaagcttttcaaaaaaaatctttattcttatgcataatgaaaaattattgaagttttgaaagatttatcttgtattggacctctgattgccttacaacaaattatacatagttatcaaaatcctaatcaaaagagtaaaaaatctaatttatagagattttattatagttgtagtgttagttccatcgctaaatcccttgaacgacaacgtttattatttcttcttcggacgattgtttgaagaaatttaaaaacgacatctttttattacttcctcttcgaaagattgtttaccaacaagaacaatggcggtttatcatctccttctctcgagcccaccttcgcttcttcttctccctccttctcctcgccgccctaacctcaccttaatccgccgtatcccagctcatcctcgcctcggaaactcgaccagcttgctttcttcttcgtcaccggtaattcggaaaattctggttcgtagcactctccgggaagaccaacccatcgcctctgactccgagagtagtcctactctactgatcggtgaagattctgctgcttttgaattagggaaacagaagcttgtttcctgggtttatttcggtgttgtccttggagttgttctctttatcctcaatgttgtttggatcgataattccaccggtttcggaaaatcattcatcgacgccgtctctaacatctccggctcaccggaggtatagatcaatttaacagtaactgaaccagtttcaatttcagttatttgattgttaaaaaccacttgtttttgcaggttgctatgttaatgcttatccttatatttgcaattgtacatagtggtttagctagtctaagggatataggagagaaacttataggtgaacgagcatttcgtgttttgtttgctggaatctctcttcctttagctatgagcaccattgtgagtactctctcttctaactctgcaatttttctcctgatcaatggtataaatacctgtttgatgtctcttatggtctatgcaatgccttgttcttctttcaggtttactttataaaccatagatatgatgggtcacagttatggcagcttcagggtgttcctggagtccatgaagctatttgggtcgctaattttgtatccttcttctttctctatccttcaaccttcaatcttctggaggtagcagctgttgacaaaccgaagatgcatctctgggagaccggcatcatgagaatcactcgacatcctcaggttttgaacatttccctaatgtgcctaaacatgaagacaatttccttcatttttgtgtttcaaaaatacagaaagattggatttttatgagccaaggtttattagtggctgtgttaatgagacccccaatcattgaatcaattatgggcaggtattggccattgacttaaatacacccattacatcagcacaatcaaatctcctcatccttctatgtttattacatcaatgcttgattactttacttgatattgcttttgatcttaaaattcttatccaattgcttcatcatgtgtttggaaaaacttgataatatatagaaagataggcattttagcttcagttttggtttgttctattctctcttcattatactggctttgttaatgagacttgattgttgcacctctctcctctgatcttctccagatggttggacaaatcgtttggtgtttagcacatactctctggatcggaaacacagtagctgcatcagcttctctcggtttgattgcacaccatttgtttggggcgtggaatggagacaggagattggcaaaaagatatggagaggattttgaaagcatcaagaagagaacaagtgtgattccatttgctgccattttcgaaggacggcaagttttacctgaggattactacaaagaatttgtcaggttgccatatcttgcaatcactgcgttaacggttggggcatattttgctcacccgctaatgcaaggtgcaagctttaggcttcattggtaaattatatgtcatgctttaggcttcattggtaaattatatgtcatttatgtttgtttgtttcctgcagtgttcataaagacttgttaaggaacaaatgtatacaaaaagccatattgtttgtgatacttgactcttcttcatttctcgattattttggctcaacactctgtaaccactatgtgtgagttcgatccaacaagtgggtttagattagtattaactaggaatgtttaatagtactgctaaatgaatatttaggtaaaactattttgtatataaattcccactcagatgtcatgggtcactctgacgcctaccactatactaatagaagtaaatttttcttttttcgatgtttagttacaatcggaaaatgaatctaaattttaactaatattaataatatgccaagatctccatccaaatctagattgatatctacatattgatgccttgatatctctaaactctaaagataaacttaaaggcaagtgattaattgttaactaaaattaaaaattaacaatacaattttaattcgctagttataaaaattttattaccaagaagaat

SEQ ID NO: 7824 - DNA, 2247 bp, Unknown; identical to SEQ ID NO: 7814
  misc_feature (1)..( 2247): cDNA_ID_1394643_gDNA_ID_1621165_Annot_ID_173816 3000 nt of promoter + ATG

SEQ ID NO: 7825 - DNA, 3000 bp, Unknown; identical to SEQ ID NO: 7813
  misc_feature (1)..( 3000): cDNA_ID_4359805_gDNA_ID_1621165_Annot_ID_173815 3000 nt of promoter + ATG

SEQ ID NO: 7826 - DNA, 3000 bp, Unknown; identical to SEQ ID NO: 7820
  misc_feature (1)..( 3000): cDNA_ID_1809380_gDNA_ID_1621165_Annot_ID_57199 3000 nt of promoter + ATG

SEQ ID NO: 7827 - DNA, 3000 bp, Unknown; identical to SEQ ID NO: 7818
  misc_feature (1)..( 3000): cDNA_ID_1809372_gDNA_ID_1621165_Annot_ID_57202 3000 nt of promoter + ATG

SEQ ID NO: 7828 - DNA, 1603 bp, Unknown
  misc_feature (1)..( 1603): cDNA_ID_1989570_gDNA_ID_1621166_Annot_ID_57856 3000 nt of promoter + ATG
aagcttagtagatatttattttctcctgatcattcaacatcaaaaatgaaaagtgtgtcttatgagaacaatttcttattttcttgaagaagtgtcatgattcgatttgtgagtctcatgcattattcaaaagttatacaattttgctagaaagagtcattttgcattttttttttttttacattgatatgattacctatgaggctatgacccatttctatatctttataattgatgtttattttaagtgatttgaaatgctctaacgatgaaattggtgatgaaaatgagagaatttaacccaattactggagatgatccattaaggtatattatcttcccttgtgtttactttagacaacgaaactatacgtgggaaaattttatgttaaaagttactataaaggtagtaacaaaacttataagatttcttccctttatagtatatttgaaaacctgactgactgagacatttttgttactataaagagaagaaaatatactagaaagctaaaacaagacattccatttcaaccaaaactataatctctactgatttaccttataactttttaccattctttgtcaactttaatagtcattttcacttttaagatgggttactttccaaaatttgaaaatctgactgagacgtttttgtgtgctttacatatacaaaaaaaactttagagcataagaacgactagaaaaaaaaaaaaaaaaactaaagtgagttcccacaaataacacaaaaatagaagaagcaataaaaaaaaaagagttacgttatagaaaagagttttcgtcaattattgtttccctggtgaaagagtaaaaagatgaaaaatcatattaacaataatagaagattacgataaaagcttaagatgggagagacctcatatgcataaagtgttcccatgccatttctatctctacatgttaaacctcattgctttcatcagcatctttctaccaaaccgatgaagtatgattgatatattgtgtgattcaaatctccaaattttgttttattgcatgattaaaaatatccccgaccttataatatacgtctaccttttgtttatgtccttgctgtccactatcaaaaataaaaaggaacatacagataggataacaaatacatcggaaactcaaaggaaatgagagaataaatacaaataaataatacttccaaattgtaaactctaatttaacaaggaaaaacattttctaaaaattatcatacgattaaaaaatattataagcattaaatagaaaaaaaaagtgtacgtgtgggtgtgggtcagaataattaaataattttgtacgtgtgggttttttagtcaaaagaatcaacaccgtctactttcactatagctaataatgtcgggacaatgtctcctaatagatcacctcccttagcttcctctacattatatattcaccattcttctttctttgttcctcaacagggctcacattctctatccaccaaaacttttcttctacttttctatctatatatctattgttgagctacaaagtgaaagtacttttacttgctatattgatcaccaagttatagcatttaaaaaaaatg

SEQ ID NO: 7829 - DNA, 3000 bp, Unknown
  misc_feature (1)..( 3000): cDNA_ID_1989567_gDNA_ID_1621166_Annot_ID_57859 3000 nt of promoter + ATG
agttctctttctctgatggtgtttaatctctctatctcatctcttgatgaaatcaacacgtcaacatgacacaacggtgtcacaattagtctcggcttcctgcaccaccacccatgagctctttcccttttctttgatctagtaaataaaactcaccacgacgtcgtttgtttggttactcagaggcggtggctacgatcccactgttaagccttagggtttctcaatgttttctttatttttccttctcgtcaaacaacgatgatatatatatatatatatacatatatattagtcttcggattttttctgcaacataaattttttgttttcctccagaatgctccattatctccaaatgaatcccaaacgtgtaaagacctgtaaaggactagaaaagactatagaaataaaaatagactctaaaacctatacctaaatcataactaaaagcagtaaaaatagggttatatcaaggagaacttatcgcaaagctctgaaatgggtacctagaatcaaacatccaatcacttgggctagagtgtacaaatctctggaattcgtagatcatgcatccatttgaacaatttttggacgctggaatacctaggatcgaattccaaactgaagtgagtgaaataaccattagggccaacgaatccagaagggatctaacctaatcttaactacctgactatcctagagattactctaatgtgtttagccatcgacttctactcttagtcttccaatagatctcctcatctatataggcttgattaagatcagttttcatatgtcttcctctatcaaagtagagccaccagttgcaatcgctctatccagcttatgctgaatgattttgattcactttgctgcattgatcttattttgttgcttccatgttgagataacctttctacaatgagtgagcttctccattaagggaacatgattatcatcgaccccattgtatctgttccagttgttaagcacaatgtctttgaaaccctctttatgagtgaggcgattgtcatagctgaagaaaccatgtctctcttccttataggttgagatgtttgtcacaagagggcgatggtctaattcaccaaactcctggaaatctgtctctgattctggaaataaagtgagctattcagtattagccattgtttgccaataaagtaggtgatggtctaattcaccaaactcctggatgtttattctttatctttagaaatagagtaatctattattcatctctatttttttctctacttttgaaaaaactttattttagatgtgaccattggagtacaatgcctctagaatagagtcacctctaaaatagagaaaaatatagagatgaccattggtaatggtcttaatgggggtggattgtaacaccccagtttcaagaatatgatagtgcatgcagagaggtttaagaattgatttggccatctatgtcaccgaattgcacttatcttttcggtcaaacgtcttgagaaaactctacagttaagcatgtttgggctagagtagttcactacaaaaaaagtcttcattgatagcataccattatagcacggattactcaattgctattgaagatgtcatgtaattttcgttattatattacagcagttgataaacgctaaaatatagttttaatattacagcactttataaacgctgatataaagttttaatgagcgggaacacaaaatacttattccgccaaataacacttagtcattttcgagaaaaaaaaccaaacacaaagcaacttttcgaaaaccctaagaaagaaaactctctcagtcctcagccgtctgtccgacgaactcactattccggccaccgattaaaccctccgttgcctctccgtcgccgccgtgaaagctctccgtgcaactggaacctccgccggcactcaatccgctctatatctgtccacttcgagatcgaatcgaaggcaagtcattttctatgttgtttttttctcctttgccactcaattcgttaccctagatctgtttccatcaatctctgagactcaataaccgatgtttgtgtgattttagaattcgttaccctagatctgttttctttatcgattcttaaaattttctctactttgcatgcctttgtttattgcgaattcatatgaatttcgtcttagtaatggtaacctgaactgctctaggtgcttgtgaacaattttgcattcgaaattgtgtatttatttgggcattagagttgcaaattttggattttggctctgtaatgtttgattttttattgagtgataaaacttgagaatttcattgtcagattgattaagcttcgtctgttgtctgaatcgtgttgttattgtctcatcgatttagttattttgttatgtcaaactatcattgattcactttcttgaatataaaacattttgctcattcactatattttgtttaatttgtaagcgttgctgagcgaatcaatggacatttggaagcttatcaattctctcttttcacaggaaaggttagtatcattgtctctcttttgtgaattgttttcttttgtcatagttagtatataagtttgagttatttgtgaatgttgtctgcttgttctgtgattgtttacttagaagaattcttttcagtttcatttattttaaaacatgctaatataatctagtaactgtacttatctactgaattgttttgatagagtgatttgtaaatgttgtattttgtgtttgtttatattgaagattcttttgagttacatttgtttaaaacctgctactataatcgagtagcatgtacttaaaacctgaattgctttgattgattacgtttataagtttgaatttatttgtgaatgttgtctacttattgtgtgattgcttattcaagagattcttttctttacacaatatggtatgctgcttaggttactaaaggttaatttatgttacggttagcacatagaatg

SEQ ID NO: 7830 - DNA, 3000 bp, Unknown
  misc_feature (1)..( 3000): cDNA_ID_2172815_gDNA_ID_1621166_Annot_ID_173858 3000 nt of promoter + ATG
attacttgcggtgtctagagagaagctgtattcatagtgaactctttggttgaaaatattcatcatgtgacctgatataaccttgtttttactgattttaactatgttttagatttagaattttgagtctttatgttatttctcgagttttttagagtcttagatattctatgcaatggggcaacaatggagatgaggagacattttggaggaagagctaaggaaaaggaaggtaaggactttcagttccagattcggtgagagtgtcgatcgacacactcttggtttcagcccagaaaagtccatgacgctttcaagtttacagaagtggaaatttgccccataacgttttatagggcatatatagttttagaggttattgtttagactaggggtgtcaaaatgagctgatagctcatgagctggctcaactcggctcggttattcatgagcgccagttctatttttaaggatcatttaataaatgagtttaatctcacgtgttatacgagcgagctttaatgaacatgaactagctcatgagcttggttttcttgaagtaatcatatatatgaaaggaggctaactctcttccacaacttgacacatcagcacatgagagcttgccacctagacttcataaaataagtaatacataaatagtaattaattcaacataacaacttaaataggaagatataattaatcagaatttgaaccatctctctttttacatttttttaattcaaaatatcctctttcattttgagatccacttaagtggctaaaatgatcataaaattcaaacatgctacatatattccttgcctaaaaattagacgattattatgaaagaaactaaatgaatatgcagattcaatatatctaagcttttcgagatttatgctaagaaaaccagtaatttaaaagatgtttgaggagctatctttataactaatacgtaggatataagattatgacaagaacttaactaaactttccaagaacctcaagttaaatatgtttagattgaatatgcagagacatggttaataaagacatgttatatttttagtgtaagaaggaaattttttaaaatttcaccgtctcacaatctaaacatataaccaaaaaaataaggatatataaaatatttttaaaaaaactgagaatctaaaacaacaataaaaaacaacttaaacacattcgtttttcagatgaactaatatagttggacttttcaaaaacaattacaaatcatatttatgttcaaaaccgatgcattcaactttactttatatgaacagacattatataaaacaatttgtaaattgtaatacataagcccgcacgtagtgcgagtactcatctagtatatacaaaaagtcaacaatcaacgtatatatatatatatatatttttctatcaaaaataaaaatatattcaggaaaatatatactccctctgtcccatgaagaaggattttttagaaatttcacattctttaaaaaataatgtataatgacaatttgaacctctttatactatttaaaataataattattatttatctaattatctaataagggtaaaacaggcaaacagttctaaaaatttacattggaaatataaaacttctatctaagtgggacaaattttttttttagaaaattcatttttatgggacggagggagtaagttacataacaatttcagaaaataaatattaataatatacacaaaatgtcaacaatgaaaacatatatctatatatatatatatatatataaatatatatatattttataaaaatagaaatatatcttaaaaaatatttaatttacataacaattttagaaaatataatttttttcatttatttgcattacctctcgaagtagctcatttagctcgcgatctagatgatctgagtttgagtttgtattttgaagctcgtataataaatgagttgagagatataagctattcttcccttgttcttcagagattcattcagttctcaatacagtgaagagatcctttcatactctaatcttatttgctgtgtttatgctttctatataaatatgttgcttgtttcaatcaatatgtatgagtagtttgcttgttaggaatagagtttctcattagcgattcatatggtttagtagatcgcccccatgttaggttatctatagaaattcttcatctttagttgtttttaatgttagatctagagtaattaattagaacttgaatacatacaatagaaatacccaccataggtatttgtagttggatctattctttgatgagcttggtttatagtataataagaatcggcctatctactaaggttaacaatttaattcggttagaatgcatttctaggtataagatctctcgacttctccttttattcttagctataggcatagtgagtttcgcggaaagccataggttattccataattagagtttgagtttaagaatggttctataacaacctaactttcattagatctacgaaccaatagtttcctgagaataccctacgcctagctatttattttaatcgtttcacataaaatcaatctgttattttcttactatgtatattgtttatttcaaccattctctgctagcttaatcatgacattcaattcattatgtgaacaaaagaactttgaggaaatttgatccttaaatactacaaccgatctcttatttgaaagagtaggtttaaggcaatctgaagcatatcaaatttggcgccgttgcaaaagttcttgggaatcaccattgagtttagtttagagatttcgtctagtttttactttgattttgttactcacgcgtttcttgttttctcttttttgtgtgtttaggtgtatgcctagacaaacaagaagcacacaacagaaggagctgatcaacttgtctattcttgacttgggaaaacttaaacgcaccaaccgcaaaactctgagattagcaatg

SEQ ID NO: 7831 - DNA, 3000 bp, Unknown
  misc_feature (1)..( 3000): cDNA_ID_3046647_gDNA_ID_1621166_Annot_ID_173850 3000 nt of promoter + ATG
aaaacctgttgggcacaagtgggtattcgtgcagaaaataaataagaaagatgggatcacacgatataaagtccggcttgttgcaaaaggtttttatccaagacaaggagttgattatgaagaaacatattctccggtcatggatgcaattacattctcgtaattaatgagcctttcagaatctaataatttagatatgtaccttatggatgtagtgacatcttatttatatggatctcttgataatgatatatatatatatatatgaaaatcccggaaggattaaattcttgaggcattagactcatcaaagtctaaggatatatatgcggtcaaaatacatcaattactttacggattgaaacaatccggatgcatgtggtataatcgtttaagtgattatctacttaagaaaaggtatgtgaataatgaaatctgcccttgcgttttcattaaaaaatacgcttcggaaactgtgatcattgttgtttatgttgatgcctaaatatatttggaactccaaagaagattgatgatgcacgaactcatatgaaagaaaagttcaaaatgaatgatcttggaaagacaaaattttgtcttgggctacaaattaagcatttccaagacggtatatttgtgcatcaatccaattatacaataaatattttaaagcgctttgatatggataaagcgaatcctgtaagtactccaatggtcaatagatcgttaaatgttgaaaacgatccatttagaccttgtgaggataacgaagattttcttggtcccgaagtaccttatatgagttccatcggtgcgacttatgtatcttgcaaattgtataagaccagatattgcttttgctactaatttgcttgcaaggtacaattcatcccctactcgaaggcattggaatgagataaaacacatcttccgttatcttcgaggtactattgatttaggattatattatcctagaaaatccgagtttggtctggttagttttgcagatgcagggtatctatcggaccttcataagtctagatcacaaaacagatatgtttttaccattggaggaactgcaatctcgtggcgttctcaaaagcagactatagtcgccacttcatcaaactacgcagaaataattgctcttcctgaagcatgtagagaatgtgtttggtttagatccatgactaaccatattcaagaagcaagcggattagtcatcaaaagagagccaacaagaatatatgaagataatgttgcatgtgttgctcaaatcaaagaaggatatatcaagagtgacaaagcgaaacatatacctccacgattcttctcctacactcaagaactcgagaagaataaggaagtcgacgttcaatacattcgttcaagtgacaatgcaacagatatattcacaaacgcgcttccaacttctacatttagaaagcatgttcaaagtattggaatgcgtcacttacgagacttgtgaagtcttttcgagggagagttcacgtcactgtactctttttccattgtcatgatttttatcccaatgggttaacgaagcagtgcgtacttcataaaaaatgagggataattaagggggagtgttgaaaatatggataattatccatcataactctctccacgtctcattaactttgtccccaataaaagtaaagtttatcttatcccttatcaattaataacttgatcaccaagttattgatcttatatatatatatgttgtattgtgcgaagagaaataagaagcataagaaaaagcaaattattctctctttaagtctttcatcttctagaaaataaaatagtattaaatatatttgcgttacagtttttaacaattatgtatatgtaattagttttcttttgattaaatatgttatgagttttaaacttttaatgacaaaaatagagaaaaaggttaatgtaaaatcacaagaaaaccaacaaaaaatggatttatgtaataaattttattgtctcaacatttgttttactttagctgttctttggcttcataatatattgcaagtttctcattgtaattttggtgttcagaaaacataattgtttcatggtcattttggcaatttcctaggtattttctttttagtttgtgaatactttcgtttttcctatcaacctactaatcaacagagctttccatgtacgaataaaaaaacaaataatcactacaagaaaatatgtgatattccaataaatccttccaataatcgtattttgttaaaatattataaccgatatcctataaatttgcaacaaatacttttttattgaatatttattgcaaatttctaaaaaaatttggttatgataaatttgtcacaaacatcgtacgaaaattgttagaattttcctacaaatatgatattgttgcaaattagcaataattattaaattattggaaattattaacaaaatatttgttagaaactaattttttatggaaatttatttctaacaagttaatgacaaaatatttgttgcaaaaatggacaaaaaataaaaacgaaaattaaaagaaataagagaaaataaaaaaataaaataaaaaaatttaagttaaatatgattcttcttctccttttttttctgtgaagatttacatctgaaaaaaaattgaaaactgttttcaatgataggaccaaaaaacaaaaatcgtgagtagatgtataattatatagatgaaggtactggagaattaacaaaataagatgtattgtccttgttctacttgtggtaatgagaaaaaatttcgagtagattctatttgaaagcacttatagtagaggatttacgcctggatattacatgtagttttctcatgggaaagattttgaaactttaacaaatagtaatgaagatgatgaaaatcatgggttggaacttggagataataatagtaatgaagaggaagagaatataactagagatccaaccagtgtaatacatatg

SEQ ID NO: 7832 - DNA, 1603 bp, Unknown; identical to SEQ ID NO: 7828
  misc_feature (1)..( 1603): cDNA_ID_1989570_gDNA_ID_1621166_Annot_ID_173847 3000 nt of

SEQ ID NO: 7833 - DNA, 3000 bp, Unknown
  misc_feature (1)..( 3000): cDNA_ID_1809450_gDNA_ID_1621167_Annot_ID_57204 3000 nt of promoter + ATG
aggaccaaaggaatgaaatagatttctatagtcagcggaggtatgcctcaaatttggtgcttcacataataaacattcagggtgagacaactaaaaaagagacaaaaataaaaaccttttgtagcttggtaaaggtagaacgtggattctgctaattcaggacgtagtggatagtacttcattgtcggatgtattatttgatgatcgagtagatacctgaacaaagatttgttcaatgtacttcagcgcaaacaacaaacttgaaaaatgactaactcaagatcgatgtaggaagcccgcaaagaaaagacaagtgaatacatacctctcaggtaatacaccaaacttttcccatacatggaaaaactcacgatgcgatgaatttgcagctgcaatatctccaacaagaacctagaagcaagaacttaagaatgacaatgagaagatacccttttcgactgttctttctatgacatttaagtaatccattcattcattatacctgcagaccaggccaaaacgcctgaagacttgtgagctgccagtaagttggttttccactccacatattagcttcatggtacctaaaccaggtagataaactcattagcaattttcagattttgcccaatagaagtcttaagtgtcataacagagattgcggaagtacattttttcaggctagtatattaccaaggcccatgtctgaagtacttctgagatgccagataagcagaatgaaacattcgccagtagtcttcttttccaaaaagaatataagccttcaagaggtattcatagaaagagtcaacccctttaaaagaccagaaatgaaattacacatcagagctacatcaatctaaggcacaagttaattccacacatataagtaaaattattttgctatctcttcggaacaagaactgccactagaatccctctgaatgaacaatataccagctccaatgctagaggagtactctatccattccccagttaccacatccaatgttgtcccaagcagatctaacgaacttcgcatcctccatagctgacgaagcgcacgtagtgcagctgattcaaacctcgggtcaccagtgagccgtgacaatgctcccatttcaagaacgagagaacctaaagcgtaaaatgcatatcaataaattcatgagcacattcggaaaactagaatgtaaaagaaagtagggataacaagatacataccacatcctgaagtgcttgtttcagttgtctcattctccattactccattctgccaaaagatattattcagggtcaaatattccattttccaagaaaactagaagagcaagctcaaacttaagcatagaaacctttaagaattgaatgaaaattatcaaagtgactgttccttttcgcattagatagccaggatttcagtgaagtaagtgctcaaagtgactgttccttttcgcattagatagccaggatttcagtgaagtaagtgcatttcataagtgacgattcaataccttcaaattaatccatgcatatggtaatcctgtaggtgtttcaaacgcgggtaaaaaacgttttccaaggtcttcagctaatcgaagaagctgattgttgtaggaaccctgaatcaacctattatttggatcaattgcaagaagatgagcagagataagtcctccaagaactcttatattgcactacaaatgagaagccaaaaagagcaccagttagaagcatcaagtgcgagtaaactcattttcagtactcaaggacacatccactcttgaagcaaacttcaacagaatacagaactagactcctacctcaaaaaggttgacccgggcatcaatatcgaaagtaagattttctgagagccagagaacccccttttcaaattctgtactgttccccaatatagcaaggctgggacaaaggagaatcatgtcaaacgggtactgaaaaaacacacagggaatgctttcacttatgcataacatacctggataatgattcaacaagagtaacagctgatccattataatctgttggcaggtgttcaagctggaaaatcagaaatctttgtgtcaagcttctgcttcaaaatcatttatgatgctatatgagctagtacaaagttaccttaagatttccaagctcactgagggagtctgtgaaacttttagttagaggctttagctcatcatgctgttggaattcagaacttagtgtaatccaaacccagtagccagaattcaacaacttaaagtagatcactaaccggaaatgcataagtcatgtaattgtcatacgcatgatagaacctgtaaaaacgagatttgaagggttttcaatagttgctaaacaaattgggtcatgaagaattaatataaaaatcactgcttacatacatctcgcgtactttctctcgcatttgtttcttcttgacctcgatatgctgcgatgaagggtcgacgacgaagaaagtgagagaaataagcaagcagaggaagagacgcctaggatggataggacaagacatgatgacgaagctgtgtaagaagccaatcaaatgaaaagagaggaaaggagaagaaggaatttatgaattcatcatctccgccagtctccgccgcgtctgatctctcgattagaacaacgtcagttcttctctaactggggatttgttcccttctttcaattaccattttgcccttttggtaaaaaacgaaagtcaaagagcagaaaatattataaaattttaaaagatattgattggttggttcccaaaaagtgaaaataccagaaccaaaaaaaaaaaaaatcataggaaaataagaaaaactcagcctttgcattgctattttaccaaattgcccttaaaccatctctagctaaagttaaaagttaaaacctatccatccatacatgtcctgaggtgtcaaaaactaaagcaaagcctctcagcacggtgagagattccggtgataacgtcctccgatg

SEQ ID NO: 7834 - DNA, 3000 bp, Unknown
  misc_feature (1)..( 3000): cDNA_ID_1809446_gDNA_ID_1621167_Annot_ID_57205 3000 nt of promoter + ATG
ctcggtgccataaggcccgaatgcacccacatatagacctgcacttagaattcagaacatatttcaagttgagttgtacaaaaacattctgagtccaaatcaaaagaaagagaataacactaatgcacaacatgcttaccatcaaaagggtctaagttgctttcaggagttatgattctattaaatgctgtatactcggagagatggtttcctttttgtgcctggtttatagcaagcttgacaatctcatgcacatgtttcgatacctagaacaataatcaaacaacctttatatctaaaaacattaacacgacaacgtaaaagaggttttaaataataacaaactcctagatctgattctagaggttaactttataaaaagcggtgtaaattcaagtaatataccttcaaagaagctttctctccccagaacgcctcggcaacctctggtggcaacagatctgaaagtccttgagctgcaagagctgttacttgttctttggacactctatttttccttgtatcgatatccctcttacttctcccaggaacatgcaatataaaggaatctctttcagtatccattatatttgccgacacacggacaatctcatcatctatagaggaatcctctatgttatgtagaacccctccgatgacaagcttagtgtttgaatgctttccataatctgcactatccatagatgagattgcttcaatactgtcattttcttcttcttctacttcttcttcatcatcagaagaatttgtttcctcagtgccttctccaaccagctcttcagtagcgtcatcactgccaacaatctcttcctcagggattttaataacatccattactttcagttttagccctgggattttatcttttagaaattttatcacatttttaattccttcttcagttggttccccagcatttagttgtgtatcttcttttttatccaccttcagttcacttcctcgtacatctaaaatggatgggtcattgatcgaggatttcgaggattgctgtacttttgaaaaggaattctcggaaatggttaggttttgcttcacgtgttgcacatacaccacctaaacacagcagataggtacatatcacttcaaaagggttaatcagtgattatcgaaacttcagagaagtttagagcagcaattatgaaacactaatcttatacaataatacaagatacaggtaaaaggatatactgtcaccagaactgttacttaattaaatgtgattttctcaaattacctgcataacatatcctccgtcagtgtctttaataacgaaaatctcaaacaggggtgttccagctgcttcagccaccagctgtctgtaagaaacagtaatgagattcaattatcaccagcaactgagaaaagatttaaatcctcagcataacctgctctcaccttggactgtaactcttgccaataaacctaccaacacctggagttatgtgtacaattctgccaaatggttcctcagaatctcgaggtaaaccaacccaccaacccacctatataaacatcagaaacgtgacaaatgcattgaaattctaaaacaatcatcgtctagataaaagcatagattcttgactagagatttgggtaacactgaaaccatgaagcaatccttgataagttgactaggtgaaaccatcacttatgtcaggaaacatatattacttcaactaaccttaactaccttaatagtttacagacatgtaacctattttcttgattcaaatgtgtaagagtcgtctagtaatatcttacaagctaaacaagaaagaacaaagtataaaggacggtaaacaaaattaccagtccacttcctgtctcgttacataacctggaagcatcatggtaacgctcttcgtttactgcagtctgcaaggaagttaatcatatataagtaagaagataacataagagtttgatgtaataaaaaaacacacatatataaacctgtaactggcgcatgatctcagcgacagcatcatcaacagtagcttctgaaatagcttgtttcaacttgactgcttcttcaaagtcttctttttcaacagcatcctcaagttgagactgttacataagctagaagactccaaatttagaaatctataatcaaccaataatcgaacaaaaaatcatcaatagtagacagagtttagatggatagaaccttgagaagagaaacaacgctctcgacttcttcaatctcggagaagtgacggttccaacgatcccaatcccaatcccacttatcctcactcgaactagtatcagctccatcaacagcggcgcaatttcgcagacagcttaaagatggggctttagggttacaggttgatatagaagaagcgaaggaatgtcgtagaccgatagatacggagaaatttgtgcgtttgttggtcgagagctccggctttagagaatttctggggctgaagaggatgtgaaattgaggaacagcgattatttggccgataagacatggttgagttgtcgccatcggaggacgttatcaccggaatctctcaccgtgctgagaggctttgctttagtttttgacacctcaggacatgtatggatggataggttttaacttttaactttagctagagatggtttaagggcaatttggtaaaatagcaatgcaaaggctgagtttttcttattttcctatgattttttttttttttggttctggtattttcactttttgggaaccaaccaatcaatatcttttaaaattttataatattttctgctctttgactttcgttttttaccaaaagggcaaaatggtaattgaaagaagggaacaaatccccagttagagaagaactgacgttgttctaatcgagagatcagacgcggcggagactggcggagatgatgaattcataaattccttcttctcctttcctctcttttcatttgattggcttcttacacagcttcgtcatc

SEQ ID NO: 7835 - DNA, 3000 bp, Unknown
  misc_feature (1)..( 3000): cDNA_ID_2175480_gDNA_ID_1621167_Annot_ID_57206 3000 nt of promoter + ATG
agatcttgacccgaaaaccctcgacacccggcttcttgaggtacattctctaggtgatgaggccctcttctatgatttgggtattaccgtgcctgctgaccatacccttggaattgagcctaactccatttatttcactcgtgatgatcgtatctgtcacaataaattgtcatgcctcgacatcggtgtcttcaatcttgcaacaaagaccgtcaaacgcttccacggtctctccaacttcaacttcaacgatgctcagtggtttcttccttcttgattctagccttctccatggtttctccctcggccttgctctgttgtcgtataaataaatttcaaaatagaaaatgttcatagttcacttacgttgatgatcataacataaatttagtgtccgacagctaagtgtctattaaggcattaattgatgttagagtattgtggattacaagtttacaacgatcatgttgttgggatgtcagtttagttttggtaaaccgacttatttgttattgctagtttagctttgttaattaacgttctgactttgattatgctttagtgcatatgtaaaggtatcctatcgtatataaaatcaatccatggaaatagtggctgcatgcatacccaaatcacatgtgtgtgcaaatattaattgtgctggttagaagatattaattacaagattaagcattttacttcacttacttcgttttttttattttgtatgtagagtttgtgaaagtccatagacaacacaatatcaaagagttcacgacacatgtgtgcctccacacttccacttactcttttttcacaactcgttcttgtcatatattttgttgttggttgttttcatttgagtaacctaatgtatgtttattcgttatatgttaaacaatcacagtattagctagctggtaaagttaaagcgacatattagagtaataaagatctcataatgtgtatacatattttgatcaaagacaactagaccgtcaacaatagtgcatagttgatcataacataattcatatgccgtatttaaatatatatataaatagcaaattggagaatctatttgcaaatggtagtacacttgaataaaagtacattaaaacctctaaaaattaataatattggaatgagatattttgttaattaattaagttaattaatttatcaagatattaataattattaatttgaggaaaatttgcctaatttctaagatatttaaattttataatttaaaatagattttgtagttagaataataattttctagaacgaactacatgaaaaaaatcaattatcatgcctcaaagacaacaccaaaatatttaattgcaatacaaatattagaaacgaactctaacaaaaactaatgcaaatttaagaataagcaaataacactaaagcatgttaaagtcttcttgaacattgaaataacacatctcgtacagagccggtccaacgtttttggatatctttatgcaaatatgtttttgaatttagttcatttgttaaatctaatttggttttacatattccactaccgttgatgtccttactttatagaacaaatacaacaatgataatccaaaccatcaattattatattgcttaattatttattattgatctataaacaactaaatataaaatctctatttacaaagttacgaatctttcaaatttggataatttcatgattaatgtaatcaatgcaaaatattttgttattgaattaaactcccctagttaagcaatacgacaaaaggaaaatagaatttgaatcaatcaaatattttttgttgtcgtttaggatgattgaagaagaaccgttcataatatcttggcagtaggtgaacagacccgttgttactttcttgtagcaaaagattagttgtattcctatttatgttagcaaatcggatgtctgccacaacaattttgtgtatttcatccactgctattctaccatgaccgtgtttctcaatggtaccatttgactctacaaattcagtcaaaactctcatcttcatttggtgatacttcaggtaagccataaacttgttgagactgtgatctatgattatcttctggatgatccaagatgtaaacaataccctcattcctaactgattgttcatcattatcatagaatttttcaaataaacaccttagttttctatctcaatcttacacctagaagatgtgttcataaccactgaattcatgtagtttttctccgacattcgctttcaaatatagctttgtgttttagaataagatatcaaaacctagagattcatgttcatgttcatgttatgcaatcaccttcacttgaagttgaaactttaccacttgatcatattcatagcatcatattgatcaaagcaaagtattacattatgtaattaaactcaactacctaagcaacatgacaaaagtaaaaatataaattgtatcaataaaaaaagaaaaagttttgttgtctattagaaatatatatttttttaaaaatcagaatttcactaataatatccttgatttctatttcactaataatatccttgatttttagtttgttaattgaaatacaacttactaatttgaaaaataaactttgttaaataaaaaatttactacattgtatacgtttaagcaaaacatatgttgtattcagaaatctttgtttgtttgtattttgtttacatcgtgtaatgtgaaaaagtcattagatttttacattttgtaatcaaagtatcaaaccaaaacaaatcaaactaaaccaaaaggtttttaagcaatttgaaccaaatgaaccaacatcaaaccaaatcgcatgatccaatacggtttgattgtttgtttcggttacaatggtgacaactgaaaatagctaaaagaggaggaatcagaatcaagcatccgattccgatcgacaaatagggtttagaatccacacacccaaatcggaaggcgaagaaaatg

SEQ ID NO: 7836 - DNA, 3000 bp, Unknown
  misc_feature (1)..( 3000): cDNA_ID_1809422_gDNA_ID_1621167_Annot_ID_57212 3000 nt of promoter + ATG
gaaagtttgaccaaaaaaaaaaaaagaagaaaaacatgaaaagagtcctgtctcaaaagaatggccacaaaataaaataagggtttagagtcctgtttcatatcggcataatagcggagccattctggtcaattgtcacagatttttaatgcagaagattagagtagagcagaaaggaatataaaacttcaacatacgaactcagacctgatcttgcagtggtaacaatagtgataggtcggttcgaagacagcaaacctaccagaaaaatagagatcagacgaagtaaatttaagtcattcctaagtctttcttaatcggctctatcaaataacgtttctgcgtctctttctctcgtccttagctgctatgtctaacatacgatctggttgtggcaatttgtggaagtctatcttactttcacagaggcatatgtttaaaagtgcatgtatgatgattttatctgaattgatggtttgaaatttgaaacctaagtccaaaatatttaaacactggcaatgtcacagattatacatcaaaagaaaaagaggataatagtctggaaatgtgagaacaacaccagaaagcaacagaaagaaacagagcaaggccgagggagaaaccatggagaaggctagaatcaagaaggaagaaaccactgagcatcgttgaagttgaagttggagagaccgtggaagcgtttgacggtctttgttgcaagattgaagacaccgatgtcgaggcatgacaatttattgtgacagatacgatcatcacgagtgaaataaatggagttaggctcaattccaagggtatggtcagcaggcacggtaatacccaaatcatagaagagggcctcatcacctagagaatgtacctcaagaagccgggtgtcgagggttttcgggtcaagatctttaggatccctcttgtacagatggaacatcctgtgactttcagaggtacctaaatcgtacgtaaagacaaccaaaacttgacctgctcttgtaacagcaatgcctttgttagatgggatagacctcttttgcttcatacgttcacgttccttcattgtcatacttggcatccacattggaagcctatgtttctcggatacatccttgaaaccatcttcatcttgtccagacaaatctaagtgtcgaatgaactcacgggtggcatagacgtaaagattgtaacctttcagtaccatatcgtttaaacctcgtaactccctctgaacctcgagctctgttggaatctcgcggtaatgatcatcccctgtcctgcaaaaccctagaaatgggtacatttcaaactgccacacaacaacgtagtttccattcttgtcgtcaacccacaaacgacctctcagatcttcggcagcatgaggaaattcatcacgaaatggatcctcatcatccattagcatatgcttgacattctcctctccttcacgccaaatcttaaaatggctacccttaaatgattctagtggtggaagatcgatcctcttctcgctaaatacatctataatatagagtttcattcgggaatctaccaccagaaaccacttacctgagtttcccaggaatcgataccctgaaaagtcactcttcgtctcgtaaaccctatcattgtatgggttgtacacactattactacgacaaccatccttttctgcagaaagcatcagcaatggagatctggcttttggccgctgaatcaaattcgaacgcagagccttagcagagtcaagcgttagcgtagtagacctttgcattattgggacggagatcgattatctcgtgctgaaaaaattgagcaagggttaaattgtgcacactgtgtgtaaatataggtaccaagcccaataacagcaacaaaaaatattctaacgggtctgtggcccaatataacatcatcatgaattatttttggttattcaagattttgagaaacgtttgtgtgtaaactcatagtcgtagttattcaagattctcttgatattttcaagttgaattttgcaagagatactctcagttgtacaagcttcattggtgtcattagcatatgtcagatcagtgatagtgttgatgggttctcaagaaggtattaatattatgaggttgggaaaaagatatagaattctttatgaattgaaaggaacctattcttaccaaaaaaaaacaaatgctatgtcacagactgtgtttgaatttgagaattacgttcagttgtgtgtttgactcaaagtagacggtattgcgacgatccgttcatggcttcatagtttttgtgtaggcaatggcatgcgatgtttagtgagacatatagtcgattttgtttccacattactactaattcaataaagctatagttagttcaaaatggctgacttttgtttcgaagttgcttagctttgataatagaattattagtttcgaattttatgttagtctttcaaaacgaactagctagtgatgtaaaatcgaatttatctgcacttgtacatagcaaaaactctttattttggtttgtattttgtaaacatcaatgacgtacaaaattggttatgacaaatttaataaaccaaaagaaaaacaaatataaacatgttgtgtagaatgtagataacaaatttctgcaataaggttattcagctgtctgaatgaacctaaactatgctaagatagtgttactataagtcttagttaggtgaacaaaaacggcgctcattggagctcctacaaagtaaaacgacaagttgtttctgcgtatggcggacctaaaagtttttttagaaaattaattgaagccatccggtttttctgttctgcatttttgtaattgcgtaaatcgcctaattgctcttgtgtgctgctgcttctgtgtcgccaagattcttcttcttcaaccttgaaaaaccctaaaagttaaccgccactgcgatacggcaccgtatttgacgtttccgccggacgaatctagaattcagta

SEQ ID NO: 7837 - DNA, 3000 bp, Unknown
  misc_feature (1)..( 3000): cDNA_ID_1809418_gDNA_ID_1621167_Annot_ID_57213 3000 nt of promoter + ATG
taaatgattacgaacctgtatgacaagaggaggaatatccaagaaactctgagcttgaaccttgaacaagagcttcctccaagacttgtttggtttgggagaaagttgaacaaaatcttgacaagttatatccatgaaagcttctgcgaaaactgcgccttctccattacagtctacctcgagcttgctcccttcatcggagactcttatccgacccgcgaaagggtagtaatcaactagaaccctagagagcgaatctttcagggtgagaggggatatagatttttggaaaaggtaaaggtacttgatagagaatctgagaaaatgatggtcgtcgaggtttgaaaggtagagagagtgatttggtgtgggagataaaggagttattaaggttggttggttttcctcgtacaaacaatccggcagttcttgcatcctccgtttatatttttcactttgttttttgagagagataggaaaaatggatagagatggtgggaagggaaagtagtaagcaagattggggagagctaaattggtggtaaaagttggaatccgcttaaacaggggtcagtcttcaactatctcggacccatgccaaatttaagtatttcttattaatgtgtcatttgtttgttatccttcattatagtatttcttaatctgtaatttgtttgttatccttcatatatataaccctcataattatttagtttgaagttggtttttgtaataaaaaatgtgtgtaagaaaattaagcggatatttttaacaatcggaaaaccgacattaaacaattttctttttttgttgatagtaagaaaaagggtgggatataaaatagaagtttatgtattttctttcacttcctcgctcgtctctctctctctatctatctgaaaccatcacgatcttcatctctaaagtaacgatcttctattttcttttgtaaacgaatatgatcctctcgactctctacgctttgattttttttcctttctctgttaggtttttctctccttgtaaaatcatctatcatgactggaggagagtatgcaaaagtaaacataacttgcaatgactcagttgttaaaatccttgatccttgttctatggctgaagtatccacaaaagtttcagaaattcttaagaaatcatccgatcccgaagtcgtttgtactctggatgtctctagtgaaatcatgaggaagattgtaaacattgaaggaaactaatgaacacctttataaatattcatataagagttctgtttcccacaccagaaagacagcttataacacatgcttgttggagcttcttctttcaaagcaactatcaaccagaagaagattcctacaaacccttctccactaaggatgagaagtggatccgcgaggaattcaacaaaaaagaagaagatcctaagaagctcttcgagcttttcaaggtatgtgcttatatgattatcatttataggactttcttaggttttggattacatttttttgctttctgctatattatcgggttattgctcaaattttatggatttgtacacctatgtggtgtgtaggcttcagagtaccttggatttgtacatccaagtcgtttgatcagaaggatggagacgaagaacagtatattcatcacatttatttataatccttcattaatgacgggttcatggacgaactacctacgaagccctccaatgaaaggcttatgctactttgggtttttgttttgcaagtctttacaattttcatagccatcttttttcctttgtagctcactttagaagaactttagaatcgtgtatcgtttatctgataccgtttgcttcacaacatacgttgagtcgataaattgattgtttttattttatgtttttatctgttttttgccatgagatcaaatcaatagatttaacatcttgtaaacctaaacatttttattttaataaataattaaaaatcactacataaatttttaatattttgacacaaaaacttatgtaaatctatttttgaaactagatatctgcttgtaccgttaaaaatagatttaacaaaacaactgagaaatttttttgactaagctttcaaacatacaatactaaatctaattctacttgaaaaaaaaagaaaaagaaaaaaaacaccacagcaaaaaaaattaatcgcttaatcaaatattacgtcgccaagcttgatattatagaaaactggtattaaaataacccaaactttcgaaaaaggactgtaaattacacatgttttaaaattttgtctaatatttttgcaccgttaaaaaccaaaacggaatataatatctttttgtaccatatgtgttgcaatgatgtaagaaatgcatgctaaatttaatagtaaatctagttgacatatgagttatatctatttttattaccgctaaaataaataaaattttcaatgtaattagaacttagaactcattcaagtatagtggataataggtaagtagaggccattactttatatgatgataaaacttagaattacttattaatcatgttttctttttttggcagcgtttacaattacaactaaatccaatttatgttttaattattgtttttaccatagtagaccatttcctcgaaacttaaacgtaatcattattttgccagagtgtacgagccataatctcgccacgtgtcccacgaactcgcatagcttaaagatttttttttaacaaacaaacaaacagtgctttttccgcaactttctccgccagctcaatttcagatctcggcggcgacggatccattccaatcgtgtttcagatcggtgactttgagttagaaccaaccaccttactcaatccgacttcagattgaaattgctatatcctacgcggattctcctgcaaacttggtgcggatctctgcgaaaattgctgttttggatgtttgatttgggagctgtgaaaaataggacggtggagtgagattatctgatg

SEQ ID NO: 7838 - DNA, 3000 bp, Unknown
  misc_feature (1)..( 3000): cDNA_ID_1809414_gDNA_ID_1621167_Annot_ID_57214 3000 nt of promoter + ATG
gaccacaattagaagcttcttcggcacaaaattgacctccttcttcccattttcagtctccgccacgaaactcaccgcatctacagctgcttcttcccgtttcctattttccaaccgttcttcaacgtagggctgtttgatctcgaaggagaatcgatcggaaccgtttacatcttccatttttccgaaaggtgtcaaacctaatacaaatccaagaagaaagaagacgagaaactggtaaaacggtcgcctccatggacctctacgcgagcttttaggatcagacgttactccgaggagcttggtgagatacgaaagaaattgcgaagaattgtgtttgctgctactaccaccaatggtgaaacctttgtgtgaacctccattctcgtgagaacgatcgtgatacatcggcgagagagttcgccggattgacgccatcagataatctcactccaccgtcctatttttcacagctcccaaatcaaacatccaaaacagcaattttcgcagagatccgcaccaagtttgcaggagaatccgcgtaggatatagcaatttcaatctgaagtcggattgagtaaggtggttggttctaactcaaagtcaccgatctgaaacacgattggaatggatccgtcgccgccgagatctgaaattgagctggcggagaaagttgcggaaaaagcactgtttgtttgtttgttaaaaaaaaatctttaagctatgcgagttcgtgggacacgtggcgagattatggctcgtacactctggcaaaataatgattacgtttaagtttcgaggaaatggtctactatggtaaaaacaataattaaaacataaattggatttagttgtaattgtaaacgctgccaaaaaaagaaaacatgattaataagtaattctaagttttatcatcatataaagtaatggcctctacttacctattatccactatacttgaatgagttctaagttctaattacattgaaaattttatttattttagcggtaataaaaatagatataactcatatgtcaactagatttactattaaatttagcatgcatttcttacatcattgcaacacatatggtacaaaaagatattatattccgttttggtttttaacggtgcaaaaatattagacaaaattttaaaacatgtgtaatttacagtcctttttcgaaagtttgggttattttaataccagttttctataatatcaagcttggcgacgtaatatttgattaagcgattaattttttttgctgtggtgttttttttctttttctttttttttcaagtagaattagatttagtattgtatgtttgaaagcttagtcaaaaaaatttctcagttgttttgttaaatctatttttaacggtacaagcagatatctagtttcaaaaatagatttacataagtttttgtgtcaaaatattaaaaatttatgtagtgatttttaattatttattaaaataaaaatgtttaggtttacaagatgttaaatctattgatttgatctcatggcaaaaaacagataaaaacataaaataaaaacaatcaatttatcgactcaacgtatgttgtgaagcaaacggtatcagataaacgatacacgattctaaagttcttctaaagtgagctacaaaggaaaaaagatggctatgaaaattgtaaagacttgcaaaacaaaaacccaaagtagcataagcctttcattggagggcttcgtaggtagttcgtccatgaacccgtcattaatgaaggattataaataaatgtgatgaatatactgttcttcgtctccatccttctgatcaaacgacttggatgtacaaatccaaggtactctgaagcctacacaccacataggtgtacaaatccataaaatttgagcaataacccgataatatagcagaaagcaaaaaaatgtaatccaaaacctaagaaagtcctataaatgataatcatataagcacataccttgaaaagctcgaagagcttcttaggatcttcttcttttttgttgaattcctcgcggatccacttctcatccttagtggagaagggtttgtaggaatcttcttctggttgatagttgctttgaaagaagaagctccaacaagcatgtgttataagctgtctttctggtgtgggaaacagaactcttatatgaatatttataaaggtgttcattagtttccttcaatgtttacaatcttcctcatgatttcactagagacatccagagtacaaacgacttcgggatcggatgatttcttaagaatttctgaaacttttgtggatacttcagccatagaacaaggatcaaggattttaacaactgagtcattgcaagttatgtttacttttgcatactctcctccagtcatgatagatgattttacaaggagagaaaaacctaacagagaaaggaaaaaaaatcaaagcgtagagagtcgagaggatcatattcgtttacaaaagaaaatagaagatcgttactttagagatgaagatcgtgatggtttcagatagatagagagagagagacgagcgaggaagtgaaagaaaatacataaacttctattttatatcccaccctttttcttactatcaacaaaaaaagaaaattgtttaatgtcggttttccgattgttaaaaatatccgcttaattttcttacacacattttttattacaaaaaccaacttcaaactaaataattatgagggttatatatatgaaggataacaaacaaattacagattaagaaatactataatgaaggataacaaacaaatgacacattaataagaaatacttaaatttggcatgggtccgagatagttgaagactgacccctgtttaagcggattccaacttttaccaccaatttagctctccccaatcttgcttactactttcccttcccaccatctctatccatttttcctatctctctcaaaaaacaaagtgaaaaatataaacggagg

SEQ ID NO: 7839 - DNA, 3000 bp, Unknown; identical to SEQ ID NO: 7838
  misc_feature (1)..( 3000): cDNA_ID_1809414_gDNA_ID_1621167_Annot_ID_173879 3000 nt of promoter + ATG

SEQ ID NO: 7840 - DNA, 3000 bp, Unknown
  misc_feature (1)..( 3000): cDNA_ID_2175516_gDNA_ID_1621167_Annot_ID_173878 3000 nt of promoter + ATG
taatctgatagagattaccaaaattggatatatattaatatttatttgaattttggcttcgatttaagaaccgtacgttaagctaaagttgatgaactaaactaaaacatgtattcctttgaattcatcgatcagtcaatatcattatcatactagcatggagaaagactgtttttaaactcatcatattatccattttgtgtttaataaaaaccaatcaaaaatcgacaagtgagctactctagtactctctttaattagtctttattggggttcatatgtctattttctgttttcaaacttatatataagaaaatatttcgtacataaaacatattaaaaccaatcaaaaatcgacaagtgaagtactcttttattatagaccactgaaatgtatatagaaactttagcatgcacgagaattctcatcttcgttatcttttccgtctaaaaacttaaccatgcaatactctagtctcttcacaacttcctccggcagggacatttgaactctgatggcatcattatcgctcgccacgggtaaaaataaacagtagatatcactcgtcaaaggacccatatacattggctttcctcctcccaagtccaactcctctaatcccaatttcgcccattgtgaaatgaccaaactgcacgagacgtccgttttcaccgttttatcctccagtaaatctatcgttgatcttacatattcgtcggtaattcttgattttgcctcttgtatcgattttacagcgtggtaaatattaccattgactaggtcttgtaccttgctctcggcgcaagctagtacgaatccattaccgtaatacccttggggaagttctggagttagtcgttttctcatattgactgagaataagagtttgaccagcatggtcattggtaaatctagagattgagcccacgagcgccaagtgttagccgctagtgcctcgaacgtggtgcattttagcgaaggagcgcaggttttctttaagcgtaggagatgagattggttgaaggttaaggtggcaggagccaatggttgggactgtaaatacttggaaatgtcgaaggtggagcttttgtctacggtggtggttcgggtgaaaccgggatgtgagtgtgtgacacgtggagggtttcgcggatctaatacgtgacgggagtggaatggtcgggtcggaagatgagcttggctagtggtcgcatgggcccatgcatgtaggaactgcgatgtgccaatgccgtcgcagaggcaatgattgatcgcggtgcagaggatcatacccccacaacggagatacgtcacctgaggcattaatattcgtaagatatcaaaatgtcgatttattattacattcgactagctttcaagcgttaataatcaaacttgctgatactttatacgtaagttcatagaaacgcagttttaataaaacacataacatgagttgaacaaaacgacttatagaatgaactaattcaatgcaagaaaaaaagggttttgtttttcgtgtaaacgagaaaagaaaaagagtatgattgaacagacaaattattctctatgcgcccttctttttcttccatataatctctttattaaagttcacgtattttaagagtagaaaataactttatgttattgatacatcgaatgcttatgcacgaccagtaaaagtatgcatttctaatttgaaaagaacaaagtggccgaatcaatttaggagttaggaatttaaaaacaatttagattattcctacgaattatatttaaacagaacagtcgatccaactaactttaagaaacctaaaatattcgagctacgtttatccccctccaaaacaaattcgaatataattctttcacgaaattaactaatatggaaacaatacgagtcatggttttgacttttgaaattgaaatcataagtttcccagcaagaaaaaaataaaataaatgattacgaacctgtatgacaagaggaggaatatccaagaaactctgagcttgaaccttgaacaagagcttcctccaagacttgtttggtttgggagaaagttgaacaaaatcttgacaagttatatccatgaaagcttctgcgaaaactgcgccttctccattacagtctacctcgagcttgctcccttcatcggagactcttatccgacccgcgaaagggtagtaatcaactagaaccctagagagcgaatctttcagggtgagaggggatatagatttttggaaaaggtaaaggtacttgatagagaatctgagaaaatgatggtcgtcgaggtttgaaaggtagagagagtgatttggtgtgggagataaaggagttattaaggttggttggttttcctcgtacaaacaatccggcagttcttgcatcctccgtttatatttttcactttgttttttgagagagataggaaaaatggatagagatggtgggaagggaaagtagtaagcaagattggggagagctaaattggtggtaaaagttggaatccgcttaaacaggggtcagtcttcaactatctcggacccatgccaaatttaagtatttcttattaatgtgtcatttgtttgttatccttcattatagtatttcttaatctgtaatttgtttgttatccttcatatatataaccctcataattatttagtttgaagttggtttttgtaataaaaaatgtgtgtaagaaaattaagcggatatttttaacaatcggaaaaccgacattaaacaattttctttttttgttgatagtaagaaaaagggtgggatataaaatagaagtttatgtattttctttcacttcctcgctcgtctctctctctctatctatctgaaaccatcacgatcttcatctctaaagtaacgatcttctattttcttttgtaaacgaatatgatcctctcgactctctacgctttgattttttttcctttctctgttaggtttttctctccttgtaaaatcatctatcatg

SEQ ID NO: 7841 - DNA, 3000 bp, Unknown
  misc_feature (1)..( 3000): cDNA_ID_3436784_gDNA_ID_1621167_Annot_ID_173877 3000 nt of promoter + ATG
tttcagggtgagaggggatatagatttttggaaaaggtaaaggtacttgatagagaatctgagaaaatgatggtcgtcgaggtttgaaaggtagagagagtgatttggtgtgggagataaaggagttattaaggttggttggttttcctcgtacaaacaatccggcagttcttgcatcctccgtttatatttttcactttgttttttgagagagataggaaaaatggatagagatggtgggaagggaaagtagtaagcaagattggggagagctaaattggtggtaaaagttggaatccgcttaaacaggggtcagtcttcaactatctcggacccatgccaaatttaagtatttcttattaatgtgtcatttgtttgttatccttcattatagtatttcttaatctgtaatttgtttgttatccttcatatatataaccctcataattatttagtttgaagttggtttttgtaataaaaaatgtgtgtaagaaaattaagcggatatttttaacaatcggaaaaccgacattaaacaattttctttttttgttgatagtaagaaaaagggtgggatataaaatagaagtttatgtattttctttcacttcctcgctcgtctctctctctctatctatctgaaaccatcacgatcttcatctctaaagtaacgatcttctattttcttttgtaaacgaatatgatcctctcgactctctacgctttgattttttttcctttctctgttaggtttttctctccttgtaaaatcatctatcatgactggaggagagtatgcaaaagtaaacataacttgcaatgactcagttgttaaaatccttgatccttgttctatggctgaagtatccacaaaagtttcagaaattcttaagaaatcatccgatcccgaagtcgtttgtactctggatgtctctagtgaaatcatgaggaagattgtaaacattgaaggaaactaatgaacacctttataaatattcatataagagttctgtttcccacaccagaaagacagcttataacacatgcttgttggagcttcttctttcaaagcaactatcaaccagaagaagattcctacaaacccttctccactaaggatgagaagtggatccgcgaggaattcaacaaaaaagaagaagatcctaagaagctcttcgagcttttcaaggtatgtgcttatatgattatcatttataggactttcttaggttttggattacatttttttgctttctgctatattatcgggttattgctcaaattttatggatttgtacacctatgtggtgtgtaggcttcagagtaccttggatttgtacatccaagtcgtttgatcagaaggatggagacgaagaacagtatattcatcacatttatttataatccttcattaatgacgggttcatggacgaactacctacgaagccctccaatgaaaggcttatgctactttgggtttttgttttgcaagtctttacaattttcatagccatcttttttcctttgtagctcactttagaagaactttagaatcgtgtatcgtttatctgataccgtttgcttcacaacatacgttgagtcgataaattgattgtttttattttatgtttttatctgttttttgccatgagatcaaatcaatagatttaacatcttgtaaacctaaacatttttattttaataaataattaaaaatcactacataaatttttaatattttgacacaaaaacttatgtaaatctatttttgaaactagatatctgcttgtaccgttaaaaatagatttaacaaaacaactgagaaatttttttgactaagctttcaaacatacaatactaaatctaattctacttgaaaaaaaaagaaaaagaaaaaaaacaccacagcaaaaaaaattaatcgcttaatcaaatattacgtcgccaagcttgatattatagaaaactggtattaaaataacccaaactttcgaaaaaggactgtaaattacacatgttttaaaattttgtctaatatttttgcaccgttaaaaaccaaaacggaatataatatctttttgtaccatatgtgttgcaatgatgtaagaaatgcatgctaaatttaatagtaaatctagttgacatatgagttatatctatttttattaccgctaaaataaataaaattttcaatgtaattagaacttagaactcattcaagtatagtggataataggtaagtagaggccattactttatatgatgataaaacttagaattacttattaatcatgttttctttttttggcagcgtttacaattacaactaaatccaatttatgttttaattattgtttttaccatagtagaccatttcctcgaaacttaaacgtaatcattattttgccagagtgtacgagccataatctcgccacgtgtcccacgaactcgcatagcttaaagatttttttttaacaaacaaacaaacagtgctttttccgcaactttctccgccagctcaatttcagatctcggcggcgacggatccattccaatcgtgtttcagatcggtgactttgagttagaaccaaccaccttactcaatccgacttcagattgaaattgctatatcctacgcggattctcctgcaaacttggtgcggatctctgcgaaaattgctgttttggatgtttgatttgggagctgtgaaaaataggacggtggagtgagattatctgatggcgtcaatccggcgaactctctcgccgatgtatcacgatcgttctcacgagaatggaggttcacacaaaggtttcaccattggtggtagtagcagcaaacacaattcttcgcaatttctttcgtatctcaccaagctcctcggagtaacgtctgatcctaaaagctcgcgtagaggtccatggaggcgaccgttttaccagtttctcgtcttctttcttcttggatttgtattaggtttgacacctttcggaaaaatg

SEQ ID NO: 7842 - DNA, 3000 bp, Unknown
  misc_feature (1)..( 3000): cDNA_ID_3046680_gDNA_ID_1621167_Annot_ID_173870 3000 nt of promoter + ATG
ctccgactatgaggctcggacgatgacggtctcgtccacggcgatctcaaactttcttattccagctttaagcgagattgcattaaacaaggttgatgagtcggtttctcgctttctcactgaaacaagaaagaaaacaactaaattattgaaataaacacaagcctaagatctagagaacaaagacacgagactacaaaaaaaaaacaagtaacaccaataatcaaatctgaacaaatcttacgtttaagttcgtcgaggacagatttagacacgaatgattgagtttttagaggataaagatgaatagatgataatgaattgatgaaggagaagagatgtgatgatgaatagattggagaagaatgttttttagatcggagaagggctcacttggtttgcaagaggcagtgaagaagcaaaataaaacaaattagggtaattgactagggttaagtttatatatgattgcatattttaataaaccgatcggtccgattaccgaaccgacccgacccgaaatccgaacaccaaaattaaattcgccgaacggttagttacagtatcttcggttttcgccgataaccgaaattatcagtttaatcgggtcggtttgctcggttcctgccgtaatcccaggcctaggaaacacggatggctctccattaaatagtgccttacgtaaaaacaccctgtcgtcttatctttctagagttgcaatgagggctgttttctgttacctatccaaaagccctttctttaaacgcagtttttatcttttaagacagctttcgttaaactgttaaaagaaaatgaaaatgcgatgtgaacaaattagaaagcaccaataaaaacatgccacatacattttctatttaataatttaattttcataaaaataaatcaaaacaaaattgagatcgtgcaaaacagaaaaaattttttaaaaaaaacaaaattaattattaaccaaaaaatatgggcttagtaatggaaagaaaaactttctaaaaaataaaattcaagccaatattgatatgcaaaaaaaaaaagtgtaaaaaatcctatattccttaatttgctcctaccaaccccttcacgatcaagctaaaatcaaagcatgttttattaaccgattttctctatttaatcattttttctattatcttccatttttttcttctcttgtggatgctatagaaactactatggaaattctattcaagttagcgcttaatttttctttatattcattcatttgctatttaactcatattaattgtgattttattgtacttatgttttccaaattacaaattattagtagtttaacgattttgttgttaataaacaaatacaaatatttgtattttgttgttaattatttgttgcacaaaataaacaaatacaaatattgcaacctgttgttaataatttgttagttttttaagctaatttttcttagttaactttacaaaatttaaatattgtctaaaaacagaaaaataaataggatttttagatagtataggatccacttttattttccaaaccctttaattatgattgaatctctactgctctctatcaacctcaatcttaacttgtccccgtacgtagtacggggtagaatacttgtatattagaaatttgatagtttttttttggagtcagaaatgtgttttatttattgtataaaaccaatataacaggccaagattttacttatatttaaaaacaaacaaacgtaagaatagaaaacaaaagtccaattaagtgaaccttaaactgaagataaagttgtatacagtacaaacacatgtcaattgagaaccaggttgaaagacacgttgaagaagttggagtcaccgatagattgttgcgacgtcagaaagctccaattccaccaaaaacatcataaatctcattcaatttacatatttatatatttgcctaaagaaacaaggtaaaatcccaattttagctttgttgagaatatgactccatttattgtagatctgtaaattttcttcatcttcttcttcaatcaacaacttttcaaccttcaatttttttttttttttacgtcaaccgatattaacttttcaaccttcaaaaaattttgttgttcacaaaatatatacttgtttttattgaaaaagttcttactatccaaaatatttgttccatcattaaaaatcgaaatagtcggaaaaagaaaaaacaaaagcgagaccaaacctaaacggtccggagaagaagctagcctatcattaccgaaagaccgctaaatccgaagccagagccgaccaccaatgttgattaaaccaccgatgtcagaaacatagccggatgaatatgcaaacgaaggcatctacaccggaagcaaagccaatctatatataccgttgagaaagctggtacaaccaaacgacaaacccacctcaaatgagataaaagtcaacgaaaaaatacatcagagaaatctgagagaatgaaaaatgaaagagagaagagagagaaaccttagaaatttgatagtttatacaggaaaaatacattaaaataatttagttttaaattgtaatgctacttgtcgtaaaaaaaagaaaaaaaaaatttcgaaatactacttagtaatttgaaaaaagaaaacaatattcaaaaaatttccatgttagcgcaaaaaaaaaaaaaatctataatcaaaccaaaccaaaccgaaacaaccaaaaccaacattaaacctaaatctcatgatttttgatttgaataaccacgagttcaccaatccctcttctacattcagtatttaaaatctttataaacacagttagacacataaacgtttctgaaaatcttgaataaccaaaaatgatccataatgataatgatgttacattgggccataggcccgttaaaatatttttctcttgctgttattgggcttggtactttatatatacattatcaaaagacgagaaaatctccgtcaagatg

SEQ ID NO: 7843 - DNA, 3000 bp, Unknown; identical to SEQ ID NO: 7835
  misc_feature (1)..( 3000): cDNA_ID_2175480_gDNA_ID_1621167_Annot_ID_173867 3000 nt of promoter + ATG

SEQ ID NO: 7844 - DNA, 3000 bp, Unknown; identical to SEQ ID NO: 7834
  misc_feature (1)..( 3000): cDNA_ID_1809446_gDNA_ID_1621167_Annot_ID_173866 3000 nt of promoter + ATG

SEQ ID NO: 7845 - DNA, 3000 bp, Unknown
  misc_feature (1)..( 3000): cDNA_ID_1989575_gDNA_ID_1621168_Annot_ID_57816 3000 nt of promoter + ATG
gtccgatccgtctggccgatccgatccgtctgacgatcggtctggccgatccgatccaacgatcggtcgacccgatccgattcgtctctaagacgaacggtctaccctctccatcctctacactccatcgaaccgttggaccgggaggtagcatgcgcatcagttcggtcgagttatactcgccgagccgcaccccctttccgaccaacaactctaggatgtgttaggactcctttaagaatgttttatggtgttttggatgttgtgagatgatgtgagattattccaaaggccttgggcgtcctcccttatatagggggcgaatggatgcttcccgaagcatcacatccgttccttgcaccactccgaaaggtcacatccgttccttgcacccttccaaaaggtcacatccgttccttccaaaaggtcacaaccgttcgttggtacccgctcgaccttacaccttttggccgagacaccttttcacccgtgagctaccacagtccaccagctcgagtgtcagctgaccagaccacccagctgggtcagtacacgatcagctcaccgagctcagtcgagctgtctgtcagctcacctagctgagctagctagtcttccagctggtttagctcacctagcttagctagctagttcatcctagcttgtccagctcacctagctggttcagctttgaactttctcgttcttctgactaagtattttagtccgtttcttgaccatggtctagttttctcctaaaacaacctcacctctttatgaacgcgggacgtggtcgtttcaagtctaccccccttaaactgaattcgtcctcgaattcggcgtgtgtaagatcttgcttactccctaactcgggaaacgggcgttacactttggttttaaagacttgcaatgttttaatcaagcactgttggccaaactagcttggagattactcactgattcaaggagtcttctttctcaaattttcaaaagtcggtactttttaaattcagatttcctcaatgcacctcaaggaactagcccttcttatgcttagaggagtattttatatggtagggaattattgatgggaggtctgaagaggattgtacaaaggtgtggatttataaatgggtgtttgatggtcagaaccggagaccaatgaatgtgcattcattgatggatatctagatgatagtaaataagttaattggtcatatcactcggaattggaacttgctgatactcagagatttatttcaggagaaacatgttcagttaattatgcaccagagacctcttgtcactatagaagacttctattgtcgggctaggactaatgatggtttatatacagtaaattcgggttatgatagaagtagtagagcgacttacccgaatcctttaaagaagctgaggtatgtccttctattaatcccttgtttgataagatttggaatcttgcaacggctccaaagattaaggtgttcatgtggaaagttttaaaaggtgcacttgcagtggaggatagactaagatcacatggaattcaaattaatgatgggtgtttattgtgtgaagaggaactttaaacaattaatcatattttgtttcagtgttcttttgctcgacaggtgtgggctcttgcgctcattcaatcacctgcaatggcatttggatcctctatcttcacgaatattgattatctgattcacaattctctgaacttgggactttctcaacaactgagatctgttagtccttggatcctgtggtttttatggaaaaaaagaaataagattttgtttgagggtacatgttcattgactcaagaaatcgttgattaagcttatgagaattgttctcaatggatcaatgctcaaggaaaagggtctgttatggttaagtcaagttcccagaattggattcctccaccagtggatgaacttaaatgtaacattggtgttgcttggactaaacagaagcaattagctggtatatcttgggtggttcgagattcgatggggcatgttttacttcacagtcgaagatcatattcttatgtacactctctatttgttgcaaaaattaaaagttgggaatgggcattagagagtatggatcatctacattatgataaaataacctttgccgcctcctctcctaatattattaaggctttgaataaaccaaatgacgggcatcggtcatatttctgaattactcaagttcactaaggataaaccacactggtttatgatgatgaaaacagattattgtaatacaggtgcttttgaaatagctaagagtgtcatcacaggaatgcggtggcaatcttatgtagctcacagtttcccctattggttgagaagtctttttgataaggaattgacttatcaatagagtatttgagttttcacaaggaggttaggattagattttaggtttgtcttttataagagtagaaatcaaagttttttttaagtaatgtaaaatttgatacaaatcgataaattaataagagaataatttttttgaaaatcttatgtaaatatatggtcccatcaatatcataaattaataattgtataaatatatcaactatatatatctattatatgtaagaaacttcaatgatatataattctagtattgtttttttcatcttaaattcatattagttcttgtttgaatttagttcatttatttttattgtatcaaaaacttttggttttgttttttagacataataactgtttttacttgtatttggttcgaaaaatatattttatatatagagagatatattatattgtcatagaaaaataaaaaattaggaaattaagaaaatttatctataaattaatacctctataaattaatagaattttgcggtcccaacattattaatttatagaggttttacactatatgcgttgtgtcttaggtttgtgtttagtatctaaaactcccttgtgtttctcttttctctttggtatc

SEQ ID NO: 7846 - DNA, 3000 bp, Unknown
  misc_feature (1)..( 3000): cDNA_ID_1989574_gDNA_ID_1621168_Annot_ID_57817 3000 nt of promoter + ATG
cagtcgaagatcatattcttatgtacactctctatttgttgcaaaaattaaaagttgggaatgggcattagagagtatggatcatctacattatgataaaataacctttgccgcctcctctcctaatattattaaggctttgaataaaccaaatgacgggcatcggtcatatttctgaattactcaagttcactaaggataaaccacactggtttatgatgatgaaaacagattattgtaatacaggtgcttttgaaatagctaagagtgtcatcacaggaatgcggtggcaatcttatgtagctcacagtttcccctattggttgagaagtctttttgataaggaattgacttatcaatagagtatttgagttttcacaaggaggttaggattagattttaggtttgtcttttataagagtagaaatcaaagttttttttaagtaatgtaaaatttgatacaaatcgataaattaataagagaataatttttttgaaaatcttatgtaaatatatggtcccatcaatatcataaattaataattgtataaatatatcaactatatatatctattatatgtaagaaacttcaatgatatataattctagtattgtttttttcatcttaaattcatattagttcttgtttgaatttagttcatttatttttattgtatcaaaaacttttggttttgttttttagacataataactgtttttacttgtatttggttcgaaaaatatattttatatatagagagatatattatattgtcatagaaaaataaaaaattaggaaattaagaaaatttatctataaattaatacctctataaattaatagaattttgcggtcccaacattattaatttatagaggttttacactatatgcgttgtgtcttaggtttgtgtttagtatctaaaactcccttgtgtttctcttttctctttggtatcatggcagatgagttatgggatgcattacaacacttagagttaggaagggaggatcctgctctgtttattccgcatgctacttatgcaactgttgaatctaggaatagacttagcttgattgttaggcctcttaatcctcgatctcaaaatctcaatgttgtggttgctgctttgccaagggtttgggatctgacgtctagagttcatgggagagtgattaatgcaacgtttgttcagtttctctttcagtttgaggtggatctcttgtctgtgctaagaagggaaccatggctctacaacagttggtttgtcacggctcatcgatgggaggtaaatatggcttttgagtacttgtctaatattgatctgtgggtgcaaatgtttgggatccctctcctctatgtttgtgaagaaaatgtggtagaaatagctcatggtttaggggaaataatatcattggattttcatgatgctactacaactcaaatagcttatattagagtgagaatccgatttgatattactgattgcataagattcttccaacgaattacctttgattctggtgagactgcgctgataaggtttcaatatgagaggttaagaagaatatgcagtagttgtttcaggctgactcatcataggaatttctgcccttatcaacaacctgagcctaggtctcttgttcgtggtcctactaacaaccttacaaggactagaagagaaggagtgtgtacccataatgaatatcatcgatcatccctgaactctcaatcgcatatgtctgaaaactcctttccagcgcctcttgaacctcctccaagagtggcagctccttctttgaatcctcatgaattggtggctgcttattttcctcaaggaagagcagtgtctttaccaaatataggaacactgaatctaatcttaatccatcatttagcagacaagcggtttcaaggaattttaacattcaaccgttttttggtcctgttattgctacaaatgttcctcgtgtggttgaagtaggtgagtgttctagacaaggagagtttggagaaccagtaaacaagatggataagggagactcaacaaaaaggaagaatatgggaagtgctagaagtgatgaagaagaaagaactcatggagttgttgggcataaggatggaggtattctgaaacctccaaagaagcgctaaacactctgaaaattttgtcatattttttgttttctatgctgcttaggatccatgatcgcagcttcaaggtttatataataagcgctgcattgggttcaagtatgcaggtccaaggtttgaataaggtgaagagtgggtatggccgttggaacactttttggttaaggctactctttgtgtgcagtttgttgtttcagtttacctatcactttttgattttacaacatgggtaacattgatgttttgttaggtcatgtttctttacttgttttggtgtttgtcttcaaactgaaagtggaaggtctactgatgtactttttgaactatgagagcagccccaacggtaaaatacattctcagtccattgtttctattattttaatcatttaagtataattttattatttatttatatttttagttacaaataaaaaaattgatcaattatactttatcacatataaagtgagtttttaagtacagtaaagcaaatccgtctttttaggactttctttctttctttcttacttctctcttactttttccaattaactatcattttttttctttttaagggacttattaaaaccgaccgctggggctactctgatcttaatatatatataaaaaaaagttgctccatgagttagcattgattacatttatcaatgtcttacatgggctacactaatgatagtatgttgggctttttatgtgtgctctagtagtattgtcgtttgtttgtatttgtactatgactcatcctcttgttcatcggatctaaagcgccactcaaaagggtttatgaaaaggttagggttttaacaacaactcaaaaaacagag

SEQ ID NO: 7847 - DNA, 2360 bp, Unknown
  misc_feature (1)..( 2360): cDNA_ID_1989571_gDNA_ID_1621168_Annot_ID_57820 3000 nt of promoter + ATG
caacacaaatatatatatctggatccaaaagaagcttcaaggatccagaattgtgctcactatgtttgtggagggcttgtttcctcaaaagaaattccattgtttagactatgtgaatattgaaatcttgttcttgttttgtctgtaatgctccttgttgtatataggacatccttggatgaaagaaggagaagcttcggataagcctattgatggcgttgttttatcccgtttgaagagatttcgagatgcgaacaagtttaagaaggtagttctaaaggtaaagagtgaaccattccctattcttgctactacctcctaagtattatcttaaacagcttactaatatgtgattttcctagtcactggaaacatatcataccctgggaaatgatccatcttcctatctttgtctatgaagcatcgatttatgatgtgtgtgtctgatttgcagtttattgcagcaaatctatcagaagaggaaatcaaaggtcttaagacactgttcaccaacatagatactgacaaaagtggaaatattactcttgaagaactcaaaacaggtcttactagacttggatctaacctctctaaaaccgaagtggagcaactcatggaagctgtgagttgattacttattgcatcggacttgtctttaaagaaaaaatataactttgtaacacataatgattaacttctcaggctgatatggatggtaatggaacaatcgacatagacgagtttatttctgcaacgatgcatagatacaaattggatagagatgaacatgtgtacaaagcattccaacactttgacaaagacaacgacgggtatgtttcttccactttttgcttattagtcgaataatgtttttgaactaaaatgtgaaatgcttgacaatacaataggcacataacgaaggaagagttggagatggcgatgaaggaggatggtgcgggagatgaaggtagcatcaaacaaatcatagccgatgctgataccgataatgtaagttggtcaatacatcaaacatgaaacatcagaccggtttttttcgaaacactgttaagtaatgaacaactctgttacaggatggaaaaataaactttgaggaattccgcacaatgatgagaactgagagcagcttgcagccagaaggggaacttcttccgatcatcaattgaataatacatatttgcatgctttaaggtattgaataatacatatttgtatggtttagtttgatctgtttaatccacattttttgtttgtcaaggttgtaaaatccaattaaaaagaattcattcttttggtatatttgtgattccttataaagtgtgttgtagttttatagatacttgacctaaggaattgagaaatacaaacatcaaaaatattcagagaattcaatagaatatttcggacgctctacgttttagggtttctttcacaatttgccttggcgtttaaggtaacctaactgagaaaggtttcttgttattcaataaaccatctctctgctacagcgagtgtcaatggctctcatcttccattagcgacgatgcatagacacagattggaacgagatgaacattttcagaaagcattgttgataaagacaacaacggtttgcagccacaagggaaacttcttcgtatccattgatcattaagctctgtaattgtttcactaaatagtggttttccggttttggtaaacccaaagattcaaagctaaaccggagaaaacagaggccttttctcttgtaaatttcttgatcattgcaaacctttctagctgaaacagagtttttcttttgaccgaaccgaatgtaccggaccgaaatatccgaaaccgaatggatataaaccgaaatattttggataaccgaaaatatccgaaatataaataaatttcaaaagtattagttatttctaaactaaataaataaaaatacttgagaatatatataaaatagtaaaaatattcgaaaataaccaaaaattatcctattatccgaaaataactgaattatccgacaatattcaaagtaaaataaccgaatggatactattttttaagagcaaaagaaccgaaaccgaaacctaactttcaaaataaccgaatggattctaaactttagaaccgaaaaaaacgataaccgaatggataaccgaacgcctaggactgataatatgaatttaaatattctaaagaccattgacttaaagaccaaatcattgtaaaccctctagctgcaccagagtgtttgcttttgaccaactatgtgaatttaaatattttaaagaacattgacttaaagaccaaatccacaaatgtacgagttcagaattgagatg

SEQ ID NO: 7848 - DNA, 3000 bp, Unknown; identical to SEQ ID NO: 7846
  misc_feature (1)..( 3000): cDNA_ID_3088205_gDNA_ID_1621168_Annot_ID_173901 3000 nt of promoter + ATG

SEQ ID NO: 7849 - DNA, 3000 bp, Unknown; identical to SEQ ID NO: 7845
  misc_feature (1)..( 3000): cDNA_ID_1989575_gDNA_ID_1621168_Annot_ID_173900 3000 nt of promoter + ATG

SEQ ID NO: 7850 - DNA, 3000 bp, Unknown
  misc_feature (1)..( 3000): cDNA_ID_3088209_gDNA_ID_1621168_Annot_ID_173899 3000 nt of promoter + ATG
tgtccttcaagatagactcagtagaacgagagacgccggagtggagacgttggtttctttctctccaaattgcataaacacaagagtgaaaggccagcctgataatgagacaaatatttttttcccttgagggagataagagccagttaagacagtccattaattgggcaggaggattaaggttggttgaggctgtaaaaaacctccacacgacaccactaaactggcactcaaagaagagatgtgctctcgaatcgtcatgagcattgcaaagaagacactcagcagggatcgagagaccccaattctgaagcctatcccttgtgtgcaatctattccacgccacaacccaacaaatgaaggcgtgcttaggaacatggttcttaaaccagaccgccttatgccaggggacggtgtgagattgcggatgcagagcagaccaagttcttggagcggagaatctgtttgatggtgcatgaaggtccgttttccaaagaaaggagtcgtcatgctgacagtcaagcaaaccctgagcctccgggagaagatttttaagctgaacaatgattggattcctgctacggcttgatgcaatccaccaagacgtgccccttaacgcatccctaaccacagcatcaataggcaaaccaactgtacgagggcctagaggaccgattacctctataagggggccaaggccaatccaattatcatgccaaaacttagcggtgaccccggaaccaacctcacaaacaataaagggccttgccacaactctgagcttacacatcttccaccatcttggatatcatttcaacaccttcaaggacatcttcgtcctctacatgagaggaaaggttcttcacataagtggagtcgaatcctgtaattgtggagttaaaatagaaaataagacaaataatgaagtagttcattaaagagttttattaaaatgcgaggaaccaaaaagaaaaaatttatatttgttttagttcataaaagattgaatgtggctgcaccaataatcagctttggctacattaatttacacaacatatatatggacttatatatatgaacccatatatatatatttatatatatgaacccatatatatatatttatatatatgaaaaactcttattataaaacctaataacattgatttagatggactacactaatgataatatcttgggtttttatgtgtgctcttatactattgtcgattgtatgatttattcttcatcggatctaaagcaatactcaaaaaggtttatgtgtgctcactcaaaaccttaactaggggttcaacaaaacaaaacaaaaaaactcaaaggagatggatttcgagttgagaaaactttcaagaacattttcaaactctagaaaaaaggaaagcttcattctatgaatggagttaaatagaaaataagacatgaaataaagtgattcattaaaaagttttttttttctcataagtgttatactttattttaaaacttgtgttgtaaagatacaactgtggaaccttccacttacaaatcttgacagttgacacatattaaatcttacaacgttggatcaactaaagtatagtcatccatgttgcataaaaacaaacaagtctagcttataagcagatgcccataaagaaagcccagtccaggaaacaaaacccttagagaaagtaaatttaaagattgccttccacccaaaagccacgtgtgatgtgaagaaacaaagttgaaacacgtggactgaagaagccttagtcgtcgctgttcatcgccgaactggttagcaactcagagaactccaaaaccatggaaaccgccagagcttcaagagaagtctatcaatttttaattagagaaccccaccaaacttcatcagcaaatcaggaaaggaaagatctaccaaaggcaattgactcccgaaatccaaggaacatcgacgtagagtaagtctttgagctttcaacaacacctaaaaacaaacaaaaaagcactcgtctccataaaacggttagagaaatagccacaattgcattagattcaaccgagaggcgtaaaaaactttaatctgcaactcaatttgttcctaaaaaattgaaatcgataagcttggaaaacaaatcgagccctttaaacaaaggaggttcaaggaattatattccaaatggaaacacaaaagacctcaatcaaaccaaatataaagaaatcgagagatgaaaacataaatctaaaccggaaatcaatttggccaaaagctagacgagacaccgaagataggcggtgaaactctggaccttagctagcccaccgccgctaaagaagccaacggaagccagacgcaagcagaccaccgccgtaaaaaaccggacagtgtcagaacgaaaacagatcaaacgttgcccaaaacgtcgctggacaaaagccagacatccatactgaaaaagccataaattctggacagaaaaccggccaacaaacgttgaagaagcgattattgtcggaaaaagaagatccagtgcttcctctctctaaaagatgctgatgagagaagagagagaaccaccaagatttatttaaatgcaaggaacaaaaaaatgtttgccttcaaggataaaatagatatagatttaatctctttaaatttaatcttcgtcaataaatttgcttcatgagttaacgcgatcaaactaaaaaaatctttgttctctcacttagcagctcattttagaaattctcatcgccgttcgtttgccgtcccgtttctgttgggcttaagaacttctcctctgtagtatatcattatacttgagcggagcccttgtccgaagaattaccagttttttgttggagttctgattcagttggatttcatttgctactttcaaaagttggtttgctgtttcaattaggctcgattctctgtgaattgattgcgcttggtttcttatcgaagttgattcaagtggatttctcgtcatgaat

SEQ ID NO: 7851 - DNA, 3000 bp, Unknown
  misc_feature (1)..( 3000): cDNA_ID_1989573_gDNA_ID_1621168_Annot_ID_57818 3000 nt of promoter + ATG
ttccagtgattaacttctatgtactgtttattttgttaaatcaacctcaacttctcggagatgccctccgagactagtaatcctgttattgcacattttgcttaatttcttggatttattatatatgtttttgttgcttgttgcattgacatcccttcagataattgttatctcaaattttcttctaaatgcaaattctttgaatttgagcaggcatcgacatgcagcagccagtgttggcacaaaagtatacatattcggtgggctttacaatgataagatagtttcctctatgcacattttggatacaaaggaccttcagtggaaagaagttgagcaacaaggtcaatggccctgtgcgcgccattcgcatgctatggttgcatatgggtcgcagtcattcatgtttggaggatacaatggggaaaatgtactcaatgatctatacagctttgatgtccaaagctgttcttggaaacttgaagtgatttctggaaaatggcctcatgccaggttttcacactcaatgtttgtttataagcataccattggcataattggaggttgtcctgtctcacaaaattgtcaagagttgactttgctagatctgaagcaccgattgtggaggagtgtgagattggaatttatgaacaaagagttgtttgttagaagtacagccagcattcttggtgatgatcttatcgtcattgggggtggggctgcttgctatgcttttgggacaaagtttagtgaaccagtgaaaatcaacttggttcaatctgtgactatgagtgaaaatcatcttcctccccaacctgaagatgtttctctagaatcgaataaaaacaatgcagatttgaagactgagacgtctctgtctcaaccatgggtgatacagctagaaagaaagtatgcaaagttcggcaaggacatacttaaaagtttcggatggttagaccttgagagaaaggtttactcaaacgaaaaaggtctttgtatatgctttcctgtgactgaaaacttttctgaacttttccatgagaagcagctattgggcaaggactttgaaaggtcagaggaaaataatctaacaaagggtctatcgttaaaagatatatcctgctcagcggctttgaatctattgaaggaacatggtgccaaaaaactcattaatgtagcttttgaagccaaaaaagttgcaaaatcccccttacagagaatgagagaagatatcacatctatacttaaacagaaaggcctaccagaagagcttttggatgagctcccacagaagtaagtgttccagaatcctgattttataatactcggggactaaaatggtgagaatctgattgcgtgcatgttgtttttgcttccatctgataagtaattggtgttttatctactattagatgggaacggcttggggatattgttgtggttcctgcaacatcctttaaagatccaacttggagctctatcaatgatgaagtttggtgtgctgtttctaaatcgcttagtgccaaccgccttgcacgccaagtatgttacttttagaagcttacaccaatattctataagtggaaacgtttacatcttttcatcttaaagccactcaaaacctacaatattgatttattataagctgtgagaatgctgagaactttacaaaccgttgtcttacccaattgcatctccttagcagtaagacttataccatcaattttgtgtctttttcagggacgagttgaacctaatggtacaagggatagtacattggagattcttgtgggagacaatggatgggttaatcaccgtgaaaatgggatcttgtactctttcgatgctacgaagtgtatgttctcatggggtaatctctcagaaaagcttcgtatgggtaacatggcctgtgaaaatgaagttgtcgtggacctgtttgctggaattggatattttgttctcccatttcttgtgaggtatatgccattattgaataaacgagaagagaaagtggttttatacaatcaaaagtcaatactttattagatcgcatgcaactacaatgcattcttaattgacatttacagggcaaaagcaaagctagtatatgcttgtgagtggaatccccatgctattgaagctcttcgacgtaatgttgaagcaaattctgtttctgagcgttgtatcattcttgaaggggataaccggatcaccgcaccaaaagtacggttgatgatattccaaacggctcaccgtctatttaattctatgcaaatggttctttttataactgttggatcgagtaaatcgctgaagtaatagattttgcgtttcaaatcttttgattctcagggagtagctgacagagtcaatcttggtctcatcccgagtagcgaaggaagctgggtcacagctattcaggcattaaggtgattttactttccttaaaacttattcttaactacaagaaccaggagcataaaatctggaacaagttttaaggttcagtctctccaaaagatataatctttaagacgattcaaactcagagatgcgaaaatcttaagccacactgctcttggaacctctgaatatgatccaaaaatgtaatcattagagagagcaaccgctcgattgaatgtatattcactgatgtctctgttcttgttattggaatttgtaggcctgagggaggaatactccatgtgcacggaaacgtcaaggactcagatgagagcagttggggcgagcatgtcaccaaaacattaagtgatatcgccagagccgaaggtaataagtttatgaacaaaatcgaaagctatttggactaaaaaaagagcattggttttttatcaagactaggagtttactaggacttatatttttttggggttttatggtttaaggtcgtagctgggaagttacagtggaacatatagagaaggtgaaatggtacgctcctcggattcgccatcttgttgccgatgtgagatgcagatg

SEQ ID NO: 7852 - DNA, 1533 bp, Unknown
  misc_feature (1)..( 1533): cDNA_ID_1809554_gDNA_ID_1621169_Annot_ID_57218 3000 nt of promoter + ATG
aagcttttttggaagagtttagagtttatggttaacctttttttttaagagattagtgcgttatagttgcaaatagtgcgtttttttccatcagaaaagttagtggaaacatgaacaaattgtcagttaaattatgttatcccacttgaatatttttgcattttgcttttaatttctaacggtccaccaaatcaccaaatggagtattttaattattcttgaattaaaaactcactcaaagatttgcttcttcccatccacccaggcggattgaagtttttagcgtctttttaattatcattttgtatttataatttattagatttttaaatttataatttgaaaattattatcatttatttattttatatcagacttaaatataaaaatattgtttttgagttgttatatttgttacctaaattcttgccaaaaaaaaagaaaaagagagaaaatcttctagcttcgaaaacatctaatactgtaatagtaaaatcattaaaacttttaaattggtttatcaaaactatgtcgtatattcttctccttctccacggaacccacacatagtagagaaacaatatgagcagtttatcacactcttgagttaccaattttctctcatttctcattattccttcactttctttcgaggtacttcatacatagtcgtctttctcaagttgttgtggattgtagagaagacctaataagctagagaatggattcgaggaagtctttatcttccatcgatagcttcaacgattgttacgtttgcttgtaacccaagattcgaaggtcaacaattccacggatgatataccttacttgagtctttatttctaaccagttatatgttacaagctaagtctgattcttgtattcttttctaccattgaaaccaataaaatggtctccttaccaagtaaaacagggttattattatgtactctaacaacattttccgttcaatcaatacaagaagcttttggatttcttatttcttttttttttttgggtttttttctttcaacaaaatgattataaattatttatttttctttaccaataagatttggggttttatgaaccatgatgaaatacttttttgtctttttatgaagaaatgatataactctgtttctcctctcttggtagcaattggctttttatttctcaggtaagtagtctcccccttttaaatccttattgggtgttgtattctcccaacaggcgtgagatgttcgttaaaaacaaaaacaattgctcaagagcatggcgtctggttctgttatgtatgtgtcttgttttaggtaataagagtcaacttcaattttgtggtcactttcttgctaattagttgtgataacagctgttgcttagaaacttcaacggccaagacttcaattttgtctcccagcgtagtagacttggaacttctgatatgactttgatcacaaacaagatatatctttaaaaaaccactttagaaagaaatctatttgccaaatcatccatctttctgaaactatg

SEQ ID NO: 7853 - DNA, 3000 bp, Unknown
  misc_feature (1)..( 3000): cDNA_ID_1809550_gDNA_ID_1621169_Annot_ID_57219 3000 nt of promoter + ATG
ttctcatctttcttgcttgcgtagtcgactagtcgctgaaactctgttttctcaggtgtggaatctgtttaaagagaacaaaattcgtgaggtgatagatctgtctttgagagattctgcgcttgattaccctcaagtgttgagatgcgttcaagttgctctattgtgtgtacaagaaaacgcggaagatagaccaagtatgttagacgttgtgtccatgatatatggcgaaggaaataatgctctttctttgcctaaagagcctgctttctatgatggtccccggagaagctttccagaaatgaaggttgagccacaggagccggaaaatgtatcggcgagtattaccatcacggtgctggaggcaaggtgaattgaaaataagaaaactgatataatgtgaatctcattgttacttgaaatgtttttcttcgtttaatagagatataaacggattatatattcgggaattaggatacatactcttacaagagcaagtaatatcttaagtatcaatatacgtgcatgcatgactcttataaatttttccgttatccgaatccgggaaagtaaaagatctatacatattcatctcaacttaattgatacataaaagaagaccaaattcaagagataacatgtaaaatataacacatggaagtaatatttaaggtctaaataacttggacaagaacttctaaccacattcaccaataatattaatattaaaacatacaactttatatgataagtattgtattatatagaactcgcaaactgaagaaattccgtagaaatctagctactatatgtcgttccggtagaatattaatgatgtattcatataaagtcatgctcataacttcttcttttttgggcaaaatagtattattatgttatacagtacataagtttagcaaaatagggtctacctctcttcttcaaaagacgacataggagccaacataatgcaagatagaactaacgctaattaagataatcgaaaagaatatgacttgggtgcaaagcaaaaggattacggtttcttgagagaaactcatccaccggtggaatcaatgagtgcttcatcttcttccaatatgctgatatcatcattaatattcttggtgtaaaacttgtaacagataatccagacatcattatacctaggaatccatatactcatttctttttctttttatcaattgggtgtgacggctaaatgatgtaagaacaatgaaaaataaaaaaaagagcaaagtagaagggaaaaagcaaaattcgggagaatatttttccaccagtatttgtattggaaattttttgttggtaatacaaaactttaaagagctgctgaagttgagtaatctttacgatgttcattttcaatcttgagactatatctatatgtgttaagattgtatggtagaacgtgatataatatctgtatggtaacacgtgagagtagtttgttggtccattctacaaatcgaactaccacatgacagaaacatgtatgatgtagatgtactgtatattttaacagttgcggacaacattggtcggaaaaaaaaaactcataccaaattggtaagtagtgatattaattttggttcaatttcttgatcatgtgaataatagaattaaaatttagccaagccagccaaaaccaaaagaatccgtaagcatagcaaatataaagccactttcgaaactagcaacaatgacggtgaaataattttatcctagtttagtagactagacagtagaaacatgatgtgataaataaaatgatttaatctcatttctcatacttcacttaaataagatattatcttatagatttcatgctttagttagcttctaagcgtgttttaatgattatagggggacataacgacattaacaacacacctcaaatagtatagtttaaatgtacatttacagaaaattcattttaaactgattctaaaatgtaaatttacagaaaaattaatttaaactaaattgataacccttttatgaaaaatattctaagatgttagtcgcaaaattgaaataataagaaaaagatttataataagaaaaagatttataaaactcaattttaaacacaattattggaaaaaacttctatacagagactttgagagaccagcgagcacgtgtcaaaggcatggcatttacttcgacggctaagtgagggacagggaccctgaccgtaacagttcccaaggagttacaatgttccgtacctccttcatttgctaatccctaacacttacgtgagtagtgttagttatttaccctaatcaacatttggattaggctaatccatgtttgtgaggaccactatgatatttttctctctttttttgtttctttatcattatgatatcattataatgaaaaaaaaaaaatggcgaaaaaaaaatatcattatgataaataaatatataattggcaatcaattacacatgccaccatacttttacctttgttcacaaagtctcaaaattacagtactcacagtcagtcaaaattatagtactcatcaatataaacattactaatttagataattttatgttaatagtggatctaatttatgaacccccaaacagtaaaacttttttttctaaaacattacaataaaaatgatatttgtaataccgctatatattttacgattagtcacaatcaaaacggtatcaatcgacaaaattactgatgaccaatagaaattttggcaaacattattacaaaaatgtgttatgtcaaactaaattaaatgaaaacaaaaaatttgtaattgaattattaaatacgttgccataaattgatgttttgcccttaattaattgattacagtatgattaaaaaggtataactaacataaataaatacccttcaagaaccaaccaatctctcattctttcgtcacccaccttcttcactctctgttattttcacaaaccagaaaaattcaagtacagagaa

SEQ ID NO: 7854 - DNA, 3000 bp, Unknown
  misc_feature (1)..( 3000): cDNA_ID_1809546_gDNA_ID_1621169_Annot_ID_57220 3000 nt of promoter + ATG
tggaactctttcaccggatctcaacaagtgtaaacagcttcaacggttgatcctctccgctaacaacttttccggtgagattcctggtgatatctggccggaattgactaatttagctcagcttgatctctctgctaacgaattttccggcgaaatccctaaggatatcggagagcttaagtctctctctggtactttgaatctctcctttaaccatttatccggccaaatccctaattccttaggaaatctaccggtgacagtctctcttgatctccggaacaacgatttctccggcgagattcctcaatctggttcgttctctaaccaggggccaaccgcatttctcaataatccgaaactgtgtggtttccctctccagaaaacttgtaaagacactgatgagaactctccggggactcgaaagtcgcccgagaataatgcggattctagaagagggttaagtactggattaatagtgttgatctcggtggcagatgcagcaagtgtagcttttattggtttagtgttagtttacttgtactggaagaaaaaagactctgagggagggtgtagctgcacagggaatgcgaaactcggtggtggttcggtgaaggggaaatcgtgttgttgtatcacggggtttccgaaagaggatgattcggaagcggaaggtaatgagagaggagaagggaaaggagatggagagcttgtagcgattgataaagggttttcttttgagcttgatgagttgttgagagcttctgcatatgttttggggaagagtgggttagggatagtgtataaagtggtgttagggaatggagttccggtggcggtgcggcgacttggggaaggaggggaacagaggtataaagagtttgttacggaggttcaagctatggggaaagtgaaacatcctaatgtggtgaagttaagagcttattattgggctcctgatgagaagcttttgattagtgacttcgttaacaatggaagtttagctgatgctcttagaggtattacattacttcttccttcttctttttctgcttatcgaattagtctactaactaaagtttgagatccggttctgttctattgacttaagaaatttatgttgactttgactttgtcaacgctagattagacattactaccttagtgagagatgagattagatctgagagatagtttgtgggattgtcaaagcaagagtggaccaagatttctttctctttttaggcatattttggtattttaatttagaatttagtcaagttacatgtaaaagagacatgtcttgtaagagaattcgacatgtccgaataataaatatcttttttaagtattagtatatgatttaagtgtggtagagtcttagagtagaagtaattagtaaaaatagcagaatgaggaaacaatgatgagagaagtttacttgtgggctaagagtaatgattttatacacccactctgttgagcctctagctgtcccgtctttttctcatcgtaactcattacttactttaatattggatacttgtttgttttggtgtgtgaatagggaggaatggtcaaccatcaccgagcttaacatggtcaacgcgtataaagatcgcaaaaggagctgcgcgtgggttagcttatctacacgagtgtagtccaaggaagttggtacatggcgacgttaagccttccaacattcttcttgattcctccttcactccttacatctctgacttcggtctcacacgtctcatcaccatcactgccgcttctgcctcttctaacgaaccttcctcctcctctgctgcgggtggtttcttaggtggagctcttccttacacttccatcaaaccctcagatagatccaacggctataaagcccccgaggcccggctccctggagggaggcctactcagaaatgggacgtatactccttcggtgttgtgcttatggagcttctcaccgggaaatcgccggattcttctccgttaagctcttcctcgacgtctacggtggttgttgaggtgccggatttggtgaagtgggtgaggaaagggtttgaagaggagactccattgtcggacatggttgatccaatgttacttcaagaagttcacgccaagcaacaagtcttgtccgtttttcatctagctctcgcttgtaccgaaggtgaccctgaagtccgtccacgtatgaagaacgtctctgagaacatcgacaaaatctgattcaattattatattcttttttctttaatttttcctattatatttttgtatctccgatagttcttacacgaggtcgttacgtcactcccacgtctgggactagtggtcgatttgtttttattgaataattatttgttatgaaaattgaatcaaatgagttatactttaggctttaaatggctttgtcttttattttgctgtctttttctcatctgttaaaagacaactcctagttaacgggcacttgtcttgtccttcagttgaagatacacatacaagatctaatatcttccaagaaccatccatttgaaatttcgcttttcatagagtttatgcaaatgtggatttgggtttttagatttaaacgggtcacagaatatttaacttggggtaaattttcaaaaaagcataatggataattaaaatttagattggcccattatatttatcaggcccactaattaaatgtttgttgcttttctgctttttgacattttacaccggcaacctttgtcggagaacggttaagtagctgggataactcaggcggcgtcgcggttaggtagagtagaagaaactacaagcaagagagagcgattcactgaaggtaaccacgtcttaaacaaaatgaaccgaactataaccgtttggttagaagatttaaaacggaatgatccggtttgattttttggtttcagattctgcgggtactggcgccaaatcataattcgtggttccggtcaaagtcacggcgaaacagcc

SEQ ID NO: 7855 - DNA, 3000 bp, Unknown
  misc_feature (1)..( 3000): cDNA_ID_1809542_gDNA_ID_1621169_Annot_ID_57221 3000 nt of promoter + ATG
agtgtggtcgtagcacacttgagaaggctatttcattcgtcaatgccaatgataattggaacgctagagttgtatatggtgacactgataggtaaacattaaccaccatctttcatggcactattttaacttcctacaatataaagtatagccagggtttcatgcttgcataagttaatatatattcgtattacttccgagtgtttattatggtcatttcagcagccttgacaagtatgtatcacagtttctttatttacttcttcctcgtggcctcatgcattttaattacttctgtagtatgtttgtcctcctaaaaggacgaactgtaaaagaagcttttgtagtcggacaagagattgcatctgcaataactgaaatgaacccacacccagtcactttaaagatggagaaagtctatcacccttgtttccttcttacgaagaagcgttatgttgggtacagttatgaaagtcccaatcagagagagcctatatttgatgcaaaaggtattgaaactgttcgaagagacacttgtgaagctgttgcgaaaactatggagcaatcgttgagactcttttttgaacagaagaacatctctaaggtacaaatttgatttcttgcactctttcgaattatcagctgaaactgcagtgtcgtacatctgcttttctctattcattgtgcaggttaagtcgtacttgtatagacagtggaagcggatactatcagggagagtgtctcttcaagattttatctttgcaaaagaagttcggttgggtacttacagcacaagagactcttcactccttcctccagcagctattgtggcaaccaaatcaatgaaagcagaccctcggacagagccacgctatgctgaacgagtgccttatgttgtgattcatggggagccaggagctcgacttgttgatatggttgttgatccactggttcttttggacgtcgatacaccctaccgactgaatgacttatactacatcaacaaacaaattataccagctttgcaaagggtatttggactcgtgggtgcagacttaaaccagtggtttttggagatgccccgtctcaccagaagctcccttggtcaacgtcccttaaactctaaaaactcacacaaaacaaggattgattatttttatctatcgaaacattgcatcttgtgtggggaagttgttcaagaatctgctcaactatgcaaccggtgccttcaaaataaaagtgctgctgctgcaaccattgtttggaagacttcaaagttggagagagagatgcaacacctagccacggtaagtactccaaaatctaacgtttatgaactgttacagaacttggtaacgtttacaaccatcatcttactgtctttactttccaagagatcgtgtgcttcatagaaacttgtacactttctgatgtgagcatttgcatttaatcttgcacacactttgaattcaaagagacagtttcatctcatggtagtcgcaaaacaatttatgctaaaaagtggagacttattagtttcagattatctttcagaaatgtttgctattttataacaagaacgagtgtagacctctttccatgtgtgcttaagttgtgaccttggtgaatctctgtagatgcattcagttccaactttgttggtccattaattgatttttctttatattatcttatttgcagatatgcagacactgtggtgggggagactgggtggtgcaaagcggagtgaaatgcaattcccttgcgtgctcagtcttttacgagagacggaaagttcagaaagagcttcgtggcctctcctccattgctactgagagtgagctttaccctaaatgcatggctgagtggttctaaccttgacgaaaactcaaaaaaaaaaaaaaaaaaccagtaatctaactctatcccatacgtatttccactcaaactaatctaaaccatcctatcctgttaagtaacgatgtgaatttttgtatttgcaggattttgagcgaactagtaggtttatatggttgtgatcaaagagcatttttttcaaggacgtgtgaatatgtgtatagatagtagtagcacccacgagtacagtactgtcactcatcattctgttcaactcctttgtgttgtgttgtgtataagcaatcttggaaaaaataattataattttgtatagcataccaagttcacgagaaagatagatagatagataaagaaacaaaaacaacataacaaaaaaaattaacagaagaaacaaaaacgcctacgagtcttttgggtggtggtgagatggtgcaatgcttcaatctctctctttttaagactttcgagcacaaccaactgtttcacacaaaatgggtgataatcccttcaatgtaggcaaaacttatagaatgcttaagaaaactgaataaggaaaaaacctcacctcttcaatagcacgctcccgcaaaatcgtaaagtgcatagccctgtgtttggatataatcttcgtatccatatatgataaagcaactacatggaaactggcagagttatatcaaacatataaatggtcatggatatgagtgtacaaaaagtaaaacagatttggtcatacacaatttgaatttcttcccgtaataaacatattcttaggctctatatatatatattgtatcaatgttattgagatcaataacacataataaagagttttcccccaaacccttctctagttagtagtttctataattttggcaaatagtattcaagtgctcttgcattctcaagtgattaattcaattcctaggtttcggtttcggtttcggtttggttcggttcgtctcggttattttaggaaaagaaaacaaaattagagagcaaacacgattggtcaaagtcaactcttctctaccttcctcacttcccagcttcactgatcatcgccaatcacaaaaccaactacacacattcatcatcatttcgattatattttacccgacc

SEQ ID NO: 7856 - DNA, 3000 bp, Unknown
  misc_feature (1)..( 3000): cDNA_ID_1809538_gDNA_ID_1621169_Annot_ID_57222 3000 nt of promoter + ATG
gtgtcaaactaaaaaatagttgtattacctttattcaagatttccaaaacatccgaacgaaaaacaaaaagattttatccaaagcctgaggtgactcacggccatgtaacatatgtggtttactctaattaacaaatggatcaaatggggttttatacgttaaaggctaatcaaaattaaaatatgaaccgtcaaaaatggctagctaccacataacttgtcaacatcgcgcggacaaatgattattacaaagaaaacgatttttaaaaagtgaaacgatcgctttcaggtcgccgcttttagattcagaatttcataaataagtaggctatagattaaataagagattaacaagccttctttttcattatggtgggtggtttaagtcaaacttcacgaaatgtttgctttgtcttacttttcattaataattggatgactttatcctttttctaagttttaacactaaagaatgtgtatatttggattgaagttccagatttcttaaagtcattcggaatcaaagatgtactttggaaaactttgttttttttttttaataccaacgaagcctgtaatgatttaccattttggtcttttagagagtttcggaaaaactagaaggatacttttttttcctgagatgttcatgatgcttaacatttaaataaaatcaaaatcttttgaaagtgttactttctatgatttgattaatgtcaccaatttttttttgtaaattaagaatcaataacaccctcttagtattattatcatggctttggatttcattccagttttagtttttttgggtatgtttagcttccttttttccaaactaaatttctaaaaaatatgttttttcggatttttttttgattatttgtttaaccgtcggttatgtttttcagtatagcttacgataacaatatcccacatcggaaattaggaaaagatcatgatagtatataagatatatgtcatcatttactcattgccaagtggttttgtttgaatgagataatatatctcattcattcattgtcaattagttttaagttaaaaaacttatattttaatatagtatcaaaatgcttgatccatacattttccagctcggttcgtattcgatatgatccgaatttggtctattgatccttgcttaatatatcgagagcagtggctaaaaaatcatcatctctacaaagcgtattatcatcgtcatcttgccacactgttagcaatatatattcatcctctcattttcacatccatttgataaagataatttgaattatttatatgccccctacatagcgaggattacaaagaaggaataaaactgaaagtgaaaaatgggatgcgactttaatagagtttcatggtcaccactacccataccagttggtccacgtcagacgtatacaaaggcatacgatacgattgcttgtgctttcagattgagacaccaaagatcaccgattcaccatcatctgatctgatgatatgcttttttcccatcttctgagtctttctttttttcttctaaatttcacaatatacatatattaatttcaataccattaccatcaataattttatagctacaactaaataacctacaatatacagaaaatataaaaaccatttctaattttaaaatgggttttgtgtaaaaaagactttaattattgcaactttatttacatcttaaaaaaatatagattaatcatacaaaatcaacaataatatataatataattttttttgctaccgtcaaatttataaaatttgaacaaataatatgtcaaattgaagtcctcacgattaagaatacaaatttagttttagaattttaaaattttaatgtatgtaattgtgaaattgtaggattaatctaccaaaaataattatatatataaaaaatatgatcaaaaatggtaaactttaacaaaaaaaataaaaaatgacaaatctggacaaaaattagtttatgcagtatataatattatttttgtagcaaaaacatgtctttgttttcttggttgtctcgatcaaaaacatgtcttgagagcatatatgaatactaatatagtattaaactataggatgatggggtcattgacgtggtgactagttgacattattatcaccgtaagatctgattgtgctatataatccctaatctgacgctccatttatttattcctccattaccattattagatctctctgtctctttctttctgtcaaaaatattatcttctttgcaccaacttcaacgcattacgaagcagaagacagaacccaaaaaccgacaaagttcccctattctctcggtataacctcatctttatcttctttctccgccattttctcttttctttgtataaatgtctttacccattttggattagattttccccctccaagtaaatgaatcatctgcttcttcaggtctccattgattctcctactctgttttcctcctatatttgtatttgatgttttgtttttttctttggaaccaaacaagtcataaagtttcgatctttgagatcttgcccaattcttggaactagtgtttggttttcttgataatatttctgtgagagaattcttcaattttcagattttcttgataatgttttgctcttttaggaaataatttatagccattcagatttattctcttgtttctttgtggtatatggtgcttgtaattttgcaaaatttggagcaccctatctttttgtttgatgttgatcttattggttcttgacttctttcaaagagttgacttatctgtaaaaaaatattttgcagaaaattcattacttctaaagatggatgttgtaggtggctgatgactcttcttccctagcatgacctttattggtaacatcttctttactcaaaaaagaaacattccttttggaagaatcttgttgttgttgttgttgactaatcttttttatcatgttcttggcagatacagagatg

SEQ ID NO: 7857 - DNA, 3000 bp, Unknown
  misc_feature (1)..( 3000): cDNA_ID_1807798_gDNA_ID_1621169_Annot_ID_57227 3000 nt of promoter + ATG
tacctgttttcggaatgataagcactcctatgttgaatcgaccatattttccccaaatacgggttccaaaccacgagcctagtgttgctgacctccttactcatcattaacaataagccatcgcaatgaaagacttgagatatctcaacatgattaaacttagctatttgctttatagatggctcaactacttcgacgttgttattttggattccatgaagatcaaatctcattgaacaaaccttagatccctttatcatgaaaccagcaaactgttgtctagcttctgctttacatatgacccgagctttagataaatcgttccatctcaatgctcctagagatattattgaaaccctagacagtatctcttctaccatatcctccggaagatcggatatcatcatcgtcgtcttcaaatgaaaatcagggttttttgacctatcatgtatttcctacagtttttcgatttgattatatatatgcgcataactttgggcccataactctaattttcttcttgcttcccgtttgtgtataacacaccttatatgccctcatatttcataaggaacattttgtagaagattattacaagattcacgaagagaaagaataaagacacaagacaaaacaaaaagatgcacctctctaaaacatctataaaacgctctatataatgtttatgtgtttgcgactgtgataaccacatctggcacatgcacatctcctagaagatctctactctaaaactcgacatacctctcccggtcatggtctcgtgcactgtctcggccacaatccatatggaattgcattgagaaagaaacccaagacataagtccaagtaaattgtttgaagctttgatcccaaattattttcacaattattacaaaaatttaacaattacaatcattctatagtactagaaatcttatttttagtccacgggagcaagttgcagtttgtcgcttctccttatgaacttattgcgaattttcttttctttttttaccctggaactttgctctaattcattgttcgataatagtaataattctcaacatcacaactacaaggggaaagcccggtacaagaaactcagtaagatttgttgatccataataattggtagtcttcaatcatatgatataaatgtatttataaaaaaccataaatgaccaatctttttcaaatgaaaacagaagaaatgaacgagaagaagatgatgaaagaaacaaataacgtactgtaaacaagactggctaataatctcgatcttttcttttcctcgataaccgagagttcttggccttgggtgattttcactaaactaggagcataagagactggtaggttagatggtatgaaagttactccgaaatccaatattctcaagtatccattatctccaatgacgtaagctatgttgcacctcatttgtttagataagcttctaccaaacactacggctaatttcttctcttggtcaatgaagaaactcgtaactaaaaacttaattctaaaatgagtaaatgttaagaagttgctccatgacacagcattgggttcaatcttagttgtcacccatatctccatctcagattcttcccaattattaaataacaccacaagatgttcctctctaacagaagatagagctacattatcatcaaacttagcaatttgaaatgggagaggaagacacgacacaaatctctctcttgtaaaatcaaaagaaagtaagcaaccagctagtccttcccctattttctcacctcgatagaaaaaataagtatttccctttattgacatgtcacgtacataaatatttgtatgcaagtcgggaatgatatcaagaaccttccatgaatcagatttaaaatcgtagatttcacaatttttcctattatacatcaagattttgtggttacggttgttgtcgtatccgagagcatacctatatttgaaatgctcagtatctctgcattggatcaacctggtttgtcccaaatacggattccaaaccacgatcttggaatctacctcatcagttaccaataacaacaagccatcgctgtaataaacttgaaataactcaagttcaataaatttatttatcttatttatagagagctcaactagttcaacgtcttcattttggatttcattaagatcaagtctcattgaacaaaccgtagattcgttcacatatctcgtgaaccctgtaaactgttgatttgcatctcctttacatacaatacgatctttggataaaccgttccatcgtttgcaagtagatctcactgctcctagagatgttatcggaaccctagacaaaatctcttctaccaaatcattcggaagatcagacatcatcatcgtcattttttcaaatgaaaaattagggttgaactatcacgtcttttccacacttttaagatttattctgagattgttcacagcataatatggattaatcttctaggaagccttatattgtgtaacagattaattgtacagatgcctttcatttgcagacttattaaagatgaaatgattaataagagcagatttgttctttttaatcatcagtcatcatcaatgtcaatattaataagccatcaaatcaatgaaagacttggaaaaatatctcaaacttacttacaccttcccacacacatttacggtcgattatatatgcaatagatgggccctaattttgggcccataacacttatcacaaaaggcccatcactttaaatcttcttcataattcactgctctcttcctcactacacagttttctattcttctagaatttgcttatgcagacattttcaatttcactcctccgtcactcttctccgttcctccgtcacaccgcgatttttcacggcggagttggagttagattcaaattccttcgcagcttttctcctctctcagcaagacgagataatcccgatgtctccagaaaaccccaaccgagcaaaaat

SEQ ID NO: 7858 - DNA, 3000 bp, Unknown
  misc_feature (1)..( 3000): cDNA_ID_1809519_gDNA_ID_1621169_Annot_ID_57229 3000 nt of promoter + ATG
gatgttttgtgtagtagctacacttttctcaaagtgaacatcagagttaccagctaataacttctccaacctcagacgaattttaccttcatctttcctaactgtattcccacgaaagtaaagaagcgttgtacgagcctcaaaaggatctcccataccatcatcgccctcctcattcaaagactcaacaacatgtacataaggagaaactacgtctttacttaaacgtgccatgtctttagaataacgcccaaaatccacaacaatgagaatcgacgcattcacttgttgccttagaaatctgaaagcattaggatgtgtcatcggaatcacatgatctttacctcctgaacgattccaatacttcgaattctcaagaaactccattaactcaacctgatcacacaacatgaaacaataatggtggcgattcataaagattcaaaattggcaacaaagtcaacgaatttgacattacccatcatcccaaatcaccggaatttcaaaaatttcgattaaaatttgacaatagttagggtttatagttcataattcgatcgccagacgctgcaatggtggcgattcataaagattcaaactttgcaaaaaaagtcaacgaatttgccattacccatcacccaaaatcaccggaatttcaaaaatttccgatcaaaattatacctgtaatagccgatcaaattcagtatctggatcagtcatgttcttcccatgagtattaaaactcaacgaagagaaaaaaggaacataaaacacatccgccaaatccggatcaaaaaccctaattgcttcattctcatcctcaccaccgttaagaagagaagccataagccaatactcaacgctatgttgtcttttaatcccagaagtctgaggccaagaaggtaaattcttccctgtgataggctcaacatctgagctatgaggatccatcatcgcgatattaaactttcgtgggagatcgtacatgaagacacggagaggttttccagaggagctacaaggagaagaagctccattgggttgggattggaggaggtagaagtaaggtcttggatcgacggttcccatgtagattgagaatgaagcaacgaggaagatgaagaagacgattgtacatattgttttgccgtacatttcttcttcgagagagatgatacagagaagaagaagaagaaagtgagagatttagatccaacggtctctgttttgggttttttcgttgcttggtgattgtaatgagttttgatgaaatgaaacgtattgagtcattagacatttaatgatttatgatttaagaaagattctttcagttacaaacaaatttactgtagttgttttttctttttcttttacacacaacataggtgttgtaattcaagaaattgcacattcactttagaagttttaaaagattaggtaattgcacattacaatcaatatttttttgtaaaatgatcactatactataatagaagctaaggatgttgaacacacaaaggattcaaaaagtaaatgtttggttttccggttcgatgttgaaagactgagttatagaggtaatggttcgaattaccatttttgcaactcttgttcatcttatttgattgtggtcaattggaaaaaacgtttacgggtttcttttggttttcagttttgttaccaacaatttgatcattgagacattgacaatccgattttgttcacatgtttgaaaataacgagcgaatgggccgaaccctgctgactcagacttggtcaaagtttttctaagcaaatttcattcttgggccgagtctagggataaagctcatatctagcatttatgtataaccaaaacacataggtgcatatagactagacgagtgacagtccaggatacatacatatagatatcctgataatgatatccatccttgctttgtgaggatcggacaactatgaagaatggactaaaattgtgcttgcctcaaagaagaaatttggtttcctcgacgaccaacttgtaaaaccagaggaaaactctccccagctatgatgattgaaaatccattaattaatactctcttgatatcttggatcaagataactattggtccgagacttggctaatatctcacacaaatagttggtacgtgatgtgtgggaacatatcatcacgtaaagaaaggaaacgtagtttgctttatttaacatacatagacatagttatgttcacgacactttaatgtctacatgtttttttgcgtgttggattacatcccaaaacaaaaaaaaaacatttgtgtcaaatgtttttaattaaaacaacgtgtcatttccttttaaccaaattttcttccctagatatataccccaatacatggtagtagatcttttttttggttttttttttggttcaaaggtagtaaactaattaagccttgattttattcctcttattcttcttagactcgtatttagttcacgagttacgtacaaagtttgtttttttgtctaagcaagcggaaatattttgtaagattataccatctacttttgctgcatcgtatttaaaagtcagaaaaacaacaatgtcactttgataatgacatctgtccatagacatgcaaaattgattcaaatttatgaaatcacctttaaattgtctaagatattcaaattaaatgacttcaaactttaaatcaaaattttaccaaatctacacttcagaacaaaatgaatctgaataaaattagatttagggaaacgtaaagacttcattatggaataaatcgtgaggacttttaagtcattttgcatctcactctcacgccgtaacagtctctctctatgacacaaagcgacggtgttcccgttctgttccgttccgttaagtttcggacttatattacagaactgaacaatcgttgtcttcaagtacgagatttgtctgatttttccaaagcgccgattcgaagatttgaatccatttcagtgatg

SEQ ID NO: 7859 - DNA, 3000 bp, Unknown
  misc_feature (1)..( 3000): cDNA_ID_1807798_gDNA_ID_1621169_Annot_ID_173923 3000 nt of promoter + ATG
aagataagtaattccctttattgaatgatatgcaacctttacgaaaattgttacccgagtggggaatgatattaagaaccctccacgaatgagatttaaaatcgtagatttcgtaatttataaaatacctcaagattttgtggtttacggttgttatcatatccgagagtatacctgttttcggaatgataagcactcctatgttgaatcgaccatattttccccaaatacgggttccaaaccacgagcctagtgttgctgacctccttactcatcattaacaataagccatcgcaatgaaagacttgagatatctcaacatgattaaacttagctatttgctttatagatggctcaactacttcgacgttgttattttggattccatgaagatcaaatctcattgaacaaaccttagatccctttatcatgaaaccagcaaactgttgtctagcttctgctttacatatgacccgagctttagataaatcgttccatctcaatgctcctagagatattattgaaaccctagacagtatctcttctaccatatcctccggaagatcggatatcatcatcgtcgtcttcaaatgaaaatcagggttttttgacctatcatgtatttcctacagtttttcgatttgattatatatatgcgcataactttgggcccataactctaattttcttcttgcttcccgtttgtgtataacacaccttatatgccctcatatttcataaggaacattttgtagaagattattacaagattcacgaagagaaagaataaagacacaagacaaaacaaaaagatgcacctctctaaaacatctataaaacgctctatataatgtttatgtgtttgcgactgtgataaccacatctggcacatgcacatctcctagaagatctctactctaaaactcgacatacctctcccggtcatggtctcgtgcactgtctcggccacaatccatatggaattgcattgagaaagaaacccaagacataagtccaagtaaattgtttgaagctttgatcccaaattattttcacaattattacaaaaatttaacaattacaatcattctatagtactagaaatcttatttttagtccacgggagcaagttgcagtttgtcgcttctccttatgaacttattgcgaattttcttttctttttttaccctggaactttgctctaattcattgttcgataatagtaataattctcaacatcacaactacaaggggaaagcccggtacaagaaactcagtaagatttgttgatccataataattggtagtcttcaatcatatgatataaatgtatttataaaaaaccataaatgaccaatctttttcaaatgaaaacagaagaaatgaacgagaagaagatgatgaaagaaacaaataacgtactgtaaacaagactggctaataatctcgatcttttcttttcctcgataaccgagagttcttggccttgggtgattttcactaaactaggagcataagagactggtaggttagatggtatgaaagttactccgaaatccaatattctcaagtatccattatctccaatgacgtaagctatgttgcacctcatttgtttagataagcttctaccaaacactacggctaatttcttctcttggtcaatgaagaaactcgtaactaaaaacttaattctaaaatgagtaaatgttaagaagttgctccatgacacagcattgggttcaatcttagttgtcacccatatctccatctcagattcttcccaattattaaataacaccacaagatgttcctctctaacagaagatagagctacattatcatcaaacttagcaatttgaaatgggagaggaagacacgacacaaatctctctcttgtaaaatcaaaagaaagtaagcaaccagctagtccttcccctattttctcacctcgatagaaaaaataagtatttccctttattgacatgtcacgtacataaatatttgtatgcaagtcgggaatgatatcaagaaccttccatgaatcagatttaaaatcgtagatttcacaatttttcctattatacatcaagattttgtggttacggttgttgtcgtatccgagagcatacctatatttgaaatgctcagtatctctgcattggatcaacctggtttgtcccaaatacggattccaaaccacgatcttggaatctacctcatcagttaccaataacaacaagccatcgctgtaataaacttgaaataactcaagttcaataaatttatttatcttatttatagagagctcaactagttcaacgtcttcattttggatttcattaagatcaagtctcattgaacaaaccgtagattcgttcacatatctcgtgaaccctgtaaactgttgatttgcatctcctttacatacaatacgatctttggataaaccgttccatcgtttgcaagtagatctcactgctcctagagatgttatcggaaccctagacaaaatctcttctaccaaatcattcggaagatcagacatcatcatcgtcattttttcaaatgaaaaattagggttgaactatcacgtcttttccacacttttaagatttattctgagattgttcacagcataatatggattaatcttctaggaagccttatattgtgtaacagattaattgtacagatgcctttcatttgcagacttattaaagatgaaatgattaataagagcagatttgttctttttaatcatcagtcatcatcaatgtcaatattaataagccatcaaatcaatgaaagacttggaaaaatatctcaaacttacttacaccttcccacacacatttacggtcgattatatatgcaatagatgggccctaattttgggcccataacacttatcacaaaaggcccatcactttaaatcttcttcataattcactgctctcttcctcactacacagttttctattcttctagaatttgctt

SEQ ID NO: 7860 - DNA, 3000 bp, Unknown
  misc_feature (1)..( 3000): cDNA_ID_3436222_gDNA_ID_1621169_Annot_ID_173918 3000 nt of promoter + ATG
aggtcgccgcttttagattcagaatttcataaataagtaggctatagattaaataagagattaacaagccttctttttcattatggtgggtggtttaagtcaaacttcacgaaatgtttgctttgtcttacttttcattaataattggatgactttatcctttttctaagttttaacactaaagaatgtgtatatttggattgaagttccagatttcttaaagtcattcggaatcaaagatgtactttggaaaactttgttttttttttttaataccaacgaagcctgtaatgatttaccattttggtcttttagagagtttcggaaaaactagaaggatacttttttttcctgagatgttcatgatgcttaacatttaaataaaatcaaaatcttttgaaagtgttactttctatgatttgattaatgtcaccaatttttttttgtaaattaagaatcaataacaccctcttagtattattatcatggctttggatttcattccagttttagtttttttgggtatgtttagcttccttttttccaaactaaatttctaaaaaatatgttttttcggatttttttttgattatttgtttaaccgtcggttatgtttttcagtatagcttacgataacaatatcccacatcggaaattaggaaaagatcatgatagtatataagatatatgtcatcatttactcattgccaagtggttttgtttgaatgagataatatatctcattcattcattgtcaattagttttaagttaaaaaacttatattttaatatagtatcaaaatgcttgatccatacattttccagctcggttcgtattcgatatgatccgaatttggtctattgatccttgcttaatatatcgagagcagtggctaaaaaatcatcatctctacaaagcgtattatcatcgtcatcttgccacactgttagcaatatatattcatcctctcattttcacatccatttgataaagataatttgaattatttatatgccccctacatagcgaggattacaaagaaggaataaaactgaaagtgaaaaatgggatgcgactttaatagagtttcatggtcaccactacccataccagttggtccacgtcagacgtatacaaaggcatacgatacgattgcttgtgctttcagattgagacaccaaagatcaccgattcaccatcatctgatctgatgatatgcttttttcccatcttctgagtctttctttttttcttctaaatttcacaatatacatatattaatttcaataccattaccatcaataattttatagctacaactaaataacctacaatatacagaaaatataaaaaccatttctaattttaaaatgggttttgtgtaaaaaagactttaattattgcaactttatttacatcttaaaaaaatatagattaatcatacaaaatcaacaataatatataatataattttttttgctaccgtcaaatttataaaatttgaacaaataatatgtcaaattgaagtcctcacgattaagaatacaaatttagttttagaattttaaaattttaatgtatgtaattgtgaaattgtaggattaatctaccaaaaataattatatatataaaaaatatgatcaaaaatggtaaactttaacaaaaaaaataaaaaatgacaaatctggacaaaaattagtttatgcagtatataatattatttttgtagcaaaaacatgtctttgttttcttggttgtctcgatcaaaaacatgtcttgagagcatatatgaatactaatatagtattaaactataggatgatggggtcattgacgtggtgactagttgacattattatcaccgtaagatctgattgtgctatataatccctaatctgacgctccatttatttattcctccattaccattattagatctctctgtctctttctttctgtcaaaaatattatcttctttgcaccaacttcaacgcattacgaagcagaagacagaacccaaaaaccgacaaagttcccctattctctcggtataacctcatctttatcttctttctccgccattttctcttttctttgtataaatgtctttacccattttggattagattttccccctccaagtaaatgaatcatctgcttcttcaggtctccattgattctcctactctgttttcctcctatatttgtatttgatgttttgtttttttctttggaaccaaacaagtcataaagtttcgatctttgagatcttgcccaattcttggaactagtgtttggttttcttgataatatttctgtgagagaattcttcaattttcagattttcttgataatgttttgctcttttaggaaataatttatagccattcagatttattctcttgtttctttgtggtatatggtgcttgtaattttgcaaaatttggagcaccctatctttttgtttgatgttgatcttattggttcttgacttctttcaaagagttgacttatctgtaaaaaaatattttgcagaaaattcattacttctaaagatggatgttgtaggtggctgatgactcttcttccctagcatgacctttattggtaacatcttctttactcaaaaaagaaacattccttttggaagaatcttgttgttgttgttgttgactaatcttttttatcatgttcttggcagatacagagatgtgtatgagaagaaacaacatcaatttaacaacagtcatagattctaacgaagccattggtatggaacatgaattagattctgctagacatcaatattcttcagtgctcactgcaattccattcttctccgctacattgtttattcctctctctttgaaaatcactatacgtgacgggtttcacgaaagtctttaataacatttccatacacaaaacacaaatagtttagagatttgttcttagggagatttagctatctctctgttcaaaagattggtctaaagatg

SEQ ID NO: 7861 - DNA, 3000 bp, Unknown; identical to SEQ ID NO: 7853
  misc_feature (1)..( 3000): cDNA_ID_1809550_gDNA_ID_1621169_Annot_ID_173914 3000 nt of promoter + ATG

SEQ ID NO: 7862 - DNA, 1278 bp, Unknown
  misc_feature (1)..( 1278): cDNA_ID_2135794_gDNA_ID_1621169_Annot_ID_173911 3000 nt of promoter + ATG
aagcttttttggaagagtttagagtttatggttaacctttttttttaagagattagtgcgttatagttgcaaatagtgcgtttttttccatcagaaaagttagtggaaacatgaacaaattgtcagttaaattatgttatcccacttgaatatttttgcattttgcttttaatttctaacggtccaccaaatcaccaaatggagtattttaattattcttgaattaaaaactcactcaaagatttgcttcttcccatccacccaggcggattgaagtttttagcgtctttttaattatcattttgtatttataatttattagatttttaaatttataatttgaaaattattatcatttatttattttatatcagacttaaatataaaaatattgtttttgagttgttatatttgttacctaaattcttgccaaaaaaaaagaaaaagagagaaaatcttctagcttcgaaaacatctaatactgtaatagtaaaatcattaaaacttttaaattggtttatcaaaactatgtcgtatattcttctccttctccacggaacccacacatagtagagaaacaatatgagcagtttatcacactcttgagttaccaattttctctcatttctcattattccttcactttctttcgaggtacttcatacatagtcgtctttctcaagttgttgtggattgtagagaagacctaataagctagagaatggattcgaggaagtctttatcttccatcgatagcttcaacgattgttacgtttgcttgtaacccaagattcgaaggtcaacaattccacggatgatataccttacttgagtctttatttctaaccagttatatgttacaagctaagtctgattcttgtattcttttctaccattgaaaccaataaaatggtctccttaccaagtaaaacagggttattattatgtactctaacaacattttccgttcaatcaatacaagaagcttttggatttcttatttcttttttttttttgggtttttttctttcaacaaaatgattataaattatttatttttctttaccaataagatttggggttttatgaaccatgatgaaatacttttttgtctttttatgaagaaatgatataactctgtttctcctctcttggtagcaattggctttttatttctcaggtaagtagtctcccccttttaaatccttattgggtgttgtattctcccaacaggcgtgagatgttcgttaaaaacaaaaacaattgctcaagagcatg

SEQ ID NO: 7863 - DNA, 3000 bp, Unknown
  misc_feature (1)..( 3000): cDNA_ID_3593506_gDNA_ID_1621169_Annot_ID_57230 3000 nt of promoter + ATG
agaagatgaatgttcattaaacaatattccatacgaaagagtactaagcagcataactgtattaccagcataaaaagctcttcagcaccattgaagagaaaaattacaggttgaggcgggacccaaccagaatccactaccagtcttgctaattcaagtagtgatgctgcaaaacggaaacacataaatccatgatttaatggtttagaaggtaaatctaaagatatagtaccaaactcacctacacatgacccacaatcaccagctccaggagagttaacaggactgtcataatgtgcattcatcaatacagatgcatcagtgtcaagagaattcattgacgagatactgcaaaaaaaaaaaaaaaacgatgaaaatgtttagcattaataattggggacacaatcattcaatgttgcagtctattgatgactgaataaaataacacaaagaatggtcaaccccaacgtgaatcataaatacaaacaacaaagtctcctgaacaacacgtaaaaaccataaatctcaatgtaccagtaaaggaacaaactttagtaccgcataagtatattagtatggtttctgtatccaagtgatatgctgtgtcctagaaacatcatgctaaaggaaccatccacttgagtctcttccacttcaaccctataacagcaacaaaaagcattcatttttcagctcagacacaaaaagttcacaagaaaaaaacattcttttcttggagagtgatgaaatctcaagcatttaagttattcaaaaaaaccttaaatttggtccagctctctccttcaccatctccaattgcgattttatatacgttgcagcttctttaagtccaggtcgtccttcctacaaaacccatgtcgtaaaaacaagatcagagagagacagagaaaagagagagatgaaacggcggcgaatcatcacctgacgaccatcgatctcttcagccaagacacggatgtgttcgacggctctagcttcagagaatcgttcgagaggagcgtttgccggaagcggagagatgaatttcatgtggaggacggagtaaacaatagctgacattaaagcgtagatgaagacgagtgagaagaggaatttgaatccagtgacatctcttgcgctcatcttccaaaacggcatcactgaaatggattcaaatcttcgaatcggcgctttggaaaaatcagacaaatctcgtacttgaagacaacgattgttcagttctgtaatataagtccgaaacttaacggaacggaacagaacgggaacaccgtcgctttgtgtcatagagagagactgttacggcgtgagagtgagatgcaaaatgacttaaaagtcctcacgatttattccataatgaagtctttacgtttccctaaatctaattttattcagattcattttgttctgaagtgtagatttggtaaaattttgatttaaagtttgaagtcatttaatttgaatatcttagacaatttaaaggtgatttcataaatttgaatcaattttgcatgtctatggacagatgtcattatcaaagtgacattgttgtttttctgacttttaaatacgatgcagcaaaagtagatggtataatcttacaaaatatttccgcttgcttagacaaaaaaacaaactttgtacgtaactcgtgaactaaatacgagtctaagaagaataagaggaataaaatcaaggcttaattagtttactacctttgaaccaaaaaaaaaaccaaaaaaaagatctactaccatgtattggggtatatatctagggaagaaaatttggttaaaaggaaatgacacgttgttttaattaaaaacatttgacacaaatgttttttttttgttttgggatgtaatccaacacgcaaaaaaacatgtagacattaaagtgtcgtgaacataactatgtctatgtatgttaaataaagcaaactacgtttcctttctttacgtgatgatatgttcccacacatcacgtaccaactatttgtgtgagatattagccaagtctcggaccaatagttatcttgatccaagatatcaagagagtattaattaatggattttcaatcatcatagctggggagagttttcctctggttttacaagttggtcgtcgaggaaaccaaatttcttctttgaggcaagcacaattttagtccattcttcatagttgtccgatcctcacaaagcaaggatggatatcattatcaggatatctatatgtatgtatcctggactgtcactcgtctagtctatatgcacctatgtgttttggttatacataaatgctagatatgagctttatccctagactcggcccaagaatgaaatttgcttagaaaaactttgaccaagtctgagtcagcagggttcggcccattcgctcgttattttcaaacatgtgaacaaaatcggattgtcaatgtctcaatgatcaaattgttggtaacaaaactgaaaaccaaaagaaacccgtaaacgttttttccaattgaccacaatcaaataagatgaacaagagttgcaaaaatggtaattcgaaccattacctctataactcagtctttcaacatcgaaccggaaaaccaaacatttactttttgaatcctttgtgtgttcaacatccttagcttctattatagtatagtgatcattttacaaaaaaatattgattgtaatgtgcaattacctaatcttttaaaacttctaaagtgaatgtgcaatttcttgaattacaacacctatgttgtgtgtaaaagaaaaagaaaaaacaactacagtaaatttgtttgtaactgaaagaatctttcttaaatcataaatcattaaatgtctaatgactcaatacgtttcatttcatcaaaactcattacaatcaccaagcaacgaaaaaacccaaaacagagaccgttggatctaaatctctcactttcttcttcttcttctctgtatcatctctctcgaagaagaa

SEQ ID NO: 7864 - DNA, 3000 bp, Unknown
  misc_feature (1)..( 3000): cDNA_ID_1809605_gDNA_ID_1621170_Annot_ID_57235 3000 nt of promoter + ATG
tcctaacgataagggtttatctaggaaacatatcgttgaaggcactaaagcttctctcaaacgacttgatatggattacgttgatgtgctctattgccacaggtgaccaatttcagatttgtttttttatttagtgattttattttttttcacttggttctttgaagatctagggttttgatatgatctgatttgagtgtaaggtttatctgaatatttctggtgtactatgttgtctgcgcatttaattttcttacatgtgcttgcctttagtacaaattgctgtttttgaatttataaaatttacaatttgaatccacttatgatgtagcttagtgctgtatagtgtggatctatttggtttccacttttatttcatatctgataattgggatctgcattttgccatacattgcacaagatattttggaaaagtggcatctttgcattgatctaagtgtcactagattctttgattgacatatgtttattaaaaatgtttcctttttttgtgtgaattgggtcatttattacaggccggatgcttcaactcctatcgaagagactgtgagggcgatgaactacgtgattgataagggttgggccttctattggggaaccagtgaatggtcagctcaacaaattacggaggcatggggagctgctgaccggttggatttggttggtccaattgtcgaacagccagaatacaacatgttcgctaggcacaaagtttgtaatctgactctctttttctttaatttactttcatgtttgcgtcttatcttgtacagtcttaagttgttgtagtctcgtgttatgtagctcaagttatgctcttctgttatgtaggttgagacagagtttcttcctctgtacaccaaccatggtataggtctcactacctggagcccacttgcatctggtgtgctcactggtaaatacaacaagggagctattccctcagacagccgatttgcattggagaactacaaagtattccttttttttcctttttcttgtgtattcttggtcatatttgctaagacctcaatctgcttctgcatctaactaatacactggtacatgtcttggttttaatttctttcgcagaaccttgccaatagatcacttgtggatgacgtgctgaggaaagttagcggtctcaaacccattgcagatgagctaggtgtaaccttggctcagcttgcaatcgcatggtgtgcttcaaatcctaatgtgtcatctgttatcactggtgccacaagggagtcacaggttagttcttgatcgcttataaagcattaacatagcgagtctcggtctagatttggatccaagatctgaaagattttgtttctttttttgtaccttgacagattcaagaaaatatgaaagctgttgatgtgatcccattgttgacccctattgttctggacaagattgagcaagtgatacagagcaaaccaaaacgtcctgaatcatataggtaaaaccaacatccaagatctctcttccctattcaatcgtttacaaaagagtgttgcaggaaaaagaaaacattagaagaagctctgtgatgtatgttgttggatgttgtctcgttttcgctttgtttgttctctttagcagcttatgcatttttaagactcagacagagagaaagagagactaatgtttttttttagtttttcttgtttcatcatttaaaaaacggtcttatttgttacttgttagtgcaacttaaagtttggttcttgtagtttgccatgtcatgacgtcaatatattgaatagctcatcaaacaattctggttatatcttaatgttgtgaagattttaatttagtgcaagggggttgatatgttattaataaagatttaatggaggtatttaaagctcaacgtgcacaacataatgtctcaactatataccatgtttttaaaaacatacatgcatagacatcctacacaatctttttaggtaagatcccaataaaaatctaaatttggatgatctgttttatttggttaacaaaactaagagatgagtaaagaaaataaaagagtttctggaattggctaaaaaaagaaagaaatagataaaaacgttccctcaaaaacctccacatgcaatttatgaatttactatttgaaaaaaataaaaataagataagacaaaattattaatagattgaagatgatttcacccatgattcaagtgcaacgaataaaatcaaaaataatttcaagaataagaaataaaaagagagaatttcgagagagaaaggtttagtttttattttgtttggagtttgtcacccacccgcgttattttgagagcgcttctctgcgtctctcttctctctctctctctcgcaaatcaaaaacctcaacttttgaaaaacttcaatctctagaaacattcttctcttttacccaaaaatctcatcttttgtttgtttgttattcttctccttcattgttaatctcattggccatttttccctaggtaatcaaattcatctaaagctccaatttttcaattcgattacaccacattcggtgtcatcaatgatctcgttgcttatatatgtatatacaattgatttgtgtgatcaacatttgcagaaaaaattgattttgaaatttgtttctcgttgttgttgttgttgttgttatgcagggtaatttctggtctaattcgtttgaatgagactctggtctttgtttgatttggtatgatcttgtagcaatataccctgaagatgtttgttggaggtttgctgatagacaaaattgcttgtggcttgtgaatctccattacctgttcgctgtatttcctcaaagagcgtaagagaatcctgtattttcctctcaacattttttgttttgaaatttggggagttgaagaacagaaattggttactcagaatctgtgatacaagagattgtgcagaagaaagaataaagcgtttttggttcttgagaacatgagaatg

SEQ ID NO: 7865 - DNA, 3000 bp, Unknown
  misc_feature (1)..( 3000): cDNA_ID_2042340_gDNA_ID_1621170_Annot_ID_57237 3000 nt of promoter + ATG
aagatatgtcgtaaactggaataatggtaacgacgattgatcgtttagctcatttaatattttcgcgtaatcgtccaattcatcaaagaaagacacactcttttactgaacttgtaatttttggctgattaaacaaacactatatggctagactttcccggtttaatggttaatgacaaaaattagtcacagagtcgaataatgggttcttgctgtttttcacttaggagaggtcgtgaggaaaatgagaaaaaaacgatgagtaaaaaagaagtgattgggaccaatttgacccgcgagttttggcgtaaccaaacatttcgcaccaacaagatcttctctttattatagctttttgcacttttacaaaagtaaatttgagcaataaaagtgtaacaaaaaaagtttcaattattactagttacccgccaatccaacctcccccataatgcacacacatggtacacatcatatatgtaatatataggacaatattttcttacgcgtatatatatatatatatatatatatatattcagaaattaactaattactgggaaacataataattaaaaaaatatttaaataatagaagatgataatgaagagtgcattttgacaatagtgtatttaaatctaattatatatgttaagcgaaacctatacaaacttcggagtgatctaaatttttagctaatagatcattcgattttacaaaaaaaaaaaaaaaaaatattattttctatttactatagctttacaacattcttttaattacgacagtgatgtttctccaattgataataatgttccataataatcaaacggaaacgagtatgttaatgtcaccgtagttaaactaagacaaaaggttctgacttctgaaccgtttgatcgtatcatcaattgtagcatgacgttggatcatcattatgtacccaacaaaaacatatataacgttgtactcaatatgatcattcacttcaagtcttcgaaagtaagttagaaattgtcaactatttaacaattttttttaacaaaatccaaccactcttcagaagcttaaaaaggtaaaaacctaccagattattctttcacaaattacagtcgttagattacttttcaaataatattgtgtagaaattctttatagtcacattttgaatgatagtaaccgtctactctaaactattatgtttaatctcaataatccatattttatagttggagtgggttgagacttgggagacggtcaaaacgttacaataatattcttagtttaaagctcgatttggtagaaagtttgactttacatatttgtgtattttttggataggataggtccgataggatttgggatatgatatcatgggttcgtccaagttatagtaatgttgggattgggggtaaattggtaaaactataattaggcaaagcgtgaagaaaaaaaaaattgacattatgatgagaggagttcgggttgttgcatgggaacattatttgtgctcccataaaggtaaataaaaaccaaattataatcatgggatatttaactaagaaaacttgatatcacgaggaaaatcattataagttcagatttaaagccttttcaaatatagcgtacataactatattctatatgtagtcgatgtctcgatgaaatgcttgtttattaaggagacgaatccactagcaatttttatatccaactaatttatttattttagtttctttctcaaaatataaatttcgattgtagtttaattgataagaccaaattcattgagcatgcagtaccctagcaaccaactaatcgtgagaacagtttgaaaattctaattgggatagtcaagtcaacgacctcaacgcgtattctttaagttcttccgttttctttttttctttctaagccgtgattaccgcctcggaaaatcatggagttttcacggaaaataatttttagactatagttatatactctaataaatacaattgcaatacccgctaattcagcaggaaactatgacaactggtttccgtgtacggaatgactctcttgcccgcatcattcttgatgatgtgtcatacactacaaggcaagaaaaaatcaataaataaatcaaagttaatagtagtatagtatatagtataatctgttttgctcagtcatattcactcaccgtaaatgccaaagtgaaagcatcagtttgaagccagttagcttctgtttttttattatgtcatattcaaaatcattcaattattcatatgtcaataattactcggttacagggtgaaattttataatctgattcgtatgaaccaacgactcaaaagtttagctagctagtagctactcaaaaaaaaaaaaaaactacttgttaaaactacaagtttagatttagacatatgttcactagattttgacagctacgcattccttaaaatgtctgatgtttaattagcatgatttactaaaatagacttgtatttattatgttaaaacaaaatacgcagtttttgttcgctgaaaatgttccaaaacaataatattctttaagcgaaaaatagaaattcatataattatattacagttaagggaaacaaaaagaggaagaattcgttggcaacaattgacaaatacctaaagcgtgcgaggtcagtaaatcacacgcttgagcagttagtggcggttagaacggtaaataaaggagacggaattaacaagtaatcacgttaaaaaaagctaaacgaagaatcaaattgtgtaggagacgacgtcgtatagatacataacggccgtctgtcttaacggctctttttggtgtcgtcttcttttatttttattttggtctcccaccagattctataagaggaccaatatatctccaaactcgtacattcactgtctttaactctcactactctctctctctctctcctctgttctaattctctaggaacagagtaaaagactttggctcagcttctgcctctcca

SEQ ID NO: 7866 - DNA, 3000 bp, Unknown
  misc_feature (1)..( 3000): cDNA_ID_1809601_gDNA_ID_1621170_Annot_ID_57239 3000 nt of promoter + ATG
aaatcagatcttttgtttaatatcctaagacgcaaactctaataagaagctttattttctcttattatttataaatgagagtattaaatttgtccggttatgagcatttgtaggtttctttgtggtttgtctttaacaaaacccaaatttctcaaaccctgattgttcgcctatagactcgatcttcgttttttttttgtcttaatcactcaataatatattgtctaaagtacattgtatatcattagttatgaattatgatgatatagctcgacatataaattaataatagaattcaaatgctcgctcgctgactgtagtaccctgatatcactagccaatacaacttacgaaaaaatgaaaaatgaaaaaaattttaaactcgaccaatcaatcgtccatggtatagttgtatcatcagacagcctttactaaggaaaaatgttataaattgggttcgtggccaaatttatgactttcaactgtcaccaaccttacattttgctatataaaccctaagaaactcattataaacttcaacaacataaaagacgatcaatataatctagaaaaaaaaaaagaagagagaagagagaaatgtcgagagctttgtcagtcgtttgtgtcttgctcgccatatccttcgtctgtgcacgtgctcgtcaggtgccgggagagtctgatgagggaaagacgacgggacatgacgatacaacaacaatgcccatgcatgcaaaagcagctgatcagttaccaccaaagagcgtcggcgacaaaaaatgcatcggaggagttgctggagtcggtggattcgccggagttggtggtgttgccggcgtgggaggtctagggatgccactcatcggtggtcttggcgggatcggtaagtatggtggcataggcggtgcagctggaatcggtggatttcatagtataggcggtgttggcggtctaggcggtgtcggaggaggtgttggcggtctaggcggtgttggagggggtgttggtggtctaggtggcgttggcggtctaggtggagctggtttaggcggtgtaggtggtgttggcggtggtattggtaaagccggtggtattggcggtttaggtggtctaggcggagccggaggtggtttaggtggagttggtggtctcggtaaggctggtggtattggtgttggtggtggtatcggtggtggacacggcgtggtcggtggtgtgatcgatccacatccttaatagagagtatttgttggttagggttttaattaaggaataattaattagtttcgatgttattgttggtcttttaattctgtgatcattagggtgacttttgatctattttctagtttgggcttttgtaacgtttgctttgatttcggccgtggtgttatgaaatgtgcgactctctatgtttgaatcgttttggtttaggaggttctcttcttccatacttttgcatgttcaaagacaaatttttaattaagaggaattatcaaggtttccgacgagatattttttgaaaatgaaattggtttgaacttgtaatgatatttaaaatatgaaaacatcactcaaaaatggatggagtacaaactttttccactatatatacattacatgtaaaaagtgtatagatttcgtttttgttgcactgtctaactctaaataagtcggatatcaaagttagtatatagtaaaaaaaaaaaaaagttagtatatatatccaagtggtaaaacccgtaaaattaacatatatatatatatatatatatatatatatatgagtttggtcaagggttttgaaagatctcgactaagagaagacatatgagttttggttcaaaaagtccttcgataatcattagaaacgaattaatatatagtaaaattgagtaaaaatgttaatctattaaccaaaggttaactatatagaagattaatatattataaaactaaccaaaacattggatattggtatatccggattattttcctcgttgatgatcgcaatattgcattcagccatctactacacacttcctcgttgatgatcacaataatgcattcagccatctactacacactgacacatatgattcgtaatttcgtatgaaatgtttgaactcatacttttaatttacatatttaagatggacgtaacaatgaacatttgttcagaacttgagattgtactacccctataaataacgcctatttactaattactatgcatggttcatcatggttggaaatttctttgcaaatgatctagtgtatattaatccaaaatatataggaaaaatacattaattgtgggaggaagacagcaagaatccacaaaaaggaagcactaataaatgacgtaataattgcgttgggatgagagggacacaaattaaagaagataggatttgcatgtcaaacacttgttgtcccatttcatgcatcgtcctctctattgtctatttcgctgtcacaacctctaaatttacatctcatgcaatttattacgacgtatacatacacccttcaaatttttattcgtttgcatttgtatatatatacatatatattagctagtaaaattaatcacaatttataattttgtaatcattaaaaatattgtagtaaaaaaagcaaaacccaaaaaaaatagaaaagaaaactgaactggttggtgtttgtggtattttttttaataattttgttaaggatttgatatgggtttcaattttaatggtggaccgaattgaaaatcatcgagtgaaaattgagctacttacaaagcccaattagatccaacgggcctcaaaatatcttttatattccattttttttaatttgtttttgtttaataaatcaaaaattgaaaagcgaaaggcagagaaaatttccaatataggcgaaatgtaaagagcgggaagctaaagcctagagagagattctcacactgccaaaacaaaatttccctgtagagagagagagaaagagtgagtg

SEQ ID NO: 7867 - DNA, 3000 bp, Unknown
  misc_feature (1)..( 3000): cDNA_ID_1809597_gDNA_ID_1621170_Annot_ID_57241 3000 nt of promoter + ATG
gatctccaagcgcttatatctcttatccaattaaaaactgcaaaatttgaagaccgaccattgacaatctctgagacttctttattgtcaccttcaaagtaaattttcctatagcccctactccaacaatgttgcatggccatgactaaagcttggagttcactttccatcggattggtagtaatagagcctatagcatgagctgcacctagaaaggttcctcgatcatcccgtaagagccaacccgctttactcggagcgttgctgtggtaagtgccgtcatagttgcatttcgtccaaccaatagggggtgttgtccagagattagctgttggttcttgtgacgttactctgtcaggttttgatgataaacggtgggtgtactcttctgcatcttgccattctttggcgtcttgtcttgcatatcggagagaagcttcccatggaatgatcttgtagtttagttttacaaaattgacctaaaattggtggataatgttacgacagagctacactaggactttggaatgggctttgctgtatgaggccttcgttacactaggactttcttcattctaactttttttcttcttttctttaaaaattattttaaccaaaactaaaactttcactaaaacatttaaataaataattttttaaaggttttttataaatactaaattaatatgacgttgtgaaatctaaccggatttttgatcccgccatttaaccgtggtcattagcgattccataaatccaacatatttttcacatcttcatgtatatttagcatttattttttgttttcttttcttaaaagtttttcaaattttttttgatttttttaaaagttttaataaatactaaattaatataacgttgtgaaatctaaccagattttggatcccgccatttaaccgtggtcattagcgattccacaaatccaacatgtttttcacatcttcatgtatatttagcatttaattatttttattttatttttttaaaaatgttttcaactctctttttttttcctttttcttttttttaaaagattttataaatactaaattaatatgacgttgtgaaatctaaccggattttggatcccgccatttaaccatggtcattaacgatttcacaaatctaacatatttttctcattttcatgtactatatttagcatttaattttatttattttctgaaaaggttttactctttttttcattttcaagaactcttgttttcaaaattttattgttttggatattaaattcacatataattatatatgatttggttcgatttcactcggtaagctttttcgaatatttttcacctggagctgtcaaataagccaatttcttgcagcttgctgatgaatcatgaaactgtttttgcctcatattacgattgaaacacttaagagaaaaccaatacaagaagaatactgtctgttgaatcattctcttattacccgaagaaaaaaagatataacaagaacatatcaatcctcagcgaaacatcattcatcatcatcatatgcatttgagagaaactaggaaatcaccacacatcaggacggagttccccagtagccggaggcatccagcgaccagaattgtacacattctcgccaactttccatcccggaacatctttcattacatcagcctcatattccagatactttttccactcagacacaaacctagaatgcaaaacggggattgaaacaagattgctatctgaaggttgctgcaggcacattgacttaaatttgagaatatggtttacctttcatcttcttctgcttgaagaatgggaagtattgttctacgagcagcatatttctcttccttcaatgccctaaacatcacatcaatcttgataagagcattaatcttgatacttactgatatcaaatcagacttgtttaggaccattgtaaatgcataagaagttaatgatcaagccagatataatactaaaacaatctatctacatagaaacagtatcccgataactactatcaaaacatgcaactagataattgctttcatcataacagattctcacatctttgcaattgtggctttaagagtttacaaattgttgacgaactttatattcgtttaaggctaaactcatgctgattaagcttcaaccaaaatgtcggggaatactaataacagaatacataacagtgattcaacaagcctatgtttccataggttaataatattaaccaattcctacgataaacatactcaagtttcaacaattattaaccaaaatgtatccttcactacattactatggtcatcaatcactccacaacactaattttaccaaggcgatctcgaattttagaggaaaaattgaaatgtgaacgagctattacaagtcgttcttacctgcggattttgtttccctggccgacctggtacattccccaagcaaaggcaccagaaacggcaaggaacatggccattgcactaggacccgtattggatatccggcgggcatatcggaccggtgcgaacccacccggtggcggaccatcctgaagcagcggcatatccttcacactcgccattcctggcttatttcttatcatcgcctccgtcatcttcaacgctcaatttcttctcgaccaaattgacttttgatcactgaatccgatttgattttgctgaaatcgagtgttctagggattccgatgaacaacgaagggaacgttggagattaactaggctaggaccatataactaagcccattagttagcaaatcacggagtcgtatgagatgaaatgggctataactaagcccatttcagatatgttcaaagacccaagtccataagtaagcaagtcacgtggagtcacgtgattatcttcttcttcttcttacatataaaatgccctaactacatgttcagaatatctttagccgccgacttggtatcatcaaatcgaggagattcgaagaagcatg

SEQ ID NO: 7868 - DNA, 3000 bp, Unknown
  misc_feature (1)..( 3000): cDNA_ID_1809589_gDNA_ID_1621170_Annot_ID_57243 3000 nt of promoter + ATG
ttagtatttataaaaaacctttaaaaaattatttatttaaatgttttagtgaaagttttagttttggttaaaataatttttaaagaaaagaagaaaaaaagttagaatgaagaaagtcctagtgtaacgaaggcctcatacagcaaagcccattccaaagtcctagtgtagctctgtcgtaacattatccaccaattttaggtcaattttgtaaaactaaactacaagatcattccatgggaagcttctctccgatatgcaagacaagacgccaaagaatggcaagatgcagaagagtacacccaccgtttatcatcaaaacctgacagagtaacgtcacaagaaccaacagctaatctctggacaacaccccctattggttggacgaaatgcaactatgacggcacttaccacagcaacgctccgagtaaagcgggttggctcttacgggatgatcgaggaacctttctaggtgcagctcatgctataggctctattactaccaatccgatggaaagtgaactccaagctttagtcatggccatgcaacattgttggagtaggggctataggaaaatttactttgaaggtgacaataaagaagtctcagagattgtcaatggtcggtcttcaaattttgcagtttttaattggataagagatataagcgcttggagatcaaaatttgaagaatgcaagtttacttggacaaggcgattttcaaacatggctgcagatgctctggcaaaacaacaacttcctttgaacactcagttttattgctataactatatcccgtttgtaataactgattttttacatcgcgactttgctacagcaaattattaataaagctgatgtttgaggaaaaaaaaaaaaactacaagatcaaaccctagttcctccgatgaaattgcggttagaaaactaaatattgattgacctaattcaaagagaccttttttgtgcagaaactaaatattaaaaatccaaggttccaagagatcaaataggaatttaagcgagaagcaacatacctgagtctcgtgacaacggcgcgtggtttgcgtcaatacttgggactctcggtgagatccgccatgatttgctagagagatcgtgaaacgcaagaaaacagagagacaaacggtggcgagatcattgatggtgtgatcaccgagttacagttccgacggttctgacggtggtgaaaatggatggtgatcatcgagctttgacgttctcgtgatcggtgagttctttttgtaagagaggaacagaaacaaacagaggctaaaaagacaaaagaagaagaagaaggtggattttttgttttcttctcgtaatccatgctttggaccttgtatcagccacttatgatcatttgctatattgatgctttccaattttagagtattgaaatgggtttctttgacaatcattttgagttagtcatcattccttgttctgaatcaagaattggcttttgttatgttgtctaggttctgcttgtaactagagtaatgctattgtagtctctgttgtttatttgtagaatcatagagagtcgtggaagcatgttttagttgttactctcgatttcttgtcgatgttgtggtgttataaattgagcgttttaaccaatacaagttaggagatggttagtatgtgactatgtgttagtggccatgtatgtagttcgatcagataatctgaatgatgtgctaaagagcttgcataggaagactgcctttgtgttagcttgcatagagacttgttgcaatatatgagactgaaaactattatgtgaaaactttaatttgtgtacaaatatttttaactcttaaaattaaactaacattgtaccaattagcacatgaaagaaacacagaattctgtgaacatatgatgaataactatataaacacattatggattcagttaaggagacagaaacaagaagatgaatttcagatatatagcaatagagtcacttataatcatatcagagcttatactttatacaaattatcactttagtccttaaattaaaaccgatttaatcgacaatcttgttattctttaaaacaatttgttcttattttcaatctttaaattttgcaacaatcgacagaacttatcgttattccgtgtttttattttcatatctttcttaaaatgtttcaaaataatatatgtttaatattttctgatttacaatagttattaagttatatgaaatataattattttaaattttattttatttttcagaaaactcttataagagagcttaccattagaatatgaaaaaaaattaaaactctcttataactttttaaaaattttaataataaaaaaatggagaaagcccgtgaaagagctcttacgaaccaaaaccattcagtccggttaagaattggttatcaagtttggttcctaaaagatatccaagttcaaaagcaaaaaaatatcttcttttctctctctctactctcttctcttcttctcttcttctcttcttctctggctgggcaaccatgattactgtcgtcacctccaggctctctctccttcctccagtcttctccgtcgttaactcttcttcttcgcgttccaaaggtgctcaatttatttctgccacgtcttctctttatagcactctgttttacacacgtcgttgattcttcagttttttaaaagacccgtcttatacaaaatttcagtgtaaccgatccctgaaattcgttaaagggatgaaattttatctaagattcggagttttcttttcgaacatagtggtaatgtttgtcgaatgcttgatttggtcttccacagctgtcactatcgagtttgaagatagaaatcttgtgttaacttagtatgtattactgcataatgtcaattctgtttgaaagcatcagaatttcggaacagatttttgtttcgtatagcatcgatctttgtcttgtgtgtttttatcttctctctgaagcctgc

SEQ ID NO: 7869 - DNA, 3000 bp, Unknown
  misc_feature (1)..( 3000): cDNA_ID_1809585_gDNA_ID_1621170_Annot_ID_57244 3000 nt of promoter + ATG
aactaatgtagaatgacacatgtcattttcttgtgtgatgatgtgtcactcatatggaaagtgttggccaacttttatatatatgattctgagaaagcacaagcaaaattcaatattctctccgtcgctaaaattttattgtccactaataaactagttgtaactgaatttttttttttggtgaatcaaatctttttataatatatatatttccattatagtataaactactagctactctgtttttcttaatgaggataaaatacattaaatttatgaagatttgtggagatatatacgaaaaaggaagcgttgtccgtaagtataggtatgcaatgcatatgatatgatcatacatatatgggctacatagcacgtatgatgtatgcacgtaaatcaaaacagtacatcgaacattttagttaaatttaaaccaacataccgtaagaatgctaagatatgtgtaatcggtgcattaatgttagctttcgaggtttctaggaaatgtgaccacaccactaaccaagtcttggaatatggtgaatgtgagcaattccccaagtctttttagtcttcacttctcactttatgatctctcaatcaacgagaatggaacacgccttcaatttcgattctctatatatatgcatcaaattaaccaaaaaatagtgtttattccaagaaatgttcagcaaccacgtacccgttatccacatgtagagcttatttcactttgatagtttatagttataatgatatgtgactttttgtgttaaataataaattgtgcctttttcaatatgctgactagcaaaagtgttgagttacgatatactttttggtaaacgagttatgactacagaaatggtcggtgaaactaaaaggtaagaacttccgaatattctcgagaatttctattcaattgttcgtcgattatccgattatatatggaaattaacactaacttctctgccaaagcaagcgcatattggttttcctctagattggtgcatattattctacattttcctccgatcatatttaagtgaaaaaattattggtatagtttagaataaagttaacgtcaaatattttttcattaatatgcatatgagctaagaattctttttcatttttttttggtaacactatatatacaataaagttactaattttgtaaacttctagtagtaaattgcctatttatcaccattcaccactggtaggtttattgatacaaaaaaaaatgtttagcttctcattagaaatcgacgtttgaatcgcaaatgggagttttgagcaatcatttaatttggatatatgcaacatcccaatgaatgtcttaacaacctaattatatagataggttcactggatcttgataacaatttatcttcaccaccaataacaaaagctagtacaaatgtttataagtatatttattaaaaatttaagattctcttcgtactaatatattgaaaaaacccggaaattacatataaaattattacaaaattgttattatcttattatcatttaaaaccaatatatatttctcatgaacccaagatatcttgatgtggcgatatctgttgacccaatacgtcaagcaaaacccataaattatcattatatacatttttattttatttttattttttctaacatatttatgaaaaaaaagttaattagtctgtggattgaggaagtctgtgggatgtgtagccacacctgatggaaggtttaaccacgttgcctcaaattccacagccgtctatacacatttatttacttttctaagaaaaataataattattagcttattaaatattacacctaccaacaaaagtaatataatctgataccaaaaaaagagtaacataaacagttatattttgtctttaaaatttcccctgcgtaatttctatgtttttcaacttaactctttttctatacatttttctccataaactctgtctatgttataatcgtcgcaaaatgtgaataaaatgtatataaagttttctttagcaaaaaaaaatactatataaagtgtagctcattaaaatcgtataacagttacataactagtatgcctaaaattcttgtatttctctaaaactagaccaaagaggagcaaaagagaaactccgaagtcccaatggacctttcatgtttatgtatatacatgatcgtgaagcaaaatgcgttgtcatgtctcttcagtgtaatcgatcaatgtaagcaacatataagtatcactttttttaaccctaaatgattcccacgttggcagcaacctgacatcaaatttaattatcttgctttctttctcttctcaagtgtatatccaaagtcatgtatatcttctctctcaatacgctttaaattttctattttatctggtttcgacttggactataagattttggcaactaaaaggagattaaaaatagtctctttaattcggtctgaaccgaccataatctctcttaatgattttaaacattttggtagttcttttcctaattaaaagagtcaatcttcatcttgtatatttgttgtatacgtagttgatatttgccatgcaaagaaaagaagatgcaaaatattgaaccacttttcttgtgactaattattgtatttgttggacgaggattaatttattaccaataagtaagggacatatgaaaaaaaaaaaataaagaaataatggtgggctgcaaagcttatcatttgagatataaataacattcagaagctaaatatataataataatatttttactaattttacaattaccaatttgcatcaagtcgtcttctctatttatacatctccttctccaatccaacagaacacacacatacacttacatctccatcctcttgtcttaaaaagtttccaaaatctttcttttttcttcttctacattcttaaaatttcttctgttttctcctcacaaccagacaagcaaactctaaactctgtggaagatg

SEQ ID NO: 7870 - DNA, 3000 bp, Unknown
  misc_feature (1)..( 3000): cDNA_ID_3046792_gDNA_ID_1621170_Annot_ID_173955 3000 nt of promoter + ATG
ttggaaaattaaggattattatgcaagaaacgtaaaaaacaaaaacgagattctggcatttctgaatatacaacacataacggacatgcatgaagctttaaagctaatacaacaagacctttgtttcatgaagaagagagctattgaatcttatattttttacctcagctatagacatcttcttctcttcttgatggtcattcatctatttcccataagaaccgagcgtactctccaagaataatgctggccaaacacagaaggtgataatgatcacatttcagttttaaagtgcgaaaacaaaaagaagattgtgtaagagctattacatatttctaattatacctatcatttggagaggcttcaacggccttctcaaagtagaacaaggccttctcatggtcattattaatactccagaacgccttcgcgtatctgcatagcgtttctccatcttctgtcttggacaagcttgatttgccttttcccgctgcatcagcctttttcggggacaaaaataaacgccaacattagagacttgaattgaaaagccaatgaacaacaacaccaggcagaatacaaacttgaatttatatgctagtaaatgtctactatgagctaagatgcctaaaaatttcaatgtcagatcgaacaataacaggtaacaattagagtcattcattgatccgcagagtttaaaccaaataatctatagagctacgacacaaaacccacctcaaattcgtcttttccttgtccagaagactcatcatcatcctcatcatcatcctcatcatcatcatccgcgtttatctcccagaggaaactagcatatgctgcaagaacaatgctgaaaagaaaaaacatattattatcacaggaactgataaccaatggtggtatttccaaaaaatgttccaacagacctatcatcaggagatgcttgaactgcacgttcaaagtagctcatggctttagcttcatcttggtgaagcttcattactaatctaccatagtttgctaaagctactccatcactaggctcaactacagtacacttatgataatactcttctgctccactaagatctcctttatactgttttcacattaacaaacgaaacttagacattaatagaaactacttcaaaacagagccattacacaacactaagatttgagtcaaaattcaatacctccaagaacttggcatagtttttgagaagcaaaggatgcaatggatactcctcgagcattcctttgtagtaatcaccacaattcttatcatcgtaacccggcaaatcgaatttgatctcactaccatacaaatcaaacttatcaattcctaaccctgcagctaaatgcataggagggcttggtggtctttcaatctcaaaacctagttcatctctcacaccaatcccaagcttcttaataacctcttcaaaaacacctctctcaccttcaccactatcttcttccttgtgtttcgcaaaactgaactcgccgccgtcaatagcatcaccaatcgtaaccgttctctccaaattctcctcgattccagtcaccggatcttcggatttgaacccatctccagagtcgcagtaaatcgagagagatgcctcgctcttcagcatctttttgggtctttctttctaaatccgtccaaagtcttcaactttaggttcaattgggtcgtcgttcacagattcctcgattgttatttgtgggttcttgattcggaggaccccaagacaacgaccaaacgaagatgattttgaggttcttaggtgaccgacccagttagagaaacaagataagtggggttctgttagatttcctgagaaacggcaaaactcaggaaaggatcttttagtatcatattgtttacaaattattccttaactttatgttttgtctatttgacccatcactccgaagcaaaaactaatctgttcttttgttcaagaaatcatcaattagtctcggttttatactaagcatacaatttttctaacgtatatcaacatttcaatttcggtttaagtatttgtgtacttacatattcaaaaaattagtttgggttcgatttggaaggaacaaaaagttttgtgactcgtgattaaataaagaaagaagggatatccacatgagttttgacctttcttttgggcggacaataaggtccacatgaactgaggttttttgagtctagaccggggcaagtcaataatacaaaaagaggacaacttgtcaaatcattggtccattcaaatgaaaagaagcccataataaatgtgacaaggatgtgtaacatggccacaaaataatcagtttggtttcgttcattttggactatggggttggttttgaaattccattccagcacatagaatttcagaacaccaattacgaaaggctttatcgtgttagaagttatatattttgagaagaaaaataaaagatattgttattatgaaggatcatgaactattctaagactgagctaacacgtgttacttgcttaatccttacactcaaaaagtctaaatgttaatggtattaaaaattattcaccttgtttgttattcttatttctgcaaaaccagacaacaattcagtaatcaaaaggacacatacgtaagttgaaattggaaagagttcttcaccaaagctaacttgatcctcacgaacgtctcctaaaatagcaatcttcagctgaagaacaacacacgcctcctaataaactcgttgtctttctcacatacacaaaaccaaatttagcaaaatggttattattacctttctccctcctttcggaaattgccaccaccaatcaaacaatctaccttcttcttcattcatcattcacttctcagaattttgagaattttgaattgagaattgcgagagagatctcattctccctctcgcaattctccgtcccctcgaatccaacaaaaagattttaatgtaaaatcactctattgatccacaatg

SEQ ID NO: 7871 - DNA, 3000 bp, Unknown
  misc_feature (1)..( 3000): cDNA_ID_3046796_gDNA_ID_1621170_Annot_ID_173954 3000 nt of promoter + ATG
cagaaccagcaacaatgaatatcgtcgtaccccacctccaggaatgagatttgttgcgcttcaagttcgtcgtacttcaggtcgacctcaggggattttgaacattggtgttggattaattgatggttctatgcggagtatgccgctttatacgcatatggattcatctgctgtgggatatagagatttgctcggagaagaagatcatcatctacaacatttgcatttaaatagcaacaaagggagctcaaagaatccacaatctccatcttctcgacagtaccaatccgtaatctcaaggcctgagctccgtcgtacgaagagcgatacaagttctatggttgtttcggatcttcttagcagggctgaacggagtcgtttagctaatagacaaccagcgagtgcaatagtgagcagtgaatctgaaactcttcccaccacgacagattctgatgagaaaaaatcgagtgagtatacacctcctagtaaaaaccttagagttccaaggcaacgatacaattcgattgaatcagatctcataaatccgtcgccaatggagaaccaccatgtggtagtgtcgagaagggagagacatgatgttatgccgtatagttcgtatcaacaaacaggtaagacaccgaggaagaagacaaggatcgagaaacaaagatcagtgaaagattacgatcgtggccgagcttccccgtacttatcgaagcacggaacaccattgagatcaaacattatcgcatctactccgatgagatctaacggagttggatcaactcctatgagatccaacatcatcgcaatgtcaccgatgcatcccaacatggttggatcgactccaatgcgaactcctatgcggtctaacatggttggttcgactccaatgagatcaaacatcgtcggatcaaccccgatccgatcaaactacatggctacaccgatgagaactcatcacgattttggtacaccagtgaggaatttagctggaagacgaatcttaactgaatcggagttaggaccatcgccatctgaagtggctgacaaattggcgaaagatagatcgcacgaaacggaaagttcaatactcagcgaatggagcatcgatgaatctagcatcgaaggattgcgatcaaaactcgagagatggcgaacagagcttccaccgttgtacgacataggatcaagccatataagtagcactgattacgatggcgcgagcgttccagctgcaactgccgggggaggaatgagttcaagacggaaaactccgacgacgaaaaagcataaccgccgtcacacagatggaggtaatggacttttctcgtgttttagtaagatttgtggtgtggaatgcagtttcgtatgcggtggtggtggtgggccgatggtctcagaaggatctactaagaaaggtggagccggacgtgtgcaacgcacatattccgctgacgatctgagctttgtgtgatctttattttattggtcttatattaacttttattttttttggaaaactatattttttaaggatctgagctgatgaattaatcaaatagtaaacaaaaattaatttattaatgttgtgttaataaatcatttatttttgtgtattcctcttcttcttccttatttttaaaaaattaaaaaatgttcttcttataatatagtgtttaatagaaagtgagctcacacaacaaaattagaaaactgtgaatgaatgtaagagagtgagtggaataaaaaaaatataaaaatgaaatctaagagtgagtgaacaaatgttggtattgtagacaatggtgactaaaattaaaaagaaacaaaatgatataaacattaatctaaaaaaaactaaaataaatatacaaattctgcatttctaactatactttcatgtattatgtatacttatttgattcatacatgatataaccggttatttagtttattttctatcaaatccatcaattagagcatgaaatctatgtactccttgataatgattttgatcaaaagtgtaatttccacaaaccaattgcgcctgcaaaagttttcaaaggatcatcaaacataatgatgaatatctcatcaccacgattttataataatgcatcttttcccaccattttttttccctcactttcttttataatcttgttcgacaacaatcatggtctaaggaaaaagttgaaaatatatattatcttagttattagaaaagaaagataatcaaatggtcaatatgcaaatggcatatgaccataaacgagtttgctagtataaagaatgatggccaacctgttaaagagagactaaaattaggtctaaaatctaggagcaatgtaaccaatacatagtatatgaaatataaaagttaatttagattttttgattagcccaaattaaagaaaaatggtatttaaaacagagactcttcatcctaaaggctaaagcaatacaatttttggttaagaaaagaaaaaaaccacaagcggaaaagaaaacaaaaaagaactatattatgatgcaacagcaacacaaagcaaaaccttgcacacacacatacaactgtaaacaagtttcttgggactctctattttctcttgctgcttgaaccaaacacaacaacgatatcccaacgagagcacaacaggtttgattatgtcggaagacaagttttgagagaaaacaaacaatattttataacaaaggagaagacttttggttagaaaaaattggtatggccattacaagacatatgggtcccaattctcatcactctctccaccaccaaaatcctcctctctctctctctcttttactctgttttcatcatctctttctctcgtctctctcaaaccctaaatacactctttctcttcttgttgtctccattctctctgtgtcatcaagcttcttttttgtgtgggttatttgaaagacactttctctgctggtatcattggagtctagggttttgttattgacatg

SEQ ID NO: 7872 - DNA, 3000 bp, Unknown
  misc_feature (1)..( 3000): cDNA_ID_2042293_gDNA_ID_1621170_Annot_ID_173949 3000 nt of promoter + ATG
actgaagatcggctttgtgttttgctgtccaagtcttagtgtgagctcaatttatgtttctcttgcagacagatcttatacatcttcacctagatataagttatagcacataactaaagtgtgtattctcattcactggcctgtcgatctcagtagttcatagcacataactaaagtgtgtgttctcattcactggcctgtcgatctcagtagttcatatagtcaaacacatcactgatatatctgatgatcaaattactttctgttttccatgtatttttggttagtaaattcctgagaattgtgcctttcatcaattatatttcttgcgttatttttcaccaacgagagatccttaggatgcatatttttcatcttgttgtaggatgaggaagatttttctgattcatcaaagaagggaaacgctgaaaaccctaggaaacatcaaattggggagaacatacccaagaaggataaaataaagtttcttgtgaacactgtaagcagaatttttttgtacactaagctatttctttttgcctttctaatggtttgtcgattatgagaattttcatattcttgtttaaccttagttttttactcttatggttcttattttgctctcatctgtgaatgcagcttcttgatattgaagataataaagaggctgtttatggagctctggatgcttgggttgcttgggagcgcaatttccccattgcttccctcaaaatagtaatagctagtcttgaaaaggaacatcaatggcatcgaatggtccaggtatctatcacctgagtgttctatctcttttctgggactcatgaaccatgaataatcaaatatccaagaacatatgtctattgctatagtaactgaaaaagtagaatagaatcttggggaggtgtttatttcttttcccctgtttaatcgtttgtaggtgataaagtggatcctaagtaagggacaagggaacacgatggggacgtacggacagttgatacgggcgttagatatggatcgtagagcagaagaggctcatgttatctggcgaaagaaagttgggaacgatctgcattctgtgccttggcaattatgcttacaaatgatgcgcatatatttccggaacaacatgttacaggaacttgttaaggttctttttcccccttgtcttcactgaccgaaaactaaataagaaaacattgcacattgatacttaactgaactagtaagttactttatttcgtggtgacctcaaacttgtgtttattttgttatgtgggttatgaagctattcaaggatctggagagttatgaccgtaagcctccggacaagcacattgtgcagaccgtggctgatgcttatgagcttttgggaatgcttgatgagaaagaacgggtagtgacgaagtatagccatcttttacttggtacaccatccgatgataaaccaagtagatcttcgaggaagaagaagaaaccaggtaggtgactgcgatttagccattgatatcttcaaccatctttaaagccgtttgatattgaactcatgtgctatagattcttgcgcaaaacaggataagttttaaactgtctaacttgtgatttcagaactgaggattccagaagcaacgacagaaggcgcagttgatgcagcaaaagctgaaatccaagaagagcgaaaagaaaatctggataatcaccaagaatcagaagctgccactgaaaaacaattcgaacatggagcgtaagttgtagtatttaatcgataaagtatcactgcaagagaaacatggactgtaaggatgtatttaatcgatggattgttgacaatgctcacatcccttgggatttgtcgcaatggatggatatagagtttagggtttgagtgcggcactagtattactgagaaataagataacaaaatcacatctacatctgaagttttcgacacactcaacatccaacggtctgaaccaactaccaaccaaaccaataacatcgtctaaaacctacaaactgattgaataaaaagataagctagggaaggtatcatagtggttcggtacggtttgaattggttagatgagattggacccctaccgaaaatagagtcttcggttacatttggtttaataacaagttcatttgaaagttaagaaaataactagtattcgaatttagagattgcgggagattgtatgttcattcgaaatacagtacagagatgcttcgattccagatctgcgtccggtctctaatggccattcgattctcgaccaaagagggaatctttcgggatgggttgatttgtgggaagtgggaaccaaacggaatgggaagacggaagaggaaaggtttaggagatatcaatcagacctccaaggccaaagtcaccttccgatttaggtaaagctttgaaataaagagataaattactctttttcaccggacacgaatgagatatcgtaatttggtaaacttgatagaagatgatcagtgacgttatttctcaccaacactataattccattttaagaaactttttctcattttagttacagttttccagtttgaaatctctcacacctttacgactagactacaaaccatatctcttacccatcaactcttaaaaatcaggcattgctttatcactcagtaattagtatttgacgtttagagtgtactcgattagatagatagctttgcgtccaattctctactttctatttaccttgtttcgtatcgaaattgataacgtaattgactataagaaactcttttgccaatcacttgctgttgtgtttttatgttcctgaaaacagttcagtaactggttttcttataaatgtcacgaagagcttacattttcttataaattacataaatgaattctgccaattttctctttcagacttttcttaaatttgagctcttcgtgcagctaactgttgcctattgattgattaactactttttggttagtttgggaagaaa

SEQ ID NO: 7873 - DNA, 3000 bp, Unknown
  misc_feature (1)..( 3000): cDNA_ID_3046804_gDNA_ID_1621170_Annot_ID_173948 3000 nt of promoter + ATG
tgatttttcgtccttaggttctgaagcttctgattcttcaccctttgcaaactcgatgttccctagatgaaggattgcagccactactcggaagattccatcctacagtagtagaattgtaagaagagttgttccaatgactcaacatgtaaaataactagaaagtacctgctcttcagaattgatcccaacaacgtccatagctttccttgtagctaggtattccttggaatcatcaagcccatccaacgcataacaattagactgatttagatagcgaaatgtgcttggttttcccaacttgtacctctcagtttcctgaaacctcatgaaaaaactatttagtcaacgtgaatctcatgtaaagcatgtacataagatttcgagctaacaccgccttagaagagaccagggcttacctgttctggtgcagcgcaaagcatgtaaaagcaatgatagtttctttcagggtctgagacttgacaaacccgcgacctctctagcaaatatgtcctaatagcagctcccgagattcttcccctctgatcaaactgaatctccacaaatttaccaaaacgactgcaaaatggaatttgcgtaagtatcttaaattgggttcaagaaaatacacaaaatggtcaaatcatcaaacgtgagactcctctcctccaccttgaattattgtttctaacggtttttgcattgccaaaagcttctaaaactggatttgactgcaaaacaggaaagtcaatcagcgaaaagtatgacaagatattactggaggaaactaaccaagtctatcttttgcaagaatgaagccatgtattttaaaaaattcattacctccaaaacttgctgctccacagatcttccttcactctcagctcttcctcccatgtaggcaagatactgcatgagcatcttcgtgctctctgtcttgccagcaccgctttccccactcaccaagatcgcctggctcactccctcgttaatcattttcctgaaaggttatgtttttggtgatcataatgccgaaaaacagttgtaagtgaaacaataatataagctaatttaaacggcaaaagagttacctgtacgcagaatctgcaacggcgaaaggatgtggactcaactcaccaaatgctgtgcccttgtactgtttcattgtctcacttccataaaggtggggcaatctcttaaagggattcacagctatcaatatatttcctgtgtacgtctggatccatcatgaaaaaaattagattgcataaactgtggagacatcttaagatcacgtgatggttaatgtaaacaacaaaattacttgaaagcaagaaatacttgacaactagtaatcgaattgaagcttacatatatttcatttgcattataacggcacttaagattgagcaggacccctggttcatgcaaatatgcaagctttgtcatgtcgtctactccaagttcagggaactcggggtccttggggtagacattatttaactttgccacaacctaagaaacaaatgcatcagaaacgagagctttttttctcaatgctcatgtcataaacaaatctcagataatgcatgaccattaaggaactagttccatggtcacagaactcagaagatcaaaagctaaacgttttccacaataacaaatgtctccatatcaagaaatcatatactccttcggcagattatctaacaagttttatactttcttaccgtctttccagagcagttaactgtgatttcttcactgttaacttcttctacttccccatctatccaggcatcatctggatcctccacccagacatgagaccctaccgttactttggctgaagcagcctgcacataaaccacatcataactacacaatcaaacaggtaactgaaaatcgaagacaacaacaaagagagatgaattttctcaaaaaaatcttttttttctttctttctcatccaaaacaaaatcaatagagagagtaaagttgttcacagctttgttcaatcatatacaaaccaatcaaaaaaggaatttttttgttttttaattcaacgacatatggttccatttttacacatttagaaactcaataacaatttgatacaccatacgaaaattcatgtatcacagtatgataaatttacataaattaaccaaaaaacgtttgttcacagaaaaattaaaattgaaatcacacaacagagagaaatcaaaacgaatcagattttgttagaagaaaccacaatgcgattaaagaagagaaagctcgtaccattgttatgatggaatttggtcagatttttctaaaacgatcccggctcgacaatacccaacaacgggagaaacatcaacacaaacttttgaaaatccaatcacaacggatccatgataaaatcaagaaccaaaatttcactttcccagcttcaaaactttctgatcgacgtcaacaacatagaaacataaacgaggctacatgcgcaaaatttcgtgacgattgcagaggatcttaaacccttgagtttttttccctttgaaaaaaaatcccagaacacataggtctgtttcatccagattttctcgcagaaacctgaattttttttttcttggattttcttgtcccctggtttatttccccccaaaacggacgttggaacttggaaagcgaacgaagaagaatcatgaaactttgtaattccgatgttaccccttttcattaaaccgatccggtttatctatctcgctttcaacggatctaatagaaaagagagaagcgtctttctcgttaatgggccaattcttttcttaatgggctacacgttttatcatctctatttcaacggatctactactacatagagaagaagcttctttttgttattaatgggccaattttttttattaatgggctaattgtaacagtatcatttctgaaaacccctcccttaatacgcctccgtcttcgttggttctcgtagcaccgtctcca

SEQ ID NO: 7874 - DNA, 3000 bp, Unknown; identical to SEQ ID NO: 7867
  misc_feature (1)..( 3000): cDNA_ID_1809597_gDNA_ID_1621170_Annot_ID_173941 3000 nt of promoter + ATG

SEQ ID NO: 7875 - DNA, 3000 bp, Unknown; identical to SEQ ID NO: 7865
  misc_feature (1)..( 3000): cDNA_ID_2042340_gDNA_ID_1621170_Annot_ID_173936 3000 nt of promoter + ATG

SEQ ID NO: 7876 - DNA, 3000 bp, Unknown
  misc_feature (1)..( 3000): cDNA_ID_1809581_gDNA_ID_1621170_Annot_ID_57245 3000 nt of promoter + ATG
agtgaagacaagggggaaaaagaaccttaacaagttcctgtaacatgttgttccggaaatatatgcgcatcatttgtaagcataattgccaaggcacagaatgcagatcgttcccaactttctttcgccagataacatgagcctcttctgctctacgatccatatctaacgcccgtatcaactgtccgtacgtccccatcgtgttcccttgtcccttacttaggatccactttatcacctacaaacgattaaacaggggaaaagaaataaacacctccccaagattctattctactttttcagttactatagcaatagacatatgttcttggatatttgattattcatggttcatgagtcccagaaaagagatagaacactcaggtgatagatacctggaccattcgatgccattgatgttccttttcaagactagctattactattttgagggaagcaatggggaaattgcgctcccaagcaacccaagcatccagagctccataaacagcctctttattatcttcaatatcaagaagctgcattcacagatgagagcaaaataagaaccataagagtaaaaaactaaggttaaacaagaatatgaaaattctcataatcgacaaaccattagaaaggcaaaaagaaatagcttagtgtacaaaaaaattctgcttacagtgttcacaagaaactttattttatccttcttgggtatgttctccccaatttgatgtttcctagggttttcagcgtttcccttctttgatgaatcagaaaaatcttcctcatcctacaacaagatgaaaaatatgcatcctaaggatctctcgttggtgaaaaataacgcaagaaatataattgatgaaaggcacaattctcaggaatttactaaccaaaaatacatggaaaacagaaagtaatttgatcatcagatatatcagtgatgtgtttgactatatgaactactgagatcgacaggccagtgaatgagaacacacactttagttatgtgctatgaactactgagatcgacaggccagtgaatgagaatacacactttagttatgtgctataacttatatctaggtgaagatgtataagatctgtctgcaagagaaacataaattgagctcacactaagacttggacagcaaaacacaaagccgatcttcagtgtaatctattgtacctcattcttcacaatacgtttaggagatgaatgagaatcagcgacaaactgatagctcatagattggacccttaaaaaggcgggcttgtttgtctggttgacctgagaaataacatgtatcacaaaatgaataaaaggaatctgaaatatacgtgtgcaccttttatttattggggtttttgaagtttaagatgaaaaacatttcacaactgaaaacttaccccaagaagatgatgaaatggaccagttagtgcgccagcattaccaacggtgttgtactttctgtagaagaatggtaaagtatcagattcaaatcaatacaccaagactcaagatgcagcttgtttttggcagtacaaaagcgagacttggagagcagaaagaaatgaagctaattgatccaatctgagcttttaccttattccattggaatgagaaaacactcctggctcacctacaataagtttcaaatcataagagactccgactatatgaagacctcaaccaggttacacaatctagcatttcacatttgtatgcaatttaatcaacttatcagaagaaaaagagagacctttcaaagttttacagaaattgtctacttaattaaatgaccatttttacagaaatcagctccaaattcgaaacttagagattccaagtcagtaaccaaacattagagtgctatcttcttccgcattaaacttttaagtatacaaacgaatttatcatgagcaatactaaccataattttcgtcacatcctcctccaatgaagagatttcttgctgctgaaatagaagctaacggcgccgttagatttcttgttgcgctactaacggcgcgtttcagaagcgttctaggaattagagaactgaaacccgccattggagacggtgctacgagaaccaacgaagacggaggcgtattaagggaggggttttcagaaatgatactgttacaattagcccattaataaaaaaaattggcccattaataacaaaaagaagcttcttctctatgtagtagtagatccgttgaaatagagatgataaaacgtgtagcccattaagaaaagaattggcccattaacgagaaagacgcttctctcttttctattagatccgttgaaagcgagatagataaaccggatcggtttaatgaaaaggggtaacatcggaattacaaagtttcatgattcttcttcgttcgctttccaagttccaacgtccgttttggggggaaataaaccaggggacaagaaaatccaagaaaaaaaaaattcaggtttctgcgagaaaatctggatgaaacagacctatgtgttctgggattttttttcaaagggaaaaaaactcaagggtttaagatcctctgcaatcgtcacgaaattttgcgcatgtagcctcgtttatgtttctatgttgttgacgtcgatcagaaagttttgaagctgggaaagtgaaattttggttcttgattttatcatggatccgttgtgattggattttcaaaagtttgtgttgatgtttctcccgttgttgggtattgtcgagccgggatcgttttagaaaaatctgaccaaattccatcataacaatggtacgagctttctcttctttaatcgcattgtggtttcttctaacaaaatctgattcgttttgatttctctctgttgtgtgatttcaattttaatttttctgtgaacaaacgttttttggttaatttatgtaaatttatcatactgtgatacatgaattttcgtatggtgtatcaaattgttattgagtttctaaatgtgtaaaaatg

SEQ ID NO: 7877 - DNA, 3000 bp, Unknown; identical to SEQ ID NO: 7873
  misc_feature (1)..( 3000): cDNA_ID_1809577_gDNA_ID_1621170_Annot_ID_57246 3000 nt of promoter + ATG

SEQ ID NO: 7878 - DNA, 3000 bp, Unknown; identical to SEQ ID NO: 7872
  misc_feature (1)..( 3000): cDNA_ID_1809573_gDNA_ID_1621170_Annot_ID_57247 3000 nt of promoter + ATG

SEQ ID NO: 7879 - DNA, 3000 bp, Unknown
  misc_feature (1)..( 3000): cDNA_ID_1809569_gDNA_ID_1621170_Annot_ID_57248 3000 nt of promoter + ATG
ggaggtggtgacgcaaaccatggatgatgcagcatatgcgtcgttatgacgagattcaggtttgttgcttctagcctaagtcctattttgatctcttggaaccttagatttataattttagcgcaacttgctgctgcataaagaaagtctctttaggttgtaggtcaatcaataattagttttctaaacgcaatttcataagaggaactagggtttgctcttgtagtcagttttacgaaattgacctaatttgcggttttcttgtctgttatcactttgtttcatttaggacaaattgacctttagttttcttcttgttattgtaggttcgtattcttgattcgccaaatcagtgggtgcatccgcaaaactgtttgtttggattcgtgatagacaacatattttgctatagcttggtaacgactttctatactctgtttcttattctttcttacaaaaaataataattgatttagttgtaaaatgtttttttttatttgatgattggattttttcaaaagctcttttttaatatatttattattattttaaaggttttataaatactaaattaatataacgttgtgaaatctaaccggattttggatcccgccatttaaccgtggtcattagcgattccacaaatccaacatgtttttcacatcttcatatgtatttagcatttgtatttttttttctttaaaggttttcaactctttttttatttttttaaagattttataaatactaaattaatatgactttgtgagatctaaccggattttggatcccgccatttaaccgtggtcattagcgattccacaaatccaacatgtttttcacatcttcatatgtatttagcatttgtatattttttttctttaaaggttttcaactcttttttttatttttttaaaggttttataaatactaaattaatatgacgttgtgaaatctaaccggattttggatctcgccatttaaccgtggtcattagcgattccacaaatccaacatgtttttcacatcttcatgtgtatttagcatttatgtttttattttattttctttaaaggttttcaactccttttttattttatttttattttttaaaggatttataaatactaaattaatatgacgttgtaaaatctaaccggattttggatcctgccatttaaccgtggtcattagcgattccacaaatccaacatgttttcacatcttcatgtgtatttagcatttatgtttttattttttttctttaaaggttttcaactcctcttttatttttttatttttgtaaaggttttataaatattaaattaatatgacgttgtgaaatctaaccggattttggatcccgccatttaaccgtggtcattagcgattgcacaaatccaacatatttttcacatgtatttagcatttgtgtttttttttctttaaaggttttcaactccttatttatttttttaaaggttttataaatactaaattaatatgacgttgtgaaatctaaccggattttggatcccgccatttaactgtggtcattagcaattccacaaatccaacatctttttcacatcttcatgtatatttaacatttatttttttaatttttttttcttaaaagattttcaactcttttttcgttttttaaaagttttataaatattaaattaatatgacgttatgaattctaaccgaattttggatcctgccatttaaccgtggtcattaaggattttataaatccaacatgtttttcacaaatcttcatgtgtatttagtattttttttttaaaaagtttttaactgtttctttttttcttttcttattttgattttttaaaaagtttttctatttcagggtggataaaattagcagaaacaaacaaatggaatagaatcaaatcaaaaatcaaacaaaaaccgaaaaccgaaaaaagaagagtaaattataaacataattaattaccattccccaaaaaccattcccaaaaaaactagctaccatattttcatgaaagttaaatacagaccaatcccaataataaaaaatctctcgaaagtgaagttttgcgcaaagaagtcggctcagatattatttgaagttttgaactatggtagatacttatttataaatcaattacatataaaattaccaaaagctaataaatcgtaagccacataattcacgtaagattcctgtccgtctctgaaagtgtggtcgttactcgttaccgacgaaccgttgattctatggaaacaagaaagtccagaaaaaaacaaaattgcatacacgtgaatcaacaatttatgggtcgacctgaaatatatttagaaaaataatttactaattctttttttgatagagaatttataacaaactttagtgacaagtcataatcaaaatcagatgactcatcattttccaattttcctaggacagtggatttttcatatggaccccttaaaaaataaatatattaataaatatctaaaagcttttgtaaccgttgattaattacttaaaaactcattagaagcttgattattagtggaagacagacaacctttgtacttaaataccttttatgagttttgtctgcctctaatttactctttgctacacgcttctagatccctcttccttcgtcaaaatctcatttttcttttttcttgttgatattgagaaatgacttaatcctatttcgtctccttcctcaattcaacgatgcttagggtttgccccaaaattatataaactcgtcgatacatacaaagcttgtgactagaattcgtttcttcaagagtaaagcttcctcctttcttctcctctgttttcatctctctgaaacaatggaaagaattatgataaatccattgttatcaattcaaaactccccaaccaagttcttgaaaccaccactttcgtccattcacaggcaacaacaacaacaagagaggcagagcaataacaatacccttttc

SEQ ID NO: 7880 - DNA, 3000 bp, Unknown; identical to SEQ ID NO: 7871
  misc_feature (1)..( 3000): cDNA_ID_3046796_gDNA_ID_1621170_Annot_ID_57250 3000 nt of promoter + ATG

SEQ ID NO: 7881 - DNA, 3000 bp, Unknown
  misc_feature (1)..( 3000): cDNA_ID_3046792_gDNA_ID_1621170_Annot_ID_57251 3000 nt of promoter + ATG
taaggattattatgcaagaaacgtaaaaaacaaaaacgagattctggcatttctgaatatacaacacataacggacatgcatgaagctttaaagctaatacaacaagacctttgtttcatgaagaagagagctattgaatcttatattttttacctcagctatagacatcttcttctcttcttgatggtcattcatctatttcccataagaaccgagcgtactctccaagaataatgctggccaaacacagaaggtgataatgatcacatttcagttttaaagtgcgaaaacaaaaagaagattgtgtaagagctattacatatttctaattatacctatcatttggagaggcttcaacggccttctcaaagtagaacaaggccttctcatggtcattattaatactccagaacgccttcgcgtatctgcatagcgtttctccatcttctgtcttggacaagcttgatttgccttttcccgctgcatcagcctttttcggggacaaaaataaacgccaacattagagacttgaattgaaaagccaatgaacaacaacaccaggcagaatacaaacttgaatttatatgctagtaaatgtctactatgagctaagatgcctaaaaatttcaatgtcagatcgaacaataacaggtaacaattagagtcattcattgatccgcagagtttaaaccaaataatctatagagctacgacacaaaacccacctcaaattcgtcttttccttgtccagaagactcatcatcatcctcatcatcatcctcatcatcatcatccgcgtttatctcccagaggaaactagcatatgctgcaagaacaatgctgaaaagaaaaaacatattattatcacaggaactgataaccaatggtggtatttccaaaaaatgttccaacagacctatcatcaggagatgcttgaactgcacgttcaaagtagctcatggctttagcttcatcttggtgaagcttcattactaatctaccatagtttgctaaagctactccatcactaggctcaactacagtacacttatgataatactcttctgctccactaagatctcctttatactgttttcacattaacaaacgaaacttagacattaatagaaactacttcaaaacagagccattacacaacactaagatttgagtcaaaattcaatacctccaagaacttggcatagtttttgagaagcaaaggatgcaatggatactcctcgagcattcctttgtagtaatcaccacaattcttatcatcgtaacccggcaaatcgaatttgatctcactaccatacaaatcaaacttatcaattcctaaccctgcagctaaatgcataggagggcttggtggtctttcaatctcaaaacctagttcatctctcacaccaatcccaagcttcttaataacctcttcaaaaacacctctctcaccttcaccactatcttcttccttgtgtttcgcaaaactgaactcgccgccgtcaatagcatcaccaatcgtaaccgttctctccaaattctcctcgattccagtcaccggatcttcggatttgaacccatctccagagtcgcagtaaatcgagagagatgcctcgctcttcagcatctttttgggtctttctttctaaatccgtccaaagtcttcaactttaggttcaattgggtcgtcgttcacagattcctcgattgttatttgtgggttcttgattcggaggaccccaagacaacgaccaaacgaagatgattttgaggttcttaggtgaccgacccagttagagaaacaagataagtggggttctgttagatttcctgagaaacggcaaaactcaggaaaggatcttttagtatcatattgtttacaaattattccttaactttatgttttgtctatttgacccatcactccgaagcaaaaactaatctgttcttttgttcaagaaatcatcaattagtctcggttttatactaagcatacaatttttctaacgtatatcaacatttcaatttcggtttaagtatttgtgtacttacatattcaaaaaattagtttgggttcgatttggaaggaacaaaaagttttgtgactcgtgattaaataaagaaagaagggatatccacatgagttttgacctttcttttgggcggacaataaggtccacatgaactgaggttttttgagtctagaccggggcaagtcaataatacaaaaagaggacaacttgtcaaatcattggtccattcaaatgaaaagaagcccataataaatgtgacaaggatgtgtaacatggccacaaaataatcagtttggtttcgttcattttggactatggggttggttttgaaattccattccagcacatagaatttcagaacaccaattacgaaaggctttatcgtgttagaagttatatattttgagaagaaaaataaaagatattgttattatgaaggatcatgaactattctaagactgagctaacacgtgttacttgcttaatccttacactcaaaaagtctaaatgttaatggtattaaaaattattcaccttgtttgttattcttatttctgcaaaaccagacaacaattcagtaatcaaaaggacacatacgtaagttgaaattggaaagagttcttcaccaaagctaacttgatcctcacgaacgtctcctaaaatagcaatcttcagctgaagaacaacacacgcctcctaataaactcgttgtctttctcacatacacaaaaccaaatttagcaaaatggttattattacctttctccctcctttcggaaattgccaccaccaatcaaacaatctaccttcttcttcattcatcattcacttctcagaattttgagaattttgaattgagaattgcgagagagatctcattctccctctcgcaattctccgtcccctcgaatccaacaaaaagattttaatgtaaaatcactctattgatccacaatgtcgatgatg

SEQ ID NO: 7882 - DNA, 3000 bp, Unknown
  misc_feature (1)..( 3000): cDNA_ID_2107008_gDNA_ID_1621171_Annot_ID_57253 3000 nt of promoter + ATG
ttagaaaatgatgaagatattagatattctctcgaaatcaagtcgagggccattaaaattgatgattattagaaaaaaggttataaatacttagttggaagacctagctagctaataactaagaaaattaatagaagaaactctctcttattgatatgtcgtcgtccatgcttctatattggatatagttctcgcatatgagtaaatctactatcattaatacaaaaacaataatatcaaacgcttaattagcatttgaacaataaaaatcatttatgtattcatgcataatttagacacacacacacacgcacacgcacgaatatatacatgttgtagtacactagcacttaggtctaaattttgagaactacgcaatatgacaagtaactaaatctttgttaacctaactaatgcgttgttgttgacatagatgaggtacgaaatggttgtaatatgaattcttatacacattagtatatgtggaagccaagtagccaacgaaacacttgcatgtaaatttttttgattattctttacaagcttaaacgttttttatttaacctatagaggtaaaagaaaaacagtgattttggttttgacttatataaaccgaaactctttctatcactctatagagataaatatacaaagaaatgagtaagtttctctcactatagcattaatggagctttagatcatcataaatgcattgcaccctctctatgcgctcatcaataactccttttaaatttcttattgcaactccacctgttcttttccttcctctcttgtcctcttctccttcttcttcttcaacaacaaacttccattgttcttaatacctagctagctcttccccggtttgagattatcccaaaataacaccggttctcgggtaaccggtcggtttttccggagcaaccaacccttttacttctctttatcattgtctcagatcttctgttcttcaaaggcaaaaatgggcataaaccaaagatcattgtgaattagggtttcactgtgtctccaaaagtaagatctctattatcaaaaaagatctttctctctctacacatatatgtatgcatatgcatttgtgtgtatgtatcttaggttatgtttatagatcggatccatattgcatgttgttgagactcttagatcttctatttttttgtttatggtgttttttggttctcaagatctcgatgcctatgatttgtttttttttctagattattttagtttaatttaatttaatgttttttgtgtctttttgcggagacttatgatctaagataaataaagcgttaccaaaaactttcttggagttagcagtttcaaaaggggtttgacgaaatctacttggtggttgtgtcacaaaaaaaagaccattgacttattgtcaacgctttaattaaccctatatactatatactatttttaatcgcttttaattaatcaaccctatatatcctgtattaaactaattaaacttagcctttttcattagttttgttactggaaacggttcgtctttagtgcacaaagaccaaggtcaatttaattctttaataaattcaattgagagatcagaagcttgtgaatctggttctctctctctcttctcttactagcttttgagtcgacaaaagagagagaaaagatcattaaactcgaatccaaaacttcaaccaacaaaagggaaaaaaagaaaaaataactacaaagagatctatctttagggtttcaaaactttcttgagtttcagatcgaattgagtaagtatttatattatttaagtgttcttcttactgtatcatttctgaccatacaccaaactagggtttcttaaagatcataactctctctctctcgcttcttcctacactagatctgtccgatagatctgatgctttgagaagtcttgtgactttcaagattgatttttctttttgtttgtttgtttatatgtacacatacttggagatagatatactctcatatatgttactgtgcatatggatggatccatcttaagtgtgaataaaaactacccaaatctcatttttgtttgtttcttatctcatttgttgtttttgtaaggccgtcattataaatctaaaacaatttatccgttttcgtaaagaaaatcgctttccaaaaaaaaaaactttgaagtaaaaatatcattttgggtctatattcaaatctctcctcatatttccatctcattatttgtaaaattaatatattaggtcattatcatattgattatagagtttatatgttatgttataaagtaaaagttatatatgtaaatattacgtttgtaatatatatatttatacatatgtacgtatacataatttgtatgtatatgtgcctcatttttaacaaatattatcgttaatctttagtttcattataattttttagggatgtatacattatataaatattttatgttatttatatctgaaatttctatactataacatcttagatagttttcatacgtaattaagagttttaattaatagttacataattatgattagatgaatttatctataaattgtatgcaaaaatatatacatatccaaccgaaaaaatggagagtaaacaaaaacctaacaattaatggtttagtacttgtgaaaatgataaaattattaatttaatatatagtttcataacagctagaaataactttcccttaatataattattttcttccatttccataatgattttcttcttcttcattctgtatacatatatgagcgtttcatatataatcttttactaattcgattgtgattttgattttgggcagtggaagatatacttggagaagaaaatcaaatcacgaaaatatattgatcagtgccttgaaggaaaccaaagttgacaactccaaaaatccatttcgttattaatatctaactgagtgatcatagtcaatcatccataacaatgtaccatccaaacatg

SEQ ID NO: 7883 - DNA, 3000 bp, Unknown
  misc_feature (1)..( 3000): cDNA_ID_1809637_gDNA_ID_1621171_Annot_ID_57254 3000 nt of promoter + ATG
attgcatcataatcgtttatcacccactagatcaaccgagttcataaataattaactgatatcaaaatacctgccacaacattaaacaccgcacactcagtagggcgctcaggtatcaagatatgtattggtatccaaaaaggtgtatttgccttggagctgcaagagatgagaacagagaaagatgaaaattgagaaattcatcactgcccatacattcaagacatagaaaagtaacaaaaaccataccttggaatcctggcacaggtctcggaagcacaagcaatagcattcaatttgccacaccacgcaacagcactaacacaaagaaaaggagaaaactttacaggaattgatgaaatttaaagattttccgatgggagagagagtcaaacctgaagttacggcacaattcaggaacactcatcttatgaagcaaattggaattgggctgcttaagcttaacacagaaaactgtagccggactcacaggatcaatctccatgttactactactactattatcgtcttctttctctccgtctactgatttctctaacaatttctcctcaacgacgacgagaatcggatcggtagactcaatagtctcttcctgcttctgctgtaatccttcttcctctttctcctccactatagctggagcttcgatgattcctccaccaccgctattattaaccaaagaaacttcttcttctgggttttgctgattcatgtcaacgaaagcaaacaaaaccctaaatttatagaaaaatcggagaaaagagggcaagtgtgacaaaaagtcgcgattgaaggcgacagaaagcactgtgcgttgagagagagagaaagtgtcaaagtgagaaactgttaagtggggttaacgagacgacttagtgcggggaaaattccaaaatccccacaaaatcaaaatcgaacaaaaaatgcaattttgattttagggtttggtggagtcacagtctcgtcgccgggatgcagaaaaaaaatctcggtgaaagtgatgcaaaaacgccgtcgtgtctggtcactttctctctaaatttttttcccctctttttgtaattttttactttttcttttaagagcaaaaaatgaagaagtaaattttaaatgatagttttgaatcttttgattaaggaaaatgatcataatttcattttttcttctaatttaccatcttcaaattcaaatttgtaaacatggaaaggtactaacttaatttgacatttggcatttgaggatccttgtttgacattagtttttttttttttttgctaaatttgttaatatcattacaatgagagttcagaaaatacaagaacgtacaacctatagaaaagtaaccaaggcaaaaaaaataaaaacaaggctacaatagaattagaaaagatttaggtgtgtttaacgaatccataaaagcattagccgctgccaacgcttgcgatgtcgtcgagaagtgattaggttgcgaagctcacgatccaccaatttgaagatgataagaggtgccacgcgagtagagttgtgcaaaatattaggcttaggcattagttcatttgcctcctcccaaatcaaaagttaggcttaggcataagtgtttcccatggttgttgtatctccctcaatgtagcacgaccaagaatgagaatcacttattgcttacaccaaattctttgagttacatgcatagcgtactgaaaactagttgtttcggcttctaactagatacaagcagagccatccatgagcacaaacgggtcaagctcatgcttgcggcttcaattaatataaagggaatttaatgaaaaaaaacctcaactttggccagatccatttttaaaccctaaactatgtttttagtaaaacaaaccctgaactaaaacctgttaataaacttaaccctaaacgttgtttaattactgtggggttaagtttattaacaggttttagttcagggtttgttttactaaaaacatagtttagggtttaaaaatggatctggccaaagttgagggtttttttcattaaattccctaatataaataaaacttttgcctcattttcttataactttcagtagaaaagttggttatttgcttataagattacattagagagtcaaaagtttgagttcatcttcatcttcatttgcctttttatttattttttcattttcactcattaaactagaaccaaaaaaaaattccttctttcaatctattaaatactagggatggatatgtctttgcaccatacccttttaaccaccttctcatatctaagaatgcaccaaatttcaaacttattcattccatgtttacaacattacttataagtttacttgagctagttgttcaatttaaaaatctccctatgtgaaggttgttttgcctcatcttccttctcattgtgtttattccattcattagcatccatcatctatcattgctctgtgacagtccaagatcttttgagcttttatgtgttgaccttctagtttcacataattgatcatcgattgaagttttgaactatttgttgaaaaataaataaatgtggttaatccgaactcaaattgaattgtgaggatgtgtctcatgcatgacttgctcaaaataatcagtgagcaagtattctaaaatttagactgaaaaaaaaaaaaaaaaataagaaaagaacaacaaaaaaaatgaattatgatttgtgttgcaaaccggattctaataccgagccgagagggtatgaccagatttaatttaccgctttttggtttaattcagacggctattggtcgaaccggaatgtttggtctggtttccaaaacattgatcaggactcgaaaaataaaagatcttattaaaatcaaggaagcaatcgtagtcttctgtttattgcttctccctcaaatattttcttattcgttaaggttacaaaaatcaaaaagactcgaagaaacctgagatcgaaaccccagccatg

SEQ ID NO: 7884 - DNA, 3000 bp, Unknown
  misc_feature (1)..( 3000): cDNA_ID_3046833_gDNA_ID_1621171_Annot_ID_173979 3000 nt of promoter + ATG
ctcgcttttagttcctttcttcacaaattccaactccagcgtcagcatagccagatcaaaattttcaggaggaacaaatctgcaagaacaagacaatattcagaaaccaaaaacgtattcatgccagaaaattaatataaaaacaagctgtataatcacctgctaacagataccatatcaccagtcgaaactctagcgtgtcgcctttgaatagcattgagagcaatatttccatcacggatgcttccatgtccagtaatcaccagttaagttcacaaaaatcgaaataaatgacacaatgaacaagttcaacattgtcaccgaccaaaggagcctagatttctataatccatgaaaaccagaaaaacctaacttgtactacgatcatagatcaatcaatcattataagaaccattcataaggccgagattcaaattcgaagatcgattttggtaaatttagcagtaattagccatatcacataaacaatcaactcctaggatcgcatttcgcattgcaatgtaagaaatgaatcgtaaaatggaaataagaaaggatatcagagagaaagaatgaagctatcggcaacgttggcgaggaagagatcggaaccgggaacggagaattgacggagatcggaagaagagcagtaagcgaggttagtaaaagctagatctgcggacggagtattggtcacagtcatcgtcatgacttgcgatccgtaacgacccgccatggctggggtttcgatctcaggtttcttcgagtctttttgatttttgtaaccttaacgaataagaaaatatttgagggagaagcaataaacagaagactacgattgcttccttgattttaataagatcttttatttttcgagtcctgatcaatgttttggaaaccagaccaaacattccggttcgaccaatagccgtctgaattaaaccaaaaagcggtaaattaaatctggtcataccctctcggctcggtattagaatccggtttgcaacacaaatcataattcattttttttgttgttcttttcttatttttttttttttttttcagtctaaattttagaatacttgctcactgattattttgagcaagtcatgcatgagacacatcctcacaattcaatttgagttcggattaaccacatttatttatttttcaacaaatagttcaaaacttcaatcgatgatcaattatgtgaaactagaaggtcaacacataaaagctcaaaagatcttggactgtcacagagcaatgatagatgatggatgctaatgaatggaataaacacaatgagaaggaagatgaggcaaaacaaccttcacatagggagatttttaaattgaacaactagctcaagtaaacttataagtaatgttgtaaacatggaatgaataagtttgaaatttggtgcattcttagatatgagaaggtggttaaaagggtatggtgcaaagacatatccatccctagtatttaatagattgaaagaaggaatttttttttggttctagtttaatgagtgaaaatgaaaaaataaataaaaaggcaaatgaagatgaagatgaactcaaacttttgactctctaatgtaatcttataagcaaataaccaacttttctactgaaagttataagaaaatgaggcaaaagttttatttatattagggaatttaatgaaaaaaaccctcaactttggccagatccatttttaaaccctaaactatgtttttagtaaaacaaaccctgaactaaaacctgttaataaacttaaccccacagtaattaaacaacgtttagggttaagtttattaacaggttttagttcagggtttgttttactaaaaacatagtttagggtttaaaaatggatctggccaaagttgaggttttttttcattaaattccctttatattaattgaagccgcaagcatgagcttgacccgtttgtgctcatggatggctctgcttgtatctagttagaagccgaaacaactagttttcagtacgctatgcatgtaactcaaagaatttggtgtaagcaataagtgattctcattcttggtcgtgctacattgagggagatacaacaaccatgggaaacacttatgcctaagcctaacttttgatttgggaggaggcaaatgaactaatgcctaagcctaatattttgcacaactctactcgcgtggcacctcttatcatcttcaaattggtggatcgtgagcttcgcaacctaatcacttctcgacgacatcgcaagcgttggcagcggctaatgcttttatggattcgttaaacacacctaaatcttttctaattctattgtagccttgtttttattttttttgccttggttacttttctataggttgtacgttcttgtattttctgaactctcattgtaatgatattaacaaatttagcaaaaaaaaaaaaaaactaatgtcaaacaaggatcctcaaatgccaaatgtcaaattaagttagtacctttccatgtttacaaatttgaatttgaagatggtaaattagaagaaaaaatgaaattatgatcattttccttaatcaaaagattcaaaactatcatttaaaatttacttcttcattttttgctcttaaaagaaaaagtaaaaaattacaaaaagaggggaaaaaaatttagagagaaagtgaccagacacgacggcgtttttgcatcactttcaccgagattttttttctgcatcccggcgacgagactgtgactccaccaaaccctaaaatcaaaattgcattttttgttcgattttgattttgtggggattttggaattttccccgcactaagtcgtctcgttaaccccacttaacagtttctcactttgacactttctctctctctcaacgcacagtgctttctgtcgccttcaatcgcgactttttgtcacacttgccctcttttctccgatttttctataaatttagggttttgtttgctttcgttgac

SEQ ID NO: 7885 - DNA, 3000 bp, Unknown; identical to SEQ ID NO: 7883
  misc_feature (1)..( 3000): cDNA_ID_2154662_gDNA_ID_1621171_Annot_ID_173977 3000 nt of promoter + ATG

SEQ ID NO: 7886 - DNA, 3000 bp, Unknown
  misc_feature (1)..( 3000): cDNA_ID_2154659_gDNA_ID_1621171_Annot_ID_173976 3000 nt of promoter + ATG
atagattccatgcacttttcttctcattaattttcaaagtgatttttggagaaaaaatgctatatttataagagttattactagtaaactatagttcaattaacaaaccttttggcaaataacagagttttaagatatgtgtaataagactattaaataaaagttcaaaaactttcataatcctactaattttctctttaagatatggtgaagtaatgtgccgtagagggactcaatttctagatattttgttatcttctggaaatttagctattataacaaaatttgtgagatcatgcaaatctaactccattgccaagtgaattgctcaaagcctcaaagtgttactcgagatgacgtttcagtcttttgtcgctttggagatattgtttgtcttcacaactagtgcgagaataatcaacatgcaaatttacgttctttttattttttttaataatatttccttgctatgttttgagttttgactttcttcccaaataacacaaaagataattccactcaaattcaccatcatttcatacaaattttcttacttttttctttccctatttctaagtttacattaaaataaatcaaacgccaaacactacacgatgtctacatatgtgaaaaaaaatcccaaaatgaatcagcagaaaatgcaaacaaaatccccttaagtatgcacaaagatgaccaaacttttgattttttttttctttcacctattatatgttctagattaatcgtgatacagttgatttatacgaagatttggataatacagatgatcttgaagattttggagatgatgatgatgaagaagatttctttcttctactgcttttcttcttgttatttttcggtaaatttatcggagtaactggaggtatatctcgtagtgtatctgatattcctcgttgactcgatccttgatcaaaatctatatttacaaaaagaacataatgtgattagtaaattttgactaaaagcctaaaactgtagtaaaaaagacattaggtgaacaaaatgttttgatttaagaaaataaaagggtgaataaacctcaaatctttttggtagaatgaataaacttcaatataccaaattgggtcctaattttcaaagattaaaaacaattcataaatcataacttaaagtttttcccatcttgcaaatttcattctgaaaccttcgtaaaaagttataatattttggtgcttatttcaataaagttcatttttggttttaagttaaatatatattaccaaattccatctcttatctgcaatgatgatatacaaatcttctatttattcaatctatatataaaatttggataacccatctatatttgtttacctattcaaattgtaatttgaaagtaagtggatggttaatcacatcaattttaaagaaaaaaaaccaaggaaatgaaaaagttaaaaacaaataaataacttaccagtggaagaagaagaagtgaagaaagaagtagaaggtcttgcattactgaaagatgatggtcttggagataaaagctcagccccgaccttaaactcactcatcttcacaagaaatacaaatattcactgattagctatatgaattttacttcttttttaggttttacttgttagaaactagaattttcacatataggccgaaaaggcactaaagagcttacccaaccaggagcactaccagatgaaccctcccagccaatatgagccacatgttttacatctgttggaaacccaatttctatttcatctctctctttctcaacggctgaaacataagataatattcttaaaagccaaacaattacatgagaacactctacaaatatgtgatagacatttggtataagtactcaaatattcttggtacacatcaaaaacataatgtagaagcaaatatcaaaagatatatgcactaaatgactatatatatatatatatatatatgttgaaagtttattagcaagaataatgcagtagtaaaatcgtaaaatcataaaatgtctattaaatagcatgaaaaacccctattatacatgaatatcacaataatttgtctaaaccacttttgaaaccacgctcatttacgattttatcatcgtgtcattttgcaaattaataaatcttcactgtatccctatttagcaattttcatcaaatataggtaaacaattaatatattatatgaagagagaaaatggtaaagaaagtatattaccaaatatttgagagatacatttgaagcctttatagatgcccttcattttcattgacatggtgaagaagatcacaaaacctccaaactataatgctgaatttgtcttcgattatccttcgtaagactcgattacctgaaaactatgtgtcctttctattgccaagattgaagaagccaaacaacaatctcctctctccggatgctacttcaatgttctatgttttgtttaccaaaagttctggtttcagtatttagtattttactaatcaacccacaatatatatacaaaaggaaactagtagcaaatgatcataaagatataatgcatgtgatagatgaataatgtttctcctatggaacaagattggaatttattcgtttgataaaagatctaattaagcttcaaaatttaactttataaaagcacataatgtgaaaatattttaagttcaagattggtatacatgaccattatcatatgattttgagatttttgacattataaacccatgaaattgaattattgatgatatatatcattaagaaacttaattacgataaagtttacctgtaattctataaactcgttggaaaaagaatgatataaacaagaatagcagaatagagaaacagcctctcctttgattctatgcttctttcatcttttggagaagcctctcttgataaatcacaaagcatattatgtacaaaaggaatctcaattaacaaaacataatttcgtgaatttctcacgaaagt

SEQ ID NO: 7887 - DNA, 3000 bp, Unknown; identical to SEQ ID NO: 7884
  misc_feature (1)..( 3000): cDNA_ID_1809633_gDNA_ID_1621171_Annot_ID_57255 3000 nt of promoter + ATG

SEQ ID NO: 7888 - DNA, 3000 bp, Unknown
  misc_feature (1)..( 3000): cDNA_ID_1809625_gDNA_ID_1621171_Annot_ID_57257 3000 nt of promoter + ATG
tattttgttatatttacataaatctcctttctttctccagcaacagagtgtattctgctcgataataaattggtaaatcacaacacaaaaaaaaagtgttaagagatccttctccctcttcgaagatgagcggtacggtgaaggatatcgtttcaaaggcggagcttgataacttgcgccagagcggcgcaccagtcgtgcttcacttctgggcttcttggtgtgatgcttcgaagcagatggatcaagttttctctcatctcgctactgatttccctcgtgctcacttctttagggttcgtctctgttctcttgaccaattcaaaattttatcactttcaatgaggtttttgactgttattggttttatcttcttaggttgaagctgaggaacatcctgagatatctgaggcttactctgttgctgctgtgccttatttcgtcttcttcaaggtaaagttacgttttttttgttccctatgatttgatcaaaacttaggatttagggtttttgtttttgcttaaagttgtttgtctaatttggtagaagaagaagacattgatgaagtcatacttattgattctttatgttgctttgtttggttgcaattttctgtctttatagcattgagagtgtgttcaaaagtttgaatctttgtccctatgttttgatcgaaagtttaggatttagggtttttgttttgattagtttgcgtctctgttagattactgaaagctgtttatctaatcaggtagtagaagaagatggttcgcctatccatttagctccagacttattgattctttgttttaattggttggttgcaattttctgtctttataggattgagagtgtgttcaaagcttgaatctttgtcactgcactgtaatgattgttctgaaagttgttactttcttctgactgtgaattcgttttcttattgaaggatggtaaaactgtggatacacttgagggtgcagatccatcaagtttagctaataaggttggcaaagttgctggttctagtacttctgcggagcctgctgctcctgcaagcttagggttggctgctgggccaacgattcttgaaactgtgaaggagaatgcgaaagcttctttacaagaccgagctcagcctgtatctaccgccgatgctctcaagagccgtttggaaaagctcactaattctcaccctgtcatgttattcatgaaaggtattcctgaagagcctaggtgtgggtttagcaggaaagtagttgacattttgaaagaggttaacgttgattttggaagttttgacatactatcggataacgaagtgcgagagggtttgaagaaattctctaactggccaacgtttcctcagctgtactgcaacggagagcttcttggtggagctgatatcgcaatagcgatgcacgagagcggtgaactaaaagatgctttcaaagatcttgggatcacgacagttggttcaaaagaaagtcaggatgaagctggaaaaggaggaggggttagttcaggaaacacaggcttaagtgagaccctccgagctcggctcgaaggtctggtcaattccaaaccagttatgctgttcatgaaaggaagaccagaagaaccaaagtgtgggttcagtgggaaagtggttgaaatcctcaaccaagaaaaaatcgagtttgggagtttcgatatcctcttagatgacgaagttcgccaaggccttaaagtgtattcaaactggtcaagctatcctcagctttacgtgaaaggcgagcttatgggtggatcagacattgtcttggagatgcaaaagagcggtgagctgaaaaaggtcttgaccgagaaagggatcactggagaacagagtcttgaagatagattgaaggcactgatcaattcctcggaagtaatgctattcatgaaaggttcaccagatgaaccgaaatgcggatttagctccaaagttgtgaaagcattgagaggagaaaacgtgagtttcggatcgtttgatatcttgactgatgaagaagtaaggcaagggattaagaatttctcaaactggccaacttttcctcagctatactacaaaggtgagttaattggaggatgtgatatcattatggagctaagtgagagtggtgatctcaaagcaactctatccgagtaagtaatatatacaagtctctgtctgctggtttgccttggtgagagagaacatttcagttatggtaataatatgttttaggtgttacaaacattgatattgttgcttctcaagctttgtcttgttatttctattgctgagtctattagattcataactatttttctctctttgtatcaacataatctttatttatggttatcttgaccacatttgcttttagactgagtaacaaaacaaagagtggtttaaacaaagaaagcttgatccgacggctaggattaacaccaatctttctatgttacagagtttcttaagatccgacggctgggattttgtgtgattaaactcaaatttcttagaatcaaaccgaatggaaatcatttgtttagagtttagaccaaactgcaatcgagcattaaccgagactttgtacatttaaacaagatttaaaccaaaagtcatcataattttaaaattgatactgatattgacaattagttaaatattaaactaaaatggttttggttttacatttcaatgacttttagccaaaaccgaaccataattttaccaaaccaaatttaacattctccaaaccaaataaagaacctgtataaaccgagcggacacttaaaccggaaaataaaattaaaattcggacaaagaaatttcgttaaaccctaaaccccaaaggtcttgtttgctgtatctcctccatcgctcctgcgccgcgttttctctctcaagctcttaaaaaacctttctttgatttgataatcctaaaatcgtttttccgaggaaaccctaatttcttgttcgaactcgaaagatg

SEQ ID NO: 7889 - DNA, 3000 bp, Unknown
  misc_feature (1)..( 3000): cDNA_ID_1989583_gDNA_ID_1621172_Annot_ID_57805 3000 nt of promoter + ATG
caataacgacaaaaaatgtgagaccatcattttctacggtttgtattatgtatgtttttgtggatttgtattcatggactacttcaatattcatggatttgtcactagtggatttgtcactagtggatttgtcactagtagatttgtatacttgaaaccataattatattttttatttaatttctatcatattttaatcatttacatttttatcagaacgacgtagttgtcaaatggtcataaaacccaaatttatggggtttcctatagaaacaagcttagtctcctcgtacaactttcaccacacaactacaacatggtagatcgacttggaggtatctcgattgtctgcccttgtggcgaggaagtagtgatgaaaacatcagctactccaaggaaccctggtcgtttgttttatgtatgtcccctgggatcttccgtaagtaaatctactaattatctaataatttctactacttgctatccaaaataactatcaataatacaggaaaattggaaccatttgttcaaatggacggatacatgtatcgttgaagagatccgaagattgatagaaaaagtgaataacatcgagggttctacactaaaattgcaaaaagggctaaatttttgtgattccgtgattacctctttgtcacaggagacgtgagacctagattccgttcttcgggaagacattgaagacctgagatcgcagcttagatctatgaaaatattcttgttttatttttgctctttattttattttttatgttttttaatcgctttatttccgaaattattgtaatttctgttagtatatttatcaagacctaattcgactatccatcattgcttaaccatttcgattctattatcttccttcgttttgatttattcatcctaacgagtaggattagttaattttcagagttacatattttacagaacatgacatgtaatccacttgcactagataattcaagcaacttcaagtagatatcataatctattcgtactttttagacctaatacatcaggttatcacttcaaactgacaccctttacactaatttatctgttggatattactgtttgtgaagctacacatcaagggacccatcgtcaacatgtctatttttccgatgctagtttgtagacatatccactcttatgtttttttccacattttaattatagatttatatggataacaaactaaacaattttcgttatatcaaatgatacaaaattgtcttttaatggataagacttcatgcattggagtttatatgtttacttagatggataacaaacgaaacaatttccaataacgaaaatgagaacatatgattaaatcaaaattggacattagatgtcattgtaaattaacgatcacaatctttactggtttacattcccgttcaacttaatctaatataacaaaaacaaaaacaaaaaacacctagatgttagtatccaacaaaaacaaaaacccatagaaattattattcatgagatccaccttaagcgagacaccttttgcacctttgcccaactttcttgcacctagggcacgtacgcctcaccattcttcctggctggaaaggaagatgcataatgcacattttctcgttattcatgtcaatgaacatgcgtttgtcgtgagtacattccatcggcacctcatctgatagtatcctgttgtcgactcatacgccagtcctttgttcttctctacaaactttgcatacggattatttgcggcaagacacttttggaagaaactgtagtacttagaatgaggcattgaccaccacataaaatgattgtccatgtcaatgcgaacaaaggctagggttttcctcgacataacagcatcctttccctctctcccagctagcaaccagttcttcaaatcatcaacaccatcttcagcaacttttctaacgatgatctccatcaacggctgagaaatgtgtatatccatctttggaatctcctacatattaaatgaagatatttattcacaatcattaaataaattaacattattataaaccttgctttcccgtaaatcgcccaccttatcttcaattaaacgattcatctttttataagaatgtttaaaggttttgttctatttatagattttattaaaccaataacttaaacatcgattatgtggtatagaaccggtttggtcaatgcataaatttgtcgttggttttgatttttctgtataaaatatatttaaaaatttttacattagtttagtaattcaaaaaaaattacaatccgcgtggatatttgtttccgaaaaagttgatatttgatgtgttttggcagcaattttctctctcatccaaattagatttccccatcttcctggttcaaatatttttgatgtaacattttactattttaaccatttctaaacatttgttgtaatccttgtcgttattgaaatgtttgacatgtcatggatcctcaaaaatagtgaattattgtttgtcataatctcttgtttgtggatttgttaccatgggtacaagtataaatacgtatttatccaagttaaaacaagatgatttttttgttgttttggcggcaattttccctcgcttccgaatgagaattccccatcttcccggttcaaatatttggatgtaatattcgactattttaagcaagccaaataaaattgttgttatccacgtggatcttcagacgtttaacatctgatggatttacatatatagtgatgtaatgcatggcaataacccaaattttgtggatttgttactatggatacacgttttaaaaataatttttgatccattatgtcgtgatacctaaacgatatccggttaattcgtgtagttattactagccggttgttattctaaacgattgatttattggttatgtgagatgatatttaaggaagttgcttaacccattaattgaccataaaatcactgaaacgaaaaaaacaaa

SEQ ID NO: 7890 - DNA, 3000 bp, Unknown
  misc_feature (1)..( 3000): cDNA_ID_2165672_gDNA_ID_1621172_Annot_ID_173995 3000 nt of promoter + ATG
gattttggttaggtgatagagcctattaaattcatccaaatggtcgatttgatccataggcagaccatggaacttgttcccctgaatcatcgagatgagacctctcttaatctcgaagttgttgttctggatagcaggaggtgcaattcccatcctcaaacggtgatcccttagtgcatctctagcaccaatgttcgcaggtccattttgttgattttgttcatcagccatttcaagtggttgttggtgttgtacaaggtcgactatgtttctcctttctcttagttcgcgagctatgcgatcaatgttatcgttgaaaagcaggttatggttgccggttgatcgagttcgcatacaggagaggtgtacctggatcaagaagacaacaagaaaaacacacagttagtacttgaagtgaaaattgaaaaagaacttgatgtaagcaagtctgaaatcttaaatataacaaacaaacacccaattgacaacggcgccaaattgataataggtttttagtcaattaatcctaaaacactatcctgtcgttgtagtattttatgttgtcaatctaaatgggtgtgatgctagcaatcaagatgcaatcagagtttacagagtcaagccaagcaataacaggtttgggatattttggtatgggccgaaaaacatttatatattgggccgaataatgttttgtaattgatttagtaatgaattatgtttgtaatgaattatgtttttcttattttggacagataattaaattattgtttgaagacacgttgtcttttggtgcaaacccaaattgttgaacattgtcggtcgatcgacaaatctgtagcaaaattcacagataatccacctattttagtctctgttatactttgtatatactttacagatttagttctataaagaagtatgttttttgttgcatcatatattagttttttttgttttcaaatctgtcgattaaatttataatctttgaaataatttgtttgataatagatcgtccccaagaattgtcaaaaaacaggatctgctatgggtaattattttgaaatctatatatagtcgtagatcaaatgagacggatttgatttcgttttcttttaacactacagctaacaaaatcattatgtgctacaatttcccgtgttccgaactaaaatttcttgataataagctactcgaaacacgatagaaggcttagatgttcaccttggagatttccagaattctaaatgtaaagattcctttgacttgaaaagttttcctcacctaaattatacatcgtcacttgtttctaagaatgttaaatgaaaaagattagtctttggaacttcacagaaagctaaatgaaaaagattagtttgatgttaagtacaataatacctttgtttagttgctaaaaatatatacatatatatatatatatatatatatatatatatactgttattcttaactgttgaagttgctaagtacctactcttcacctattcgaatttgatgaataaacatagttcactttgttttatcattgtatgtcgatggttttgattataataaattgcttgcttccataaactatattatcctattgtttgataagcagtaacaaacctaaatgttgtatatatgaaattgttaacttcataatacttaatctgaagttaattagactgaaaacttttagaaaacaaagttaacctgattagaaaataaagtaacataaaattaacatatgcgatttggctgcaatatcatttcttctcttcattactcatttaataacaccaacgcttgcctaatgcaaagaagagctagacaaataaatcaaaagaagagctagacaaagaaatgttagaccatttgtttcctcaatcaataatttatagtgagaggaatcaaacttgttactaatctttgattaatttggtaaacgttgaaggtgagtgaatcaaacctaatttagtataaattaatttggtatcaattaattttttaaaaaattatgagtgatgagaaacagttgttcaacttttgaaggtgagtgtattgttcttgaaaatattgggcatatatttatactaattactaaatcaatctcgtggagcattaggttaggttgagagaatatttttcagtttattaggatattaccgaataagttatgataaggtatattctttctgcaaaaggatcaatttaattaaatggattagttttggtaagtcagtatattgtcaaatgataattagtttaggagatgaatctatattctgtacaaaggcaagaaatattcggaaagcttaaatatgatatgtagatattcagaaatgttaattagttaagagatatatatatggtatcttttgaaagttacgatttattgttgattgcgttatagaataaatatctgttaatatgaattcgaatgtggtgttgttgctgtatttttgcattggaaaacggatattatgggataagaatatattcgtttagctaagattttattgttgattgccattagtttttgaatctaaatagttgctatttatttgcgtgcaggggagtgtcgtgttattgggtcatatttggaatcattggcccatatagtccagtgtaccaatctttgaatacgactggcccgataatagatcagggattcgaaatagttccgcgtttttttcaatatgttaaatgaccagtatacccatggacgaatacttgatttagtcttagacattataaaaaactactcttcaaaggttgtaaagtttcccaatgatttccaattaataatatagttgatatgacaatccttcactacattattagttacctaagattgcattatctacaaccataacttacccgactattcattgttgtttatttaagagtaggaatttcattatttttgaaatacgtaattctaagatatgtctacaccaaatatacctgacgatttgctagccaagatagccaaaa

SEQ ID NO: 7891 - DNA, 3000 bp, Unknown
  misc_feature (1)..( 3000): cDNA_ID_2165694_gDNA_ID_1621172_Annot_ID_174001 3000 nt of promoter + ATG
tctagggatggtttcaggaaatagataaattgtagatctagctatgaaaatgattgttattgaaccgttattgaactcaaactctaatatcaaaataaccggtggcattccgtgaaactcactattcctagagataagattcccggtgacgtgccgtgaaacctattcctaaacttgcatgctaaacaagtttgattagttcacctaagtagataggccgattcttattacacacctataaaccaggctcatctataatagttctgataacagatacctatggcgggtatatctattgtctaaaatcaagttctaagtgatcaatctaaaactagcagtcagaaccattatagatgaagaactctaagaataatcctaaggggttatcaatctactaatccaattaaatccctagtgagactccctaaacccaataaggtgattactgaaaaattatcaaaatctgattaaattgcattgaattataatatgaagatgagtaaaagggaggtcagaatcctctctgcaaggattagattcttctctccaaaagtgtatctctcaataaaaataagcttaggtctaaacaatgaccataaaattatgtatataggttacttaaaaacgtacagggtctattttgcaaataaggaaaatttatggggcttctcaaacacttagtgaatcatgaaaattccctttgccaaatatgggtgtcgatcgacatagatgtggtgtcgatcgacatagatgtggtgtcgatcgacaccaccgcgtgaaaacgtctcggataatcttcattgctgaaaaagcttccaaagttccttattatgcttcatagctctcaaatgcataattgcacctgtaatgactcaaaacacaagaaaaagattggaaagactaacactattctgaaactatgttagaaatcagtaaaaaccatgatatatcaatcaccatcagtcctagagacattgttcccgagtgccttgacaatttaatgaaagagacaaacaagaggacactaagatccccaccacaaatcaaaaagaacgtatccaagcccatttgattgtcaatgtagacatgagagcgtttactttctatcatcatagacatcttttccgacatccagtaactaattatgggattgcattcggtgtacttcaaactgaaaacttcgcataatatatgcacaaattccgtgtacgtcatgttttccttaacacgtacatagcgaccaaacatgcattcatctggttcaaatttcaattcttgttctttgcatctccactcacccaccatagtaaatacgagaatatccattacccacttgaattataaattcagtagaacctcatttaatgcatctgaaaacatgattatatctactaaaaacaaatagaattttgatatacacacttataaacataaatatatactcatttaccattttcaacaaataaaattggaaataaaaaagttatggggttttatataaaaaaacaatgttaatttcgaacacaatcaaaaatcctagtgtgttataacaaaaaacttcttaaacaacttcattacttacacgatcaatgtttgtcttggctccaaactttgtaaataaaaaagatcaaaactttttcaacatcacattcgttcagaatttgtttgtttcttggttcatctttatctctacaattattcacaagtataagttaatattagaacaagtaatgataatttttgtattaattgtgacgaaagtcatgtctaaacttttttgacattaaatgttgatgtcacattgttttttaatgttagtaatctctttgtttactatacaacgcacaaaacatttaaaaataaaatatgtttgcttaaccggaataatgtacgtaactaaactttataactaaatcatacacagaagagtatgtcgttacgctgacaaagataaaatagttagattttagggaatattaggcagaagggcacttttttgagttctaattaggcaatggagcactcttatgggagtatgtacttttttaagtttttttaccataagcccctcaaaagtaagttaaccatagttaatttcatgtggttgaggaattcaataatattttaaacagttaatcgactatgtttttcttttttcttctaccaattatagttatctgaacgtttaagccattgttattccaaaatttctttaccagttaggtaaatttatattttatccattgttgttctaaaatctcagttgcagatcgataatttcctcttcacaaatcgtccctttgatttcaggcacagttgaggctgatataaatgttctcgacactcgtcttcctcctaggctatttgcaactaaccgttaccctgatgcacgtctcaatatctaatccagacccgacattctgactgtaataagtgaagtattgaaaggtaccaatgagatggaaaccatcttagactcttgttttgggtctctgtttagttgaagggttagcgaatgtccaatatctagcaaactagttcatgctttgttatgtagatagttagttaccaaacagaaatacgaaatgtggactgtttttggtggacagcctcttagattctctttagttgagtttggttctgtaactagtttgccgtgtggtgaatttccgaaggagtatgaacctgactactttcctagacgtgtcaatgggacgaatgattactgggatgttttgattgggaaagataagaatgtaacactagctgatgtttcctctaagttccaagcgttaaaagggattgaggaccctttaaaactcccctggctcttcttttgattgttgatggagtccttattgctaataaccagactcatcgtcaaactttcaagtatattaagatgttagaggacattgactcattcctggctttcccatgggggagagaatcttttttgaagactattcatatcatgaggcttgttagaacaaaccgtca

SEQ ID NO: 7892 - DNA, 3000 bp, Unknown
  misc_feature (1)..( 3000): cDNA_ID_3046856_gDNA_ID_1621172_Annot_ID_174000 3000 nt of promoter + ATG
aatatatgacccatgttaagtacacaaaatatgaatgaacttaataaacaattaccagatgcttttgtggggaacaaactgaatctttgcaggtctccatggatatcccatcctgtgtagtatatcgaagttaaagtagattattgactaatatctacgaaagtatacgaactttaatcaaatgcggcagaccttatcatttttaaactcacgccataactaatcatcaacaatcttttcagaattttctgatactgtttcgtctccatcatgcactgaatcagataaaacattgactcccccttccaatgaagttaatggtggtgaagggggagttgtgatttttgtcgctctacaacagggttgacaggagattgagagactgtggagaggtgtgtttgtgagcgtactttcttggatggatgacgagtacacggtcttgacctgtaagacttgacagattgcagaaccctgatctttttcagaagatttagattctgagatcttaacttcttaacactctccgcaaattcatgccttatagaagacaactgagacttcacccacaattttatgtcttttgcttcatcatcattatcttctgcttcatcatcatcaaccatttcaaaattacgcttcctgcctcgcgtgaatgtactaactttagtttttgatggagttcctttagaagaagaagttggcgaaagtttccttttccagataactatatgtttcttgtgttcaactacaggctccttttcattgacagaaatgagcggtagatcagcataactaccaggccactcctttttggtgaaattatggcattttcttatctattcaatcaaataaagaaccttcttgtctctcacttcatcatcccactcaccccaaccatcctcattagtgtttacaaacagcttcaggataacagtcatctgaagaaacagactcagaaaattagaccaaataaaaaaagtcataagagcacatgaaagaaaagataccacaacaatgtttacaattacttacatcaggaacacgttcaaggagatgaacatcgttgatagtaagattgcttttcggtatcccaattgaatgccattccaaaaacgttctctcatctgcagaaccaggaattttgtccagtagaccagaaatgttcctataagcaagaagttgcagggctaagggaaagccataaatagctatactctgctcttgcatctgatttgtgaattgttggatgggatcttctagcttgattccaggacgagacctttttctcttagaatcagccattgacggtttgttctaacaagcctcatgatatgaatagtcttcaaaaaagattctctcccccatgggaaagccaggaatgagtcaatgtcctctaacatcttaatatacttgaaagtttgacgatgagtctggttattagcaataaggactccatcaacaatcaaaagaagagccaggggagttttaaagggtcctcaatcccttttaacgcttggaacttagaggaaacatcagctagtgttacattcttatctttcccaatcaaaacatcccagtaatcattcgtcccattgacacgtctaggaaagtagtcaggttcatactccttcggaaattcaccacacggcaaactagttacagaaccaaactcaactaaagagaatctaagaggctgtccaccaaaaacagtccacatttcgtatttctgtttggtaactaactatctacataacaaagcatgaactagtttgctagatattggacattcgctaacccttcaactaaacagagacccaaaacaagagtctaagatggtttccatctcattggtacctttcaatacttcacttattacagtcagaatgtcgggtctggattagatattgagacgtgcatcagggtaacggttagttgcaaatagcctaggaggaagacgagtgtcgagaacatttatatcagcctcaactgtgcctgaaatcaaagggacgatttgtgaagaggaaattatcgatctgcaactgagattttagaacaacaatggataaaatataaatttacctaactggtaaagaaattttggaataacaatggcttaaacgttcagataactataattggtagaagaaaaaagaaaaacatagtcgattaactgtttaaaatattattgaattcctcaaccacatgaaattaactatggttaacttacttttgaggggcttatggtaaaaaaacttaaaaaagtacatactcccataagagtgctccattgcctaattagaactcaaaaaagtgcccttctgcctaatattccctaaaatctaactattttatctttgtcagcgtaacgacatactcttctgtgtatgatttagttataaagtttagttacgtacattattccggttaagcaaacatattttatttttaaatgttttgtgcgttgtatagtaaacaaagagattactaacattaaaaaacaatgtgacatcaacatttaatgtcaaaaaagtttagacatgactttcgtcacaattaatacaaaaattatcattacttgttctaatattaacttatacttgtgaataattgtagagataaagatgaaccaagaaacaaacaaattctgaacgaatgtgatgttgaaaaagttttgatcttttttatttacaaagtttggagccaagacaaacattgatcgtgtaagtaatgaagttgtttaagaagttttttgttataacacactaggatttttgattgtgttcgaaattaacattgtttttttatataaaaccccataacttttttatttccaattttatttgttgaaaatggtaaatgagtatatatttatgtttataagtgtgtatatcaaaattctatttgtttttagtagatataatcatgttttcagatgcattaaatgaggttctactgaatttataattcaagtgggtaatggatattctcgtatttactatg

SEQ ID NO: 7893 - DNA, 3000 bp, Unknown
  misc_feature (1)..( 3000): cDNA_ID_2165774_gDNA_ID_1621172_Annot_ID_174023 3000 nt of promoter + ATG
aagtgtccgagtgttgtttagagatttggcgctgacttgatcagtgtcagaaacagagatgatggaacataggtgtgatactacattgttgttataacatatgtgtcgaacagagaacaaaaacatatttgcttaatggtactttattctctgattttcaatgattgtctctgatactttttcagaatgagactacatgaatctgtagaagaagaaaaaaacgtaattgcacccatcaaacccatcgtctcattatgtcctacaattaaaacagaaattgaaatccccaaaccgtgtttgaattattcttcaacattgggtgacaataaatgtatttattgcttttgccctcgtgaagattaattagggcataaattgtatttgtaacttccacttcttcttatttcatagatctgacaattttatttaccctaaaaaaattgcttcgtcgtcttcgttgtcgtcaactcccttaccttcgctgatgaaagacaaaaagttgagaaactgggcggagcttccgtccaagttgacgtcatcgattctacttcgtcttggcgctattgagatacttcaaaacgctcaaaaagtgtgcaaaccgtggcatcgagtctgcaaagacccctcgatgtggcggaagatcgacatagataaccgcaatgatagggcagccttcaagtacgacctcgagtcaatgtgccgtcacgcagttgatcgtagccacggtggtttgattgagatcgagatttggtactacggtactaatgatctcatcatgtacatagctgacaggttctgtttctccctagctctctttccatgttaaagagaatttggtcggtgctaatactagggttagagtgtttgctaactatagggctaagagtgatcggtgctaatccaagggttcgagtgattgctaattctgaagttataagtgattggaggattttgtgtcactctttttaaactagatttatttttatctgttctatatccttctactgaatctctgataaagcaccttggtttgcttagtggttttgtcaacgaagtgttctcaataaggttatgtttttgacttttttagtaacaattatttgcaggtcaagtaatctgaaaagccttggacttgtaaggtgctttccaataacagatgagggagttgccaaagcagtttcgaaagtaccgttgcttgaataccttgaggtttcatactgcttgttttcaggagagtctctgagagatataggccggtcttgtccgaatctgaagacactgaagctaaaccgagcccctgaaatcatgttttcaaatagtgggtttgatgataatgccaaagcaattgcagaaagcatgcctgaactacgccacctccagcttttagggaacgggctaaccaataagggcttgaacgccattcttgatggttgtcctcacctggaacaccttgatttacgccagtgtttcaacatcaaccttgttggggatctcaagaaacgatgttttgagaggatcaaagacttgagatgccccaatgactcagatgacgattcagatgatggctcagataatggtgcggtgacaacatttgggtcacaatttaatgaaaccgactatcattggtactagatattgaatctttctgaatcttgcggaaatacctttgttgttgttgctttgttttttgtttttgacaattgacacctttgttgtttgacttatgaatagtttcagtttcctttcttggtagtttcagtgtctttcctttgaacttttttaagaagttttgagggcgtgattttaagtcgttcgagaacgatgtcatgggtctttatattttttttagttggtacattactttcacgattgtttagttacatactatcaaaagtaataatattataattaattaaatttacttatgaaaaccactaattttagcatcaatccaaagccttgcgattgatagcttaaaaaaaatgttgagtagacccgtagctatagagagaatataatcgtgtaacacttttcccttggtgtttcatcaccaatttcatttgatctttatatcaacaatgtccaaaacacaaggtatggtgtccccatgcaaatcacaacatcatcaataatcactagctagtagactcttaatgattgtttacgtgatcacctaactgtataattgactatcagtagagccggaccataacacatgaagatgaaacattccaatggggctcccattttaaaagggcccaacaaaaattttattttagttaaatatgcatatattaatttttgataataagagaaaatagttagttttatacatataaatcacaaataattgtgtgatccaaaatatttataaatctaatatacaattaaataaataattcaaaattttgtttaaattggttttctatttactctatagtttttaagacaaaaatattttgttttcgtaatttaaatggggccccggatttcattggtccgggactatcacaagaacagaatataaggtgataaaaagaaataagattgtaaataacttttccttttggtaatattttttttttttgttcaatccttttggtaatgtgtaaaaattcacaaattatcaaaagaaaaagagtggatattgattttactctttacttttggtgaatgcacttttggaaattgattttactctttactgtatttgggaatatatgcattgcaagttacaagtcaatttgttaataaaagtgttgaatgttttgtttcatctacattattattcttcacctttgttctaccgggtttaggagtagaaaacaatcaaatggattctcagattgttaatcttctgaggtctaaacagtattgtgggcctaggcccaatacattatttcagtatgcttggcccaaattagtttcgtataaaataagttttaccgtgaggaactaaattgtaaaacagagacggatacggcaattgtatcctttaga

SEQ ID NO: 7894 - DNA, 3000 bp, Unknown
  misc_feature (1)..( 3000): cDNA_ID_2165766_gDNA_ID_1621172_Annot_ID_174021 3000 nt of promoter + ATG
tgccactacttggcgactaagtattggtgactgaattgcgactatttgacgactggttacaggttgaattatcgattatacattctgtttttagttaaaactgtaattaacaaacttgataaagcaactaaaaaactgtatttcacaaacaaaactgtaattaactaacaagctgtattttataaactccgaaccttaattcaaatacacacacattaatacaagttcttaagtttgataagaaaagcaactaaaggaaggggaaatgagatgttcactcctggggtggatcttgtgaagcagtagcagtctggacatcctctgtttgatcttccgaagcagaagcagtagcaccagcagactcgaggaatgcgagaaacttggggtctctttctgtcaagtacttcttaaccatcctcaagtgtttgatctcttcttgttgctcattagcaacacgcttgatatctgcttgctcagctttcaccctcaatgcctctgcctcacgatgtgcctggagagtcgcttgttcttctatcttgcagttggcttcctaaagctgtgactgcaaggtagtgaaagcagaactgcagcctgggtacttccgctttccattgatgtacctccctaagcttcccattccaaagtatacccatctcttgtttgtgacagttgactgcaaacaaaagacaagaggattattgtagaaaagatgaagcaagtgataatataaaaaaaagacaagaggaacaagaccattacctgaaggaagacctcatcatcctcctcctgagatagttctgatcgacgggaagtaccatctgacccttcatcattctcacgggcagccaacttagcttccttgttcctcaaatatgcctcatgaatttcatgcgccttcctatcaacaaaagtcccatcttttttggtatgagtcttaacgaatatctcaccaatagtaggtggtcttcccaactcaatttcctgaaatgttgttcacaaaacaattcagactcttaataaaaatcattctataaataaacaaatgtaacttactatctcttgctcaatctgtaagaaagactttggccccgatacatgtttgtgaggaccaggaccattacggtcagacattcaagctgctgatgtggttgaactcttggcaatggcttcttttgtgtcccaatacgcacacatttccttccacaatgtcttctcaatccatggcggtcgctcatttgcacgttttgcgcaagccttagaaaccatgtccttcatacgcgtttgacatattttaaagaatttttcttcaactacaccagtcagtgatggatgccatgtgtgtgtactctacaaaacaagaggagagtttgatgttagtgatcaaacaaccaaaccaaaccaaatgtaagagattaataagagatagaagttaatttattgcgaattcgaggaagtatatgtgtcttctttcagtaggtacacagctccaactgtaaaatggcccattaaacttgtttgtgaagacctttgtgatcttccgggtcagcttaccattgtcgtgaccaaaccttcaattacataaaccaattagcatatacaaacctaatcaacttagcatatatacacacattactcaatattaacgcttaacctaatcaacttattaaatatattacacacctaatcaactttgaggatacacacacacattactcaatattaactcttattctaatcaacttattaaacacctaatcaacttaataaactaagcttaccatagggtttcacacacttaacacacacatattacacacctaatcaacttagcaactctccctaatattctcagcttaccatacggttagaggctcaaatgtgggagagataaccgttgtatacttctcacggcctggctgggcaagcatgtcatgtagatttgcaagcaaagcttcagggagagttgattccctttcaagatcagccacaaactcagcatcatcatcttcatcttcctccgcgtgtgagttttgagcttgagagctgtgatgagatacataggctcgaggtagaggatttgaggcttgcggaagtagaggattggatgcttctcgttgaaccagcgctatagactgattggaggcattcttgtgaaccgccgctggagattgtctcgccgtagaggctagacgatgaacagatcctccagatctaggttgagtcgagccggatgctcaaaacagagtcgatccagatccacgaggagaacaagatccgcgaggagacccttcgcctgactggaaaagttgcgtcggaggaggatagtccctgacggatggacccgttgaaggctgtgcagtcggatgatgttcaaaatcttgaagcggggctggacgaatcaccagcgtgaactcgtagtggctgggatgaccactgggccttcgatttgatgccctagtcttcggttcaactcgaactggctgggaagaagtgggtcgatttgagggaatgtttgatacacttcctcttcctctcttgcctccaccacatgtcttcatcacttgaagctaagaaacgagagattgagaagattgaagatggattgatgaagtttaggatcgaaaggggattagggttaggttagggttcgtcgagagtgagagagtgaagagaagggggattagggttagggttaggcgtaaaatcgtttatatagtctgggtttagggctaactttactggatcgttactaaatcaagcatgtgaaagcccaattaattgcccaaataaaacatatgagtcgctaaatggtagctgtacttggtgacctattagcgactaaattaatgagtctcacattcaagactgattagcgactattgtataatatagactaattagtcgctaatacgtcactatttagttgccaaaacttacgactacataatcagtcgccgaattaagtagctaacaacgtgatttcttggtgatgacgaattc

SEQ ID NO: 7895 - DNA, 3000 bp, Unknown
  misc_feature (1)..( 3000): cDNA_ID_2165755_gDNA_ID_1621172_Annot_ID_174018 3000 nt of promoter + ATG
tagatcttaaaagaaagatagaaaatagataataattaatttatcaaaaacattttgtgaagaaagtatatttaatttgtagatagtttttaattatgctgggagaagatcaaaaaaacttttaaaaattatttgtgtgaaagcctctattattggactttaaaaaaaagaagagaaatgaagagaaaaaaaagaaggctttaaaaacttaaaaaaagaaagtaaaaagcctaattggcaacaaaaaaaactgaaagagtttagactctttttaaagccttgaaattcacttgccaatcaccccaacaatttggtctaagcaatccaacaaaagtttaagtagaagttaccaccaatctcggaggacgaagttcgacctcgacgacctatataagaaggaaaaaagaactagaaagtgattttataatcccctaagagcacctccattgatagtttgttaattagagactcataatcactcataagcaaataaagaagaaacgagatatagtctttttaaacaagaaaaactattaagaaacccatatctcacttatcttcttataatcaattatatttatttttatagtttaaaacttaatcgaaaaaatttccaaaaaaaactccacataatttttatttgaacatttaataccaaataccttttggttggaacaaatatatcatcattctgagccttgacttcatggctgatttatactagatcccaattgggtttactgttaagtataatcgagttgtgtgattataaaatgcaccataatggtttggcttgctcacgatggagctcagataaaatgcaccatactgttaagtataatcgagttacatttgctctgtttcacgtctcggaaggactaggggccgattgatagcgactgttagttttggctttacaggctttgactttaaaaatccgagctatagagaatttggctgtaaagacttcggctgtagaaactttggctattaaaatctaattggtaaaacaatgctgtagaagctgtacgtgcttgttattaataataataataaataaaatatatttagaaataaatttatctaacaataaattttattaatgatttaaaaaatatgtattattcatttattttttagaaaccaaacattgcatcatgaagttggatttactaaaaatgaaattgttaatttaaaatatttatgttaaagaaatgacaaaggtttagaaataaaataagaaataaaaattcttaaaagatacatttattgttttatgcagagacttaatatccaaagaaattagtaagaagtgggataaacttaataaaacttggatgaaggcgtggagcttgaggatcattataatatatcttgtactacatcttcaaataatctaaactgtttttagatgttgcccctctaaattagctccgagttgattgttaaatttctgaataatattttttattgagtaattgtataagtttgacttatcaaaaaaatcaaaaactttattactgattaaccaaataataaaataattattagtgaaataaaattattagtgaaatggatcttaaaagaaagatagaaaattgataacaattatttttcaaaaatgttttgtgaaaaaaatatatgtaacttgtagagagtttttaattatgttgggaagaagtaggggtgtcaaaatgggtcaaaattcatgggtcaactcaactcaattcaacccatgaaccctaatgggttgaaatttttgactcaaatgagttgatgggtcaaatgagttgatgagtcaattggtttgatgagtaaaatgagttgggttgtaatgggttaatggttttagtggtttacccaattaacccatcaaattttgtaaaattgaattaaaccaactaaaatctctaaaccaatatttaaccaacacatctaaaccaatttaataaaatcatccccaaatttaagaaatcaatcgtttctcgacctccacttcgacctatactctccaccggtctcatccacatcggagactgacaagacgacgaagactgcttcaattgaagacgacgatgatgatgtgcttgtagtgggtcaaaagggtgaggtatgtttccactggacccttctcatttctaagttctttttcgttttcttcattcgaattggcgtgaaagttcagattctgtatgcgttagtgttgtttagctcttaatttgaatcctctaagaacaaattattttaaacaagttaagccttcattcgaaacattgagttcttaagggttttagttagtgtttaagatccttgagttttgttcatttggttgatcaattgagtttaacttgaaggctttggtgattcaatctaagggatactaagttaggattgaattttggttaagataagagagactgttcttgtgtgtgtgctttgactattcttttaggatcaatttagttagactgttcttttggttaattttcactttatttgaatggctctacctttaatagactagtcttcttctagtttgtggtacttgagcgatgaagtttgagttctgggattagttacttctgatagttttgatgtgattgccaaattgttatgtgtttgtttcggtaaagggtttaagctgaaagaagatatttcagcttatgtctagggtcaaagatgatgtctatcacgtctcctcttggtttgggaaatcatgttcatgatctaacttaaccaaatttttaatgtatcatgtctaatcagagttacactcagtgtagaaatatttttagaataacaagagctaacaaaaatcgtatttagtcatatgcttgccgtattgtccaaaacagtcttcttttctctttgttttattgattctttgactgtgtctatgtgattaattcttgtatttggctaataacaggttttattaagcaatctctaacttggccttatttctatgtatagttatttgcagctgatcttttacaaaaa

SEQ ID NO: 7896 - DNA, 3000 bp, Unknown
  misc_feature (1)..( 3000): cDNA_ID_3046844_gDNA_ID_1621172_Annot_ID_174014 3000 nt of promoter + ATG
ccattcaaaaatatgaataagaataaaaaaggtttaagtgctattcagaaaataaataattcttcagaatattaacaattattttggaaataatttgtgttggaaacatgggaaaaatcgtttggatagtttgacgaagcaaaacaacatatatcataataatctcgaaacaccataattttctcagtttatcccacttcttaatgtaatttttggttactaagagaataaatgaatgagtaagacatatgtattttgtttgttgaggatatttatttcgtcatttattttaaaaaatgttgtattttaattttttattattattaaaatatatgttttgtcactatgttacaacataattcaattttgatatcatttatatttataaatatatttaataataataaatataagtaaataaaattcacagcttctacaactttttgttaccataattttctacaacataattttttaaagtcgaagtctctacagccaaactttctacaacataattttttaaagtcgaagtctttacagccacccttattgtattaagtcttaatatagtataaaaataattactttatatatctaaacagaaaataaaacatagaaaatatagtatatctattttattacgtaaaaaagttagaatatgttttgttgtacaataaaaaatgtaatgaaactcatactaaaaatttactcttttacatgtgcaaattgcaggaattatatcgagaatcattgttgcttttaaaatttaataatcaatgatatgtttttaaataaatttaactctcagataaattaacaatttatttttgaaacttatggttttaaatgattggttttgataatttatatgtttgttgtgtttattcattatatgtgaatacttagctaataaaacgggatttgtaaaacaaatatttactaatatatacacgtttataaattcttccatacactaaccgacaacgtatatactaacacatgacgttttacaaacacacaacgtatacaactatacatactataagattcatttatactataagattcaaatttgatatagactttaatactttgtaaattgggaaatatgtcagaaaaatcgccaattttcaaaaataggacgaaaaaatctccaactcctcaaacgtcgttttaatcacaaacttttggttgacttttccagaaaatacaaaagtttggttgacttggccaaattagtcatcacgttaagtctccgttaggacgacgattacagggttaataagccgttaagggcttccgtcttagcaaaacgacatcgtttctataatgacaaaatgagccataatcgatagaaacgtcgtcgttttgattcagagagatttgagaaattcccaaatcgattagaaaccctaaaagagagaaaattctgaaattctctcaatctctttccaattgatcccgatggcgaagacgcggggaggaaactggaatcctcgtcggtcgcggaggctaatggctattgcaggcgaagctaacagagcaaacataacgaatcgaccaccgaaagttgttgagatctcagaagaactggagacaaatcaaaacccagaagaaaccgcgatgaatcagatcccagaagaaactgcgacgaatcgaaacccagaagaaactgcgacgaatcgaaacccagaagacaatgtgggtgggactgttggtgaagacaatgttggtgaagacgatatggatggaggtctagaggaggaaaattgtgatgattttgaagcagattttggtgttggtgcaagagaagatggagatgcaagcaacactgatgctgacagtggaggtaaagattgtgatccccaatccacacacacttcgatggcacatcacattctccggtgactccagatgtaacagagcttgaactcattgttagagagagagagatcgaattgaagaatagaaattttagggattgaaatctgaaatcgatttgggggtttttagagtctcatctgtcattacaaaaacgatgtcgttttgctaacccggaagccgttaacggcttattaacctcataatcatcgtcctaacagagacttaacgcgatgactaatttggccaggtaaccaaactttggtattttctggaaagtcaaccaaaagttttgtgattaaaacgacatttccggagttggaaatttttccatgcaatttttgaaggttgaagatttttctaacattttccctttgtaaattatagaagataacattttatccacactaagaatccatcaaattagtataagatattaccaaaataacagacgaattaaaatgttatctcgtgcaaagcacatggtactgacctatattaatgagaatggtatgaaatttttgttattttaattacttttacatattaattattctacacaatttatgaaatactaactgtttttccttttgtatgtgcaggttgcaagaattattatatgaatactgacctactctataaaatttaacagctacatatgaccgagatatgctgagctgagattttgcagaagtgacgctttttcaagttttcaaatttagtaaaaattaaattaaaataaataaatctggcgagatatcaaatcacagccgttgattgctagcaaaaaatctgacctctttaaactgtaatagcaaaaaaatctagttaattaggctaattatctattagatcgaactttcacgttgtttcaaatttaaagagttacacagcgtgtcggccacttaaaacgatgtcgtaatgttgtttcccctcctcgacaagcgccaagcccgttaaaatccccaatttggatatatatcttttctctgtcgacgctctctctctctctctctctctctctctctctatcttaactcaactattcagtttcaattttcaaatttcagaaaccattttctctctctatctctcttcttcttctttatctcagtaatg

SEQ ID NO: 7897 - DNA, 3000 bp, Unknown
  misc_feature (1)..( 3000): cDNA_ID_2993828_gDNA_ID_1621172_Annot_ID_57807 3000 nt of promoter + ATG
gtccttatatcctccttcatcaacaaggctggaatctcaaaacgttttgatagcaaacgtagagtccgaaggcaatcaacacagacaaatttgttgaagcaatcaaatgtgaagcttccttgtttctcctgcaagaaagttctggcttggcgaagagcttgacgggctacgatcatattcttcacatcgttagacgatagaaaggacttaggcagatgtgtatacaaatccaccatatccttctggatcttcttcattgtttcacttaacccatcaaatttttccattacaaactccccaaatgtaagaatgatttcttcttccttctccggtgtttctttcgagccaagaaacattttcattacaaactctccaaatgctgtcagaatgtttttagtttcttgattctccttcctttcacttagcaacagatatttcttataactagattcagcattttcaagaatatctatgactgcctccaaactccgttcccattcattcgatggcgaaaacagttcacccaatttactaatgcgatcatcaagaaacacgttgaggagatcatcattccccctttcgtctatccccattcggactcggtttccgactaaaacaatattgccaagtccgtaagtagaatgttctgttgaagaagattccttaaatagcgccaagagccttgatgcaactgctactacagccgtgtttgtaggagtgcacacaactgttttgcaacttaggctgagaagagcaaacagaagagtagcgactgtctttgtgttaccggtaccagggggtccccatatcagtttcacactagtcttgtcgcggatttctcttgtctcaaggcaagccaaaattgcagattcttgagaagagttcaaattcgctgatcgtataatatctaacacatgattcccccaattcctagaagaaacagattgctctgtatcctgaaatatttacaagaaaaaccacagttactccacattagacgctaaagccagatcatttcatgtttacttaccgcggtatttgcttgaaggacactcttgatgagactcaagtttccatctccgttgtgcaaagccttccagatacgagtgtttgtggttaagtatataagaaaaaaacccgaacgaaacgaatattgctcatcaatggatatagatttagaggaatgaacagagaaatgtagctcatctccaacagagaacacatacgcaagaatcagtgggtttaagtcatccacgtttccttgtgactccaatgagatctccatgtttcggctcgtagttagttctatttccttgtgcaacactcgtaagtactgatatattaaccttgtttgagcttctactcggtaattttattgccgtagcctccacggaacttatgtaaaagacaggagctttccacaaacagttcaagcttgaggacaactctgtacgtgtttcctctagtagaagaggaacaaagctcttacggtattcatcaacggaacaaaacatgcctggtatcgagtatcgacctaatctcttccttgttgatatctttgttgagaatatagttgagagaagatttgattaatcagacttgtcttctcatttctctccatgtcacagaaactttctgcaacataataacaatgaaaaacttgagttaggttcctaccttatagcaggtcatagctacatagagaagtaacttggcttacaacgcaaactaaataggaagatgataagtaggaaacagtttcttcaaaagcactgatgcaaaggaatcaacaaagccacaaacgaagacaacaggaaaaagctggcttatcagtttggtctacttataaagaaggaagaggaagaggaaaggtccaaatagaataagtaatttcttcaacttccaagaataaattgtgaatatatattagacagacatataaagtgaaaatagcacattgcttgcataaactagaatttaagtcaatatttctttttatttttgaaaactgtcattagtacttttttgtttgttttacgagaaattagttcactaagaagaaatgtcagaaacttaagaacgaagcatttacggtggagaggacaccatttgtctgctatgagtcgtcataatcatcatcatgattatacgaaattagtcacatccgtaagattatattataatttgtaaaaaagtactttaaaataccacacatacaaattttatccaaaactaataaaacatttctttcgtttataaaaaactgattcaaaaagtagtaaaatggagcaaaagaatttaaatagaataataaaaatttacacttgaagatttcacataactccgttgtaaaagacaaaaaaatcgatatggttgactatacattatacaatcgctttatagaaattagaatgggcagcaggtcaagaacaaattgacaaaatgagatatcgttttcacgttttaataattatgttaaaatttagagattttgttatgatgaaacattttataaatttttaagctcattttgagcattttagagggaataagcatttttttttttgaaagttttctacttttttaaaggtacttttttaatttatttcctaatgacgtcagctgttgcgctaatatggttaacaaattttaatcacagctgttcgtttgttttggagaaagaatcaatttggtggctattattaagagttagagaagagttggttgttgtgtggatagaaccgacaatctcgtttttttttgctctccagaaggaaacatgagcgaggaggtaaaatctaaaaatttattgcggttattaaatctgttgatggttgtggattcgtgttgatggttgtgaaatgttattgtatgtaggttccaatagagagttattgtatggtcatctgcggggaatgggaatgctcggatattcaagaatggtattttgaaattaacaaaattctaatgtctagaattgttccaattcctgcagggatg

SEQ ID NO: 7898 - DNA, 3000 bp, Unknown; identical to SEQ ID NO: 7893
  misc_feature (1)..( 3000): cDNA_ID_1989577_gDNA_ID_1621172_Annot_ID_57813 3000 nt of promoter + ATG

SEQ ID NO: 7899 - DNA, 3000 bp, Unknown
  misc_feature (1)..( 3000): cDNA_ID_1809721_gDNA_ID_1621173_Annot_ID_57259 3000 nt of promoter + ATG
ctgatttcaaaaacaattaactcagaaaacagagataatctaattcttaccggtttcaaaggattttgaaagagtttctggggattctaaaaatagaaaaacttttgaagattctttggaagatgacttcacgggaaaagcgtgagtgaatttaatacttggtttcgccggtagggtttcatttgatttccggtgggtccaaattggagtgatgttgttggtgatgtagtgacgtaaataaccatagaggaaaagcagagaagaagatgaagatataagcgagataagtgtgtgttgtttttctgtatcaaaaacggcaagacaacaaccagttttttttttttttttgtcgtcagacaacaaccagtttagacacaccacttgcccctaacttttgaattcactagatgaataattttatcaatattatcaatatataggtatcatatttactcattacgttgcatataagtaccttttgaacttcaaacaacaaatcacaccaagaacaattacattcaaaagaaaaaaaatggcgaaaactctttcaatagtttatgtcgtcctagttatcatttcataaacaaattttaatttcaaattagtatctagcataacatgcaaagaagcatttgattatgtggacccgtgcctcccacacgttatgcggccatattctatcaatcaatcatattgtgaaggttttaagcatgtggaccgtcaagcgacgacaccacaaattcgccaaacctatgtcactgttttcagttaggtataaaatgatttcctcagatgaaggttcttcttgagatgccaaaagtatgtggcatagcttttgcgtttccattcgatttaaaaacaatttgccaaaggtaacgttttatattaaaagtaataatattttaacgttaagtttttttttctctgattttcttcactttttattcaatcatacatttttatgtcaatggttgtcacaacaaaaaattgttttttttttttgtagcggaaaccaattatttgataactagatcatgaccagtgttacaacgcaggttaaatttcatttagtacaaaaatttatatatcatatattttataatatagttttgatatattacgtaagtaagtgaaaaatgttaatcttatgttaacaaccacaaaatgagattgtatatatttcagttagatcaaaaaataaaatatcataaatgagccgcatctaaaaactaacatgtagattattttgagttaatttaagaaatttagtattaatttgtaattctttggttgttgaaatggagatttgtttgagttaattaggaaatttagttattttttgcaattttgcataatccaatatattttaaacatatttttggtatataataatactgaattcaacctatatatggagtttatattttcattttgaaatcccaataaaaaattgcttgtataatcaattttttttccaactatttagaggtgtcaaactctatttatataattttatcatataatattaacccgccgtctcttaaaatatttttagtgagttgaattagtttgctctttaaaattttatttccaatggtatttctaagtaattatttacaaagggtaagggtactttgttaaatatacttcccaaataatagtataagattatttcaagaaacaagtaaatgagtttaaaataaaatacaaattgtgtaccaatcaacccatttattcataatttttaattatatcttacaaaataattttaatcctttttatatatccaattaaaaaaatttaaactaaccacttataatttctaaatattttgcgcagcattaaggtttgaagaaaaaatattgggattatcaaggacattttaaatggaaatctatgtactttaatatttacataatactcaaataaattttaatttcattcatctattatgagaaactttctcaaaattatgagtgtcaattttttacaaaatgaaatcaaaatcctacacctaatcatacaatatatagtcctcggcaaaaaaaaactgattcgaatttaccgaaccaaaaccaaatcgaacaaagaggaaccaaagtcgaactcaaattgatgtactaactcaaattgatgaactcgaattgaaaatagcttggcggaagcatatgattaagactagtgtgaaaaaaataggaaaaaaatatcatttaaaccatcagtttactattttcgttggtctagtatcgtgagttaaatctttaatttatcttaacttttaatttaatcataaattttagttgacaaagccaattaagacacatcatcaaaaattatcataatcaaaaaccctaaatatccaaaatcgatttctgattttttctatatttttcttcagattttctcttcttcaacgaatttaaagtaatctctggtttctagtttttagcacatccctaactgttgtaactccacttaattaaaaaacaaagcttcgaaatcaactcgaagcccaaaacgggctacgctaaaatcgtcatacccccaccaaaagatgacctgtgttattagtttaaaacaagtatttaatcaaatagtatttattttaggacttcttctatactaaggtaggctcaatttttagagaatgcaaattatgaaagattatgtgtttttagtttttaaacaccatattttcttaaaacttgtattgatttcccatatttgttttttcgttaaagagattttcccatataataataaaaaaacaactgtttagtacatatttattaccaatacgtatctaaaaatactttcgttttttgaccgaaagaaaaataggtaataatcaatggttgataagaacttgatcatgtctcatttaccaaaaaagaaaagaaaaagaaacttgatgtctcgtccgttgaattgagagaagaaaaccttagaccacaagctcctttgcggtgacataattctgcctagtgtggtatgaccatg

SEQ ID NO: 7900 - DNA, 3000 bp, Unknown
  misc_feature (1)..( 3000): cDNA_ID_1809713_gDNA_ID_1621173_Annot_ID_57262 3000 nt of promoter + ATG
gtaagctcatggatggctaaaattcaatgacatttcaaaataatatcttggattcagaaacaattaattatatatattcaactcatgacatatataattgagtcagagtgatctttgcatattgataaagatgattatattatttgaaacattctgttgataataaatggccaccttgcccaaaaaaaaaaaagagagtaaaatatgaaacagccatcattacaaattagattaaaacaaaattaaagttgggaaaaattcaaggtggctaatacatataatctagattgtttaaccatcttcggtcggaaaaagtcagatgtgaaactccaacctcaagtatattaattacaaattgaatgatttacgtttgtcctcgatttttatttttcttacgactccttccaattagtctcgccttctatccccatattatataaccacttatttcatcgtaattacatctcaccattaaaaacttcaacataaaattttaccaccatcaacaatagaatagacggatcataattaataacttatggatgatgatccaatccatgataaacacgaacatggcaatatataactctatgtctctatctacaattactacgtacattgtcaggatctccgacaactctataaataagacttactgtaatcagtagtatattccatactaattaagtttcatacataaccatatgagaatgcaaatcatcatgttagaatttcactaatcacgtcaattaatatggcgtgtagctatgaaattattacacttaatcaattggcagatgttaatgataaattgtggtacagatgttaatttttccttgaataaaccttctaaaagttcatattctaaatttcaattaaattatggagaaatgtttttatatagaaactgtcgaatattaccttaggcccctagaaatgtaggaacggcactacatgtaccatgtcaataagatgcatccacaaatgagtaagtaaaaaaaaaaattaagtgaaagattatacacatttttaattagttttattttaaataatattttttctagaagagcctttgcttatatcatcgaaatttccaaaaataattagaagaatgcataagaaggaaaagaaaaagagaaagaacaaaagttgtaatttcttcttcacacgcttttgataaagtggagaaatttgttttcaagcttttgttttatgcccatatattcatcgcgtattcgtgtcagtgcctctattgttttcaagcacattaacaactacatgctccattaattttaatatcgtcaagcatcatatctactacttggacgtgtaatttataagtttctattcgtttgaaagttgaaattaaaaggtggaaaacaaattgaggttcttttttgaagagagtttcctttaaacagtttgttatatataaatctaaaatattagaacttttacaaaacctcatatattatataatttatgtgaatgttgatggttactatattaaatatgaggtttacaatatattttatgtatataatataatgattttaatctgatcatttacgactgaaatcgcaaactctcagaaggaaataatttaaacgttataaagcggtttagctgatttgtgtcataaccaaattaaacaagttctcttattacgcaacttaaagaggcgtgaaagtaatgtctttgctgaatttacctataaaagcaaagcaagtaacacattgtactcttacttttaatcctagtttcactgctcattcgtgtctttcttctatcaaggttactttttttagttgattctagctagctctaatctttgtttcttgcataatgcatgggtctttttgtcttgatcttaaaattttgcttctgcaactacattactcggctcttttgttgtcaatttctgtcaggattttgatttattgacaaagaatctttaaatcaaacatatttacttaatttttgttgatctgaaaagagttagaccacatttttctgatgacatttggaataatgtctgaaatcttcaaaagatgtttggtgatcttcaaagtttcgtacaatgctttactcactttaagtctcctctttggtctcgattaaatattgtctcatttttttttataattttgtgtttgatcccatgttttttaatgatgattatatatatactctggtcattctagctagggttaacccttatttttaagtttcttgaaactgtattaactaaatcttgtttcacttttgcataaattgtctctacaaggtctttctctggttaaatttggtgattatggacatggaaacatcttggagatttctcagaagtgtttgcttactttcatttatccttgggtctttttctgtctaccaaaccctttgtcttgttgacgctcaagaagacgccattgtaacactgcaagtagatgcttctaacgtgacacggcgaccgattcccgaaactctatttgggatcttctttgaggttttttcacaacttcatgacttaattataggatatttctcacccaaattctctctaagcctttattcacattgattaaagaaataatggtgactttgtgaaagtcacactttaagcatgctgcatgcatgagctaaatagaaactattttaatgtaactttactagtcatgatgtttaatgttttaatttagctctaataaaatttatgaattctgatgaaattaattacaggaaataaatcatgctggagcaggtggactatgggctgaacttgttagcaatagaggtttttgtgattttatcttggagttttctataaagcttttcattaaaaagaatggtgaataaaaatctttggttataggatttgaagctggtggacaaatcattccttccaatatctggccttggtccattattggagatgaatcatccatttatgttgttacagaccgttcttcgtgttttgagcgtaacaagattgctcttaga

SEQ ID NO: 7901 - DNA, 3000 bp, Unknown
  misc_feature (1)..( 3000): cDNA_ID_1809710_gDNA_ID_1621173_Annot_ID_57263 3000 nt of promoter + ATG
ctaatgaagaagctttcaacattttcttggttataggcttttgttagcgaatacgctgtaaacaaagcagatgctaaaaatggcaaccttttggccgctcttggtgaagcagctttcctccttggtttggaaaagaacaggttttttttttctcaaacctctatcttcttctttggttttgaaaagaaaagttaaaacactcactgtcatgtttttgttgcagtgacattgtagaaatggttagctatgcacctctctttgtcaacacaaacgatagaaggtatctctcactttagtttcaacggtttttatcggtatatcttgaatgcggtaatcagaaacaagcccgttgcttttgttttgtttttcaggtggatccctgatgcaatagtttttaactcgtctcatctatatggaactcctagctattgggtccaacacttcttcaccgagtcaagcggagcaactcttctcaattctacacttaagggaaagacttcttctgttgaagcatctgccatctctttccaaaccaatggcaaagattacatacagatcaaggtttgcttatctcccatacgcacaaaacaaatgtctagaaccaaatgaatgttctgaccaaatatgaatacacaggctgtaaactttggagaacaatcagtaaatctaaaggtagcagtgacaggattgatggcaaaattttatggatccaaaaagaaagtacttacatctgccagtgtgatggatgagaactctttttcaaacccaaatatggtaaaacatatgaagaatcaatcatacaagagttagggcttagtattgttctgaatcttgaaaacgttgctaagttgttttctctgttcttttctgtagattgtgccacaagaaagtttgctggagatgactgagcaggaagaccttatgtttgttctcccgccgcactcgttctcttccttcgatttgttgacagaatctgaaaatgtcatcaagatgccaatatctgattcatacaagaaaacttcaacaatgtgaagagaaacatcatcttggagactttcatgtcttttgtctttactcttcagtggttattaaacacataaacctatatgttcgtgaataataccaaagttagttgattataatcacgttatgcccttagattacttgatatgcaagattactcttccttggtaaaaaaaaaacaatggtaacacattagaccctaaacagttcagtcaaaggaacttacattgtgtcgtcaaaatgcagctaaaaatagcccaaagtttaattctttattgtttaaaatccttatctaacaaacattgcttctcacagtttcttgtttttttcttttcttcaaactataattagaaagacatcgagaacatatcttaatacttgagaaactaaaatcccctaaattccagcaatttatctgtcctttcaaagcaattttaagattaagagaaccataaaattaaattccattactctcacacaatttttgattatattataacattttgtatgttggagcaagatggctcccttcatcgccttattcaccggcctttgtggcttcaagaaaaacgctcggccattgggaacgattgagacgatgtatcagtcatctcctcgggagaccaaagaaagagaacaaacaaataatgacttgcagatcacgaaaagtgatgacttgtggaacaaggaaagcgatgatcgagatactaatgcatttaatgacgatagtaatgaagcggactctgagcttccgttgcctccaggaagaaaaggaacaatacgtggaacatattcgtgtaacaacatggtgttaagaagatccttgtctactaagaagaaactgagtgcgagcctaacgatccaaataccgagatcattgtccatggtcctcaaacgtgacaaggaggaggataaatctgtgaggaagaagaaactgaacgcagataattcgattctggtactcccaattatacttggagagagatgtagggttcttgatgcggaagaaggagatgaagatcaaagccaaagaatggcagagaacagaatatatcgtcctagatccatgagttcgatctcgatttcgagaaccaagtcgaacatcgatatgaatgctattcccgtagaagtaacatcagaagaacaaaaaatctgatattatgatgtctaaaatgaactagcttcatggtgattaggggttaattacttaattgttaaatctcatgaatctgagtgacatcatcgtgaaatatttcgatggagagtgatatcaccaatttagtttgaaggatcatgataaagaaaagtactcaatgacttggaagcttttttgaaacaagtagagttgtaatataaataccggttcacaaaaatgtaaacgaattgatttggtttcatatatagacatatagctaaagtgcatttggctaaagaatttcactattagacattgtttcaaatcattaaaattcacaagccaacatatttgtctttttttaatacatgtaaaatttattcgaaaaaacgtttttacatcaagtgcaacatttggtaaataaattgcgtacaaatttccaagttttcatggatctatcttctatctcattgttaacgaatagaggagatccagtttcagacttgtttgtcgagttatcgaagcaactgtacgtgctggtggtattggtgtctctccaaattattaaactctctaagatgcattcattgtaatttttattttttttctgatgaagataattttatattcatccaaaaaaaactatctaatttgggtaaaaattgagaatgacttaaggattatttagaaaataactcaaaatgtatcaaatagggttttggaaattttccaaaccgaacgaactaatcataaacaatgctgtttctgtttttcaattcaaatttggataaaccaaacaaaaaccggttcatgttcttataatttcggtttttgattccggt

SEQ ID NO: 7902 - DNA, 3000 bp, Unknown
  misc_feature (1)..( 3000): cDNA_ID_1809699_gDNA_ID_1621173_Annot_ID_57266 3000 nt of promoter + ATG
ttgaacgactagaaaagaaaaagaaggtgagtgagcaaagaaaacaaataagacaagccattgtgctatgatacaaaaaatgtggaaaagaattttgttatttatcgttttgtaaattcataaccacgatttaatttagccatctctaccgtcaaattgatacaatgaatatatctattagttatatgtgagtaacataataaacttattttggtatgtatgaaaacgtgaaaaacttgattaatgtggtgaataatttaaaaaaaaaaaggtgtatgataacgttctaaacttttcaacgtatcaaacctagctatgtgataacaatatcaacgaggatgatgacgaattctggtcaaactttcagaaacagcacattttatttttcaactttttgggatttattctctgttctatctccaaatatagatgaaaatagattctagtacttctaaatttagaagccacatatgtaacggtctaattgccagttaatgcacattatatatcggtcttacgcgtaagcaccaagactcgacgaaatcaagaactaagaaaacattgcgatcatttgatcgaaatgggaagagacctcggctggtgcttcttcgtggcgacggttttgttagcagcggtgttgttacccgcaccaaccatagcgggtcgactagagctaaagaatgaaatctcgggggtcgctagtgtccgtaaagcgaagctagccgtgcggtgctggtcaaacgaggatgacctcgggtggaatatgctaaagccgaagcaatcgcggatatggaagttcacgacaatgaacatgtggccctttcagaaaaccgagttccgttgccagtttcgtagcgggtttggaaccacgaacgaagacgtggtgacagtgttttctgtcaaggacgggtttcgaaagcaatgcggggtgggaggggacgagtgcttttgggtagcgaagagagatgggttctatctaagaaggattgtaaaagatggaggaggggatagtcgcaagaaatatgttgatgttctcaaaagcaaatgggtttggaaatggtgaaatcttcaatttaattctttttatccaacaatctttaattttattttttttgtcaataacatgcaatttatgagtcttcgttacaaccactgatatacttattcattatcttcacccctttgtattagactcacacgacgcatccttgaatattcatggggttataaatacacaaaagtataaaaagtatgtagtaatattattatttcaaatcacaagaaattcctttatccgctttagttttaataagctgaacgtccaagcctttggtccaaattctccaaattctttgttttcttagttagaaaatatccaatcaagaagatgaaacttgtgtattaatcaaattcatagtggtaggttaaaatgttgaatcacggccaccactattcgtgacttcatgtcgcattttggtccgtggactttactcttgtccgagacgaagttataaaataactagttcactccaaaattttagtactaagaatttgaatgggtaccgcggtcgggatggacaaatccatcagcaattgagccgctttatttttaaagtaaacaataaatcaccacggaccaactctatttgtatgtaaaacagatgtgcttgtagagaaagagaagtctgagacaagaggaaagataaatttatatgattaaaatacattcatcctcttaatctagtttactacattagtttaataatattacttggttaaagttaataatactattgaaaaaacagatttttttttgtttatctaatatgatttgaattttaaaaatcggaaacgaattttttaagaaatgaatagtggtatcaagttctatacatatcatcaaataaagatagaatagtatatatttgttcaaatagaaacgtttgttccgatgaatccaaataatcaattaaatactttttgatggaaggatactaaatcctaagataatatatagggaacccaaggcttttaatataaaacactgatcaaatcacttaacatccttaatcaaaacaaacaattcattttaaaacgtatatagtacaagatatacgtaaatagtatattcacaaaatgtaatagtatctctcaaaattttctcaaaatcaaaatagatttattggttcccgatatagttctgatatctcactccaacatttatggattggcatttcgtcgccacacttcatctatccaaatccaaattagagaagaagtaacatccagttgttaaataaggaacccaataaaaacaacaaacgaaaaccccaacgaaatcggaggaagaaaatataatcatgtctctgtaaattaaaaccccaacgaaatcggagtaaaaaaatatgatcatgtctctgtaaactaaaaccccaacggaatcagagtgagtcctacacgacgtgtcggcaatttactcgactatctctcctcgagactttacacggcctgccacaaaaaataagtcaaaaacttaaaatttcgtgacattagcttttctggacaaaaactccaattcatatttttatagcaacaaagagaagaagatgacttaagcaatatgagataatatctgtctttattacataaaatatagataatatctcttttttatgtgttagtttcttaatttataacttttttttggttatagagtcaaatttcccatttaacttttttgtgccaagagaaagtcagtgaaacgcgcttgttccctgcgttttgaaattagtcgtcttcgtcgctaacaaaaatctctgccaacaaaaaaaatatctcaccgcttcagaccaaaaactaatgacacatacccgagtcatctcgacctggaccgagttaactcgcgacttagctatttacttgctcttcacgtttttcgcaatcaaagtcttcaaatttctcttctcctgtaatcgaacctctgaaatatcatcgttttcg

SEQ ID NO: 7903 - DNA, 3000 bp, Unknown
  misc_feature (1)..( 3000): cDNA_ID_1809695_gDNA_ID_1621173_Annot_ID_57267 3000 nt of promoter + ATG
caagtatcacacaaactaacaatgttcattcatagactaagattgtgtgactataaaacttatgaaaaacaacttacttaccattttcataagattcaaaaccttttaaccaattgcgactgcatattaatgcttaaaccgttccagacttttgagtattgccttctcttatttggtttcgatgactttccattgtcctcatcatcatcaacatcatcagctccattgtccccatagtcatcttcttcatcatcatcatcttcgtcttcatcactaatctcaaacactttttttggttttttagatgcttcagcttcagacttttttcttctctctgttttagaggcagaagcttcatcacccttgcctcttctttgggtttttgaagcttctggttcacacacttttttcctctgcgtcataggtgttcctgtttcatctctcacttttcttttcagctctttagatcctcctgcttcatcattagcttgttgttgttcatatctagcttgttccaactcaatgactctccgagattccacatctaatgatctcaaatacccagcatcaacagaatccaacggatcctatcattaacaaaatacaaaaactagtcaagactagcaaatcaatcaaacaaaagtaaaacatctaattgtttatgtgtagtcacaaataacataccattacaagtgttagatgctctgttttgatctgaaatctgaatctaaaaagcttcaatgatcgtaaaaaagaaacttgaagagatagagaatgacttttcagtttccttgttaatcaattgagcgtgaactgctacttctagggtttgaactgcacaagaaactctaatagagagaaaaagtttgaaaggctctatgagaaatgaagggttttaaaagagttggtttttctttcgtgggctacccgcatacccgcagtccgcaacgggcttgtccactagaatccgcagtccgtaatgggcctgcccgcgaggcccgctaatttgtggacaaaaaaatcaacgtccaagctcgctccgccatggactacttggacaaagcccgcgggctagcggcccgcttgacaactctaagaataatgaataaaaaaaactcaaatgattccatttaagttgataatattcttattcaaccttgatctttatgatgaattcacccttattgttgattccctcatgtttggtaaatctactccaaatgatcaatacaataaagaagacatatccaacctaaaattcttggccaataacaaacagtttgtaacgattttagatgtttcaattacgataattcatggtgtggtccccttaatcatgtttaaaatatctaaacaaattattggtaaacgaatttccggtattgtggatataacccgaccggttgagatctggcatgtctcataacatggtcaaattatatttttttcgtatcaaattattttgactagtcaggtggccgctgttcggccacgtagcccaatcccataatcagaaaacaaagccgtgttgtgtgtgtgttttccatcgacatctcttgttaaaccaaatctcacaattattcctaaaaaaaagcttttttcctttcattttaaaatcttttatacaagtgtgtcaatttgatgatgaatctttttttttttttttttttgttttttttggagtttctcggccaaaacccgtaattcccccagacccgaaaccatagcatgtaatattagtttcgttccaagcgtcactcgaaccagagacctctaagtttcgtctaaggtttttaccaattgaactaacgacacttggtagatgatgaatatccaaattagctcataatatcttacattttataattaatgcaaataacactaaaacgaatatcatcaagagttgacattatacatgttcagatcctctagcacaaataacaatgccaccttcggaagatgtttaatcacgagtgatcgactctagagttcgactctatctcccatacataaaactaaaaaaaagttgacactatacttagttaaatctagtgttagttccttttaaatgttatgtttttattttatatatcaatgtctatgataaaatttacgaatgacttatatcacttcaaacttttagatttattttttggattgaggaacttttacaacttttttttaaccacacatttattaaatttgtacaattttaaatacacagatttgtaataatttacatttttcggaaatattgactttaattagtgaacgaaaacaaagtattataatttgtacagctttcatttctaccaatcacaaattttttatcaaaaacgttgcacaaaaatttactctcagctttattgtataactttctcgtacaacttttttttacagttttgcactattctgaaaagcttaccgctccagctaacagataaaatttttatacagttttatgttaccaatcggaaccattagttttggttttgtatctaaacttagtttttttaagttttcagttccgtaagattttcaaattttattttatttggactgacaaaggtattaattctataaattgacaaaaatgtttttatttaatttattatatacataaaaacacagaataggtattggtaatagaccggttcgatttggttctattcgaagaataaaataaccaaccactttgttaacaaaacgcagccgtattaactgtttcgggacccaataaaggaaacgtataaaactttgactccaaaaaaaaaaaaaaaacacacgcctaacctgcttcaatggaaaagtcatacatttacctaaccagaccttcttcgcatcttcgtcttcttccttcgtgatctctcaaattctctcccttttaaagtcctaaatcaaaaccctaaacccataaatccaatccctccattcgaattcttcattctctctctctctctctctcacaattactgatcggttctgaaatttgtagctatg

SEQ ID NO: 7904 - DNA, 3000 bp, Unknown
  misc_feature (1)..( 3000): cDNA_ID_1809691_gDNA_ID_1621173_Annot_ID_57268 3000 nt of promoter + ATG
tttcaaatttgtagatcgtcgatccaatccgattattcaggtttgacttgttgttaatttcctaatatgtaaaacaaaatattaatgaaaaaactaatgacaaaatcaataacaaattatgttttatggtgtatctcttgatttctatgctcgtgaactcttaaaaagatcttcttatcaagtaaagctttagtcctctctttatagatatttgtgttcttgtaggccttttgcattatttcgtcaaggtaattcaactggacgcaccaaccgcctttttgaaacggattttatgtcatcgatcaataattttgtagctcaacaagttttgtgttcaatttcaaccggaaaatggcaagcctttccatagacaagattgaaaggtgcgtagaattgtatacatatgagacatactacaagaatggaaaatccactatccatgagtttttagaatatgtagcttttagattatatgattagttatatgattttgatttggaaattttggttcaggttcagtcggtttggttctttgaacaagaaatcggtatagaacagaaatatttttgagtttttttttttcaattctaaccaaaaatattttgggtattgtcaagttatttggggtattttggatatttttgggtttttcggctatgtttgggtattttggatattttttgtatatttttgcttcagttatttgagtttctttttgtatttgaattttttcggatttttcattttggttctttggatagtttttagctattgatctaaaaataactaatattttatattattgtatttatgatattttagatatctattcagttctcggttcaatataagtttggttatggtttttaagtttaatatccattctgttagtatcttattttcaattcggtttgtgttcctctgttaaatttggtttcagttcattatatgcgaatcagtttttcttttcttttttttgctgaggactatatgtagttttagattgttgtagtattagttgtgtgttttttaattcattttgcaaaattttcataggctcatagtgttcagaaggtcgatcatgagtcgtgataaaggaattgaaatttcaatttattaagtttattgtaaatattaaggttcatatatttccatttataatgtcattgatatgattccaatttttttacttcaaaccataatgctgcacaaattatttggaaattagcagaggtttttgttttgttttgtttaaaaggataaataattatctaattttgatctaatttaaaattagcaaaaataaattgggatgaaatcagtagaaatgtttttctactattttgttcaccagtcacacccaatttggattttatttcaaatttatttacttgtttctgaaatagttatcaaatattttttttatcaacaaaaaataatttttagttgtgacaaccaatgacattaacatatatgattcaacataaaaatgaagaaaaccagagaaagaataatcttaactttaaaatattaataaaatttctaaaatttaaatctaaaactttaccttgggcagtttgttttcaaatggaattaaaacgcaaaagcaatgccacataatttaggcatttcgagaagaaattcatctgaggaataattgtatcgatgtcttgtctcgaaacatttacataggttttggcgaatttgtgttgttgtcgcttgacggtccacatacttaaaaccttcacaacatgattgattaatagattgtggttgtaacgtgtggtaggcacgggtccaggtaatctaatgcttctttgcatgttatgctagatactggtttgacattataatgtgtttgagataaatgttttttataatgtgttacggatcgttgagataaatgatcgttattaagttagagacgttacaactcgactattcaatgatattattaagagagctaggctataaaggagaatgatgttgatcaagaaaatggacaacttttgacagcttagcatcaacaacatattagaccattcatttgtaatttcagttcacatctcatcaagaaaataagtactgtctctttgattcatatttcaatctctttctttgtccattctagttcggttttgtatctaataaacaaaagagttcactccaaaaaaaaaaaatcagggaattttaatagccgagatttaaccgttttgacattgttgtttttgaataaatcagaggtgacaaactagggtttcaataacgacttctaaaatgctagctgtgataaaagatgagttctatacttttattcttgctaggtcatgtgtactttatcacaaaaaatacttgttttgtttttttatgttaagtgggaagtcgatagatcgagttttttggggtcaaaaatcggatttatatcgaaatccggcaccaacaacaaaccttttgcttctatatacagtatagttctcttacaattcacaaatcctgctagctcagcgggggttctcctcaaacaaattgaccctataattcaaataacttcaaagttcctcaataattcttatgtaagatatttaagtatttaattaataaattattctgttgaaaaaacgggatatgatctataagtagaatgccttgtcaaagtagtgcaaggatcagaacttgccctttcaagcaaaacacggacaacataaatgtgtatacattattacatagcatatatgtcaacgtatatacatattatcacataataaattgatttcattgacacttggaattcaagttggtgccacgtaaacagtaataatgtttatatatggaaagacagctttataaaagatatctaagcagaggcttttcatattcaatgtatattataagatctgcgatccgattaacataaggttttatttttgtttataagaattattcttcgaagtcattctctttggtcactttggtgagaatctgatcggaaagagagattat

SEQ ID NO: 7905 - DNA, 3000 bp, Unknown
  misc_feature (1)..( 3000): cDNA_ID_1843238_gDNA_ID_1621173_Annot_ID_57269 3000 nt of promoter + ATG
gtaacatgcgacaatgcgacatgcggatttgattttggtagttagataacaatatcactagacttatttcttatctcacttttgaggtaggaccaaagacacattaatgttgacaatctcaaacaagaaagattcaagcttaattgacatagataattaagatggctcattgagctttattgaacaagaaatgtaaaagaggaaattgtatttagattgtcaccaagaacactaaaactttagatttgatttcaaaaaaatggaaagaggagagttgcaaggttgtcttacattgatgttcttaagacaaattaatatgtatctctacttggtaaaaccctagtaacatgggttaatggacttctcatcttgggcttcatttggatccaccaattattaacaaggagaagtgttataggaacatgagaaagcaagaaggaagctaagatcatcttttcatatgcccaaaattccctagttagtcttgtttagttcatattttcttgtacctaattgctttatttcatgtaagcaatatcgcatgtacgtatacgatgtatttttatataaccctagttcttaaatatttgtaatgcttattaaaaatcacaggttttcatcttaaaacaaattggcaataagtaaaaaaatttaatgttgaatttatcaaacttccaatgtgggacaatttccctatctaataagtctttgagaatttgtgagaaacggtctaacaagaacaatccaaacttaatatattggaaataccataacaagacggatcacttatacgaaccgcagaggtgagaaacccctttatttggaaaagtgtctagtgggtcaatctggctctgataccatattagaaattataggctttcaactcaaaaccaattgacaatgagaggagaatattagtgtagaatttactacaagcattatataatattaatatatatcaaattacaactttaaaatataaagtatcatattttgttttattcctaatatgatctaatttaggaaataaaaactctaatacatgtatagtacgtacactgatatgtgccctcttgggaggaaaattgcggaaccgcatttttgcgggaaaaatattgactcacgtttttgtggaaactatacggaatcacatatttttgcgagaaaaattcattctcttatttttagctggaaattatgaaccgtattgttagcaaagaactatagaattatgttttgacgctaaaaagcgaactcgcattttttgcggaaaaatggtgagatcgtgtatttgacagaaattttgattttgagagagaatgagagatcgatgatgaaagatgtgagaaatttgtgtttgcttctgtttactaaaattggtttaaacattttattcagttatatttggtttacacatttggttattttgtcaatttggttatgggtaatccactaatctatttcaaccaattattccaacccaaatcattacactcattaatccattgattcattaattatcaaatttccaacaactcattagatccatgagttggattggtttgggttgagttgaaaaattaacttcaattcattttgacatacctataatatggtatatcatacgaaccacctaaaatatgtgatgcatgcacttattaaattgcattttacaccatgtttttgtttaagtacgtcaacattgaattagcacaatgtatacgtacaaaaaagactactttcatggtaatttaatattctaactcaacaagatatcatagaatgcaataagaagttgtcattgcaatgaggtactatcaaaattctaaaagtctcaattgtgtaattttccctaagaaatagggaaaataccatttaaatatcaaacatttacaaaatgctaaacaatgttcaaattttctttctatacttcttaagttttaaatacgaaatttctttcacagtaccaaattaaaactttgttaatatcatcggatatttctaaaaaaggaaataatttacatgatcctcaatccccgaaaaaaagtatggaagataacagttctgcatatgataaagcacctccaattttaataacgattaaaaaaaagcaaaagggtggttggtttatatttattgtcttttggatagagagtctctagtttcatgtgataaagtatcgatcgcccaaaatccattcatacgagatatgctgtgctgtgaggtgtgagcggtaaggctcgtgatgaatggcaaacgattcatgtaactattttcttttattatcttaacaaagtcgttgttactctaaatttaacacttgatcatatttctaatatgtatattctgaataatggcatggcgtcaattctaacttatgagactttaaacttataatgttcactttctcggtagcaaaaacgcttctctttgccccttaagtagaaggacaagaaatctattttttgtttcattgctcccgtttcctcacatctgcacttgctaagccaaccttggcttacttatgaccacctcgagaagaacctatttgaaaacagtctaatgccacaaaccaatcttgatgcatggacttctagttttgcgagaacgtttaatacatattatactgtatgactgttgaccaatcaattgaaaatgtgacttagtttgtgctgcaagtcgtgttccgtatgaggataacatgagataacgatagtaattaacagttcacaactgagtaaaagaatgcaacacattaaaatgatcaattgaaaagcaaagcagtccgaaaagtgtaaacaaacatttaaaaataaaaaattgttacattcaggtagagtaagcaatcccacgggattcatgtcaccttaacctcccaaaatatcatgacgctaagacaaggtaatgtatacgtcactcttctctaacaaaggctatataaaccctagattggcactaggcttccatgcaacacaaaaacatacacactactaataaacc

SEQ ID NO: 7906 - DNA, 3000 bp, Unknown
  misc_feature (1)..( 3000): cDNA_ID_1809685_gDNA_ID_1621173_Annot_ID_57271 3000 nt of promoter + ATG
tttccacatggttacgtttacgtggacaagttatcatggagacaaactagcataatttttatcttctctgtcttccatgttttttttttttcatcatttttattttctttttcaaaatcatcaatcatggtggttctctataattcttacaaatcatagaaattctgagattatctcaaaattctctatcataacttaaaaacgaagaatatattaagaatcaacaacagaacattgctgctacaattgatcttcttacacgctttatatacttaaacttgagtacttggacactcatcaatggacaactatgcttcagatgtgagttactagatgaccacttggactagagtgcttggacacttatcaatggacaactatgcttcaaatgtgagttaatagatgaccatttggacttgaatgcttggacactcatcaatggacaactatgcctcagatgaagttacatcgacaatggcctttttgctgctactcgcgttctcaacatcacgaaccgtttcaagcccagattgcttagaaggtaactgatcatggttaacatcctcacttttcattgtaatcgatgacagagattccttaatcaaggagagaaataaatggaaccaaatcaaataattgttgagagacagggaagatgatgataaatcatatgaaattgggtttttagttttgatttggaatattgagattcccgtaaaaaattgattttgattttggaaagagagagaaataaagacgatggagaaaagagttgagagagaaaatgaggagaaagcgttgtggttcagagggcaatttaggaattttgatttggtaaagtgccttctcctttcaaagtgcctatttgtggctaaagtttcaaaatagtgcctatacgtgtaatattctcaaaaaattatgaactccttttggttctgttttatccgcaaaattttcttttttttttgcctctttaacctataaattttccttttatttttgtcaacaaaatattctctaaacatttttagccatagatatgtgtacggtcgcattattaaacaataacaactgaacgtattcgaaccaaaatttttaaaataatcgaatggttagtaaactcccttatccaaactagccaaaactgaaccaaactgaaccgatgcttaaactattaattgacatatccaaaaccctagaaaatacccaaaaataatatccaaactataattttaaactcaaaatactaattatttttagaatcaaaacaatcaagtactttaattaatcaacatattcaaatcttgttaatatttatcaaagtcaaatactctattacaaaactgaaccaaaatttaatattctttataaatttttccttttttgtattttctttccgtatttttttggttaatttcttttagtttcggttaattttggttattttgataaaacctaaccaaatcgaaaagtaaccgaacagaaccaaatcgaaattcctaaaatatctgaatggttattatattaacatatccgaactaaccgatactaaacgcaaacgaaccaaaaccgactggttaatcgaatgccatgcctaccctgacaaaacaacaagattgaaaccctatatatttttttagttaatatatataagaaataaacctatattttcttaatgtatttaaatatgaataaccaataaaaaaatgtaatggtaacgaaaatatgactgttttcagatgaaaagcacctccaattattttgaaacgattaaaaagtgcaaaaaaagtttttccttttcttttggaggacgagtctctggtttcatgtgataaaagcatcgtcgagcggccacaatccataggatatgtgatgtcagcggtgaggttcgtgatgaatttacttgtttttcttaacgaacgcattgtaactctaaattaaacagtcgaaaatatatctataaacgttttcaataactctctggtgttaattcaaaactctatgctcaacattttttttttttggataactaggagataatccggctttttaccatctcacttcatcaagatgagtataaccatcaaatggccaattcaccggattttctaataagcgtaaaacatacgactatttcgactaaccaaatgaactgtacgtccaatttaattaagaggctttgatgagcataatctactacaaggaatctttgcccaaaacacaaaaaaaaacaaacaaaatctactacaaggaatcttgatccatatccttctagttttgcgcaaacctgcgatgcatgccatgctaatccccaatccaacccaaattgacgcggcggcataggcacaagaagagattaggggtggcatttgatcccataaaattattaaaatttcgcgtacatttttgtcaaaaaaaaaaaaaagtggtgtaaattcaattgaccagaaaattagcaaaatttaccttttcccaccaataaatatttgtttgaaaaggtaaatattcatatttatttatttgtatattttaaccatgatgaatgtttttattattattcccgtattccggcactgcttggcatccgtgtggtgttgatttggtagatgtcacacaacccatttctctttaccaaataaactctaaaaatagaaataatcaacggtttttttttctaatttatatatcaagagtatattttaattttatttttaatcaacagttcacagttgagagcttgagataaagaaattttcattatatcaaatataatctaacccattctcaacgtgggaaaaagaattagtatcggtgacactgagatagagtacgtgtacgtgaacccttgaacccacgggattcatgtcacctaaacctccggaaaataataagcacaatgtaatgcataggtcagtactcttctttacaaaggctatataaaccctagattggcacaaggcttccatgcaacacaacacatacatctacatattaaccatg

SEQ ID NO: 7907 - DNA, 3000 bp, Unknown
  misc_feature (1)..( 3000): cDNA_ID_1809681_gDNA_ID_1621173_Annot_ID_57272 3000 nt of promoter + ATG
agtatatatgcaggttctaaaacatgtgccaaaggaaactattgcttcatatttttgatttataacgccaactttgaggcattaaccaaaacacatacgataaaagcaaaaaaaacgaatctaaggactgcctaaatgtgtttaactccgcttaataacataaacacctaactccaatctttacggtctatcaaagcatagacaactacctagactacttttaaaacattggatatgtgtataaggcaaaaatgttaccaagaacatgctcacggtgatgaaatgttgtttttgcgaggtagtcgaaacgggttctattgctgcacccaatgcaaacttagtagttgtttgcacaaaacctgcgcataagaggttgacgcaccccgttttagagtatccatctttctgcaaatccaaatagaaagagaagttatgaactcatggaagagatttaagatgttataaagtcattagtgatttagtgatgttattacttacagtccaatatgtgaaaagacgtgtgcgggagtctccgaaaacacttggattcacctgaaataggttgatagcgatcagtttaaaatttacctcaaatacgagatatagtacttcgatggaagtaaaaatataccgcccaaccagcttctatgctttcaaaagtatctgagaggccaccaagcagccatatctgagcagagctgtagtcgctagcctgaaccctcggagggttccatacatttatatcggattgagctccaataaaattataccctaaggccataaggacagcctcctatatcattaacaaacaataagtgttttctagttaaccatatataggttttagtctaacgatttagcttttgaatggatgtgttgtttttttggttctcttttcatttttattagcaaagagaaggaaaattataaactatgaatgtagatacgaataacaaaataaattatgtttaacgtaccgatcgaagctttgggcgggcatgagttatttttgcagctgttatattgaaactacccttgtgttgaagagccttgtcgagaaagctatatctgtgaggagttttcctcccaaaatgagacggtgaagaggctctgtttgtcttctctactaactctacgtaccggtattgtccctttgggacaatttccggatttagaccaaatttgagacgttatttgttccgaagaaccgttgtttggaatagtagttttctttgtaccaaagtccacgctcggtttcatctgcatgtataaatgtagattaggtaaagatagaaactttcctaggtccaaagcaaaatataaccaaattttgtatatacaaaatctttgatttatatgatcgttatatagtagaatttgtttacctgaatcttgtggttccttaaagcgggatgatcaaaggcatgttgtttgtagatatctatacaatctattatatctccatcttcgctctacaaatcgatttgggagcttagaaaccaaaaaatatacagaaaatgtcatatcttcgcatttagatttagtccataccttgatggtcttcaaggaaggcttattaagagacttcagtttcatatcgatatctaaagaacctttcccataggcttcattgtaaaaaccacacagaatcgcaaatattaagaacaatctcattgcggaattttgttgtgtgtgtttactaggttgaaggaatagaattaggatataggctttgaatcttgaaccttcttcctacttatagagtttacaaaacctaatggtttttcttcttctagttaatatgatactatcacgcataaatattgaaaaaacggatttgtaaaccttttggtcaattcttcgtgctataaaactcagcaagcttaacgtactaaatatgaatgctccggtaattactactccgattctagatttttggtttgcttttaagtcggtgcaaaacgtaattaagttaatcctttgactatctttttaacgcctaaactatctatccttgcctaaaattttatttgctaatactttcttttgataaagccataaaaggattcatctttcacagtaaaaaaaattggaaattaaaaataaacaacaccttttctaattggtttatctatttataaacttattgattaattgtgatttatgcgtaaattgcccattataattgatctaactaaatttaagagtggaaaaaatgaaaacatgttcacacttcacaagcaagaagtaaggaagataatttaaggaagaaacattgtgagtttgaataggcaaaatttgggataagttaaaatatttaataatggttaaaccaatgtttttatttagaaaagatgcaaaaaccttaaacatcaaacattttaaagccaaagcattttaattgttatttacttaaacacaaatcaacaaataataaaacaaactgcatatataaatggctaaaaacgttgaaaatgataaaatttggatgaaaaatgagaacatcatttagttttgaaaaaaaaaaaaaaaaatctttaagatatcatttgttttgaaacagaatgagtaatagaaatatagaattatcttctattgtcgaggcgatagaattgtggtattaccatccccattacatatatattagcttaagaaaattacaaaacttatagcacacaacaaataaacttataaaataattaagagtttgcatattgatatttcttatgttaactaataattaaaaaatatgaattcaaatctctcttcttttttttaaagaacagaaaggaagaagctaaatattatgaaagtcaacccttaatacaggcttttaagttttaacaaaaatgttaggaatcaagtggaccgaactccgaaccaaaccttcttaagaaaccaaacactctagttgccttaaaataggacggctttggatacctaaccttctctgacttatgaagtcttcactttttgaaattttcaaactttctgcaaatg

SEQ ID NO: 7908 - DNA, 3000 bp, Unknown
  misc_feature (1)..( 3000): cDNA_ID_2108769_gDNA_ID_1621173_Annot_ID_57276 3000 nt of promoter + ATG
cgcaatggggagtggacaatgggcatcttacatctgggccgaagcttgtttccacacaaaccttaggatcaaggactattccatgcagctcaaatacccccagtttctatccgagtatgctgatgagtacaactgttattctacactgctccaccggaaaacatatatgtcagagccccacttttacttcggaggacctggccggaactctcgttgtccttaatctcatgttgattttgtcaatgttcattctcctgtttttttgttagttttatcttcggaggacctggccggaattttgtttgtcttctaatttaaactaatcagagaagatcttatattgatcataatcttttaatttttttcattactaacaaagcctaagaaagtggaaaacacaatagggagggtaaaagaaactgagccaaatcaaaaggaagtctctaaactgctaatcacaaattgcatcgagtcttgatgccgcggtggaaagtttcaacctctacatgtagaacaaagagacatgttgaaaaataaaatgtgataaaataatttttccgtgtatacataaaaaataaaataaactagtttcaacctctatataagtatatattaccgtcgacatcaatagtaataaaaaatactcaaatgaataaaaacaattctgtggataataagttccaccaaaaggaaggatcaaccataagttcatgacttttgggattatctttggtagttaatcttagtttcatagcacaaagaatgagccaaatgtacgttaaatatgcatatttttattaatttgtatatatagttttgtgtatgtttcttatcaacttaaaaaagaggaaaagtaaaatcatatatatatatatatatatatattatataattgaattatactataaggagaaggcaaattttaattgtgtctaagttactatatatatatatataattatgtacatataattaattttgtattaaattaaatatttgctaccctttatggagcttatataccaaattttgtattaaataaaaaataaataaatagtctttaacctttataaggtactgaaaacctttaattcgtataaattaatatatatgttttgtttcacaataactaaaaaaataagtaaaagtagaaacaacagatatgtaagctctataagtagtaggaaaaatgtaattaaggatccaaaataataatatttatattttatttgcaaccgaaaattttatagacaactcgcattgaaaatgttctcaacttgtttttataggaggcaatacttcttgcggtagggttcaattatattggtgctcaatcagggaattgtccgatgccattttccagtggaatttgatagaaaatttaaaattaagcatcaaaaagttgtctgatggcattcatcggagttgtcttgaatcaccatttttccgtttcatctcctaacgtctgtttttcacttaaaaagtctccaattccagtataacttcgtaaaacttgtacaaaacaaccgaaaaatacattaaaaacgaacaaaaatgtgacaaacaactcaaaacaaacactagacaaaggacataagacactaaaaacacaatataccacatacaattttggagacacccgcacaccgctcttcacctcttggactgtcagtaacattatgacatgactatagacattacattcactttcatgaaatttacaactactctttggatttgggttgcagaaagatgcatacagtaaaacagctccatcaacctcttatgctcatgtttcatgcacataagtactcaattagccataggtggaagcttagaccctgtttcgactttcgagtagctcggatatatatgcattatatcacatatcccttagcaccatattttctaatttaatttacaatatcactcattgccacaagtgtataaaaaccatagcaatagaagggtatcaaagttcaagtaaccaattaaattagaacactagaaatacattctatcatccaatctaagcaatcaagttaaatcattagaacaatattgaactaccgccgaagtaagatctcgtctaccggagatattgtcagattcttgcctccgttttgtatttgttgttttgatttgtaaaactttggctcaagtccaattcaggtattataatatttttaaaaaaagaatattgaactattaataaaatcttaacattttctgttggtccctagtacttttgatgggctctctatatcttcgcttttgtatgtttgaagcattaaggccgaattcatttaaaactcaacttctataccaaaaattttattttaaattttatgtaattaaaataaactaaccaattttttaaaaattactattttaatcacatataaaattaagttttaatttatctttctatacaaaaatatcatcattaatgaaattaactaatttattatatttttttaatcattttttcacttataaattttatctaaaactgaatcgattaatttcttatatctctaaagatatccgtatggtaacaaaattgactccaaacatttcttaagtcgatttctaaaaccgctccaaaagaccattgtgcattaaaaatactaaaaatctaaaatttaaaatattctcaataacaaacatttacgaaccactgaattttattttattttaaaaataatctataacataataattgttttatctgttttctaacacaaattattctaaatacatgattgaaatacatttctaaattggcgttttatagactatagtattttgacaactttgttttcaatattggcgtttcattattttggtgaaagattcccaacttataaaaaaaaaaaacgaatttttaattttcgtcctaatcatttatttcctaaccaaagaaaaaggcaaatcgcgacccgtctctctctctctctctctccttgaaatcgaaagatcaaaaaagcgacactgaaa

SEQ ID NO: 7909 - DNA, 3000 bp, Unknown
  misc_feature (1)..( 3000): cDNA_ID_1809665_gDNA_ID_1621173_Annot_ID_57277 3000 nt of promoter + ATG
ttaagatcactagtaagttgtaatttattattagaaaaacaaattaaaacctaggttgcctggaaattcgttttgaggtatgttttccgttttcgaaacgtttcggaaatagagactcgtcggaaacacaaaaaatgttacgaaaacacgtttttaaaaaatctatttttggaaatacgatggatccgaactagtcacacgacaaatcctttttattgactttagaaatttaataaactaaattagaaatattaagattactaaagtatataacttattttgaaagactttgagttttaagatcttttgacaaaccaaatttgatgaaactaattaaaatgagaatgaaaatgttggtctaaattaaatatttgaacttaaacattttaatctatatcttttagaattttaattaacttatttaatattaatgtcttggacttgtgttgtttaagccatttttaatataatttcatgctaatatacatatatatatatatatgtaaatatatgtatatatatttccaaaatgtttctaatctctaattttagaaaaaaccgtttctcatatccacataatcgttttctttccatgcaacataaattaaaacaatataaaaaaaacttcttattttcttttggtaaacaagacttttgggcaactggtcttcaacaaacatattccgaagcaggctaattcggagtatatgagtctggagatcctttaaactttagactatgtatgtcctctgcaaaatttactctctggtttgtgaatcacctgttttaactttgtttataagttcgttttatggtttctgtaagattttactattagctacaatacaaaagattttgtaaattagggaaatttgcatttataacctacaaaaatattataattaagtaaataacattctcaaaaaaagcaagcaatattgtttgtattttctgtaataatgccaatactatccctgtttgaaatacacgcttttcatcttctcccttccatagaaaaccaactattttctttcgccaactattaacttttgaacataggtttggctctaacaaattccagtccaccgtttatgaagcttttgattttgccaacgattaacagaggtatattgggcacaaaaacaagacagttaatttttggaaatgacatttaggttttgctcgaaattgaattagaggttttgatttacagaggcacgactttagattttgttggggtctttggtttttttaagagactttggttttggtttttgaaattcaattagtcgagattctcgctaataagcgctgaatttgatcaatctctgttctctgtttccttcatttgatttctttttttcggtctctctaatttattggcgtcgttgtttccttatcctgaaccaataaatcgattttgattttgagaaatttttgagagatactattctattttgtgaatatactatttacgtataccttgtactatatacgttttaaaatgaattgtttgttttgattaaggatgttaagtgatttgattagtgttttatattaaaagtcttgggttccctatatattatcttagggtttagtatccttccatcaaaaagtatttaattgattatttggattcatcggaataaacgtttctatttaaacaaatatatactattctatctttctatgatgatctgtatagaatttgatatcactattcatttttttaaaaaattcgtttccgttttttaaaattcaaatcatattagataaacaaaaaaaaatctgtttttacaataatattattaactttaaccaaataatattgttaaactaataaagtaaacaaaattaagaggggtgaatatatattagtcatatatatttctctttcctcctgctagtggcttctctttctctccaagcgcatccgtgggaaagagttgagtgtattttcacaactgacatgtgctatcaaataaattacatacattatagtactatatatttaataactttttcaaaaaccgtcattttttgcaattcaccctataaattaacactttataaaaactataattaaaaataaaatgaaactacatgttgatatacagagcaacacctcccaatagaggtttggtgagtaattattatataacaatagtatcaatttattagaacaatcgaatcatattctagattctttcatcaatttttttttaaaatcattctagattatagataactttgactttacttccgacttttcaaacggcacatttttcttggcaatatatttcagagaaatggcctattaattactctttgattttttataatgttcgcgtctttgaattgaacaacccaacttttagcatactagctctttaagcacacttttatttttttcacaatttggccaataatgttctagaaggaccgcatatcatatgattagtcattattggtgcttaacggagactctgttttttgccaaattgaaagttttagatttcatgctaatagataagagtgatgttttaaaacatatttgaaaccaaagttccaaactaataccattagtaaaaatcatttacttataagttataagccctcgtcatggcccattttacatggttttggattttagatcgtaaagagaatacaacaaaactgtagacaaaacgaaatcaaaatttcgaatcaaaaagttgtacttgtacagtatataagtaactaatcgtcaaatgtgtatccagttaaaatcgtcacatatgtagatacaatgacgtaatgagtacccaaacatcaaatctctatttttattacaaaaaaaaaaaacacatctcatcgatgacttcacctactcttctctataaagacttgaaaaaaacttgaaaacttcttcaaagtttgtatccatttcacattcacagtcaaactcggttgccgaagaaatttcccggcaaaacctcaacaaacaaaaattagagaatg

SEQ ID NO: 7910 - DNA, 3000 bp, Unknown
  misc_feature (1)..( 3000): cDNA_ID_1809657_gDNA_ID_1621173_Annot_ID_57279 3000 nt of promoter + ATG
agagattatagtcagaaaaactataataataagaagataacattaaacggatagattcatgtctcttttttgaaatccaaaattgggtaaaatccaaaaaccaaaatcttgccaaatgccaataagagcaaaaatccaaactttcctttctcttcactattacacaatgaaatcaacactacattttcacatcaaaatcacattccttccatggccttcttctccatgatctccattctccttggctttgttatctcctccttcatcttcatcttcttcttcaagaaacttctctccttctccagaaagaacatgtctgaagtctccactctcccctctgttccaggttttttttttttttttttccgattttgtaatctgggttttgcgattcataggtttggtgactacttctgtttcaaagtttgaaactttctttgattctagtgatttatggaactaaaaatttgatctttgagaactttaaaagttgggtttttgatgtagtggtaccagggtttcctgttattgggaacttgctgcaactaaaagagaagaaacctcacaagactttcactagatggtcagagatttatggtcctatttactctataaagatgggttcttcttctcttattgtcctcaattctactgagactgccaaagaggttagctttctaggtttgattgatatgtttggaatcgaaaaatcgttcctttttcgatcttgaacacatgactaaagccttacacaacttgatgattgctcttgtttatatgattgtagtctgaacttatgtagaaaagttgagttgatgtcttctcttatcgtttaggttactctttatgtgtttgttttcaggccatggtgacgcggttttcgtctatctcaacgaggaagttgtcaaatgcgttgacagtccttacttgtgacaaatctatggttgctactagtgattatgatgatttccacaagttggtgaaacggtgtctcttgaacggtcttttgggtgctaatgcacaggtgaattcattgttcgtttatcccgcagcttctccttggtatacataatggcaactgaatcaatcttttgtgttgtgttggttttttttgcagaaacgaaaaagacattacagagatgcactcattgaaaatgtgtcttccaagttgcatgcccatgctagggaccatccacaagaacctgtaaacttcagagctatatttgagcatgagcttttcggtgtagcattgaagcaagtgagtgtttcgcttatcctatacatcatttcttcgtcaacataaagtatgaaaatggatttttggttttgttttcataggcttttgggaaagatgtggaatccatttatgttaaagaactcggtgtgactttgtcgaaagacgagatcttcaaggttttagtacatgacatgatggaaggtgcaattgatgttgattggagagacttcttcccatacttgaaatggattccaaataaaagttttgaagcaagaatccagcaaaagcataaacgtagactcgcagtgatgaatgctctgattcaagatcgactgaagcagaatggttcagaatcggttagttttgtttgaatagtctttcatatattgcattacactgctgatctaatctctacttataaacaggatgatgattgctatctcaacttcttgatgtcggaagcgaaaacactaaccaaggagcaaattgctatcttggtttgggagacgattatcgagacagctgacactactttggttacaactgaatgggccatctatgagctcgctaagcatccaagtgtccaagatcgtctgtgcaaagaaatccaaaatgtctgcggaggagaaaagttcaaagaagagcaattgtctcaagttccttatctcaatggagtctttcatgaaacgcttaggaaatacagtcctgctcctctagttcccattcgctacgcccacgaggatacgcaaatcggaggctatcatgtccctgcaggaagtgaggtaaacctacctattactctcaagtcattcacatttgaagttcacttacaaagtctagtttcaaaatcttgatgtgtagattgcaataaacatatatggatgcaacatggataagaagcgttgggagagaccagaggactggtggccggagcggtttcttgatgatggcaaatatgaaacgtcagatcttcacaagacaatggcgtttggagcgggaaagagggtttgtgctggtgctcttcaagcatctctcatggcaggcattgctattggaagattagtgcaagaattcgagtggaagcttagagatggcgaagaagagaatgtggatacatatggcttgacctctcagaagctttatcctcttatggctattatcaatccaaggcgttcttaagacagaaatctcttctttcttttgttagtttttaaccttgtatcaacttttatttgtaacaaatgctgttttgtagtactatttatgttttactgtgttatattttactatcctctgagattgcatcatcttattgattcttataggatgctgatggaacatacctagagcaacaagataactaaaacattgattaaagcaacatattaataggattgatgattgatgacttcgagcaaaaaaaattaaacatgactttttgagtttttagatgtgaaatttggttgttttgctgtgtggatttccaagtgtctatttttttttttttttttgtgtctatgtttttgatttgtcaagatttaagttatttaacccctaacgactaagctaaccacttgatattgtcgcatgtgtacaaacgggtcaacgacgtaacgagtacccaaaattcaaatctcttaatggataactccacctgatagaaactctttaatttcaaagtttgtatacatttcatattcacagtcaaactcggttgccgaaatttcccggcaaaacctctgacaaaccaaaatcccagaatg

SEQ ID NO: 7911 - DNA, 3000 bp, Unknown
  misc_feature (1)..( 3000): cDNA_ID_1809653_gDNA_ID_1621173_Annot_ID_57280 3000 nt of promoter + ATG
tgagaccccacacggctatgaaccatgttaccatatattctaagtgggtttttaatttgataaccacctacctataactctaaattagtctattggatttttctaatgatcatcatataaatttattctctttatataatagtaatcgttgtaaataatatatgtgtgtctcccatcaatccgcatcacattcgtagaatcatacacgtatgtaaacgcatttttgacatacggaaaccatacaagtaggatctgttaggtggttattaattcaaaataaaatctcttttcattagaaaatataaagagactacttttataaaaagattgggattgtagttccttgccaaccacccatataataatactccccaacaccaaaaacacaacacaaacttagaaaaatggaagaagaaaagagattggagctaaggctagctcctccttgtcaccaattcacttccaacaacaacatcaatggatctaaacaaaaaagctcgaccaaagaaacatcattcctttccaataacaggttctcttaatctcttctcatgaatgatttgaatcattcttgttcattgtagatgtcttatatgataataaaataaaaataaaaaacaaaatcctggtaattctacagttttcggagattagtttgggtttcggtatctagttatcaaaaagtatttgtgtatatgttataactagatatggctaaaacagggttgaggtagctccagtggtgggatggccgccggtgagatcatcccggagaaacctaacggcacaactaaaggaggagatgaagaagaaggagagtgatgaagagaaggaattgtacgttaagatcaacatggaaggagttccaataggaagaaaagtcaacctttcagcttataacaactaccaacagctttcacatgccgttgaccaactcttctctaagaaagattcgtgggatctaaacagacaatacactttggtctacgaagacactgaaggagataaagttctggtcggggatgttccttgggagtaagttttaaatcaaacaaaactaattccatttttttttctggaactgaatatgaacttactttatcaaaaattcattttatatctatctacttttgtttttgtcgaatttaacaaatatttttagtatgagttcctaaaaagagtttggccatttctcatcagattattattttcctttaaaggtcatatttttggatatttatctgataataatttgaatcattggacatattaatgatatagtttactttatttgttaggatgtttgtatctactgtaaagaggttgcatgttttaaagacctcccacgccttctcactctcacgtaagattacaattcttacgaaactttttcatacatctcatcacttaattactgccttgaaattaacttatatatttatttattttttcacagctagaaaacatggcaaggaatagagagaggttggccaaaatcatcagttcgatggtttgtttttaatgtaatttttgtggaaactaatggggtttggctttgatttactggttttctttttcacttatgtactaggtttttgcttgctatgttatttcttgttttggttgtaaatatgctgttcgtttaagaaatcgggggttagtatgttatcgtgtgtataaaaatagtgtaagcacgtaagttgattacaatgcctgatatgattcatgccttcgtttcgttttttagtagggaaaatggtatttaattagcgaaatcaaaccgactcattttatgtttttttcagagaggtaaaaatccagagagcctgtttactatgtatgagtaaagattacccgaaataatagagaaatagatacaagaggctatccaagtttggtgggttcgagttttataacaccatccaaaaaaaattgttgttttgtaacacacatgagtaccaattgtttatttcacaaaagacaaaccatttatttcatgaactgtaatcttgttatgttcatgaattatttcggtataacatgtaattaactcgagtaatatcttaaaatagtatttagagtaaagatagtagggagaaagatactttatttttttataactcatataattttaaaaatttcatacacccaaaaattgattatggagtatggaaaaaccatgttaaattacttaaattttggtggctaatactactcgaactcagatggtgaaaacgactttagacttcattaatataaatatatatatatatatatatatatatatatatttatatgagtttttacttattgtcaattggttttggaattagtaatctatgaaacttaacatagtatcagtctatcagaggttgaacattcgctgacccgttaatccaacttggaaaatggtccgattacctctactaattgatgatccaaagaaaaactcaattatgtcgagataggtaaaaaaacattattttaaaagaaataatgaatttaaaattagtaaataaaatttaaaatttaaaaattctcctataaattttgtgtctcacaactttctttcaaactttttttcttcaaaaatataccgtatgctgatgaaatttttatctttaccaattaagaatataatcttttgtttccatctcaaatcatcatcatcacctccaaagcgtttagcaaccccaaaaccaaccacttggcgactacacagtattttactcaaaacatcacaagtttctatgaaacgtaaaacgatgagtttagtaaaaaaaaactagagattatagtcagaaaaactataataataagaagataacattaaacggatagattcatgtctcttttttgaaatccaaaattgggtaaaatccaaaaaccaaaatcttgccaaatgccaataagagcaaaaatccaaactttcctttctcttcactattacacaatgaaatcaacactacattttcacatcaaaatcacattccttccatg

SEQ ID NO: 7912 - DNA, 3000 bp, Unknown
  misc_feature (1)..( 3000): cDNA_ID_4359668_gDNA_ID_1621173_Annot_ID_174066 3000 nt of promoter + ATG
gtatgtttaagggtttagtttaaaatcttgtttattctcaacaattttaactcaccaacaaagatgtacgtacattattatacatgtacgtacataacatttttcaaaagtacgaggaacaactatactctgaccatataattttatttaattattatatatgaatagatttatgatgaaaaccccaaaagatattttatctaatcaaaataatcaaaagtttctaatgtacaaactcaataaatattttgtatgtcgcctttacaataaaacaacatctaacatgtttatttctattttaaataatattttatttattatcatttgaagacaattcacgattagcaatatcatataaacatatgtgcgtaacggtaataatatatacgtacacggtagtaatgtgtacgtacacggtagtaatgtgtacgtacacggtagtaatgtatgtagtaatgtgtgtgtacgtataccgtaaattacatatacgtacaaattttttttttaatgaagggtataattgtaattttgcactcgtcttcaacctctgcaaccctaattttgcagccgcttgttaactcattaacatccgaaactcctcgccgccgactactcttctttatctccgccatttgagtatgaacaataattcaagaaaccagaaaatcctctttttgttatcctttatcacgagctcgatcgaaatttcctcaacttaagcaacgaatagaactcgcacagagcctcaatcgaactttcactttcgatcggagtttgtgtttcgtcggaattgttattcgtcttcgacaaacagtttttgattttctttggttgttagaaagttaataacgtatttttgatttaattttaaatttaaattttggtaatcagaaaaataaagaaacgaaactgaaccgcctcctttcatttctcgttccagggcaaatttgtccatttttggctgaatggctaaaatctggttgggcgagcccactttgtctctttgtgaaagaaaaagtcagaaaggtgtcaacggtgaaaatttcttttttttaaacgggaaaaatgtcgttttatacgtgaactttcaaaaagtggacattcaatacgtgaactttgcggtcggccaaataaaacatgataaaaacgttgacccgccatttaacacaaatcaaaatgttgaccaggccaaaatcccgagacgttaactggcattaacagatctgataaccgccgtaagcagacgttaattgtttctgttaaagtcgaaaacgacgtcgtttcacgaaacaataaaatccccaattcaattttgaaatccctaattctatcatcttcttcactcttcttccatagctaattgaaatcccaaattcttctatcttccatatcttcttctatcattttctttaagtttgatttcgaaatctctaattttatcatcttcttccattgtttgatttcgaaatcctaattcttccatcttcatccatctttctagctccgtcgattaccaagtatctcctccatgtgaatatacttataccaaaagtggtccacgtgaggaagaatcttcacagctcaatcccaaacgttcctcgcatggttgacgtctttgttccatagcttcattaagcaaccatggatgataaaagatgatatgaaagctatggaagtttgattaagttagaagatggacgaattagggattgaagatggaagaagatgatagaattagggattttaaaattgaattggggattttgctgtttcattttatatgaaacgacgtcgttttcgattttaacagaaacaattaacgtaattaacgtctgcttacggcgggtatcagatctgttaatgccagttaacgtttcgggaattttggcctagtcaacattttgatttgtgttaaatagcgggtcaacgtttttatcatattttatttgactaatgtcaaagttcacatattgaatatccactttttaaaagttcatgtataaaacgacatttttataaacttgacgaagaatctatctacctccaagatttgttattaacggaacttgataagacgttggcgtgtaaattttttcataatattgtggtaccgatgaaattcaaaaagctgtcactgaacggtgattaatatcgtaataaataactaataaattgtcgaacgattctttttttctttagtaatgttgataggcttatagctaatcgcctaatcccctacgtgtgaacactagaaatagcctgaagagacaagtttactagtactatgccattgaaatgcgtgacatttacagtgatacaaaattactattgctttcctttgttagtttagcaactaaaatttaattaaatggcttctgacaggagtatatttaaaggcttaaatttgatttgtgacaatttaaagtcctttatgatttgtgaaaaattttggattcttttttaaccaagtgattaaaacttatctatatcaacaatggtcttttataactctcttgcttttgtgtttaggtacatttaacgaaagataaagaaacaaaaagtgacgaagaagggtttaattgcaacacttgatactttatggtttaaaatacatcccaaatttagtgagtgatttgtagtttgacaaatttcgaagaagggtttcattgtaacatttgatagtttagggtttaaatcaaatctcaaatttagtaaggtaggtttacataaacaaaaccaagaagttgtgttttgttttgcaattttctcaaagacaagagtacgagactcgtcgacgtctttcttcctcaacttcgacaaaagaaaataggattatttcagaccataagtcattgtctccgcctacaaaatcggcgattattaatcacattgtcttcttctatgtttgatccactttaatctcttcataaacatcatttttcctctaaaagctttttcctttactcatcttttctcttctgatcaaaattgtgaataatg

SEQ ID NO: 7913 - DNA, 3000 bp, Unknown; identical to SEQ ID NO: 7911
  misc_feature (1)..( 3000): cDNA_ID_1809653_gDNA_ID_1621173_Annot_ID_174063 3000 nt of promoter + ATG

SEQ ID NO: 7914 - DNA, 3000 bp, Unknown; identical to SEQ ID NO: 7909
  misc_feature (1)..( 3000): cDNA_ID_1809665_gDNA_ID_1621173_Annot_ID_174060 3000 nt of promoter + ATG

SEQ ID NO: 7915 - DNA, 3000 bp, Unknown; identical to SEQ ID NO: 7908
  misc_feature (1)..( 3000): cDNA_ID_2108769_gDNA_ID_1621173_Annot_ID_174059 3000 nt of promoter + ATG

SEQ ID NO: 7916 - DNA, 3000 bp, Unknown; identical to SEQ ID NO: 7907
  misc_feature (1)..( 3000): cDNA_ID_1809681_gDNA_ID_1621173_Annot_ID_174055 3000 nt of promoter + ATG

SEQ ID NO: 7917 - DNA, 3000 bp, Unknown; identical to SEQ ID NO: 7905
  misc_feature (1)..( 3000): cDNA_ID_1843238_gDNA_ID_1621173_Annot_ID_174050 3000 nt of promoter + ATG

SEQ ID NO: 7918 - DNA, 3000 bp, Unknown; identical to SEQ ID NO: 7904
  misc_feature (1)..( 3000): cDNA_ID_1809691_gDNA_ID_1621173_Annot_ID_174048 3000 nt of promoter + ATG

SEQ ID NO: 7919 - DNA, 3000 bp, Unknown; identical to SEQ ID NO: 7903
  misc_feature (1)..( 3000): cDNA_ID_1809695_gDNA_ID_1621173_Annot_ID_174044 3000 nt of promoter + ATG

SEQ ID NO: 7920 - DNA, 3000 bp, Unknown
  misc_feature (1)..( 3000): cDNA_ID_3046902_gDNA_ID_1621173_Annot_ID_174033 3000 nt of promoter + ATG
aaaggaaatgcttttagaagcaaatggaacagataatggtgcaagacttcagtttacaactaccaaaaaaggttcaatttggtttgatcaagtctcagccatgcctatggatacttacaaggtttgtttacttcattgagacaacggcttatagagtctagcagcattttcaaggcagagtaattttgatttttcttgatttggtcacagggacatggtttcagaaatgaccttttccaaatgatggtcgatctaaaaccgcggtttatccgattcccgggtaatttctagagagtaaaatagcatttcacttggtaaaatatgtatgaacataaaaaatgagaaaagctaaaagaattagcaatgttttgggagttaggtggttgttttgtggagggtgattggttaggcaatgcattccgctggaaagaaaccgtgagagcttgggaagagagacctggccattatggtgatgtttggaagtactggactgatgatggccttggccactttgaattctttcaagtaagggatttttttcttttcggttctatatccatttaaagtgtttcaataattactaagctcgaaacaaatatttcttgtagcttgcagaagaccttggtgcatccccaatatgggtgtttaacaatggtaattcttaagctctatatctcaagactttgctttatttacatgtattaacctctgagtgactgtttcagggatcagtcacaatgatcaagttgaaacaaaaaatgtcatgccttttgttcaagtatactcatgaaactttctattttaataaagagagtgatagtaattcattagtaagccaaaaattaaactaaaatgtgtatttctctgtctaaggaagcgattgacggtatagagtttgctcgtggagattctaattctacatggggatcggttcgagctgcaatgggacatccagagccttttgaactgaaatatgttgcggttgggaatgaagattgttttaagagttactacagaggtttttgcatttctctctgttatttaaaaccattttgaaagatacaaacaagagagctttggttatactaacttaaatacacaactttttacaggaaactatcttgaattctataatgctatcaaaaaagcttatccagatattaaaatcatctccaactgcgatgcatcggctaaaccgctcgatcacccggccgattactttgattaccacgtaaaaaatacaaaaaacaaaaaaaaactttcaaattttaccattcatatcattgattttgacagaatcttgttattcagatttacactcttgcaagagacttgttttccaagtcccatgattttgacaatacaccgcgaaacggtccaaaggtgcggtaatagatgaaacaaaagagttcattttcgacaatgaaaaactgcggttattcgccttgtatattcttctaatgaagaagctttcaacattttcttggttataggcttttgttagcgaatacgctgtaaacaaagcagatgctaaaaatggcaaccttttggccgctcttggtgaagcagctttcctccttggtttggaaaagaacaggttttttttttctcaaacctctatcttcttctttggttttgaaaagaaaagttaaaacactcactgtcatgtttttgttgcagtgacattgtagaaatggttagctatgcacctctctttgtcaacacaaacgatagaaggtatctctcactttagtttcaacggtttttatcggtatatcttgaatgcggtaatcagaaacaagcccgttgcttttgttttgtttttcaggtggatccctgatgcaatagtttttaactcgtctcatctatatggaactcctagctattgggtccaacacttcttcaccgagtcaagcggagcaactcttctcaattctacacttaagggaaagacttcttctgttgaagcatctgccatctctttccaaaccaatggcaaagattacatacagatcaaggtttgcttatctcccatacgcacaaaacaaatgtctagaaccaaatgaatgttctgaccaaatatgaatacacaggctgtaaactttggagaacaatcagtaaatctaaaggtagcagtgacaggattgatggcaaaattttatggatccaaaaagaaagtacttacatctgccagtgtgatggatgagaactctttttcaaacccaaatatggtaaaacatatgaagaatcaatcatacaagagttagggcttagtattgttctgaatcttgaaaacgttgctaagttgttttctctgttcttttctgtagattgtgccacaagaaagtttgctggagatgactgagcaggaagaccttatgtttgttctcccgccgcactcgttctcttccttcgatttgttgacagaatctgaaaatgtcatcaagatgccaatatctgattcatacaagaaaacttcaacaatgtgaagagaaacatcatcttggagactttcatgtcttttgtctttactcttcagtggttattaaacacataaacctatatgttcgtgaataataccaaagttagttgattataatcacgttatgcccttagattacttgatatgcaagattactcttccttggtaaaaaaaaaacaatggtaacacattagaccctaaacagttcagtcaaaggaacttacattgtgtcgtcaaaatgcagctaaaaatagcccaaagtttaattctttattgtttaaaatccttatctaacaaacattgcttctcacagtttcttgtttttttcttttcttcaaactataattagaaagacatcgagaacatatcttaatacttgagaaactaaaatcccctaaattccagcaatttatctgtcctttcaaagcaattttaagattaagagaaccataaaattaaattccattactctcacacaatttttgattatattataacattttgtatgttggagcaag

SEQ ID NO: 7921 - DNA, 3000 bp, Unknown
  misc_feature (1)..( 3000): cDNA_ID_2147566_gDNA_ID_1621173_Annot_ID_174026 3000 nt of promoter + ATG
ggtcaaaaaacgaaagtatttttagatacgtattggtaataaatatgtactaaacagttgtttttttattattatatgggaaaatctctttaacgaaaaaacaaatatgggaaatcaatacaagttttaagaaaatatggtgtttaaaaactaaaaacacataatctttcataatttgcattctctaaaaattgagcctaccttagtatagaagaagtcctaaaataaatactatttgattaaatacttgttttaaactaataacacaggtcatcttttggtgggggtatgacgattttagcgtagcccgttttgggcttcgagttgatttcgaagctttgttttttaattaagtggagttacaacagttagggatgtgctaaaaactagaaaccagagattactttaaattcgttgaagaagagaaaatctgaagaaaaatatagaaaaaatcagaaatcgattttggatatttagggtttttgattatgataatttttgatgatgtgtcttaattggctttgtcaactaaaatttatgattaaattaaaagttaagataaattaaagatttaactcacgatactagaccaacgaaaatagtaaactgatggtttaaatgatatttttttcctatttttttcacactagtcttaatcatatgcttccgccaagctattttcaattcgagttcatcaatttgagttagtacatcaatttgagttcgactttggttcctctttgttcgatttggttttggttcggtaaattcgaatcagtttttttttgccgaggactatatattgtatgattaggtgtaggattttgatttcattttgtaaaaaattgacactcataattttgagaaagtttctcataatagatgaatgaaattaaaatttatttgagtattatgtaaatattaaagtacatagatttccatttaaaatgtccttgataatcccaatattttttcttcaaaccttaatgctgcgcaaaatatttagaaattataagtggttagtttaaatttttttaattggatatataaaaaggattaaaattattttgtaagatataattaaaaattatgaataaatgggttgattggtacacaatttgtattttattttaaactcatttacttgtttcttgaaataatcttatactattatttgggaagtatatttaacaaagtacccttaccctttgtaaataattacttagaaataccattggaaataaaattttaaagagcaaactaattcaactcactaaaaatattttaagagacggcgggttaatattatatgataaaattatataaatagagtttgacacctctaaatagttggaaaaaaaattgattatacaagcaattttttattgggatttcaaaatgaaaatataaactccatatataggttgaattcagtattattatataccaaaaatatgtttaaaatatattggattatgcaaaattgcaaaaaataactaaatttcctaattaactcaaacaaatctccatttcaacaaccaaagaattacaaattaatactaaatttcttaaattaactcaaaataatctacatgttagtttttagatgcggctcatttatgatattttattttttgatctaactgaaatatatacaatctcattttgtggttgttaacataagattaacatttttcacttacttacgtaatatatcaaaactatattataaaatatatgatatataaatttttgtactaaatgaaatttaacctgcgttgtaacactggtcatgatctagttatcaaataattggtttccgctacaaaaaaaaaaaacaattttttgttgtgacaaccattgacataaaaatgtatgattgaataaaaagtgaagaaaatcagagaaaaaaaaacttaacgttaaaatattattacttttaatataaaacgttacctttggcaaattgtttttaaatcgaatggaaacgcaaaagctatgccacatacttttggcatctcaagaagaaccttcatctgaggaaatcattttatacctaactgaaaacagtgacataggtttggcgaatttgtggtgtcgtcgcttgacggtccacatgcttaaaaccttcacaatatgattgattgatagaatatggccgcataacgtgtgggaggcacgggtccacataatcaaatgcttctttgcatgttatgctagatactaatttgaaattaaaatttgtttatgaaatgataactaggacgacataaactattgaaagagttttcgccattttttttcttttgaatgtaattgttcttggtgtgatttgttgtttgaagttcaaaaggtacttatatgcaacgtaatgagtaaatatgatacctatatattgataatattgataaaattattcatctagtgaattcaaaagttaggggcaagtggtgtgtctaaactggttgttgtctgacgacaaaaaaaaaaaaaaaactggttgttgtcttgccgtttttgatacagaaaaacaacacacacttatctcgcttatatcttcatcttcttctctgcttttcctctatggttatttacgtcactacatcaccaacaacatcactccaatttggacccaccggaaatcaaatgaaaccctaccggcgaaaccaagtattaaattcactcacgcttttcccgtgaagtcatcttccaaagaatcttcaaaagtttttctatttttagaatccccagaaactctttcaaaatcctttgaaaccggtaagaattagattatctctgttttctgagttaattgtttttgaaatcagagacctttaagtattctgattccattagagactaaacccattccaaagttttcgtttttacgttctgggtcgtgttagattcttgtttttgtggttcctgaactaagcaatgattgtttctatgaattcttcagcattgttgatgacttgatcaaagagagtgtaagcaatg

SEQ ID NO: 7922 - DNA, 3000 bp, Unknown; identical to SEQ ID NO: 7912
  misc_feature (1)..( 3000): cDNA_ID_4359668_gDNA_ID_1621173_Annot_ID_57282 3000 nt of promoter + ATG

SEQ ID NO: 7923 - DNA, 3000 bp, Unknown
  misc_feature (1)..( 3000): cDNA_ID_1809783_gDNA_ID_1621174_Annot_ID_57284 3000 nt of promoter + ATG
gtccttgctaggtaatcttctttcttatggtataacatttcttctctcttctttatttgtggtctatgaaagaaataccacaacctggcttacaatgagcgacatattatcaagaaaatagaaatgacttcggatttcatcgactttcagtggaaaggacatgatgcttcctagccaagaagaagcaaagcggcttcacgggttacttaaaaactgttcagttcgatgcttcaaggacaatgggcatacccttttattggtaatttaacatagtaatttacatactaaattactcttgagtttccttttgttccggatggtaggtgaagctattaagtagtattagagtaatttcttacaagaagagaaaaacacagagtagtatgactatttattcattgacatactaccatttattgtcccaggaagatagcatcagtttgctcacagttataaaaggtacaggcaagtaccggcggtcctggagatatgatttggtttctgatttcttgcctccaagtaagggagaacttgcttacgcccttgatgaagtgcttgggtaactttgctaagccttccttgactctatttctcttagaaaaaagttccatctactaaatattcaaaaactttctccaaaacagttgacactacaagttaatgtgtctcgttccttgatctcctcaaatgagcaaaagagaaccaaatgtacttagcttcatgtgatttatctggtctgattttattccttgtgatatgcagattcttgcgaaatgctgttggttctgtgtttttttcaactatggaagacgggaaaatagtgaagggacttgctggtgttccagataaaggtccggtgctacttgttggttaccacatgttgatgggtcttgaacttggtccaatgtccgaggcgtttataaaagagaagaacattctctttcgtggaatggcccatccggttctgtattctgataatgatccagctaaggcgtttgattatggtgactggattaaagtatttggtgcctatcctgtcaccgcaaccaatctatttaagctgttagattctaaatctcatgtccttctcttccctggtggtgcacgagaggctctccataaccgggttagccatctttcaattctttttttttctagtttggtttaagaaaaattagtagccaaaaggagagtggttccacccacttgacggtgaaatcaaagtcttgactatgcagttgaacctgtttaagctcaaataatactaaaatgatttggttatctgagatcttctgtttctttgtcctaatagaagtgtgtacttaatttattaacctggtggtgttgttagaatttctgatgatacatatactactttctatgacattgcagggtgaacaatacaaactaatttggcctgaacagcaagagtttgtaagaatggcagcacggtttggtgcaacaatagtgccgtttggaacagttggtgaagacgacatagctgaagtaagcttcctgtcacagaaaaacttcccaaaaaatttgaatttcgtgtgctcagttattgaaaatagtcatttataaatatatttttcttttgctattgcagttggttcttgattacaacgacctgatgaagatccctattcttaatgactatatcacggaagttactcgcgataccaaacaatttaaattgaggtaacattgtttttcatataactgaaatagatgctaatgagtgtagttgttactagtcaaagattgatgagtactattgtttgtgatgatagggaagagtcagagggagaggtggcaaaccagccactctacctaccaggactcataccgaaagtcccgggtaggttctattacctgtttgggaaaccgatagagacaaagggaagaccagagcttgtaaaagacaaagaagaagcaaatcaagtttacttggaggtaaaggcggaggtagagaatagtatagcctacctgttgaagaaacgagaggaagatccatacagaagtgtcttagacagattaaactacagtttgacgcacactaccgcaactcatgttccatctttcgagccatgattcgaacaaaaaaaaaagggtaagtttagtcttgttacatacacaaaagaaaacaaaaaaattgttgtgtcataatgtctcgtatagaattttttatgtatattccatttcttatatagatgaaaacattatttactcgagtgaaagaacttcataaatttacatttgcttgattcttgctcgaatgtatttcatattacgtgataatttcaaagtaaataattagaaaaaatttaattcgtgagctaaccaaagtctaaaatcaattttagctttgaaaaaattgagagtgtgatttgttaccaaaattaaaaaagctgagaaagagaaggatgagagagagtgtggtgatgtgtgcgaaagaagagactcgatttagggccacgaattggcgcgaattcgtagggaagaaacaccgaactcggcgaagaagaagaacattatgccactctctgaatttttcattcactattctctcttcccgttttttccgttttctacacctctttcgatcgaatctcagttttttggtgactcgatttcgtttaattttgttctgctttaccctaattctcgaggctctgtggacttatgcagttgtttcgtttcgtttttgggtaatttgagtggtgttgaattgtgattttggggtttctcgatgtgtttatttaggaatttacataatcttatagcttccttgtgtaacaagtcagtttctgtgaaatctacccatggatagggtttcattcagctgagcattgcatttgaagcttccaaatggtatgtcattcattcatttatttaaaatattgtttatgcaacattgagattcgaaccggagatttttcaatttctcgattagtagcatgtaggcttgaaatctaagagtggaagaacaatgagatg

SEQ ID NO: 7924 - DNA, 3000 bp, Unknown
  misc_feature (1)..( 3000): cDNA_ID_1809775_gDNA_ID_1621174_Annot_ID_57288 3000 nt of promoter + ATG
aaatttatttttggggtagttagcaaatttattttgatatatactgtaaaatatttttttaagcgccataaaatatgatttatagtaacgctgcgaccgacactacttattggttctcatgtcttctcccagtgtgtaagacacatgattggtgcggtactccaaaaagtttgacttaattagttttacgacaaacactatgaaaagtatgtctttttttttttacatatttggatcgacaaggccagatccataatcaattcctagtacgcggaattacgcgatgtaatagagtcaaactccgacgagaaatgcggagtcaaatgaacttaatcacttgactaaaggcatatatatacctacaaaaagatgtcttttgtcacttattttgtatattttgaattttaccgtctaaagaattaaaaattgcttcactatttacaagataaagataattctcatacaactttatgttttagggccggctttgtggttttatgagatgaaaagtgtgtcaaaaaaatttcattttaaatgattcttacatattttttcattaacacttattttcttcttttcaatccttaatccttatcttttgtggtgaatggagctagatacctaacaaaatttgataaactaaaactccaagtttgttacttcttttacaacatttaatcatttattaaatattcatcgcattctttacaactgttgaatacctttttttaacatatcaactgtttctagtctaatgagtttattgagttttttaataattagaaaatgccacaacgaatttatttattttatctgttaatcaaaaaatatatttaaaatcctaccctcattgatttttttgtgattttctatattttctttaaataaatgttgataaaagtaaaattactctagaattatttcataatattatttatgtgcgatgtcatattttacaaaggacaatcacacattaaaatgtgttactaagtttgaatttgaaaatcataatactcgaatttaacatatcttaataaatgagaagtttagttttgcactttctttgctcacaatcaaattacaaggtcaaacctcggtaaactaagttagcaaactttgcaccctatagaagattttgctataagacattgtaaaaagacttttgacttctataactctaacatgtgaattaaacatagatttgaaaagtctatatatacaaacttagataaaaaaaaataatgtaagaatcaatttactggggtgattgttaatgggatgtgagaatttttacttcactacaaaagtctttacagtttaattttatatttttatatccaatcatacttctaaaagtgttaagaagtgcaactgcctatttctcttttttttttaaaaaaaaaaatacctagaacatttgaataaacaacaattacaatatgtttcactattgacaaaaataacatttcaacaaaaataaagacattccaaaagataatagtggatgttaacccgagtttatttttagtagtctttaaagaaatcattcaaaacaataatagtcaataaaagaaatattatatacaaaacaaattagcacagtagataaaaaactctttctaagaagttatttatagttttttatgtcactataattaaaaaatatattaacatagcgtcactattctatagctttttaatttattgctttgttgaacacattacatataaaatctattgcagaatagatataaagaacatataagatgctttacaatgatattacatgaaacatgttattataaaaaattaaagtttttaatttgtcccaaacatacatgttatgtcttctctctctcaagatgtatacatagatgataattagataacaatttaagcaatgtaaaggacaaaaaagaatccaagtagaaaattgataccagcgcttctatttttgtacatgaagttcttagaatgttatttgtgcattttgtcttgtactatgttccttttgggctgctgcaatacactcatgtggaaggtacacatgcgcgacaagggggttacatatgcatcaaacaattcctacaaaacatgtgtacgaaaaaagagttgaaataacgctgatcactactacttctctagaacatattttacaaacttttaaaaaatcaacaagacccaattatatatatggaagtctgtgtcattttgcaaattttgtgattaggtaaacaatcaagtcactttttatttcggtataatactaattattttatctgttttgaacgattaatgaaattgagaatacgcacataacattaaattttcatccgaaaataagctttcaattccttagttatggatgactattgagatgttaatacattcttcatttttatgtccaattagtcccacttgtatatagctgaagatatatgaccttgaacataaaacctcttagtaattcaaaataaaaaatcaactcataaaaacttttactgttactaatttagttgttaaaaaaaaaaacaattctacatcatttctattttatttatatttaattaattatctgagtttgaccctgaactgaagagagatctgcgttcttcttcttctttctttgtcatcttcattaataagaaaaataaaaaagaattaaaaacagaaggaaattaaattgactgtctcaaccaaatcagtaagacccaaccaaaaaaaaaaaaaaaacgctcgcctacttctcttctctctcaccatagagatagtttcaagctccaaaagttcttcaatcagattctggaaactaggtttttattcgtatttcaacttctacctactttttttctttctttcaatggagttcaagatcattaattagggtttcgttttcttcgattagatcgacttcattttatatagttgtgatggttttcttgtaggttgttggtagaagttatggtgagaaatgaagcttagattgagatttaagttatg

SEQ ID NO: 7925 - DNA, 3000 bp, Unknown
  misc_feature (1)..( 3000): cDNA_ID_1809761_gDNA_ID_1621174_Annot_ID_57294 3000 nt of promoter + ATG
gacagtcctattccttgcatatggtactttcaagtcgagctctagatttgagtaccacctacaaaaaaagaagaatcgacaatcattatggtagtctctccatatataagagttttaaaatgtatatataatctatcttgctagctcataatggcacctgaagacttggcaaagctctttgcggtgcaaaatttgcagaagattgaaatctatcttagcaaattctagcaaggtttggtcgtgcagatcttcttcttcatagtatgagatatattgtcgtgtctctatccttgatatacccctagggtatgcatgtttgagggcatttttaatgcggatggacataggtggactagattgatcagccagtccttccaaatgagacctagagaaagcaagagcttcatcgagaatgtcttcaccatgggtgctccaatgtgcagcttcataaaggcataaaagacctcttgcatcctcagctaggtgctccttgaactttccatccttattcttgaagttgttaaacacatcttacacatataattttttgttagtaatcaagtttaataattaacattgacttggtagatttactaatcattatgcacagagagtacaaagtgagtataccttgcgcttccacagtattaatatgatcgaattaggtgaagttgaaaaagaagaaaaaatacgctcgctatacttatgtcagttttcacattaaccaaaatgtaatatagttcttagaccaaaaacaaaatactactaacaattagcaacattctctttcatgactttttcttagtaatatcaattcaaattttttttaacccaaaaaatatggaaacataaataagaaacttattcatactgataaattaattaacatattacgctcgataattctaacattagagtgacttaccgacaccaagtttatagccaaattgtctaaaaatttggaagacgagggagacggtgtataaatcgaactcattgcctcttatcatctgcataaaaccatgacaccaaacatcgtctctaactgcgtgaagatgtctacttcaaagtggtaggaaacaccaaggcgacaaagagcatcaatgaatttgatgttctctatcggctcttcttttgaagccattaacaatcctcttacggtttcctttagtgaactcagcttctcttcgtttatctcactctcctatatacatcaaaataatggcacgagagaagacatcataatatagagtatattcatagtgttttgtgaacaaatttgcctaattgtgacttcaagtcgtgtgggtacgtaccggatccaaaacagaaaaagagatcaagggatcttcccatatattcaccggaaaatccgctaatggccgatatatttcttcagtcgtaagcgctgacaaagtatttatcagctcctgcatgcttaagttctttttctgaataaaagtgtatctataatcacacttcaaggttttctaaagctttggtaaaactgtggctgcacttgatacatatagaggccatatatagggagatgagcctccctctcttcttttggtgtttctttttttagtaacctttatcttaattttgtttatttctatggtattttcttttaggcgtgtaaaaatgagtcattgattgggactcttagccgacacgatagatatgaacacattggccattttacttttctagtactccctctgttttaatatatttctagtttaaaggtgtttttttttgttacaaaataaatgttgcttttatatttttttatgcaaaaattaaatatatttaatagttttaactaattatatttaatagtatattttcgaattaattttatttgataatattttataaaaaatagatatattaaagaaggtttttatgttttttcttttaatttgtatgaaaaatctttaaactataaatcaaataaaattgagggaataatagacaagtgacagattttcttcggttactaaaagagcaaaatcaattcattttaatattttgacgaaaacaaaacaaaaaaaaaaatcattttaatattttatgtccatcagcccgttgaattaggcttaaatggcggcgacacattaaagcttctttaattgcgccactaatatgatatgcgccactaatatgatatcccctacctcatatcaatcattgtaagtgtcattatagtttcttacatatattaacataacaattaaaaagaaagggttgccttccatgccaagccagcacatggaccgaattgttactcgctacagtgaggtgactggtgagatgggaacaagttgccatgatgtatgcaggtaagtgagggatgaacgcctgtctgtgttgctgcatgcctgcatgtgctatttgtttgtttccaaggtggtgtgatctgcccccgaggaatgtctaggagaagggttttctgctgtgattgctgaaggcaaataataatcaagagtcgaggaacaaaatttgtttcaaataaagtggaaagaaattcatatttgaaactccttcgttttttaaacagttcaacatttgatgtagattttaaaaatgtaaattctatttaataggctgttcttttttttatataatatgtgaaatctataaaaattaaataactatttgaaaaaagcttttaaattgattataattttgtagtgggttaaaatctagaatgtcaataaaaatataataaaaaaaccgaattaaaaatcactaataaaagccttcgaattcataatcccaatgcttttttaatctttttcttctacacaatttccagaagatgattactaattagaacgaaatataaaatacaaaatttgtccaaaaacttggagatgcgggggatcgaaccccgtgcctctcgcatgcaaagcgagcgctctaccatttgagctacatccccagttgttgagttacaatgcttcacgttttataaattcgaatatctaaaccaac

SEQ ID NO: 7926 - DNA, 3000 bp, Unknown
  misc_feature (1)..( 3000): cDNA_ID_1809753_gDNA_ID_1621174_Annot_ID_57297 3000 nt of promoter + ATG
tattagcaagagctccactgctccgccatcaacagctccaagatctgaaatgagatcgaagcagagctcaagttcagctaaagagtcaaagaaagaaaacgacgtcgctcagcttaacaaaggaaaatggttattgggccactcaccaaacaggcccaatgacaacacaaccaacacaacaacgaagcccaacaagtgttcttcctcttctcaacagacaagaccaccacctgtgcaagaaaacaaatcagagtgaagacagagaagaggagcgtctgtacggatccaatcaacacaaagaacagatttggttgtttggtgacctccgaagcttgataagacagagacagctgtcagtttacaatcattgaaaccctagcattgtttagctataaaagggaaccatgttgtaacctaaagattaagtgaaataatacaaagcaaagttcactcaaaacattacctaaagtagccgtcttgctcttactttcagtagcctcttagatctaaactcttttgggctaacatcactaacatttattcaattgttttagaatttattgataatctttagttttcttacattttgtattttaattgtcataataattgagtagtctcattcataggtgatcgttaggctagattagggtgtttaatgtttgattcatgatatatagttgcatagtctcatcacttagagaagagctcaatgctagttaagttgacccctgttgatttagatctttcatttcacgcctagaaggtgttaaataaaatgcttgaacactttctgagtaaactggattcagggtaaccatcttcatttgggtgtttcctttctcttatgctgagactcttcctgagtaaactggcttccatgctcttttgtctctccattgttgttgtttcttttttcttctgatgatcatactctttctttttgtttaagatacagttaaagagagagatagagtaagagacttaagaggatattgtcacttatatttgtgacaagtactaagttcaaaactcttcatacatttatataggatcttgagaagttttagacactttttttttaaaaaggcttgaagatatcgtgggtaattaacaaaggacgaaaaacaaatcaagtaggagtgtaggacaaaaaaacagtagttggcttttatttttaagttttttggtgaaattattggcctttattttaaaagaacatatagttatattaatgaaatggtgttcgtaaaaacgtgcaactctgacaaaatattctttaaataattggagacgggtagacgcaagatttggaactgttctttggtctcaacaaaagtcagttaatcaaagtttactaataagttttggcatagttgccttcgtaaccaagagggtgaaaacatgaaacaaaatagtgaaaacacttacagttatgttttagccttgctgtttgatcgtagggtggttggtatatgcatggtactgtcattttggtgaattttatgaatttgtaaaaccatataaaagaagaataagatatataggagcaacttccttttagagctttttttcatttaatatattactaaaccgtgtgagtggataaatacaagtctaaggaatcattttgattaaactcattgctactgaaagaatgtgtgagttatagggttataacttaagtactatatacagatatagtttctcttgttcgtccatatttatttaatctttttttgtaacttctcaaataatataaggttataacatttttttttttgtcgtctaatataaggttataacttataattatctttacacgggaaccacattttattgtttgttatataatctgtatactaacaacgacgtaataaaactcttacttcaataatctgacaagatttcgaattagtcactctttaagtctttattaatgcatgtaatatagttgagaacacattgactagagggagtacatttttttaaatggtgaacagcaaattcaataataattaaatatattttttaaaaattaggggatagcttctgattagctagaataaagagggtgaatgaaattatagtgtagcaatttctaaaaaatttagggtatataatctgattattcatgttgactaagaaaaaaaaaaatctaacctaaaaaagaaagatatgattcaacatacaaagcaattgattacccaaatcactagtcgttgggcattaactgctttggtgcaaatgggtctaaacatggaaggcttaggcctgagggatgccttgattttctttgagttgtgacgtgcaaactaaaacctatttcaattatacaccaaataagtaacaactagccctaggacctatattatatggaacattaagcttgcacgatctctacatttcttaaacaataaatagatctattgttgattcaattaatcaatttggtgtaatttttgaatgataatatttaaacattcccaaaaaaaaaggtaataatgtgaacatgcacgagataaaaaatacaaaaaattgtttgcttacacagcaatctaaaacacccgtagacgccaaagcactacagtaactctttcttttaggacagtgacttttaagttttactcaaaaaccaaatagacaaaacaaaactaactaaaacttaaagccacaaaggcccaaagaacaaaacaaaaagcaaacccaaaaaaaaaaaaaaaacagaaaccaaaaaaaagcaaagaaccgtttcttctccatcatcatcatcatcttcttcgcttcttcttcttcttccgtgaagaaggtcaaaaaacacaccaccgcttaaccccaattaccaaaaaatggcaaagcttcaaaatttctcaaattaaacaatctctttacttattcttcttcttcgaaatcgccgccggcttatgctgtttccgatcgttgtctcttctccggtgtatctccggtggtatcttccacgaagaattcataattactatg

SEQ ID NO: 7927 - DNA, 3000 bp, Unknown
  misc_feature (1)..( 3000): cDNA_ID_1809749_gDNA_ID_1621174_Annot_ID_57298 3000 nt of promoter + ATG
gcatcacaatggaaaagcattaacagacagtagaaaacttgcactccatatcgaagagatagataagcacataaaaagctaacctgcgaaccgaggccaacagcgacaatccgaggactgcatctaaccatataaacagtagatctaaacctcaaaacatgaacatagttatgcgatctaagcgaataaaatcgcacaaccgtgggagagagtgcaagaggatcctcataaccatttctaacagatccatctctactagtaacaataggacctgaacctttagcttcatcagcaacagctaaaagtataggatgtgatgatctaaacccttcaactccatcacatttagcaggtaatggctgcatctgtaaaaatgtaaccggatcatcccgcctcgacacgaattcggtaacatcatttgaatcatcgatatcaagaacttgaaacccgtttgtataacctagtaatagaacgttcttgaaagatgattcacttgtgtgcaatctatcaaatgaagaccacaacacctgcttcaccaaacacaaggatcacaacaagtcaaacctatctcgataaaaaagactcacactttttcctaatctgatcaaaatcacataaacccaattggaaaatgaatcaaaaacccccaaattccaaaatagagaatcacgaattggggaaaatcaaaattgaggtcaaaacctgatctttaagctcgtgagaatcagaagagagggaagcagcgacggaggcgctagctgagcgaacaccggaggaagcagttctgatgcaagtagagatgaattttaacgaattgggcaaaaagccattagtaccattattcttcgtttgattatgattatctccgttgttgttgatgttgaccttggagttactcttcatagtaattatgaattcttcgtggaagataccaccggagatacaccggagaagagacaacgatcggaaacagcataagccggcggcgatttcgaagaagaagaataagtaaagagattgtttaatttgagaaattttgaagctttgccattttttggtaattggggttaagcggtggtgtgttttttgaccttcttcacggaagaagaagaagaagcgaagaagatgatgatgatgatggagaagaaacggttctttgcttttttttggtttctgttttttttttttttttgggtttgctttttgttttgttctttgggcctttgtggctttaagttttagttagttttgttttgtctatttggtttttgagtaaaacttaaaagtcactgtcctaaaagaaagagttactgtagtgctttggcgtctacgggtgttttagattgctgtgtaagcaaacaattttttgtattttttatctcgtgcatgttcacattattacctttttttttgggaatgtttaaatattatcattcaaaaattacaccaaattgattaattgaatcaacaatagatctatttattgtttaagaaatgtagagatcgtgcaagcttaatgttccatataatataggtcctagggctagttgttacttatttggtgtataattgaaataggttttagtttgcacgtcacaactcaaagaaaatcaaggcatccctcaggcctaagccttccatgtttagacccatttgcaccaaagcagttaatgcccaacgactagtgatttgggtaatcaattgctttgtatgttgaatcatatctttcttttttaggttagatttttttttttcttagtcaacatgaataatcagattatataccctaaattttttagaaattgctacactataatttcattcaccctctttattctagctaatcagaagctatcccctaatttttaaaaaatatatttaattattattgaatttgctgttcaccatttaaaaaaatgtactccctctagtcaatgtgttctcaactatattacatgcattaataaagacttaaagagtgactaattcgaaatcttgtcagattattgaagtaagagttttattacgtcgttgttagtatacagattatataacaaacaataaaatgtggttcccgtgtaaagataattataagttataaccttatattagacgacaaaaaaaaaaatgttataaccttatattatttgagaagttacaaaaaaagattaaataaatatggacgaacaagagaaactatatctgtatatagtacttaagttataaccctataactcacacattctttcagtagcaatgagtttaatcaaaatgattccttagacttgtatttatccactcacacggtttagtaatatattaaatgaaaaaaagctctaaaaggaagttgctcctatatatcttattcttcttttatatggttttacaaattcataaaattcaccaaaatgacagtaccatgcatataccaaccaccctacgatcaaacagcaaggctaaaacataactgtaagtgttttcactattttgtttcatgttttcaccctcttggttacgaaggcaactatgccaaaacttattagtaaactttgattaactgacttttgttgagaccaaagaacagttccaaatcttgcgtctacccgtctccaattatttaaagaatattttgtcagagttgcacgtttttacgaacaccatttcattaatataactatatgttcttttaaaataaaggccaataatttcaccaaaaaacttaaaaataaaagccaactactgtttttttgtcctacactcctacttgatttgtttttcgtcctttgttaattacccacgatatcttcaagcctttttaaaaaaaaagtgtctaaaacttctcaagatcctatataaatgtatgaagagttttgaacttagtacttgtcacaaatataagtgacaatatcctcttaagtctcttactctatctctctctttaactgtatcttaaacaaaaagaaagagtatgatcatcagaagaaaaaagaaacaacaaca

SEQ ID NO: 7928 - DNA, 3000 bp, Unknown
  misc_feature (1)..( 3000): cDNA_ID_4254639_gDNA_ID_1621174_Annot_ID_57302 3000 nt of promoter + ATG
ttactaagtatctcgacaaagtcagtttcttggagagtgctgattacaggcagtttgagaaagagagagacgctagtttgagaagacacgatgagaccgactcctctaacgttcttctacatctgctgtaagtaatcttgttttctgttctgttagagaagtcttctttagtagactttgtagcattttctcaagtgatttggtcacattctttggcagtgtctaaaccgagtccccgttttcttgattgattcggatttatttcttatgtctctctcgagagagagttcaaaactgagaccatcctctctgaaggccatggccaatgaaatgggcttgcaatgcaacgtaagcccaacttgaatcccacgattctaattcgagccgatatctgaaacaacaattcatttgtgactgcaatctacaccaatctacaccttgttcttgtaaatcgtttgttttcttagtttctacctaatgaagctcatttggtctctatacaacataaatttcttcttttggttttgaaatctaaaacctgaagtaaagcttgattgatttggtttatggattgcaggggaaaaagtggctctctctttaacatttacaaaaaaaaaaaaaagtggctctctacagagttgatagtcgtaaacaagcaagctcgtgttaggttttttctattgttggatggttttgtatcaatgttctcaatattgttttactagataatgaagataacttttatattgtaaatatattaaattcattttgtaattattattttttggacaaatataaatgcatatataagtaaaaatgtgataacacgtttcattgagtgtatatttaaaatgtaattatgcaaaaaaaaaattaaaaaatatttaattagcaatttagaagtttaaacatcaattctgttttgagaaaatagtatagtttatagacatgtagtatagctaatgtttatttcacacatatgccaatttttagtaaataaatcgtgaagtgatcatcaccataaaatctgatggccgcaattcaaacccatgtaatcgaattttgtttctaagatagaatctaacacaaaataaattagtatacatacatgatatattaattttttttttgtaacatgatagattaattaatttaaagataagaaaccacacacataaattatttatagatttttaaaagtttcaatatttattacatagaaacccaaaaaatccatcataaaagcggttatcaggaggcgtgtaaaatttcacttgagcaaatttgttttggttgcagagatttttgcaagcaattctcacaaaaaggaagagttgccgttttagaatctttcatgcactgatttgggacacaatgtttaacacatacttctatcgtactcgcgtatgttgaaactatcatcgttaataaaactacaatcatcaaaacactatatatctttttcattgtttcagttgccattatttgaaaatatgagtttgtgaatgtttgaggtaataaaaatattgtttaggttatatagcaaaaaaaaattaacaagataattagtgttgagttggctttttgtagttttgtactttatatagcaaaagtatttttatccacttaaaattattgattttggaagtatatccgtttcttattaattaaaaagttagttttttttttgtttatgttattagctgtccaaacaatcttgcaatgttaaatcgtcatttaccaaaaaaattgccaaattttcaccattgtcaataataagtcaaatattttataatcttaattcaaaaactatcccctaaaacatgattatataaaaaaaaaatcgtattgatgggtcgagatatttagcattaacttataaaccaaaatgaatttacaggttgatttgatctatttaaatttattggattcataggttgacctaattaatttagctaaataatttatctaacactcaactaattaagacaatagatggtacccataatagattaaatttgagtaacttcaaaagtttctattcagttttttttcttacaatttttttgtggtattaattctaaagcattatcaataatattgtcacatttttaaaaatcttatttcagaaattatcccctaaaaaagattataaactagaaccttttttttgtattgatgggtagagatatgtaatcatttaacttacaaaccaaattgaatttacatgttgatttgatctatttaaatttgatggattcatgggttaacaacaacaagaaaaacaaaattagtttaatattataccacatgtcacgctctagtgagaatgttaagagtttatgtaataacactaacaaattttgtatatttttcctatactataaacatttttaatttttttttttgaatatattaacaacaacaaaattaatagaatgaggttaatagtttaatatattagcattttttatataagaagtaaattttatttatttttgaatatttaacaaaaacaaagtttaataaaattagtttaacagtttaaaatagcaataacaaaagtcgaacataaaaacaattttttttcttacttaatatatatatttcttttttcgataggattaagaacttttgtatttctatttttaaaaatattaacaaaattaagtttaacatcttaagttttaaaaatttggcaaatttttaaattacatatatttttattcttttgtttttgaaaatagggagtaatagttaatgtagttatagactatagagatgcattgtcaacaataaaacgccacgtcgcagcataattaaaatcttttgcacaaaaatgtggttggccttagccttggccctggaattaaaacattatccagaaaatcttacatttccaccaatccttcacttcctttcacgatccaaaacaaaacacaagaaaatgcaacaaaatcttctccatctctgaactcaaaaactcattcactgagaaaa

SEQ ID NO: 7929 - DNA, 3000 bp, Unknown
  misc_feature (1)..( 3000): cDNA_ID_2144864_gDNA_ID_1621174_Annot_ID_174101 3000 nt of promoter + ATG
tcgcttatgatttccatgtgattggggtgtggaacaggaagagaaataaaagaaaaagtggaaatttgaaagagaagtgaacattagggaaataaaaagaatcatggctcaaagtttataagtgtagaaagaaaaaaagtgtttatgtgtttatcaccgagaattctctcaatcttttttttgtgaatcagatttttctcaccttttttttttgtttttttcttttctttctgtctgatgaagagaaaagagttaaatatatagagtccaacggttccggcgtacatttgcaacattacatttaataaattaaccataatctcaatagttgcaatggttagagagtaaccgcttataacacttaaatctccaacatgttttgcttgcagtttgtggcactaattgttataagagttagctctctcagtagcaccaaactggtaagtgagtttctgatacaagtgttgttatataaaaatccaatgtgattgatcgttggggatgatttaacaaagagaatgatcagttctgagaagagcatttaaactttccgttaagtggagtgatgaagatgatttattggtgtaaagacaaatgttacgttgctatctattttggggaataatgtaactttttttaccgtgctatctttactatgtagacgtatataatttctgtcaaacatcttacttcgattttccataactctgttgttacactttcaagagatcatctataactctttcaagagatctaccaagttattcaaaggtaggaaatgcctacaatgtgaaacttaaaaatttaacatattccctcttatttagaggtctagttttgattttcatgtgaggagaacgatttagtgtataatggttttaacttactctgtgttagttaacacatatttatgagtaaattaaatatcaaatgttggaagttgctaagcatattggcctcatttactttgctagaaagttaatactctacatgttttcactataaacccttatcatcatgcatattgctgacaatgttattttagtttttatgaaattaaaataatatgtgaaatagtgaattctgtcaactaaaaattatttcagtcaaaaaataaaaattataaataaaaattaattcgaaaaacaaatatgagcatattattaatgtaatttttagcctaaatggcaaatttttccctacacaaattagctcattatttttcttaacattaaaattatttgtctaaaacctgcattcttctaatagagtgaaacggttttgggtttaagacatgtgagattgaacaaacaagacgttgacttgtgagtagaaggaacatgtgaacttatatggaccatgtgaccttcaactacaatcattggaatgttaaactactgtcttctcttatttggcatctaaattttgtttttattactctctaaacaaaaacgaattaacaagatttctgcacaaaaatgtatgcattttgttttacgtacaatcatctaattcgaaacatatggggtgaaattttttactttttaaagacaacaaaccaatcaatcacacgtgaatattgccagaagagatatacacttggagaggataatgaaccattaggtgtccccaagtactaaactagacctctacggtgccaaagaaaggttccggagttatgagtggtcacctctcctacctctttgaaagacatgtatatcgctttaactccttaattattgattcttgtgtgtaagggcaggcaacctatgcaaatagacaaattcatatttttcatcgtgatcatagtaaatactacaattttttttttttttttttttttggtaaaatattacaaatttagcaaaagacatgcaaagattaaagacgctatgataagaaagaaaactaatcggatatataactaaaaagacgttgaaaatggcaaatatcaatcatcaatccaaataatattcatatacctttcatctatgaactaaggttttttaactaatatatatatatatataccgtatgattacactgtcaaactaaagtataaaatgcaacaatagaaaatatgagaaataaaataaaatatattaattatttgcttttcaactactttaatatcttaatttaccatgagaaagaaatgaaaatatgagtcgaaataaaaaaagaaaagaataagtagtttgagaacaattttttaaaaaagggtaaaagactagaacatatagtcaattgatcatctacacatgttgttgttagaagaaaaaaaccaaaagaccaaaaatccaaaaaggaatttctcttcacattatgtgtatggccataaataaaaacttatctatctatctcgcgggaggaaaacaaactgctcgtgttggtgcttttgtaattcgtcttttcttatgtattatctttaagaaaagtcttttgcattgtgcacctacacaacattccgttttactaaaagttaatataccaaattgcaaataattcagctccagtttactcttgtttatttagtttgattttgggtgcatttgatatctttttcatcgaacttatgtaaattttctctaataatcgtaaactttttctaataatcgtaaatttattatcgtcaaatattccaatttgttattgaaatgttttcgtaatatacctcaatttcaaatttaaatattttattttaattttaaaattgcgtaaccgtaattttaattttaaacttgctcaccctaagatgggttttattttctcccgaatttaatatttaatttactaaaaatgatatgataagcctttatgtatgtaaactttttttcttaccattttttttaatacttccattgctctttttttctgacgtcttctttaatttattctactctatacatatctgccatatatgtgtatatagagagaaatatacttcaattcgtttccaaacctatactctcctctctcacaaaaatgaacaacaccaaa

SEQ ID NO: 7930 - DNA, 3000 bp, Unknown; identical to SEQ ID NO: 7928
  misc_feature (1)..( 3000): cDNA_ID_3046942_gDNA_ID_1621174_Annot_ID_174099 3000 nt of promoter + ATG

SEQ ID NO: 7931 - DNA, 3000 bp, Unknown
  misc_feature (1)..( 3000): cDNA_ID_3046948_gDNA_ID_1621174_Annot_ID_174095 3000 nt of promoter + ATG
tgtttagacccatttgcaccaaagcagttaatgcccaacgactagtgatttgggtaatcaattgctttgtatgttgaatcatatctttcttttttaggttagatttttttttttcttagtcaacatgaataatcagattatataccctaaattttttagaaattgctacactataatttcattcaccctctttattctagctaatcagaagctatcccctaatttttaaaaaatatatttaattattattgaatttgctgttcaccatttaaaaaaatgtactccctctagtcaatgtgttctcaactatattacatgcattaataaagacttaaagagtgactaattcgaaatcttgtcagattattgaagtaagagttttattacgtcgttgttagtatacagattatataacaaacaataaaatgtggttcccgtgtaaagataattataagttataaccttatattagacgacaaaaaaaaaaatgttataaccttatattatttgagaagttacaaaaaaagattaaataaatatggacgaacaagagaaactatatctgtatatagtacttaagttataaccctataactcacacattctttcagtagcaatgagtttaatcaaaatgattccttagacttgtatttatccactcacacggtttagtaatatattaaatgaaaaaaagctctaaaaggaagttgctcctatatatcttattcttcttttatatggttttacaaattcataaaattcaccaaaatgacagtaccatgcatataccaaccaccctacgatcaaacagcaaggctaaaacataactgtaagtgttttcactattttgtttcatgttttcaccctcttggttacgaaggcaactatgccaaaacttattagtaaactttgattaactgacttttgttgagaccaaagaacagttccaaatcttgcgtctacccgtctccaattatttaaagaatattttgtcagagttgcacgtttttacgaacaccatttcattaatataactatatgttcttttaaaataaaggccaataatttcaccaaaaaacttaaaaataaaagccaactactgtttttttgtcctacactcctacttgatttgtttttcgtcctttgttaattacccacgatatcttcaagcctttttaaaaaaaaagtgtctaaaacttctcaagatcctatataaatgtatgaagagttttgaacttagtacttgtcacaaatataagtgacaatatcctcttaagtctcttactctatctctctctttaactgtatcttaaacaaaaagaaagagtatgatcatcagaagaaaaaagaaacaacaacaatggagagacaaaagagcatggaagccagtttactcaggaagagtctcagcataagagaaaggaaacacccaaatgaagatggttaccctgaatccagtttactcagaaagtgttcaagcattttatttaacaccttctaggcgtgaaatgaaagatctaaatcaacaggggtcaacttaactagcattgagctcttctctaagtgatgagactatgcaactatatatcatgaatcaaacattaaacaccctaatctagcctaacgatcacctatgaatgagactactcaattattatgacaattaaaatacaaaatgtaagaaaactaaagattatcaataaattctaaaacaattgaataaatgttagtgatgttagcccaaaagagtttagatctaagaggctactgaaagtaagagcaagacggctactttaggtaatgttttgagtgaactttgctttgtattatttcacttaatctttaggttacaacatggttcccttttatagctaaacaatgctagggtttcaatgattgtaaactgacagctgtctctgtcttatcaagcttcggaggtcaccaaacaaccaaatctgttctttgtgttgattggatccgtacagacgctcctcttctctgtcttcactctgatttgttttcttgcacaggtggtggtcttgtctgttgagaagaggaagaacacttgttgggcttcgttgttgtgttggttgtgttgtcattgggcctgtttggtgagtggcccaataaccattttcctttgttaagctgagcgacgtcgttttctttctttgactctttagctgaacttgagctctgcttcgatctcatttcagatcttggagctgttgatggcggagcagtggagctcttgctaatagctactacaactaaccataagtgaaaactatatatgaaaagcttaggattttagttcttatatgatagtatttatatgaaaatataagtgtatccggatcgaccgattcagattgggcaaacccttaaaggagaagtagataaatgattgatcgtctggtcgattaccattataaatctcatgaaatacgtatgtctttcctctttttcgttgaaggactaacttttttcaagagagatttacccgttcgattgctactggtcttagtttcttcttactcgaactcgttattctcttcttggttctttgcttgttcccatctatagagtgtgtgcttcagatagtttcatagacctattaaaagataatatatatttgcaatgcatatgctctaggatcttaaattcaaatcaaaactaaaaatacaaaaaaagaaaagaaaaaacaaaaaaaagaagacataaacctagttgtttaaaccactaaaatacaaacgcataaacttactacacatgaaaatgaaacgactacatacgactgactactttgcatatatatatttgtgaattactcttcactttttctctatatataataacaacttgaagacaaagacaaaataataaaataaccttatctcttctctatatattagttcttgagatctctccaacaactctactttgtctttactcaagtatttcactaagaaagatagaatcacaaaaaggaaagagaaa

SEQ ID NO: 7932 - DNA, 3000 bp, Unknown; identical to SEQ ID NO: 7925
  misc_feature (1)..( 3000): cDNA_ID_3046955_gDNA_ID_1621174_Annot_ID_174089 3000 nt of promoter + ATG

SEQ ID NO: 7933 - DNA, 3000 bp, Unknown; identical to SEQ ID NO: 7924
  misc_feature (1)..( 3000): cDNA_ID_1809775_gDNA_ID_1621174_Annot_ID_174083 3000 nt of promoter + ATG

SEQ ID NO: 7934 - DNA, 3000 bp, Unknown; identical to SEQ ID NO: 7929
  misc_feature (1)..( 3000): cDNA_ID_1809729_gDNA_ID_1621174_Annot_ID_57304 3000 nt of promoter + ATG

SEQ ID NO: 7935 - DNA, 3000 bp, Unknown
  misc_feature (1)..( 3000): cDNA_ID_1809849_gDNA_ID_1621175_Annot_ID_57309 3000 nt of promoter + ATG
aggtgatttacatgacaggatggagagaacattcgtctcacccgcaggccaaacgaagaggttcagccaccgtatccttcacggatctccaaaagcaatttggcggacaatcttgatggaatgattgaagaagagaaacattcaataagcagagactttacaaatgacacttgagagagaaatcagtgacttaagctataaggtacttggaggaactcttgtagatttgtcggagtctttcactgggcgaaagcatcacaattaggacgcctgctttcgcccatgtatttcgtatcgaataatagctgatcagaaacatatttgtattttacaaaaatattacgaatacttaaaaatctcaatcttcaatcacgaaacatgatctcgcgctaggtttcttgaatagatttgtatacaatggaccaaacttcactaaatcagtgaaacaaacattaatcaaaaccttataatgtatattcacaaccatttgattgtttctctgtggtacctaatcttgttttgagtaagattttagcaccacacctgttttgattatggtacaaaatcttactcaaaagaagatcaaacgtgatcatgaccgtcgagataaatcaaacgtgatcgtggccgcccagataatcatacactgaaatattcaacggctccacttgatcagctccattctcgtaatacgtcgtcgtatctccgcatccagagttcacgctggtactgtggacgattccggcgtcaatggccatgccggcgttagaagcagcttgctggatagatctcggagaagttctggaaacgagtgaaggattaagcaaatgagggaaattgagagattctaaagaatcaggttggtgtaaacagaagaaagcaacgtcgtgtgctacggcggcaccttctgctgttgagaatgaacctaaccagagacggtcacgagttcccggaactctaatctctgatacccatttgccccatttccgacgacggattcctttgtactttgactgactttcaccggtggattctctgtaatccattttttgttgttgtatgatgatcgatgtgaagaagaagaagaagaagaagagacttttgagtgttgtttatgtttgaatatgaagatacaaagactatttatacgttgaagtttagtgaaagtcaaaatattatataatattttttaatatgaatcaagaatgagaatgaagttgaccaattataaaactagttaattctcgaggaaaaaatcaactggtcaaagtatgacccatttttttagtggtaccaatttgacatgtgcctgactagtcgatttttttttctttcaagttgtaacttttttttttgctgtgtctaacagtaaattcaatgtatttagaaagtaagagtcatttctataaaacaagtggtatatataccgttctgtttggtttcaaaataaatgatattttttgtttttttaaaatagaaaattaatctttattttttgttgttgttgctttggtatatcatagttaggttaccttaatttataggtttttcatttttttttatatgaaaaagtcttaagtcgaaatctagaattttatactactatatatcctctatttcgtttcataaaaatctgtaaaataggtgatgacataatagtatagagaaaagcagtgaaaaacacaaaagtcgattcaaactccaccgatgaagaatgtgaaaacgtcgtcgtcgatggttaaaccacgtgggataaagaaagactttctttgccttttttggttacaaattgcgtcatgcgtgacatgagcaccgtctaaagggggtcctttatttttggcatttgaccaaagatctgtaatgacttaatgattctccacggacaacacacagacacaacagcccaaactaactggaaaaagttattttttgtcttcttctgtgtctgctgactcatgtacatggttgtcaaattttagttcacacacaaccacatccaaaacacgaatcatccacggagaaacccagtctcataatgtatttaatgtgttttcatccttcggatgcataaccaattctttgtagttgatacttgattaggtttttctcgacactgacatttgggagttgattgtgatgtgatacaccgtcttatcatagtcaccgactcatttagaagaaacctcaaaggtaacttggtaagttacgattagagatgtttttagaaacgtctagcagattattgatatctgacaataaatattcacacctactcggttggtctatgcgattttagacaatttaaatgtttataaaaaccctagtgtatcagtatatataaaatcaatattaatgaaataatgcaattaataaattacttattataagttcttataaaaaaaatactagtgacctcattttgtaatatcaaaaactggtgccaacttcatctaacacgatttatttaaccttggtaatattttgaaaaaaccataaatttataaagttgttacagtcagattttagtgggctaaaatgggttacaattgcaatgggtctggaagtggacaaatctaaacaagcggcccaaatcatctgagcacatgccagaacattgaataaatgtcaaaaaggagtctctttctacataaccttcacgcgcggctactcctactttcgcttcgtccggttccgtcgatactgtctccgaatcactgtcttctttcctttttcttcctacatgacatctgtcttatctcttttatgtttctctagatgtacttatacttccatgtttcgtctgtatacggtatgtttcgctcaccacatgttcgatgaaattcctcaacgaaactttttttttatctttctcacctttcttcctttgactttcagacggagaagcaaaattgcttgaactttcgctttgatggatcaaactagtcttggaacaataatcaaaatccattcgttgccatcatatgcagcttactgtatatg

SEQ ID NO: 7936 - DNA, 3000 bp, Unknown
  misc_feature (1)..( 3000): cDNA_ID_1809837_gDNA_ID_1621175_Annot_ID_57314 3000 nt of promoter + ATG
ttaaaaagtcaacatcagtgctaatttcaaattgaccatacattagcacacaagaagactaacaaaaaaaatgagtgaataaagaagagagtgagtggggttgatacatgtcaccgtccaaaatgtgtctgacccttctcattggagctacaagagccgaccctttgcctcatcatttgttgacttcactctccttttacatatttaaattataacttgctcatatttccattcattgtgttcggttctagattgttccatccactttcttttttctcttactttgaaatttagaaatatatgaatacttgacaaatatttgaatattgtaactgatttgtttgttcgtaatacttgacaaacttttttgaatatacacctttacatatattttgagttgagataaaaagggaattatgttagtttatggattatattatgtaaataccacatctaactatgatcggatgaaaactaaaccagcatatctctaatcagtaatatttactaaatttatatatcattaaagattttttgaatttagcaaaaaaagaagaagatatcattaaagatttttaaatttaaagtataacataatgaataaatcaagtgttgagcttagtttcgcgttgcaaagatgttcatttgatttttttttttttttttccatttgatttttcttatactaaattgattgatgtcacggtccttctgtgaaaaaagtatattgtactgtataaatttataatagtcatacttgaagataactaatatcattttctaaaggttttgttgacaatgaaatgggtaatgatgaacatctcgtttgctaaaccacaaaagaaataattcgttggactataacttaaacttataatatatcaactgaaatgcctacaatttgagaatacgccttttcaaaaagttttagaattttataaaaatttctccaccataatattactttaataaaagcttgttattaaaatgatatattaacaaaaaaaaaagaggtaggcaaagtagcttttattaaaattaatgttttccctaattggtaaatcataaaccaaaaaattgaggtaattcttaatatatttactatgattagaatgatacattaatgtaacattttatcatcttcattaataatagtaagttctcctcaaaattacaatttgatatcaaaaaatatatttgtattacaagcaattactgaaaaattaaaattacaatttagcccagttacataactccacgtaaggtttgagcccatcacatcacatggtacatgaccaaagcccagttatgttaccatggagtattcttcagacaagagccatccagacagaagtggaccacacaatcacgaatcgtatggagatcattacaatatattgctcacatcttattgcgccacgtctcttatttggcgagtgatcaacgtccacagatctcttgctccactctgattggtacacgtcatcattttattgtgctacttgtttatgtggtacagtagagacaagtggtaagattttaaaatatcttaaaagatgtgtgaggcccatttagatattttctcaacgggctgttcctcaaaagctgcccgtttatctacaaccatcgaacggctcgaaactattctgggctagctgcccgaaatctcttaaaggaatttgttgagtgggcttgaatcaacggtggataattcgaaggtgtacgtaacatctcgtagcatctgaacttagctcccctcaaaatatctgtggacatatgtcactagctttttttttgtgtaatgaaactattaattaattaggcaatcacatgagagatgttatatacttaaattaataactcaataatacaatcatgaccaccaaaccttgaaataaaataatctctctgattacttgtacaaattctttaccaatatatgccatactgtgaatgtaatggtttattttaaaacagccaaatattattgatataattatatgtttaagtagattttaaacttagctcatggttaaaaatagacagaattttggagtaaatctgagtttacaaaatttatttattaggattaaaattaattacttaaattggcaaacatttttcttggtgattgtaacatacaatatacgaatttgaattcgcattgtgattccaaaacaacactaacataaactaccagtaaaattttttaaaataaaatttcatatatatatgcttaaaaaatgtaacaaaaatatggtaaattttttaaccatggtatgggtggagatgtatgtgggatgatgatggttatatggtaatggcgcataaaggtggtggcaaaggcaaggaaatatcgatgacacgtaagcagacgggaaatcttaaaccgagtggagaagcctccaaatctcttttttctctctctctctcctaaggccaccacaatctcttcttctgtgtatgtattctttttttctccgatattcgtcgatctctcaaaaatatcctcaaagccaaaaaaaagcaagagtagagataaccaaccaacaaactcataggaagacatatttactttcaggtctttcttctactacctttttcgtggtttttggttgattgattctcagatgagattttttcccgaatcatttgatgtcttttttttttaaataagttcttggtaaatcactgtttctactagcattttttgttttctcagcttagatttgttgtttgatttgacatcttatctgattgagattttgttcttctgaattgttgttacagggtttagctgtttgattcagcttcgatttagtgtacagtgtgttgattagtataaaaaggatttaaaagaatctgggagatgtgtatagtgattgttcttgctggcgaatgttaacactacgtcgtattgattctcgattgatagtagaagaaaggtgttagttagattgttcgttcatctagttggggtttagtttcggttcctggatg

SEQ ID NO: 7937 - DNA, 3000 bp, Unknown
  misc_feature (1)..( 3000): cDNA_ID_1809833_gDNA_ID_1621175_Annot_ID_57315 3000 nt of promoter + ATG
ggaggaagcaaagttaaaagtaaaggctaagttagtgaactctctcatgggtcaatggcagggctggagatatgtacgagcgcactcattctgcggctttgcgcataatgtgaagctttgtcatttcatttttaacattttaccacaaaagttcaaaacatatttttatctacattttaagtttgtatgtttcatagttttcttctgtatatactttctcttatgtgacgacaattacttatgtacttaacttttttgggtcacgacttgaaaaaccacatatggattgagactttttgggctattggatgacatatctaagtttgatcaaatactagaattgatctacctacattggatgcatgttaagttgttgctactcttagctcagattcacacagaaaagtataaacccaaagaattacgttcgaaagaaagatttaaattgattatcaaagcaataactaaatcaaatccgaatatcagagatcgctcgctaaatgtttgctcacgatctacaagtaatcaacattgactactcacttgaacatcttcaggattattggctctctctcaacaactcagataaaaagcctgaatgaaagagaaggcaacaacggctatatatgtttcctcagtcgtaacagcaaagcctccctctggaacaaagtctttctcttccttctcttcttcagcaaagactctaattccttcagtgtctttcgcttccgttgactgaagctgatgtggcattgaccgcttcctataataagcttgatgaaccgtatcaatgccacaattataatcttcataaataaacggatgtgttttacacactactgtaatattttgttactccatcattcaacataccaatcatcatcatttttatattttaattaaaaagattacatttcacaacttatatacaattgaaaatagagaacatcttaacaatatccctatagtaaattttcttttagtcaactatttaaagatttcaaaatggtttattgtaatccatgtgatccggtcaaagaatccaaaatagtttaatatctctatttatagtagaagaaaaataactagctacacaaaatatcggagaatgcatgatcacacatgtcaagcatattagtgtatccctagctatacgaagtagatgtattgtatgaccacatatctgaactatacgacgtcatgtagttaacaccacagacatgcaattccggtacactaataaatttactccgttgaagaccagtgttgaccggcatagttgaggatactatagtataattggcatgggtaaattaactaaaaatcatcaatccatttatcataatccaaattctggtcaaaagaatctaaaaatagtttcataaaaatagtttcatgtttctgtttacagtaataaaattgatatcttagtcatgaccaaatcaatagccgcaagttatgctcccaaaaattagctgttcatcttttactccaatcaaaaacataaaaaaaaaaaaacaattacaatttctattctaagtaaatgttaaataaatttattaaattttacctcctaagacttcagtggttacactattagaaaataattagatttgtgtgcctaaaagccttagaagcatgcattttttatgaataaataaatttagtattgatttcggtatagaaaatgaaattagcaaattcttgatatgtgtaactaaaataaaatcttatgtaaaaaacagaagcgataaaggcaaacataattcaaaactgcgaccaattcttattatcaaagatttatgaaacaccaattagctattaatagtaaaaatcaagtgacactttccctatactaaattgttaattgttcggatttataggcttagctagttaagtataaatattaatccacactcttcacactaattcaattttatccctaataaaaaacttgaatctatatatgtgtatcaatatatgtgtatgatatttaaaggggtttgtagtctattgaaataaataaaagattccattatccatgatttttaataagttacttcgtagcattactaaacctatttacatcatcaacaatacaactgatttaatttcaactaactaaaaaattaccaatttatttatcataaattcataatctaatatctggtcaaaagaatctaaaaatagtttcatgtgtctatttatagtaataagattgatatcttagtaatgaccaaatcaatagccgcaaattttgctctgaaaaattagttgttcgtctttactctaatcaaaaacataaataaaaaatcacaatttttatccaaagtaaatgttaaatcaatttattaaattttagctcttaagacctcattagttatattattagaaattaattagatttgtgtgcttataagccttagaagcatgcatttttttatgaataaataaatttaatgttgctttcgatatagaaaacaaaattagcacatgctcgataagtgtaactaaaataaaacctcatgtaataaaaaaagaaataaaggcaaacataatttaaaactgcgaccaattcttattatcaaagattcatgaaatattcaattagctattaatagtaaaatcaagtgacattttatttatactaaattgttaattgctcggttttataggcttagctagttatgtataaatatgcatccacactcatcacactaattcaattttatccctctttactcttcttgataatcggaggaaactaaaaaaggaaaaaaaaaaatctaaataagaataaaattcctaaaaaataaataaatcaaaaattgtgaagaaacaaatcctcgagtcatgttgtttacagaaaatctctttctcacttaaaacccttacagaaacaaatcatcgaatctttgtttttttagaatcagtgattttgtttcctttcacgagacgaaaataacaaatcgtcttgtaaaaagtaaactcataatcatg

SEQ ID NO: 7938 - DNA, 3000 bp, Unknown
  misc_feature (1)..( 3000): cDNA_ID_1809829_gDNA_ID_1621175_Annot_ID_57316 3000 nt of promoter + ATG
ggtcgtacattgtctagacaccgaattgaatgcatcttcgagtcagctacgcgcaatctttgtcaaatatctgataactctagcaatggacaggaagaaaagagagaaggagatggcttgtgtgctcgtctctactcttggtttccctcccaaagatgtcagaagcgcattctcgatgctcatagaatctgcagacgacactgctttggacaacccagtggttgttgaagaccttgccatgttcttagcaagagctgtggttgacgaggtgttagctccacgggatttggaagaagtgttaaatcagactcccgaggcaggctcaagtgtgggcgagaaagtgattcaaatggcgaaaacattgctgaaagcacgtctttccggtgaaaggatcttacgttgctggggaggaggaggaattgagacaaactcgccgggatccacagtgaaggaagtgaaagagaagatccagattcttctagaagagtatgtctctggtggagacctcagagaagctagtaggtgcgtaaaggaactaggaatgccgttttttcaccacgaagtagtgaagaagtcagtagtgaggatcatagaagagaaggagaacgaggaacggttatggaagctactaaaagtgtgttttgattcaggactagtgacgatatatcagatgactaaagggtttaaaagagttgatgaatcacttgaagatctgtctttggatgtccctgatgctgccaaaaagttttcaagttgcgttgaaagaggcaagcttgaagggttcttggacgaatcattcgcttctgaggattcgcaaagtaagaaacagaacggctcgtcttcttcctctggatgataacatttgagcaccatacctcaaacctcgagacgttggtttcacgcaaaatcaccttttggagttttttttttttttttcttataaacaaactaaaaaagttttggatactttttgatgacgtttcttacagaaaacaaatttatctttatcttagtgacgttttgttatagcacattattactttatgacctgttttttttgttcctttgtcaatgattacattgtcttgctaatattttcatacagaaattttattttatattctatgatattatcctctcttaaaagctggacaaaccccacggaccacgagtcttccagctaagactttttttagttcccaaaagatcgaacttggcgctactttcattttctcatctctgtttttccaacatcctaagaacagagttcgttgctccttttgttttctttaaagaaaaagtcagattcagatacatacatactctgaagaacatgtcgacgcgaagacgaactttactcaaagttataattcttggagacagcgggttagcttatttttctacctaactgtgttttttttttaatgtttgatccgttaatcattctcttgttgttgtttttgtgtacaaatatcacagggttggcaaaacatcgttgatgaatcagtatcctaactaaactttttgatttttctttctttggattttcttcttttcgtaattttgatttttgtagctgtcggtgagaaaaaaaaaacttagctttttttttttttcaatttgtagatatgtgaataacaagtttagtcaacagtacaaagctacgatcggagctgattttgtcactaaggagcttcaaattgatgacaggcttgtcacattgcaagtgagtttctttgtttgtttttttttggtttaaattgttgtcgatcttttaagagaagagtgtatatgaattattattattattgtaattgtgttaagatatgggacactgctgggcaagagaggtttcaaagtcttggtgttgctttctatagaggtgcagattgttgtgttcttgtctatgatgtgaatcacttgaagtcatttgaatctctcgacaattggcacaacgagtttcttacacgggttttttttttttgctttctccatcacattttctcttcatccaaagattctttcttttagtgactgatagttgttttttgtggatttttgggccaggctagtccacgtgacccaatggcattcccttttatacttcttggtaataaggttgatattgatggaggaaatagccgagtggtaagttactattagtcttaagcttttaaatctgaatagtccatttcctttgtttgctatatatttcctttctttgtgttcaggtatctgagaagaaggctagagaatggtgtgctgaaaagggaaacatagtctatttcgagacatcggctaaagaagattacaatgtcgatgactccttcttgtgcatcacaaaacttgcccttgcaaatgaacgcgaccaagatatgtaagtgttattagtctttctttatgtgatcctctcactttgtgaatctcctccatatgatggatccttattaaactcaagatgaaaaaccagaatctctcaattcaaattttcatataatctttttttgcaactcggtgctacagatatttccagccagatactggttcggtgcctgagcaaagaggaggttgtgcttgctgaatgctgaagaaacatttcttactctcttgatttatgcattacttgttgtgtgtgtctataatcttaatgctgagaaggaccaataaaacttgtattgttccctaagtaaggttttgttacctttctggttcttcatctttgacatttggtggttcacgatttgtatgtaacaacagttcaagtgtacatgtaatgggttggttctgtcttctttatgtaatgggaaactaatgatgagtccggttcagccgcgctaaaccgaatccggttcggtttgaaatatcagttagcaatttggcggtgacgtggcgcttccttccccacttgtttcgctccttagaattcagttgaatctctcgaatcgtcgtcgtcaatcttttcgatttctcttcctctcgtctctctctctgttaacaatg

SEQ ID NO: 7939 - DNA, 3000 bp, Unknown
  misc_feature (1)..( 3000): cDNA_ID_1825906_gDNA_ID_1621175_Annot_ID_57317 3000 nt of promoter + ATG
atcactctccggccgagtctttcactttttgtttcgagtacgcgatttttattatttgtttctttgcgattttagactcgatcaatgaaacttatatatatttgacctaaattcagatttggttattgaatccgttgattgttctaaattgaatcctttttttgtatgattgtttagaggaatgcaaaactatggtgattgattaaatcgtgtgacaatcgaaaagttgaggaattgcaaggattcgagatagagtctaaaatggagcaccaagaccttacagattcgagaaaggatcctctttgcatttctcaattgaaaatttcttcttcttctctcgacccattgcctcaggccaacatggcagaggatttaacaaagagtcgtagacattcacctataaaaggtatagctttttgttttttacttcctctggatattgtttgtttaacttgtgttatatgtgtttagagtttttctttctattgcagtggaagggagtgaagaaacttggggagtagaagatgatgatgaccttactgaccctatttttgataccattgaggtcttatttcatcactttatatgtctctctctctttgattttaaaattggcttcttttttctataggtttgagattaacttctctttttcagggcaatggacattcagatccaacaagctgcttcgatgctgatttaagtgagtacaaaaagaaggccacagtaatcgttgaggaatactttggcaccaatgatgttgtctctgttgttaatgaactaaaggagcttggaatggctgagtaccgttattattttgtcaagaagttagtctccatggctatggatagacatgacaaagagaaagaaatggctgcttttctcctctctaccctttatgccgacgtcattgatcccccagaagtttacagaggtttcaacaaactggtcgcttctgctgatgatttatctgttgatattcccgatgcagttgatgttcttgctgtctttgtggctcgggcaattgttgacgacattcttcctcctgcgtttctcaagaagcaaatgaaattgctgccagataactccaaaggtgttgaggttttgagaaaggctgagaagagctatctagcgactccgcttcatgctgaagttgttgagaagagatggggagggactgataattggactgctgaggatgtgaaagctagaattaacgacttgttgaaagagtatgtcatgagtggagacaaaaaagaagcttttagatgcatcaaaggattgaaagttcctttctttcatcatgagattgtcaaacgagcactgatcatggcaatggaaaggcgaaaagctcaagtcaggctgctagatctgttgaaagaaacgattgaggttggtctcataaactccactcaggtgacaaaagggtttagcagaatcattgattcaatcgaagatttgtctcttgacataccagacgcacgccgtattttacagtctttcatctctaaagcggcttctgaaggatggttatgtgcttcttctctgaaatcactctctgctgatgcaggagaaaagttacttgaaaactccagcgccaatgtttttaaagacaaggcgaagtcgatcatccgagagtatttcctttcaggtgacacttcagaggtcgtacattgtctagacaccgaattgaatgcatcttcgagtcagctacgcgcaatctttgtcaaatatctgataactctagcaatggacaggaagaaaagagagaaggagatggcttgtgtgctcgtctctactcttggtttccctcccaaagatgtcagaagcgcattctcgatgctcatagaatctgcagacgacactgctttggacaacccagtggttgttgaagaccttgccatgttcttagcaagagctgtggttgacgaggtgttagctccacgggatttggaagaagtgttaaatcagactcccgaggcaggctcaagtgtgggcgagaaagtgattcaaatggcgaaaacattgctgaaagcacgtctttccggtgaaaggatcttacgttgctggggaggaggaggaattgagacaaactcgccgggatccacagtgaaggaagtgaaagagaagatccagattcttctagaagagtatgtctctggtggagacctcagagaagctagtaggtgcgtaaaggaactaggaatgccgttttttcaccacgaagtagtgaagaagtcagtagtgaggatcatagaagagaaggagaacgaggaacggttatggaagctactaaaagtgtgttttgattcaggactagtgacgatatatcagatgactaaagggtttaaaagagttgatgaatcacttgaagatctgtctttggatgtccctgatgctgccaaaaagttttcaagttgcgttgaaagaggcaagcttgaagggttcttggacgaatcattcgcttctgaggattcgcaaagtaagaaacagaacggctcgtcttcttcctctggatgataacatttgagcaccatacctcaaacctcgagacgttggtttcacgcaaaatcaccttttggagttttttttttttttttcttataaacaaactaaaaaagttttggatactttttgatgacgtttcttacagaaaacaaatttatctttatcttagtgacgttttgttatagcacattattactttatgacctgttttttttgttcctttgtcaatgattacattgtcttgctaatattttcatacagaaattttattttatattctatgatattatcctctcttaaaagctggacaaaccccacggaccacgagtcttccagctaagactttttttagttcccaaaagatcgaacttggcgctactttcattttctcatctctgtttttccaacatcctaagaacagagttcgttgctccttttgttttctttaaagaaaaagtcagattcagatacatacatactctgaagaacatg

SEQ ID NO: 7940 - DNA, 3000 bp, Unknown
  misc_feature (1)..( 3000): cDNA_ID_1809825_gDNA_ID_1621175_Annot_ID_57318 3000 nt of promoter + ATG
gataagaataaattacgtttcagcatcctttcagtattactgtttcgttccatattgtcatgatttgatttgttaatgtaatttttttcttcgattgatatattcctcgttatgttgctcttttttcgaagttaatacattctcaccttcgaacactaagttttttctcgctctttttgttttaattttagaaaatagttttgtgatttgatatctattatgaagttcgaatatatgcttatatatacatcaatataagttatggtgtccagctttaagtgaagcataatgtactcttgtgatgccgttttgttgattaagacagttgattctgatttggtacatgatatagatcaaattaaatttcaagtaacatccctaaataaaaagatcgttgatatatctcaaattaacgttaagtttactctctcaaataaaagatcgtagttagtatttaaagatcgaattccactaaaattttgttgttcacacaataaactattgatgtttgatattaagccaaataaaatagataaaaaatttaagacaagaaatcagttacataaagatgtagatcaaatgattaagacgtcagatatacaaatattctcaggaaatagataaactgtagatctacttatatatgattagagttgttaacacaccgttctataactcaaatcactaatgtaaagttaaccaacgctagtcgcatcaactaactatgcctaataactaaagatcctaatgctagttgcaataaaaaaagctcgatctccagacagcagcccaaaatcttgattacgttcatgtgattaatttgagagagtatgagcacttcgttgatgaagtgctctacttggctactgtctcctagtcgagctttttttattgcaactatgaaattatccgacagtatccctttgtacacttttccctggcctccctggcccaatatcctgctctcatcataactattagttgcttccttcatggcttcctcagtaaatattttaacatcaacatttgatggccctgatcctgagagtcgatgtatcaacatgccaccgccattttgctcgaagaatatttgtcggagctcaatgtctttacggtgcttaattttctgttttatacagctaacgataacaagcaagacgatcaagacgccgatggtggttcttgatcacaacatcataggtgattagagtaaactgatcagggaaacaatcaagtccagaaacagcgaatgaatcttaccaagaagaattatacctcatccaacgtctaaaacataaataaccaaagtaatttctctccgtaacatatcaacaaagattttctaaagaaacaaattaattttaaaactaacttaaataaacaacactttcactatttaaatagtttataattctagttctaaaatactttacattattgtattgtatacatattcacaacttttattcatattcttgtcttatcatataaaagatgttcgtagaaaatttcataattaaaaaaaaaactaaaacaaagtacaccccactcgaagttatacctaatataacataaaattagagagaaagaaaaattagtggttatatttgatagtaatgaataaaatataagcagttttggtttttgttatgcaattattatttttgaaggaatagtttcttattcacaaattcttagtttgttaataaacttttcatctttagttacaaatatattttttataaacatatattaaaatgtataacagtttacagtagtatgctgaattagttatttttgtagacgttacttttgtaaggtcgattttctaacttttaataaattcgaggatggtatacaaaactgaaatttacgtacctacacaaatgaggatcgtctgactctttctgatctcgcaagtcgcatcgatagctttcgggactattttggcaagttccaccgtcggtacaaatattaggacgtccatttgcaagctccttacactcgtcaatatctggatgatcgatcattaatgagatgaatcagatgatgatcttaatatagtattgatgacttggagtacgtactgacctttacagccgtttagaacataagggttacccgtggaatgtgctgatgattttatgatcattgaccgacaattcagcagtggcaaggattatagtaaaagtcgtaaactgtttccattgcattctaagaaattgtttcaactatacgatactacaatatgatagttgaggtcattgatcataaactgtttgatactacaatattttttgatacaatatgaaaaattgtttgaaaactctacctctttgtaacaaatgacagtaagagtgttaaaaattttgtttcatttttctggttaatataattcaactgcctttttttttaagaaataggaaaatagagactgaaatagtaaattacatataattttataatttgtgaaggagcgtaaaagactcaaaagaaatggtaaaaaagcattaaaaaacggggaaatagtttctttaattattgtattaacaaaaaaaagaaagaagtaataaagtcttatttatttccagaaacaaaataaaataaaataaatcccataaaattgaaaaaatcaaattaaataaaatcagttacagaggaggagcacatcatcgtgttcttcttcgactcggcgattccaaaaaaggacgcttgcttcatcgccggcgtcgctgtatcactctccggccgagtctttcactttttgtttcgagtacgcgatttttattatttgtttctttgcgattttagactcgatcaatgaaacttatatatatttgacctaaattcagatttggttattgaatccgttgattgttctaaattgaatcctttttttgtatgattgtttagaggaatgcaaaactatggtgattgattaaatcgtgtgacaatcgaaaagttgaggaattgcaaggattcgagatagagtctaaaatg

SEQ ID NO: 7941 - DNA, 3000 bp, Unknown
  misc_feature (1)..( 3000): cDNA_ID_1808749_gDNA_ID_1621175_Annot_ID_57320 3000 nt of promoter + ATG
gactttgtttgtaaatgtccgaatattttttcaagatatttatgtatttggtacttcaaatctagtacccaagccttagatcattaaaatttagaactcagtatataactaatgccattttttatttttggattcgatatttttttttttagtgtaatattaaattatatttaaaaaaacaaatatacgtttttataatttgtgcttcgtatgtttgaaaaagtaagctctaaagatttctgatgatttttcgaaaatgtttaaagaaaatgtttaaacaagctaagagtcgaggttaactagtcatgggagtgaatccagttttaaataggcatcgtcatactgcttgtcgcctaataatcgtattgctgaaatcagatttcgaatttgtttatcaacccatatggtgataccctttatattatgatcccacgcacctcaaaaatttcggcgttggattcatgtcactcctagctagcaacctcagggctcgcagtatcccattcgtcttaattagttaagattttttttaaaaatttattttgttcagttattattcatttcattcgaacgattaaacaaagattattatggtctcgtgatttatatgttgacccttctaatattctaaatttaaaaataagaaaaaagaggaaaattgaggcaaaacacatgttgccgagtcattatcaactaggggtgcataatgatggaacaaagcacaaatcttttaacgcaaactaactacaaccttcttttggggtccccatccccgaccctaatgttttggaattaataaaactacaatcacttaccaaaaaataaaagttcaaggccactataatttctcatatgaacctacatttataaataaaatctggtttcatattaatttcacacaccaagttactttctattattaactgttataatggaccatgaaatcatttgcatatgaactgcaatgatacataatccactttgttttgtgggagacatttaccagatttcggtaaattggtattcccccttttatgtgattggtcattgatcattgttagtggccagacatttgaactcccgtttttttgtctataagaattcggaaacatatagtatcctttgaaaacggagaaacaaataacaatgtggacaaactagatataatttcaacacaagactatgggaatgattttacccactaattataatccgatcacaaggtttcaacgaactagttttccagatatcaaccaaatttactttggaattaaactaacttaaaactaattggttgttcgtaaatggtgctttttttttttgcggatgttagtaaagggttttatgtattttatattattagttatctgttttcagtgttatgttgtctcatccataaagtttatatgttttttctttgctctataacttatatatatatatgagtttacagttatatttatacatttcagatacttgatcggcattttttttggtaaaaaatatatgcatgaaaaactcaagtgtttcttttttaaggaatttttaaatggtgattatatgaatataatcatatgtatatccgtatatatatgtagccagatagttaattatttgggggatatttgaattattaatgttataatattctttcttttgactcgtctggttaaattaaagaacaaaaaaaacacatacttttactgttttaaaaggttaaattaacataatttattgattacaagtgtcaagtccatgacattgcatgtaggttcgagacttcagagataacggaagagatcgataattgtgatcgtaacatccagatatgtatgtttaattttcatttagatgtggatcagagaagataagtcaaactgtcttcataatttaagacaacctcttttaatattttcccaaaacatgttttatgtaactactttgcttatgtgattgcctgaggatactattattctctgtctttattctcttcacaccacatttaaatagtttaagagcatagaaattaattattttcaaaaaggtgattatatgcatgcaaaatagcacaccatttatgtttatattttcaaattatttaatacatttcaatatttcataagtgtgattttttttttttttgtcaatttcataagtgtgatttgtcatttgtattaaacaattgtatcgcgcagtacaaataaacagtgggagaggtgaaaatgcagttataaaactgtccaataatttactaacacatttaaatatctaaaaagagtgtttcaaaaaaaattcttttgaaataagaaaagtgatagatatttttacgctttcgtctgaaaataaaacaataatagtttattagaaaaatgttatcaccgaaaattattctagtgccactcgctcggatcgaaattcgaaagttatattctttctctttacctaatataaaaatcacaagaaaaatcaatccgaatatatctatcaacatagtatatgcccttacatattgtttctgacttttctctatccgaatttctcgcttcatggtttttttttaacatattctcatttaattttcattactattatataactaaaagatggaaataaaataaagtgtctttgagaatcgaacgtccatatcagtaagatagtttgtgtgaaggtaaaatctaaaagatttaagttccaaaaacagaaaataatatattacgctaaaaaagaagaaaataattaaatacaaaacagaaaaaaataatatacgacagacacgtgtcacgaagataccctacgctatagacacagctctgttttctcttttctatgcctcaaggctctcttaacttcactgtctcctcttcggataatcctatccttctcttcctataaatacctctccactcttcctcttcctccaccactacaaccaccgcaacaaccaccaaaaaccctctcaaagaaatttcttttttttcttactttcttggtttgtcaaat

SEQ ID NO: 7942 - DNA, 3000 bp, Unknown
  misc_feature (1)..( 3000): cDNA_ID_1809791_gDNA_ID_1621175_Annot_ID_174143 3000 nt of promoter + ATG
ataaaagagaaaataactaaataacggtttaagtaatcactaatcagttagtgaataaagtgtttttaacatcatcaaatttacttcttagtttctgtaacgattttgtaaactcgttttaatatcaataaatttgtttagcggaaaattaaaccaattttttttgcattattgaattaaacaattgtttactgcattattaacaaaaaaaagtacttaaacctaattttgggaaaatgttaaaaagaacaaaaaaaaagtagatctgggagaaagtaggtagatagattgggaagatgagtaggtagctgtcttttttcatctctctcttctccaatcactctctccacacgctacttccttcacgtacctccacgtgtcctttcttatgattttatcacattcctctctcctttgtctcttcaattataaaaacatgaatattatttagattagttggataactgaattattgggtttgggcatgtgtacttggtccttcttctactgttgtgtctcttaagtttttttttatattttattttcggatttcacattgtaacgacggtccaattaaagaatacatttttaaaatgaatttactagtaacttgtaaggtacttaaatggtatcaatcaacattgggatgatttttcttggaaattggaataacgtcgctataacaggcgattagataaattagtcgcatagaatcgtataaatgttaaatgtttttgtctcacacgccccatacgtattttagtcctttgcacttttgcagaagttatcagaattcttttcaatatttaaagaggagttgaattttacaacagtgatgtaattctatctaaagcttaatttcataagtttattatagttctgtttttctttctcaatcgtaaacattttttcttatatagaaaaccccgtacaatctaactactattcaacgtaatttaactactgttcaatcttcaatgttttgtcataagctagtaatctatgcttaattaagaaagaaacataagaagagtcatgagcggatgggccttttgttcatagcattgtattggtcatgggccattacttgcaaagcccaacatggctaaccgcaaacaagcttctaatttcatcacgctacgccaaatgccaaacattgttgtacaacacttctaccttctgagtcttcctgactattggctaacatgaactacgacgttcaaagaaaggttcttcggaggtacactgatcgatatggaattggaatcgaaggttccctatgcacaaaagaacatggcgaaaacacgattcaaaaaaacataacgtccgaagcgcaactaaaacttaatatttcgtgttaaaagccaactaaaagttacatttccgttttgtaagcagaaagtgtgactattttatgtgttcttaacaatatatcatttttttttttactttgttaatatcactttctcatttctaaacgctttgtaatattctagcgaaaatataatttattaatgatttttatttttacatgcaaattatacgactgaaatgttataggaatagagacatgtttgtatcacaaaattaacttatgtaggaaaaacaaatagtataagtctatcgttcccctctctgttcaggcgtcaagcctcccttgccacatttaggacaactcttcataccaaatccttgacaatcaaaacatctgcacatattcaaaatcccaaattaactctccttaagtactcattgaactgtaaatttttagattgatatttgagaaccatgtgacattgttagttattacttacttccacctctcaaacatatttccgttcttcttatttttacctgttccctgtagacaacaagagaattttgtctagtatatgcataaatatagagtaagaaagagtaaaatgaataggtatggtctggaaaagattgatcatacactaaaggtattagtttattacatagtatctagtaatgaaaatcaaattagtaccttgcaaccgggacattcaattgctcctttggctccacaagtctcacaacttttgaatatctgtttatataaaccttttgaagaattaacaaaactcttcattgacgatgataacatatcatattgtatatggatgtatagtgaaatcttaccgaaccaagagagaaatttccgatttttcccgcagaaactttgattgtatcgcgtcgccccgaaacaagctgactttcaaaagctagaatcttcggttctaaagataactcactgcaacaaagtggaaatttcaacatttttgtaactcaaattagaactaggaagtaagatatctatgtacatctatatgcatatctatgcatacaagtgatagtgaatatggatggtgtgagaaagctaaagaatttgcttggttgtggtttgtggatattgaaacggatcatgtggagggaatatgttgacaaggattattgacttaaaatacataagtgaaagaagccaaaagaccctacaaatatccattgaaacaaattaaattataatttttacctaactaataaacaatatcaatcacaatttaattctttattttaaaacagtaaaaagcataaacaattaagagcttaacaatcattttttaatcaaaatatctaaacagtatacattcaagtaaatattactttatgcatgcaaaatgtaaatctgaattctgaatatgttaatttttctttttacaatgtatcaaattttataaattaagaataatatattttcttataaatttatccaattttaatttaagagtaagatattagttcaaaaagataaagaaagggacaaaggataattaattcaatgaacacgatcctaaaatagaaaagtacgaaaacaccccttatcttccgaacacttttccgatcgcaaaatgatcgcctgaaaccatcgccggcttcagagtgtttgatcgtttctccagatagatagattgatccaat

SEQ ID NO: 7943 - DNA, 3000 bp, Unknown
  misc_feature (1)..( 3000): cDNA_ID_2137036_gDNA_ID_1621175_Annot_ID_174133 3000 nt of promoter + ATG
gaccacccgttctcaaatgaggaatccaacgtgtttcgtagccaaaaaaaacgaaaaatatctacgatcaacagatgattaaactagacaaaataaacactagtgaacattttcatctacttgcaatacataaattagtttccaactactggtactagtgaacatttttaaatcatataacaccaaagtattgggagaaaacatagtataccaaaatgtgtcaatatccacaaaactttcttgatcattttgatggatttgtcttcgaaagttctcaaatctaaaactttcatgatatcagtttgcaaactgtaacgataactgatttaatttgatgaataacttgattgaaatttccactttcatgaatatttattactatgggtcctccaaacataatttcatgttaactgtgtatgaataatattcacatgagggaatttgaatggtgaatatcaataaattagaatcccatcatttgtaaactttgtctgtcgttggcaatgaaagtttctcatttatgtactcccatcacttccattattcatttaaatatcattttatacgaccgactaaatatataaaagaatactagaaattccagtagttagcttagttaagaaataacaatcgagaaaatatacatttacattgtcttttagagattaaaacccctactattcaagaaaaaaatgataaaattcgcttttcctaattaaaagagtaaaattgaataattgactggcatgatcgacgaaaagtcgattgctcctaaatactatacatgatacatattgttttgatgaaaacatccaagtgctctatagtctatacaaaattaaattgattatgattttaactgaactgtctgtgtagatgatcatatttcttccttaatggtcacatataaaagtgcattgacactctcacaaaaaacgtatgagtattaaccaacttatccattggaattggatctaaccatgcatttgctgtttttcacatcatctctcgattttttttctcacacacacagattctagagaatctaacgcaataatgctcctttttatatgcattaataatagaaaaaacatatttatttacgtattgtataattaattatcttttattcaaatcttattatatttaataaggatgacgaatgtgatcaatcatcggcgacgacgaccacgagtgctgagatgaagatgatcgtaggaagcaatggacttcgggagataaacaatggattcagaaacttcacaagctcttctacaagaagagtaaagattcagtaacccgatgctcctgctcttcctcaagaccttccttgattcgccgccggtatgttctccgtctgtggtagcgcctttggaacactctaccaacgccgccatgaaaggatctctcatggccgcaggggacgtgttcttcttacatctggtgttagggctatggttactccagtgaggagggagaggcaagaggttgcttaatgattcgtttttccggtgatacgagaactctttaggtttaccgggaagcttttcccatgaaaatgggatgccaagtggatggagaggagttgccggagagttgccggagaataggagggaattggaggaggaggaagagagtgatcgccgggttgaaatgttaaccgtcgaggagaatttgaccgagttggatcgtctagtaggtacaattcgggtccttggcgaagtatccattcaaaatagtgtttagttttggacttgagaacttgttgtctctttgatctcttttatataaaactttggacgtgtaggacaaacttgtcaacataagaaacaaaatggttgcaacagagaggatgaatttataagttttcaacaccgcttttcttattagacggacaacaatctatagtggagtaaatttttatttttggtaaaatggttagtgaattcaaatatctaaattttgtgactcactaacattaacaaatatgcataagacataaaaaaaagaaagaataattcttatgaaacaagaaaaaaaacctatacaatcaatctttaggaattgacgatgtagaattgtagatgataaattttctcaaatatagatgggcctaatgaagggtgccgcttattggatctgacccattttgaggacattaatattttcattggttataagccttttaatcaaaattgtcattaaattgatgtctccctctcgggtcattttcctttctccctcacaattaatgtagactttagcaatttgcacgctgtgctttgtctttatatttagtaacacaaacattttgacttgtcttgtagagtttttctcttttatttttctatccaatatgaaaactaaaagtgttctcgtatacatatattaaaattaaagaaacctatgaaaacaccaatacaaatgcgatattgttttcagttcgacgtttcatgtttgttagaaaatttctaatgacgtttgtataaaatagacaattaaacgccaaacactacatctgtgttttcgaacaatattgcgtctgcgtttccttcatctatctctctcagtgtcacaatgtctgaactaagagacagctgtaaactatcattaagacataaactaccaaagtatcaagctaatgtaaaaattactctcatttccacgtaacaaattgagttagcttaagatattagtgaaactaggtttgaattttcttcttcttcttccatgcatcctccgaaaaaagggaaccaatcaaaactgtttgcatatcaaactccaacactttacagcaaatgcaatctataatctgtgatttatccaataaaaacctgtgatttatgtttggctccagcgatgaaagtctatgcatgtgatctctatccaacatgagtaattgttcagaaaataaaaagtagctgaaatgtatctatataaagaatcatccacaagtactattttcacacactacttcaaaatcactactcaagaaatatg

SEQ ID NO: 7944 - DNA, 3000 bp, Unknown; identical to SEQ ID NO: 7940
  misc_feature (1)..( 3000): cDNA_ID_1809825_gDNA_ID_1621175_Annot_ID_174127 3000 nt of promoter + ATG

SEQ ID NO: 7945 - DNA, 3000 bp, Unknown; identical to SEQ ID NO: 7939
  misc_feature (1)..( 3000): cDNA_ID_1825906_gDNA_ID_1621175_Annot_ID_174126 3000 nt of promoter + ATG

SEQ ID NO: 7946 - DNA, 3000 bp, Unknown; identical to SEQ ID NO: 7938
  misc_feature (1)..( 3000): cDNA_ID_1825902_gDNA_ID_1621175_Annot_ID_174125 3000 nt of promoter + ATG

SEQ ID NO: 7947 - DNA, 3000 bp, Unknown
  misc_feature (1)..( 3000): cDNA_ID_3047017_gDNA_ID_1621175_Annot_ID_174122 3000 nt of promoter + ATG
atccgaggctttggatgttctcaggctatctgttgatccaactgatcatgatcttggtttctctaccaccgactgaaatttgcaatgcgtttgctcaactctgttttcttcttttagttttgatatcgactccttttcttttcttttttgggttttagtcttcctttactattttagcagtttttttttgtttacttagtttatggtttttgtgtctttaacttagtttatggtgtttttctttttctttggacaatgatgatttcttaataatctgagtagacttcttcttccgaatccccaaataatccatctctacttgaaatttaagttgttcggtattcatggtcagcaacaagggacaatccttctattatggtagcagccttctattatgaatttattcgaatgtgtctactcataatttgtggtttgtatttcaacttgtagttgatatcaattatatgcacacagactttttctttttgaggggttggaagcaagcgattcaatgattgtaccactcatttcataatagtgtttgatatgacgttaatttgaatggtttatgttgatcgaaaatactctcagtcacaacaagaatctaattcgattaatttatttgaaaaacatatgttggcatggtacatgaaccagctcgttcatatgaaaatattttaaaaagtcaacatcagtgctaatttcaaattgaccatacattagcacacaagaagactaacaaaaaaaatgagtgaataaagaagagagtgagtggggttgatacatgtcaccgtccaaaatgtgtctgacccttctcattggagctacaagagccgaccctttgcctcatcatttgttgacttcactctccttttacatatttaaattataacttgctcatatttccattcattgtgttcggttctagattgttccatccactttcttttttctcttactttgaaatttagaaatatatgaatacttgacaaatatttgaatattgtaactgatttgtttgttcgtaatacttgacaaacttttttgaatatacacctttacatatattttgagttgagataaaaagggaattatgttagtttatggattatattatgtaaataccacatctaactatgatcggatgaaaactaaaccagcatatctctaatcagtaatatttactaaatttatatatcattaaagattttttgaatttagcaaaaaaagaagaagatatcattaaagatttttaaatttaaagtataacataatgaataaatcaagtgttgagcttagtttcgcgttgcaaagatgttcatttgatttttttttttttttttccatttgatttttcttatactaaattgattgatgtcacggtccttctgtgaaaaaagtatattgtactgtataaatttataatagtcatacttgaagataactaatatcattttctaaaggttttgttgacaatgaaatgggtaatgatgaacatctcgtttgctaaaccacaaaagaaataattcgttggactataacttaaacttataatatatcaactgaaatgcctacaatttgagaatacgccttttcaaaaagttttagaattttataaaaatttctccaccataatattactttaataaaagcttgttattaaaatgatatattaacaaaaaaaaaagaggtaggcaaagtagcttttattaaaattaatgttttccctaattggtaaatcataaaccaaaaaattgaggtaattcttaatatatttactatgattagaatgatacattaatgtaacattttatcatcttcattaataatagtaagttctcctcaaaattacaatttgatatcaaaaaatatatttgtattacaagcaattactgaaaaattaaaattacaatttagcccagttacataactccacgtaaggtttgagcccatcacatcacatggtacatgaccaaagcccagttatgttaccatggagtattcttcagacaagagccatccagacagaagtggaccacacaatcacgaatcgtatggagatcattacaatatattgctcacatcttattgcgccacgtctcttatttggcgagtgatcaacgtccacagatctcttgctccactctgattggtacacgtcatcattttattgtgctacttgtttatgtggtacagtagagacaagtggtaagattttaaaatatcttaaaagatgtgtgaggcccatttagatattttctcaacgggctgttcctcaaaagctgcccgtttatctacaaccatcgaacggctcgaaactattctgggctagctgcccgaaatctcttaaaggaatttgttgagtgggcttgaatcaacggtggataattcgaaggtgtacgtaacatctcgtagcatctgaacttagctcccctcaaaatatctgtggacatatgtcactagctttttttttgtgtaatgaaactattaattaattaggcaatcacatgagagatgttatatacttaaattaataactcaataatacaatcatgaccaccaaaccttgaaataaaataatctctctgattacttgtacaaattctttaccaatatatgccatactgtgaatgtaatggtttattttaaaacagccaaatattattgatataattatatgtttaagtagattttaaacttagctcatggttaaaaatagacagaattttggagtaaatctgagtttacaaaatttatttattaggattaaaattaattacttaaattggcaaacatttttcttggtgattgtaacatacaatatacgaatttgaattcgcattgtgattccaaaacaacactaacataaactaccagtaaaattttttaaaataaaatttcatatatatatgcttaaaaaatgtaacaaaaatatggtaaattttttaaccatggtatgggtggagatgtatgtgggatgatgatggttatatggtaatg

SEQ ID NO: 7948 - DNA, 3000 bp, Unknown
  misc_feature (1)..( 3000): cDNA_ID_3047025_gDNA_ID_1621175_Annot_ID_174120 3000 nt of promoter + ATG
ggaatgaatagtccgtcctatcgattcttcaacgccgcctcaatagactggaaagccgatatccaaaactgtttaaactgggaagctcacagcttgctctccacaactatgcctactcagtttctcgacactgcggctcgggaactcggctgtactatatccttgtcccaataacgagcacccacttttgtttttggtaaattttagttctctagacaaaacatttggacgtagaccaagaagaatatatatatagtttgttgtatgtaatgttgtaatgatgagtgactgacgcaatcactcccaccggcgttggatttgctctcgctcggtgtcttatataactcaacctcttctctgtacattttaaatgacgaagtagctcaatctttttttttgtgcgtctggtgtttagtcttcagtggattctaaatcgtaatgtatagaagtgaaaaatttacaaatttacttatttccgaatactcttaaaacagcaaaaattaatattgcaaaagataatttatagtattttaatctttttcctccaaaaaaaacattaaagggtaaattagtaattaactacaggagcttcatattaggttggaaaaccctaaatatgccgcttataacagacctgagcttaagctgtggtggcgcctccagagtctggtaaaagagcttaatcctcctctcgcgatctttctcggcatccaaaaatggtacgattatcgttcttcaactcttgtctggttctccaattgctcgtgcttcattttgcgtatcgctcgtttttcattgctggttttgggattggagttttaagctcaaatgttttttgtattcccttacacgatttgcgactgacggatctgttttttttttttcgtattcgtgtgtgtgtagtctctagttgcgaacgaggagtttcagcatattctgcgtgtgctcaatactaatgtcgatgggaagcaaaaaattatgtttgctttgacctcaatcaagggtattggaaggcgattggctaacattgtgtgcaagaaggctgatgttgacatgaacaagaggtttgtttcttagcttggttcttaatactttcagttacttaggaattctatggataaggattatgaatcttgcgaggttttggatgttagtagaaaatgtagctctttgactagaattgtacctgctcgatctggtttgattgatttctaggaaatcagatatttaggttttctttgcacatagaacttctctagattgatattcttgaagaagtttggtctagtgtgtgtttttaaatgttttttcctttgctggtatattcagggctggagaactaagtgctgctgagattgataacctcatgacaatcgttgctaaccctcgccagttcaagatcccagactggtttcttaacagacaaaaggattacaaggatgggaaatactcccaagttgtttccaatgctcttgacatgaagttgagagatgatcttgagcgtctcaagaagatcaggtaacaaacaacacatacagacactctcctctgtagtttttagataccatgttaatagtataatgatgcccatcataactttctatatggaagaagctaagtacacaactcttgtgttaaatcatgtatacactcattttcggcaacaaaacctaatctgtagtgtaatgatttactgatgcatcctttgtttctctcttgttgttctgataatcgatatagaactttgtttgtactgactgagattgtcactgtaatgtaaacagaaaccatcgtggtctgaggcactactggggtctccgtgtacgtggacagcacaccaaaaccaccggacgccgtggaaagactgttggtgtttccaagaagcgttaaaaagagtttgagcttggttcaatggctttgttttgttttttttgtattgttgttttttgcagaagagatagtttaagagatgttgtttcatcaaaagacggtcttagcttttacaatatataattgaatccaaaaactagtctctatttattacattctcttctctcaaaatctgctttaaacaaagttaataatagcacactcctccatacgcaagaattatataattagagaaaacttttaagtgtcacaagcggctgtctctataatgcgcaaatacatcgttatcagttttaatcactatcagtaactttactgaacttaattgatcattttaatttttcatgttactctctccttcttcttcacttgttctctttctcatcgcctcttgattcacgcgaacgagaaagcgacgatcgtaaccaccggcgctgaccaaaaagtaatcgattctcttcccgagctgatctctcaggtgcgtgaattcacttttttttttttcgatttttcccgagaaaaaaatccagcaaagagtagtagcgatgaagaagacgaggtttgaattgagattcgtattctttcggtggcttgaagtagcttatgcatgtttaaactcttgttcagttgtttgctcatgattcgaaaatggctttgtagatcttctaatataatctcttctctttatcaattcactagtgttctatatctgaagaaatttacggctacagatccaatctcatttcgtttcgttacactatctctactaagattttgttttttgttttttttccctctttttttgcgttttagatctcctccatgattgaagttgatccatgcttttgagtttaagtgatttatttaagatcctctaaacttttttttcttcacttagtggtggttccagtcaatttagcaagtaagatgttgtatgtgtcaatgctataactgtgaattttcagctattgtagtttgatttttgtctttgttagcttcaggtgtcttgaatctgaatctgtggctatatttggtgctcggtggtgagcaggaagggagggggatattgtcagggttttaatgtacgtcagatgaatagagcaactaatg

SEQ ID NO: 7949 - DNA, 3000 bp, Unknown; identical to SEQ ID NO: 7935
  misc_feature (1)..( 3000): cDNA_ID_1809849_gDNA_ID_1621175_Annot_ID_174118 3000 nt of promoter + ATG

SEQ ID NO: 7950 - DNA, 3000 bp, Unknown
  misc_feature (1)..( 3000): cDNA_ID_2137036_gDNA_ID_1621175_Annot_ID_57322 3000 nt of promoter + ATG
gtttgcaaactgtaacgataactgatttaatttgatgaataacttgattgaaatttccactttcatgaatatttattactatgggtcctccaaacataatttcatgttaactgtgtatgaataatattcacatgagggaatttgaatggtgaatatcaataaattagaatcccatcatttgtaaactttgtctgtcgttggcaatgaaagtttctcatttatgtactcccatcacttccattattcatttaaatatcattttatacgaccgactaaatatataaaagaatactagaaattccagtagttagcttagttaagaaataacaatcgagaaaatatacatttacattgtcttttagagattaaaacccctactattcaagaaaaaaatgataaaattcgcttttcctaattaaaagagtaaaattgaataattgactggcatgatcgacgaaaagtcgattgctcctaaatactatacatgatacatattgttttgatgaaaacatccaagtgctctatagtctatacaaaattaaattgattatgattttaactgaactgtctgtgtagatgatcatatttcttccttaatggtcacatataaaagtgcattgacactctcacaaaaaacgtatgagtattaaccaacttatccattggaattggatctaaccatgcatttgctgtttttcacatcatctctcgattttttttctcacacacacagattctagagaatctaacgcaataatgctcctttttatatgcattaataatagaaaaaacatatttatttacgtattgtataattaattatcttttattcaaatcttattatatttaataaggatgacgaatgtgatcaatcatcggcgacgacgaccacgagtgctgagatgaagatgatcgtaggaagcaatggacttcgggagataaacaatggattcagaaacttcacaagctcttctacaagaagagtaaagattcagtaacccgatgctcctgctcttcctcaagaccttccttgattcgccgccggtatgttctccgtctgtggtagcgcctttggaacactctaccaacgccgccatgaaaggatctctcatggccgcaggggacgtgttcttcttacatctggtgttagggctatggttactccagtgaggagggagaggcaagaggttgcttaatgattcgtttttccggtgatacgagaactctttaggtttaccgggaagcttttcccatgaaaatgggatgccaagtggatggagaggagttgccggagagttgccggagaataggagggaattggaggaggaggaagagagtgatcgccgggttgaaatgttaaccgtcgaggagaatttgaccgagttggatcgtctagtaggtacaattcgggtccttggcgaagtatccattcaaaatagtgtttagttttggacttgagaacttgttgtctctttgatctcttttatataaaactttggacgtgtaggacaaacttgtcaacataagaaacaaaatggttgcaacagagaggatgaatttataagttttcaacaccgcttttcttattagacggacaacaatctatagtggagtaaatttttatttttggtaaaatggttagtgaattcaaatatctaaattttgtgactcactaacattaacaaatatgcataagacataaaaaaaagaaagaataattcttatgaaacaagaaaaaaaacctatacaatcaatctttaggaattgacgatgtagaattgtagatgataaattttctcaaatatagatgggcctaatgaagggtgccgcttattggatctgacccattttgaggacattaatattttcattggttataagccttttaatcaaaattgtcattaaattgatgtctccctctcgggtcattttcctttctccctcacaattaatgtagactttagcaatttgcacgctgtgctttgtctttatatttagtaacacaaacattttgacttgtcttgtagagtttttctcttttatttttctatccaatatgaaaactaaaagtgttctcgtatacatatattaaaattaaagaaacctatgaaaacaccaatacaaatgcgatattgttttcagttcgacgtttcatgtttgttagaaaatttctaatgacgtttgtataaaatagacaattaaacgccaaacactacatctgtgttttcgaacaatattgcgtctgcgtttccttcatctatctctctcagtgtcacaatgtctgaactaagagacagctgtaaactatcattaagacataaactaccaaagtatcaagctaatgtaaaaattactctcatttccacgtaacaaattgagttagcttaagatattagtgaaactaggtttgaattttcttcttcttcttccatgcatcctccgaaaaaagggaaccaatcaaaactgtttgcatatcaaactccaacactttacagcaaatgcaatctataatctgtgatttatccaataaaaacctgtgatttatgtttggctccagcgatgaaagtctatgcatgtgatctctatccaacatgagtaattgttcagaaaataaaaagtagctgaaatgtatctatataaagaatcatccacaagtactattttcacacactacttcaaaatcactactcaagaaatatgaagaagatgaatgtggtggcttttgttacgctgatcatctcttttcttctgctttctcaggtaaactgttaaaaccattttcaagactaccttttctctatttcagacaaaccaaagtaaaacaatgaaaaatctctctggtctttcataggtacttgcagagttgtcatcatccagcaacaatgaaacttcctctgtttctcaggtaagagtgatacaaaaacatactaaacaaactttcaagagagtaatatataaggaaatgttggcttcttttttttgttgctaatcagacgaatg

SEQ ID NO: 7951 - DNA, 3000 bp, Unknown
  misc_feature (1)..( 3000): cDNA_ID_1809803_gDNA_ID_1621175_Annot_ID_57325 3000 nt of promoter + ATG
acccactcagggatcgagtcagggataacgttgaacttgttaaccgctgtgtgcgagtactcttctgttttgtaacggtaaatgtcgttgagctgctgaaaatcgagccagaaataacttctcatgtggaagctaagcgcgtgtagccgcttcactatcctctccatgaactctttaccttccgcgtcgtgctttagcatcgacattgctgatctaagagccatgaagaagagagcttggatctctatcggatacccgtaaaccccctacacaagtatcagttcgttaaacactaattctgtaaccaaacctaagtttgtctagagacctatctactagattcctaatgatttataaagagaagaaatagagggattatttattaccattcttcgatcgatcatggagcagccatcagcacaaagtaaggtagggaaagtatcgaaaccttcggagagacaaagagagagaatgagtctcattcccttttgacattcagatgtttcagctagagaagtgtctccggtggattttgtgtaggctctaaggagaatgatccaccagaaacctgagtccaccggagccactcttccaatcgcgctctcgccaaagtcagcattgatagagtcggtttccttgatcgggtcgtgaatgaccttgaaactagccggcattgcgccttcaccgagcttgaatcggtctattcttttctcccttccttggatttgaattgtcttgaggagaaagtttttaactatgtctggttctccgttcatgagaaaagctagtgcacttggaacaaagtctcttacgaaaacctaaccaacattttgaacaaaattgtaataacagagtcattacaaaacagaacaaggtttaattatgaaacacaaaaacaatccaaataaccaaacctgatcataattcaagacttcctcagtagcatggtcataagcagcgatagtaccaaccggttggccacgaaagtaaaccaatgatcgtctcaaagcatcccaagcctctgcaaccataggatgtggctcaaacgagtttctagccgaagacaccggagtttcccatcctccgggagaattaacgttgtcgaagattcccatttcgctgaaggacctctcgtcaaacgatcttttccgttcaatatttaccctcggccggtcaagtaaccgagccaattcgtctaggtcggatatagagcttgaagagtttactccttccatgaggattctttaactttgtgtttctgtgtgtatagatctggaacaatggataattataaatgaattaaaacgtatttgtttggacatgatgattaaggaacattaacgtaaaaaatgtaacggaaatattaagattggacttatctagattaaagtaattaacattagttatcgtcataactactgttcttatggatgtaacaagaaatcgttacaacaaaatgtcgaagctcatctaagaaggtaaggataaacataacggaccttaattacgacggagagataatctccgggcaaacaaatcagccggtgaagaaaaatgtgataaatatagaaagaaggaaaaaaaaaagagagagaaaggaagatgttagatataatatagaggggagattagagacgactacgaacgtggaaagtctctcatttttcttctctcattgactgtggtaatggtggagaagagagagatgaaggcatgaagggtcgtagagagcaggtgattggagcgtggcgttcacgcgaagaaaacgacatcgtttttgagtctgacatgttaatttggcttaatctctgtcgattgggtcattggacttttcgccggttcgatcagctttttctcgagttttgtttcgtttagacgactattatgtttttgtcttcacttttaaatttgactttgtataatgtgataggttgaaattgaccaattggcgtaacttggtggtgaaatcaaatgatttgtttctggagtactatatgtttcctttttggtttatacaaatatggtaaccaaaaccgcatccaaaaccgcaccgcaacagtgctgtaatagtatcaaaatctttacatatacatatgtatctatgtattttcgttactatttaaaccgcaccgtactttttccgtaccgcaaaacgcagtcaccattcggagcctaagttttttatcaaaaaaaaaatgtaaaagaaagtggttttagctatcttgaaaatcaatcataattagtagttgatcattgcataattgaaatattcgaggattagaaaatacgttttcatggcaagttgatgtgtacattaccgtcaaatcaaatataacgtggatttagaaaataaatagaaaccattgtcagtgcatgcggttcacgtggacgatgttaaatccaggattgtgtttttgctttcaagtcaggtcttatagttgatgggaactgaacttagctagctgtaaattgactttttgcatttatgtacaatgcctttacctgtttttttgtttttttggacaaccatgaagttcggagccggtactcgtatctccatgagtcgggatgtgttttaatttgtgctaatacaaatttgtgttgtagtctctctttgtacgtacgggtgatcgctacttttgttggtatacatgatctaacgcatgcgtgtaaatctatttaaagacctatacatagtttcgtaggtttcacgtaaagtcttcaatggttgaactaaatagtgttactcataatcacctatccatttgcaccagatgaaagagacgtattcattttcttttcccgcttaaaattatatattgaattgatctaaataaccgattcaccaattgtatatcttagtaaaggaaattgggccactattgggcctaataaccattctaacttttacggatccgacttagcccaaacacatcgccggttcagaacgctgccgtaaatcgctgcatcggaaaaagcacgatgatactaaaaaccatg

SEQ ID NO: 7952 - DNA, 3000 bp, Unknown; identical to SEQ ID NO: 7942
  misc_feature (1)..( 3000): cDNA_ID_1809791_gDNA_ID_1621175_Annot_ID_57328 3000 nt of promoter + ATG

SEQ ID NO: 7953 - DNA, 3000 bp, Unknown
  misc_feature (1)..( 3000): cDNA_ID_1809897_gDNA_ID_1621176_Annot_ID_57331 3000 nt of promoter + ATG
ctatggtagtgtgagcagagacaaagtttctgtaatattcatctcttccttgctactcattcccttactctaactttgtctgtgtttccgaattgattcttttgggttttgtaagtataatggaagaagcactgcaaatgttgttcttgtcactacctctcttcaacaatctaaacatgagaagatgattattgctgggttaagattgtctatattggagagaatgtcccctggatgcattaactgtaactgggcaaactttgattttcaagaactgaacaaagtttgaagcttttgaaccgctgaaatcatataccttcaggcttcagcccttgatagaccaatagagcgacataaaataatcattcagactttggtaagtgttgggactcactgttacgtgagagccctccaaaaataggcgtatgccacttagcgtggagagcacacggtattctttagtaaaaggcgaaagaatagttcgctttgtgctcaccacatggctgcgtgaatttctttaaggaagagtgaagtctatttatataaaagtttcaactacaaactctttcagctttccgatgtgggatacatgaaactccttgttaaatggttttgtgggatactaaagcccattaccattctttttatacttgtttatccatttacaaaagacttcaccaacaaagtctcattttttttttcttgaacaaaacaaagtctcattttaagtaaggactgtacaatgttgatttcgtataagctaattcactggatatataaccaacatttacaaacagtataattctacatttcctatactctctaatgtgcgtaacaaacctgtcttgtacactaccgctcacccgcctattcgttctagctagctgcttccgatcttctcaccatatccaatggaaacgtagctgcaattttgtttttcttagatgagacattttacgtaatgcatcaattctatgaagtggtcctactgcctatgaatgcagcatgagataagcttcattaggatatacaccaaaaccaaccgtgaagaataagactcaacgtgaaactcatataaggccataagagacattattcacaaatagaatgatataggtaaacattgtttatttctctacttttcactatgttaaatgatatatatctcttactatgttaaatgatatctcttaaaagagttatatggagcattcaaacattgctccaacgattgagagaatcgcgacgatcatgaaaatgtataagacatcttggtatgatgcaaaaagcacaccaaaagtagtaaaatgggatcgttaatttgttgcaagagttttaacatgaattcgtaacattcatcatcattcatgacgttaaaaagaagtataattaatagcgagcctattgaaatctgacaccaaaacctctttatagcttctctcttgtttatagtaaaaagattttggttatggtgatatatatagtaaagcttaacaatcatattgacatttacataaacgctcgggagggtaacccttccaaacaaaacgttgagaacattcgcaacgtacgacaagatcttttggcgcaccaggcatttttttgatgtcgcttatgcatgtatcctttccattagttccacactttcctggaaatggtctgttcatgtcgcatccccattttgttttggattccacctctattgagttatgtcaaccacaaaaagatgtgtcaaattacaaaaccattaagataaaacaattgataatgcgaataaagaaaaacgaaagttacctctaacatggctgagaacaaggaatgtgatcagaagacaagaaatcataaacaaaacaccacatttcataacttagaaaatgattaattgatcgtctcctttagtagcaaatacttatagtttatttttatttattttgacaacaacactcataataaatataactcaacacaagataaaattagatgttctattaattggggaacaaagaaaaaaagaacgatggagccaagtctacgaaatcgatgggatcggtcgtttattgtttacgaagttcgcctatgcaaaattataattttctaatccattcacatcccaaaaaaaactgaaaacttcatattatagaaattcataaatatctcacaatttattctaatacgcaatatattgacataatattttatatataagaaaaattagtgatgagttctaaagaagattcattaaaacaaacacaaaactatgtattaatattatacatttattaataagaccatatatttatatagagattctaaaaaaatattatcgctattgagttttatttaattttatactagccaaaatttaatattattttacagtatattattaagaatttatggtaagtatgctaaaactaacatatcgaataataatatgtaaaattgtaaaatacataataactcttaaattcctatagtaagttcacttttcagttattttaatatcaattttaaaatcatagaatattaatttttcatcgtttttgttcataagccacgtaaaccaaccaatgggacggatcataacaaaactcaacacatatcaaccattttaaatcatccgaacatgaagactacatcctcgaattcgataaatttacacaaattctgggtttgtatctgtttaatccaggaaagtgcaataaaatcgaagaaattgtgtaatttgctcaaaacattgatgcccacaaggtgttcgacacaattcctcaatgggacttcgtaaaaagagctgttcgagaagaagacaccacgaattgggttcccactcactgctcgtctctctagtcacgtggatctcacgtgataaaagcttcatcatctactatcacgtggatcacacgttataaaatcttcttcttctcgttatcatttccgtttattttcccgcctcgcaaaccctagagaccaagaaaacacaagaaagctaacagaatcatg

SEQ ID NO: 7954 - DNA, 3000 bp, Unknown
  misc_feature (1)..( 3000): cDNA_ID_1809893_gDNA_ID_1621176_Annot_ID_57332 3000 nt of promoter + ATG
gaggttagttggtaactttggctttatacaaagatctttcatcttccctttgattttctgttttaacatgttcctttcattataatgtatgtatcttcttctaggaagagttagaagatgcagcaccaccagaacttttatcagagaaaaaacaagagaaggcgaagaagtcagggtcaaagaagagaaaccataaaagcacgaaggtctttgatggtctaaactctatgtttgcttctctgacttttttgattactcagttgtacgaatgaatggtcttcatgccatatcagagaacttcagcgagcatgtctagtcatcttgaccaggatgtcgaacagtaagtactctagatgagaaatttggtttataaattgtttttaggttttctctgagcaaaacgtgttcttaaatatgtccagtgaaatatagtttgtcaagatgagaaatatagtttctcaagattcttttgcaaattgttaaactgtttgtaggttttctctgagcgtagaattcggataattcttcaatatttgttattatctagtctagtaattattttattttaattaggattattcattcaggattttctaggggtttttggttatcttacaaatagttttgtttgtttgatgagaagcctatctcgaaccacattaaacttctgcttcatcacacaaaacgtgatcttacctcaaccttaaacctttcacactaaacagggcaaaagaagattctatggaactagaggacgacactaaaggtgaaaagagtctatttgaaatttcatccaacactaataatcaagaggaagctactaaaggtgattctagttgtaaaagatcttattgattgacaaatattctaaaactctattgtcttgagcttatttctttagcatgtcatcttaaagatatgcaaagcatgcctcgagaagatttggagacagtaaatggcaaagctgcaactagatacaattcagctcttgacatgatgttgaaggtaaagcagtcaacaacaaaaataagattcaaaacctaaactctctttttctgattcaacatattctcagttttcatgtatctctttacttccttacttctttgaatatttttttgctactgcagtccctctgtaacattaaggttcttaaagaggatttagtgaacaatcggaaaccattttctgaaaaccaagttccttgtgcactacgagatttcttttctgcttttgtctcggagaagataaaagaagaggaactctatggtcacctactgagcaacttacttgattccctagaagaacttcattccctggtttgtgtagatatagataagcttctgagtactattattattatcccgaatcggttagaatgttgtctttaatgtcatttgatttttttgttaaactcatttcagtcaagtaatgctgctgaggtacttgttgcaatcctcgagttttgtcattgctggaaaagtccagaaagtgaaagcttggtaactcgcctttttacattggaggaatatgaaagaatgagttgtagaaaatgcagaaggaagccaaattatccagagcaaagttcttatggaattgttatggctgcagattcaatcagagacctagaggtatgtttcatttattcccatattttacttttctacagaaactggtacttaaaatgcttgtttatatatgcagtgtgctttggggaatataatgtttgaggacacccttaaagtaatccgcatgaacaatgaaatgatatgtgatgttggaacaggaggctgtggagagagaaaccttgttcaccacactataagtagatgcccgcctatcttcacaattggtaacttttgaccatgattgtgatcttatactcatatttcatttatttcggtatgataaaacattgttgctacttttttttttggggttttaacattagtgttggaatgggagaagaatgaaactgaaatagaaatatatgaaacaacaaatgctttgcactgggagatagatatcagcaggttatacgaaggcttagaaccaaacactaactaccggcttgtgtcaatggtaaaatctgaaacatcgtgacaaatgtttgtgctattgttcttctgtatttctctactacagtctgagaatttgggaatgcagattggttgtgttgaagaaggagaatacatttgcatggcttatgaaaagaaccggtgggtgagccgcagacatgaagcttcagcagaggaggtgagatgaaacagttgcctttgtctttattgccctgaattgtgaactttgttgggataagacatatattgatgtgtggtgatgccataggttgttggcaactggaagagtgtggtcaaaatttgtggagaaaggaagattcgttcagaggttcttttttatgaagctgttcaatgatagaaatgtattagtatggaactcaagtttgtaatcttttggttcattacttgattttagtaataaagtactaataagataattgcaacaaaatatataaacaattgttaacgacttaaggtttttgttaattcctcttacacaacataaaccaatttcgatcatcccatgaccatctttgatcccgaattcgaaaacttcacacaatttttttgtcttatctgttaattcacacatttctggggtgtttttttctgtttattctggatggcgaaattaaatagaagctgttgtgtaatttactcaaaacaatgaatgcacacaagatgttcgacagaattccccaatggagatatcgaagaagaactgttcgaaaaagaagacacgacgacttgggtttctcttgtcacgtggatttcacgtgataaaagcttcaacaactctgttacgtggatcacacgtgataaatgcttcatctctgttgttattatcatctccctcgcaaacaagtttctatctgaatctcaagaagcttgaagaatcgttcgttactctttccttaacatg

SEQ ID NO: 7955 - DNA, 3000 bp, Unknown
  misc_feature (1)..( 3000): cDNA_ID_1809889_gDNA_ID_1621176_Annot_ID_57333 3000 nt of promoter + ATG
tctgtttttaggatatctaaatatctaccatgccatgtctactactctatgacttacctactctgtttttaggatatctaaatatctaccatgcatgtcttgactattgtatgtttgtatgacttttgatgcggttgtgaatgatcgtagtttattaaagttcttgaaatatttttatgattcaacatttgcattcttttcttctgttaaggtaacatcaaagtttttagagatgtcactcagaaatcaaaaaccattttgaatacatttattgctctccagtcaaaaatcaacatctttctctctttattcactttttggatcaaacctacctaagcaaagaagcaaagatcctagatcaatccagaatgtctcagctagttacactagtcctgtactaaacaagaatgccatatcattgttgaaacccccccaactataatgcctctcgtcctcgtcaaagcatgcagcccaatgatggcaattttgagttttatgcgtttgttaatgatcttttaagttattaaattttaggttgtgtacatcttctactaaagcttcatgtttaagaactttgctttggtttatagggctcccttctgcttctctcatgttcttccaacgttaaaaggatagtatctttatacaagtgttgaacttgataaaatggtatccaagtatctactattcaatgatcataacaatcaaaagcattgttctatacttactcctataaagtttttgacttctacatcaaattcctttcctgcaccatttgaaaagcttcttctattcagtcttcagatccctgctcggaaaacatctggtcctttagaatagcctgcaattcaagtaggtggaattgagaacacacacacataagcaaaataaacatgcatactcagtcaaaggagcttacgttttcaaagaatagaatctcaggtcgaatatgcagttctcgaaaaatgcggagaacaccatcccagtctccaataacctggacaaccagcaatatacatcactcagtcacagatcaacaacatactagcttgtcttttacaaaaatgtctataaagctttacctctatctcagaacaaaaatgtctgacccatctattgttttcataagctacacagttgtatagatttccatgcgaccaaacctgaatattcaacattggtaaacatagtaaacttaaacggaactgaaacaaattaaaaatcaaatacttggacccttaccattgagacaagacggtatttggtaaatgcactgtcacctacatatctatatatagcactaatatctatttcagtcgccagaacagaagctgtatcgaatatctctttttcggtctcattgttctcccactgaagtgctataaaaaataagagaaaacaagctcaaaactactgcattatgttgttaaagctactaaccaattaacaatccaaagcttaccaactataaaagcagatggaaggttacttatcatagtatcaacatagtttcgtttcccacatccttccttgtcacaaagcatctttacattgatcatgctggccttaatgatattctcaaatgtaaactccttgaatgcagactgtgattacccaaaaacgttcaaagacttaaagactctctctttcacatcaaagataagagaaaagagaaatgacttgccttgtatactctgagtgaattagcattgatgatgataccataagacgtttcacctgaatatgccatatccgtcttgcacctaatgcaaatcgttttcgctacttcattcacttcaaagtgatagttccagcgagggataagctccaagatgtttagaaacagtttagaaacaccgtttgcttcctgacaaaaatatgaagcgtgagaaagaagtaatcaacatacataagggtttaaagatcagagctgagaccagaggatgagtgagactgagattgttgagcatgaaaatacgaagaatgtcttgtagaggaacagattcattatctgtgaggctctgattcgcttcttgaacataatccatcgaaagattgcttacgaaaacgctaatgttccacagagactgcacaaaatcaaattcttgaaaacattaatcaaaaaaacaagatcgataacaacagattcgttttggattgttgagttctgcgaaaccttgagtatcatatcaagagctgaaagtgaagtggcgtcgagtatcttctcttcaggctcctctgtatctgagtctgagagatctctgaataaacaccaaggagagaaaattctcagagaaaatcgaacgaaaaaagcataaagatactcgaaaaatgagatttgactacttacgaatcaatttcttcgtctttctccatttctttaacctctgatagatccatctccatgatctcgctgggactgatagtaagaacaacaatggcgattttctatctgaattttctcgagaaaataaaagaaacagagagagagaaaatgaggaagcgtggaagagaaggatttatagggttaggagttagttggtttgttcacgtgagggtcacgtcatctgttaagaattgagcgcgaaaattattccacagagaaatcctaaatcgtgtattatagtattgtgaacttttgtcgaacatttggtgggcacaatccattttttcctgattatatcgattcgtgatatcacttcatgccttctcatacaaaaaaatatatacataaatgtctttagtgtaagaaataaaaacaccaaagacaatcctgaatttttaacctgaagaatgctcacaaggtgttcgacacaattccccaatgagtcttggttgttatttttcttaaaaactcttgtcacatggctctcacgtgataaagtgtgcgtcactgatacatgaccgtcgattttcccgcgtctaccattcagttttctctcgcacaagtaaaacaagaaagcgcaagaagcttgagaatcgtcactcttcccaaacatg

SEQ ID NO: 7956 - DNA, 3000 bp, Unknown
  misc_feature (1)..( 3000): cDNA_ID_1809878_gDNA_ID_1621176_Annot_ID_57336 3000 nt of promoter + ATG
tgaatagaagaagcttttcaaatggtgcaggaaaggaatttgatgtagaagtcaaaaactttataggagtaagtatagaacaatgcttttgattgttatgatcattgaatagtagatacttggataccattttatcaagttcaacacttgtataaagatactatccttttaacgttggaagaacatgagagaagcagaagggagccctataaaccaaagcaaagttcttaaacatgaagctttagtagaagatgtacacaacctaaaatttaataacttaaaagatcattaacaaacgcataaaactcaaaattgccatcattgggctgcatgctttgacgaggacgagaggcattatagttgggggggtttcaacaatgatatggcattcttgtttagtacaggactagtgtaactagctgagacattctggattgatctaggatctttgcttctttgcttaggtaggtttgatccaaaaagtgaataaagagagaaagatgttgatttttgactggagagcaataaatgtattcaaaatggtttttgatttctgagtgacatctctaaaaactttgatgttaccttaacagaagaaaagaatgcaaatgttgaatcataaaaatatttcaagaactttaataaactacgatcattcacaaccgcatcaaaagtcatacaaacatacaatagtcaagacatgcatggtagatatttagatatcctaaaaacagagtaggtaagtcatagagtagtagacatggcatggtagatatttagatatcctaaaaacagagtaggtaagtcatagagtagtagacatggcatggtagatacatagatatcctaaacatagatagagcgttaacttcacattcagtttttacgcttaaaacagagtagtcccagactctagagtagtagacctgacatggttgatatcctaaaagaagggatggtttttatgggagtttttaatttcacattcaatctctacctccaaagtcccttcacgatccaagtaagccccctcatttttatcgaaagacatggattgaggaagaccccacgctttgttcgagttcatgagccaacagttaactacagaaacaagcaatacattagttataaacttaataccactagtttatagtcaaaggagtaggacatttgacattttaaattaagaacgcctattgaaaatgtcatcagctttgacaataaccattgacaaatagtaacatcaaatagtttttgacttacggcttcctgttaggtgattggatccacgcgggtctagaaccttcaggtttactcgcacgaaaatcagctcacccttggctaaagtttcaccgtcagctaaatgcaaatgctgaattaacttgtcatctgcctcagagtccccctttggatacaactttagagtcctttgaaacataaccatccacttgttagcaagttaccactaatgcacacatacaacaatatctatcagaaagaaaaaactcaccaatccttttctcccatgtgaaaggttttggatacgtaatcattctgttccagaagagcgaaatcacgaatagtccaagagaatttgtgaaaagggagatcttcaccaaaagaggcgggtcgtgaaacaatcttcacatgagcaccgaactcatgttcttcaccgtacaagataaatccctttgcacggtctttgagtgtttcaaccggaagagcttttgacaatccccaaaccgtttttgaagaattgaaacgcttcacttcaacatctacatgtataaacacatattagagcttcattcttatatatacacagagaaagagagagataagagcatacgaaccttgaaaagagaggtacttcttctcttcctcgctgaagacaaagaaagtgagataggcaaacacatcaatgggtggtgttgtcgatgagaggcattccacatacatagacacaaacccacttccattgtccgcttcgtttccttttgggtgaacaaccaatctcctgatttttacaaaaaggacaacatttcttacttatatatgtatacagtgaagaaagatgggaactttagtgaagaaaaatgtgaactttagcaaagaaagatgagaactttagtgaagaaaaatgtgaactttttagcgaagaaagatgagaacttgaagtatagaacaagatcacataccagttgtgtgcaccagaagagaaaggaggggactcgtatttctcgttagcaagctgagaaagtctgacaagagtagaggaaggaggattccttctccaagtcttcaacactgcaggatctgacgcatttgaacccattttctctacacaacttacacaagagaagatttttttagaattccccaaacaacagagagatctatagaaatttgtgtgctttattctcttaagagactaaagaagttgaaagcttaaagaaagaaatcgacgaaccttgacggagatggaaagagccttgacggaattctgcgtcaccttgaagcaaagagagagattgaaaaaggagagagcttttaagggattcttcgtcactaacaagtaagaagagattttctagggtttagatattattttcatataacgggcctaaagctacaagactggcccggctcgttttttattttagcttcttctgcttcaaaacgttgacgtttcaatctccaaaaaagtgttttaagattttgataatatgtactcgaagagctatgtaatgttgattaaagcttcataacaatttttggcgcacaattcttaatatatatcacgtgaggatcacgtaaacaaactaacagactctaaccctattaagtcctcgcctaatcgcctttggtcttctcttcaacttttcccattttctttctctgccgtttattttctcgagaaaactcagaaagaaaatctccattgttgtttttcttgggaaaatctgccaaagaaagaaggttttgccttcgatcattgag

SEQ ID NO: 7957 - DNA, 3000 bp, Unknown
  misc_feature (1)..( 3000): cDNA_ID_3047046_gDNA_ID_1621176_Annot_ID_174173 3000 nt of promoter + ATG
gtttcgtctccgatttaatctttctacgtcttggtttatgaggtaagcttgtttcacaatctttcgttaggatttctgatgatgacgaatctaccaattttgtttctcgtggaaatttgattcagatctcatctcttccttcgattttgcattcttctgaatttgtttataatccttatagctattcattgttcttaattgaattagatttgtctcgaatctatgaattacggttgaaacgagacttgtttcgactgctagggtttcgtatgtatattcaggatgatttcgttatcactgctaatctgttttattgctcttttttcttgcagctcaaaggagaagcccactctcgggtatgtgaattttaaagcttttcgacatttatttgttttgtagtttgagcctttttgtctatgttaatttctctgtaattcgtccatggaagttgaaaacttaggttctgatgtttatggttagatttagttctgaatctctgaagttgatgcataataatgtattttgaagtactttgaaatgaattgtgagaagactctcttcccttgatctggctattgactcttctttaagttgtttcatcttttgttagaaattgttaacatgagcattaagtttagaatgattgtaattataagtttgtgtttatttttatgtgtagaggtacgcggattaagacccgcaaaaggaatattgctgctcctctcgaccctgctgctttttctgatgcactagttcagatttatctggataatgctggtgatctggtactttttttttcgtgttttaagtatttatttatctgtttttatttgcttgtaaaatgtcgtgcaccttaacttatgactttgtttttgttttgtcttaggaacttgttgccagaagtttagagtcatctgatcttaatttctcaagatacggtgatattttctttgaggtaaattctccatatatcaatactgtctcagctatcttctattgcctgtgtattttttgttttcttgtagcaaggggctttttgttttgcttgtctttccgagatttaataattgatggatctcttttattatataaggttgttttcattggaggacgtactcaaactggttcagtgaaatctgatgaaggggaacgccacccttactctataatcgactgtgaaccaaagcgtgaagctattttaccatcagttgtatacatacagaaaattttgcggaggaaagccttccttattaagaaccttgagaatgttacacggagattcttacagtcactggagctttttgaggagaatgagaggaagaagcttgcaatattcacagcacttgcattttcacagaagctctcaggattacctgcagagactgtcttccagccattgcttaaggatactcttgttgccaaagggatagttctcaattttgtaacagacttcttcaatgaatatttggttgagaacagtcttgatgacttgatttctattctgaggcgtggcaagatggatgacaaactcttggagttcctgccacccacaaagcggactacagaaagttttgccgagcatttcacgtgagttttaatttcttgaagtttgctgcattcaatagtataatgttggttctttttttacttgttgtagtttccttgctcttctgtttacctgcgtttctctaaattttagtcgcttaatactgatatgattgccatttctcattgataagattaaattagtgaaaatgcttctatataggttaacttttgtcactagtttgttgtgttcaacaattctcagttacttctgattctgtattcgattatcacttgtcttttatctctgctttcttattgtatatgtaaaattgatatatctgctatacttttccttctgattttaagtaaggcaggattgacagctctggtagagtacaatgaaaggaaaatatttgaggtgaagctgaaggaaatcaaagcggtccttacgagccaagtgacagaggaaataaacgtagatgaagtgactgaaatggtgaagcaacaggtgaaagatgcaaagctgccagagactgaggttgtgcatgtgatctgggatgggataatgaatgctgttcaatggtctgggaaaaaccagcagcagaattcgaatgctgtattacgccaagtgagttgattttctattttattttgaagcaagattatgttgttttgttcaaagctaagctaagctagccgctgttttgtggtaggtgaaaacatgggcaccccttctgaacacgctgtgtagcaccgggaacatggagatggaactgatgtataaagtacagatgcaatgctatgaggatgcaaagctgatgaaagtgtttcctgaggtagtgagatctctgtatgaactggatgtgcttgcggaagacaccattctgcactggtatcgcaaagggaccaaccctaagggcaggtactattttcgagtttttcacaaaaacaaggttaataatagtattctcttagtaacatatatgtaataatggtttgtgttggttttgcattgcaggcaaacgtttgtgaagggattggaaccgtttgtgaattggctcgaagaggccgaagaagaggagtgagtgagacgctctgcttcttgttttctctttttactctcttctaataaaagaaagacaatattttacttctcttaacgcaaaattcagatgctctacattgttggtgacttggtgtgatctcttttttgaatgaataagtacttctttagttgattatttgttggttttggttaacctctttgtgaggtaatacaggaatgtcatcttgaaaaatactaaccaaaaaataaaaaatagagaatataaaaccttatccaaaagtagggagattgtgttatttaaaagggaaccacagaaaaaaataggcgaggaaagaccattaagccgttggccacacaatcagatatcataatggaaatacactccg

SEQ ID NO: 7958 - DNA, 3000 bp, Unknown
  misc_feature (1)..( 3000): cDNA_ID_1809866_gDNA_ID_1621176_Annot_ID_57340 3000 nt of promoter + ATG
tgtaatcatacataactccttcaagtggtcctgatgctttagcttgtcgaagataaatcgtgttggttcccgtgcgtagcaaccttccaggtacattgatgctataaagccgatagagtccatggattccatgtcttgctatagcattatctcttccaatatatcccgttgagaaaaatggcctcgtgtattcgttattgaaacgtacttgtagattagcccatgcagccgaggctaaagctagctgcaatgtgtagctacctcgcatgtttacatatggaagatgaaacacagtctgccatgtagttggtgtgtacgttgaatcaccgatttttcttgtgacttgagagtagaaccagtctttgctatagttactaactccaattgtgtagatgaggtcatggtttggatataactctgtgtatcgttgccataatccgtactgcctaaacttgtccgtgtggtttagatataaagggttcattgtgttcttgtatggctccggtacaaagtattctcgagctcgttgatgtggatggagaacattattgactcctttgtatttgatgccagttataagtccttggggactcgagaaactgacactaataatcccgttgtccactatcacctctctagtcccatgtttgtttcttatttgttgaacagttggagctcttccacttggtccatctaagtttcttatcggcctagaaaacgcgattggaagaagaaacaacagaaaagaacagataattagcgaagttatcttcttcttcgaaatcaactttgctttcaagatctttagatcgaaaataatttaagaaaagattgttgcttcaagttcctcctttggatgtggagtcatgacatgcatatttatatgcgtaatgcgtatgtggttatttgttaatcaaagtctaagactcaatgggaataggtgcaccaaaacttaactaggacttactttgacattcatttaatttgtctgataattgtttttctattttaattgttgtctaagataatattgaaatatgccatgaaagaccgaccaagttgttgcgaaagggtatatatcattaacatgataattaggtcttacaattagtaacgagcccaacattttggatccttggcaaaaagaaaaaacaaggattccagttttcatcgcagcaacaaggtcataaaatttcaaaaagattttcctatctattctagcagtggtgtttttacttcactattgatgaacttgaagactgcgagcgtagagaggctattggatgtgcagaccattgttcatttggttccataggtgaaagaccgaccaaaaataaaaataaactattggaaactagcttgcgaatggataacatatttaaacaaatattgatatacttaaaagatggaaatttgatgtatttttattttttttttatttttttttggtctttgctttatcagtagtattataaaaactaaaacgatattttttttgttgataattttcttttataatttggttttggtttaatttgatttttgtattggatcaatttggtattcgatttagattcagtttgatttttgtcaaaaataattttactataacaaaataacgatttcttttccgaaaaattcaaattaattaaccaactgaatacaatggagttatgtgaaaagttagtaagggaaaaactctttacaagtctatcacaactgggataaagtttctttacccttaaatctacacactgcgaatatttttcgggcagactttacttcattaaaggacgttgacgattcacaatacttgatatgcattatatttcttgctatccagtttatctccatatatctcaaaaacaaaacaagaaaaacagagcaataatattgaaaacagagcaacgatcttgaaacgacaagacagagcctacaacaatatcgattttattactattttatgactacttcttttgaatatgtgaatctaacatctaatggacccttagttttgatttttggtgcgttatgtaactattttggattgattttttctgaatttttcatcaagtatcatggcaaataatcttttttgatgaaagcttggtagttttggagttacatattttaatttaactattttatagttaaccgaataaatttaattaaacatcgacatcacaaatgaaattttaacaatatattaatcaaagatacttataatttgtttttggatatttagacaaaattccggttattcagataaaattcggatatttgggtaaaagttttgggtattttgatgaattttcgactatttgcataaattttttgagtgtttgagtaaattacgggaattcgagtatacctgaatttaaaggatacctgatttttaaaagtatttagcagttttgaatttttatacccagattgatccgaacccgatgagatccaaaccgaaacctaaccaatattttagttttaccttcttagctcttaaacttctctacttaaagcaaccgtacccgatcggattttaaccgaacccgacccacaataccgttccaataatcttttcttttgacatacctttgaagctttcaccttctgttgctctttcaaaaccaaagcctattgggatgaccaatttgatcccaaacatgaacacaattccacttataagtcactacacacccaaatttgaatgcttttctatttttctacactcccaaatttactctgggaaggtccaattaaatcgagaaagctatgtcatttactccacacggaggatgcccacaggtgttcgacacaattccacaaagaccctgtcacgtggctcgtacgtgacatcttcttcaataccttactcgttgattttttcccgcttctcctctgttttctcccgtcacgaacaaaacctctctcgataccaagaaaacgcaaagatcagatcactgagaagcgttactagcttctactctcttccccaacatg

SEQ ID NO: 7959 - DNA, 3000 bp, Unknown
  misc_feature (1)..( 3000): cDNA_ID_1809863_gDNA_ID_1621176_Annot_ID_57341 3000 nt of promoter + ATG
cttttcatcagcagctaaaggccagtctttggaccatccattctcatatgcaaactctttcacatcttccaatcgattcttaatcagttcaatggcagctgctgcatccactggttcccaacctccaatggatatcttacgagaccagactttacttatcctttgaggcatatgctttgtctcattaggtataaactttgcacaatgttcttgatcaagatgattcttacactcttcagcgctagtgaacttgttcgaacaagaccgacacatccagaatctccatttcccctcttcccttgcaaaagtgagaacttgctccaacgcatctcgtccttcactaccatataacccctcaacataactcgtaagttccgcagtgcttactttcataaagttccgtttgatctcaacattcaaaccagcccaatacaacatcaatcctttaatgaaatcaggctcactcttccttgtatccacatcttctttttgttcacagttttttacaacaagtcgtgtcttggattcagcaattctcgactctgcaatcttgatcacagacaccattgctttctgttctttcttggtgaattctggatcctgcacattcactgaaagatgatacaaagtttcttttgctttgcgcacagatttcttgtaatacaccactgactgaatctgttgtgccaaagtgaagagtgaaatagccgccatcgatgacaaagcaggagctatggaaacgcattgtacagaacccaacaagtaagcaactttcacatcagtgttctctgtttttttcgctagctccttaaagatttgaccttgtagtgcattaacacacaccctgtcgttcccttggacgaaacgcaaatcttcaattatctccaacgccttgatgtaatctttcgcaaagtaggaatcgtaggcacgtttgaagagattttcgctgttagcatcttctagagtaggacgctccatgttggggaagagagtagaagctagtaacgcttctcagtgatctgatctttgcgttttcttggtatcgagagaggttttgttcgtgacgggagaaaacagaggagaagcgggaaaaaatcaacgagtaaggtattgaagaagatgtcacgtacgagccacgtgacagggtctttgtggaattgtgtcgaacacctgtgggcatcctccgtgtggagtaaatgacatagctttctcgatttaattggaccttcccagagtaaatttgggagtgtagaaaaatagaaaagcattcaaatttgggtgtgtagtgacttataagtggaattgtgttcatgtttgggatcaaattggtcatcccaataggctttggttttgaaagagcaacagaaggtgaaagcttcaaaggtatgtcaaaagaaaagattattggaacggtattgtgggtcgggttcggttaaaatccgatcgggtacggttgctttaagtagagaagtttaagagctaagaaggtaaaactaaaatattggttaggtttcggtttggatctcatcgggttcggatcaatctgggtataaaaattcaaaactgctaaatacttttaaaaatcaggtatcctttaaattcaggtatactcgaattcccgtaatttactcaaacactcaaaaaatttatgcaaatagtcgaaaattcatcaaaatacccaaaacttttacccaaatatccgaattttatctgaataaccggaattttgtctaaatatccaaaaacaaattataagtatctttgattaatatattgttaaaatttcatttgtgatgtcgatgtttaattaaatttattcggttaactataaaatagttaaattaaaatatgtaactccaaaactaccaagctttcatcaaaaaagattatttgccatgatacttgatgaaaaattcagaaaaaatcaatccaaaatagttacataacgcaccaaaaatcaaaactaagggtccattagatgttagattcacatattcaaaagaagtagtcataaaatagtaataaaatcgatattgttgtaggctctgtcttgtcgtttcaagatcgttgctctgttttcaatattattgctctgtttttcttgttttgtttttgagatatatggagataaactggatagcaagaaatataatgcatatcaagtattgtgaatcgtcaacgtcctttaatgaagtaaagtctgcccgaaaaatattcgcagtgtgtagatttaagggtaaagaaactttatcccagttgtgatagacttgtaaagagtttttcccttactaacttttcacataactccattgtattcagttggttaattaatttgaatttttcggaaaagaaatcgttattttgttatagtaaaattatttttgacaaaaatcaaactgaatctaaatcgaataccaaattgatccaatacaaaaatcaaattaaaccaaaaccaaattataaaagaaaattatcaacaaaaaaaatatcgttttagtttttataatactactgataaagcaaagaccaaaaaaaaataaaaaaaaaataaaaatacatcaaatttccatcttttaagtatatcaatatttgtttaaatatgttatccattcgcaagctagtttccaatagtttatttttatttttggtcggtctttcacctatggaaccaaatgaacaatggtctgcacatccaatagcctctctacgctcgcagtcttcaagttcatcaatagtgaagtaaaaacaccactgctagaatagataggaaaatctttttgaaattttatgaccttgttgctgcgatgaaaactggaatccttgttttttctttttgccaaggatccaaaatgttgggctcgttactaattgtaagacctaattatcatgttaatgatatataccctttcgcaacaacttggtcggtctttcatggcatatttcaatattatcttagacaacaattaaaatagaaaaacaattatcagacaaattaaatga

SEQ ID NO: 7960 - DNA, 3000 bp, Unknown
  misc_feature (1)..( 3000): cDNA_ID_3047032_gDNA_ID_1621176_Annot_ID_57343 3000 nt of promoter + ATG
tgttttgtagtttgagcctttttgtctatgttaatttctctgtaattcgtccatggaagttgaaaacttaggttctgatgtttatggttagatttagttctgaatctctgaagttgatgcataataatgtattttgaagtactttgaaatgaattgtgagaagactctcttcccttgatctggctattgactcttctttaagttgtttcatcttttgttagaaattgttaacatgagcattaagtttagaatgattgtaattataagtttgtgtttatttttatgtgtagaggtacgcggattaagacccgcaaaaggaatattgctgctcctctcgaccctgctgctttttctgatgcactagttcagatttatctggataatgctggtgatctggtactttttttttcgtgttttaagtatttatttatctgtttttatttgcttgtaaaatgtcgtgcaccttaacttatgactttgtttttgttttgtcttaggaacttgttgccagaagtttagagtcatctgatcttaatttctcaagatacggtgatattttctttgaggtaaattctccatatatcaatactgtctcagctatcttctattgcctgtgtattttttgttttcttgtagcaaggggctttttgttttgcttgtctttccgagatttaataattgatggatctcttttattatataaggttgttttcattggaggacgtactcaaactggttcagtgaaatctgatgaaggggaacgccacccttactctataatcgactgtgaaccaaagcgtgaagctattttaccatcagttgtatacatacagaaaattttgcggaggaaagccttccttattaagaaccttgagaatgttacacggagattcttacagtcactggagctttttgaggagaatgagaggaagaagcttgcaatattcacagcacttgcattttcacagaagctctcaggattacctgcagagactgtcttccagccattgcttaaggatactcttgttgccaaagggatagttctcaattttgtaacagacttcttcaatgaatatttggttgagaacagtcttgatgacttgatttctattctgaggcgtggcaagatggatgacaaactcttggagttcctgccacccacaaagcggactacagaaagttttgccgagcatttcacgtgagttttaatttcttgaagtttgctgcattcaatagtataatgttggttctttttttacttgttgtagtttccttgctcttctgtttacctgcgtttctctaaattttagtcgcttaatactgatatgattgccatttctcattgataagattaaattagtgaaaatgcttctatataggttaacttttgtcactagtttgttgtgttcaacaattctcagttacttctgattctgtattcgattatcacttgtcttttatctctgctttcttattgtatatgtaaaattgatatatctgctatacttttccttctgattttaagtaaggcaggattgacagctctggtagagtacaatgaaaggaaaatatttgaggtgaagctgaaggaaatcaaagcggtccttacgagccaagtgacagaggaaataaacgtagatgaagtgactgaaatggtgaagcaacaggtgaaagatgcaaagctgccagagactgaggttgtgcatgtgatctgggatgggataatgaatgctgttcaatggtctgggaaaaaccagcagcagaattcgaatgctgtattacgccaagtgagttgattttctattttattttgaagcaagattatgttgttttgttcaaagctaagctaagctagccgctgttttgtggtaggtgaaaacatgggcaccccttctgaacacgctgtgtagcaccgggaacatggagatggaactgatgtataaagtacagatgcaatgctatgaggatgcaaagctgatgaaagtgtttcctgaggtagtgagatctctgtatgaactggatgtgcttgcggaagacaccattctgcactggtatcgcaaagggaccaaccctaagggcaggtactattttcgagtttttcacaaaaacaaggttaataatagtattctcttagtaacatatatgtaataatggtttgtgttggttttgcattgcaggcaaacgtttgtgaagggattggaaccgtttgtgaattggctcgaagaggccgaagaagaggagtgagtgagacgctctgcttcttgttttctctttttactctcttctaataaaagaaagacaatattttacttctcttaacgcaaaattcagatgctctacattgttggtgacttggtgtgatctcttttttgaatgaataagtacttctttagttgattatttgttggttttggttaacctctttgtgaggtaatacaggaatgtcatcttgaaaaatactaaccaaaaaataaaaaatagagaatataaaaccttatccaaaagtagggagattgtgttatttaaaagggaaccacagaaaaaaataggcgaggaaagaccattaagccgttggccacacaatcagatatcataatggaaatacactccgatgactacttcttccttcctcctccctgcttctcctccctcagccgcctttctccggcggcgcttcttccgccactcctggctttcctctaagatccaccaccgtcttccccaaggtacattactactcttctctatttcacctgtcaccacttctctgatctttggattattctggaatcttcgttttatgtgatcttgttacaaaaagtttccattacgattccatgttttaacccttaagttcaaaattgtggtacaattctatctcataggtgttttgagttgaatgataccttctgattttctggagccctattgattgtatatctcccactctactcttatcttactatgcaactatcctgtctttctttacttgcttcagtt

SEQ ID NO: 7961 - DNA, 789 bp, Unknown
  misc_feature (1)..( 789): cDNA_ID_1809853_gDNA_ID_1621176_Annot_ID_57344 3000 nt of promoter + ATG
ctaccttttccaagttacaaaaatatgttctgtcttttttatttttggttaaattcttttttttttcttagttttttagagcttatttatacaagaaaccgtatatcacttccttgtaaagattttcactaaaaactaatggattttttaagaagttgtccatagctttcaaattctttgggagcttctacaagctttggagagcttccaaattcgctcggaacattcataatgaagaaagtagttgcgaccaaactaccttctaagttttatcttatcaaattcattactaatcattaggattgaacctacaagacaaaaacttattccaagtttttaaacattatactataatttatcaccgttttcttatcaaaattatttagcccaacagtttttctaaattatcatttacgttttaagtttataatcagttaatcaccaatcattcttttcattcctatcattttatcttaactccttaaatattgaattcttcaagtttgtcaattgttcccaaaatggattttctttactaatataagcattggtttaaaggaaataaaaacaaaagcattggtttgtaataaatgaaaagtaaaaaaaaaaaattcaaacatcacatttggcacttttctaaatccgtctttgaaaacgcgttctgtgtttttcttttgccgtttctttgtctgattatgaaacaaagaaatcaccagaattcaatacattaattcaaacaaaatctcaaatttttctcctccggagatatctaacatattataggcgatg

SEQ ID NO: 7962 - DNA, 3000 bp, Unknown
  misc_feature (1)..( 3000): cDNA_ID_1809956_gDNA_ID_1621177_Annot_ID_57346 3000 nt of promoter + ATG
ttgtcgctttgaagaccaagatatcaagttgttaccgtgaaaaatgcagtaaccggaagtggaacgccttgttgttgggcagcctgcccaatctgcatctgtgtatgcgattaacccggaagtatctgatggataaagctgcaaaccataattgagtgtaccttttagataacgaaggatatgtttgagggcattaaggtgaggttctcttgggtcgtgcatgaatagacagacttgttgaacagcgaacgagatatctggccgtgtaaatgtcaagtattgaagtgcgccggcaaggctgcggtagagtattggatcttcgactgctggtccatcgttagctgctagcttgactcgtgaatcagctggtgtggtggatggcttacagtttgtcatattggcccggtgtagtatatcggcggcgtagttatgttgattgagaaataatccagaggagtttcttttgatggcgattccgaggaagtagtgaagttctcctgaatctgtcattccaaattcttggcttagagatgaaatgatatcttggagaagcttagttgaagatgcggtgaggccaatgttgtccacatataggagaagataggctgttccattggcgcgatggtagacaaaaagcgatgggtcagccttgctttgcacaaaaccgattcgacacgcgtattgggtaaatcgttgattccaggctcgtggtgactgcttaagaccgtaaagtgaccgtttgagtaagcatgcgtggtcgggtttggtgggatcacggaatcccgaaggttgatgcatatacacgggttcttcgagtgtgccattgaggaaggcattttttacgttgagttggtgaattggccatttgcgagagagggatagttccaatacgaggcggatcgtggccggcttgactacagggctgaaagtctcgtcgcaatcaatgcctatttcttgtgatttcccatttgcaacaagtcgcgccttgtacctatatagtttgccatcgggaccaaacttatgcctaaataaccacatggaacgcacaatgttagtatctcggggccgtggtactaagtcccacgttccctttttaatttgagctgcatattcctcattcatggctgcgttccagttaggatcttctaaggcttttaggtgagaggtaggaagaggagaaataatgtcagtgtgaagagataatggttgtttgggtttggtaataccgtttttacttcgcgttctcatagagtgcgcaacgacggttggaggctgcggaggagctacttgtggagttggttcattgggaattgtttgaggtggatcaatttggcgaaggagaggagaaatagacaccggaagttgtggttcatctatgattgaaggagattctgagatagatttagagaaaggaaatttagattcatcgaaggtaacatgacgtgaaatgattaccttacgggttgcgagttctagacaccgatatcctttatggttagatgggtatccaagaaaaacgcacgcagtggagcgaggatcgagtttatgagacgaaaccggaagaagattggggtaacaaagacatccaaatactcgaagatgattgtatatggccggtttgtggaaaagtttggtgaaaggtacctcgttttgaatggtagatgaggggagaatgttgaagagatgagttgccatcataagtgcctcaacccaataggtggtgggcatgtttgcttggatgagtaaggaacggacagaattattcagtgtccgaagagtgcgttcggctttgccgttttgctgcgaggtgtatgggcaagagaagcgagggataattccatgagtggctaagtgattaaggaattgtctgttttggtattcaccaccattatcacattgtaatgatttaatgctgcagccaaattacacgtaagccataaactttaagaaagtggaaaacacttcagattttttacgaagaggaaaaacccagagaaagtgagtgaaatgatcaagatatataacgtaatattttattccactgatgctaggaaccggtgaggtccatacatcggaatgaataatttcaaaaggtgcagaaatagaagaaataactgaatcaaatggtaatctagtgtgtttccccaattgacatgcatgacaaagagacatgtcaattttagaacaattaattaagggaataagttgagatttagtacgtttatgaaacaaaattatggaagtagtacactcactatttataattaaggaaataatcgggtccactatcgactgtaatacgcgtcgcttgtaatacagaaaaacatgggccatgattcgtttgaggaaattacgtttaggggtcgccgtttgttttgttcgtttgcaggaaaccctttgactgagttcgggggtttgctttacaagatacaacaaacgtcatgggcctagcgtatttctagatgggccttaatcaaagtctgtttacagatttataattcgtagcgaaggcgttgaagtcaacttctttatcgtcggcttattcaatgccggagtgcgagctgagagaaacaactgcatttatgaatgtttcaaatcaacggaattagttaacaagtcggtgaataaaattttataataatcaaattctctttaggtttttctcgaaagtagctaaatttttggggggaatttgagctcgtttttttgaggattaggttatttttaagtaacaaaaggagatgatgattgtcagtttcggttgtgtttctttgttaccgggaaaattcatctttgcgtttctaccatggaaggtggaattctgatcagaaaattgttttgtaaacttgtcctcataatgtttaaaagccttcagactgataaaaagtgaattccttttttgcagtggatgatattgtcgttgtacaggcaggtagatggattttgtatagcactggtgaatgggaattcaagcttgattcttgtcgtcacggtagggcg

SEQ ID NO: 7963 - DNA, 3000 bp, Unknown
  misc_feature (1)..( 3000): cDNA_ID_1809935_gDNA_ID_1621177_Annot_ID_57353 3000 nt of promoter + ATG
tgttttgtattttataaatatataatcctaatttctatatattgtacaatctcttgattttatcatggcgtacaccgtaagtcgatttttaagactttaatttaaaattatatatgttttttttgttaaaattgtttgttttgttatatattttaaattatataactgtatttaaattgttagttatagagtttcacccgttgtatactgtttcgtattactatagactcaaacccgtcttaccatctaattccgttctgtggaattaaacatatttaatggatttcatccgtggtatactgtctcatattactatcgatccaaatccgtcctaccatctaaccccgttcaataaaattaaatattattttattgtgtttgttttaatagtactttaatttaaaatatatatataattcaaatcaatttcaaattttttattttaaatggttatttaatttttataaagttcatatattataatattctaaacccgtcataccatctaatcccgttcggtgaaattaaacattattttttattttttgtttaaataatatttttattaaaagatttataactcaaatcaatttaaaaggtgactttcaaatggttatttaatttttatagatttcacatttcaaatatttatctatatgtaacatatagttatgtattttataaatattataaacgtttttccgttaaatattataaacgtttaataaacattaaataattacaatatttaccttttaataaagtataatattaataatgttgtaaataattatgtgtacctaattttaagggatttgatttaaagtttgttgtttggattaaatttgaatgataacgtgattgatatattaaatcaagaattaaaatcaaatcaaatattaaggaaaaaagatttaatgtcaatggcatgccattgtaaataagtgtcaagtagaagatttatttgctaaagtggctgcaaaaatgtatatgtagatttaaattttttttgccattctgctagtcttggatgttatgttattcattcggttttggttggtatccatttggttatcggttctttttgttttaaagtttagtatctattcggttattttgaaatttcggttctttctttttaaaaatttcgtatgtattcggttattttgctttgaatattttcgaattttttgattatttttgagtattttactattttatatatattttcaattgttttaagggaaattgcactgggtatgctcagtggatacaatatttatgtcctaattttccaaaagtttcgacgctactgttgcataaataaagacgcatgtacccctatgtccattagaaatctaaatgtagctcttatatctctctgtgtcaggcggatagtagaagatcttgctttggatattttagtgggtgaattaaatttttatattattttgatagttttcaatcaaggcgtcgtttcggtccaatctatatttacctcatgttttttcttcgtctctttcatcctaattggtttgttatcagataatttgttaccgtacacgagtttttgcggttcagaattcgtctcacgtgtggcgagtggtgaatatattaactctattatgaatatattaactctattatctgctatcttgttatctcgatatttcatattgtttcactctttgtaatatctcgacacttcattgcgcgtgttgaaatttattgcgcgtgttgaagttttaacctctaacggatttataatcagatactttattatcgacattgcgcttcagaattctacattttatttactctccctacgtgtaataagtcgacatttcattgcgagaggacctatatctatattaactctattatctgctatctcgttatctcgacatttcattgcctgttttgaagttttaactcctaattggtttgttatcagataatttattaccgtacacgagtttttgcggttcagaattcgtctcacgtgttgcgagtggtgaatatattaactctattatgaatatattaactctattatctgctatctcattatctcgacatttcatattgtttattctgtataatctctcgacattttattgctcgtgttgaagttttaacccctaacgaatttattatcggatactttttaccgtatacgaatttttgcggtactctcactacacgtgtaataactcgacattttattgcgagtggtgaagccctacaactatattaactttattatctgctatctggttatcgtctttgtgggttctgaaatccacactagagatttgtatttaagattatgagaaaggagggttagatcttcactgaaacctttagagttatattgctaagaacgaatggactttaattatgacagagcttttacaatatgaaatgagattacaagtgtaaagtgtgtgtgtgccaatgtgaactagattgaatgtgtcttccaagtcgtccttgctcccttatatagatctacgcacgtggtagctccgtccggaatctgcggcgatcctcctggatattcggcaggtcagttccgagatatcaggtccgctccgcgaatatctcctcatcaattcctaggtcattattcgcttatctccctgcatcaggtgactgggcttatctggcccaaatacccattcgcgtatgtgggctcgtcagctgcgtaggtcctctacttggtgggcttggtgggcttttgtgggctggcttggtattttcgcaggtggattcctggaggggaatacagctccaacatttgccccccagcccattgagtgagtaggcgaactcgatgagcggacatataggtcaggtaagattgcaaaaatattcttgatgagaagataaatgtgattagatcagtcggttttgaggataaactcaacaatttcgttttaatttcagattcccttaaccgaaagattttgaggagatacgcgagataagtcgctgctg

SEQ ID NO: 7964 - DNA, 3000 bp, Unknown
  misc_feature (1)..( 3000): cDNA_ID_1809927_gDNA_ID_1621177_Annot_ID_57355 3000 nt of promoter + ATG
acattgttgatgtgatctataaacgagcagaaaatggttataactacggtgtcattcttgttcctgaaggtctaattgattttatccctgaggtatatggttactctcaaatctataatggtcaattcgagtctagtccctatatttgtgttcttcaacgttcatctattatgatccattggcaggtccaacagcttatttccgaactgaatgaagtcttagccgaaggaaacgtcgatgaagaaggccaatggaagaagaatcttaaaaaagagactttagagatttttgagtttcttcctcaaactattcaagaacaactaatgcttgagagagatccacatggaaatgtgcaggtctgcttctatccaccactaactgattcaaacaaattaaaaggctaaaacctcaagcaaactcgaactgaaaacctgtttattttgaacctttatatgaattttctcttcaggttgctaaaatagagacagagaaaatgttgattcaaatggttgaaaccgagctagagaaaaagaagacagagggtacatatgaacgcgagttcatggggaaatcacacttctttgggtaatgaattagcctaaaacatttgttaataactaattagcgtcaacataatcatattctcattctcattgtgttttaggtatgaaggaagatgcggcttacctacaaatttcgatgcaacttactgctacgcattaggttacggtgctggatcacttctccagagcggaaagaccggattaatttcatcggtttagaatttttcttcctttcttgataatatcacaaactgtttctttatttcaagattatttatattcccctttgtgatgttttgcaggttggaaacttggctgctcctgttgaagagtggacagttggtggtactgcactgacttcgttgatggatgttgagagaagacatggtaatataagtcgatactatcgtgaagtgtttgataagattatattcttttccaacattctcttttttttatgttgcaggtaaattcaagcctgttatcaagaaagctatggttgaacttgaaggtaattagtctttagctcaaaacatatattattcttcggtttcttttcttgctaacactataaatttcaggtgcaccgtttaagaaatttgcatcacagcgagaagaatgggctttgaagaatcgatacattagtcctggttagttcacatacacatgtctctgcataaagtagtaaatgatttcgttctttagtgtttttcatgctaactcttattctttctcttgttgccaggtccaattcagtttaagggaccgggatctgatgcgagaaatcacacattaatgctcgaactcggggctcaagcctaaagaattttggtactgtgagattcactcactgactcactttctttgttgttgttcgtttttgctgtaaaatctagttactgtgagtcaagtgaaccaacaagtggtcatcaatgtgtaagtcctgtattgtggtgtcacttgaatatagatgactcatgtgttaataataaagtttcgcaatttcatacactctacatgatgtttttccggaaacttaatttttcgataatcatatacttagtccattgttgaaaatctcttcgtctataagtcgattgatcatttatttttttatttttttaacaatatgcattaagtggatatgaagtggagttgaatttgggatggtaaccttttgatcacattaaaccaggttggtagttcagattttaacgtagtcatgtaactcatgttggtggttcatacttttcatgacctcatttttctccttgttgacctctacacattttcaggagatttagtgttcaaacacattgtcatttttcatagcagaatgaaggtctggacaaataaatcgaaccgaatgtaccaaaccaaaaccgaagcaaaagaaataaaccgaaccgaatatttaaaaataaccaaatggatacaatattttataaccgaaagattagaaaccaaatcaataccgaaccgaaatatttcgggtaaccaaaaaaccgaaatataataatattttcaaaaatattagttatttttagactaattaatttaaaacaagggtgaattaaatttttatgctcagacgaatgcgaaattaggaatgtatgaatgatgatttcatatttagttctctttcctcccgacaataaattctgacatatttgctcctattgagcagagatattgttggatacgtaatgattgtgcagcatttaattctaacacaagtatgaagataattaggttagtcgataatatgttatttgatatggtatcataggttatattagaagatacttgatagaagataagaataaataagactatgcccaatagtagaagactgttggagctggattcctggaatccacctgcgaaaataccaagccagcccacaaaagcccaccaagcccaccaagtagaggacctacgcagctgacgagcccacatacgcgaatgggtatttggaccagataagcccagtcacctgatgcagggagataagcgaataatgacctaggaactgaagaggagatattcgcggagcggacctgatatctcggaactgacctgccgaatatccaggaggatctccgcagatcccggacggagctaccacgtgcgtagatctatataagggagcaaggacgacttgtaagacacattcaatctagttcacattggcacacacacactttacacttgtaatctcatttcacattgtaaaagctctgtcataattaaagtccattcgttcttagcaatataactctcaaggtttcagtgaagatctagcactcctttctcataatcttaaatacaaatctctagtgtggatttcagaacccacatttggcgccgtctgtggggacggaaatagatcattccaacaccgaagctaacacatcaattgtgaccaacgatcatg

SEQ ID NO: 7965 - DNA, 3000 bp, Unknown
  misc_feature (1)..( 3000): cDNA_ID_1809923_gDNA_ID_1621177_Annot_ID_57356 3000 nt of promoter + ATG
atccatataacttttcattttggttatggatttttaattaagctgttaaactaaaaagtgaactattaaaacgaaagactaaataaaaaattgattaaagttgatctaaatacagtcagtaagtaccttatcaacttgttaagctgacagttaaaccacatgttgccattatggtccatactttctagggtttatgattgtctattacatcttccttaccattttatcattaggtctaaacttgttctttcgattaactaagaaaattataatcactttttagtctaacaactccggtccttcaacacaaaaaaaacaagaaaaagtgatgttcgtttcgcagttagtaacgacactaacacaatgtttttccttttcatagttttttttttttttttttggtcaaactagctttttataaatgattctactctccaacaatggagaaatggttcaacaagtacatcaaagaggctacaaaggccaaagaaaccactgctacaaatggcatacggaaagcacgaaagaaaaagatagaagcatacataacagttaagcaactaaagttgaagataccaatagtgctgaaacatgagatgagctttcggaaataagagagcacacatggtgatctgctgtccggagatgcaacatcctctagtggataaaacgcatcatgaaatacggctacgatagcataggcgacaaagcaccaacttcttgagcctacgagatgtgagaaaaacctcaatttcggagaggtgtggggttgcgaaaaccaccacttctcgatgaacaaatctggagtccaagacccaagatcatttcttgttaagacgtcatatgtcttttcctttatcctgcgtgaaatttcaagaaaccaaaccaaagaaacaataacatgaattgctcttaaccaaagtttttgaataacatcctcataatgaggtaagagaagcctaagcttatacagaatcaaaccaacctcatactgaggtaaaagaagctgaattcgaagtccaatcgaaaacaacacatcctcataatgaggtaagaacagcttgagcttaagcaagatcataacagcctcatactgaggtaaaaccagcctaaaactagtagaaatcatcacatcctcatggtgagggaactgaagtataaacgaaggcatgttccaaaagaaggtaaaaaattcaaagaaattactacctttcagagagacaaaaccttttgatagagtgactagaggatgagagaggtgtggaatagagaaccaaagctccaaacaagcgagaggaaatacttggtaccacgaactgcacacagcagtaatagatcgtaaagcaaaacccagatctagagggctcaaagcctgaacaagatctgatcctagatctgaagacctcaacagcaaaatcgagagaaaggagttggaagctccaacgagatagtctggtgggtctggagggtcgggaggttcagaaggagagaccaaactggtcaaatcttgcggtagagcacacggcggcggattcggagaagggaggagcaaaggtggagcaggagcccgagcaagcatcactaaagccatagaagaaaggaagaggagggagaaagaggaagattctcgccggtgggcgagaggccacaccaacggcggcaaggagaagaagaaaccctagtcgtcaagttgagagagaaaaaggggttttggattgacgatgtcccttttcatagttattaacaatatatatttaacatttttttgctcgatttacattcactcagtttttgacaaagattgatgcaacgcctaacaattttcattgctagattgcttttgaaatttgctcgttattattatcaccaacggctaccaaacaaacatgatttagtcattgttgttatcgataaataaaacaaacatgatttagtcattgttgtcagcttcaaaatttgcatcaaaaggagattgatccccggtctctgaaaagggtacagtcgcaagttaagcgagaaagatctcgcatggtccagtactctaacaaaataatagtccaattttgtatccttccaatatttccatcatccaaatatgattaggttgcccttatactagaatcagagagatacccactagatcaatcaaaatattaaagcggtcaaattttcactatttggatatacggttaatcagatcgttaacataaaaagatatagatttatttgactatcctgcttttcgcatagtggaccaaaatatcttgtaacttgagatccaaccaaattgtagtgttcgtttctaaacctatagttatttttagttatgattagcatgtttttttagttaacgctgcggcagtggcaactacggagtaaaacgacgtattatgaaaagtaacatttaagtaaaacgacaccaaaattgaaaataacagatttagatgattcgtagatgacagacgatgagttgcaacagcatcggatgagtcgctcaaatttaatagaagcaccttaatcttcattggcgttcatcatgtacgacagtttttctctcatcactgtacattcttctctctgcttaaatatttttctttttttttgccgctgccgctgcgttaagtaaaagaacttgaccgatgttaatggttaagagcggttttgtcgctataatactcgctacgagaaagaggattttgactgttgatgtgaagtacgatttattccaattgtgtgatacaacatcaatactacaatacaataataatcataaaaaaaggttttaaatttcaatgtttacaaattagaacgaaaattgcagttattgaaattccaataaccatataaaacaataaatgaccaaatttggcatattagaatattcggaaacttgcaagttcattatccacttgaagaagacttatccaaacactttctgacacacacttctgacattcacagatttttgtaggaacaaaataatcctaatactcacaaatg

SEQ ID NO: 7966 - DNA, 3000 bp, Unknown
  misc_feature (1)..( 3000): cDNA_ID_3047087_gDNA_ID_1621177_Annot_ID_174194 3000 nt of promoter + ATG
cattatggtccatactttctagggtttatgattgtctattacatcttccttaccattttatcattaggtctaaacttgttctttcgattaactaagaaaattataatcactttttagtctaacaactccggtccttcaacacaaaaaaaacaagaaaaagtgatgttcgtttcgcagttagtaacgacactaacacaatgtttttccttttcatagttttttttttttttttttggtcaaactagctttttataaatgattctactctccaacaatggagaaatggttcaacaagtacatcaaagaggctacaaaggccaaagaaaccactgctacaaatggcatacggaaagcacgaaagaaaaagatagaagcatacataacagttaagcaactaaagttgaagataccaatagtgctgaaacatgagatgagctttcggaaataagagagcacacatggtgatctgctgtccggagatgcaacatcctctagtggataaaacgcatcatgaaatacggctacgatagcataggcgacaaagcaccaacttcttgagcctacgagatgtgagaaaaacctcaatttcggagaggtgtggggttgcgaaaaccaccacttctcgatgaacaaatctggagtccaagacccaagatcatttcttgttaagacgtcatatgtcttttcctttatcctgcgtgaaatttcaagaaaccaaaccaaagaaacaataacatgaattgctcttaaccaaagtttttgaataacatcctcataatgaggtaagagaagcctaagcttatacagaatcaaaccaacctcatactgaggtaaaagaagctgaattcgaagtccaatcgaaaacaacacatcctcataatgaggtaagaacagcttgagcttaagcaagatcataacagcctcatactgaggtaaaaccagcctaaaactagtagaaatcatcacatcctcatggtgagggaactgaagtataaacgaaggcatgttccaaaagaaggtaaaaaattcaaagaaattactacctttcagagagacaaaaccttttgatagagtgactagaggatgagagaggtgtggaatagagaaccaaagctccaaacaagcgagaggaaatacttggtaccacgaactgcacacagcagtaatagatcgtaaagcaaaacccagatctagagggctcaaagcctgaacaagatctgatcctagatctgaagacctcaacagcaaaatcgagagaaaggagttggaagctccaacgagatagtctggtgggtctggagggtcgggaggttcagaaggagagaccaaactggtcaaatcttgcggtagagcacacggcggcggattcggagaagggaggagcaaaggtggagcaggagcccgagcaagcatcactaaagccatagaagaaaggaagaggagggagaaagaggaagattctcgccggtgggcgagaggccacaccaacggcggcaaggagaagaagaaaccctagtcgtcaagttgagagagaaaaaggggttttggattgacgatgtcccttttcatagttattaacaatatatatttaacatttttttgctcgatttacattcactcagtttttgacaaagattgatgcaacgcctaacaattttcattgctagattgcttttgaaatttgctcgttattattatcaccaacggctaccaaacaaacatgatttagtcattgttgttatcgataaataaaacaaacatgatttagtcattgttgtcagcttcaaaatttgcatcaaaaggagattgatccccggtctctgaaaagggtacagtcgcaagttaagcgagaaagatctcgcatggtccagtactctaacaaaataatagtccaattttgtatccttccaatatttccatcatccaaatatgattaggttgcccttatactagaatcagagagatacccactagatcaatcaaaatattaaagcggtcaaattttcactatttggatatacggttaatcagatcgttaacataaaaagatatagatttatttgactatcctgcttttcgcatagtggaccaaaatatcttgtaacttgagatccaaccaaattgtagtgttcgtttctaaacctatagttatttttagttatgattagcatgtttttttagttaacgctgcggcagtggcaactacggagtaaaacgacgtattatgaaaagtaacatttaagtaaaacgacaccaaaattgaaaataacagatttagatgattcgtagatgacagacgatgagttgcaacagcatcggatgagtcgctcaaatttaatagaagcaccttaatcttcattggcgttcatcatgtacgacagtttttctctcatcactgtacattcttctctctgcttaaatatttttctttttttttgccgctgccgctgcgttaagtaaaagaacttgaccgatgttaatggttaagagcggttttgtcgctataatactcgctacgagaaagaggattttgactgttgatgtgaagtacgatttattccaattgtgtgatacaacatcaatactacaatacaataataatcataaaaaaaggttttaaatttcaatgtttacaaattagaacgaaaattgcagttattgaaattccaataaccatataaaacaataaatgaccaaatttggcatattagaatattcggaaacttgcaagttcattatccacttgaagaagacttatccaaacactttctgacacacacttctgacattcacagatttttgtaggaacaaaataatcctaatactcacaaatggcatcacaattagatttgatcggaggagactacatcgccggaatttcgatcaatcctccgacgaatagccgtgtgacttctgtatacagcgaagtccaagctagtcgtatcgaccacacacttcctcttccttccgtctttaaaacccctttcaagatcatcgatg

SEQ ID NO: 7967 - DNA, 3000 bp, Unknown
  misc_feature (1)..( 3000): cDNA_ID_3047095_gDNA_ID_1621177_Annot_ID_174192 3000 nt of promoter + ATG
ccaggtccccatagatctgacaggtaccgtctccccgaccgatcctactccgagaactcgtctggatttcgcctttttacaggcacctgcgaacgctctcgtcgaaaacctggcaacagaaaacgaaacaagcacaacgcctgccttcccaaggctaccggccccacctttattaccgatgggctgttcgccccctaggtacacgtgtactagaaaccaaacaaccgcatccagtttccgcattcccgggaactcaacgcaacaacggacctctatcgctaatccgccatctgttcctcagataccaggaagcgacttccttaacagtccccaagcaccggtcgatccgcgtaacgtcgtggatatggaaacattccgcaattacgcagctcaaacaaacgcgaacatggctcaaatgcattctcgaatgcacctagctgtgagcgatgctcccgacatagatcgcgtgatcgaagaaaccaggcgcaccccgttcacggataggatcgcttgttttcgcctccgagatgtcgagagactccgtttcccagaatacgacggaacgagcgacccaaaggctcatctgagatccttccgtttcgctataacacgagcgtacctaacagacgaagaaaacgaagcaggtcattgccgtttcttcgcagaaaacctcgtaggtcacgccctcgaatggtttgctagcctcgaagggaactccattgataccttcgaccagctcgccgccgctttcttaaaacaatattcggtacttatcgaacacaggacgtctgaagccgacctctggagtctcactcaacttcagaacgaatccctgcgatcttacgtcaaaaaattcaaagcaatcaaatcgaaaattgcaaatcgaaaactgcaaacctaaacgaagaggtagccattgcagcccttcgtaacggcctttagttctcctctaggttccgtgaggaactcactgttaggcaaccagtctctttagacgatgcccttcacaaagctctccacttcgccaaagccgaagaggagcttagtgtgctggccttacgattcaaagaatctaaaacgcaaaacgctccccttgcaattaagaagcccttcaaaaaggaaaaccaaacgcaggggtagcataccttattcgcaatagacgaggcagctgagaacgagagtccagaacttgacctcggaaaatattgcaagtaccacaagaaaagaggatattccaccgaggagtgtcgcgccgttaaaaaattaatcgcagctgggggaaagactaaaaaaggttcaaaccccaaagttgaaacccctcctcccgacgaacaggaggaggagcaaactcccaagcaaaagaaacgggaacgaacaccggagggaagtgactctcccccaccttctagaggagaacgcatagacctagtctttgcagaactcgatctaggtggtcagtcaccacacctccccccgccccgcataagaaaaacatgaggtttccattacggctcttgaaattctgcagaagcgcaaccgagcacctctccccgaaacgcatcgatttcatcatgggagggtctcagctctgcaacgactcaatcaattcgatcaaaactcatcagaggaaggcagattcttacacaaaaggcaagagcccgatgatgggacctaaccaccagatcacattctgggaaagcgaaaccaccgacctcaataaacctcacgatgacgctctcgttattcgaatcgatgtaggcaactacgaactctcccatataatgatcgacacgggaagctcagttgacgtactcttttacgacgccttcaaaagaatggggcacctcgattccgagctgcaaggcaggaaaacgccacttaccgggttcgccggagatacgaccttttctctaggaaccatccagctcccaaccatcgcacgaggagtgaggcgactcacgagtttcctcgtagtcaacaagaaagctcctttcaacgcaattctgggaagaccatggctacacgccatgaaagccgtcccatcaacctaccaccaatgcattaaattcccctcggacaagggaatagcagtcgtatcggcagccaacgcagctcccgaaaatgctatatgggcagttacgatcttatcaaaaaggctgaccccgtagtactaatgatagaagacaaactcgcggaaatgaaaacagtcagatcctctgatccttctcaacgcggacctcgaaagtcattgataacacaggtctgcatagacgaatcagatcccaaacgatgcgatgggataggtcaagacctcgacctagcgatacaagaggatctcataacctttctcaaagaaaacaaagacagctttgcctggtcaagtgcgaacctccgaggaataagcctcgaagtaacctcacacgaactcaacgtcgatccgatctaccgacctataaagcagaaacgtcgcaagctaggtcccgagagggctaaagctgtgcacgatgaggtcgatcaattgctcaagatcggatcgataagagaagtaaaataccctgactggctcgctaacccggtcgtcgttaaaaagaaaaacgggaagtggagagtatgtatcgactttacggacctgaataaggcatgtcctaaagacagtttcccactcccacatatcgaccgactggttgaagccactgcgggacacgaactattgtccttcatggatgcattctccgggtacaaccaaatacttatgcacccagatgaccaagaaaaacagcttttataactgaccgaggcacctacttttataaagtaatgccctttggtttaaaaaacggtggagctacttaccaaagattggtgaatagaatgtccgccgaccagctaggtaaaacgatggaggtctatattgacgatatgctggtcaagtcagctcgcgaaaaagaccacgtcccgcaattaagagaatgcttcaaaatcctaaacaaattcgaaatg

SEQ ID NO: 7968 - DNA, 3000 bp, Unknown
  misc_feature (1)..( 3000): cDNA_ID_3047103_gDNA_ID_1621177_Annot_ID_174186 3000 nt of promoter + ATG
gttgtagtacaaacttaattcgtacgtttaccaaatccccaaatcacattaggttataaacatttgggttgcaatggcaacacatatagcaacaaacaggttttcgtagatggatttaggaaactctttgaaacacaacaatggcaagcggatgtacggctcaaggcaggagcagtgatgagagtacatacaactgtccccacccacacttgttctggtcttctctacttctttctcttctctcttactattgtaaaggctaaaagcctaaacaatttagcaatggatttgagagtaaaatgctttttatcgttagtggtatttaatggaaatttgaataggcacccaaagtcttttaaaaggtgttgaaatcagacgatcgagttcaatgcttatgtaaacctaaagagataattactctctttgagatgaaacatgataattagtccttttttcccactttgctaatacttatgttttgtttaatataattatcaatagaagagagataataatttaagaattttcgtatattgatttatgtctcattttatttccaaaaacgtcttggaaaacgaaagtaaaagtaaagagtaattttgaccgtctatgctctctctatatatgtataagctacattcgttttctacattagaaccaactaaccaagttatacgatatagctatggggacacaaacaaacaaatatattttctttgatagattactgaaggttataaaagaacaaccagccgatgtacggctagaggcatgggacagtgataaggatgcagctatcatgcagccgacaaatatgagattccttgacaacgacttacgctctctcacccttggcgacctgtctgtgcatgattattgccagaagctcaagacactctccgatctcctcgccaacgttgactctcctgtctctgatcgtgtcgtcgttacgcatatgctcaatggactttctgaaaagtttgacaacatcatcaacatcatcaagcatcgccaaccgttcccatctttctctgttgcccgatccatgctcattgaggaagaacgtcgtctctccaagcaggtcaaaacaggatcctctcactcagccaactcatcgtctcccaatgtgctctatgtaacgtctaatggaaatcaaaactccatgtctcgcgacaacaatcacaacacttatcgtgacaacaacaacaccggctaccgcgacaacaaccacaacaactacaatgggcacaacaacaatggtagaggtcgtggacgtggacgtggcggtaccggcagtaacggcagaggtcgtggacgccaaaactggcaatggaatcctcgcaattggcagacacaacaaccatggctctcaacaccaaccccatatccacactggccacaacaaaactggatgcaaagaccaccgatggcatacttgacagccacgaacccagcagcagggctccttggttcttctccacaagcagctatggttggttcgactaatcaattgacgcaaattcctgcaaaccttgctgcagcttttgggactacaactatgccagatcctacagatgcaagttggtacatggacacgggcgcgacaactcacctcaccgcgcagccaggtaccctccattccctttttaattcgagctcatccccatcggttgtcgtcggtaatggatcttctgttccaactaaagccatcggttattcatttttgccttctaaaatacgacctctccatcttcataatgtgcttgtttgtccttctataatcaaaaatctcgtttctgtacgtcaatttactaaagataattatgtatctgtggaatttgatccatttggtttttctattaaggatttcaatacttggacgaatcttctccgatgtaacagtgatggtcctctctactccatcacgtcgccaccattatcatcatcatcatcgtcatcacctccacaagtcatggtagcaacggttcccgattcttcattgtggcaccgtcgtcttggccatttgggaaacacaactcttcaatctcttatttcttctcgcttaattaagagtttgtttgccaactagtacgtttacagaacataattatgaaactagtacacttactatttacaatatgaaatgtactacaggtggttattgttggcttttttgttaccccggttctgacactacgatttccatgtaattacagagttgccagtgaaaccaaaaaaaagaggtttcttctcgactcttcatatttctggtttcttaaggaagttgagagaagttggtttctgtattatgaagaatatctgcaatgacgaagaagaagtcgagtaaatcgaagacaataagccctccagtggtaatgaaacaagaacccaagcggcgaaactccagagcagatgcacagagaggtaagtcgttatactgatgacggttcctcaagcaattttcgggataatttatgggttaataggggttcataattaggtttctgggttatttgtagatacgcatgcaaaatctccggctaaatctccagcgagtgctcgagggttaagagacgagtctccaatttcaccagcgccggcgaaaattccggcaaaatctggaggattaagaaacgaatctaaacaaggtaaacaaactcttatttgttgtcccttgccggtgaatttgatgaatccgactctatcatcaccgaacattttttttgatttggtttttttctgagatgaataataggagatgagagatgcagagatagtgaatttacaaacccgagcctcccttgccgtttgctgcatccatcggagttcccggatgggggacgccttaacatacactcaaagccggagtatttgggaactctggtggaattactagagggttcagaggcgtgggatgagcttattgcgtcccaattcaaaaaattgtttgaacttccagttgctaggtgtcatcactctgcaaaactcattcatgggatg

SEQ ID NO: 7969 - DNA, 3000 bp, Unknown
  misc_feature (1)..( 3000): cDNA_ID_1809919_gDNA_ID_1621177_Annot_ID_57357 3000 nt of promoter + ATG
ttagctctgaaaaccgaataggaaaccaaacattaaaacacaaaacagagagaagtgagtctcattaatcttaaacaatttcaaaaaattacctaaagtgttcagcaaggagacaagcattagtattggagtcatctccaccaattaccacaagaccatctaaatccatctttgtaacagtctcttcagcttgcttaaactacaaaatgtaccaaactgaatataactaagtccatcgataaaagcatcaatgcgcgccatacaaaacattaagaaaaacatttctacctgctctggagtttcaatcttgtctcttccactacatatcatatcaaatccaccctgcaaagagactcacaacaaaaactactaagaataaacacaaaatgcatatctttaagtaacaaagcttttagttccaactcttcatgatgaaaatttgattactccaacaatacattcttcaattgatccaaacaagcttctatctaatccggttaaagcaatccgaaccaaaccaaaactgaagtgaaagatgaaataaaccgatttggttctttttctatatctgaaatctgaagaaaccgaaaggctaagacaataaactaggcctgggagatcggtttaatcgggttaaacggttcggtttgatcggttttctggttttttcggtttctaaaaatcctgccgaattgaaccgaataaaaattcggttcggatcggttcggtactcgggtttttcggttcggttattaagatatataattcgccgagattaaaccaaatgatggtcatttccattcactttctatctatgttttcatgaacctaaacatctaaaaccgaaaccaaaccaaaccggaacaataaaccgacaaaaatctaaaagacagaacatctcatacctggtttctataagggtacacaaactcagaagtaagctcaatatatttccccttcatgattccagctggaccgccacgaaaaccaaacagactacttcctcttgcatattcttgcaagtaatctatcaaaccaacaacaaaaatacaatcacaaatcaagtttttaaagcctgaaaatgaaaaatttgcacaaaggaacaaatgtctactaaccaaagattccacaaataacattgtgtcctccaggtgcttgaccaccagacaacacaacaccaatcttaagcttttgatccgatgaaacttcattagattggttaggaaccaataaagctgatggttgtccaaataaattagggaataatttctcaatttcctctgcaacaacatccaaaaccaaaattgacccaatcaacaaaaattttaaccggttaagtgaatccggtttagtaagattgtgattgaaccatagaaatcggacctggatgtccggcggaggagcttggaggaccatcgatgatcttgaaaggggttttaaagacggaaggaagaggaagtgtgtggtcgatacgactagcttggacttcgctgtatacagaagtcacacggctattcgtcggaggattgatcgaaattccggcgatgtagtctcctccgatcaaatctaattgtgatgccatttgtgagtattaggattattttgttcctacaaaaatctgtgaatgtcagaagtgtgtgtcagaaagtgtttggataagtcttcttcaagtggataatgaacttgcaagtttccgaatattctaatatgccaaatttggtcatttattgttttatatggttattggaatttcaataactgcaattttcgttctaatttgtaaacattgaaatttaaaacctttttttatgattattattgtattgtagtattgatgttgtatcacacaattggaataaatcgtacttcacatcaacagtcaaaatcctctttctcgtagcgagtattatagcgacaaaaccgctcttaaccattaacatcggtcaagttcttttacttaacgcagcggcagcggcaaaaaaaaagaaaaatatttaagcagagagaagaatgtacagtgatgagagaaaaactgtcgtacatgatgaacgccaatgaagattaaggtgcttctattaaatttgagcgactcatccgatgctgttgcaactcatcgtctgtcatctacgaatcatctaaatctgttattttcaattttggtgtcgttttacttaaatgttacttttcataatacgtcgttttactccgtagttgccactgccgcagcgttaactaaaaaaacatgctaatcataactaaaaataactataggtttagaaacgaacactacaatttggttggatctcaagttacaagatattttggtccactatgcgaaaagcaggatagtcaaataaatctatatctttttatgttaacgatctgattaaccgtatatccaaatagtgaaaatttgaccgctttaatattttgattgatctagtgggtatctctctgattctagtataagggcaacctaatcatatttggatgatggaaatattggaaggatacaaaattggactattattttgttagagtactggaccatgcgagatctttctcgcttaacttgcgactgtacccttttcagagaccggggatcaatctccttttgatgcaaattttgaagctgacaacaatgactaaatcatgtttgttttatttatcgataacaacaatgactaaatcatgtttgtttggtagccgttggtgataataataacgagcaaatttcaaaagcaatctagcaatgaaaattgttaggcgttgcatcaatctttgtcaaaaactgagtgaatgtaaatcgagcaaaaaaatgttaaatatatattgttaataactatgaaaagggacatcgtcaatccaaaacccctttttctctctcaacttgacgactagggtttcttcttctccttgccgccgttggtgtggcctctcgcccaccggcgagaatcttcctctttctccctcctcttcctttcttctatggctttagtg

SEQ ID NO: 7970 - DNA, 3000 bp, Unknown
  misc_feature (1)..( 3000): cDNA_ID_1809911_gDNA_ID_1621177_Annot_ID_57360 3000 nt of promoter + ATG
tccaccacttttctttcttctttctcttcacatttggactgcttcctgatgcatcatccattggaagtcctgttgttatgataaactctctcagggagaatcgcataggttgatcagcaaatacaaaccacaattcgtcattgttggttagtattcttctctggagtaaatgatgaacgatatggcttgaaaatgctaagtccatttcagcgaattccactataggacccaagaatgtgtccattaatgtgttgaactctatcggctctaaagctttcctgacagtcgagacaattttgaaggatgaatgctttgatacccttgtaatattatctacttcgctgcctggttggaacagtcttttagggaagaacagtttttttgtactcatatttctcaaaacctgattaaatacattaacacagtcattaaattaacatagttttgaaatggttttaaaaaccatttttgtaaatctattatgcatttgtagttttcgaaacataaacatagtcattacaagtcgtttaaagaactttaaaaacccttgtaaaaccatttttcaaagtcattacaagtcgttttaagactttaataacccttgtaaaacacagtcattactccataatcctttttaaagaccgttttgaaacaattccaaaaacaaaattttaatccttttcaaagaacacagccgctgaaaatagaaacaaaaaacccttttccaaaccaactccaatcaactggtaacccataaattaagtgaggatctataaattaaaacacaaacccaaacatcaatctatttactgttaaagtttcaaaacgaaaaaactttgaaattgctacaacagagaagttaatcggcattcgaaatcttctttgaaggtttttggaacccaaatatcaaactttaaaacataaatctatcaaaattatataacaatttccaacactccttcaaaatctcaaatatcaatctattttacttgtttcgttttcaaccgaaaaacctagaaatgctagaacaaaaaagagattcggtaaaaatcgaacaaacccaaatgttaaacttcagtttcgtaaattaattaccttcaattgcttcctttttgctggataatcggattttcttcagattgttgaaaggaagaagacgaagacgacagtttctattcttctttttcttttgttgtcttttcacggttcccttccgtttttgtttttgggttatagtgaatttttgggctttagtgttttttgggcttttagtgtttttttactaaaacagtttgtttttctaaataacaggcgtaggcccaattagtaacagatacagtgtttaacattactgtaactttttcaacggttgatattctcttttaaaaacggttgtaaatcattttaaaaacggttgtaaatcttttcaaagtgactgaccctaattcggtaaaaatgtcagcagtcaatccctgtttaatttgtttttaggttatagtgaatttttgggctttagtgtttttgggcttttactgtttttttactaaaacaatttgtttttctaaataacaggtctaggcccaattagtaacagatacagtgtttaccattactgtaactttttcaacggttgatattctcttttaaaaacggttgtaaatcattttaaaaacggttgtaaatcttttcataatagcagctactgcagctttttcaacacatttaaaacgcttttaaaacagcttataaatcgtttaaaacccctgtttaaaagcatgtttaaagttcttttccattcaaatcaaagcacctgttaacccaaacaaccattatacagtaattttgtaaaacaggagttgaactaaataaacttcataaatcttgttccatacagatgttcataaaatattcaaatgacaaagtttataaatctatcttgtactccactactttttgattagaagtctgctacttctacaaagtaactaaccctaattcggtgaagatgtcagcagccaatccctgtttaatttgtttttagattatagtgaatttttgggctttagtgttttttgggcttttagtgtttttttattacctctttgtccatgatacatatttagagtatacaccagagagagatttcgctcccaggcacgacttccgaggaggacaaaagaagaatgttcctttcttttaaccagaactcacccacttttggcctctaaaagtagtaacttccaacggttaatagactggttcggtatgttccggcaagtttcctggttctccggtggttttcccctgctcagaagctttacacctctcgctgctggacatactcactcacgtctcccttaatgaagacccctcccaggtagccttctgctctcccccatcttgcttccaactgaaaaccctgaagaaaactttgtaaccctgttaaacctttgtaaccctggtaaacctgtttcaaaccctaaacaagtctcagcgcatttattgtttctcaaagaaatctcttccaacttaaccccacagctattactcacccacctgaagtaatagagaagagaatcccctatcaccttaaaggcaaagaagtagctagaggttactcccccccccccacctcgtaaaagaatcagagccccggatctggatacatctgagctaatcaaagagaactccctcactcttatgggaagactaactaacccctccgtccaacgcctctggtctatgtttccctttttatcaaacagatgtaatctaagaggcaaagccttaggctcagacttgggaaaaggctgtttccagttcaagttcgactatgaagaggatctactgaaagtcttggataacagaccttaccattatgaccagtggatggttattttgcagcgttgggaacctattatctctgagtcattcccttgtaagatccccttctggatagagcttcaaggacttcccaaacacttttggcaacctgaaatg

SEQ ID NO: 7971 - DNA, 3000 bp, Unknown
  misc_feature (1)..( 3000): cDNA_ID_1809991_gDNA_ID_1621178_Annot_ID_57364 3000 nt of promoter + ATG
cccgaaaccgaccccaaaccaaaaaacccaataaataacggaaccaaagccaaatctgaatttttaaattatccattatcctaaaccacactatccaaaaaaattcgaaccgaacctaaaccaaacctaaactgaatctaatattcctcagtatccgaatacaaatctaaacttaaaaatattagttaagatatattttcgtaataccttaaatatccaaaattaaaattagagaatattgcatactcagacacttttcataactttagacgtgtttcgacactttaaaatcatcaggcactttgccttggcaaagttactctattaccctaaccggttgttttcaaaccaaatccgcattaaccaaagagatcccttaaccaacccactcgtcgaatttgcagttaccttaccctatttgacttttgaagactttttcagtagcgtaaaaacctaatccagtaaaaaactgcaaattactgtttgttgtagaagacgaatccggcgacatcatcctcttcagtttttccggtgactctgttcgctcagacgacgacgcagacgattttccggtgaccctgttcgctcagacgaagacgcagacgacgacgacttctaatttcgctcacaaaccctaaattctctccaacttctccgtcactgtccaccaccattgttgcacacgactttctctcttctgaagactccaccggtatttcccccaaatttctctttgttcttatatcgaattggatttatgtttcatgtaaaatttgaattgtcgaaactctaaaacagttatacttggctgtttgattattattttctagtttctatcttcggttttcgcttctcgtttttcgtatttaagttacaaactcatttgattgacaaaaccatatactctgtttatgaattttgctcactcttgttgcgattactcgtaaagccttaacctttttgggtttctttcacttactagtatttgttaggttattccacttcaccttgatcctatgattattctcccatgtttagctttttacttatagtggttgtgtctgtctgttgtttttttggattttaggttcatttacgggcctaaatactcaccagagtgttctccaagttcaggtaagctaccaccaatatgactcagtgtgttatgatcttacagttaataattagcactcgccctttttgtggacagggcactgaatcaattcacattgtgttatgattttacagtaactaatcttggtttactcactgattgtttggcattttcaactttggcagttatcttaaacatgttggatatggtctgatggtcaactatatttggataacatcaattcacattgtgttttgatttttcagtaactaatctttagttggtttgttaactttgttttgtttactctctgatattttggcatttttaggtacctttctgacttactcgcagagcgtcactagcttactccatatttgactgtgctagacgtgagccatactgttataattagagtttctttctttcatcataagattttataattagagtttctttcgtttcttgcttcagaactaaaatctttattcatttgatatgcattttagtggtgcttctaagttatatgttagcaaaaaacaataatagagtaattgtacaatcccataagtaagatatctttatgtgaattgtttcattgtttagttttcttttcgtatttcagttataaacaagagaatttcttgtttgggaaacgtaattcatttgtaacaaactcatttgattgacaaaaccatatgacctgttgatgaattttgctaactcttgttctcatttctgaagtagccttaattatttttggtttctttcacttactaggctttgttaggttcttagagttgtccttctgctggttcttcagagtgatccttttctaatccgttctattttattttagctgtagtttagtggttacacctaatcttctgctggtttgtgaactttgttttgttcactttgtggtattttgtcagtttcatttgcaacttgattttcttttgtggagatgaaaaagatacttcagattttgacttgtttaaaaaaaataatatctgcatatagttataatttccttttcctatatctattgctgccatatctaagatgagtttatctgtttgtgttacaggatttggaagacagttaaacatctaaatcgatagcattggcagataagtttattctgttacactatggaaggtactcttacactgttaatctaatctaagcaagcaatagagagacgtttgtgaactcgttttcatttggtcatattatctgttaatctaatcttaatcttctgaacttgtttcttgctaatgacagggtcaacgtctcaggaaccatcttctcagtgtgattcaaatcttcctaatagacttttcgccactgatcaatatccgaggggaaagctaaatatatactcaagaccagatattctatcctttctccggaaggtttttcaggggacaaaggaattggatttcattctgcaatcttgctttggacctctattcatttgccggttagtaagtgtgcgatgtctggtaagcttatgcatgccttgctatgtaggcagctggtaacgaagaaaaagtatgagctgtggacagtatttggtggatacccctgagatttgcattacctgaatttgcttgcgtgactggattgccctgtggggagttttctgaggattatgatccagatgatgatccggtttatgttgttggcatgaagagttactgggacgagttaattggtccagataagactgttaccttaggggatgtttcagacatgctaaccaacaaacacaagacattgtcatctgccacagacttaagctcgcgtttctacttattatagatggtgtactcatagcatcgaaccaaatcggtaggcctacatttaaatatgtagagatg

SEQ ID NO: 7972 - DNA, 3000 bp, Unknown
  misc_feature (1)..( 3000): cDNA_ID_1809987_gDNA_ID_1621178_Annot_ID_57365 3000 nt of promoter + ATG
aaattataatttaggcttgtattgttcatttacttacatgtgttataattttaccttttatgtaataaaacttgatttttattacttagttaaactgaaaccatctcttccaaaatgaacacaatttatgatcattcttacaaaatttatgtaagaatttatgatcattcttataattgacatgtggtacactacgggtttataattgtattcaatagtttttttattttgtttttagcatgttttataaatatatgttaatatattttttaatttaaatatattatacattttggaaggatactttataactaaaaaatgaaaattttaagttgtattagttttgttaatattgtttatttttagtactttaaaattgtataactgtaatttgattgttaatataaataatcaagttatattttgaatttatcatattattttttatatctatttacttttgatattatattagtattttctgtaaatttaatttcacaatcaataaatgtaagatcaatatgattattattggttctcaacaaaatatctttaagaatccaaacatgaattttttcacatctaagacatctgtgaaaatagtcggatagatgatatcttttttactgtgtctattgcttttagtaagacagaagccatatttctgaatcttttgattagccaggtcacgatcatatatgttctcctcttctgccaaaatccaaacaacacaaactttagacgtggcagaaatcagcatttatttctaacaataattggaaaaactaaaaaaatagaaaaatatttcgagttttagctagagaatgaaacaaataatcaaaacgaaaactaaaagaaataaggtgtctgtaaacgctaaaatatttcatacctttgtgttgggtgatggtaaatggcgtggtggtgcatagtatttatagggacaactaataggttactaacccgcatctattaaatagaaaatattccctgaagcaagatatttggaagaaaatctatgaattcgatagattttgaggaatatactattgttatgcgtttttaattttttatgcggcattattatgtttctttaaatggtttttgtgtagattatgtagaggataaaatatgaaatccgaattggtgagttattacttgattttagtaaaaaacggaattgatttttatggagaagaaacattagttagtttcttaaaatctgttttgtagggatatattgcaatgtatgaatttcaaaaatggatatgatttgtttggaagaaatcgtggagttaatatggagagattttaggaaataattttgatagagacgattaagatggcaagacgttaaggaaatcataaattgtgattagcaaaagaattaattacgtttattaaagattgactaagattgcctattgttgttggaattaattaagaaaaatataggagaatatatgtgataccaaaaacatattaaaacaaatgaatgttaaatctggcagattttgaatcaaatcatattttatcctctacatagtcccaatcgtaatttctttgaaaacagaatgattctgaatggtttagaataggaatatgcttgagtatcataagtgcaaaataataatcaaaatgccgtatttagattttgatttgattctgaatcaaactgtcgagatatggtaaatgtatttacccttatttttacgcttgtacatgtaaaacagaaagatttgggtggtttataagatggaatattgcgggatttagattatatcttgactggcaagcaaatagtaaaagattttgtagttaaggtgatatacgtaaatcaggatacataattgctatgaatgaggagtggagagaatatatgattcgatcggataaattttttggaaggcaataatcaataacaatttgaataatattatagttggcgaaatttaatttgcgaggtgatatattggaattttgaattgatgatgatttgtagaatgtgtaaaaatatattgactataccatatgtaagattatatgataaatagagggttcttttaaggtttatggaattaatgcatgattaataatcgtttaacttatagaaatgtgatatcgaaatacgaatatttggtaagagtgtagtaaatatttagagattttggaatgaagtaagtaaagatatggttagttatttggttgttcggatttttaagaaatattatttcgtgtaatattgaattagtagagatttaagggattaatgtgtgcaatttatgagggtagtgcaaaataatatttttgtttaggtaattaattagtgcaaaacgtgaatagttcatcaaaaatttggtcattgtcctaacgcagacaatcttgtctgattgattttatagggactaaacatacaatatcgaaattgaaaaagaatttttcgacacaaatctttcccaaaattgtatatgtagataatttataaatttgttatcactatcttctaagaaatctgtcaaccaaaaaagtatgatataaaaaatctgtcgtatttaaaaaattctactgaataagaataaatctggtataactaaatgatagacttttgtaaaatcgctagaaatttttttaaagaatattttgtatttattttatttttaacacatgaaaaaaatattttaaacaaaaaaaacaatttaattccaatattttagaaaatattctaataattaatctcattacttaagttaacccctaaatatgttacgttttaaaactatctaagcacgttctaatacacatcatacatcatacagaaacacatatattcctccgtgctgtaacacgggtctgatcttagtaaaatagtggagagaagaatattcttctggataccttttaatattccccaaaacttctgaatcttcttctcaatttttctcgacattttctcatcgaaagctctcttcctttccctttttggcgctcaatacaatcatg

SEQ ID NO: 7973 - DNA, 3000 bp, Unknown
  misc_feature (1)..( 3000): cDNA_ID_1809983_gDNA_ID_1621178_Annot_ID_57366 3000 nt of promoter + ATG
ttatgagaagaagagaagaatagagaagaagcttcaagcgtaaaagaagagcaaggaacaaagtcaacaaaagagatgttgggctttgtgttttgttaaaatgggctgcagatgaattaggcccaagtatgtttagttaattagtgttgtgttatagaatcaaagatgttatgtagagtgaattaaggagttgggagttccaacatagtagagtagctgatgtaagtcttaagacaatgatgtggtctagggtctaagcaagtggagtaaagccactatatgtatgtgtgtcttgtgtaagattatccaagtttattatcaatgtagacatgcaagtgtttaaacgtgttcttgtattttctgttttaacaagaacaaaaacagagatcgtgagaaaagcagagaacttgtggtgaaaattagaacaaatgcacaatcatcataagttataaaagactaaacaactgcacgcagataaagcaaagaagccgtgtaatctttgtttccaattataaacgtcatgtttctcctctctataatgttagaaacataagaatctcctccagatctttctcctgatttctccattcccttctcaagaccctatcgaaagcacaaacatgcccaacaataagtaaaaaaaaacacacacagaatcaattagtatctgcaattcacgcaacaaatttgtatgcatcttgattcaatatattatcatatttataaaaaaaaataatataaaactcgtaaatttttaaaaatatcaagtttttgtgttatttattttcgtttataaatttaataaaatagaaatttacattttgataagttttatattatttggttacaaaatatttagaaaactttccatattttcttattttggttttttccattttacaaaaataaaattaaaaaaatagaaaatatgaataatttcataaatgttaattaatgagatgacttataatgattggttgtataaaatcctatgtagacgtactaaaaaaaaatagttttgacttttttataatatagattagttgtttttgatttatttaatttctcctagatccattaaaagagatgcccttagatcttagtcaaatagtaacatcatgtatttcaaatctaaggaaggaaatttatcttatgggttgtcatattgctgttaaatcaaaatcaaatatttttcttacctaaataaatggtcaaattatcaaaaaaagaaaacaatgaattgtttgacaaattgctaataaattaaatcatttattatggtacataatctgtaagtatttatttttgaaaaacttttcagcatatataaatctcacgtaaattccaaaacacacaaaacaagaaaaatggttgcttacgtcgataaaaacttttcattggcttgttttttggttttacttctttttgttgactcatcgtatgcaaggtttaatacgttggttacaaaagatcagatccacaccatatgcaccaaacaagatatcaattcttcatattgttttcaagttctaaacgcaaatcctgaaattgctagattagattttcctagtctcttcaaatttgtgcttaattatcaggctcaaaatatttcagataagctgaagcaatttaaattatcaggaggctacacgccgggtgttgaatctaaatataacttatgtatagaattttatgaaaattctttcgaccggcgtgatgaagccctcagatatttggctgccaaagactatggcagcgtaaacactatggtcggtggaacggcgataaatatgttcaactgtgctgatgatttgtcaacaatgaagccagtaccacaattttttgtgacggaaagtaatttgattaaagaattgtctaagattctcttagtgattctagaatgtttcataagtaagaaaaaagaatattgtaatagagatctataataataataatattagtatgattgttgccattatccttttttaatatataaaaaataagaaaaatagaaaacatttctccactccctctgcctaagaatctctcgtttaaagctacattcttttttttttttgtcatccaagctaaattcttctctaaatcgttttaatcaacttgttgactcgtgagttgactcgtgggctgtttctctaattgctaatagaatttttatacgatgatggaagaaactagaggaaactgacaacagataagaatccatttcttctacgcagattggtggttgtttggtagaatttgttctctatgttatgctaaggttataaattctcatattgtttttgcttaggatttgggattaatagttgaaataaatgattgatcgcatcacttttggatttaggaccgaggccttacattctattgtattcatacagaggtatgatatcagaaatggatttttgtttcatttgtgtgatggaccttaacatgatggaccttaaaattgctacatataacaaaaacacaattttatttatatgatgatttatatatccatcattctgtgaacggattagattttctttgccttgtagatcaattgtgtgtccagtatagtatagacaagttcaaacttgcttagctttgcttaaccaatcattaattcgtattttaatttcaatctcacttatcaaaatcactgatacttaacttagctcatggacagtctctacggccaacaagacgtaaatactaaaaagacccatatctagagctctctaatagacacaatcaaaaatcatttacgtaatcaaacataatctcaatttttcttatgttgtcaacctctaatgacccatatttttcctcctctctgccctcacctccttcctaaccctataaaactttctctttgttcctttgtctcttccattttcccaagaaacaaatggatcgttatcttttcttatcaaatcttcaatcaaacccacttagagatcaattgcttacaccaaattctcaaattaagaaccgatg

SEQ ID NO: 7974 - DNA, 3000 bp, Unknown
  misc_feature (1)..( 3000): cDNA_ID_1809975_gDNA_ID_1621178_Annot_ID_57368 3000 nt of promoter + ATG
ttttaaaatcccttgtaaatatttttaaacccttttaaaatcccttgtaaatctttcagaacacttttaaaccctttaaaaatctttaaaaaatctttaaaaaacctttctaaatcttttaaaatcctttaaaatctcttgtaaatcttttaaaatccttttaaaacaattttaaaccctttaaaaatcttttaaaaacctttgcaaatcttttaaaacccttaaaaatcccttgtaaatcttttaaaacctttttaaaatcccttgtaaatctttttaaaacgttttcaaatgccttgtaaatcttttaaaagccttttaaaatcctttgtaaattttttaaaacccttttaaaatctcttgtaaatcttttaaaaccttttaaaatcccttgtaaatcttttaaaaccttttaaaattccttgtaaatcttttaaaacccttttaaaatcccttgtacaacttgtaattcattaacgaccgtggaagttgtactcaagaacagtgatcattttgtctttcattgacaaccacattgacccggctggttggttcccatgggatggcgagtttgcgctctccacattgtattatggagagtatgcgaatactggtcctggagcggatacgagcaagagagtgaattgcaagggatttaaagttattaaagactcaaaagaggccgaacaattcactgtggcgaagcttattcaaggaggattatggttgaaacccataggagttactttccaagagtggctttgattttaatgtctacttgttcttgtactttgtgttgtgtcacctctgttttagtttaatgtattttctgttttgttttgtatgacttacccaataaataacatgctctgtttcgcaagtattaggttaatgcatataatattttgaataactttaacactaactaattgaatattttcaatatataatcatactcgcactcatcagtcataacaccatcaatttaatttttttttatggggttattatatgtactagatgactaaaactttgagaatattttcatgaataatatgaattttgtttaagttgattacattatttatcaggaacagtagttaccaaaaataatagtttcatattaaattttacacgttggtcatataggggatccttgcttattgcattctgcatggcatgtcagcacagtgtatcagcatgtgatataattttactataagtagagcattcatcggtcgtaaattttcggaatattcagtgtatttattttctatttttttccgttttctattatttctgtatttctcaatacaataaaaattcaaactaaccaaaaattcagaaaagatcactatattatatataaaatcaattgccgcccaaaaagaaatctgttttacaatgaatataactgaacaattatacatatatctagcaaatctatcttttggcatttctaaattaataatctccattgaagagctgcaactttgtgcttgctaaaactttttcacctgcaacaaaatgagtattatgggagatttaaaaatcaacataggcatacaaaaatattccagaaagaagagagagacaataaggacaacaaattttgagtcatatcatatttgttgtgatgggctccatcccattgataaataccttaatcaaccgattgtcagctgaattcctcatgctaatacctaactatacaatattataattgccatatactggaaaactagcagattgcacaacaatatagaaaagacacaagcataagaaagaagcctacgcgacaattactacaacatctccatattgaatggtcttctgatatacaataccattccatgcgcgcagactgagactttgtaagtatgtgaagcatctcacgagagttctcagtcaaatgcaactcaacaaagaaatcataagaaagcattaaatattgaaagcattgagaagcaaattagttcatgaaccacatcacatcagcatcctggagaccaaaaaaggaagacaatgaatcactcaatagaagaactgataagtttttgctttcactgccaagagtgtaagaaacataccgcaaaaacagactactaaacccttttcaagaacaatccgaaggaaattgattcttctccacatcatttagcatccaaagcaatgaccaccatctttagttgcagctctacgcagcacatctaaagctttcttgttcttttaccaattctaaaaatctcaaagaagagatcgattccagatacaatagctgcataagattcattcaaagttgtcaaaattacagtaccatttttttacggaggaatgacaagttatgagagtgcttttattatatcttttcgggtaaacattgtaacgtagtgaaagttgagagtgaattgcctaacaaccgatagaatcaaccaaaaagaaaaaaagaacatcttttctaacgaccaaaaaaaaaacctaggggttttctatttattaggtgtatattgtcttttctagtactaaaacaataatggctaagtctcatcctcacacgtaagagattaaggttgagaatatattgtattgttgttagcataacctaaaatggatgaaaccaatttctaccaaattcatttttttttagccatttagagtacagtggaaaacaagtatttcaactaaagtactctaagacaattcttcttctatcttttatgagctgaaaattttggaccacttttcttttctgttctttgtggataataaaaccaaacttcactgaattatagcttcaattcacattgcactgaatttttagattgatctcaaaataaagtttttttcctaaatattgtcatttattgaatacaattaattaaatgtaaattgattaagttgctttgctttgtatataagaccaccatcgctccctcctctttcatcagttaagataatataaattcagtaattaagagagaagaaataaacacaaaaatg

SEQ ID NO: 7975 - DNA, 3000 bp, Unknown
  misc_feature (1)..( 3000): cDNA_ID_1809971_gDNA_ID_1621178_Annot_ID_57369 3000 nt of promoter + ATG
atagcgtagtgttcatacagaaaatagcacatcaatctatgattcatataggatacatgttatactcaaaactatcttcaaaacccaatactaaaacatgcaatttaaaaaagtctgaataaatttgataaacagatgacacttatataatttacttcaaaactcaaattcaaacatgaaaattaaacgcaaagaagtttgaatatatttggaagcttacttttgtctttacgacaaattgattacagaggtcactaaatatgattttcgggtctccattgcacaacttgaaattcgattcacctcttaattgaaatcccgattgacttatctaaatgatcgatagttgggcatattgagtagccgattgagattgtgaatcataaatccagctgtatgaataaaaccaattagctgttccatgtgtgtactacatatctccataaaacgattgaaaacgaaattgatcgaatcaaattataaaaaatcagatcggaggaaaataaactcttacctaatacttgaatcaaattgtgtagcacaaagtattgaattgtaacatgagctacatggttgttaacggatgttgaagaattgctctctgaaattgattaatcgatgtcgggaagcctagaagtgaagacaattggttttgaaaaaaaattgttgacttcccgaatgaaaatgacagattcaaaaatgggcataaatatgggcttttccaaaactcggtattatactggacctttttttttgtttgttgggtgtacatgatatcttattatataaagtacggttttgaaagttactaactcaggagatcatgacatttatataaaaagtacggtaatatcatgccttattgcttaccttttttagatgataagcataatttttagatacataattaaatgtaaacaacaacgaagaatatatatcttttgggtttatataaggttgaccgttgacttctctcccaaaaaggtgaaaagtggtttctttcacggacaatctccagcgtctccaacggcgccgggccctctcttcgtccctctcttcaggccctcccttcctcatggggaagcaaaagcgccgcaaaggctccctagccccggacccgtccccccctcgtagtgttggttcctcttcgctcgcttctgtctcttcagttgctttgccgatctctcagatccagccgtctgcaactctcccagatgcccaagctgccgtccctcagacagccttggccattccttctcctcctgttcctagatctggctcagatctggaaactttgcctataatcgatgtgacctcagcggttacccctgtaccggctggagctccttctgcggctacctctgttccagcggtagctccatcagtaccttgtgaagtgactccctctcggggtccgagtccttctcctgctactgcgccagctacacccgtcaaggttgttgtggcagacccagtaaacaagcctgaatctaacacagctgaggttgacagctggtgtgatatcttcaaaggaacttctaaacggcttcaaaagcaaggcacggcttttcacacttccttctggagaggcctgtgtcaagattcctgattcgattatcgaaaagcataagaaatcttgggagtcttttatcctgggtcaattctattcggatccccctgctcaaggcaccatccacacaattgttaatggaatttggagcaagcaattccgggtatcactgtctcaagaatggagggtaatgccttccttttttgcatccccaacgtccaaaccagaactcgtgtcctcagccagcgtctttggcagatcgacggacagactatgtttgttgcaaagtgggagcccggtcttactcctgtgaagccggagttgactactgccccgatttggcttgaactgaggcacgttccttttcaattctttaatgacaatggccttgagcacattgctagtttggttggcgagcccaaattcctccatcctagtactgccaacaagactaaccttgaagtggcaagggtcttcactataattgatccgaggaaacctcttccggaagcagtcaatgttcactttgcttcaggagatattaggcggatcgaggtctcgagcccttggatgccgccagtctgtgctcactgtaaggaggttggccacagcttgaggaaatgtaaggtggctcctatcacctgcaaggcttgcaactccactttgcacctagctgatgcttgtccccgtgaccagccccaaggggtcaaaaagaggcataggcgcaggcgctccaaaacccctaagccagttgtcgaggaaggcgattggaatactgttgccccccgtaacaggcgctcaactaggagtagcgttgtcctgaccattggcccgcctctttcggtcccagacgccaatgccgctgctatggctggctctagtaaggaagcccagaggcccaatcctatcacgggtaaagctgcttcctttaaaggcaaagggaaaagtattgtcgtggctaagagtaccacagtctcagaggcggactatgattcttctgatgtaccttctgacgatgtggatagtgatctggaaaatgaggagcaattcacagaggtgttgtctaagcgacagcagcgaagtgcgaggggcaaaggccccaaatcacactgatttttatgtcgatagacatcttttgttggaacgtccgcggttttaattcttcctctcaccgcagcggttttaagaagtggtatagaagtagaaaacctcttctcgggagcctcttggagactcatgttcggcttccaaagcagcagaagtttttgaatgctttgatgcatgggtggctttttgataataactatgacttctcggttttgggtaagatttggcttctttggcatccaagtgttaaagttagtattctctttaaatcgctgcagatgatctgttgcgaggttcagatgcctaactgttctgacactatg

SEQ ID NO: 7976 - DNA, 3000 bp, Unknown
  misc_feature (1)..( 3000): cDNA_ID_2139898_gDNA_ID_1621178_Annot_ID_174231 3000 nt of promoter + ATG
gaatactggtcttggtaaataaagaccgatttctttcaaagattgtccttgactcttattaatagtcattgcgaaagcaacaactataggaaattgttttctacgcatgttgaatggtagtttagtatcagatggggtaatgagaatctttgaaatcaacactttatcaccaatcctacctcctgtaataataacagcctgtaaaataggcggagtcatctgtatcatctgaagccttgtgccattgcataatccaccttttgggtctaaattccttaacaacataattggggcaccaatattcaaacgtaaacaatgatttggtagacctgatatcttgatagagtttaagaaatctggagtgaacactggattgtactctgaagtagtgtcggaaagatctattgaatcaatacttaggtactgaatttcttcacctgatatgaaaaagttaaaattaaacattaaatttaacatgcaactaataatacagataatatagtattctaatacatacctggtagcttctctaacagacgctgattaatagtattaacatcctcattggtaggagacaatatagctctctcttggatgaatttgagatctttattttcgagtaaaagagttggatctccacaaatctctaaacttatagctttaataggatcttctccctctgtaattaaaaactcttctggaataccaattaacacttctccatcgtttggtttggcgaagtgatggatttcattaaccatgacttgtaagttagtgaccatttgtttaattctccttttcactaattgtcatcttttaaaaacatttggttttacaaagttctggtgtcgtgtgtttgcgcacggaaaatccacttgaaagcacaaactcagaaggagatttctacttttgtattatgactccaaaggagatgtggccaaaaagtaattcaaaatacggctagctaatggacatggtaaataacttcccattgttagacacatatatgcatggttatgctaaaatctaagttattaagttttggttcatttcagcatatgtgcccaatcatgcatttgctaaggcgaaggtcgttgcagaccccatgtccctatttgagtgataggattgcctttctcgatctgtggtttgtcaaacagttgtgtgatgaagacaagaaatttgattcaattatgaattggtttttctctgaaacctatatcaagggggtaaatggcgagtatccaataactgggaagacatgaaaaacatgggttaaagatgttgacatagtctacttggttcacaacatcaacaacaatcattgacttgggaggtagacttgttaaagcggaggatcaatgttttcgacagcattttaagttgcaacaaggataaggaggtaagtaaagcatgcaagcctttcataagaatgttttctgccttactacaagcggtagcgtcaccagagaagaaaaaagaaatcagtgttgttgcattcagtttctatagggttaaaactgcaccgcaaaacattcaagaaggtgattgtggtgtgtatgctatgaaatacattgagtatttagccataggaattaatttcgttggtctaggtgaccgtgcaatgcgtgatcagaggctaaaactggcagcagagttatttgacgaggttccagaatcagattattggatacaaatgtctgatccaaatccctgaggtgaagaaagatggggagttgagttcctatctgagactaaaaaagctgtctgaaaaatagtggtgtgtcattcctttttgttgaagttttttgccatctaatttttgtaaaacttaatattcgatagttattcggtttggtaaaaacaaaatattgatgtatccttgtttattgaggtttattaatgaagtaaaggctaaagatgaattaatagtcggtaatagagttaaatattacagcttgtgactcataattaaacatcgatgcatcaggtttttaaaatgctcccctaacacaactccttgaaacgacatgaataagtaaatgcaaagcaatcctcacatatgtctacattaagaagtagttaaaatggcaatctggtatatcaaagaaatgccaaaaccctttgaatactttccgaccacctacaccgatatctttgatctgcctttcaaccacattggcaatatctactctttcttgaagagtttcaactcttctaaagaaagctttggtgacgtaaacaccttggtcataagcaccacatcatatcagcatcatagctaaagcaaacgtcgcataaatggaagatgtacacacctctacaagcatgtcaagccgtgcttgcgttggacctaattgagtcaattggcagagagcttcgaggtaccatgctgtcaggtgtccttcagtcgcgcattataacaggaaatgacggtagatggatgtctctcttccaagccgagagttgaaaatgaattcgtctagatcaacatcggctaaaacttcaaatgtgtagacttgaatttgaagccaagggcaatctacaatgaatgggccaaggtaccgaaagccctgtcagccgacgcgacggattatgccagttactagtgcatctagaatgaagttcatattttgtttactaaattatgtccgtcgctacgtatatttatactaatttgaaatatttggttgacctaatcgacagaattgtacacatcggtgacgcataacaatatgcaatcatacaaaactagtgggccacaaattattgaccaaatatcaaactaacctcatataaaagcccacttaatgaaataggcccatttgcaaaataaaagacagttattctattataacgtaacccccgaggagggaaagtgaagggttgcgtctttattcaattatatatatattagagtctaggttaaccctaaaatcggtgagtctctcaactcttctgtttaaccctagcattttatctgcaacttttcaacttctg

SEQ ID NO: 7977 - DNA, 3000 bp, Unknown
  misc_feature (1)..( 3000): cDNA_ID_2139877_gDNA_ID_1621178_Annot_ID_174225 3000 nt of promoter + ATG
tgaaacaatttgatgggagagaaaaaagaagaacaaaaaatcaaataattatattttagcactaatttctcatgccggtaaaccttaaagtaatcaaagtaatcaatcttggtatataaatgtttgtgccatacataatcaaagttatcaatcttgtaccccaatttatggttgtaaaaactcttataacatgctaaaatcttatcatacagaactaaaagctcctaacattaggagattgaagcaaatgaataattgaagagagaatcagaaaatgtaaagtgtggaaagacgagagagattctacgagcaccacatattcgtattattattctaccatcgtttcaagacatgaaagaaagcaaaaaaacaaaagagaaaaaaacaaaaaaaatcagacaatatattggaggaccctagaaaacaatataccaccaaaacaacgactcttgaaataaggtttatataaaataagttactaactcaaactcaggagatcatgatatttatataaaataaagttttgaaagttacttaagatacggttttgaaaattactcactaacaagatcataatatgtgacaagtctaacaataagatgtttatatgtgtcattaaagacttaatatttttattctcttaaaaaaatagaaaacctaaaaaactaaacaaatttacatatactaatttttatgtctatatacatatatataattatttttattaatcaaaaagaaaattaacgaatttgattttacatgtgttattggtcaattaaataaatctaacatctactctattatttgagacgtacgttaagtgattctcggttaaaaaaatttttacctttaaatcatatgtttaaaatgttaatgtcatgaaaaagtttaccttttactaagaatcacttaagttacgttataatcttggccattcgattgaattgtttgtgaccgtccgatctctcgccttcacttaaaaaacacgtggatccttatgacccgggtttacaattattgggtcatacgttataatcttggccattcgattgaattaattgtagccattaatgttttttgaataaattctatagcaagatttttggagagagaatttttatttatttccaattaatatattcccttattcaatactattcataattacgtgggtttaaaattggaaaactaattatactcatatatcaacaatatttattatattctaagagatcattaatccaatcaatatttataaaacatttcataatcaaagctgctttatttatagatataacattataaatatcgaattaatatgtttgaattcgaaattgggttaaatattctaaatttatttaaataactggaaaaataattttaactaaacttttttttatgtttgataattaaaatagaaaaaatatttttaaacatttaaaaataaaattaattacatttttggtttatattaatttttgttaattaaattaatcgaattcctttttcagcaactgaatcatattaatttaaaatatccaatgcgtatattcctttcttaaatttgaatatatcacttctccataattataggtaatcaaatatttagttggatattcatttttgaattaacataaagtttccgaacaatttccataattaaataactacttataagataattgctaaacattctcctataattatgggattcatcataatcattaaacttgacttccacgatttaatattttatgcatattttaaacctaaaaatttatatcttataaatattgtacgtcccatttcaagaacttactcagcagttcctatcttcttttactctctcgtttcttttttattctagcagaagaaaacgagaccatgaagaaattaaaactgaggttgtggatcgacgagaccatggagaaaacaatatatcgaggtatcctctcacactctctgtttttctctatttttttcatgtttttctcacatctgttttttaaaatatttatgcaggtaatgtgggagattaaaatgtagacgcacacatgattttgttaaagtatgtcttgctttctaattatttatcttttatgcaaagtaatatgttaagctttttttacctctctatatatttataagatgagtaattctgattgaattttttttattgggattacggtctttttcctgttaatttgcagaaacatgatgatgatttataatttgactactatcttccaatgaacaacaaaattataaggtatgcaataattttcttaaatctgatcgatagattctctttcactaatatattgagattgtgtaaatatttttgactgtagtttagattttaatatattggtattgttaattaaattaattgaattttaatataagtttaattttgataaaatttatttttgtcttattaatttgtcaaatttgataattaatatatgtattaataaaatacactaaaccccaacacaccatgtatataagtacatatactaaatatacaattatatattcaaagggatacatcaattttgtaatacattcaatagtatccatgtttaaatatgagaatatttaatgaaaacaccaaaaattaggagaataggagaatagggcttagagagattaggagaatagggcttagagagattgattatttgatgaaatgttaatataaaatttgaatgttttatttttaaattttaagtcatttaatgtgaatttggtattatgtaaaactaatttatgagctgactatagtaaaaaaaaaaaaatgtgttcgccctaattattctctcccaagcacggaaaccaaggagccgcttcccttagaaatatgagcttctttctccgacgttcctcttctggtatcttccttgtctgatcggtgctagctgctaaggcgagatctctcaggcggacctcttttttggcggcgttgctgtttttcggtgagactttccacatgagatg

SEQ ID NO: 7978 - DNA, 3000 bp, Unknown
  misc_feature (1)..( 3000): cDNA_ID_3088000_gDNA_ID_1621178_Annot_ID_174223 3000 nt of promoter + ATG
ccttgtaaatctttcagaacacttttaaaccctttaaaaatctttaaaaaatctttaaaaaacctttctaaatcttttaaaatcctttaaaatctcttgtaaatcttttaaaatccttttaaaacaattttaaaccctttaaaaatcttttaaaaacctttgcaaatcttttaaaacccttaaaaatcccttgtaaatcttttaaaacctttttaaaatcccttgtaaatctttttaaaacgttttcaaatgccttgtaaatcttttaaaagccttttaaaatcctttgtaaattttttaaaacccttttaaaatctcttgtaaatcttttaaaaccttttaaaatcccttgtaaatcttttaaaaccttttaaaattccttgtaaatcttttaaaacccttttaaaatcccttgtacaacttgtaattcattaacgaccgtggaagttgtactcaagaacagtgatcattttgtctttcattgacaaccacattgacccggctggttggttcccatgggatggcgagtttgcgctctccacattgtattatggagagtatgcgaatactggtcctggagcggatacgagcaagagagtgaattgcaagggatttaaagttattaaagactcaaaagaggccgaacaattcactgtggcgaagcttattcaaggaggattatggttgaaacccataggagttactttccaagagtggctttgattttaatgtctacttgttcttgtactttgtgttgtgtcacctctgttttagtttaatgtattttctgttttgttttgtatgacttacccaataaataacatgctctgtttcgcaagtattaggttaatgcatataatattttgaataactttaacactaactaattgaatattttcaatatataatcatactcgcactcatcagtcataacaccatcaatttaatttttttttatggggttattatatgtactagatgactaaaactttgagaatattttcatgaataatatgaattttgtttaagttgattacattatttatcaggaacagtagttaccaaaaataatagtttcatattaaattttacacgttggtcatataggggatccttgcttattgcattctgcatggcatgtcagcacagtgtatcagcatgtgatataattttactataagtagagcattcatcggtcgtaaattttcggaatattcagtgtatttattttctatttttttccgttttctattatttctgtatttctcaatacaataaaaattcaaactaaccaaaaattcagaaaagatcactatattatatataaaatcaattgccgcccaaaaagaaatctgttttacaatgaatataactgaacaattatacatatatctagcaaatctatcttttggcatttctaaattaataatctccattgaagagctgcaactttgtgcttgctaaaactttttcacctgcaacaaaatgagtattatgggagatttaaaaatcaacataggcatacaaaaatattccagaaagaagagagagacaataaggacaacaaattttgagtcatatcatatttgttgtgatgggctccatcccattgataaataccttaatcaaccgattgtcagctgaattcctcatgctaatacctaactatacaatattataattgccatatactggaaaactagcagattgcacaacaatatagaaaagacacaagcataagaaagaagcctacgcgacaattactacaacatctccatattgaatggtcttctgatatacaataccattccatgcgcgcagactgagactttgtaagtatgtgaagcatctcacgagagttctcagtcaaatgcaactcaacaaagaaatcataagaaagcattaaatattgaaagcattgagaagcaaattagttcatgaaccacatcacatcagcatcctggagaccaaaaaaggaagacaatgaatcactcaatagaagaactgataagtttttgctttcactgccaagagtgtaagaaacataccgcaaaaacagactactaaacccttttcaagaacaatccgaaggaaattgattcttctccacatcatttagcatccaaagcaatgaccaccatctttagttgcagctctacgcagcacatctaaagctttcttgttcttttaccaattctaaaaatctcaaagaagagatcgattccagatacaatagctgcataagattcattcaaagttgtcaaaattacagtaccatttttttacggaggaatgacaagttatgagagtgcttttattatatcttttcgggtaaacattgtaacgtagtgaaagttgagagtgaattgcctaacaaccgatagaatcaaccaaaaagaaaaaaagaacatcttttctaacgaccaaaaaaaaaacctaggggttttctatttattaggtgtatattgtcttttctagtactaaaacaataatggctaagtctcatcctcacacgtaagagattaaggttgagaatatattgtattgttgttagcataacctaaaatggatgaaaccaatttctaccaaattcatttttttttagccatttagagtacagtggaaaacaagtatttcaactaaagtactctaagacaattcttcttctatcttttatgagctgaaaattttggaccacttttcttttctgttctttgtggataataaaaccaaacttcactgaattatagcttcaattcacattgcactgaatttttagattgatctcaaaataaagtttttttcctaaatattgtcatttattgaatacaattaattaaatgtaaattgattaagttgctttgctttgtatataagaccaccatcgctccctcctctttcatcagttaagataatataaattcagtaattaagagagaagaaataaacacaaaaatgttggttaaagttttctcttttttcatccttatgataacaatg

SEQ ID NO: 7979 - DNA, 3000 bp, Unknown; identical to SEQ ID NO: 7973
  misc_feature (1)..( 3000): cDNA_ID_1809983_gDNA_ID_1621178_Annot_ID_174219 3000 nt of promoter + ATG

SEQ ID NO: 7980 - DNA, 3000 bp, Unknown; identical to SEQ ID NO: 7972
  misc_feature (1)..( 3000): cDNA_ID_3047132_gDNA_ID_1621178_Annot_ID_174217 3000 nt of promoter + ATG

SEQ ID NO: 7981 - DNA, 3000 bp, Unknown
  misc_feature (1)..( 3000): cDNA_ID_2139834_gDNA_ID_1621178_Annot_ID_174212 3000 nt of promoter + ATG
tatagtcttatacgtttgacatccaacataaacaaaaaaccaattgtttccaaccttttttttttttaatgcatgttgctattatccctgaaattcacataccggcaccagtacttgctaaaattgttagctacgttgctgaagaaggcgtggatgctttgaaaccctttgtgaaagctggaccaccatttaaatcggctgtgtatttaaaggaaactctaagttgtgtccgccttgacaaatctcgttattacatgtggtggtccatgacgcactccatctattatcatttcttcacaaaatgtcttgaagccaaaaatccacctgctttgaaggctctattgtacaaaccaatagcttatgagaattttgcagccgaatgctatagagctaccgtatgggcggagctttacggagagtatgaagcatagaaatcaatatgttcataatgttatgtccattattatcttgtcatgtacattgctatacttaatttatcttatatcttttgaagtttaatcctaggtaaattcattcattctcccaactaacttttttggttgacatgaatctgttgagcaagtttgaataagttaaatccccaaaaaatattctcaaatgctaacccttttgggtcatataactcagatcaagaatgtatattacatccaaacggacggttatcggtggatatgttattttggacagaaaaagattatgaacacatataaattgatgatatccgcaacctgcttcaagatgaatttccgaggtcaagctgtatttctgcttagtacaagacacattaaatccccataccgtatttcaaactttattttactttattgaattttcatagaaccaacgttttttaattaaaagttacaacgtttaattccttcgacgaatcaacacgtcattattacagtttacatcgtttcagtttgtataaattcaacttctactcacgatttcatcaagacaaccacatcacaaacgcaaaacaaaactaaagattacaatatttctcagttttcgttactctttacttctcctgttcacgatcgttcaacatcacaatctttacgagttgtctccgatggttactggctggaccatctgtgtcattgtattgagaatttacaaaaaatttctcaacttgtacgctttcgaactacgtcttgtcttggccgatgaatgggtaaacaatttttttcaatttattttgcaatttgtggaatttttatttacccgtgtatccctcacccctaaattgttatttgtaacagggcacccaaatagaagcaaccatcggacctcgtttctctgccttctattttgacaggatccaagagaatcaatggaaaacgataagtacgtttctcgttcgacctaactgcgaaccaataagaacaactcatcatgagtttcgcattttattcatggatcacaccattatcacttattccacacctttagcaatcagtttactcaacaagttcattacatttgactacattgtggatgatgttgttggcaaacataccttggttggtaagtaatggcttcttcataaattccattcacttttttcaaaaaatttatttttttaaacacatatctccgacatatttcttatagatgttattggtgcactcgtgaatgttgggattctcactaataccgcaagtaacgggaaagatacggctggattcaaactgccgttcatgatcatggataaaaagtacatttcttcaacatcaattttcagttttttttcaaacatatcatgtttatacatttttgtagtaaggttagtatataatctcaaatacttactgattttcagcaaagatacattggaatgcgaggcgtatggacaaatagtagtggatttggagaaaagatttcgagcatttcgcaagaacaatgtttttattgcacttgcttggtggaaggtggttagatattatgcaggttgtaactagtttaagattcttagccatgcgccaatatcaaccatgtatcccgaacctgatgttgaggaagttgaagaaatcaaaatggttgtaagatgcttagaactatcaaagtgcttgttgcttacaattgttatctcatcttctttttttttttttttcacatcttatgtttacctccaacaatgttttaatatttttataaatgatattatatattaataaaaagttatttatttattaaaaatttgtcctttttatttattgcaacaaaaacttagattaagcagtacaatagtaatcaagtgtctgaattaagttcacctatggaacattgttgaactgttttaaaactgaagaattacccacatacatgattacaactgtttgtaaaacgtcaaaccataataactttttcaaactgtttaaacttctgtgtctgctgttttgttgttaggttaattcttgtttacattttatctacatttctatataagtgaagtcttttcattttaacaatttttttttgtctttaatgacatcggtctatgaatgtaaaacctattatcttctcatatttacgaaaaacattataaaaaaaaaaacgtaaatccccataaataagttccggctaaattggctgtaacaaatcactgtagcacgtctatataatatattatagaccatgcgtatatatattcatggacgtgagaatatggacatatctactttactatcacgaacaatttttggaatatttgtaggatccactaattatatttagtaacccatcgctccaccaaaccactccctattcatttatccagagaattagggtttccatttcatcacgatctcaaatccgtttcccttcagcctagtttggtcctctttaattatcagtgattcttcaaattccttagatcattatttgttcactttcactattatactaatttgataatccaaaataacaaaaatcgtctgcgagaaaggaaaatgtacccaccctcgaccaatg

SEQ ID NO: 7982 - DNA, 3000 bp, Unknown
  misc_feature (1)..( 3000): cDNA_ID_2139824_gDNA_ID_1621178_Annot_ID_174210 3000 nt of promoter + ATG
gtctttgaatttttttccaataaacaaagaatcagcatcacttagaccagttgaaaacgcagaactagaatactgttgatcaaaaatactagatgtttcagatacacacgcctgaataatcctagaggttaacctcggctgccaaaataaaaagcttaccttaaacatcaatctatctttaataatgattttacaaggatttttaaaaggggtttaaaaacgttaataatgattttacaagattttttaaaaggattagtacctgagtagtagatgtagaatgagaagcaaaatgatttgaagtcgtctaagcctgtaataaacacaatcactgacttaataatgattttacaaggatttttaaaaggggtttaaaaacgttaataatgaatttacaaggatttttaaaaggggtttaaaaacgttaataatgattttacaaggatttttaaaacgattagtacatgagcagtagggagagaatgagaaacaaaaggatttgaagtagtctcagcctgtaataagcacaatcactgacttaataatgattttacaaggatttttaaaattataacacaagaaggttattgaaaaatctgctcaactgtcacagaaatttgctctacagtcaaacataactgaagcaatcctccactctgtgagaatttgtgcataaaagttgcaagctgtctatcgtttctaatataaagaggatgagattgtatggttgtagatgtggagactaacttgtaactaagcttcaaagaattggttgaactatctatttgaaaatcctctacaagaatatccaccaacgcgtgataggtaatgtgctcatcaatgaccattaaagaagctcccaattcaatgtctaattcaaattcccaagtcatattgtttgtcaacttccacaagccacaaacaggatacaattctagcattataacctgataagataaataacaacaatatcaacacccataaaaacactgtcactacagagagaagcatggtttacaaatcgttttaaagcgtaagtaagtagcatagaataatttacaagggattttaaaagctttgaaaagtggttaacatggtttacaaatcgttttaaagcgtaagtaagtagcatagaatcatttacaagggattttaaaagctttgaaaagtggttaacatggtttacaaatcgttttaaagcgtaagtaagtagcataaaataatttacaagggatttaaaaagctttgaaaagtggttaacatggtttacaaatcgttttaaagcgtaagtggcatagatctatcacgaaagcatatgtaaaagaggtaaacactaaatcagaaccaaaatctattacgaaatagtataacgaattcacataagcaaatctatcacgaaacagtataacgaattcaaaaggtattaacgaatttacaaggattttataaacaaattcaatcatcaaatctcaaacaaaattcaaattcgaagctgaagcaaatgtcaaactgtcgattgaatcaggattcaaataacgaattcacataatcaacaacaaaaatcgaataaatcaattcgaaatcgaagatttaagctaacattataaaatcaaaccggggaaacgcaagagattcgacggcgacacacagctctacttccgacggcgaagatgggttttcacggcgagtaaactcactatttccgacggcatgggattcaacggcattcacaatttccgatggaggaagaagagagagagtgaagaaatgaattaggtctgtgggtagctcattaaaggtaatttggagagaaaagtattagaaagggtagaaatgaaaatgggaaaaagggtagagttgcaaaagggcattgagaaaagggcattacagtgaattattcttaaaaataagtatataactgtttgtttagcaagctaacatatataataacgtggtaaatttacatattatatgttaaataaatgtttatctacttaaaattatgaataaatatttttatttatatatatatcaacaaaataaaatacatcatgttacataattaacatgataacgattataacaacattttacatagaataataacatgctaacatactaaatatcgaaataatatttgtctcaacacggtaagataatcgatatatgaataataacatggtaacatactaaaaatcaaaataatatttgtcttaacacggtaagataatcgatatatggataatatttatttgaacgtactaatgttttagttaaggtactaatgtttcatccaactttttatttttagtttaattaatttaggggtataagtgtcataaaattaaaacagtagaagacaacaatgttttttttttgtcagttaattatcagttcttctgggtatagataatcatattacccaaaactataacattagttacttttattccaaatatatatgaattactaaataagtctagtatatttggatttataattttaagggtttgttacactatgaggcactttcggagaaacttaattcactttagacactttaaaaactagaggcactttgccttgcttttggagtgaaataagacatatatacccccactaattcgtttgagatatttctacaaaccggtttatggtttcgtttggtattggtctaaaatatacggttattatggtcggtttagaaaaaacagtttgggcgtgacgacgatcgtcggatttcagtaaattaaacggccgagattaatcattgtaacttcccttgcttttcgactttattcaaactgaaacacgagatccattgaaacacataagattctgggtttcaatcatcgatctttggccaactgtcgtgtccaaggaggtacgattgtagaaaactgatatcatgatattaaaacgaaatttcgtgcattctatttgttacgggaatcagaatataaccaaatttatttttttcgtttatctgtacagggatcg

SEQ ID NO: 7983 - DNA, 3000 bp, Unknown
  misc_feature (1)..( 3000): cDNA_ID_3088102_gDNA_ID_1621178_Annot_ID_174208 3000 nt of promoter + ATG
cttgacgccaaactcctgcagaattgcttcgttcaacgcaaccaatattattccctcatgaattggtacaacccttgagaaaagttggttacatatctccaatttccactctccagtcgaagaacaaaaccactctccacatataaccatgatatagtcgtccatcgatccctgtacagataaacgaaaaaaataaatttggttatattctgattcccgtaacaaatagaatgcacgaaatttcgttttaatatcatgatatcagttttctacaatcgtacctccttggacacgacagttggccaaagatcgatgattgaaacccagaatcttatgtgtttcaatggatctcgtgtttcagtttgaataaagtcgaaaagcaagggaagttacaatgattaatctcggccgtttaatttactgaaatccgacgatcgtcgtcacgcccaaactgttttttctaaaccgaccataataaccgtatattttagaccaataccaaacgaaaccataaaccggtttgtagaaatatctcaaacgaattagtgggggtatatatgtcttatttcactccaaaagcaaggcaaagtgcctctagtttttaaagtgtctaaagtgaattaagtttctccgaaagtgcctcatagtgtaacaaacccttaaaattataaatccaaatatactagacttatttagtaattcatatatatttggaataaaagtaactaatgttatagttttgggtaatatgattatctatacccagaagaactgataattaactgacaaaaaaaaaacattgttgtcttctactgttttaattttatgacacttatacccctaaattaattaaactaaaaataaaaagttggatgaaacattagtaccttaactaaaacattagtacgttcaaataaatattatccatatatcgattatcttaccgtgttaagacaaatattattttgatttttagtatgttaccatgttattattcatatatcgattatcttaccgtgttgagacaaatattatttcgatatttagtatgttagcatgttattattctatgtaaaatgttgttataatcgttatcatgttaattatgtaacatgatgtattttattttgttgatatatatataaataaaaatatttattcataattttaagtagataaacatttatttaacatataatatgtaaatttaccacgttattatatatgttagcttgctaaacaaacagttatatacttatttttaagaataattcactgtaatgcccttttctcaatgcccttttgcaactctaccctttttcccattttcatttctaccctttctaatacttttctctccaaattacctttaatgagctacccacagacctaattcatttcttcactctctctcttcttcctccatcggaaattgtgaatgccgttgaatcccatgccgtcggaaatagtgagtttactcgccgtgaaaacccatcttcgccgtcggaagtagagctgtgtgtcgccgtcgaatctcttgcgtttccccggtttgattttataatgttagcttaaatcttcgatttcgaattgatttattcgatttttgttgttgattatgtgaattcgttatttgaatcctgattcaatcgacagtttgacatttgcttcagcttcgaatttgaattttgtttgagatttgatgattgaatttgtttataaaatccttgtaaattcgttaataccttttgaattcgttatactgtttcgtgatagatttgcttatgtgaattcgttatactatttcgtaatagattttggttctgatttagtgtttacctcttttacatatgctttcgtgatagatctatgccacttacgctttaaaacgatttgtaaaccatgttaaccacttttcaaagctttttaaatcccttgtaaattattttatgctacttacttacgctttaaaacgatttgtaaaccatgttaaccacttttcaaagcttttaaaatcccttgtaaatgattctatgctacttacttacgctttaaaacgatttgtaaaccatgttaaccacttttcaaagcttttaaaatcccttgtaaattattctatgctacttacttacgctttaaaacgatttgtaaaccatgcttctctctgtagtgacagtgtttttatgggtgttgatattgttgttatttatcttatcaggttataatgctagaattgtatcctgtttgtggcttgtggaagttgacaaacaatatgacttgggaatttgaattagacattgaattgggagcttctttaatggtcattgatgagcacattacctatcacgcgttggtggatattcttgtagaggattttcaaatagatagttcaaccaattctttgaagcttagttacaagttagtctccacatctacaaccatacaatctcatcctctttatattagaaacgatagacagcttgcaacttttatgcacaaattctcacagagtggaggattgcttcagttatgtttgactgtagagcaaatttctgtgacagttgagcagatttttcaataaccttcttgtgttataattttaaaaatccttgtaaaatcattattaagtcagtgattgtgcttattacaggctgagactacttcaaatccttttgtttctcattctctccctactgctcatgtactaatcgttttaaaaatccttgtaaaatcattattaacgtttttaaaccccttttaaaaatccttgtaaattcattattaacgtttttaaaccccttttaaaaatccttgtaaaatcattattaagtcagtgattgtgtttattacaggcttagacgacttcaaatcattttgcttctcattctacatctactactcaggtactaatccttttaaaaaatcttgtaaaatcattattaacgtttttaaaccccttttaaaaatccttgtaaaatcattattaaagatagattgatg

SEQ ID NO: 7984 - DNA, 3000 bp, Unknown
  misc_feature (1)..( 3000): cDNA_ID_2144553_gDNA_ID_1621179_Annot_ID_174246 3000 nt of promoter + ATG
atcaagtagctggaagtaaattgggagatattcttatctttgtcatgtaacatttctttcaggataaatggagaggaataccgacgagattgaataacattccacattcgagggatatcagggcttatttttatgaagatgtgctgcaagccacaattagatctatcaaggatggtaacacccgtcttcgggtgaggctaatccacacaatctatttgcaatgtcgcatgttatgtcatctttattttgcaattcctaaagcagctgcttgacgggactgatactgttacaaatgaataggtggacattaatatccctgagctaaatccggaaatggtcagttattcatttcactaactgttttatacgatttctaaagcttcataagttgtaccaaaaagcaagctattgtgataaataggatgtttaccggataggaaccttgatggaacttgttcaagctttagctttatcattcgctgacgatggaaaaagagtgaaggtatacatggtttggaagacttaagtgatgtcacatgaatacagtttcacaaatcttgttcattcagcttttttcctcttccaggtttgtgttcagggatcaatgggggaaggtgcacttgctgggatgccattgcagttggcaggcactcgaaagattttagaatatatggactggggtgatgatgaaactttgggaactttcgtcaagcttggtgcaattggtaaatatccaaaaccaaatacttttcaaagatgtattgacaaaaccatgtttaacactagaaatactcagatacctcttgactttggtgtcttctggctttagtaactagagaatctctcaacttacaaaaactgcaccatcaacagaatattgttgtgtcaataatcaaacttgtgatgcataataaagttggatacattgaattacacattattctgctctttgattatgtgtttgcaatgacaggtggtaaagaagttgatgaagaagatgacatgttcatcttagtggctccacaaaatgccgttggaaactgtattatagatgtgaggagctaggaatgcttgaattcgttattcatttgaacttatcgacctcattttatagaatataccggattcgtttgttaggatctacaagcgatgactactgctgctgggaaaaggccagttgtacttatcaatcctcgcctcaaggtacattttctgcttgcacttttttatatagagacaatgggtaacaatgtgatctatattgtgagttacatgtttcatataccttattatttcaggacttgcccgcttcgagtggcataatgcaagtaagcacacaaagtgattctttacccatccaataagaagattatgttgcttataatttccttggtgtctcagacaatgggcagggagcaaaggctggaatatgctttgacgtttgacaactgctatgtattccggcttctctattatttgggaacacaatacccgattatgggcgctctaaggtacagttgttgggttatgaagtagagaaacaactatcaatgtcaattcattctgaatgtttgacctgaatttggtcaggatgtcttatccataccggtatgagctttataagagagtgaacgaggaaaatggaaaggagaaatatgtcttgctagcaacgtacgctgaaagaccaacccctgaacaaatcgacgatgccttctctggaaaatcgcggtaaattgtttccatggtccttcttaacacattgggcttatgataattttgaacaaaaactgagaatgtcatttcacatcagggatcaaagcaagaaggcgtcaggaatctggtaatgagcactacatagttatttaaatgaggatttttgtgtgtgtgtgtaaagctaaatgtgagggatacttgcagggggttcttgagtagcgtgttttcgtaatggaactaggaagctgaagttgtggaacattcattaaatgctcatctatcagttaccaaacagagagagagtgatgctgctactttttgttcataattttctccttttattatgtctcagattgttgattatcttactttggggcaaataaaactgaaaactgtgattattttattacgtagtgtcacataaccaaaaagtaacctcactctcgtacattttaaagcctaagtcatgaatggccgagaatattgttcactagttactgcaacggcatttataggtcatctcataagtggccttctaataattttgtttttcatcagtttttttaaccacattattttgaatattttgaattattgtattgtgaattgtaactagataaaaattgtttctatgtctatggttggtcaatcaatttcttgcacttagaaatactgattaataggtccaaatagatcaaaattaatattgattgacccgtcttgcaatcagtttcttaaattttaatttttcttattaagataaaaatgtatagtcttagaagaaaaacaaaattagtaaaatgttttaattattttggggttttgctgagggctccgcctctcccatagattgatacacactttttttttttgggttaaatatacacaccctttacatactagaaagtaatttgattatgtcaaaggttacataatcaactaaagcgtattagtgaatttaataaattcttacttttagtaattaattatccctccgtgtcgacttgctcgaaaatgcatgttaaatggctaaatgtttattttaatgcagagtctgaaaatggcaaaacaaaaacattcacttgacgtggatggttttgattggagagcataaattcgtcgcagactaggctcagaatcaatgaacccaccaaactaacaaactccataattgaaacaaacaaagaaaaaagtggattctcaaaattgaatgaagcaacgaacgattcaacatcaaatctagctgaattattgtttcgcgttgattgattgatccggagaaaggcg

SEQ ID NO: 7985 - DNA, 3000 bp, Unknown
  misc_feature (1)..( 3000): cDNA_ID_3047158_gDNA_ID_1621179_Annot_ID_174252 3000 nt of promoter + ATG
acttaactatcttagccttgataccgaagaaaaaaaagccatttatatgaaggattacagaccaatctcctgctgcaatgttctttacaaggttatatcgaagattctggcaaataggctcaagatcattttgccaaaattcattacaccaaatcaatcagcattcatcaaggatagattgctaatggaaaatttactccttgccacagaagtaatcaaagactaccacaaagaatcgatctcccctcggtgcgcaatgaaaatagatatctcaaaggcttttgactcagttcaatgggggtttcttcttaacacgctgcgagctctagacattcctgaacaatacattaagtggatccaaacctgtgtaacaacggcttctttctcagttcaagttaatggagaactagcgggatattttggaagtgaaagaggattaagacaaggctgctctttaagtccatatctgtttgtcatatgtatgaatgttctatcccgcaagatcgacaaggcagcaactgacaagcagataggcttccacccgaaatgtaagctattgaagctaacacatctatgttttgcagatgatttgatggtgtttgttgaaggaaacaagaaatctatccaaggtacacttgcggtcttcgatgattttgctatacattcgggattaaagattagtctagagaagtctacattatatatggctggtattccggaaattcaaagggaagagatactccaacaatttccttttgaacatggaacattaccggttagatatttgggacttccgctactaacaaggaggatgacatcgtcatattatctacctctcatcgaaaaaatcaaatcacagattagttcttggacagttaaagcactctcatttgcggggagactccaattaatacgctcggtgatcttcagtcttacaaatttttggatagctgctttccggctgcccaaagcatgcattcaagaaattgataaactgtgttcaagctttttgtggtcaggaccatctatgaaccctcgaaaggtaaaagtggcatggactgaggtctgcacaccaaagaatgaaggtggactagggctgtggtcgattgaagaagcaaacaaagtaagtgtattaaagttgatatggcgtatacagttttaatctatgggttttttcctatcaagatttaaattaaaaacagtatacactttgatgtaaacatgtttattttttcttgaatataatttaacattaaattcaaaaaaaaaaaaaaatcctaataataataatcatgtttgctcaaataaaaatattgacaatttttttttttttagaaacccacttaaggattccaccaatggaccataaaattttcaaaaactgtacaaaatctcaaaactacaaaactatcaaaactttttaataaaaaatacttagaaactttataaactaatcactgtggttgctctaaggtgccacatgtacaacacgtgttgatacgcgagaaggagagagagatacagtcggtaccgcccaagatccacgattcagtgcaaattctgcccctaacttcacaaatccaccaccaaactccttctacaaagtttgtcgttgcaaattcgattgacttccaccgctttcgtcgttgcaagaagatatcgttaatccttcatcatcttaaccttgattcctagcagaagctacgcctaagacctagttgaggtcctcgtcataataatcgacaaatatattattctagctaaagattggaattaagccaacggtgggacgagaagatcaaatatggcaagcaggattcaaattcagatcttgtagaaatagagagaaatgatcttagcaaagaattaagtcgcaattttattagattcagataagggagagaaaataaaccaacaaagcgaaaaaaatattcgattagaatgggaaaaacaatatttataacaatattccggtatacggcaaatcgtcctctctctaaaagataaggagtgaaagaagaaagacaaagtttttatttgttaatatatatagattatgactacataatatcaaaatagataatttgctgcgatgattcgtaccacaccgattcatatcatttatttaaacaacattctttaaatttgattttttgaactctaattaaaattagatgataaaaaaataattgttactacataatagtctgaaatatatatatctagtaatatgttacaaattagatctacttaatgatcaatctcaatgatttttgttttttcttatttaatttactgacgtcttgacagttcaacattattgtaataattagtatacagaattctggaaggtaattggctaatacaaatagtaacgtggaataattgtcaagatttgacctattttcagacttttaaaattaaagcgatagactttctttttataaaaagaataataattttcgtcggcggccaaaccaaaccaaatcacgttagctcttagctcattttcgctaacaaagactttgttccctttttcctccaacgtacatatcagaaagactctgactttatacctctctccttcttcttcttcttcttcgtcttctctctcttatgtccttgtccaatttccaaatcctttgttgttgaattttgtcttctttcttcctgagatttcccttcttgtcttcaagaaaccttgatcaggtgatttaaagtcttctcctttacggatctcgattcgttgttttctcatgtttctcggactgatttggttattgatgaatctagggcttatgggtattgatcaaacaatgaaaagtttgtgtttttgggtagattttgatgtttatgttcttagctgacataagggttttgtgattcaagagaaaagttttcatctttaggttttgttgatgagtttgtgaaagtcgaagactgtttacaaggttaaatattttcagggtttctattgtttaaggagggagaaacgaaatg

SEQ ID NO: 7986 - DNA, 3000 bp, Unknown
  misc_feature (1)..( 3000): cDNA_ID_3047150_gDNA_ID_1621179_Annot_ID_174256 3000 nt of promoter + ATG
ttgtttctacgtgcacatttgttgcattgtactcattgtttatgatcatctttgtgaattggtagggttggctaagtgtagctatttcaagtggaatggaaactatgcaatacgaagaattaaagactcagtatgagaagacgctaaggtaatttgggagaacatgttatgactttatccctttcccttgtctggttttctgtgggcgctttataactttacgtattatcttttattggtcaggagttgcatgataccatcaaattcttacttgcaatacacattgatccgagacggtggtaatctggaacacctcttaactctcagcaagaattcgcagacccttctgtgtaaggtttgtggatcaccttctttaggtttaataaatgcttgattttgtattcagattttttcttatgattattgtttttcttgttcttctgagtagattactagtattgaacaaacttttctctgtttcttcttatgttcgtttgtggtctccagttgcaagtcgtaatacgtcattgtcttctatagctcttggacaagctgattcatcctaaaatctatttgatcacttcaatttgacaacattggccattgtttctttgtagattggaacaacagatacagaagaaaatctaacagtccgtcaagatctgcgatggaacaaacaagttggcacattactgtttgaatttggtaattcatcctcttaactatttttacctattcacgttcattgtattttattcttctcatcttttccattcatttgtgaattggtggcaggattggctaagcagggccaccgatcgattggtaaatgctctttagagagttttaagcttctggaacaaatgtttgttttgtattgttggcatgattggcatgattttttcctcattttgatcatctgttaaaaaacctaaaatcatactttggcccattttcatgaggcggcaattagtcgtatgtccatgctttatagctttataatattccactagattctaacatcagttaacaagacaacaatttccgatttacggtttaaagagatcaaatccttaattttaacccatttcttagtcgtatttaaacaattaattattagttaatccatattgaataaagagagattatgaaaactaccctgcttttgagttttcatttgaaaaatacatctctctctatttttaataaaataaattgtaatttttaatatgttagatgacaattttatccagatttaaaataaaagctattttcttaataaattaaaacaaaattcgaaatttagaagaaaaaaattaaaataaaataaatttgaattcataattatgttttcaactattttttgagataaagatttatttattttagatatttaaaaatttaaccaaaatagtgtcgaaaaatattctgaagtctatcatttaataaaacttatttgcttttttggacaaaattttgtttaaaactatttaagataagaattaaatttgacttcttaaatattttttcaactatttctgagataaaaaatttatttattaaaatttaataaaataatatttttaaatatttaaaaagtatcacttagtaaagtttattttttactttttagacaaaattttgtttaaaaatatttaagataataattattcttaaaattattaaatacatcaaattttaatttatgatttttttttctgttttaagttaaaaacgtttttcagttattcttaaattttaatgagactattttagtaattttgtatattaaaaattaattgtttaaaaagaaaaaaaagagaaggtatttttcaaatgaaaactcaaaaatagggcatttttccaaatttactctttaataaatctgaaattaataaataaatagaattaattaataaaacaagtcccggctaattgaaaacaaaactaaattccggttaagaattaaagaaagctaaatataattaaaccaaacaagtcccggcttattgaaaacaaagaaccaaacatgttttttaggcatcatcaaaatcactatttaggatcgtaaccgaaccgtttctaaaccgtaactgtaaaatagattagtaggattaaaaagatatacttactgtaacttttaattaacagtaacagtttcaaaccgtatagttaaaacctttaaaatatagttgtatttgtgtatatacaaagataaatatcgaatattccgatttttttatttataataaaagtaaaccataccacatatgaagaaatctatgctagaaaaagatagttttttttccaaagaaatatgtagtaatgctacattgctaaaaatcaagatatttttgcctacaatatactttttcatcttattaaagtactggatacttgaacaatttctcaaagtgagattttaacctcaaataaattgtatgaaaccggtaaagataactcgatgtagacctcaaatactggatacttgaacaaattactttttcatcaaataaatggagattttgcctacaatatactttttcatcttataccctaaccggtatggtctgtgcacgaatctttacgtacagctcttaaaagaaagtccaaaaccaacatgacagtctgatcatacataaaacattccctttatgacttaaccacttgaccatccatcctcgcttggctaagtttcttgattatttcacttagtcatgactcatgacttatccttcgtcattcaaccgattcgaactaaatcacttaaccatttatttgaggtgattgatgattcaatagaccggtatcgatatcgtggaatatatgtgtcaattgtatgaaaccggtaaagataaaccgatatttgaagccaaagatagtaaaccgaaatcaaaatggccaatgaaaccggtacaaaaccggtagaagataatccaatctttaaagcgctcccacataaacgtttcccttatctctctctctctctccactccaatg

SEQ ID NO: 7987 - DNA, 3000 bp, Unknown
  misc_feature (1)..( 3000): cDNA_ID_2144618_gDNA_ID_1621179_Annot_ID_174262 3000 nt of promoter + ATG
tacactatttttaagaaacacatcatttggtttttataatgttaatcatactaataactataaacaattttttaattttgtattaaatattctacaaaatcaaaaatagcaaagattttgtacactaaataattcgtcttattaaatatgattaatcatgataactcaaacaaaacaacctatttctattttttcattgattctcatttttttaattataatatttagtaacacgataagaaataaatgtcatcattattgttctatcctataagaaatcctattggttctagacgattcgtttcctttttacacttcaacttttcatcattgtatcttttcctaattatatgaaatcaaaaaccttaagtctagaacatttaggtttaactctttatctttctaaacaaaaaaaaacttccttcgatacacaagatgtctgtttataaactcaccgatttgagggataactcaacaaactggaagattaacgtcaagatcctatcaatttggaatcatcctccaaacagtcatggtgaaattatgaccatgattcttcatgatgacaaggtttgtattttcacttttttttcttttaatcccaatttactttgttattattgaaacagatcatcacaaactatttaatctttgacttgtttggactttttcagaataaccgtgttgatgcaacaattcctcaaggaaactatcacaatcccttccgtccgtttctcaagccaggcacatggattcacatctctgactttcgggtcattgttcctcaatcaagggttaggtattcgtccttttgttttcacatcaaattcatttgggaaacaagtgtttaccctctcccggaacttgtgaaaagagacttctttgacttcatttttcccattgatcttaagtatccatgtcttgaggattgggattatgtcacgggtaagtttttagtcaatctatgttcttctcattttaagaattaatttatgatagtaatttatgttattatttttgaaatatggtatctactctattattttatacttagatgcaatgagtgaggtgacaaatatctcggctattaagaaatttccatttgtttgtcgccaaggtgaaaccgactatgaatcaagatatgtctcattcgaacttttggacaatatgtaagttgtagtgtttttaagtaagtttagtaatgcaatgcttagtttaatattagcttaataatgtgtgagtagatgtgtcatctgtctgaaaaattagcttaataatgcattgcttagttatattggttaggggagagaaaatgaaatgctatgctgttggaagatgctgtgaactttttgttataaatttctcaaaatgtatcagttcagcctcttataactatcagcccattgttgccattgtgagattttggagaattgctgagattgagggttagttattttgtttctattgtaattctatttacttatgattattatttgtattatataattttaaatgaaactaatggaacaggtgagaatgttttgaagagtgaatttggatgttcaagaatttacctcaatccaaccaattttcctgagatagatattcaaagctacatgtaagaattttatcatttttttattgtattcgttaaccataacatcaattaatcaatatcgattttttattttctcttttacagccgcggtttcgaagattatgatgaacttccagagaacccaaggatggaagtgattgaagagaattaggagtttgacctcccatctcctattcttatttaaattatgttttgaacttattttaatttcctgcaaactttgtcattttatgttattttttttataaatatgcttatgttttgaacttatttaagtaatgtattccctttttattttcatatatcttatgttttgttaaactcctaagaaagtttacaagtaaaacataaaaatctacaaacaaactcatatataaatttgcaacgattacatataaatacaattgtagaatttgtttatttctttaaaaatactatctttttttttttttcacatatcattatttatgattcttttcaaaaggaaataaaaaaattattgggtatcaagaataaaacattaaaaactttgagataaatcattcttggaaacatcaggatcatttattattaagttcattttttttcaactcatgtcattgtcttatacaaaaagtaatcttaaatatttagactctttatatttataaccctacaaaagcattatcttccagtatcatgtctctcatattaaaataatattgattttgaaaacctaggtactgcttttaaagtttctttttggatatagatgaaaatcacatcattacctttgtggcttaaaaataatcgatacatatataaaagttagaatttaatttctaaggaatgtaatatatatatatatatatatgatatcagtttattctaaatatattttgctctcatatatattttttggaataataaagtagattttattgagtagatacaaatattaacatctatattctcttcaatctatttatgagacttgctttctcaattaaatctattgttcacatcttttctttccatcttttccaagattgataacaagattagacaactcatccaagagatatgacaacttatgttacattttgtttcttacaaaatttattaaaattcgcaagtaaccataaaaagcactataatttaccatcgagattccaaattcgattgacaagatttgcatggcatttaactttttctatttaatatacgcgcttattcttttgggcaaaaaaaataaaatacaagtaatattcctaaactgtcaaaggacacataacctgaaaaaaggtaacctcccctcttattttcatctattacttatcttcgccatattccttctaccctattagtttcaaaaaaaaaaaagatgttgagagatgatagag

SEQ ID NO: 7988 - DNA, 3000 bp, Unknown
  misc_feature (1)..( 3000): cDNA_ID_3047154_gDNA_ID_1621179_Annot_ID_174253 3000 nt of promoter + ATG
attgccagatataatgagccatgtaggtacactgtaagctaatagaaaagtattcatatgtaattacttcaattcattcttcaattgttacacttcttgttgactccaaaatagcatatactaattactttttaaaatggcatatttcaatttagtcaaactatattttctattgaattcttttttgaacatatcggaaaatatctttcaagtgatttagtcaatgtttcgagatcattgaccgaattggccggtaggactagtataagagaactttccaacacatgcaaagagtttgatattggtacattttactgcatatcgaattagaaagtttaattttggtcttttagacttcctttaagaacctttgtcgtattcttttagtgtttgagctaattgcaaatcagtcttgtaaattgtaatcttagagctcgactatctgatcttgtcttgtctccataatcttataattttattatataatggcggaccaataaaatagttttagagtaaactaattaaaaatatttttaaaatatatatgttttaaagtatatataaatatatttaaaatatatatgttttaatatatattaaaatatatttaaaatatatatgttttaaaatatactaaatatatatatctaaaaataaattaatatatgaaccataaaatcatactatctatatgtttagcaaaactatgtaaattttcagataattttaaatattcgagatattatttataataattagataaatatatatgaaccataaaatcatactatatatatgtttagcaaaactatttaaattttcaaataattttaatttcgagatattatttataataattagataaatacttaaaccaatgatgaaaactcataaggtttttaagaataacatgtcctaaaactatctaataaatttaaaattatactatttttcttgtatgcagtatttttttggtttaataagtcagtcgctattttgttaatctatactatttttttttttttgtcatccaacatttttattaatattgagcccaatgggctatacaagtgatgaaaagaaaagcccaaactctaacatttacaaccttgattaaagttaaaagttgcttaatttgattggactaagaaagtttaaggactttaattttttggaagtcttaaaagtcaaatatttactaatcacaattttaagactttagttttttcttaaaatttttaaagtctaactgcccacttttttattttttacgttcaattttctaaagtctcaaatatgaggctttcaaacaaataataaaactttaaaataaataataattaaaaacttttgtttttcttctcctcataataattagaagagaatattacgtgattagacacttttttgaaagttagttcctaattaggcactttaaatggagaagacactttagataaattattttacttatttaccttttaattacatttttttcatcggccatctcttctctctccttttcccatctcttctctctcattatcccatctcttttctcttttttttatttttttctcactttatcgaagaaaaaaacttttctcagaatatcttcaattccaaatctgcaattaatctccaaatccactctacacgatagctttctcttctctctagactaattggggagtacgaggtcttgatttctttaagattgtgatttattttgcaatttaaatatttgttttgacataaatttgagattcacttatctaagaaacttcttcttcttcaacaatggcggcttgatttgatttttgttctctctcactgtttggaaaggacaatatacacgtggatcaggaaaaccaacaatcgttttagaggtcgttgcttcccaagatctctggatatggcacgcgttttttggacctccaggtaccttaaactatatcaatattcttgatcgctcaccagtttttgatgatatattacaaggtcgagctccgaaagtgaaatacgtagtcaacgagaagactataatttggcttactacctcacagatggaatttatcctaaatggtttacatttatccaatcaatttcaattccacaaggtgataaagcttctttatttgctataactcaagaagcttgtcgtaaagatgttgagcgtgcttttggagttttgcaagctcggtttgccattgtcaaacatccagctctttttcatgataaggtgaaaattagaaatattatgcgagcatatataatacttcacaatatgatagtagaagacgaacgagatgggtacactcagtttgatgtatctgaattcgtacatccagaatcagccatctcttcacaagtagatttcacctatgctatagatatgcctccaaatctcggtaatatgatggccattagagcccgagttcgtgatcggattaaacatgaagaattgaaagctgatttgttgaacatgtatgaaaacattattatcataatcaatcttaaaatgtaatcgttattttttttcgctttttaatattttttttttttgttatatcaggtatgtttaaaattcctaataaaacactaatttattatagaaaacgctgcgttttgctctgaggcgaaaaaagggcgatctagggtttcaaagcttcttcagcaagttccatgccgccggaggtatctccgccgctggaagttggggatttgagtccgggaatatcagaagggactgtgttaactgtggatgatgataagacgggtggtttgatcagatctgaagatgagaaacagattgcagggaggcttgaaggagatgagaaacagaatgtaggggaggagaaaattgcaggaataactcaagatgtgaataaaaatgttgtaatcactaacacaactacaacacaagattcctgggtagcagtggtgaaaaacgaagttgaaacaaaagtagagttggtagtagaggaaattgatgggatg

SEQ ID NO: 7989 - DNA, 3000 bp, Unknown
  misc_feature (1)..( 3000): cDNA_ID_3087925_gDNA_ID_1621180_Annot_ID_174264 3000 nt of promoter + ATG
aactgttgctggctcagcagaagcagatacactatatcactgatgaagagcatttccaaatgcaagaaggggggaatgatcaaactgaagagcactaatgtagctaacccccaagatcaagtgtatccaccacaacagaatcagtctaagccatttgttcagtacaaccaaggttatgtccctaaatagtagttcaatggaggataccaacagcagaatccaccaccagggttcactcaacaaccacaacaagccccagcagcacaagatcctgaattaagcaacttattcaacagatcattcaaggacaagctactggagctatggcttttgaaaagaagataactgaattacacaacaagatagattgttcttatagtgatctaaatgtcaagtttgaagctctaaattccaagttcaagtatgtggagagttagtttgcatccacctctgctccgaaacatcctcaacaacttccagaaaaggcagttcagaatcctaaggactatgctactgctaatgctataaccattcaacaagaagatgagtctccaccatgtcatcagactcccaatactgaggacagtatgattcaagaaaggggggattcaactcaaattgctgcacctgccatccagcatttcatctggactataaagcacacacctttgctggatactcaccattctgggaaaattttcaaagtagaaaaactcaagaaggatcaaaatcaacagatgattagtagtgtcatcactcaagaaacttacaagaaaaagtcatccaagaaaagctagatgatcctggttcattcactctttcatggtctctaggaccattgacattcaataggtacctctatgatttgggagcatctgttagccttatgcctctctctacagctcaaaggctagggatcatggaatacaagatctgcaacctagctttactcttagttgatggttctattggacccccccccccatggtttaatagaagatcttcctgtcagaattggaaatgttgagatacctacagattttgtagtgttggatacaaatgaagagggaaaggatctcctgatactaggaagaccattcttagcctctacaagaccagtcatagatgtcaataatggaaagatcatcctgaaccttgaaaaaggcatcaagatgaaatttgacatcagcaaagcttcagggacatcaacaacaagaggtcggaattttgggatccaaggcatggatgttgatgaagaaacagaagctcgaatcccatcaagattcaacaacacttctcaattcagcaagctaaagaaaaattttgacctcaagaagagagccatagaagggttagctcagactgaagaccctttagaggatgactagcaggagatgagaaaaaaaaataaatggcaaagcagagtcatagaggggttatcgtcaagggtgatgaagctgaaagatcaaatatgggtttttgaaaaggagttaataagtattcaatgggtattgatccagagaagatggaaactgcactagctatcaaagagaaaaatgatttcacaacataatggtttgcaccagaagatcataaaggagttcattcagaggaagaaagcttagaggatgacttgttgagtgagaaagaaatccctattccgacttattttccaagagtgcctaaaatgcctagtaaaccttcttctaaggaagaacatttgacacttgactctattactggagaacttctggaactcaggatagaatgcaaagctcaggaagataccattgggtagctaacctacaagatggaagaactaaaccatgcaatcttggaacttcaagaaatggttaaaagttaccccagttttgaaattgaggattggttagaggaacctggttcagaagaggaagactactctgctgatcaaaaggaagcttattttgaagaaaagtcaaatgaatactcatcctaccatatgtcaaggaggatgcagagtatgactcaaccactgaagatgaggacttctatgttcctctcttcaaccttttttctgactaagctctgtaagagtcaacctcagtgacttaaaacaagctcactttggaggaagttacatgtttatccatgtatataactttctattttccttgttatttttgatgttttgtttaagtgtttcaggtttatttcattgaccatgaggaagtcaacggtcgagtaaactcaaaccaagtcaaaagatgatctccaccgttgatcgagtaaaatgaggaggagtgttctgagccgcgcgattgaatgaccaaatgagagaaatcatccccaccgtttgatcgagtgacttcttgaggtttattctagtccgtttgatcgagcgttttaaagagtgaaacattccccaccatctaatcgagtattacgcacttcatgggatgctcgatcctttactcgattgtgaatgattcggcgaccaaagagtaaggtcgagtggcccacttgtctcccttcacttcattactcggtggacaaaccaattacccataccctcactgttgtttccaactcacttttctatcccttccaaaagaaaccaaagaccatcctcctccacccattgaaatcgccaaaccacctttgaaaccttctctctttcatcctttcattttcgcaaattctctatctctcataaagcttcaaaattaagtttcattccaaactctccctatcaatcctcaagaatctgttctcaccttcaccatacctcaccaaacttactcgatcattcccaagtccatcttcaaatattcaatcggtttttaagctcaaaactccatcaccaaaaaccaaatcctttccactttgatacctcttggagaattgttcctgattgtcctatagaagctcatcaccaaactccatggattcaagaagaaaggatttatctcgggctagaagatcctttgttgatagcgaagaagttcagtgatcgacatg

SEQ ID NO: 7990 - DNA, 3000 bp, Unknown
  misc_feature (1)..( 3000): cDNA_ID_3047176_gDNA_ID_1621180_Annot_ID_174266 3000 nt of promoter + ATG
ttctgtatatctcaataatctgcaagtattttccaatgttactagtcctttccacaattcacaattgtagtattacccacttccgacaatatttcttagatatcaacctagtatttcagttttgttactagtactttccacagttcacaattatattattacccaattcaagggattttacttggaatacttacaatatccatgagattcgccattgggatgtccttgtttacggtcctctcctccacgagcttttcccctatgacgttcgtgcctctctcatcctctagggatttattcactatgacttcatcgtctctctcatcctcctcgtccacaggattagcaaacgagaggtcatcgtttgcattcgtctcctctgaattggaatcagagcccacggttcggctactactcaatgattcttctttttcacatgcttctctttcattctcatccaccattcaagttagaacattcttttaaatttcttctgggaattttctctaaagcatcataaaacgtatcatcctcaagcatcacgtcttatgaggcatcgttggagccgtcgcgtctatcgctgtcgttggagccgtagtaaccgtcgtcgtcgaagtcgttcgagccggcggagccggcaacaacattaccgccggttgagtcggtgactgctcctcagccattaccttatctctctcattcttagctggcggtactctctttctttttcgtgccaatccactggtcttaggcggcatctctaatctgagatatcttaaaggttacaagaatgaaagaagaacaaaatcgattaattgattttaaattgggaatgatgtttgaggctaatttctttggtttctaaggagaaggggagagatatcgcaaaatcttaacgggtacaaaaaacaatcggtcgaaaatatctcaaaatattagggtttaatttttttgattttctaaaaaagagtaaaggtggtttgggtgctcctgttcggaaacgaaccatggttataggggtaattattagtttcggatggggaaatactagtaatatcaaacaaagctctaaaaaaaaccacttactaaaagcggcccatttacaaaataataaaagtcagttgttatattataacgtaacttccgagggggatattgaagggttgcgtctttactcaagtatatatatgagagtctgggttaaccctcacatcgttgtgtcgaacaatgacaacactgtattttactcattttaggcatgtatttatcatcatttagcttagtgatcactcattttttcatatcattttgcatcacatgtagcttattttgcacacttaggcatttaggatcatcttgcatacatattgcatgttttggtgtgttttcagatgcaaaaagagcttacaaggaatctactcgaccctcaactctatcaaaccaggagggaagcagcagagcaatctactcgaccagtttactcgatcaaggcagctacaggggaggcaacagaatctactcgatcccctactcgatcctctacccgaccagttactcgatcaagggcaatctactctacaagacttgttgatcgttcaaagcgtcttcagatcctcttcattccccacccaaccagacaactgagcataagaacaggagaggaagaagcaactactcgaccaattgatcactcggagcatgtaggcaaaggcgcagactttgcagcaccctctttattcgatccccaagatcgagcatccatccaaaccgcctcaagtctcttgtcttctagtgaatctagggttttcgagattttagtataaataggttctttgggctttgtccacaggatcaagcttttattctgtagttttatttgtgttttagaatcttgaaaccttaattactcttaatctatttcgtttttgcatttagttctttgagcaaagttgtttatcttgtttagatctacattttgatatgtttagagtaatttttgggtttgtgttcttcattatgttgcttgagtagtgattagggttcttgaggatggatcagattagggtaatctctaggttagtcaggtggttaagattaggttagatcccttctggattcgttggctcctatgcggttttcactggctaatgtgggaattcgaccctacgtatccaacatcccaaagacattcaaatggatgcatgatctacgaattccaagagatttgtagattctaccccaagagattggatgtttagactgcgtattgactttggtagattgttacttaaagcttgccttgctatgtttgatcatcgagagttgagattaggaagtggtgaggttatgaggatctctgtcacgagagtggattgatctggttttgaatctatcgtctagggtatttgaatttcgtatgttagccacgtgatgaaccctagagttgcccttaccaatgaatccatccttaggacttctattcctcttagatttatttgtattcaccccctgattgcacttttatttacctgttatttgtgtcatcttgctgagttaccttttattgcattttggttcttaaatttgtcacctgttggttctactcgacccaatgatcgagtagggctcttaagttctcattttgttgtttgaatcctgatttaggattgttactagaaacccaccatcattataatctggcgtggcttagttgcttatgttcacatcttgactgctaggaatacgtggactggattgacaccccctatagctgcatcgacatgttagtgtttaaggggaattgaaccgaaccacacttcagcatataagtaggcgtaaaaatctacttatcaatttggcgccgttgccaattcattgttgcattgttacatttaagatataagaaaaaacttaagatcaaattcttttacattactcaagttactaactcatcttttcgtttgcttgtttttgtggtacaggtactaatctttgtgcatg

SEQ ID NO: 7991 - DNA, 3000 bp, Unknown
  misc_feature (1)..( 3000): cDNA_ID_1810061_gDNA_ID_1621181_Annot_ID_57377 3000 nt of promoter + ATG
tattagagggttatgatttgttctgccgcttttgatatagccttctttgatttgagcaacacacgcatcattatcttcatataatcttgttgctcctttttgatgatgaatctacttgctttttgaatatggttagtcatggatctaagccaaacagattctctacacgcttcatgaagagcaataatttatgggtggtttgatgaagtggcgactaaaatctgcttttgagaacgccacaagttgcagttcctccaatggtaaaaacatatctggtatgtgatctagacttatgagggttcgataaatacactgcatctgcaaaaccaactttccaaaactcaaagtttctaagataatataatcctaaatcaatagtactttgaagataattgaagatgtgttttattgtaagaatatggagctttaggttgcaagaatgggactcttgattaagagggttgagagtgagaaatgaacataaggaagagatagtattgcggaaatagaagagagattgtgagaaaagagattttctctatttctttattaaaaacatacataagatacaagctatatatggacattaggtaagtaaagatctcctaagaatatgctaaacacgtcgcactctatacaagtccacatcgtgtagacaagtcactatcgtactaagaaagagacatgacctaacgttcagtttgctttaaacacatgcgatcttcttttgacttgggcgcttaagcttcaacggctacatgaggagtcttctaggtcttctagaagagcttaaggtgaagaagagtttatatgggcttctctcattgtgatgttgtacggatgggcttctcttcctccgtatggtcgtctagtttaacttgcggaaggggtttccttcattaggttcaatactccccctcaagcttaaccggagatgagtcgagattaagcttggaaccaaattcaaccacctcattaaaaaccttggtgtagaaaaacctctttggataaaactacacacaagggaaaaagagtatgggatatttgataagaggatcatggcctggttagatcaactacgccaagtttgttgtgaatatattcacacaccttggtgctcgctcctttggtgaagacgtcgactaattgttcctcactctcagtgtaatgtggtaggatcactccgagttgtacttgttctcgtactttgtggcagtctacttcaatatgctttgttctctcgtgaaacaccgagttagaggcaatgtgaattgcagcttgattgtcgcaatgcattggaatggggtttggtgtatcaatgccaaagtctttaaggagagctttcaaccacatgagttcagtagtgagctttctcatggctctatattcggcttcagcacttgagagagacactactttttgtttcttgcttctccatgttactaggtttcctccaatgaaggtgcaatagcccgttgtagaacgcctatcttgttgatctccggcataatccgcatcacaatatccaacaatctccgtgtttctattcatcccatccaaatgccttgacccggagctcctttgagatatttgagaatgtgattcaccatgttccaatgatgtattgtgggagcttgcatgtgttaacttactacattaacagcaaacaaatgtcaggtcaggttatggttaagtagataagtttaccaacaagtcttctatatctcgtagcatcttcaaatggtttgttatcatgctccccctttcgtttggccttgtaatcgtcctctagtggagtcttggccggttttaccccgagtttacctacttgggcaagaagatcaagtgtatatttcctttgggataagaagagaccttcctttgatctacaaacttctatcccaaggaaatattttaactcaccaaggtctttaatatcaaaaacacttttaagaaaagtttttgtatcttgaatacctaccttgtcattcccggagatgataatatcatctacatatacgagaatgactactatacctttttggcttggtaaagtgaagagagtgttatcggcttcagacgttttgaaccctcttcccatcaatgtggtgctgagtttgtggtaccacgctctcggagattgctttaaaccgtagatggctttcttaagcttaaagactttattgggagcattaatgacttctagacccggtggtggcttcatgtacacttcttcttcgagttctccttgaagaaacgcattcttaacatccatttgccaaagatcccactcgagattggtcgccaaggagagtactactcggaatgtatgtaactttgcgaccggagcaaacgtatctagatagtcctccccatacgtttgagtaaatcctcttgccacaagtcttgccttgtatctttcaatctccccatcactcttatatttaatggtgaagacccacttcgaggtgacagttttcttacctctaggaagctcatctcggctgcaatagcgtccctccatacttgatgagttatagcttcttcataagtgtgagggatccaatgttggtctacttttccaagaaagacttgatgttcttcgggtagatgagctagggtgcacacagcttgaattgggtgttccacggcattgtcaacgtagaattgggtctacttttccaagaaagacttgatgttcttcttcttcttcttcttcttcttcttcttcttcttcttcttcaagctctttgagcagattcttcttctttgtgttagtggattaccggatcgaatctggtcccagacgtaggcttaatcatatcgattagctgaactgggtaacaaatttacgtttttcgtttattgcttttgattttgttcttgagttgagattcaacgagtttaaagagagaattgaatcagagtgattgtgagcacgaaccgtaacaaagtggtatcggaacgttggttcgaaagattcgctcgatggtaatgacg

SEQ ID NO: 7992 - DNA, 3000 bp, Unknown
  misc_feature (1)..( 3000): cDNA_ID_3047189_gDNA_ID_1621181_Annot_ID_174299 3000 nt of promoter + ATG
ctgaatcgccaaattcgtctgattgttcttcttcttcggaaccgtcagtgatgatgtcttataattctctgttttgtaggtcaatgtggataacatcttctgtggttatgtctcgtatgaaaacttctctaacactttcttgttgcatcacaacatcatcaactagaccgactatacggcctctgggattaactttaataaccgataacgacacttcacgtttaggcctcacacgcggataagatagaaatcttacttgccctgcttgtgatgttaggatatatggttcaaactttgaataagtcttgtttgcattgacatcgaccacgcctaagttatttacccgtacccctcgaccacacctaagttatttacccgtacccctcgtccgataacaagatcaaaccaatcacacttgaaaaggacgcatttctaattcaaaagtctcggatattcgacttcaagaatttgttgcagaatctcattaaactctgtttcaccttcgacatggattccataatctgcagttgcccttcgactttcatttggatatgtatgaaaggtatagccgcgagtgaagtacatcggtgtggttgtgatcttagatcttggtttttgaacgatctcatgcaaccaaagtggtaaagcttcacttccacatccgttagtaacctacataaagtaaatattatgtaagtttatcatttcaacataagtaattaagatatcaaattttcgaaatattacttacatagaattttaaccatctggcaaaatcatgatctttgtaaatttcatattctttatcttctaatccaggatatgcttcacggatttgtgaatcaaacaacctacaaattaaaatgtagatgcttagcttctttaattagtccttaattagtatcacactaattattaaatataaaaaattatgaataaaatttgtctggctttgtacctctcaaattttttaatgtaatcaacatttcggagtatgtaattgtgagctgctctagaaatcgcatggtcatcccaccaaacttctttcgacttctctgcaagtctacctatttgggcaaagctatctggaacatcaggaacgttatatgtaggtgcaacacctccatcgtcatatcgtcgaggatgagtctttttggttctaacgtttggactaaagtaatacgatgtgaagtgagacgtttcctcggttaaacttcctgcgactatcgacccctcaactctcgcaagattttttgccttttctttaagagatttcatgaatctttcaaaaggatacatccatcggaattgcattggcccaccaagagcagtttcatgtagaagatgaatcggcaaatgttctatcacgtcaaaaaaggcaggagggaataatttctccaagttacagagtaacactgggatattcttgtctaattgttctatgacatcagttgtcaatgttcttgtacataggtccctgaaaaatgatctgatgcctatcatatatcgaattaatgtaagttaatagtcgtctattaataactgagttaaagaatagaaatagaatctatatatatatttattacctgcaattgcttcatgaatatttgcaggtagcaactctattaacacaaatggcaataatcgttgcatgaatacatgacaatcatgactcttcatacaagaaaacgtttgaccttgctctacgcattgtgagagtcgaaactcgcacaagagaaattgtattaagggtttcttcaaagaacggatctttttgagtttctcaaagaacaacagaattgttgattaccgcggacggtgttcttggttatattattgaaataatgaggattcgatcgtacaagtgtttagaaatatgaaaataagtgttttgccttcaaaatcagagcgtttttgatatcctgaaattaagagcgtttttgtgcgtgtctttttctttgtcctcagaagttctttatatagggctttatcagatcgcttctcgcgatattctcggaagatttctccttatcttagagctagcgaaggagatttgtctttatcttccgaagattctggaaactcctatatttggtgatatcgtcggagattctctaatatctcttccgggtttttcggaaatggtatgttcgatctcatattggttaagtcatttcttgaaggttctgtcccgacctgatgttcctccgagccgggttgagttgaccctcaggttgtggttgagcggctcggaccttgttagtcaaatgatgcgctcccgaggcgtcttaagacccacctcgggatgactttccgggttgccatccgaggcgcttcaagaccgggtcggggaatcctttgtggtgatgctctgaggcgttcttgatgtcgcctcgagatggttccttgacatgatccccgaggtgttttgagtcccggctcaggatggttcttcgacaagatctccgaggcgttaatcagggtcggctcggttacctaggtggaatccgaccccaacagtttgccccccagctcattgtcttgacggaaagccgatgagtttcacggatgggttcccgagccgactgttcatcttcttagatctaactttgtcgcttcatcttcccggacggtcaaacttccgttgcgtgccgacgactatttttgagaagtggaaaacgtttctcgcttattcccgaggatcacgcgggtgtttccttctgtcgagcccacgcgcttaaacgcgttttaattgtttgttgcggacccgacgcgcctccaaaaactctatatatacgacgagccattccttcgggagttcatttgaagttttcgaagaaaataaacgaggtttgcttccttctctctgatcttgatatttctatcgttctttcttttccggtgaagctccgccgttcttttgttatttttgattttttcggtttagaaattcttgttttctggtcgtttctcatctcatcgatcgtccctgagccaaaa

SEQ ID NO: 7993 - DNA, 3000 bp, Unknown
  misc_feature (1)..( 3000): cDNA_ID_1810046_gDNA_ID_1621181_Annot_ID_57381 3000 nt of promoter + ATG
ccgaattacgagatagactcggttttagtgttagccggaaaataactaagtggaggcttggtcgccggaactttggttgtcgctggtgctcatggtgatttaaccgaagctatgaagtaaaagatttaatctctcctccttttagcactaaattgtggatgtcagaatccgcaattaggaatttgtggatgttacgaggacctttaaccttgttagccgagctaagattaaatcggacaatatttcagttaattggaattctattgtatagtaattttttctgtcccccttataaatgatgatcgagttctatttatacaatcaaatcgaatatctacgaagtaactgaacgcttgaattacgccacaaatcatgcctcattaatgtttacgtttcaaactgccacttcccatattaacgcatcctcatttagtccggtgattttctgttacgtaacacgcagatactcttacgcgtactgggcctcaaatgggccctcgatgcccacttcgtcacgggtggtttcaggcccaccgttttgagcccactgattgatgatgatggatcttgggtcggggcaaactgacgagatccgacatccacaacactaaggaacattggtcttaggtatgccgaactccagcacatctgtgtgctctatacaaagaatccgccaagggaaaaggaaaggaagtgaacctcgcagaacatattgaggaaatggatcacattacaaatggaacaatatccaaggcaaaccttggagatatttgcataccagatagtagaacaacgcacactattctaaaacataaaaaatatttctctgatttgaaatcaacaaaagttggagttaacatatcaggtcccacagacttaattgaagggacgagtaaagcaaattttggattacctgttaagacaaagttctcgataaataatgcattattttctccaaattcaaaaaaacttttgttgagtttcaaaaatatataccttcatggatatccttcgtggatatgacactcagtctgcaactgagaatggaagaagtacatgtgtatcacttctgaaaaatttggggaaaaaaacacattttggagaaattaacaagactcccatcaggattgcatcatacatagaatcacatcatgttatcaaaagagatcatgacgatttcacattgtggcacgatcagcttggtcacccaggcaccacgatgatgcaaacaattatagagagctcatatggacattcaatgaaatcccaagagatttatcaagggaataaaagaacatgtgttgtgtgttctctaggaaaattgattataaggctatcgccaagtaaaattactaaacaattaccagaattccttgaacgagcccaagacgacatttgtggacctatacacccaccatgtggaccattctattatttcatggttgatgcggacatcaaccttacttcacaaaccgttgaactacatcctgtaccacatcttatactacatcctgtaccagaagtcccggagggtatcatgacacgttcaaaggctaaacaattgaagaaaaggttcaacttagttgtgcaagatattttgagctccctagagctaggagtaaactggttcgtagcaccccataccggatatgatctaataggcgaacaagagcttgttgaagcattcacccaaatgagtcttgaacgaactactcccccaagtatgaaatatcatttgacaggttcaaggacctctagaaaccaagagaagactttggagcttcaagagacgaacgattcaagtgtcacatctgcaagtgatcgagagagtcaagatcaagaacaagacataaaggacatggaagagctcgaagacgttgattaagctactcaagaggaactccagaaagacccctacttcaaggaaccaaccaacaaacgagcacaagacttgactccagaagtacctcaagaagtactacaggaagtgactcaggcgacatgggcctaaaacgcatctaggtaaggtttattcagtttatattatctttgcaggtccacacagcccagacaacggctagaatcgttctcaatcgtgctcctcaagagaacttaattagtttccttattttagcttatttctttcttaaaacaatggtttttgtgttttgatttaaatttgtttccttttgcgtttttacatttaattttggccttagggatagctgatagactcttataaagtccccctgcaacagttgaacgatttttcacctttgattatcaataaagaaccgcattttctcacttcttctctttaaatgttcttaagagaataagcttgttctttgtcttgtgtgtgcaattcaccaaggccaagttcgtgtactgtatcagagacttatcacatctctgtggtgtacttcaatccgccagcacttcccctctaatagatcccacacaagagaaccgatcgccatcatgttagatctccatcttcgaccatctttccttcacaagagagaagcgaccgccagcttgtgaagccaccatctctatcagatacaagctcaccaccgagtcttgtatcatcttggtatcagagcgcagttgcacttcctttgccaggtttcatcgtttcttatagcctggcttactttctgaatcagtttctacattagtctagtttctgttttatttaaattaaaaaaacaaaaaacaagtatttcagtttcattttatttcgtgttaagtatttgtttttgagtttcgtaatattaatcaaaaaaaaatatatatatatatattgttaactttgtactacatcagcaagtgtgtcagaaagtgattcaacaagttttaggtttcttggttttgatctttcttttctattgttgtggtacgttgatttctttgttgtttttgtctaagcacatgtcagttttaggtaatactatgggagaggcagcagaaattccccaaaacaccgtaatgcaaatg

SEQ ID NO: 7994 - DNA, 3000 bp, Unknown
  misc_feature (1)..( 3000): cDNA_ID_1810038_gDNA_ID_1621181_Annot_ID_57383 3000 nt of promoter + ATG
agtcgtggtggaatccgaactctttccgatcttaaccgtaggtctggtcctgactccgacagtgattccgatggtccacaagaatactacacaggtggtgagaaaaggtcagtcttgtttctatttcgcaagtgatactaatggtgatgtggatcgtcttttgctatgattggatctagatattaattgtgaggtttagggtttcatgtctaaataatgtttttattggtcttgtgttgcagtggtatgttagttcaagatccatcgaaaaaagatgatgttgatgagatatttaatcaagctagacaactaggagctgtagaaggacctcttgagccacctccgagttccaggagtttcactggaactggtagattgctttctggtgaaaatgtgcctactggtaatcaacagcctgagcctgttgttcacaacattgttttctggtctaatggtttcactattgatgatggtcctttgaggaaattggatgatcctgagaatgcatcgtttctcgaggtgaatgactttcatgtgaaactgttttgatcttttgtttttggttattgatttagttattgtgttcttatagagcattcgaaagtctgagtgcccgaaagagcttgagcctgccgatagaagagctccggttcatgtcaacttgatgcgaaaggaagagaaatgccctgtgagtcccctctctgctttatccatattgggttactagtctctcaaagttgtgttagcaaaactagcattttggtcatacattacaaaaatcttggtagattttatatgcgataaccggtcttatttaatcgacttaccggtcttgtttgttattgtaggaaagacagaaacgtagggtttcatttcagggtgttggaagaactctaggtggtagcaatgaaggtagcggaagtagctcacctgtggctccagactccgctcccattcccatccaaaccgaaccagcaccatctcaaagtcttgtaatagatgaaaccgttccaaccacatcgatacagcttagactagcggatgggacacgtctggtggctaagttcaatcaccatcacacggtcaacgacattcgcggtttcattgactcatctcgacctggagcctcgttgaactaccagcttcagacaatggggttcccacctaagcctttgactgatctcactcagaccattgaagaagctggtctcgccaactctgttgttcttcagaaattctagaaaattctacaaggtgtggttctttttgtctatctatatgcattataatgagattttcataactgttgtagtaaccaggtctttaaaatgtaagttacttcttcactctgtatactcagcataagccggcggggacttgtggtatagtttttcttaatttattgaaattttatagtttcattatgcgtttatgggttaaatacagtgtttcaagaacaactatatatagttatatattattagtttggtaagagtataatcaagtgtcatatatgcatgtatatcattgttgtgttattcatcaaccaatagttactgggaagagtattaataagcttattgagaatttgaaatgtatatgactagttttcatgaaattacaacattttgaaactaatgtttgtgaaaggaagaactagaatcttttcatattattttcagtagggaaaatgtcataaaagtcatcagttaaacaaagcaccaactttgcttatggtgaacgggtcaagacccatttttatcttttatttgtgatttttttaaaaacataaaacgacgtcgttttgcagtttaacgaaagatgggaatgttgacttaacaccgttaattttttcaattagttgacatcacgatatgctttttttggcaaagttaatacaagttaatgatttaattgaaaaatcaattgaaattagtgatttaattcactagaagcaaagtttgtgctttgtttcaccatttttcgtaaagtgatcatttttatgacatttttcctatttttaataactttacttcttcctttttttttggtagggtctataactttacttcttacaatgatgttatgttcaaaataaaaaggttcaaacttcttatgtatattttcaattaagaaaaaaaaaacactttcaaatttattaaaatctaaaagaaagattaattcttcgttaaaatatttttataagaaaattacaaagtaattaagatacataacacaaatgtgtaatcaatgctttcaattttcaagtcaacatgatgaaatttcaacaatttattcgagaatggagacatgtagacatgtgttgtttcaacaattcaatatgactaactttgttaaaggacaacatttaagtttgttgaaatgaagaatgagcattcttgcaactatttacaacaagtttattttttacaataaggctaggttcaaaataacaaggtttctaaatcattgcacttaaagcatgtacaatggttgggactgtcaaagtccctaaaaaagtaaaaagtaataatattttattattttaattatattttagttttttaatataaattggacattgataagattacacttgcaaatatgtttgtgggaacgtcctttaaatgaggactttcagagactctctttcatccctcttttactttttaaatatttttgttatttttaagtggatgagcctgtataaagagacccacgttggacgtgctcttagagttcgaacactttcaaatttacgaaaatctaatacaaaattaatactccgatttttttagctagtattaaatacttccggacttgtaaagtagttggagtcaatggtttcaagtcaacaatgatgaaatttcaacaatttacttaaacgctacgagagtgagagaccctaccagagtcaactttgttgatttgttcggatttggtttttaaccaaaaacttggatgacaaaagaagaacagtaaggggcaaaaagcaaaatg

SEQ ID NO: 7995 - DNA, 3000 bp, Unknown
  misc_feature (1)..( 3000): cDNA_ID_1810033_gDNA_ID_1621181_Annot_ID_57385 3000 nt of promoter + ATG
ttactatgcatttaaactatagatatgtttggatacccgttcggatatcggtttggatctgattcggtttcagattttagggttttgaagtataaacctgttcggatattttaaaatttcagattcaaattccgatcgggagctcggattcgaatattatggccagccctaaacgacgtcgtgtttgaagatttagacttgaaagcgaagaaacaaaatatacctcttttaaacaacactatatgtaagaaacccaactggaacatggtgggacctactagagacaatactcgtgttactaccgtcagatgcttttagatattgtcgtctatcctgcggtcgagatttcgtgtaatttcaaagctaataccgtgatccatgatctagtagtaacactgagaagagggactgtgtttttaatcggctgcgtcggatcatttcctgttgttatcaaatttttctaatccgtattcgctagttgctttctgcttgttcacgcgttgaatctcctcgtactttgcggaattcagatttctcgaacgggtatgtacttgttatgcctagaaactgttcgatgaaatgcctaactgagaatgtttttacaatttctctctgtttgatgtatctttttttataaatgaatgttcagggtttacaagtttggtttgttcttcagttcttgaagtgatttgatacggagcagtcatggatggtgagtgaatgattcttgtgcaattgtgattttgtttttgcttcaaggaaggccctttcttcacttatctttgggaattggtgaattagatgtagaaacttaggaaaatgctataaagctttgttctttgctattgttttgtatgatgtaaaacttcttagtataacttgttaaaatcccaatctgcattaccatcaatgcgtagaaattgcttggaaaatttaaattgaggttgcatggtttttgaatcctaagaccattttttgagaactgtaacattggtgatttcaaaatattcagttgattcacaaccaatgatggaggagactatactggtcggtgatgacctaatgacgggtcctccatctcctgttatccctcctgaaattgcttcacatgtgcttgaaggtgttgatttgtgcgatgggattttgaggaatctattcctgtgtatgtctatgtatcctcggtttggtttataattctacccttacttctgtcagtgagtagaattgttttttttttttttcttgttttaggtttgcaaatcaatgatattgaaccattttgccaagatgagcttgcattgtatcgacaatgtgctgaaaagagggtaattgttgtttagccatcggctcggattatagttatataaagcttttcattctcatatcatatccacatccatttccttgacttttcttgttcttctatcctttttgtaggacaaaatattgagagttagacttcaagagagcgaacacaagttaggattgtctatgcccattgaactcgctaaggaaaggattacgcagcttgaagctgaagccacatcttttgagaggtactctttcttaacaatgcagttatattttgttttggattttctttacatgaagagtttgtgctaccatgtaatcatgtatatctacagatgttcacaaatcgaaactatgttcttaaatccaaatgttcactaaaacagttcatttgttttataatcaggcacttgattctagcaagtggagctgaaggaatagaaggatttcgccggagatggagtttacacggtcggatgacggataccaagtactgtaacaaaacctaaccttataaaacaaccaatgctcataatataatatcatggaattaatatgctgcatgatagtagatgaacccatcatagtccttcccaaatgctgcgtacataaatctgatttttagcattatcgaaagtgaagcctataaaccctttgtgctacagtctgtattactttggtttgtttcttagcttaaagctaattgtttttattgtgtgtggatgtcacagaaaaagactggagtcactgaagcagggaatggagaacaggaacaaggttgaacatgaacataaccaacaccatgatcagtccccaaaaccttctgctccaaaaagatggttcttttggtgatttccatattgaatcatgttttggatcataaaaggttcataatcattacacttatggtgcagcaatgtaaccacttttagctattaaaagtaacattaaaaatctaaaaagttttatcttctccattaaattcgctcttagtctttacaaatgtcaaattgagtaatcaatttctttcggtaataatagggatgtgcattttaactaaaccaaaccgatccaaaccaaacccaagtttagattcaaaccattcggttatgtttcttctcaacccaaatggttcggttcggtttggtattaaacaaaccgaattgacaacccaatatatttatttaattaattaattaataatattgtatattactaaatatgaaatagtttgcacttttaatttcttttcatggtttttttgaattattaaaacttttgcttaagttaactattatcaaattcaaagttcaaacaataatgtacggttacaatgattagttttttaaaaccgaattaaaaccaaaccgaagaagccaaacggaaccaaacccgaacatagattgatccaaacccaaaccaaaccatactaacctcggttgagtttgattagaattttacaaaacccaaataaatcgaaccgaatcgaacacaaacgggaccagaaattaaacagaaatgccgaaccgaacttaataatttcttgttttttctgaagcccatttgaggcccaatatctccctctacgaaacgacatcgttcttaccgaaaacgtctgctatatctgacagtatctagcactctgcaagagaaacttcgaagattttgatattgtaacgatccgccatg

SEQ ID NO: 7996 - DNA, 3000 bp, Unknown
  misc_feature (1)..( 3000): cDNA_ID_1030333_gDNA_ID_1621181_Annot_ID_174293 3000 nt of promoter + ATG
tttctgttaggagggattataatcgtggttgctcttgttgctcaattctacaacaagaagtttcctgagaacagagactttttgatctgctgcatcggattatatccttttgattcccatttgatttgctagggttaagatgaaattgaattgaatttgataattgtttccttgtgtatggcttgattggtttgtgttgtgtgcattagattttgagatactataatgtctattaggtatgaatgttatgtataatcagagaaatttctcaaagtctttatcttttggatataatttttgaataagatgtgggatttgtttgcttcttgactttggcaagtatgtggtgttgactgcggtaatgcagctgattctgtacattaaggagaagaacgctatcttgttcacctatcctcttgaggtttgttctcttgactgcttagaaaatgtggttaggttgtgtgcttttgggctacattcttgtttttgcttgtatcataaccagggactgttgtttctgtgattcggtgcatattttctcttcataactagaactatattttgatgtccttctgttttgtaaccacttagaattgttcttctgctagcttcacatgtgttgtagagttctcatatcttaggtgatcttggtgtttggcatttgagctatagcaggtgctacatctccctttcactccactcattctaaaccaactttttctcaatgtgttacttgattcgtcgatatcttgattattcggggtgtggaagttcgtgtaactcttggtatttgtgattctggcgatgtcttgttatatgagacacacttgttcaaaatgattctggaatttaatgttggtgtttgtggcttttgttatttgtctcatcagctggaaaaagtttcccatctcaattaatttgtatacgaaaaaatgcgatctttcaaaacatttgattagttctcattatggttaaggtcagaataggcaacaaagctagagaactccatttgttttgccatttcagtttctatgataatttggtttgcagattattcatatattttgctactgttaggacatgtatatttggttgttttgctgacttgaaattcggatggttaataatatgcagggatcattcaccagcactggtttggtggtatcttccaagttacctagattctctgatcagtacactctaaccatcgacagtgctgatccgcaatcaatctcagctgggaagtcggttcagttcaccaaaagtgtcactcaatggtctctttctttctgcatttttcatacacgtgctcacaccatatcctttgcattgcgtaagctgttgattttgtttttgtatgtgtattctaggctcacaaaagatggagttcttgtcgagggtttattctggaaagatgttgaagccctagtcaaagagtacacagaagcaggagaaccaaagaagaagagatgatcatctataatgggaaaagtatgttgctccttattagttctaaatgttacattttttttatgactaaaatcgatggtgacttggtttaaaagacgacagagtttttgcctcctaacagaagattcattcttataaattggaaccaaattttcaaatcattccgagatttttacaaccatcgatcttatcatgttctcttatttggaaatgttgccgtaagctagacttgttcggtcttgtctggcctaattcagttattttgttgttattgatcacttaagaaaatgttatgttgggctggtctggtccaacccaatcagtaataaacaacttaaaatattagttttcaaaaaatccgatctgaactgaatttgtgtctgtccgacattagcttttaaccagagtaacacttctactctaactaggtatgaccaaaatttaaccataaacatattttgaaccataattgtattgtttttaaactggaaccgaatcgtaacctgtcaattatgattaaaaccgaatcgtaacctgtcaatcgtaatcgtaaaatggttaaaaaccataatcgttaaccgtaaaaaatagaataattaccgttaaaatatatattaattgtaactgtcaattaaccataatcgtattaaaaccatagttaaccgtacggttaaccgcatagttaaaaccttaaaaatacaattttaactatttataatgcaaagataaatatcaaatgttcgaataaagattttcaaaaagtaactaaagttgcttataaaaaaatctacaacatacttttcattttcttaaaagcaattaaaaaaaagtcggatgatacgtaagattttgccttcagtattaaatgtatcgtaaccatcaaataaccataagcatatttaaccataattgtattcattcgtaattttatataatcgtaaccgttttaaccgtatatataataattaaagttatgtttacaaaaaatttgtaactataattattagttaataaatcgtaaccgtaataaccgtaaccttagtgatgcctaaattctctcattaaagcgtagataaaccggtgttaaaccatgaaaccatgagattttttccccctctcatttgtgaagttgattctaaaatttaatgaaaaaataatactacagtaaggtattaatgggggtggaatatgaagatattataagcttaggaatattaaaatagaacaagaacaaaacgtcactccacaaggaaagttactaaaattgacaaaaccacaagtaccaacaaatctaagttttgtattcctcctttttaagttacataattccccaattcctccaccatatcacgcgcccacgtgaattaaccagacaccacaaaccacacacattagttataacctccacgcgcttaatcagcgcgtataacaaatgaacgtctctctagcgttgttcgttttgatatcttctcgacttctccacttctttagatttgattcttcttctctgatctctgaaaaaacacaatg

SEQ ID NO: 7997 - DNA, 191 bp, Unknown
  misc_feature (1)..( 191): cDNA_ID_1810014_gDNA_ID_1621181_Annot_ID_57390 3000 nt of promoter + ATG
gagacacgaatcgaacagaaggaaacgatccgcagctccctcctccctgagcagaaaatgtcgaggccaatcagatcggggtctcggacgatgaagattcaaaagagaacgttcgatgggctgaggagtacgccagagaacaggaaataagcgctatcaagctctccctagccaaggcagaaaacgagatg

SEQ ID NO: 7998 - DNA, 3000 bp, Unknown
  misc_feature (1)..( 3000): cDNA_ID_1810092_gDNA_ID_1621182_Annot_ID_57394 3000 nt of promoter + ATG
atgattagaacaaatccaataaacccatacatttaccaagaaaatattaaaacataagatacatgacaaagtcatatatgcaacatgaaatataagataaagaaaacaaactcttagatcattttgcagacaacgttatacgacgaataatcaaacaaacgaaaaatgattctccaagaacatgttaaatttcatgttcatcagaagatcataattagtagtaagtaggttcagacgtgtagaagaaaggaccagcccagtaaagcttgaagctcttgtcttgaagaatacggtacgtgctcaatggctgtcctctaacacctttgttcacatcggtcggaaaatcgcaatcagcgagtggagatttgtaaaggtaagttttgcatttggtcactgtccttcctgcacgaagctgcgaagggaatatcgtggcgatgaagtaacctttagcatcagttttgctgctcaatatcgatattggaactaactcattcccatatgcatcgaccttcacacacgcaattcttgccgttgcacctgtcgcaaacaaacaacaatacgatattcgtttggttagaccttactatgctctaattttctcctaccattagaccaattcgtcttggtatatataattaaagaagttatgttaccttgaattgggtaagttttgccaccggacttgcacttgatgatcccttcaacggcgatgggaatcaattttccggtctccgggtcagcttcattgccgtaataagcaactgaagatatgattagagatgagaagacgatgagagaagctgcaaatgagaggcgtgagaaagccattttttttttttgcttgctttgtttatatgttgcttaagcaagtgaagttttttgaaaactaactattgggttttatagattaattgcgttgaaaaagaaggttaattttctaattaaattatttggtttagtgtacattaactaataagaaaacgagcaacttgtaatagtaaaaccaaacaaaacttgaaataagaacaacgtgtatgcacggtagacaatagtgttattgtcccgacgtgagtcgcattatagtgtgtggattaccaattccaaagacggttctaacattatggatggacaagcatatcagttttaacttttaaaagttcggatgtctctaacaaataagggcctgactggtttaaacgcagcggatgcggttgcggttgcgggagtttgcggaaacaggcggttgcggtttcaagcgttatcaagtgttttgaacgactggttgagcgtttgataatgagtgcgtttgcgggagttttatgattggtaaaccagcgggtgcgatagtaattaaataaaaaataaccaaaataaatataatatattactagtaaaagaaaaaaatacaatatattattatgataaattgataatattagaaaaattaaacatgcttaataattaaaaccataaataaaacattaaattcaaaaataaataaattttgtaagaaaaagcttagtactttatgcatttggtacatcaccaaaaattgcatcaagtagtgtaataaactgtaaataacgttgaactcgtgggttttccggattgcctctatacatatgataaagttctaacaagaaacgggtcatctcgtctgaccaaataattttctaatcgagaaaacaaatcaaaacatgtattcaatcaaaaaactcaaaaaaatacaaaataaataaaatgacgatgccataaaatactcagagaattacactagctaatgaatggatgaaaggatagatcatacttacgtttgattcttgattttgattttgattttcgttagtttgggtagatgccataattgagagaatagggtttcaatatattgattaggattttctgataagaataagatatatagggtttgggtggaagacataattattttagttaattaaaaaaaaaaattaacctaaccgctaccgcccgcaaccgcaaacgcttgcgggaaggaacttttaaaatatggcgatttcgagcggtccaaagcggtatctaacggtttttatgattggtgtcaaacgctaacaactgctaccacccgcaaacgcagcgtttgcgggtgacagagggagaaccaatcaagctctaagactaatcggaccaatttagcaacttgtgtgcttcgatgtgttggactgggctagattgggcccaaatagcctgttttaacattcccaaagatccaaacaattccttcttctttcttccgaacaattcaatgtagatccgagcgaatctcctaaattactaaaatgcacaattgtgctcagcttaccaaaaaggcccaaaagaccaaaacatattctgattttttctctttagatacaataaaagtaatttatatagattagaggcccaataaggttcacgtaggcccaaacatattaaaagtaactcagaagagatccatcaaaattttgattcacacatctgtttaggaattaaaaatattatttgatcggttattcattccttttcatgaaatcatgcaaaaaatcaaaaatcatttttttctctagaaactacgtggcgagaaagcagagcaccagttgtcttcttgctctgattatctcgttgaaaccgctttcaaagcagagcaaaagagacgacaccggagcctccactgctttacttttcctttaaactgtgactgctttcatttatataataaaatacatacactctcagagtcacatgtactctcctctaacataaacacgtcacttgtagcgaaaacagtatcaagaaaaagagaagatcaaacacgtcttcttttctctctctctctttgtcgcctaaaattccagaatcactctgctttttacccttttaatcaatgatttttccttttagtagcaatcgttggtgattcgaaaaaccaaacttttctcggactaggattctagggttttagtgatcatctgaatattcatg

SEQ ID NO: 7999 - DNA, 3000 bp, Unknown
  misc_feature (1)..( 3000): cDNA_ID_1810090_gDNA_ID_1621182_Annot_ID_57395 3000 nt of promoter + ATG
aacatcaacggctgcgaacaaagtgaaaaacttacaattttcagcagtttcataacatctttaattagcaactaaagaggttttataggaaacttacatgacctttgtacttatgaactctaaggaaatcaagcagaggctccaagcaatctttgttacggaacataacagaagacaagtgacgattcagaaactgaactccattaccaatcgaagacgaacgagaaggacgtggcacgtttgcgttaaagggctcgaaatcaagctcaagacaaaaagggtcactattaggtccatcaacgagttcttctttgaaacgaagatactcagagactgttaattgttcaacacttagctcgaagacattaacacgaacatattcccaaacaccaggtcttggtctaacggctaacgcaacaaaaggtggtacaactatagcttcctacaccaaaattaacaatctattattagtttcaagatgaattttgaagaagaggaaaagttttttttaccattgctgatttaaggatctctccaaaaggaccatcagagagactcttctttgtttcatcgtctccgataacagattcgagttcgtcaattaagttatgtggttgaagaatccctttcccctgatccacataccttcacaaaaccaataagaaactaaattaaaaagaaacgagctttgccgggagaaagaaacaggggaataaggatcttgacgacgaacctggagagaagagcaacgagttcgttgcggtgagcggaaagcgtgtcttgcacgcgatcccttgtgcttagaaccctagtgagcttagggtttgccatgaatattcagatgatcactaaaaccctagaatcctagtccgagaaaagtttggtttttcgaatcaccaacgattgctactaaaaggaaaaatcattgattaaaagggtaaaaagcagagtgattctggaattttaggcgacaaagagagagagagaaaagaagacgtgtttgatcttctctttttcttgatactgttttcgctacaagtgacgtgtttatgttagaggagagtacatgtgactctgagagtgtatgtattttattatataaatgaaagcagtcacagtttaaaggaaaagtaaagcagtggaggctccggtgtcgtctcttttgctctgctttgaaagcggtttcaacgagataatcagagcaagaagacaactggtgctctgctttctcgccacgtagtttctagagaaaaaaatgatttttgattttttgcatgatttcatgaaaaggaatgaataaccgatcaaataatatttttaattcctaaacagatgtgtgaatcaaaattttgatggatctcttctgagttacttttaatatgtttgggcctacgtgaaccttattgggcctctaatctatataaattacttttattgtatctaaagagaaaaaatcagaatatgttttggtcttttgggcctttttggtaagctgagcacaattgtgcattttagtaatttaggagattcgctcggatctacattgaattgttcggaagaaagaagaaggaattgtttggatctttgggaatgttaaaacaggctatttgggcccaatctagcccagtccaacacatcgaagcacacaagttgctaaattggtccgattagtcttagagcttgattggttctccctctgtcacccgcaaacgctgcgtttgcgggtggtagcagttgttagcgtttgacaccaatcataaaaaccgttagataccgctttggaccgctcgaaatcgccatattttaaaagttccttcccgcaagcgtttgcggttgcgggcggtagcggttaggttaatttttttttttaattaactaaaataattatgtcttccacccaaaccctatatatcttattcttatcagaaaatcctaatcaatatattgaaaccctattctctcaattatggcatctacccaaactaacgaaaatcaaaatcaaaatcaagaatcaaacgtaagtatgatctatcctttcatccattcattagctagtgtaattctctgagtattttatggcatcgtcattttatttattttgtatttttttgagttttttgattgaatacatgttttgatttgttttctcgattagaaaattatttggtcagacgagatgacccgtttcttgttagaactttatcatatgtatagaggcaatccggaaaacccacgagttcaacgttatttacagtttattacactacttgatgcaatttttggtgatgtaccaaatgcataaagtactaagctttttcttacaaaatttatttatttttgaatttaatgttttatttatggttttaattattaagcatgtttaatttttctaatattatcaatttatcataataatatattgtatttttttcttttactagtaatatattatatttattttggttattttttatttaattactatcgcacccgctggtttaccaatcataaaactcccgcaaacgcactcattatcaaacgctcaaccagtcgttcaaaacacttgataacgcttgaaaccgcaaccgcctgtttccgcaaactcccgcaaccgcaaccgcatccgctgcgtttaaaccagtcaggcccttatttgttagagacatccgaacttttaaaagttaaaactgatatgcttgtccatccataatgttagaaccgtctttggaattggtaatccacacactataatgcgactcacgtcgggacaataacactattgtctaccgtgcatacacgttgttcttatttcaagttttgtttggttttactattacaagttgctcgttttcttattagttaatgtacactaaaccaaataatttaattagaaaattaaccttctttttcaacgcaattaatctataaaacccaatagttagttttcaaaaaacttcacttgcttaagcaacatataaacaaagcaagcaaaaaaaaaaa

SEQ ID NO: 8000 - DNA, 3000 bp, Unknown
  misc_feature (1)..( 3000): cDNA_ID_1810086_gDNA_ID_1621182_Annot_ID_57396 3000 nt of promoter + ATG
caattctctccgaacccaccaaattaagaaacatggcaaaaactaggaataacctaaaaatagaatgaaagaggaagaaaagaacttaaaaatagaataacagatgtaaaagaagagttggataaaaaatagaatcaacccaaaaatacatttctcaaagctctttaaataaccaattttcaatttgtttgtaacaattaataaccacgagaagagaagttgagaaagaaaaaatagtaacgatgaaaatggccggaaggatctttctccttttcctctccgtctacgtcacggtggccatcgccggtaaagctccaccgccaacattcaccgagaaaggcaaagcctagcggagaaactctgcgagaaatccgaagacaaagcgttttgcgttgcaagcctaacgtcccgtcctgaggcagcaaccgcaaccgcaccaaaactaggcgtgatcgcgttaagcatcgcgtcctcaaatgcttcggacacatctttctacatcaaagccaaactaaagcaaaagaacctcgagccggctttagaagacaccctcgacgattgctctaagaattacttagatgcggtcgcgcagctcgacgattctctagccgctttgatgcaaaactcgttcatcgacgtcgatatttggctcaacaccgcgataagcgacggtgaggcttgtgaaaacgctttgaacgatcgtgccggtaatgatgctgagcttgctcgtaggaacacaaacttgttgaagctttgcaaggatgctcttctcattaacactattttaactccctaaatttaaagttattgcccattaattattttatatttgttcacattgttataatttttttttaaatggctcgttgatttgtcccgggggtaaattgtaacgatatttgaaatacttgtttttgggaatttttgaatgagcttattaaattatatataaagtatatacaaccaatatgcatattttcttgtttatattcacctaataataaccaatgaaataataaaatacaaatgtatattattttccttttggtcacaaatgtattttcttttcccttcttatattatatacacaataaaataaaataaaaatatgaaattatcctttttttgtgtggacattttatcatttaagaaaatgaaattaataattctaaattactatcttattacaaatgaaaattgtaaattaattaaatatttacaagcatccatataattttggtcattcaatataattcctaaatactaaaaactattgactttttttttttttttttttttttttttgtaaaccctaaaaactattgactaaaaaaaagtattttaacagaaaaagaagagaatatataattttaatgtttgaccacaaagggaaaaaaatatctcaaagttttttctttctttggtatatcggacggtatttgtgtggccagggagggctacctgagactccatatctgtctctcttcttcttcttcttcctcttcttcctctgcttcttcttcttcacatcactgtgtgcgtctctctatctctctattctatcatttcgaaatcctctctatccgaatttgaactcgtctcttcttcgtaaagagttcttaatctccgtctctgtgatttcggaatctggaggttttgaatttcttgttcgtatcaatcaaatggtggatcgatttagtgagattgctttacctcattagcaatgacttctgcttcttccatgtccggtgcgttttcttcgttcgtctctctgatttttttttttttttcatgttcgtttcaaaggcagagtttaggggaagctttgtgacgattcttctgttcttctctctgtttgtttgaattcagtagcaattgtgtattgcgtcttaacgtcttaagctaatatacccttaagactgtgtgatttttcttagttatgagtcgtattaagaatccaattgcttcgttttctgaattggattccgagagagagagagagagagagagagagagagagagttcacgtcccattgaatttgaaagctactttagttattgttcttgttttgtgtatgtgtgcgacggaaaatgaaaatccacttggttgataatttctattactttctggtgtttgttggatcagtgagtaaatgcagcaaagttagaattctgagctgattaggttattcactagttcttctttaagcaagttcatgtgccaactaaacacttcctaccattcttgttgtggaccacagttttctattactggttaacaattaatttcttttgaattcatgcatatacgtttaccctttttggttggttctgttttggttttattgaaattgattatgtgtgtacaatgcagtgtctgtggaatgtgtgaacatatgtaatctaacgaaaggagatgggaatgcaagaagcgattgcagtgctctctcctgtgcttggaaagctccaagagcgttaactgggtttctagctagcactgctcatccacctgtgtgttctgtgtattcatgtggcagaaatggaagaaagagcagaatgaaagctgtaagtatcctttattgcgtctgtttatgtagtccggtgttaagatattaatatgtggcttgaatggatatatcaagctccagaattgtgtttctactatttttgtacatgatcaccttgttcatattgccatggtggcagtatttgcaatctattcttatggtaactcctttggataatgtagtgcgcctggcagaggtatgaatatgaagtaggcttttctgaggctccttactttgtaaatgtgagaaatatcttgaagtccagattatcttgtggtggtcataaaagatgggaactgtattgcgtatcagctgaatcttcttctggtgcatccagtgatgttaccgtcgaaacattgtgggaggtacgatacactggtctcttctttttctttggaactctactagctcgacattctcaaccaatttgatg

SEQ ID NO: 8001 - DNA, 3000 bp, Unknown
  misc_feature (1)..( 3000): cDNA_ID_2139462_gDNA_ID_1621182_Annot_ID_174321 3000 nt of promoter + ATG
acacggtgcaggactacttggcatcctccaatggaccggtatttcattgatctgatgttggaccaagcgaggagaggaaaccagattgaaggtgttttcaggaaacaagcatggactgagatggttaatctcttcaatgcgaaatttgagtctaactttgatgttgatgtgttgaagaaccggtataagtctctgagaagacagttcaacgcgatcaagagtattcttcgatcagatgggtttgcttgggataatgagcgtcaaatggttacagctgataataatgtatggcaagactatataaaggtaacttaatcgctctgatctatgctgtgtggttagttacagtgttttcgtctctgttttgatgtgtgttcttgtctgaattaatcacaggctcatagagatgcaaggcaatttatgactcggccaattccgtactataaagatctgtgtgtgctctgtggcgattctgggatcgaagaaaacgaatgctttgtagctatggattggtttgaccctgaaactgaattccaagaatttaagtccagtggtactacagatttgtctatttcagctgaggaagaagatagcaactctcttttgtttgaccccaagaacaaaagagatcaacttgctaatactgatacaagccctataaacccgaaaaagcctcgagttgatgaaacccaaaccatgtcaatagaggacacggttgaggctattcaagcgttaccagacatggacgatgaacttatattggatgcttgtgatctgcttgaagataaactcaaggcgaaaactttcttggctctagatgtgaaactacgcaagaagtggttgttaaggaaactccgacctcaagtgacttgaggattatgagctgtaaagaagcaaagtagaagtttgacgataaacagaagctcattggcttatactacagagtacagactactttgcgagagtttcatatacaaagacttatgctcttagaagttgtaaatgtgatcaaatatggctgatgatattaaaccttgtacaaactctctcttctttgccttctctagtagctctgtatctgacaagggagacggcgattcccagtctctgagcacacagaaatacgaaatgtatctttagacaaggtttaagaagatgagataaagcaagcagaatcaagaaaatgtcaaagaattacttacttttctgttgaatcccttattaagctattgtcttccatgcttgcttcactagatgaatcaggttgtacaagcttggacttctttggtgacggcggattgtatataaatgataataatgggtccagaacacttttagatgtatgattagtagacaacggctcatcgattagagactgtaagtatttcctagtccctggagaaaatgctgaatatgactcatccttgtaaagtctctgcttttgttcaaggtaagtattcgtcaaggaacacaaatgtcagataaccgatataaaacataccaagatatagaataagcacaaaaagacttacaagttttctactaaatggtaacgaaagcaagaagagtaaataaaaaaggataccttgaagacatctctatgctgagtggtaatgtgatcaaccatatgcatcttcactcgtctgctacaaaccggacatatctacatcacaaccaaagctgaatttgtgagaagttattacattcatcatcaccaaaagactgttttcatttctcacaccaaacacttcacaactacaaaatggttcctcatagcatcaagcaaataatccaagtgaactaaaatccaagaagtccctaccaactctccttacagaatcacaatcctgcctactaaagtaaccattagagtacaacaatgaacatcacacgataaatagtctaaatttacaactaactgcttcatgtaaaaactcaaatgtatagtttaaagaacagtaactgatttgggagatggatacgagttgcaattaccccattgttggcgtctagttgatgctcctcatcgatatggtgacacaattcaactaaatcataatcatctgagcaaaacgggcatggataatccactgccatttcatcatcatcttcaaactcaatacatgaacctaaacaaaaatttcaccatcacaaaacttttatcaattacataacataaagtttacccataaagtgacaaaatttaaactcactagaccttaagggccaaaagaattgaaatttgataaagaaattaaaaccacctgcatataaagcataaaccctaaaacaaagctaaatgcaattgggaaaaagaatggatctttacactaacccgactgatacttggcaagttcttctaatcgatatttcttcgacgaatcaaacccacaaatgcccaacaaatcttcttccattttgattctgaatccacacgaacttgaattgaaaaatctcagataataattaaaggagcatattcttcctccgtgtatttattagcatctgtcagtactttgttcagcctgaaagtgcgaggaaacacaccaaaaaggcaagacctttaaatgtggtctttttctctggcgacatgagggaatccatggacacgaatctattgagctaaatccaatgaccaaactacccctaaccggtcactatagcctcttttaccctgaaccaccaacgtccctctgttgacttttagccgccacgaatctacgggcattttcgtctttgcgccaccgtcttaaaacgtgtgctccacacacttatattgaccctatcgcgcaagtggactataagcccaatatataaatgggcctaaaaaggcccaaatacttctccttcgttgctaagtctgtaacacgcgctaatgagaaacgattttgcgattcagattcgtttgcttttgccgacgacaaaagctccgattttgtttattttctccgggaaattttactttcgagattctgttgagaatcaattgatttggtattg

SEQ ID NO: 8002 - DNA, 3000 bp, Unknown
  misc_feature (1)..( 3000): cDNA_ID_1813843_gDNA_ID_1621182_Annot_ID_174317 3000 nt of promoter + ATG
acgaatacttaccttgaacaaaagcagagactttacaaggatgagtcatattcagcattttctccagggactaggaaatacttacagtctctaatcgatgagccgttgtctactaatcatacatctaaaagtgttctggacccattattatcatttatatacaatccgccgtcaccaaagaagtccaagcttgtacaacctgattcatctagtgaagcaagcatggaagacaatagcttaataagggattcaacagaaaagtaagtaattctttgacattttcttgattctgcttgctttatctcatcttcttaaaccttgtctaaagatacatttcgtatttctgtgtgctcagagactgggaatcgccgtctcccttgtcagatacagagctactagagaaggcaaagaagagagagtttgtacaaggtttaatatcatcagccatatttgatcacatttacaacttctaagagcataagtctttgtatatgaaactctcgcaaagtagtctgtactctgtagtataagccaatgagcttctgtttatcgtcaaacttctactttgcttctttacagctcataatcctcaagtcacttgaggtcggagtttccttaacaaccacttcttgcgtagtttcacatctagagccaagaaagttttcgccttgagtttatcttcaagcagatcacaagcatccaatataagttcatcgtccatgtctggtaacgcttgaatagcctcaaccgtgtcctctattgacatggtttgggtttcatcaactcgaggctttttcgggtttatagggcttgtatcagtattagcaagttgatctcttttgttcttggggtcaaacaaaagagagttgctatcttcttcctcagctgaaatagacaaatctgtagtaccactggacttaaattcttggaattcagtttcagggtcaaaccaatccatagctacaaagcattcgttttcttcgatcccagaatcgccacagagcacacacagatctttatagtacggaattggccgagtcataaattgccttgcatctctatgagcctgtgattaattcagacaagaacacacatcaaaacagagacgaaaacactgtaactaaccacacagcatagatcagagcgattaagttacctttatatagtcttgccatacattattatcagctgtaaccatttgacgctcattatcccaagcaaacccatctgatcgaagaatactcttgatcgcgttgaactgtcttctcagagacttataccggttcttcaacacatcaacatcaaagttagactcaaatttcgcattgaagagattaaccatctcagtccatgcttgtttcctgaaaacaccttcaatctggtttcctctcctcgcttggtccaacatcagatcaatgaaataccggtccattggaggatgccaagtagtcctgcaccgtgtgacactgcttccttttgagttagacctgactgttgacgattcacatattctgttgtacccatcatcttcctgaatcagtgtcttggattctccctcactaatactctcctcagctgaaacatacatattcattcacaggttacttaagaatctttgatctttggtgacaagaatgtacaatgaaggattcaagtaacaatcaatagattaaagattgtacctttgtgctcagacattccatctgagtaaaccaagcacagatctttgtaacaaggtatagactttatccgaaaagatctcgaatcaggatgaatcttcaataacccaaaagcaaaaacaaatcaatccctgagaagaagacacaaaatcacaagtaaacaaaacgcaaaacgcaccttaagatactcatcccaaacgcagttatcagcaacaaccatctgtctagtatcatcccaactaaaaccatcttctatcaaaagattattcacagatttaaacaagttcctcaatgtcttatgcctgtttttcaaaacatctttgccataaagaaacttgaacttggcagtgaaggaacaagacatgaacttccaagctcgtttactaaacaaatgatcttcaaatctgttgccttttctaacttgttccaccataagctcgatgaaatactgatccatttcaggtgtccacactgttcttaatctctcattgccgtttctactgctcattatctatttctcccttcttctttacctgcaaaaaaatcgattgcaagaacacaaatttgaaatcgagaaatcaagttataaaatcagaaatcagattctcgtaagaaactggatcagacccataatagagattcgactaaattagctaaagagcagagaatcttcgcttacagagagtcagagctccggtgaacgggagttggagtaccggtgagattttaaggataaggttgtccgggataaggttatacttttattcgtaaccaatttagaaacctttatgggcttatattactttattgggcttagtctattataggcctatgttaaacgacatcgtctattctagggtttgtttttgggccagagtgacgtttgttttcctttcgtcgtcgtcgtcgtcgtcgtcttcgtcttcgtcttcgtgaaagatgtttacaaaattttgctgtttaaattgatagaagaagattcgacctttaaaggctatctgaagaacatctccatcatcgcctggtgttgtaagtttcttttggattttgattcttgttgatactgactagtgagctcatttttaacatttgttcgtaccaattctgggatttgtaattagctgagtattgagctctaaatcttgaaaaattagtgagtttagtattttgcgaaagacccattaacagattatgatttgtgcgttgtttcttgccaaatacttttgagaggtttatgaaacagagtaaaaccctagaattcaattcctttgctctgttatgcagtcttcatttcatcaaattcaacacagaagattcgatg

SEQ ID NO: 8003 - DNA, 3000 bp, Unknown
  misc_feature (1)..( 3000): cDNA_ID_2990278_gDNA_ID_1621182_Annot_ID_174316 3000 nt of promoter + ATG
ctaaatcacaatgggtaaaaatactaaaaattgttgtatgtttgggtctaaaataattatatattttagtctaaataatttattattttatggatgattttttggatgttgtgatatgaagctttttgatggttcatccatgaacaatcataatggtgaatttgattgcaattgcgctggggcttgcaaagactatgtattgttagaccatctacattggtaatctctcaagagagtttttcactattaaaataacagaaataataaaaagagaagagagagtgtagaaagtttctcaagtgagaaactatgagatactctctacaagccatcattacatttctcttcttttaattgattcaatttttacactaaaataaaaatttaatcatataataaaattataataaaatactaatatttttcttgttcgagaaactttttgggtttctccttgatggagatactcttaggttttgttaaactctacaacacatcaagcttaaacctttgccatccacaccaactcacggaaacagagtaagcaagatataaagaagtagaggaaataacagagcagaataggaagaagaggagcacacaagtatttgttcacaacgaaggagaaagagggtgattacaggataatactagtgaacgtctaaaacttttctctagctaaagactcactctccatcatgtactacttgaaaaactaccccaaagcatatacagttatactttacagtttctctcaccccttatgatctaatctccttagatctacattgcttgttctttctctgctccctagtgcagcttccagacgttccttttgaatttacaaacggacaaattctccttattggccaacaatgcagaggctatagttatcgttgcctttaccttgtatactagaaaatgtgaacatcaagttctcatcttcatatgtacagtccgttttctgcattcgagtaagcttgttggaggagtgttcttcagcttttgggtgatttgtcatctttatctgtttgctaaaggattgattgtgtttgtggtcgattattgtgtctctgctttgggtgtatgataatcctccttctggtaaacaagactacgcagtttcagtttccttgatttaggggttttctttgtttgtggtacaagccttgtttgtacgaactcagagctaatctccatctccttgtatcagctgattcagacaagacggatactaagttgcaagtttcttagatgcaagagttatataatttgactttgcagcttgtatcaacttatagcaattgaaacagtcttgtcaccatcaatgtttttagattataatttgtttcatgcaagtttttgtgaaagatttttatggaagttcatatatatatgaatactactgaaaaaaaaatcaacttaaaattcaaagcaaaatctccacaaatagatctgtttcattatagaaatacttaaaaaaacaagaaaaaaaacgtggcagaaggaatttagaagcaaaaacagcttcaatctctctctgatccgcttgctacttcacaattgactgactcttaaggaagcttcaatgttttttcttttagacagatttgttagcagagaagtcttgagttgtcagaaaaacaataactgttagaattgttgtggagaggtggcagagaagatgtgtgaagcagactgctcggatcatagcttgaaaacatgtcttgagagaagctagtgttaccgacagcattaccataagtgttctggttgaaaccagaagagaattcatgtggaaccgtgtttgagagattaggatattgtagaacgttgtttttgttgatgatttcactcatcatacacatgttctgatcaaaaccatgaagctgatcctgtcgctgcatcaagtgattattcaacccgtagttattcactgcagatgcttgtaccgaaagaaacggtgagtattcttgtgtgtttgacacgccaggatgttgaaagttgttgttgttggtgatgttgtccaaacacatgttctgaccaaaaccatgccgcatcaagtgattcaggtaattggagttgattggagagtgaagcagacagtgggagttgtgagagagtagcagcatctccatggttgtacatatacggcgagaagttgctaggattcaagtgttggatctggttcagatacgatggtgttaaactctgatgcaccaagtttttgttttgttgtttctgcgactcaacaatacgaagcctttcttgcagagtagaaagagtccgttctaaggaatgaatcaattgagagagttgttgaggagagtaatgatcaaagtcaggataccaattcttcacataattcttctttttcgaattcgtcttccccttgtcatttgtctttgtctttgtccttgtccttctccttctcgatgaagtcatgaagattgagactcttcttgcgttttgtggcctctttatatctcgaagccatgtctttcactgtatttctctccttaggccatgttctcagttcaccgtctggtccgtaatagatgacgcaaacgtcaatagcacagagaatcgaaagctcttcagcttttttgaagatggttttgagtctgtttgttaaactagttgaattacgtgacgaagaagaagaagaaaaagaagattgcttcatcgtgattttgccttgattcggcaagaaactagggttttttcttccgagagagagagaacacacaaagaagaaaaattatggaaatgagggtgaaacattgtgaactcaatacgtttctatagatgccttgatgcctacggaacaacgtgtacgcatctgtgttaaattcaaaactaggcctataatgggcttagcagaaagcccaattagaaaacgattggtttttgtggaagagtaaccctagaaaatatcatatataaagatattgtcttcttcgattaactcttcttcgccaaaatcagggagaggctaaa

SEQ ID NO: 8004 - DNA, 3000 bp, Unknown
  misc_feature (1)..( 3000): cDNA_ID_1810077_gDNA_ID_1621182_Annot_ID_174315 3000 nt of promoter + ATG
caaacttttcctagccctgaaactttgtataactagtgatatgaatttttcggtttgtgcagttgcgagtaagagtttatggaaagaatttgtattgatcaatgaggatgaaagtgagtatgatactgagatgtcaggagatgatgaagtagctaaacctttggtctcaaagagagaagttgacgaccaaatgaaatcgctaatgaacgattttgaggtaaacagttcacttgtcatggccatttttgcaaacttcaaaaggcctcaaatgattctcattttccatgcttgtacagggagatgctgataaaaagaattgggttaatttccagcaacgcgtagacaaagcccctgaacaagttctgaggtgtgattcaaacgcttatgattttctgcatacttttgatcttgattctcccataacatcgatttgtgaaatacgtattgatacagatattcccggagctctggtgctaaacccctttggccaatagcaagcggacgagtctctaaatctgagcttcccagttgcaaatcttgtggtggtcctcgttgttttgaatttcaggtaattctttcttctcttctttataaacttgtattagcttggtcttagtcacttcttttgcttattttataaaccagtcaagaattggccaacaattttagctgaatcaaatcaactttaaaccaataaaacacacaattttccccatttcatttctctgttcttgcatattggaagcttggctctgttcttgatcatttcgatggcggttttatcaggtgatgccgcagctactgttcttcttcggtgggaagaacgagagggaatctctcgattgggcaacaatcgtggtgtacacttgtgagaactcgtgtgactcgagcttaagttacaaggaagagtttgtctgggttcaactatacagtcagacaacttaggatcctctatttccttcctggctgttgcctccaaagttttgttcttaaccggatcgtaccggacttaaatatatttgtaaacttgggtatgttacttggtttgtttaaagattttgttgtgtccatagtaaactttatatacaagatcttatatcttgtgatttactagaacaaacatactatattcctattatgattttgactcatactatattattgacttttatggataaagctgtttgatttctcttctaattcgcttatgatcgaatcttaaccataattatgtgctaaaaattatagatagtgtattactaagatggtcgagagagaaaaggacttgaagatagaattaagtctcctgaaacagtacgaactactgacaaaggttctcatatttgtgacaaataaagagttttcacaaagctatatcacataaaccattcaaaatcactgcttataagagaattcactaccgagcaagcttctcacttcttagactttttcgcaggtaccctgcaaatttaacagcaagtttagaatgttgccacacaacacattaacaattttgtttcacatacgatagagatgaaaacttactcagcggtttgtgcaggtggtgcagcggcaggtatgtctcctccaggacccttggcaagacgctcctctcgtcgagcatgtttcctctctcggctagccttgttcttagccctcttagcctcaaactggtcagacaatgtcttctctctagccttctcagccttggatttgtgaatactttccatcaacacacgcttgttcttgaagacgtttcccttgactttcatgtacatgtcatggtacatatgtctgtcaatcttcttggtctccctatacttcttcaacagacgcctcagcactctcatcctcctcatccacaaaacttttgttggcaaccttgcctctcgggtacccttcctcttaccttaaccattatacaacagccacataaatcatctgtggagatgtttcaagaatgtggatcaaatgttacatgtcacataccataaccagagtgacgtccctttctcttggctatattcaattgacgtgccctggatcgtgagtggatcttcgttggcttcctgatgatgaatccatccttcacaagcttcctgatgttttgacctgaagttccataacaatccaaaatacttaatcagaattacactcaaatctcaaatgcacatagatgcatcaccatttcgtatagaaaacaaacaagaatcatgatccaacagagtgctatgatggcatgttgatttggtaacaatcagaaaccatagaccatgaatccgagaagaacatagtcaatccaaagctactaaacctacgataacatctgaacaagtccaaactaaacaaaattttacagaatttcaaaaatcagattcatagcaacaccatttccaagctcaacttcatcagactgaattcaaatcattcaacgtcacctacgaagtaagctacagtatcctttttttctactatcattatcaacaagcttcgatcgcagaccaaaacaagcacgagaccgagaaagttaaatctgatcaacaacatttgagagtatgaagaacaacgtacgcgaattggccatggagatatcacttccttcgttcgggtcgagccatacttttctcttcccgcacttgagtactgaggatgcgagacgcttctggagcttcaacgaaaccattttagcctctccctgattttggcgaagaagagttaatcgaagaagacaatatctttatatatgatattttctagggttactcttccacaaaaaccaatcgttttctaattgggctttctgctaagcccattataggcctagttttgaatttaacacagatgcgtacacgttgttccgtaggcatcaaggcatctatagaaacgtattgagttcacaatgtttcaccctcatttccataatttttcttctttgtgtgttctctctctctcggaagaaaaaaccctagtttcttgccgaatcaaggcaaaatcacgatg

SEQ ID NO: 8005 - DNA, 3000 bp, Unknown
  misc_feature (1)..( 3000): cDNA_ID_2993690_gDNA_ID_1621182_Annot_ID_174312 3000 nt of promoter + ATG
ctgagttcgtacaaacaaggcttgtaccacaaacaaagaaaacccctaaatcaaggaaactgaaactgcgtagtcttgtttaccagaaggaggattatcatacacccaaagcagagacacaataatcgaccacaaacacaatcaatcctttagcaaacagataaagatgacaaatcacccaaaagctgaagaacactcctccaacaagcttactcgaatgcagaaaacggactgtacatatgaagatgagaacttgatgttcacattttctagtatacaaggtaaaggcaacgataactatagcctctgcattgttggccaataaggagaatttgtccgtttgtaaattcaaaaggaacgtctggaagctgcactagggagcagagaaagaacaagcaatgtagatctaaggagattagatcataaggggtgagagaaactgtaaagtataactgtatatgctttggggtagtttttcaagtagtacatgatggagagtgagtctttagctagagaaaagttttagacgttcactagtattatcctgtaatcaccctctttctccttcgttgtgaacaaatacttgtgtgctcctcttcttcctattctgctctgttatttcctctacttctttatatcttgcttactctgtttccgtgagttggtgtggatggcaaaggtttaagcttgatgtgttgtagagtttaacaaaacctaagagtatctccatcaaggagaaacccaaaaagtttctcgaacaagaaaaatattagtattttattataattttattatatgattaaatttttattttagtgtaaaaattgaatcaattaaaagaagagaaatgtaatgatggcttgtagagagtatctcatagtttctcacttgagaaactttctacactctctcttctctttttattatttctgttattttaatagtgaaaaactctcttgagagattaccaatgtagatggtctaacaatacatagtctttgcaagccccagcgcaattgcaatcaaattcaccattatgattgttcatggatgaaccatcaaaaagcttcatatcacaacatccaaaaaatcatccataaaataataaattatttagactaaaatatataattattttagacccaaacatacaacaatttttagtatttttacccattgtgatttagatcaaaactacacatcccaaaataaaaccatggtaggcccatcattgactatgtacaaatgtgcgttgacctttttctcgtatcacacaattctctccgaacccaccaaattaagaaacatggcaaaaactaggaataacctaaaaatagaatgaaagaggaagaaaagaacttaaaaatagaataacagatgtaaaagaagagttggataaaaaatagaatcaacccaaaaatacatttctcaaagctctttaaataaccaattttcaatttgtttgtaacaattaataaccacgagaagagaagttgagaaagaaaaaatagtaacgatgaaaatggccggaaggatctttctccttttcctctccgtctacgtcacggtggccatcgccggtaaagctccaccgccaacattcaccgagaaaggcaaagcctagcggagaaactctgcgagaaatccgaagacaaagcgttttgcgttgcaagcctaacgtcccgtcctgaggcagcaaccgcaaccgcaccaaaactaggcgtgatcgcgttaagcatcgcgtcctcaaatgcttcggacacatctttctacatcaaagccaaactaaagcaaaagaacctcgagccggctttagaagacaccctcgacgattgctctaagaattacttagatgcggtcgcgcagctcgacgattctctagccgctttgatgcaaaactcgttcatcgacgtcgatatttggctcaacaccgcgataagcgacggtgaggcttgtgaaaacgctttgaacgatcgtgccggtaatgatgctgagcttgctcgtaggaacacaaacttgttgaagctttgcaaggatgctcttctcattaacactattttaactccctaaatttaaagttattgcccattaattattttatatttgttcacattgttataatttttttttaaatggctcgttgatttgtcccgggggtaaattgtaacgatatttgaaatacttgtttttgggaatttttgaatgagcttattaaattatatataaagtatatacaaccaatatgcatattttcttgtttatattcacctaataataaccaatgaaataataaaatacaaatgtatattattttccttttggtcacaaatgtattttcttttcccttcttatattatatacacaataaaataaaataaaaatatgaaattatcctttttttgtgtggacattttatcatttaagaaaatgaaattaataattctaaattactatcttattacaaatgaaaattgtaaattaattaaatatttacaagcatccatataattttggtcattcaatataattcctaaatactaaaaactattgactttttttttttttttttttttttttttgtaaaccctaaaaactattgactaaaaaaaagtattttaacagaaaaagaagagaatatataattttaatgtttgaccacaaagggaaaaaaatatctcaaagttttttctttctttggtatatcggacggtatttgtgtggccagggagggctacctgagactccatatctgtctctcttcttcttcttcttcctcttcttcctctgcttcttcttcttcacatcactgtgtgcgtctctctatctctctattctatcatttcgaaatcctctctatccgaatttgaactcgtctcttcttcgtaaagagttcttaatctccgtctctgtgatttcggaatctggaggttttgaatttcttgttcgtatcaatcaaatggtggatcgatttagtgagattgctttacctcattagcaatg

SEQ ID NO: 8006 - DNA, 3000 bp, Unknown; identical to SEQ ID NO: 7999
  misc_feature (1)..( 3000): cDNA_ID_1810090_gDNA_ID_1621182_Annot_ID_174311 3000 nt of promoter + ATG

SEQ ID NO: 8007 - DNA, 3000 bp, Unknown; identical to SEQ ID NO: 7998
  misc_feature (1)..( 3000): cDNA_ID_3047229_gDNA_ID_1621182_Annot_ID_174309 3000 nt of promoter + ATG

SEQ ID NO: 8008 - DNA, 3000 bp, Unknown
  misc_feature (1)..( 3000): cDNA_ID_1810080_gDNA_ID_1621182_Annot_ID_57398 3000 nt of promoter + ATG
tcttcttcttcttcgtcacgtaattcaactagtttaacaaacagactcaaaaccatcttcaaaaaagctgaagagctttcgattctctgtgctattgacgtttgcgtcatctattacggaccagacggtgaactgagaacatggcctaaggagagaaatacagtgaaagacatggcttcgagatataaagaggccacaaaacgcaagaagagtctcaatcttcatgacttcatcgagaaggagaaggacaaggacaaagacaaagacaaatgacaaggggaagacgaattcgaaaaagaagaattatgtgaagaattggtatcctgactttgatcattactctcctcaacaactctctcaattgattcattccttagaacggactctttctactctgcaagaaaggcttcgtattgttgagtcgcagaaacaacaaaacaaaaacttggtgcatcagagtttaacaccatcgtatctgaaccagatccaacacttgaatcctagcaacttctcgccgtatatgtacaaccatggagatgctgctactctctcacaactcccactgtctgcttcactctccaatcaactccaattacctgaatcacttgatgcggcatggttttggtcagaacatgtgtttggacaacatcaccaacaacaacaactttcaacatcctggcgtgtcaaacacacaagaatactcaccgtttctttcggtacaagcatctgcagtgaataactacgggttgaataatcacttgatgcagcgacaggatcagcttcatggttttgatcagaacatgtgtatgatgagtgaaatcatcaacaaaaacaacgttctacaatatcctaatctctcaaacacggttccacatgaattctcttctggtttcaaccagaacacttatggtaatgctgtcggtaacactagcttctctcaagacatgttttcaagctatgatccgagcagtctgcttcacacatcttctctgccacctctccacaacaattctaacagttattgtttttctgacaactcaagacttctctgctaacaaatctgtctaaaagaaaaaacattgaagcttccttaagagtcagtcaattgtgaagtagcaagcggatcagagagagattgaagctgtttttgcttctaaattccttctgccacgttttttttcttgtttttttaagtatttctataatgaaacagatctatttgtggagattttgctttgaattttaagttgatttttttttcagtagtattcatatatatatgaacttccataaaaatctttcacaaaaacttgcatgaaacaaattataatctaaaaacattgatggtgacaagactgtttcaattgctataagttgatacaagctgcaaagtcaaattatataactcttgcatctaagaaacttgcaacttagtatccgtcttgtctgaatcagctgatacaaggagatggagattagctctgagttcgtacaaacaaggcttgtaccacaaacaaagaaaacccctaaatcaaggaaactgaaactgcgtagtcttgtttaccagaaggaggattatcatacacccaaagcagagacacaataatcgaccacaaacacaatcaatcctttagcaaacagataaagatgacaaatcacccaaaagctgaagaacactcctccaacaagcttactcgaatgcagaaaacggactgtacatatgaagatgagaacttgatgttcacattttctagtatacaaggtaaaggcaacgataactatagcctctgcattgttggccaataaggagaatttgtccgtttgtaaattcaaaaggaacgtctggaagctgcactagggagcagagaaagaacaagcaatgtagatctaaggagattagatcataaggggtgagagaaactgtaaagtataactgtatatgctttggggtagtttttcaagtagtacatgatggagagtgagtctttagctagagaaaagttttagacgttcactagtattatcctgtaatcaccctctttctccttcgttgtgaacaaatacttgtgtgctcctcttcttcctattctgctctgttatttcctctacttctttatatcttgcttactctgtttccgtgagttggtgtggatggcaaaggtttaagcttgatgtgttgtagagtttaacaaaacctaagagtatctccatcaaggagaaacccaaaaagtttctcgaacaagaaaaatattagtattttattataattttattatatgattaaatttttattttagtgtaaaaattgaatcaattaaaagaagagaaatgtaatgatggcttgtagagagtatctcatagtttctcacttgagaaactttctacactctctcttctctttttattatttctgttattttaatagtgaaaaactctcttgagagattaccaatgtagatggtctaacaatacatagtctttgcaagccccagcgcaattgcaatcaaattcaccattatgattgttcatggatgaaccatcaaaaagcttcatatcacaacatccaaaaaatcatccataaaataataaattatttagactaaaatatataattattttagacccaaacatacaacaatttttagtatttttacccattgtgatttagatcaaaactacacatcccaaaataaaaccatggtaggcccatcattgactatgtacaaatgtgcgttgacctttttctcgtatcacacaattctctccgaacccaccaaattaagaaacatggcaaaaactaggaataacctaaaaatagaatgaaagaggaagaaaagaacttaaaaatagaataacagatgtaaaagaagagttggataaaaaatagaatcaacccaaaaatacatttctcaaagctctttaaataaccaattttcaatttgtttgtaacaattaataaccacgagaagagaagttgagaaagaaaaaatagtaacgatg

SEQ ID NO: 8009 - DNA, 3000 bp, Unknown; identical to SEQ ID NO: 8004
  misc_feature (1)..( 3000): cDNA_ID_1810077_gDNA_ID_1621182_Annot_ID_57399 3000 nt of promoter + ATG

SEQ ID NO: 8010 - DNA, 3000 bp, Unknown; identical to SEQ ID NO: 8003
  misc_feature (1)..( 3000): cDNA_ID_3000117_gDNA_ID_1621182_Annot_ID_57400 3000 nt of promoter + ATG

SEQ ID NO: 8011 - DNA, 3000 bp, Unknown
  misc_feature (1)..( 3000): cDNA_ID_1813843_gDNA_ID_1621182_Annot_ID_57401 3000 nt of promoter + ATG
ttagtagaaaacttgtaagtctttttgtgcttattctatatcttggtatgttttatatcggttatctgacatttgtgttccttgacgaatacttaccttgaacaaaagcagagactttacaaggatgagtcatattcagcattttctccagggactaggaaatacttacagtctctaatcgatgagccgttgtctactaatcatacatctaaaagtgttctggacccattattatcatttatatacaatccgccgtcaccaaagaagtccaagcttgtacaacctgattcatctagtgaagcaagcatggaagacaatagcttaataagggattcaacagaaaagtaagtaattctttgacattttcttgattctgcttgctttatctcatcttcttaaaccttgtctaaagatacatttcgtatttctgtgtgctcagagactgggaatcgccgtctcccttgtcagatacagagctactagagaaggcaaagaagagagagtttgtacaaggtttaatatcatcagccatatttgatcacatttacaacttctaagagcataagtctttgtatatgaaactctcgcaaagtagtctgtactctgtagtataagccaatgagcttctgtttatcgtcaaacttctactttgcttctttacagctcataatcctcaagtcacttgaggtcggagtttccttaacaaccacttcttgcgtagtttcacatctagagccaagaaagttttcgccttgagtttatcttcaagcagatcacaagcatccaatataagttcatcgtccatgtctggtaacgcttgaatagcctcaaccgtgtcctctattgacatggtttgggtttcatcaactcgaggctttttcgggtttatagggcttgtatcagtattagcaagttgatctcttttgttcttggggtcaaacaaaagagagttgctatcttcttcctcagctgaaatagacaaatctgtagtaccactggacttaaattcttggaattcagtttcagggtcaaaccaatccatagctacaaagcattcgttttcttcgatcccagaatcgccacagagcacacacagatctttatagtacggaattggccgagtcataaattgccttgcatctctatgagcctgtgattaattcagacaagaacacacatcaaaacagagacgaaaacactgtaactaaccacacagcatagatcagagcgattaagttacctttatatagtcttgccatacattattatcagctgtaaccatttgacgctcattatcccaagcaaacccatctgatcgaagaatactcttgatcgcgttgaactgtcttctcagagacttataccggttcttcaacacatcaacatcaaagttagactcaaatttcgcattgaagagattaaccatctcagtccatgcttgtttcctgaaaacaccttcaatctggtttcctctcctcgcttggtccaacatcagatcaatgaaataccggtccattggaggatgccaagtagtcctgcaccgtgtgacactgcttccttttgagttagacctgactgttgacgattcacatattctgttgtacccatcatcttcctgaatcagtgtcttggattctccctcactaatactctcctcagctgaaacatacatattcattcacaggttacttaagaatctttgatctttggtgacaagaatgtacaatgaaggattcaagtaacaatcaatagattaaagattgtacctttgtgctcagacattccatctgagtaaaccaagcacagatctttgtaacaaggtatagactttatccgaaaagatctcgaatcaggatgaatcttcaataacccaaaagcaaaaacaaatcaatccctgagaagaagacacaaaatcacaagtaaacaaaacgcaaaacgcaccttaagatactcatcccaaacgcagttatcagcaacaaccatctgtctagtatcatcccaactaaaaccatcttctatcaaaagattattcacagatttaaacaagttcctcaatgtcttatgcctgtttttcaaaacatctttgccataaagaaacttgaacttggcagtgaaggaacaagacatgaacttccaagctcgtttactaaacaaatgatcttcaaatctgttgccttttctaacttgttccaccataagctcgatgaaatactgatccatttcaggtgtccacactgttcttaatctctcattgccgtttctactgctcattatctatttctcccttcttctttacctgcaaaaaaatcgattgcaagaacacaaatttgaaatcgagaaatcaagttataaaatcagaaatcagattctcgtaagaaactggatcagacccataatagagattcgactaaattagctaaagagcagagaatcttcgcttacagagagtcagagctccggtgaacgggagttggagtaccggtgagattttaaggataaggttgtccgggataaggttatacttttattcgtaaccaatttagaaacctttatgggcttatattactttattgggcttagtctattataggcctatgttaaacgacatcgtctattctagggtttgtttttgggccagagtgacgtttgttttcctttcgtcgtcgtcgtcgtcgtcgtcttcgtcttcgtcttcgtgaaagatgtttacaaaattttgctgtttaaattgatagaagaagattcgacctttaaaggctatctgaagaacatctccatcatcgcctggtgttgtaagtttcttttggattttgattcttgttgatactgactagtgagctcatttttaacatttgttcgtaccaattctgggatttgtaattagctgagtattgagctctaaatcttgaaaaattagtgagtttagtattttgcgaaagacccattaacagattatgatttgtgcgttgtttcttgccaaatacttttgagaggtttatg

SEQ ID NO: 8012 - DNA, 3000 bp, Unknown
  misc_feature (1)..( 3000): cDNA_ID_1810073_gDNA_ID_1621182_Annot_ID_57402 3000 nt of promoter + ATG
aggaaatagaggatcctaagttgtctgactgtatagttgaacccagacaaactcttccttgtaacttaagctcgagtcacacgagttctcacaagtgtacaccacgattgttgcccaatcgagagattccctctcgttcttcccaccgaagaagaacagtagctgcggcatcacctgataaaaccgccatcgaaatgatcaagaacagagccaagcttccaatatgcaagaacagagaaatgaaatggggaaaattgtgtgttttattggtttaaagttgatttgattcagctaaaattgttggccaattcttgactggtttataaaataagcaaaagaagtgactaagaccaagctaatacaagtttataaagaagagaagaaagaattacctgaaattcaaaacaacgaggaccaccacaagatttgcaactgggaagctcagatttagagactcgtccgcttgctattggccaaaggggtttagcaccagagctccgggaatatctgtatcaatacgtatttcacaaatcgatgttatgggagaatcaagatcaaaagtatgcagaaaatcataagcgtttgaatcacacctcagaacttgttcaggggctttgtctacgcgttgctggaaattaacccaattctttttatcagcatctccctgtacaagcatggaaaatgagaatcatttgaggccttttgaagtttgcaaaaatggccatgacaagtgaactgtttacctcaaaatcgttcattagcgatttcatttggtcgtcaacttctctctttgagaccaaaggtttagctacttcatcatctcctgacatctcagtatcatactcactttcatcctcattgatcaatacaaattctttccataaactcttactcgcaactgcacaaaccgaaaaattcatatcactagttatacaaagtttcagggctaggaaaagtttgtgaattcagctaacctttctgcttttcagttggagcaaccccattattgacagggcctgagtcagatgtttcgctaaccgttcgaagctgttggcattcggttttatgacccaagcgccaatgcagggcctggaaattagaaacaacacagattgttcaaatttgctcaaaagagcagaatctagcggaacaaaagaaactacgatgcacatatgcacacacctggtgtttcggtgaacagtatcgagcatttttgcagccgctacatagtttatctcctttccatgttccacaccaagtgcaaagcggagctaaagtgaaacaaacaatatcaagaattgacaattaaaagagaattctcggcattcagtcaaacccatcaatcagttcataatacctccatgacccaatggcttgtctgttccatcgtgctttggagcctcactcgagtaaaaaggattagctcgaggcaattggcaacggaaaaccttcgtacttcaggaacaaaaaaaacagtactttagtgtaacaacccacttggagaggagacaaacaatacaaagatgcaatatatagtaagaggtttctttctacctccgcatagccttctctggggcacgtttccattgttcatgttgatcacgaaggagacaagacatagatggacacatgaagagaaacaatgtccgatgaaaagctgattccttgtctgttaaaggagcataaagctgccaaatttccacaacaaatttcataaataaaccgacaaaaaacatgcaagaaacaacaaaatagtttgtatgaaacttacttgaagtacaaattgcataggttcttcacatagatcacatagaattgacttccctgatggtaaattaactggatccaaccatgcctatattgacaaatatcaacccaaagaatcaatacctaagaacataaagaagaaacagtttttgattgcacaaattgaaagatgttttaacttagtaccggaacaccaccagctaaattagggaacagttgacgaagatttgaccatgcgaatttaggactctcaacgaaacctaacatcacaggttcataatcttcatcatcttcctcatcatcatcatcaaattcatccatatttataggttccaccgcagtttcatcatcgtcatcatcatcaagctgagttattcggaggcctttgaaatcatccatggagtctccgttgaagctactcatcgaatcttctgtgttgaatttgatgaaatgaagactgcataacagagcaaaggaattgaattctagggttttactctgtttcataaacctctcaaaagtatttggcaagaaacaacgcacaaatcataatctgttaatgggtctttcgcaaaatactaaactcactaatttttcaagatttagagctcaatactcagctaattacaaatcccagaattggtacgaacaaatgttaaaaatgagctcactagtcagtatcaacaagaatcaaaatccaaaagaaacttacaacaccaggcgatgatggagatgttcttcagatagcctttaaaggtcgaatcttcttctatcaatttaaacagcaaaattttgtaaacatctttcacgaagacgaagacgaagacgacgacgacgacgacgacgaaaggaaaacaaacgtcactctggcccaaaaacaaaccctagaatagacgatgtcgtttaacataggcctataatagactaagcccaataaagtaatataagcccataaaggtttctaaattggttacgaataaaagtataaccttatcccggacaaccttatccttaaaatctcaccggtactccaactcccgttcaccggagctctgactctctgtaagcgaagattctctgctctttagctaatttagtcgaatctctattatgggtctgatccagtttcttacgagaatctgatttctgattttataacttgatttctcgatttcaaatttgtgttcttgcaatcgatttttttgcaggtaaagaagaagggagaaatagata

SEQ ID NO: 8013 - DNA, 3000 bp, Unknown; identical to SEQ ID NO: 8001
  misc_feature (1)..( 3000): cDNA_ID_1810069_gDNA_ID_1621182_Annot_ID_57404 3000 nt of promoter + ATG

SEQ ID NO: 8014 - DNA, 3000 bp, Unknown
  misc_feature (1)..( 3000): cDNA_ID_1810137_gDNA_ID_1621183_Annot_ID_57408 3000 nt of promoter + ATG
gagttaccagtaattagaaaactttgcaaaaaccaaaaaagaaaaagagtgattagccaaatgcactttcaaatagaaaatcaacaaaatacgcaaatatagaggtttaccatatatgtaaaaaaacatctgaaaaaagttcgtcacaataaagagaaaattttggacaatagagatattgacggagtacatgtatgtgatattgttgcaaaaggatagcctcaaactcatattcataggaaaagaccacaaactttatttgttatgaatccatttagttacaacgtcatgttaagtagattcttaaaaaactatagaagtaattattatcctaaatagtatcaacataagacaacatattcgattgagataatagttggggcagtccgtagtcgtcagagaaagattaacatcacatacttttttggcttatcgttcacttttcattttaagtggtagttgggttttacactttatatattgaacctagataacaactgttgtgaattctctgtttttgattcgaccctcttttgaaccatggttatataattgttctcgacagacctcaagatttttttgttttaaactgattacaaaaatcttatatacacatgcacatagtaaagtctaaaccaaagcaatataatagatataaatgttcagtcagagtttctattatcaatcttgcaaagaaatgaaaatatctttcgatagatgaagattaagattcagacaataacatgcaacctttttctttccccccaaaaacacatcgatcacccaccatcaatccatcatggatcgatcatccatttagggacctatttacgtttgattttttttttcctataactttctttaataaggacaacaaggccaagatcttcatcgtgtgtttcgtgtgtctcaaaatccctctaaactttttattgtagtttggtgagacttgtttggtggtgctgatgatgatgagagagagagagagagagagcgcgcgaggaaatcatggctggtaaacagaagaagagacatgatgattactgattgaaatattatatatgtacaccattgaaataagttataaaagtgtcgtaaatcgtcaaaagaatcagtagtatatatctactctatatgatctatatacaccattcatatataaaagaatcacaagtatgttattgaggatgtgtgtcaatgaagccctacgagaaaggtctgtgcactaccaaaaaagagacacatagtttgtttgagtttttttattgggttcatttgttaaatttatatccataaatacctccttgaggtatagccgtacagggtttttttgcagttcaagatatggcatttgtatgaaacttatatacccgccaaaaaaaacatacctaggtcacccgtgggtattttttgattgggacaaactggctgtagggaaagaaaaaacagacaacgttaggtgccttgtctctcaaatcacttatcaggactcaggagcaataatttgttcgaaccaattgtacgttgtaacatctaaatgggtccataacaatcagataataaaattttatcatctttcttaatttatttatttccaaataactttctttatcatgtttcttaattacgttgatgcatgtttagatagccgaaacaaatcactattactttgattcttattatttatttatcaatttctggattcatgacatttgaaaaactaaatgatgtattactgtgcatttgcaattcaatcgatcttaaagtcttaaaatcaactagacgataaaacggtctatttccctatagaactagatatatatactatgcattgtgatatagaattaagagattactgtttctttggatgtatgatcttttatcagaataaacttcttattttgtcttcagaaataatcttgacttcgatcaatcattatttcgtaagcgataaaaacttctgattatctaccaaaaaatgatttcaatatattgtgacattgttgcaatacgataaccacaaactcatattcatagggaaatgttttaacaaactttgttacaaattcatctacttacaacgtgatgctcaatcattgatatacattataaaaagaattattatcttaaaatagtatcaacataagacaacatgctcgatcgagataatacatgtgccagcgcagtccatagtcgtcagaaaaagatcaacatcaaatactttttaggcttatcgcgcacttttcactttaagaggttattgtgattacactttacgtattgaacctaaatatcaatttcacagttggaagtttacaaaaataatgccagtgtcgatcctaggatgatgcgaaaccaaaagatgatgttacatatatatacacatgcacatttagtattctggttatcaagataaggatgaaaagactaattaaaccaaagcagtgtctatgacattgcaagcattctccaacccataagacaaaattgattctacaaactttcatatcatcagaatctatgaaatgaatcaacaactatcacatctcagcagcaaagttaaaggactttccacatgatctatatttataagggtatcgttaagatcttctcacatgtgtggcacgtgacatatttaatattcttgatgggcttttctgttttttatgggccttttcgaatttcagggttttaaataagttagaaattagataaataaaaaacaaattagcaaaaaataacgaagtgtctcgtctcttctctcttgtcttctccagatcagtgtttgtggggttttcccaatggagcttcttctctcattgtctctcctcctggggttttggtgtaacaacaatcctcaattcacgaggcatgaatcattattctccccatttgcttattctctggctagaatccccagattttactgtatcgactttgggaatttaactggagaaccatttccactcaaactgggaaacaaaaacctgttattgaaca

SEQ ID NO: 8015 - DNA, 3000 bp, Unknown
  misc_feature (1)..( 3000): cDNA_ID_1807326_gDNA_ID_1621183_Annot_ID_174344 3000 nt of promoter + ATG
gatatcataaaagagaaaaaatcttgttttgttatttaaaagattgagtttgattcatacaatgaaaagatacacccatgtatgagtagaaatccgggtttccggacagagaaggtttggatttgatgttagtgacagaagccgcatgatagtgtatgactcctacaaagtcacatgagcctttaacttgttctgattctttctcagagaaaactggcagtcttgatccaatggttcttttcattgtatcaggatagtctccaaataaaagaggtctaaggaacctgagttttaaagagtaaatcttttttattgagatatgttgaacaatattttggaacagtttgtgcctgactcaccagccgacgtagaaatcttgggctctttgggttgcagtggcatcatccttggagcttgtagtaggaataagccctaatatgaataagctaaatcctatggaacctccctgcttatcctgcatattatatatactttatagtgtgtttcttctcacacattcaagagagggttatgtaatatataccttgtatttttgtttgtatcgtcttgaaacagaggcgtgcgcaagcaacaaattatggcctacaatatatggttcaatggaagagttccctgaagaacagtttttgctcggtttggaacaacgaccaggcggtgtatccccatcgttgtaacctcctatagagaatatattagcctcgttgatcgtggtccatagtttgacatggttcccaaactctctgaagcaaacatctgcataagtagtaaagtctttgctgcaatggcaaataacatcaacttttgttattttatcttaaactacaaaatctgtaagagaaaataagtaacgcctacatcattctgtggttgagccatcctccatattcatcctccagagactgaggatgatcatagtggtagagtgtaacatgtggttcaattcctgtagtaagtctacttaaactctagttaatacgaactaaacctaactcttgagtcctaccgtggatatgaagataggtcttaccgtggcttactaactcttggatgaggttcttgtagaactgtagacccttttggttaacaggccctcttccatctaatcagataataaattacgaactgatcataaatttgatcccttcactgagctataacatgtttaagaaaacttactaggtattagcctagaccaagagatggagaatctgaaagcatctaagttagtgtccaccatcaacttcacatcatcctgtataaattcataatgaaactcaggcttgatgaataaaacctcatgatgtagtcagagaaacagagaagctaaagaaccttgtacttgtgatacccatcacatgctatatctccgttaccttggtcacctgcaatgttagaaacaagaatcaaagcacaagagtgacaaactctaatactaataatagtttgtgttaaaatgaaaagcttacgagagtgacaaagagtgtcccacaggctaggtttccttccgtcttctgcagcagctccttcccactagtagagaccaaacatttggttcagttttgttcaaaagttaagaaaaaagaagctcataaattggttccaaacctgataagcagaagtgccggctccaaagacgaatccctcagggtagtcagatctgctgaaaacgtcgctgcatttcccggagaaagcaaaagcaagaaaaatggcaaacagagccaaaatctgttccatttctcacacacacacacactcttttcttcgttccatgttagaataagtaagtccagtagccatttgcgtacccgctagatatagttgtgacgtagacattaatgatgatgcaatttagataagaaacatattgggaagtgtgttgaaatgaattatggtctttatttactatgataagaaacagattacgctggatcggagcccaggtctgaccaacccaaataacgaaagaaactaggggaccggaaaaccatgcggctatgcagccccagccccacatatatgagggcttttgggccaaaaaaatatttttggactttttgttacatttcaattttttttgggtattcctaaatttttgttaatagtatggactatgatataataacttttgaggtattaaagtaaaaatatttggtcctcttataaagaaaaaaatattttatttcataaaacttaataattattacaaagcataaaatattaaacatacattatcttaaaattttaaaatagatgtgaaaaaaacggaataacgataagtttttctgttgattgttgcaaatttcaatatacgaatacttataacgatgttttgaattgaaattttctacgaatacttataacgatatatatagtaaaagagaaatttcttaacttataattaaacaccattaagtaatgtatggaggattaacaaaattggatataaaacaagaatgtataatgttcattttgacgccatttcttcttcttcatattttacaatttacactaaacattttcccaaattcagctcataatcaagtgcgcctcatattttcgccaaattcatctaattgaaaacccaaatttcaatatactcatgtcttgtgaagcaaacaaatctcttatttcgcatttctttgggcttcgcaacattattgggctttgtttggggcccatttagaatgaagaagtactttagttaaaaactcagataaacctagccgtcgtcaccgtcaccgtctccgtcgaaatccccattacttacgacaccgcgagctctcaatcttcttcttacactctattgcttgtgtttcctcttcactacaacagtttcgtgtaccaaaggcagttctttcttttgtcccaaggtaagctttgtgattccttgagactgtgttgatgaagcacagactcagagacttttggtttatgattctctttatctttgtgacatgaagcagagctaaagaaaacatg

SEQ ID NO: 8016 - DNA, 3000 bp, Unknown
  misc_feature (1)..( 3000): cDNA_ID_1380539_gDNA_ID_1621183_Annot_ID_174340 3000 nt of promoter + ATG
cctccaatctatttccgtttttattttcttattattcttaccatttacacatttttaattgtttttttctatccgtatagagagagatgtatgataaattaaatgaagcatctattattatttctacttctagtccctaaacctatctacgtgggcacacaatcttcgtaccaaaatgataaaagttttccaacgtacactttttgttgttgttggcttcaatgtatgcctatgtggaccattatgcttcatggagaagtaattatattttaaaactggatatattgaacaaattaaatagaaatctaaatgttttaagagaaatctaaaaggggaatgtttcaaagctagttgttaaggtaccgtgaattatctagtattttaagagaaatcaaagtctgcatggatgatggatagagtagaaacattatgatcaagtctttgttatgattctcgattataactctagataaacaaacttggatgtctgcgagaattggaagattatgttcattttttgtagctatttggcttttaagttccgatcgaaaagtgatttatctaaatgcaagttgctaacctttttgatttacgattttaaacaaaatatttggatttgtatttgtatttctgtttagtaattttttttcttgtgcaatatttattttagcaattgaaatattaattttcatctttatatgaaaacaaaacatgttattattcactaaacatcacataacaatattggcgcaaatatgaaaaagttagaaatatgtatcaagcacttgttttataaagccttagttagatattctatatatatatatgcaaaagtaacaaatagtttaaatgatcgaataatgaaaatattttatctgaaaatagcttacgcatgataattatatttataataaaaacaaatgagcttttaagattaatgaagtctaattcatttcttaagttaatttttaaaaatattaaacaaaaaataacggcattacgtggtgagataaaaaaatattgatatatcattcaccattgacgcttattagctcttattctccaaaatcattaaagatgaatttaaagtcgaaaatcacattacgaggcctctcgggtgaaattgatgttgcagatgatacaacagtaataaattaaaaatcgtagctagctttgaccaacataagagaataatcattggacttacatcttagtatattttattaatatgcttaagtagatatataaagttcgattatatgtttcaatatccttgtccaaaaaagaatcatttaattcgtcaatactatcataaggatccatgtgacacatttgaattagttctaccgcaaactgtgggtcctttaagtactataattttcacaaacgtaacatctccttatgtagagatgtcttgttaaattcctaggtgtataatgatttggattttgatttgacttaaatatcatgtgacctaaatacctgtataatgtcgttgattaaatccttagcatcatcaatgagattttgattcctaagaccatgacatgtgcataaatcgatacacacatgcctatacatgtatatttttgactttttgtgcaagtaaaagttttcgatttttttttatgtattgaagtatgaattctcgtggatgtaacatcaattttctaactagtaaagtaatatggtacatgcacgagagttcatactttcgagtttcaatacatacaaaaaatttagcaaactttattagtagactgaatttaacttttttttacaagagaattaggaaagaaaagaatagaggtgagagagagaaattaaaacacatgtacaaaagaatcaaaaaaagaggtacagttttcgttaactgactactgaactgaaaataaatgaatgtgttgttggtaaaggaaaaccccaaacctttatttcataggatttgaaattaaatcaatttggcagttttgtcagaaaaataaaacacttatttgaaaatgtattcattaactacatatgattttcaggtaaatagacagtttctcatttagtgtaaaacccaataatgatgaatatggtatctctacattataattagagttcaaggttgacatagtcataaaacttgcaaatttggtattcttggtaaagtatatatctggtccggactatcaatagatttaatgtgtatattcatgttaaaagatcatgtgtagctgaaaagatatcaagtttacatgaggataatctaattgtattttgttaaatataatctagttgttgattgatctgccaatccaaaaatatggcgaacttgatatacagaatatatagagactacgcgatggataacacataacatgtatttatgtctacccatactacaatattgtacatgttgttctattgatttctccttgtaaatacatgcacaaacatgaatctgaaaattgttcttaataatattatttaaattttaactcactagagacaaacaacaaggactatactatagtatactattggagaagttacacacttaaaatggtttataaacaaactaaaaaagtgtcatcaaataagcaatatttgaaatgctattttaaatatttatttagtaagtatcaggacgtctacttagagtttttcatgcgtcataaattatgtgacatttacttacatgcgaaagaaaaaggagtaaataaaacacgaaaaaagtaacgttaggtaaatggctaaacacgaggaaaagccaaaaatataaataattcaatttcttatctccatcaagatttaataaaagtaaataaaaattaagaaataaataatgaaaagatgctttggggagtggatctataaatcttgttatataaaggaggatagatagtgagggttttctaccttcttctatctaaaggaagtctttactcagagaaccaaaagaaaaataaagagaaaagaacccaaaaaaaaaaagccattgtaaattcagaataa

SEQ ID NO: 8017 - DNA, 3000 bp, Unknown
  misc_feature (1)..( 3000): cDNA_ID_1810125_gDNA_ID_1621183_Annot_ID_174334 3000 nt of promoter + ATG
caatgacttccctcatcatctcaagggtttgtctcgtgaggagttaaggaagcatctccttcaccttgactctcaattacttggagtcagggaacaaaagatagaaattcttaagaagacgctcacgggttcttccgaaaaagatggtgcaagggtttcagagaactcggccatctccgatcacaagttgaagatagagcctaatttgacggatatattgtcagaagatcatctaattagggtttcagataagaagctgggttcgtgtgatgtatttgacgagttggcttacgtggtccgcgggtcaaggaatttgaacgagaatgtttccaattacgaatcaaaagatgcagcttacacgggaatggatcatcttggcactttcggcggtaattatcttcaggaggcggcggcagaactttaccaaacttacaatctagggaatttttgtgatgatcatgtttgggatctggagtttgcctcaagactaccaccacttcatacatttagcgatcctctcatgaccaccaatacttgccaaacgatgagctccgatatgatttcaatttgataacttgatgactacgttagtgaaatcatgtttctttcaccttttctcggtgattgatcattttttagtatctcttaacttgtatgtttgctccaacacaaatccatgtttgtaaagttggtagttttttttcttgtttattattgattaatcaaacttttcctttctttctgttattctttctctgtaaccctattttgactgcaacaccaacttatcagataaacaaaacgttgtaaaccatgcaagaaacaaagagttcataacctaaattgcacaactcgttaaagcttctagagcagggaatgaaagttatacatacttgttcagatgttaattcactgtcaagtcttggagatgccttgtttttaatgacggatgacacgttctttatgtcaatctagtgtttgcttcagcaagtctttctgtccctcgacctcgtgtttaccaagtcaacattcctaatcagcattctcataattagaacgaacttcagtggagtaactcaactgatcaacttgtgacgtaaacacaaaataaagtacccatgaaactacatataagctttgttcacgatcaaattcataagcatatccatgaatcaaatccccaaaacttcaattctacaaggcttgcgatgcaatataattattactctatatgctatttatttgattgccactgatttggccactaccacaagttttaaaaaatttgagataaaaattggcacatgttctccctaaagtaactgttagaacgtgacgactagtagttaccaatgaaaagttggcagacgttcttgcaaaaatattagctaatggtgagtgactagcagctgccaatgacaaagctaacagtttttttttttttttctaaattatctaaagacaaaactaacagtaagtccccaaaaaataacagttagttgtgaaactatatacagtatactatcaattagcgactgctagtactgtcgaaccgacgactaacgtcagctagttgaagaacttgccgtctcttctggaactccgttggtctatttttcagccaaaacacaaaaactaaaaagttttaagtactgatgttcacagagcaatgatttgtcaaatttttcaagtgaaaagtcctcccttaataatactgttacttgtaaagtttcaaaagtcaaagtggttgtaacttgtggtgtagtaaggtagagttttacgctaaataaaaacatcccaaaactgattataaccccattcaatatggttccaatttagaaaagtatatagtattaatagagtaaagtgtggggatggagtcattaaaggtagaagagaagtatgcatgtctacggattgcttcgactttacgttatgctaaagtatataaaggtgaaagaagcgactgttgaatttatttcatttttcctcaattacaattttttgattaactaggttctaaattgacggtcatacaatttctaaacacataatattttttgaatattttatccgtaccaacaactatcactcgattctgtcaactcttgaaatattttcaagtttctttaccgtcgagttatcgatctctagttccctctattacattttatttgtaacgtccagactttcttaacttttgtctttcaaagtgttcttgcattatttctcctaaaaactttgtcaagcttctgtatttaacgtgattttagcgattaaatgtgaatttctatcttgatatttgtgattaatggaagagagttgagcaaagaagatattcatttttgtgtttcattctgtctgaatcagtatacatactatttatgcgtgtttccaaaatctcttgttttattgatatcaaatacgatttataatatactttaaatgtggtccttaagttaggtgatgttgctataaatatacaaactctatattaaaactaaaatttaatacttttgtttgtatttgtaaatttatttacctatttctttgtttcacaatttatgctgttctatattatattcactagaatttaaaagtaatttataaaaatagctcttttcctcttcctcttcacattgaagcttttatttttcttataggtttcgtgtcctccaagtggttctttcttctcaaaggtctttaaacgaaaacgcgcaaaatcaactttttgacgttcttgctttatattgacggtttcttacttaaattccccgacaaatgtctttctctttttctagcttcatcttcgtcttctttcactttctcactctcatttcttaaaccctttttcactttcggtgtctaggtttggattttatcttccaagctcctacaaacttaactcgttcttcaagattccagcataaagactcaacctatctctgttttttcttctcttgaattgcttttgggtttcatcagaagttaaaggaaatg

SEQ ID NO: 8018 - DNA, 3000 bp, Unknown
  misc_feature (1)..( 3000): cDNA_ID_2152445_gDNA_ID_1621183_Annot_ID_174332 3000 nt of promoter + ATG
acgagcccagtagattccacaagcaacaacttattggatcctaggagtctccatggtcctttccatagcgctaattgtcttctttgttgacaagaccaaccatttgcggtatgaaagtaacaagcaaaccaagagtttaagtccaagtaacaagtgagaattcttcacaaacggatgatggtgttgtttctttcctctatatatttttatttatttatttaatgcttattttttcttattgttttctctcttattcttaacttttcttctttttcaagaacaatgaagttttttttcttcttatgtgattttcatctcttacaaaatttaaatctggttttgaaatatatttgatcaattgtatgtcttttggtccacgacgttaaatcggctacacgtcattatgattttggtccacaatcttctattcgatctaatttattactcattcgctttgaatttgttctcaatctaatttgactacttattcgatttgaacgtatcccctatctaattctattagtcattcgatatgaattttttctcggtctaattgtattagtcattcgatatgaaattttcttcaatataattgtattacccattcaatataaacttatcctcgagttaaattctatcattcatttgatatgaatttgtctcgagtttaattttattttttcctcatatgtccttcggttatttcaaatcgtcatgtggacaagtattctagtactacccgtaaggacaaatttccaaaaattgtcccccctccccctccccctcccgatatatgattttgtcccccaacgatgataaagataaatagctaatcgtctattctaactgatccattgcatattccaactggttgtccatcctaatcattcgatttaaacttgttgatgcttcactcttttctctatcatcacttttgtccctttatctgataaacagaaatcatgctctactagcaagggtaaatcatcatcaaactatcacattactacaaaatgtgatagattcataaaagaacaaaagaaattgatagatttggaaagtttccacgagaagtggtacatctgactaaaatcacatttgttaacatgcttaggcataaagcaaattaaacattaaccaaacaatctcatcggagtcatcatgcatagataaaaacacctttgatgtggaaaacaaagaaaaatgattacacatcacatgaacttttgacatctcgaatgattaattctttctcggtcaaacccccaagaaatttataaaattttacatattaatatctaataagcaaaatgattgatagtggatggatgaaattcatgatgatgatatcccgagtcgaatcacagtcaataccctagtttagtcgcatgcccagctatctttattagagtttagatcataattattctcagccctttcatatttagtctatataaatagacaaaaccagattgtatataagtaggggtgttaaaatgggtcaaaattcatgggtcaactcaactaatgaaccctaatgagttgaaaattttgactcaaatgagttgatgggtcaaatgagttgatgagtcaattggtttgatgagtaaaataagttgggttgtaatggttaatggtttcaatggtttacccaattaacccatcaaattttgtaaaattgaataaaaccaactaaaatctcaaaaccaataccaatttaagtttaaccaacacatctaaaccaatttaataaaattaatatttttccaaatttcttaaatatacaagcgatgaaattgagaaaaagtaaactcgtaatttttccaccaaaaaacataaatccgtgattttcccgctaaaaacgtaaacccgttattttctcgcaaaaaacgaaaacccaagattttcccgccaaaaacgtaaacccgagattttcccgccaaaaacgtaaatccataattttcccgccaaaaacgtaaacccgtgattttcccgccaaaaacgtaaacccgtaattttccagccaaaaatgtaaatcccgtgattttcccgccaaaaacgtaaactcgtaattttcccgccaaaaaacgtaaactcgtaattttcccgccaaaaatgtaaaactcgtaattttcacgccaaaaaacgaaaacccgtgattttccggccaaaaacgtaaacccgtgattttcccgccaaaaacgtaaatccgttattttcccgccaaaaacgtaaatccgtgattttcccgccaaaaacgtaaacccgagatttcccgccaaaaccttaaacccgtaattttcccgccagaaacgtaaatatgtaattttcccgccaaaaacgtaaatctgtaattttcccgccaaaaacgtaaacccgtgattttctccccaaaaacgtaaacccgttattttcccgccagaaatgtaaatccgtaatttttccgccaaaaacgtaaacccatgattttatcgtcaaaaacgtaaatccgtaaaaagtggaatccgtaaatatcataagtttgatgataatgaattaataatgataattatttattattgttttataataataattaattaaattattacttcaataggttaatccatttaacaactcaacccatcaaattaaatgagttatgggttgacccaactcattttgttaaatgggttggatcaacccataactcatttaaccctaaactcatttgattatgagttgagttgagttgggttacccattttgacacccctatatataggttttcatttttttttaggcatatcctatagaggttatgtatagttagggtataattgtaattagtattaccctaatctctcgtgtatatatattgtaatcacaacctctaatgataattaagcttcacactctatatggtatcagagcattacgactctcagacctaaacttttttttttaacgccgcctcttcttcatacactcttcttcaagtctgtttcatttttcacgatg

SEQ ID NO: 8019 - DNA, 3000 bp, Unknown
  misc_feature (1)..( 3000): cDNA_ID_1011951_gDNA_ID_1621183_Annot_ID_174330 3000 nt of promoter + ATG
atttggtacccattgttataatttcagtgttaaacgttatctatacaaatgagcaaaagggaaatatacacacaaaaaatcagtactaactatctttaacatcattttttcaagtatatgcatgatgtttatatcgaattatgggtagttggacaaaaataaacctctgtaagaaaatatcgaaaaaatattagttacctatcgttacgaaattgaaacgttacaacttacaagtgaaaaacgactcgaaaaatattactttgaaaatctgccgtttcaaactaatatttttctccattcttacaaacgttacaaacatattaaattataaattaaacaaaagaagacaacaccttacgtttctttttcagaaagtgcaatttatgtaactgatattttttatttgattacacaaaaagaaacttattaacttcggaacgataagttattctttgacagtagtagtataatcaagtcctaaataaaagtcaaacgctacaacattcgatgattaactgctaaaaactatggtttattggcttatcacatgatctaaaacgagtaagaaaattaaatgcaacttaaattatatgaatcagtaagaacaaaaacaatgtcaaaatcatcggtccctgatctccggtgccggcacccacccgttcaaatcaactatttaatttccgaccatcctattactctattccattaaatttttaaactccaaaaataacaaaaattaaataaagtaaacgtcagagatgccccaggcaaccacagtcaaatttgcaacaatatggttacaaatctttaaataatattattattcttatcattaatcaactcccaaatgacagtccaattaaataatcacaaaacatcataaaagtgaccaaaattaaataataacaattgttttttgggtttcacatgttttataagcaaagccagtgtggtggacctaactcttcacgctgtcccgaaaaagactcttctcttctctcttcctctttccttcacacaactctctcattctactctctgttttttttctttaatcataacatttttttgaagaacagagattctttttgtttgtgtaagagatgggaaattgtcaagcggttgatgcggctgcgttggttctacaacatcctgatggcaagatcgatagatattacggtcctgtatccgttagtgagatcatgcgtatgtatcctggtcactacgtttctcttattattcctttgccggagaagaatattccggcgacaacaacaacaacagatgataagagtgagagaaaggttgtgaggttcacgcgcgtgaaacttctccgaccaacggagaatcttgtacttggtcatgcttatcgtctcatcacttcacaaggtttgttcttgtatatttgtttttgtttagcttgtgtctgtttgtgttcttgtaatgggtttctgattaaattagcgtttgatttgttttcagaggttatgaaggttttaagagccaagaagtacgcgaaaacaaagaaacaccaaagtgaaacgagtaaggagaagaagaagccatcatcggagaagaagattgatgaagaatccgacaagaatcagaatctggtacggaatctttacttagaatttaagatatggtttagcttcaagaatcaattttcactcgaataattaaagtaattagtttaaagattttactctatttctttccccaaattaatataaaattatgaaaattaatgggtttgtgtttttctttgtataggaaacgaaagatgagaagcaacgttcagtgttaacgaattcagcttcatcgagatcaaaaacatggaggccatcattgcagagcatctctgaagctacgagttgatgtttgggttttacgtgagggacaagaaacgtagtctctgtgtgtgaatcattcagaagatggaatctgaagaagaaagagatataaacattattgaataaactcttctcttatgttcctttctggttataatttacataggagatgaaaattttatagattaagatgtaaaaagaactatgcagagattaagaactaagtcccttttttgtcctgttaatgtatatatgtgctccatgtgaagaaatcaatcaaaaaatagattgtaaaaacatacgtttttgttggtgtttactggtttacacaaattcttggaataaagttcaaaaaactttagttaaatgagtccaaaaacatttgatttagatggttatgtgaggtataaatggttgtaagaattgcattgagttggattgatcattggtaggtacacatcctttcatgcatttatgggatggttttttaagaaaataaccaattttatttgagattattagttatttttcttcagagaagtagtagactttctcaaaatttatatttctttgaatggaaaatcaaattgaatttacattgtcttttttttttataactacttttttcatttttttagcaaatagtataacatagatgagctaagtaaaccaacaaggatgggcatttgcatcaaacccataccaaaccaaaaaattgaaccgatattatgaatcaagaatttaagatatccttgaaataaaaaatctgaaaatccaactgaagccagccaatgtttttagactctataaaaagatatctgattaataaattgttacttttaattttaatttttttttaatccagaaaacaaaaaatcaatggtcaaaacatacatagaaatctcaataccaatctcaatttattctgaaatattcttctgaaaccagaaaccaaagaaatccagaccaaaccgaaataactaaaccggaataaaccccctatccagtcatagaaacacttgattctaaagattgcgatagccgccgataggccaatcactcttttggccttatccgaaatctttttgtgggcagaaacgtttgtgtcttaggccaatctctgtgtctctctgtccagagagaaatg

SEQ ID NO: 8020 - DNA, 1282 bp, Unknown
  misc_feature (1)..( 1282): cDNA_ID_2053649_gDNA_ID_1621183_Annot_ID_174325 3000 nt of promoter + ATG
aagcttcttacatgaaaaattgcttactcctatgcattttgcgagcccaagtctctgacactcctccatttcagaccacactacttcgaaatccattggcataaaatcatcttcatcaataggaaacttgtatttaccaggtttcgagctaaccggccaatgaattatataaagatcaagatagtccagtttaaggtttctgcaaaaccatatttgttacacaggtggtttacattaagttatgtcactcccaaaataatattcaatcatgaaacataattgacacggtgactgatagagaacctgatccatagagatatgtgaaatagttttctgtatttctcaatcggaaaagtgtttacaagtatgtttgtatacatctacactaaaccaactaaaccatatacaatcacaatttaacttaaccggaatcactaaaccggactatcatatatacagttcgaatagtgacacctactctcagtgattgaaaccgtgcattctaatttcatgtgaaaatcattaaggaatctaaatcttacttcaaactccgtttgatcgccggtacgacgagaccaccatgagcatcagcacaccaaagtttggtagtgacaaagaattcagatcgagatcgaactaagccgagtgaaaccgcctccgctaaagcttcgccgatcggctcctccgtttggtaccttggagaggtgtcgaaatggcgataaccaagcttaatagcctcaatcaccgtctctttcagcatcgttggttccggtagcggagaagcggcggttccaaaaccaagaaccggcatcgagtgatgaccggatggtccggatctgatggcgagcgtagggactgtggttaaagacattggttaaagagaagtcaacgaaagtgtgctctcagaaaatggtttctctcggtggcccaaagctttactcagtagccactgactaatgctagtgcctgataatattatattaatatactctctttgattagaaaagtacgtaagtcttcatattataagtttataacgctatataatttgactataaattgttaatagaaagtagtcatgatattatatacgaaaaatatttgaattagtattctttaatattgtttatttggaaaacttttaaagaataatatgttatgtaatttgtgctaaaatttcaaaattttaatatgtaaatcaataatgaattaatataagttgttttcagctttttctcaaaagcatgtcacgtatgagcattaacacccgtgtggaaaaatg

SEQ ID NO: 8021 - DNA, 3000 bp, Unknown; identical to SEQ ID NO: 8019
  misc_feature (1)..( 3000): cDNA_ID_1011951_gDNA_ID_1621183_Annot_ID_57410 3000 nt of promoter + ATG

SEQ ID NO: 8022 - DNA, 3000 bp, Unknown; identical to SEQ ID NO: 8018
  misc_feature (1)..( 3000): cDNA_ID_1810129_gDNA_ID_1621183_Annot_ID_57412 3000 nt of promoter + ATG

SEQ ID NO: 8023 - DNA, 3000 bp, Unknown; identical to SEQ ID NO: 8017
  misc_feature (1)..( 3000): cDNA_ID_1810125_gDNA_ID_1621183_Annot_ID_57413 3000 nt of promoter + ATG

SEQ ID NO: 8024 - DNA, 3000 bp, Unknown; identical to SEQ ID NO: 8016
  misc_feature (1)..( 3000): cDNA_ID_1380539_gDNA_ID_1621183_Annot_ID_57416 3000 nt of promoter + ATG

SEQ ID NO: 8025 - DNA, 3000 bp, Unknown
  misc_feature (1)..( 3000): cDNA_ID_1810115_gDNA_ID_1621183_Annot_ID_57417 3000 nt of promoter + ATG
aatttttttatgttataatgtaagggtatgttaaaatattattccatttaaaagaggcattgtaacaagaaccattctgaatctgtgaaagaaatattccatactagacgaggaaagtcctcgagagactaattaaatactaaataacataaaatcattctgaatctgtggaagaatcatatgctaagcgaggaacttcctccaaagacatgagactctcagtgtgattatgataatagcggacctctcttacatttttatgattaagcttccagaattcttcgtcaccaattccttcatataatcatatttgaccctccttactagggttctttttggatcataatataagacataaattgcttcagatgttgttgcagctgtataaataaactcaccagtggatcatgagtaatacctctcagcccccaagaaactttccagatcgggtcacgttgaggaaattttctaagtgaccgttcttgtttctcttcatcctccaaaacccaaaatcatttaccagagacgtcgtcagagcaaacccatgcaaattttccttcgtagttgaggaaaaatttgcaaagtaaattatcagccgctgattttcttattgtgttgaacttttcgtacctcacatcgaagctcataaggactttctcaacttcagaactatcatcgactccaaaaggtatactcgcttcataatacacttccccgttgatacatatactttgtattagtccctcggcggatagagggacatgtttaggggtattttgtgtcactctccatgattcttgaggtcccaaagtaaaaacaagaggatcttggtatctagagcatgagatgcacaagactttatacttaccctcgaccggatcatatcctaaagagctacattcaaatgcgacttttggtaaggtaacatgttgtctcatgattggattccaaactacaatatgccccaagaatctcccaaacatatcaagccatggaccgactgggaccattcgtgataatcaaatatgagagtgtctttcagataacgctccacatgtggataacatgatctgtccggattttcatgttggggcattgcgcagaaaatacgcttgtcacttgttttcacgcagaccaaaagacacaacctagttgaagactgactcgcgaacgacctgatgaaatctggatgagtggtgattgatgaccatagctaagagacccagtggaacctcgcagcagatttagcaggaagtctcaagagtatatcaggaattagatcaagaggaatcatctcgagaaacttacaaaaactctcatcttctttagattgtatacttacttccctatcttccgcctcttcctctactctatccattggcgtcgatccactagtttttttttttaaccctaatttttcaaccctaagtttttcaaaccattatagtagttgtcatctctggacaaaaggaacaagtcaatgcatcgatcaccgaaaaggaagcatcgtacaaagagaagaaaactgaagattaagaacatctctttctctttaacttgcatacatcatgttcaagaactacatcttagcaaatccaacgaccgaagacgaattgatcatggacactctagctagtgaccattgttttaaaaaccatactcaaaatgtattaaaaaaacaaataaaagaattttacatttggttgtatttgacaaaacatatcaacactttagattcttgcggtaagtcagaattcttaccagaagaatctaaaactttggttcactgattcatgagaactttgatccgaacaatatttacctagaaaactgatctcaccctcatcaatactgatcttgatgaaagtgaatcttacaaaaacaaaaaaataatgatagatttgcacttaattactgataagtagactaaaagaagaacgatgaaattatagcaaatcagcaacatgaccatcacggaactagttaatactaaaaagcatcaaagttggatttctaagtgatctaacaaacgcttttttaaagattaaattcgagatgaaaatatggatgaaaaagaattaaattgctaacataaattgaccaaaatcgtaagcattgatcatcacccatatcttcatctcaaatgaatccatataatcaacactctaacgtaaccagaaaacttgttatacttatttttgggtaaaagattataaaatttagatttccaagcaatctacgagcaaatttttaacggattaaatttgagatggccatatgggtaaccaatatataaattggtaacttaaattgaccaaaatcttaaatattagttacccaaacagccatctgaaatgaatccatgcatatgatcaactctctaatgtaacaagacaagtttatccactctaacgatagatagctccacaacgtcatcaacataattaacgaaagatagacgtcgatatctatctactgtgaaaccaaacatgagtattatgaatcaaaaagatccattaatgttaattcatactcatgtttgacttcacaacagagagatttcgacatctacctttatccatcggcgactcacttttgtttttctaaaccctaattttctgtctgggtctctctgtctttgacgtatttatagtacaaaaaaaattgttgcccaagaaaaaaaaaaaaaagaaaaacaaaccttctgaatccgacagaggctttaatctgttaccgttaaagtgttgtatgattccgttagaatctgcaactccgttaatattttttccgttttctttcagggaagagaaaaaaaaaacacagacctctcttttctctcttcatgttttcatcgatagtggaagagatcaagtgaaagaaaaacactcagatctggaaattcagcttcttagatctatgaattttcaaattcgttgatccatttttccgcttcaatcgtctccgatctgatttcatcagcttcgtaccgctccggtcatg

SEQ ID NO: 8026 - DNA, 3000 bp, Unknown
  misc_feature (1)..( 3000): cDNA_ID_1810111_gDNA_ID_1621183_Annot_ID_57418 3000 nt of promoter + ATG
aaactagaacatataaggcatcctaatattcgtttaaccacatagataggatatcagcagattaccttccggaaatattcaagggcttcggaactgactttacagatttctgtgcaaaggtgaactcccgtaatgagaacaccatgatgcttttctttgagtaaagcagcaccaggattaataaagttctcagaaagatccggaacttttctgatgatccttatcgcgcaaagagctgcctaaataaagaaaaaaaaaactagttcactataatgtattagtctatgcatacaaaaaaatgacagaagtaaagtgtaaattcgtgaaaatgatacatagctcgtaaattaaagccttcacgtggttaatacatgcacgttaacctagcatctaaggttttccaacatttccaccactgaccctcacaacaaagacacctgttatctgaacgggtacaatgacagtacaagaaaacactcactttcttgcgtatatttggatcacgaaactgaagtaatcgttcaacttcaggggcgagatcacgagccatttctgctgaacaaatatttcctaaagcacagagagcaagccccacaatgtactggttcgtgtgattcagatctctagacgtaagtcaaggttctcacaagatgaacttaaaaatttgtgcgaagatgccagcaaaaagttaaaacactactagggaatcaaaatcaaaaattaacaccataaaggatactgcttcagcgagttggtgacaagcattaatacttcttgcctttcatcaagaagcaacattaatccaagataaccaatcctcttctcaggaaatccaggagaagcaattaacttcaagcattccatttgcccaaaatgagtagggtaaccaagcatatgaatgaacataagcttcgctagatcccgatgtctatagtcctggtcattttcattaatcgaagcacggatcgcagcacattctttcctcacaacagcacgttcctcagcagcggttttactcgcacgtatagctcgaatcatgtcgctgcaacacaaattgtcattaaaatgatgaattcatttacatttacatactctcaatttataaagaatcgaagcttcatcaaaaatgctaagaggattctatcatacaacatgcctaatctcacacaatcagccaaaacatttttctgataatcgtcaatttccgattgaatttgccgattactagaagaatcaagctacattatggatttagacactagaaaacgcacgaaaatggaagtatcgcaaagtcgcaatagagaaaaagcagattactagttggagatcggagtaaagtgattcctaacctgagacgcgtgccggaagagaatggattcatgaccggagcggtacgaagctgatgaaatcagatcggagacgattgaagcggaaaaatggatcaacgaatttgaaaattcatagatctaagaagctgaatttccagatctgagtgtttttctttcacttgatctcttccactatcgatgaaaacatgaagagagaaaagagaggtctgtgttttttttttctcttccctgaaagaaaacggaaaaaatattaacggagttgcagattctaacggaatcatacaacactttaacggtaacagattaaagcctctgtcggattcagaaggtttgtttttcttttttttttttttcttgggcaacaattttttttgtactataaatacgtcaaagacagagagacccagacagaaaattagggtttagaaaaacaaaagtgagtcgccgatggataaaggtagatgtcgaaatctctctgttgtgaagtcaaacatgagtatgaattaacattaatggatctttttgattcataatactcatgtttggtttcacagtagatagatatcgacgtctatctttcgttaattatgttgatgacgttgtggagctatctatcgttagagtggataaacttgtcttgttacattagagagttgatcatatgcatggattcatttcagatggctgtttgggtaactaatatttaagattttggtcaatttaagttaccaatttatatattggttacccatatggccatctcaaatttaatccgttaaaaatttgctcgtagattgcttggaaatctaaattttataatcttttacccaaaaataagtataacaagttttctggttacgttagagtgttgattatatggattcatttgagatgaagatatgggtgatgatcaatgcttacgattttggtcaatttatgttagcaatttaattctttttcatccatattttcatctcgaatttaatctttaaaaaagcgtttgttagatcacttagaaatccaactttgatgctttttagtattaactagttccgtgatggtcatgttgctgatttgctataatttcatcgttcttcttttagtctacttatcagtaattaagtgcaaatctatcattatttttttgtttttgtaagattcactttcatcaagatcagtattgatgagggtgagatcagttttctaggtaaatattgttcggatcaaagttctcatgaatcagtgaaccaaagttttagattcttctggtaagaattctgacttaccgcaagaatctaaagtgttgatatgttttgtcaaatacaaccaaatgtaaaattcttttatttgtttttttaatacattttgagtatggtttttaaaacaatggtcactagctagagtgtccatgatcaattcgtcttcggtcgttggatttgctaagatgtagttcttgaacatgatgtatgcaagttaaagagaaagagatgttcttaatcttcagttttcttctctttgtacgatgcttccttttcggtgatcgatgcattgacttgttccttttgtccagagatgacaactactataatggtttgaaaaacttagggttgaaaaattagggttaaaaaaaaaaactagtggatcgacgcca

SEQ ID NO: 8027 - DNA, 3000 bp, Unknown; identical to SEQ ID NO: 8015
  misc_feature (1)..( 3000): cDNA_ID_1807326_gDNA_ID_1621183_Annot_ID_57419 3000 nt of promoter + ATG

SEQ ID NO: 8028 - DNA, 3000 bp, Unknown
  misc_feature (1)..( 3000): cDNA_ID_1810155_gDNA_ID_1621184_Annot_ID_57424 3000 nt of promoter + ATG
aaagacttttgtcacaaaataaagtttcaggaggccgtgtcactctttgattcaatggcctacatgggattcaaacctaagattgtcatatgcaacattgtgactaatggtgtttgcaaaaacagagatctggataacactagattgctttttcatttttttataaatgattttattttgcttttcgttattaaaactatctaaatttaaagacgtttaatataaatggtttagtaactgtttaaatagtctttttattgggtttagttcaaaaaccgattaaaccaagtttatggagaaataagttccgaactatcgatttggggagatataagttgggaaatttagtttccgggaggggggggggagggataatggcctatttggtacgttgtaatactttttgtggagaaatatactatgttgtttttctatttcttcactaaagtttttacttttttattctctggattttttttctgtttttatttccttcacgttgtccccatgaaaaaaacaattattttttccacacaaattaattttgagtgaagtttctagctactctcaacagcatttctcttgatatttgatagttctactcttttttttatcttgatcaagaattggaagaaaaatgctcagtggtaatggttcgatccatatcgaacaataatatgattaataaaattacaatttctttttaaatcaaatgagctttttctaaaattctatattttattccaaaatcaaataattttttttccaggaattgattaattgcttaacccatacaagagcaaattgaggagaaagatgagaagatgatgaagagaaaagatagttgagcaatggaggaagaagaagttgttctatgaagaagaagaggaagtgttgtgaagaagaagaattatgactttagtcacaattggattaagaggctattggggtagaagataagtaaagcccaaatagaagttggtttgttttgtttaatagaaagttgaagcaccagtgatgtagattggagagaagaagcgtctaatgtattgagcttatatttttctaatttgttttttttggcccatctctaacttaacctccctttatataataaacgtaaaagttaaattaaaacctaataaaaaacgagataaaaggtattgttatcgtaattatgatttttttttccaaaataaaaaactagaagaaatagtaattaatgtgtatctacatatatatttttgcagccattttgtgaaataaatcctatagttggaacttatttacaataggtgccactggattttaatgtttgtttttgataattagaaaaaaatcttcaaattaaatatttgacatttaacaatcttccctaaatctctccacattaactacacgattagttactaaaataaaacttccaaaatatttaatatcatttaattactacaaaataaatggtttttttacgggacggattggtgggacgggtttgacaggacgttacttaataacaattgtaaactataaaataaaaatattttatagatagatacaatttgcaaactttatgtatactaactttagaaaataaattgtttccgcggtgtaccgcgggttaaaatctagttttgtaatacaaccgtagtttgttgtttccaaaatgttgttcgcattgtgtataatgatagcttattgtctaattgttgtgatctgcttcttttttcatgtttttatttttacttttgagttatacatatagattaacatatatgtcaatgttttttaacccgactcgcacgatgaaccggactactttcgtgatcaccggttcattgagtcaatccagttcgatgacgggtcaatttcttaaagttttttttaatgttacagagattatatagtttttatatataaaagatatatcatatttaacaaagtaatatatttaacaataataataaagtgattaattttttaagtccaactaaagtataaagccgtaacaaatatgaaaatagtggagatcaccgatgacataaataaactaataaaacatcgcggatttaaaacaacgaatctcgattttctctctcatcatttcattcactcttaaggcgggattgtgaagtcttcatcaatttaaaacatcaaatgagtatatgaactagaaaaagttataaaaataatataatatagtctaaaatcttttattttagactttttttccgagatatcctatgtatttttttttttcttcattaaagtttctaattttctatcctcttggtttttgttctgttttcattttcttcccgttgtctccatgaatttttttttactttttcctcataaattaattttaagctgtgttctaaaaagcggtttaggcggcactacgctcttaagtgactcgtagacaaccgctttgaccgcctaaatttgcataagttccggtttactgtattgttttttatttttaactatataaaactttcttataagtcttaactcaatatatattctttgatatgaatttaactaatttttgtttatgatttaacattttaatttttctaatagatagttatatataatttattatctataatattatattcaatatgtattatattataaacttttaaactgtataaaatcgtctaaactcctattaagcattgtaggcgttaggcgctatgttaccgcctgcctagcgttttcttcgacactgattttaagtaacatttcgagctagtctcattaacgcctctatttatatttgataattttactaattcatttttttatcttgatttgaaagaaaaatgttcagtggtaatatgattagtaaaattataaaaaaatttctttcttttattaaatacaaaagttcttaaaacgtgcagacttgaagatctccacaaacctccaaaagtctattcaaatggcagagacagttgaatccatcatcatcatcatcatcgtcttctccaa

SEQ ID NO: 8029 - DNA, 3000 bp, Unknown
  misc_feature (1)..( 3000): cDNA_ID_2145183_gDNA_ID_1621184_Annot_ID_174379 3000 nt of promoter + ATG
ccactgaaatgggtccccaaaggtctatatgtaataactcaaaagttgaattacaaatattgtttgaagactgaaaagacaacttcttctgcttagccaaatgacaaatgtgacaataagcagatcctttattcttgtgtttagtagtcctcaaaatgtctgaaatagcatccagtcttgagtaagctggatgtcccatcctcatgtgccataaactaacatccaccaccgcattaacagagactgaatccaatggaggtgtagtatccaacacatagaggttgccaatgcgtctacctctgccaattctcaggtccttggtaagatcctgtatttcacaacatgacggatcaaagatcactcttgaaccaatatctgaagtcaaactactgatgctgatcagattcaaacgaaactcagggagaaataaaacatttcgaagaagaatgttttcatttatctgtactgaacccactccactgattttaacacgtgatcctgttgggagattcacataactcaccacagaatgatccaaagaaacaaataggctcttatcatggcaaacatgatgagttgcaccagagtctatcacccaagtttcagtggaaagagtatgttgggatacattcaatataccaacaaagtagtatgtagagttagagaatgagataccagtgtaatcaataggagaacgtgaaattccagcatctgaagaagaagcagttggttgtgacttcagttgagaactgaacaaggctatgaagttctgaagttgatcattggagagattaccaagcagaccatctagagtagcctgagttggaaccatcggaggcaataaagagacctgagcagcaaccggttgaggtttggtacccttctctggtagtttgcctttaaaaccaggagggtaaccatgctttttgtaacatttctctgcaatatgtcccaccttgttgcagaatgaacagattggacgccctttattaggtccattctgaacatagcaaatcttaggagtcaaagcagtagaagatatcttagagacctgaaaagcagcaggaggagaaacattggtagagaaacctttctgactgtaatcctggtcaagaatattgtaaacttcaaccagagaaggcaaggctttctttgcaatgatctgtctcctgactatagagtaggactcattcaaacctgccaagaatttgacagttttagctctctctgccttctgttgcagacgaagaactttaccacaagtacaaggatcatcaggttcctctgtactgtccaacaaatcccaaagaatacgcaactgagtatagtactcagatagagaaagagaaccctggcgaaaatcctggatctcctgtgtcagattgtacgtacgaggaagattagtcatatgaaaacgtccataaatgtcacgccagatatctgtagcatcattcatgcgtagaatgctacgataaatctgcggagacacagagttcaacaaccatgatttcaccatactattacatctggaccaaaggcgaaagttcccatccgattcaagtggacgaggcaaagaaccatcaacaaaaccaatcttattcttagcatctaacgagatccgcaacgctgcactccaatcatcatagttagtctcatctaagcggatagagacgagattcaaacctggatgatcaccactgtgcataaaaaacggagactgagtcggatccatggaatctgaagtcacaacagctcgcgatgcgccagcagagagcagatctacagctggaggagagatcggaggagagactgtgagaccagtggatcgcgacgatttccatggaacggagcttatcgacgcctttgaacgagtggatttccgagttactcgagcaacagccaccatctttacagaaaaacgagtagtgaacaagaaaaaaacgagatcggagaagaagaaatctgatcggaaacaacaaaaacttagctcgttggctctgataccatattacaagataaggattgagctgagctagggagaaaacttgttaagattttcgattcttatttcttaaagagtaaagtgtacaacaatttccttatatacaattggtctaacttaaccagtcaattaaaccggagaataatctattctaactaaatcggatggtatatatactccaagagagttgttattatacctcaagagcgtaaaggtttagaacgaacacaagattcttgagctgcgaaggctgaatgaagaggtggacaaagagattgctctgagtaagtcatgtgcagcgaagattgttcaacagcttgaaaatgtgaagcatcacagttgcagataagtaagttgttgtctcagagataggcaagcaaagaaaatggtgtaacttgaaggtgctgagaaagtgactgcagaaaaagagagcacaaagagttaacggcgattccattatctgcaacattaaacaaagataaaaaaaagaagaaattttcacagaagtggacgaaaaaagatttgccctcaccgtttgtcaaagtgagaactggttttcacggtttctcttttcattcaatttcggaccaaattaccctgggaaaacttaataatggcacaaaccaaaccgtgcaacagttcgtatcggttcagttgacggcgtaaaccaaaccctacagcagttggttttggtttagttgatgcggttcagttttgaaaaagacaaaaaaaaaaaaaactgaaacgaagaaacccgagaaaacgaaaaagagaagagagtaacggagagatttgagagagaatcagaaagcgaaacgaaattcagtatccattgcttcaaaattcgacataacttcgaattgttgggtagttgaattgagccactgaactcccacatccggggaagtgaaagttactgtttttcccggcgaagccaagagaaagttactttttattccggcgaaatttgaacctccggcgagatagcatctttagct

SEQ ID NO: 8030 - DNA, 3000 bp, Unknown
  misc_feature (1)..( 3000): cDNA_ID_3047279_gDNA_ID_1621184_Annot_ID_174376 3000 nt of promoter + ATG
gtcaatactcagctgctccacggacttcacatctgactacagtctacaaagttttacaatatattaagggtacagttggacagggacttttctactcttctgatcctgaccttacccttaaaggctttgcagactctgattggggaacctgtcctgacactcgtcgttcaactacagggttaactatgttccttggttcttctttgatcacgtggaggtccaagaaacagcccactgtttcaagatcttctgctgaagcagagtatcgagcattagccttggcttcctgtgaaatggtatggcttgcttctttactcttagacttgaagatcatcacagggtcagtccccatagtcttctctgatagtaccgctgcaatttacatcgctaccaaccctgtttttcatgagcgaacgaagcacatcgagatcgattgccatttagttcgagaacgcttggataaaggtctcatcagaatgttgcatgttcggacagaggatcaggttgcagacatcttgactaaaccattatttccgcatcagttctcttaccttatgtccaagatgagtcttcataatatttttgcctcatcttgagggggactcttggagtatatataccatccggtttagttagaatagactttaattgactggttaagttagaacaattgtatataaggaaattgttgtacactttactctttaagaaataagaatcaaaaatcttaacaagttttctctctagctcagctcaatccttatcttgtaataaactcatttgccaaacgtgaacagagatagagttcttagattatagcacaactgattattgtttcctttatgcttttagggtctcttgcaccatgttacaaataaatgtggggatgcttgtgactgcgtttctcgagaggacaaaggtcgttcactcacatcttgtccagtaaaagtgttagagattgatgaatttcaaggaacaatgaaagagatgcacatgataaagcatttcttatactatttttcatgtttgaaggatataaagatctatatagaagagaatgctcctacacaactcagagtccatgatgtgtctgaagttattgcggagatgatgaaactctaaaacaagttatcgacttgcaatgtgcaggtcctagtgagtggttacttgtataaggagtggaatgcacaatgaagtcttcgaagaacaaaagtttcccataattttgctaaagtctctttaaaattttacttcggttcgattttgtttagttcgcttgaaaacatttttaaaccaaaccaattgcaaaacaaattcgattttattttgtaatttggtcttagttctttgttggtgtgtttaatagaagtgccaaatgtgactaaggtagaacaaaagcctaacttaagcttactaaggtggaaaacaaagtaacaaacttctttagtctcagaaaatcgaattacattaacttgtaaaaaagtttattccatctaggaacgtaacgcggaacaaaaaaaaaattatttggaaaaataaagcttcgcatctagaggaataatactctcaaactcgctgttgattagtagaaaaatagacccatagtttttttttagaagaagcgttataaaagcttataagaatggcaggatcaaaacaaatgtttataagcttttataagatgtttataagattttctcatataacctttttatgataaaatttaataacataagatttttttattagatgtaaagaagtgcttttgtattacttaataagttttataaaccttaatatttttaatagatggttataagcttttatgagatgttataaatattttatcggatgtatatatgttttttataagatgtttataagcttttataatatgtctataagatgtcttttatcagatgtttataagctttttataagatgtttgtattttataagcttttattatctgcatatacttttttggggacgatttgtgccgaaaaatcctttttcaatttcgatattgtatgtttagtccctacaaaatcaatcagacaagatatttctttaggacaataaccaaatttttgctcaactattcacgtattgcactaattacttgcctaaacatataaattgttaagtactaccctcataaattgcacacattaatcccttgaaactctactaattcaatattacacgaaataatatttcctaaaaaatccgaacaaccaaataactaaccatatctttacttacttcattccaaaatcttgaaatatttactacactcttaccaaatattcatatttcgatatcacatttctataagttaaacgattattaatcatgcattaattcctcaatatatcatataatcttacatatggtatagtcaatatatttttacacattctaaaaatcatcatcaattccaaattccaatatatcacctcgaaaattaaatttcgccaactataatattatccaaattgttatggattattgccttcccaaaattctatccgattcaatcatctattttctccattcctcattcatagcaattctgtttcctgatttacatatatcaccttaactacaaaatcttttaacattcgcttgccagtcaagacataatctaaatcacgcaatattccatcttctaaaccatccaaatcattctgttttgaatgtacaagcgtaaaaataagggcaaatgcatctaccatatctcgacagtttgattcagaatcaaatcaaaatctaaatacggcatttcgattattattttgcacttatgatactcaagcatattcctattctaaaccattcagaatcattatgtttctaaagaatttacgctctaaatctttgcaaataaatgtttaaagattcactcggctactataaatacgcttctcatatcatttcatttcatcatcactcacaccgcaaacgagagatcaaagcaattatacattttgagaaatg

SEQ ID NO: 8031 - DNA, 3000 bp, Unknown
  misc_feature (1)..( 3000): cDNA_ID_3047286_gDNA_ID_1621184_Annot_ID_174371 3000 nt of promoter + ATG
tatttaaatatgcgatatagagcaacaaaagaagtatataaataaagaaaattaactttgaatacagtaaatttagagtttttgaatgtaatgtccaatgaaaaatttaatattacctatggtatatattttaaatatatttctttaaatataaaattggaaaaagaaagattcattattttccataaaaaagagcatttatagtaaaaaaaatgtaactagtcaataaagaaaaataaataaatggaaatcttttatttataaaaacagaaacgtattcttaagaaaactgaaataaatattttccttttgaatttaacagatacaaatgaaataaatccaaaatatgtaaaatacatattatatatttcaaaacaattaagggtttaaaggcttttacataatgtacgaaattttatcctagataatgtaatttcttgcagtttaccggtgaagcttacctgaggttccaaaatattgtatacagaaccgttcatcgtggtctcctgtcgtacggagagagcatattcatcgcatactgcagaaccgtaacatcttgatatctcatttgaaaattctttctatagcttcgagagatacatcacattgatgattttgatatttttctcttgaatatcttccttttggtttcgttgttggaagtcgatccgttcaaaagcttcaaactttctcctgaacttgctttcagatttgttaagatcctcataggtttttttacttcaaacttttcctaagtcttaggtgttaagaggcccgtctcaatatatttataagcctttggtaaaatccaaaataaatctaagacctcttagtaatttttttttgaaataaaaatggaccttttttctttaagaatttttttgaattttgtaatggacccatggcatttgccctactctgccatgggtcagagacgggcctgggtgttaagaagggttttcaaagccaaatccattcaaaagcttcaaagtttaacctgaacttgctttcaaatttgttaagattctcatagtttttttttacttcaaacctttccaaagccttaaggaattgatgcataagatcatggacctttttgtcagcataagtgcacattgcatttaaaattatgaggttgattagtgtcctccattattcggtgatggttgatgatatatggtagtgaatgacgatatactagtctgttggtgatatggtatcgatcgatctgatccattagctaaacagaaggatttatttcaccaacattaatgacctgcatattttctacaaagctataccgttcacgtcaacaccatgtcacaagataaacatagttttttgtttgttagttactaataattgaaaggatgtcgttgaatagtcttctgagttcttaattacgtttcaatacaaaagccatgtatcttcactagttttgatattctattattctgagttcttaattatgtttcaatacaatttgttcaatgtataggtattctaaaaaactagaacaccacgtacatgaaatctaaccagtctagtgtcagtatcaacaactttgttttcgttcacctaatatgctcatgttaaacaattggagattctaattgcaaatcaagataatcattatctaaaaaaaccaagaattttgaaatatatgttatattattgttatagtcagttgtgtttttatctttctgttatataaaaaataggtgacatttgtccatatgcgttgctactgatgtttactaactatatgatatcgagttgaataagtattccaataactttgtttttaagtttcgaagctaagatatatatctatagaggaataactaaccggagcattgactacctaattctgctcatggttgtgcacctgccccggcccacccccacaaattgctacctaagttcgttagtgtatataacttacgaaattaaaaataaaatagcttcatctatattatataatttgttatactttttttataatttaggggaaaaacccccaaaaaaaaccatcgtctaatttaaatttgtccatttaataccaatttattgaactctcacataaccacctgactacgacaatatattcgtaacaattaaaaaagaaattgtatatatagtaaacaccatatggttaagttttaactacagctagtgattccgttacggtcgttaattcagatatctaattttgccaaaatttaaaaaacaaaagtttttaaaagacataaaaattaacttagatattttcggacaaatttcataattcagatattaaacggggaaatttaaattagaccgtgttttttgggttttttcctaatcatttataagtgattttttctgtcttgttatttcttatattattagtttattacatgcataataaaattattcatgacaatataaacacttggatagcaaatactttcatgaaatactcaagtctcaacaactgacaattctcctaacaattataagtatccacgagagactttttacctagatcacgttcttgatagatagctttattctaatttagtgatcattactgaaatttgctacatatttaaatattttaatatatatagaaattatagtatattattttttaaagacatttttttattttatattaccaaaatttgaattttcaaaaaaaatccttataaggagatatataatgagaattaagaaaagttgaccaaaaaataaattaataaccatataaatgtatattatataaaagtttctttcaaagaaaaaaacaaaaacaataatatatagaagttgtgcaggtaaagagatgtacaacactttttattaaaggtcaagtaacaactcaaacaagtgaaaaaaaaagaaaacaatttcactttttttggaatgtgtgtctctcttccatttccatatattatataaacaccaaatgagatctcatttttctaataaataagaagaaagaagagagaaacaatg

SEQ ID NO: 8032 - DNA, 3000 bp, Unknown; identical to SEQ ID NO: 8028
  misc_feature (1)..( 3000): cDNA_ID_1810155_gDNA_ID_1621184_Annot_ID_174370 3000 nt of promoter + ATG

SEQ ID NO: 8033 - DNA, 3000 bp, Unknown
  misc_feature (1)..( 3000): cDNA_ID_3047302_gDNA_ID_1621184_Annot_ID_174365 3000 nt of promoter + ATG
taccccacggttgggctgtgtacatctcaaaatcagaagcatgccgcaatcttggcaaaggtatcttctcttttccatatggtgtcaagagaattccttcagtcaacactactgcagcaagacacaacttttcttcatcttcaacagcaggttcaccttccttaggttttaaaaacaatcgatcttcgagatcaccaagagtataagatcctttactagcccaaaagtatggttcttttacaggatctttcccctttcgtcgaagttccctatgaacaggttcacattgaattcctgtatgaacaaaagacagtgtagagactattattacaggttttatagtaaatactttaaaaacgattgtaaatcatgtttaacacttttaaaagcttttaaaatcccttataaatcattcaatgccacttacttatgctttaaaaacgattgtaaaccatgcagacacttttaaaatcccttgtaaatcattatatgacacttacttatgctttaaaaacgattgtaaatcatgtttaacctttctaaaagcttttaaaatctcttgtaagtcattctattcaacttacttatgcttaaaaaacgattgtaaatcatgtttaacccttagaaaaggttttaaaatcccttgtaaatattctatgccacttacttatgttttaaaatcgattgtaaactatgcaaacacttctaaaatcccttgtaaatcgttttaagacacttacttatgcttttaaaatcccttgtaaacgtgtttaacacttctttaagcttttaaaatcccttgtaaattattctatgctagttacttatgcctaaaaacggttgtaaaccatgcataccctttttaaaatcccttgtaaatcattatctgccactaacttatgcttcttaaacgattgttaatgaagtaaaccccttttaaaagcttttaaaatcccttgtaaattatctatgacacttacttatgttttaaaaacgattgtaaactacgcaaacagttatgcaaatgccttgtaaatcattctacgacagttaattaagctttaaaaacgattgtaaaactttattacctgttgtgagatagaactctctcaaggagaaacggataggttgagaatcaactctaaaccaaagagttgatccttttgttttcactctctgctgcatgagatagtgaaagatttttccagaaaatctgattcccttcttagccttcatttttggtcccaattcaactagaagaccaagaaacgaacttctaatcttctgaaataaacactcgcctaaagcttcctctactttactaactaaattccaatccgagtattgttgaacggttcccagtgcaatagattcttcaccttctatgtatatctgttcaggcaatgtaaggatttcactctctgaatccatctgcaaaacatgttatgaaacatcgtcagatctactataaaatcgactataaaatcgactataaaatcgattataaaaacggttaccgtcggatctatcgatatctctggggattgtttgcgtcgtagagaaatgatctgaatccttcagcgaatccttcggagaggaaattcgtcggcgattttggggtttctcagagagaaaattcgtcggcaattttgagtgaaatcggagaggaaattcgttggcgattttgagtgaaatcggagaggaaattcgtcggcgattttgagtcaaaacggagaggaaattcgccggcgattttgagtgaaatcggagaggaaaatcggagaggaaaacgaagaagtttgtgaaacgaatgtgaaacctaatcattcagtaagggtaagacagtcatttgccatattagaaggggtagttttaaaaatagccttcaggaaaaggcatttttacaaaaggttattagaataagggaaattttgcaaatctcccttcttatattgaagggagatttgcaaaaccaccttttttttactacccttttgcaacaatatcctttcatgttgtccatttttaaaaatactcattcccttgaacaaaatgaccaaattaccctcatctaatagaaaaaaggagttgaaaactgaacttttcccgccaattttttggcgccaaaagttttatttcccgccaaaaaaaaagtttccgccaaacttttttcccgccaaaaaaaaaaatattctcgccaaaaaaaaatttcccgccaatttttttttttcgtaacaaatttttctcaaccaaaaaaatgattttaaaaatccttgtaaatatttttttgcggcaaatagatttacaagagattttaaaagagttttaaaagatttacaagagattttaaaatcctttgaaaatctttgaaaacacttttaaaccctttaaaaatctttataaatcctttgtaaatcttttaaagccctttaaaatcccatggaaatattgtaaaactcttttaaaatcccttgtaaatattttaaaatcttttcaaaacaattttaaaccttttaaaaatctttaaaatacctttgtaaatcttttaaatccctataaaatctcttgtaaatcttttaaaacccttttaaaatcccttgtaaatctttttaaaaccttttaaaatcccttgtaaatcacccttttaaaatcccttgtaaatattataaaagccctttaaaatcccttgtaaatctatttcccgcaaaaaaaaaaaattggcgagaaaaatatttttgaaaacaaaatttggtgggaatttttttttcgaaactttttggcgggaatattcattttggaatattttaggtgaaaaaatattaatatttcattttgttaacctaaaacaatttccaaataagggtaaaatggtcattaaaaaattaaagagggtagaaataaaaatggataaaacaaaatggtaaagttgaaaaggggcatcatgaaaagggcatttgaaagaatttttctatattgaattggatattgttacttgtattt

SEQ ID NO: 8034 - DNA, 3000 bp, Unknown
  misc_feature (1)..( 3000): cDNA_ID_2145113_gDNA_ID_1621184_Annot_ID_174352 3000 nt of promoter + ATG
ggtattgaagcttaaaattgcttaaaagtcattccatttagccaaaagaacctttaagtttaggatctcaccaaaacatacaaagatccaaccatcctatatagataattaaacaacatcctacataaaataagcattcttaaaagacataatcttaaatcctagttcttgtcaggctgcaaaaacatcaaacactttgttagtccatggagacatcatgaaaacagtctgcttgggtgcttcctctttgcctttgccacgacccttgccacgagctttagaaggatctttgccttcaccatttttggttcctagaggacgccttcgagcacgtcatgttcccttttgattagctgttggagcacttgaatgttgcaaaatttgagtggactgactttgagaacaagttggtgtggactgactttgagcttgctgccacctccttggtgcattgtgtatgctccatggatcatcattatcctatgacaagtcaacaacgcaaatcaaacatagctaagagtagacaaattatagggaaaattctagagtaattaccttactcttccttggtctccctcttttgcgtggaggagctgacttatactgtggcatttttgcaggttcctttattatgtcctgattacttgcagttagtacaagtcacagtacctccttctcttgattcctttgtcagataagtcgttgattcacctggttcaagtatcctagcaaagttcttaggacgccctcttcttccttttatcaggcacttgaattgttccttttcctgtcttcttccacaacatttttccattcaatggttctatgtttttcttgtagttggattgccagacagttgtcagaaagcggctatcaacatagctgcatagaagaacaaagtatatcagcaagcatatttacaactcaatgagaggcgagttgattaaaacttatgcttggatctcggttatgttcattgatgacaaagattgcatgtggacaaggtattcatgtgagattccatttgttgcaagcacaagtcatgtggaggatgttaactctaaagcttccaataccttccaacacctcataaacgtgctcactacttttgaggacataaccgaatttggctgacttgcagtttgcttctagtatctccattatatgaggtggaaactttgtcttgcatgtagcagtcttatcccgtctcttggaaagacgctttattgcttgtcttcttacatcttcaagcatatttatcacaggtttcttcctcgcttctctgattgttctgttgaaactctcacataagttgttgctaacatcctcacaacttgagcttgaggaaacatgtctttaactgcattgagcaatcctttttgcttatctgaaatcactgtcaaatctccacctaaagctaaacccaaacccttcttgagatggtccacaaaccaagcccatgactcattatcctccactctaactacagcccaagctataaggtagattatattatctacatccctccccacagctgctagaatctcacccttcaatttccatttcaaaaatgaacccatctaggccaaaagcaatttttccaagttgttcttaacgcattaaaacatatataaaacttgtcaaattgctgcttactatcagctttgggaatggtcatgatgtctatgtggatacgctcattagatatgtgcagttcagcctcataattgtatagctttgcaaattgttgtttctgcgtttctatcaccaaatttaaagccatcctgcttgctttctggcatatccacttagagacagagattgtgtacctcatcattatctcatcttcgatgtcagtccaccacaaagaagggcgccttcttgcttcttctctgaacatccgagcaatgaccctatagtgacccgcataagggcatcgggtacggcaaaggaccgaatgagaaaaagttgctcgaatgcatggccaatggaccgcatgtgcccaaaaaatgctaaactgtcaaagggcaaacatgggcaagaatgggcacgaatgggcaaagatgggaaaagtttggcatgccgcgggcgaagtttgccacgctggccgcggaaccgacatgtgtggacacctcacttgcggtgccatgcgactcaagtcaccaaccttggagtcgaattcggctgagtcttggagccgaagctgatggggcaatggaatgacacccgtagacacctgtcgccacgccatcgcccgagacacctgtcgcatgtgggtgcggcaactgtctagacatgtggcagcgggcggtgctacatggccgaccttgggcggactataaaatgatgctattctcagcccattttcatttttgaaggcgagagagactgtaaggctgtctgaccgataactcgtccgaaaccaagaaaacttgcccgaattcagtaaatcttgcccgtggtctaggaaagtctgatcgtaagtgcaaaataatcgtatgtggtcaagagaactcgtcctagtgagaagtcgtcgaccgtgattaagagattctgcccgcgactaaaaaacttaccgaatctgtcagttgtggtcgaattgtgtttttgtttgcatgttttctagagctagtctttagattatatgcatgcttactcacttaaacttaactaatcagaatttggcttaagttagaacttgactcttaaaataatatgagcatttgacgaacttgatagttaatatcattaaggaatgaaatgaactagtgcatggctaggcttagtgaatatggactcaactaagtttacttgatgatttattattttattcgagggcgttagaattcttggtatcagagcagggttatgcgatgctcgtggacactcgggttttcaataattttaccaagtaaatttgagtcgcagaatgcaacataagattttggttgttcttcttttagatgactaagtgggggataggtttacctcgttttgcag

SEQ ID NO: 8035 - DNA, 3000 bp, Unknown
  misc_feature (1)..( 3000): cDNA_ID_3047286_gDNA_ID_1621184_Annot_ID_57425 3000 nt of promoter + ATG
ttaaatttgtccatttaataccaatttattgaactctcacataaccacctgactacgacaatatattcgtaacaattaaaaaagaaattgtatatatagtaaacaccatatggttaagttttaactacagctagtgattccgttacggtcgttaattcagatatctaattttgccaaaatttaaaaaacaaaagtttttaaaagacataaaaattaacttagatattttcggacaaatttcataattcagatattaaacggggaaatttaaattagaccgtgttttttgggttttttcctaatcatttataagtgattttttctgtcttgttatttcttatattattagtttattacatgcataataaaattattcatgacaatataaacacttggatagcaaatactttcatgaaatactcaagtctcaacaactgacaattctcctaacaattataagtatccacgagagactttttacctagatcacgttcttgatagatagctttattctaatttagtgatcattactgaaatttgctacatatttaaatattttaatatatatagaaattatagtatattattttttaaagacatttttttattttatattaccaaaatttgaattttcaaaaaaaatccttataaggagatatataatgagaattaagaaaagttgaccaaaaaataaattaataaccatataaatgtatattatataaaagtttctttcaaagaaaaaaacaaaaacaataatatatagaagttgtgcaggtaaagagatgtacaacactttttattaaaggtcaagtaacaactcaaacaagtgaaaaaaaaagaaaacaatttcactttttttggaatgtgtgtctctcttccatttccatatattatataaacaccaaatgagatctcatttttctaataaataagaagaaagaagagagaaacaatggcttatcgtcaaattttggccatagttttgtttctttgtgtgtttcaattcttggactgcactgttagctccgccgtagaagagaatgggactgtgtttgtgtacggaagagccgccgttggaacaatagatgaagacttcatttgcgccaccttagactggtggccaccggagaaatgtgactacggcagttgtagttgggaccatgcttcaattctcaatctggtttgttttttctttttttttttttttttttttgatcaaattttgtttcattttcatgtttttccgtcgaaaacaatgcaacttgcatttttgatagaaccaaaataaaaaaggttgtgtatttatttcgggttggttaggtagcaggaatccattgaaagatttcttaggtactactactcttcattaagcaaatagaatttactaattgtagaaaatgtagagataaaaaaaaaaaatcatttttaccatttatggaatgtgaaagtcaaaaatcaagattcggcaagtaaaagtattcctttgttttgtcatcatatgccattttaacaatagattacaaacaaaatttggtcatgttaatatgaagtaatttattcgaagagttgattagagaaatatgaaatctaatgaaaaatttggtcgatcatcttgcaggatttgaacaacgttattcttcaaaatgcaatcaaaggtaatcacatgattcttgatttatattggttaatgttaggatttgaccattgttgttccaatttccaaaaacacagcatttgctccgttgaaaataagaataggaggaacattacaagacatagtgatatatgagacaccagattcgaagcaaccatgtcttccttttaccaaaaactcttcaattctttttggttacacacaaggatgtctacctatgcgtcgatgggacgagctcaatgccttctttcgcaaaaccgggtaccttcaaattctcttctatctgtctctttccttatctacttgtggtttgagtcggagctaaagtcatcttcaaattctcttcttacttttcttctctctgtctcttttcttacttacttgtggtttgaatcagagctaaagatatcttcaaattatcttctttcttttcttctctctgtctctgtccttacctacttgtcgtttgaatcagaactaaagtcatcttcgggctgaatgcactttctggacgttccataaaatctaacggtgaagccataggagcctggaattacaccaatgctgaatcgttcatccggtttacagcagagaacaattacaccatcgacgggtgggagctcggtaagtcactttacaacataacaaagaatgcataagcctgattgaattctctactcatctccaagctggttttgcttcttttctcaataggcaatgagctgtgtggaagtggtgttggtgcacgagttggtgcaaatcaatatgctatagacaccataaatctgcgaaacattgtgaaccgggtttacaagaatgtgagtcccatgccgttggtgataggtccgggtggcttctttgaagttgattggttcacagaatacctgaacaaagcagaaaactctctcaatgctactactcgacatatctacgatctcggtccaggtaacccgaatactcaactatctttcgtttcagatcctgcaggttcatcatttcccttacctgaatggaaagaaaacaatattttgattgattaggagtcgatgaacatctgatagaaaagattctaaacccttcatatctggaccaagaggcaaaaagttttcgcagtctcaagaacataatcaaaaactcctcaacaaaggctgtggcatgggttggtgagtccggtggtgcctacaacagtgggcggaatcttgtctctaatgctttcgtgtatagtttctggtaagagtagatatcatgacagcaaaaactaaggttatcataagtaatacattaaaagcatttctaatgagattaaactgtgtgatggtaggtacctggaccagcttggtatg

SEQ ID NO: 8036 - DNA, 3000 bp, Unknown
  misc_feature (1)..( 3000): cDNA_ID_1989594_gDNA_ID_1621185_Annot_ID_57867 3000 nt of promoter + ATG
agagggcaaggaagagagcgttgatggaggattgggagatggagtattggcctcatcggattccgtatgaggagattgaatccggcactaaggggtttgatgagaagaatgtgattgggattggcgggaatgggaaagtttataaaggtttgttacaaggaggggttgtggaagttgcggttaagcggatttcgcaggagagtagcgacgggatgagagagtttgtggctgagatatcgagtcttgggcggttaaagcaccggaatttagtttctttaagaggatggtgcaagaaggaggttggtagtttcatgttggtttatgattacatggagaatggaagtttagatcgatggatattcgaaaacgatgagaagattactacccttagttgcgaagagagaattcgtattttgaaaggtgtagcttcaggaatattgtatttgcatgaaggatgggagtctaaggttttacatagagatattaaagctagtaatgttttacttgaccgagatatgataccgaggcttagtgattttgggttagctcgggttcatggacacgagcaaccggttaggaccacgagggtggttggtacagctggctatttggctcctgaagtggttaagacggggcgtgcatcgacacagaccgatgtttttgcttacgggatattggttcttgaagtaatgtgtgggagaagacctattgaagaagggaagaaaccgttgatggattgggtttggggattaatggaaagaggtgagattctaaatgggcttgatccacagatgatgatgacacaaggcgtaacagaagtcattgatgaagctgaaagagttttgcagcttggattgctttgtgcacatcctgatccggccaaaagaccgtcgatgagacaagtggttcaagtgtttgaaggtgataaggctgagatctttgaagcagaaagtagtgaagatgtcgagtcatggatgttgatgaagatgggatctcgtggaagctcgcgagagttttggtatggaagctcatcacatccgacgatagagcagattagacttcagtctttgtctgtgtctctttcgtcttggaacagctcaattttagaagggaggtgatgatgatgaagaaatggcttgaggaacctaaagaatgtagttatttttgtggctttactttgttacttgttttgtacatatacgtatttgtaaacgcatttcattatacatgtatttttttattttaatttttttgttgtgaattgaaactagttttcaatttattatattttgatgtgtatataaacaagttttgcatccgaagttaaatgataaataatttaagagaagtacttataataatgctaacaaagtaaatgtgtagattactataaaacatacttttttactaaaataggatttatgttcttaagtattgaacatgagaaacatgttttatggtttttttttttttttttttttgtcatcatgttttatgttcttaagtattgaaaaaagtagtactagtatctggttgatgaataaaagattactctaaaacatgtttttactaaaagaggatttatatcaataaagcttggttatatatatatgaaaatatatatatatttttttaaaaaccttattcctaactacacccttatttatttatctaaatttttatttatttcaaaaaagaaaaatacaatacaaggctttgtacatcattctcttattaaaaagtttagatctcacataagaagttctatcgaaatttacaattttaatatacaagattacaataaaaactaccaggtttccgatcataaatttcagataatactaacagaaagaacgacaatcacatccgtcgatcaaagtttttgtaaaagatccttcgatttttttgtatacataatgatattatttaaaattcaaatatcatatacatatttacaatttttgtatgtccgcctatctatggggatcttatctagttaatcaatgaaatttggttttatatataccaaaaaacaaacattctgacaaggtctaatttgcatattaatgtaaacacatcatataaaaattcctaattgtcacgagttccaggtaatcattcatatactataatgcatatggttgccagagaggtatatttaaaaagcttttcatctttggaaaaagcataaagttatgttcatgaatcttataaaatgttttaaagatagtccttcacaaaacaagacaaatcaaacgacacaaagattcgatgctgcggtgtcctaaaaagttctctttatttggagtctcaaaatctaattcttatttgttttcctcaaaacactttctgtgaaaatttcgaaatgtcactacactgtgagtttagcaaaagagtttttgttcattacgttctaattctatgattatctaatagattaagtgccatcactttcattcatgagcacaccatcactagttaaaaagatcaagtgcctttctcagttaatcctaaatcctagttaatgtggtgtcgttttgaccaatccattaatacgttgccgttttaaaatcccaccacgagcataatataacggatataatgctatcttgtcttgtttctctctagatttcagagattctctcgagtttctgacacgcgcgtactcgcacgtgtctcatcactacactaaccctacacgtctccctttcgtggacgctccgtttacttaatctccaccatcagatcacatcttagataaaagcctaaaatcaatctaacggtcactagctcaaggagtatgtattattgtacgacgagacacacatcgttatctctctttattatttggtaatatcataattattatctctatgcacagtttttgtttcgtcactgtctttgaaacttaaaagaaaagagaagaaatagaaagaaagaaaaaaagatgaaataattttgaaaaaaaaagattcgaagcaaagaaaccgttagccggcg

SEQ ID NO: 8037 - DNA, 3000 bp, Unknown
  misc_feature (1)..( 3000): cDNA_ID_1989587_gDNA_ID_1621185_Annot_ID_57876 3000 nt of promoter + ATG
acccaacacctccatatgggaaatttactactagactaccaccacgttgtttacaatacaagaaaatgacatgaaaacgattgtagtttataacattgaaccctaataggaaccatgaatccgagagagaacatggcaaaaactcaatttctcattaatgaatcagaaagtttgttacatcaatgtatagacaacaaaccaactaaaccaaaaataaaccagagattcactttaattagaatgaataaaccgggactataccgaacccttaatgacttctattatgtacaaatatacttagtatagaaactatacacaatctaataaaccctaacactttcgagatgatttagaattgaaaaattagtataaaatgcacgttgaagaaaaagcacgattgacatatttttataaatagtaaaaaaatcttggtcaaattcgagtagacaaccttatcaaaaaaagaatttataaattagacgacaaagtgaagcaaaaacagaaaacgttatctagaaaacgattaaatgaaacatcacaacctaatttcttcgtcaaagtaaaaaacatcttatgattcataattatccaacggaaaacgacacagatattataaataacttttccaaataaacaaaaatgaattaaagtaataaaatatccattcctcttcgatcatatccacagttcccacaccaacatgtcgcgaaagttcctaaaaccgccacgtgtcagtcacttatccaacagtaatccaattattcgtcaagcctccggtttattaccgtctaaaccggtagctcctcccaaatcatatggctcactcacttctccgtctatataaacaaaacatctcttactcttcacaaaagaaaaaactctcttcggaatctgaaaagccataaatcagcagaaaaaaatcttaaggatcggaaattttataatcggatgaatagagtgattagtcagttttccggtaagttgatgaaggagaagagtgttaccggtgtaagcggcggagatacgactttaagatctgccgtcaaagaatcggtctcgtctccacagagtgcgtcgtcgtcgtcgtcggtgaggaggcttaaaggagatctggaatcgagtcgatttggtgcggcggcgagtgagaggctgaggcaagcggaggaatctttgaggacggtgatgtttctgagctgttggggatcttgttagatctggttgagaaaataatagatgagaaaacgaaaccaaaacgtttctgtttgtgtttttgagttttggatttttgttttctctgtgaatagttttttttttttttcgttttctttgtactttgtgttttatgtaaatcatgtataaaatgaaaagtaaatcaatgaagataatggtttgtcttcaccaaatcatgtatttacatgtggatttgaactatagattatacaaaaaaattagtttgataaagacgatgactcaaaatgtaataagtatgttattttggattttaataagtcgatttttagataatgtataattggtaaatcgttaaataaatcgatatataaaagttgtattctaaactcagcaaattgtcataccatgcctaaataaaaatgctgaaataggtagatttggtccattttggttgatactagaattgtttgaagtctacatttacgattataataatggataacaagatattttgtaagatgtgagatggtcatatagtttggagttgtcaagctataacgttaaaatggtacaattatttatcaagctaagcgaagatttacagcggatttttgacgcatttttaatcgtttttgataggtctgggcaaaatatctaaatctgaagaaccgaatcaaattcgataaaaatttttgatccaaacttgaattcaaaactttaaaatatccgaacggatcacaaatttcaaaactcaaaaatccgaattcgaaaccgatccgaatatgaacccgatcaagtatccgaacatatccaaaatatatacataaaaataatttaataatatttacacaacttaagttcctaaaatatttgaattttaaaatattttgtatattttggatacttaacctacttttcaatagatttggatagaaaatactcaaattttgttagaaaattttatatatttttaagtaatttaaatattttgatacaaaattttgattttggatactcgggtgaatccgaaaaacagatccgaatctaacttagagtcttaggtggtgttattcaattatggtgttaaagtcaattatttaagctttagatttgttttctgatattgcttttaagaatatgtttgtatgaatttcaaaatctctgcaatatgtcttggattttgattttaatgatttactcatgaaactccaaagagctttcatttcaaatcaattaatatacaaagattttaaaagtcttttagttttgaataacattggattttaatgaaatatttcaaatcttaattgaataacaccaaactttagaatctattaagcatgatttacaaatatgagttccaataacactagattttaaagctggatttagaatcattagttaaataacagtggattagtgtggatttcaattctattaaaatccattaacgaataacacccccttacaatatccgaatggatcttagatttctaaatttggaatacccgaacccaaaaaactcgactcgaacctgatccgaccccaatccgaatacccaaaaacccaagccttattttttgagtgtaactcaaccgtttttattgcttttcagaacgcaatcactacaacaaccaaaaagtaagctttaagcgaatccaaacgctatcgtattaaacgctattactatctgcgttttagctcttcatcttcttctccacttcagatgactttctcgcttaataaaaaaacactaacccaatcaaatccactttaatccttccctctctcgcgtccgattctccgatg

SEQ ID NO: 8038 - DNA, 3000 bp, Unknown
  misc_feature (1)..( 3000): cDNA_ID_2034963_gDNA_ID_1621185_Annot_ID_174407 3000 nt of promoter + ATG
gtatacaatgaccattttttgaaaattggggaattaaatgacatttttcccttagtaaaatacttaaataaactggatatttacttaatcgagaagaagaagatgttgttttgttttgagaaatttatttttattgggataaagaagaaatttatgcagctggagaagaactttttgtaaatcatgcctaaattaatgaaatgaaggaagtctaaaagtaatatgcatcttcgacatcactttatatgatatatatgtttgatcttcaatcatcaatttgtttatttgctgaaatcagagaacaccattagtctcaaaatatgttgacttttgcggtgaaattgaagctaaagagcaaagaagtattctaataaaattgctgacctgctaaaaatgtttgtttcaacaaaaagtgtcaaataataatcaagtagatagtactctaagaaaaaacgaatgagaagcgatagtcttcttgtttccttttgagtggtagtgatgattacaccttgttgttggtggttcccttcctcttcttctcttttcgtttgctgttcctctctcttcttctgcgtcttgcaatgggatcatcaatttgcactaaacttgaaacgtaacagctagataacataattgcggtataagatcttgcagtgtttccaagactattcatttttttcaagtagccatcatctccaatgatgtaagaattgatgtgagaattagatcttttgcagtcttcagattcgactttatcaataaccaccgcgagtttcttctcctcgtcaatgaagaaattgttgtaatctatatcaaaccaaaaatcaagagcaatgagttgctcaatataacattttaagaaggaggtccacgatagtgcattgggctctatcttagtagtaatccaaatctctatcatagatgtatccaagtgctgatataaggctacgagtttctcttctctaacccaggatagactcatccaaccatgctgaaaaggtggatcaagaagctttccaaatctttctgccgtaaaatcaaaacagattagtaaatttggggtttcatctatcgtcctaaagtaagtatttccctttaccgatgcactctgcccatcatcatctatatcccacttgggaatgacatcaaaagccctccatgaataagacttcaaatcgtaaatttcgtatgagccctgtttattatcgagaaacctcaatatcttgtggtttttgttgttgtcatatctgagacaaaacgtggaatacatagtttctgttttgagttggatccacctgatttgccccaaatacgggttccaaatcacgagcctagtatccgtggtgacacataacaatataccgccgcagtaatacatatgagatatctcaactttattaagaaaattaccaatctcctttactgataagttaacgaattcttcaccattttccttgaaggttccagagatattgaacctcattgaacgaagcctataatcagacagcatgaacccttgatgaaactgctgttttggttttgctttacatagaatccgatctttggataaagcgttccatcctttgcaagtggatctcactgctcctagggaagttatcggaaccctagacaatatctctttcaccaaatcctgcgtaagatcgaacatcatcgtcattattttcttagtatgtagaaattagggttttcaactctttagctagcccactcttttctacgattattaatataggtttctacaagttattattttattttttttggtagtaattaacgtaaacaagtgtcgggccctttttaataactttcactaagataaataatatgcggtttctaatcttcgggaaatgttaaatatacaaaaaaataaaaaggacatgtttcctcactaatggaaattccgtatgtgaaagtattctctttctgtatttagttttttattttggatcaaaacctgctctatatttctattattaactttctacgacacaactaccacatgaacaaagtctaaaacataaaaattaaggaggtaaaaccgctgtaactgtcagtgaaactgcttcaagtccctgcggaaacattaatacataccgataccgccgaatgggattagggcatatggttatcacacgaccactcttaaattttaaatactcatttttgacatggttaacgacacgaaaccggttaacgacggggaacagaatgatcaaatgacaagttggagtagacatatcttgtattttctgtagtgagcaggtagaagaccgagaacacctattctttacatgtggatatgctaacgagatttggttagggctaagcaagaaggttatgggtcataattaaattctcaacaagatggaatgatattcaaacagtcctcatagacatgtctttggggatgcattgcctattcttaacatggtacaactttcagctctattcaatttggagagaacgaaacagttagagtgaagaagtattgatctatatgctaagtataagagactctctaagtgtttcagaaggtttcagggtcaactggttgacgagctaaggagatcgtgacacgtggagcgatccaatccgtttactctcaacggcattttcttatcctttactcgtcttattctgtttcctttcagtattgttgtttctctgtagatttgattgatttagaaatttgttgaataagagaagtgagagagagaaaacagaacgattgtagagagagaaagctcgttttgagctaagtgcttttagtgaattccggagacatctccggtgagacgtagggttcctcatcggagcctgaactcgtaaaatcttgtgtgtctcttttaaaggttctttgtgttcaatctcacacgagtgtccgatcgatttcgttagtgttcttgagggttcgaggatcacaaattggtatcagagcccaggttctgagctcaagaatttcagatcgattcaaggatg

SEQ ID NO: 8039 - DNA, 3000 bp, Unknown; identical to SEQ ID NO: 8037
  misc_feature (1)..( 3000): cDNA_ID_2025014_gDNA_ID_1621185_Annot_ID_174404 3000 nt of promoter + ATG

SEQ ID NO: 8040 - DNA, 3000 bp, Unknown
  misc_feature (1)..( 3000): cDNA_ID_1989590_gDNA_ID_1621185_Annot_ID_174396 3000 nt of promoter + ATG
taccgtcgtttcaccttatctatcatgttttgatatgggggaatgtctcttttatttgcattttaaactttataatctttgtgttattttttatatatttggtttgatttaaatgaataaaaacaagtctttatctaaacacaaaaggacccaaaaatggtcaaatttgggtaggtctaagagtgggttgtcaatctccaactaaccatgttttgatgtcccaacaagctcttgccttcagatttgctagtcctaattattctttgaaattataattcataataactaatgacctaccaacttcatcatcttccactaatctaccgagtaacatgttaggatttagccaaatgtcatttccttagttttggttacaaccacaataaaaattattatagtaccctatatatatattatcattcaaccgtagaacatgcacaacgttgacaaaataccccaaaaatgtcatttcctttgttttactcttattttctaaacaggtgattttggattaaaggttacttaattttggattttattataatcgtcatgtaaattttctaatggtcaagagaagaagacttcaacgagaaacgacttttttggcattgaccaacaaaaaagtgccactaaactaccatcatgggagtaattacaaaagctttgcgtagtcaaacattcggacatcaaagacaaaaagtacacaatataacaattttaggtggaaaaaacaaccaaaaacaaaaatttgacgcgttttcttgttaacaggagtattggttaatacttaatagctttaactatgcattgtaaaaataaatcataaaaggatcaatgacgatcttgattgtttagaaaaaaaaattatttcaaaaagatttattttttaggttttcaatgcaatagttattagttataattgataaattgtaaactttaatacaaattattgaatatcattggtttagagttattgaaaattgtaaatcacaaagaacaatacatttaaaaacaacatttaatatgttttcttaatatttgtgtttttcctaaaagattaaacaaaaaagaacagaaagaatatgaaataagaaaaaatgcactagctttttttgtttgagttaaaaaggactatatttattaagaggtaaatagtatatcatttttacatgttttaacgctatgtaaacgtgattaagttacttgttatcaaataatcaaaattttatgattttcatgtttttgaaaaatgatattgccgtatactgtgaatgtgtaaaaatataggtgaaaaaaacaaacgccaacaatctattatgcttaataatgactcatatataagaatagtttgctcatttcttatgctttgttaattgttgttgtatgctaagagaggattgatgtttctagtgatgtgctaggaatgttctcatgtataggatgtatcggatcttgaggttaagaaatagagattcacatttccattcttaacacaacataaataaggattaaggctaatgaaaaagagttcacatattacacattttactaattaatcatggtgattagataaaggtaacaactaaaagtcattttaaccgcactcaatattacgagcttgttagaacactgtaacacaagtgttctcttccagtttatcaatggaggaaactggtaaaatcccatggacgatcttcttctctcatcctctgttctcttgtttcatttcactctacactatatttcttctttatttccctcaagattctcttcgaattcttatttcccatgtccctctcctcatcggagctttcttaatctcctgcctccatctcgggtcgacccggaaatccattgcccgacccggaagcaatgaggattcgataggacctgaactcaaaacgggtctcggtttaaacccggattttatggaatggaactttaaattgggagctccattggaagttattcacaaagaagaagaagaacagtcgatgacgggtgtaaaagatccgacccggttcgtgatgatcaagaggtttccatcgttatcgatgtttaacccggaatctgattccgaattggaccgcgatttcccggttatgagtgaaaatgatccaacccggttcgtgaggctggaaaggtcaattaaaccggaatctgatatggattacgactccgaattggacaacaatttggttattgatgtaaaagatcgaactcggttcgtgaaggtggagatattcccatcgttgtcaatctttaaaccggattcgaattccggttcgccggagaaattgcgttgtatatacgaaatcaaaacggaaacgctttttgtagttttatattcctggagaacaatattctaacaacttgttttggcagcaatattctgatttctgagtataatttgattcgtcaagtaaaatctaattttataattctcaacaaacaaactcgaatttgatttctctaatgtgtaatgtcgtcacgatttacgtataacatattaaaagttgtcgacaaagaaaatgaaatacatttccaccaaatataataagtaacaacatggtcagattcagagaggacgatctggcttggccaccaagattgtttgacaagtatttatttaactactatactttctcttccacaatattaataatgttttaaatgtcattattaatacgtgacgaaactgtagctctgaaataaatatattaacaaaacaaataaatattctcaaccaatcataacctcgtatttgtttttgtttccatttaaattttattttgactcgacttttacacgcatgccacgtggtcaaccaaaacgtatgacaaactctacttctccaccgtcacaatcatctcctggccccctctagatctctctctcttttcctccttagattaaaatttctccaggtttcttggcgttactgtgtgaaaaattcttcttcttcttcttctcagcgattgaatcgaaccaagagcgaaa

SEQ ID NO: 8041 - DNA, 3000 bp, Unknown
  misc_feature (1)..( 3000): cDNA_ID_3041167_gDNA_ID_1621185_Annot_ID_174384 3000 nt of promoter + ATG
ccgagctgagaatgaggatggaatttccaccctattctaccttcaaagaatttatgaagatgaatgggtgaattttctggagcggatgcgtagagagggagcagagaatgagaatgatatctggtcaaagaaggttagagatcttcgcctctgggcttcatataggggacaaacattgtccagaacagtgcgagggatgatgtattattatagtgccttgaagaaacttgcctttcttgattctgcttctgaaatggacatcaggatgggaactcagattgcccctgaggcacgccgttcgtactacacaaatgatggtggggataacacactgcaaccaacaccttctcaggaaattagcagaatggctagtggtataacccacttgcttaaagggtctgagtatgggagtgcaatgatgaaattcacatatgttgtggcatgccaagtttatgggcaacataaagcaagaggggaccatagagctgaggagattctgttcctgatgaagaatcatgacgcccttcgtattgcatatgttgatgaggttgacctgggaaggggtgaggtcgagtactattcagttcttgtgaaatttgatcaacaacttcagagagaggtggagatctatcgtatcagactgccaggccccttgaagcttggtgagggaaaaccagaaaaccaaaaccatgctctaatctttacacgaggagatgcgattcagaccattgatatgaatcaagataaccattttgaggaggctcttaagatgaggaacttgttggaatcattcaagacttactatggcattaggaagcctactattcttggagtccgtgagaaagttttcactggttcagtatcttcactcgcatggtttatgtccgctcaggaaacaagttttgtaaccttaggacagcgtgttcttgccaacccactgaaagtgaggatgcattatggtcatccggatgtatttgatcggttttggtttgtgcctcggggtggaattagcaaagcctcaagagttataaacatcagtgaggatatatttgctggattcaattgtactttaagaggtgggaacgttacacaccatgaatacattcaggtaggcaaaggaagggatgtgggtttgaatcagatctctatgtttgaagccaaggtagcgagtggtaacggtgagcaagcattgagcagagacgtttacaggttaggtcacaggctggacttctttagaatgctctctttcttctacacaacggttggctactatttcaacacaatgttgatagtatttactgtttatgcattcttgtggggtcggctttatctagcacttagtggtgttgagaaaatagcaaaggataggagtagcagcaatgaagctcttggtgcaatcttgaatcagcaatttattattcagctaggacttttcactgcacttccaatgattcttgaaaattctctcgagcgtgggtttcttccagcggtttgggacttcataacaatgcagctgcaacttgcatcgtttttctacactttctccatgggaactcgaacccattactttggccggactatactccatggtggagccaagtatcgtgccactggaagagggttcgtggtggagcataagaaatttgctgagaactacagattgtatgctcgaactcatttcattaaagctattgagctcgcgattattctgttggtatatgcggcttatagcccgttggctaagagttcgtttgtttacatactgatgacgatttcgagctggttccttattacatcttggattatttctccatttctgtttaacccttctggcttcgattggctcaaaacagtaaatgattttgatgatttcattgcatggctatggtctagaggcgggttgtttacgaaagcagatcagagttggtttacgtggtggaatgaggaacaagagcatctgaaaacaaccggagtgtggggaaaactgcttgagattatacttgatcttcggttcttctttttccagtacagtattgtgtaccatcttcgcattgcagagaatcgaaccagcattggtgtatacttaatttcttggggatgcatcatcgggattgttgcgatatacatcacaacaatctatgctcagaaaagatattctgtcaaggagcatataaaatatcgattcattcagttcttagtaattctccttacggttcttgtggtcgtgatgatgctgcagttcactaaacttacagtagttgatttgttgataagtctcttggcttttgttcccacaggctggggattgatttctatagctcaagtactgaaaccgtttctgttatcaacagtggtttgggacacagtaatctctgtggctcgcttttacgaccttttctttgggctgatagttatggctccagttgcattgctttcatggttgcccggttttcagaatatgcaaacacggattttgttcaatgaagcttttagcagagggttacagatttctatcattctcgctggcaaaaaatccacttgaagcaaatattgggtatggttcagaataagatcttctttatatgttacactgattactattaactaaacatccattaataagactgatttcatcatatttgcagggttcttaaagtttttgaaatgagttggtctgagaaggttgggcgatatccttttctctagcaaaaaaagttttgcttgaagcagcttatggtagcctggtttaatatcatcctccaccgttttgtggcattgctccaggttaagcctggtttttcctcatggtggttagcattttggagttgattgtttgaccttggtttggcttgtttataaacatataaggtatgtatctatcttcatttgctttggtgactgattttatttgtcaagaccttacgattaaatacataattttgtcatatttgcagggttcttgatttgttgagagatggtaatatgagggagcttagaaaa

SEQ ID NO: 8042 - DNA, 3000 bp, Unknown
  misc_feature (1)..( 3000): cDNA_ID_1989588_gDNA_ID_1621185_Annot_ID_57874 3000 nt of promoter + ATG
tttaacttgttatttattaaagatatggagtgactaaaaaattttcaattgttttatttatattaaagtggctaggaaaacagagaaattacataatcaattgttgaaaagttgaatttgaaaaagtgaatctagaataagacttgtttttttaagtgtcgtcaacatctgtgacgctgataatatcagcgaaaccaactttcttgcgaagccggacaactaaacatgcggcgtcgacaccttctccgatcaccaccactttgtctttctcttctccttctattcccacaaacgtcactcctgctccgttatttaaacatgagaatatgagatcattccatcaagcgaattagaacgaatataatttgctatccatagcatcagtgccggctctaggggggtgccagaggagcaaaagcacagggtcattaaatttttttccaattttacttgaggttttagggtccaaaattttcagtaattaaaaaacagtattaactaaagccaatttctataaatcagcacaaggtctttaagaagtttgagccggccctgcatagcatagtcaaatgccggttcgatatatatatttggattctaattgatatcttaccagtggttttggctccgatcttgagggcttctgaacgacatttgtcgcacctcatacttaccgacatcaagattttctgctcatgaaaattccaatattacaaataataatactgctacgtatatacttcatcctaaaaccttccgtatatatgttagacttttagaatacaaatgtttttagcgtaccttggccattttggaacctcttggagaaaatgaaaccttattttttttgtccttttggtataaatgattactataatttacgtgtgtaaatatagaagtgcttctgtctttgtctcattttcttatggcacattgcttaacatgtattaatatgcatattttatttgtactattatttgctacgaaatcgcagagtaattttcatgcaactgcttcgtagttaatattagtataaatgttgacgtttaagtggacaatataaggtattgcttgactcataagggttagatttggttaggtaaaggttagatttttatcatgcacatctaaaaagtcagtaccgtgaggaccacgaccggtcctgaattataaaaggcccgaaaggaaactagtcccttatttcgtgtttctgaataaaacaaattattaaccttaaaaccaaataaaatttagcaaactgaaaattgtaaacaaagaaacggcactacatcctacttgcaaagaggtgtcgaacggaccggcccacaatggccattagttttagatggactgcaacggagcagtccgctaggaccgcagacaaaataactttctccaggttcgccctgctaaacccaacaagtttatggaccgatccgtaggcttagtttttatatttaaaaaataataaatatatatattttaaatattaattttagttatttttaatttaatttaatttttaataaatactttttgtaaatattacaatttaaaaaatttaatttcttcatattgttacatattttacatattataataggattcataattaagtaaaattaattattcttacaaattatttatttatttttattgaatatttgtagtctgcaggtcaatccgccaaaccgtgggtcaagtccactaaaatccgtaatccgttttggccgatccgcaagacccgttatttttcggatatataatatagtgtccaaacccgctccatcatggtactagcccgtgagtctttggcccgcttgacactgatacatacatagtttaaaaaaaaaaaagtatattcgggtaggtccaaaaacgggttgatcagttcgcgggtaaaaccggttcaaccaccggttaatggtttaaccgtcgttttaagttggttttgtttttcctcctgaaacgacgtcgtgtctctctctctccctctatcttttgcgactctcctcgtcttctctgttcgtctgccatatgagtccttcccaagcccaacttttctgaaattgaagtgagtttcttcccgaatcccttaaagtttcaaacttttcaattaacttattcctctttctcttgtttctatccgaatcgtgtgagggttttcattttctatgctctgatttggtctcaatcgatgtacgtttataatgaatgtgtgttctaaattgtaataaaaaatgactagtaggtactagttgacagctctccacagttgaaaatctctcttttgtatgaggtaccaattgacagtctttgagtctttccttgttgttttgttatcaagggttctgagctttgtgtctttaggttaattttctatgttgtgttatggaaaattggtcagtgaatagccaaaccaaagattgtgaaatctgcattttgattttggtgaaaaaaactgtatagaaatgtcttaccctcaagaaacttttatattgcataaatgaatagcttagttgttatagggtttggttgtttcaataacaaagaatagaatttggtttcttatactttataaacttccttctttcagtcttttgggacagagatggcattaattcagaaaccagtggtgtgcaaagacactaataagatcttcatgaagcaaatacttgcgtttactgaacaggtataatatagaagtgttcatgtatatctttctaatagtgtgctttataacttgtaaatcaggtcttttctgaatctctcgctttccatatgaaacctctttgtgaattacatttctagtttgagacaatgtcatgtttgaggtggttaagacgataagaacgttgacattttctgattgaaaataaaagacctggcttccattaactctgcattggatgcttactctaattattttctgattaaagaaagacattcccttaatttataggtgaccattacacagaacagtaagctctcgccacgcac

SEQ ID NO: 8043 - DNA, 3000 bp, Unknown; identical to SEQ ID NO: 8040
  misc_feature (1)..( 3000): cDNA_ID_1989590_gDNA_ID_1621185_Annot_ID_57872 3000 nt of promoter + ATG

SEQ ID NO: 8044 - DNA, 3000 bp, Unknown
  misc_feature (1)..( 3000): cDNA_ID_1810169_gDNA_ID_1621186_Annot_ID_57435 3000 nt of promoter + ATG
ttgtgcattccctccaccgcatacaggaatgaacttagcgatgaagatacttgggaaattgaaggactggggaattgagaagaaagttttctccattacggtagacaacgcgggtaacaatgacacaatgcaagaaattgtaaaatctcagcttgtactccgagatgatttgttgtgtaaaggagagtttttccatgttagatgtgcaactcacattctcaacatcattgttcaaattgggctgaaagggattggtgatacattagaaaaaattagagagagtatcaagtacgttaaaggatcagaacatcgtgagatcttatttgcaaagtgtatggaaaacgttggtattaatctgaaagctggtttgttgttggatgtggcaaataggtggaattcaacattcaagatgcttgatagggctctgaagtatcgagctgcatttggtaatctcaaagtcattgatgccaaaaactacaaatttcatcctacagatgctgaatggcatcgactacagcaaatgagtgattttttagagtcgtttgatcaaataaccaatcttatatcaggttcgatatatccaacttcgaatttatattttatgcaagtttggaagttccaaaactggttaacagtgaatgagtccaaccaagatgaagttatcagaaacatgattgtcctaatgaaagagaggtttgataagtattgggcagaagtaagtaatatctttgcaatcgctacagtatttgatccgaggttgaagcttacacttgcagattattgttttgcaaaactagatatcagtactcgtgagaaaggaatgaaacatttgcgtgctcaactacgtaaactttttgaagtttatgagaacaagtccaatgcggtatcacctacaactgagtctcgtgaagatgttacacctgatgatgaaactgcaaaagggaattttagcaattacgatgtaagtttcttatgttttgtttttgttagttaatatgcagttttttttatgaaaaacagcaagtcattagtttttgtgttatgttattttaatttcttatctttgttataggatttctttgcttttcgcaaagcaaacgttgttgccaatggaaagtcgacgttggatatgtacttggatgaaccggcaatgaacgtaaaagggtttgagagtttagatattcttaattattgataagataacggtccacggtttggaaaattggcttccatggcttgtgacattctaagcattcctattacaacagttgcgtccgaatcatcgtttagcatcggaactcgagttctaagcaagtatagaaatcgtcttttaccgagaaatgttcaagcattaatatgcagtcgcaattggttaaaaggttttgaatcttatgaaaatggtaagtaagttgttttcaagttttatagtcacacaatcttagtctatgaattaacattgttagtttgtatgatatttgtagaggagtatgaaaaatttgatgctgaagatgagactctaccttccttccagtcgcttgtggatgatgcagatggatgttgagttggagattttattttaagtttgatattcatgtttggatttgagtttaagttcatgtttcagttatcatgtttgcgtttaagaagttgcaggtctttctcttgacttaagttcattttttgtttcacatttgagtttaacttgttacaattaaggtttgaatatgagtttaagttcagattaaggtttacaaatgagttgcaagatgagacacgacattgttccttttgggatattttggatttgagtttaagttaaggttctgatagcacgatttcgcagcttagagctatctcagattattttgcttcagccaagcaggctgcagttcttcaggttcttttacctgcaaatgtacaaactgaaattgatcagatcggagcgaaactggatttttctgtagctactatcactgagaaatcgactagtaactccaatcacataagacatttcctggattctgtgtaacaaactccgctgcgtaacccatgtaattctcgtaacccatgtaatttgcgtaacccatacattcttattcaaaactatctttagattgattgtagaatctttggattttgaaaaacaaatgtataatagtcatttctatactcgcaggagagtggcgcttatcgtagtttcaatcgtcatgcttgtggtgacttttcttggtctcggtaatgttttcatctttgagtacatgttactcaactatcaactaatgtattgactttagtgatcttgttatcatttcttttcctgcagtttcttcgatttgtactacagacacatgtgtggcaatgagcgaatgggttgagagaccatcaagcaatacggctctggacgagatattgccttgtacagacaatgccacagctcaagaatccttgatgcgtagtagagaaatgcccgcgggccgacccgtatatccgatgggctttgcgggccgggcttggacactgataattttgtctgcggtcctaaacgggccaacccgtcgcggcccgaaaaaagaaagcccactgcgaggcgggctagatgggcgcgggccggcccgtctgacacctctactcatcagttcctaggtcattattcgcttatctcccttcatcaggtgactgggcttatctggcccaagtacccattcgcgtatgtgggctcgtcagctgcgtaggtcctctacttggtgggcttggtgggcttttgtgggctggcttggtatttttgcaggtggattcctggaggggaatccagccccaacatttgccccccagcccattgagtgagtagaggaactcgatgagcggacatataggtcaggtaagatgataaatgtgataagatcagtcggttttgaggataaactcaacaatttcgatttaatttcagattccttaaccgaaagatttcgagtagatacgcgagataagtcgctgctgatg

SEQ ID NO: 8045 - DNA, 3000 bp, Unknown
  misc_feature (1)..( 3000): cDNA_ID_2165889_gDNA_ID_1621186_Annot_ID_174441 3000 nt of promoter + ATG
agaaattttgttctcggccaggcttacatattgatagtaatggtaaagctccatttccaacgtattcattgacagacgaagcgaaacagagtttatttcaatgtgtgaaacatgatgttagatttccagatggttattctagcgatttggctagttgtgtagatctagagaatggaaagttttcaggcatgaagagtcatgattgtcatgtttttatggagcgactacttccatttatctttgctgaactccttgatcggaatgtccaccttgccttatcaggtacagtacttactattttatttgccaacatttttttatctaattatttaacttgcacatatattttaggaatttgagcatttttccgggacctatgttcgagaactttacagacgagtcgcgttcaaattctcaaagagaacatagttttaatcatctgtaacttggaaaagatttttccaccatcattttttgatgttatggaacacttacctatccatctcccatacgaagctgaattgggtggccctgtccaatataggtggatgtatccatttgagaggtttttcaaaaagttgaaaggaaaagcaaagaacaaaagatatgatgcaggctcaattgttgagtcatatatcaatgacgagattgcttactgttcagagcattactttcccgatcatatacaaataaaatcaaggtaaatacatttatttatttagctattttctatacttcgatcttcattcaattacatgaatcaggttaacaagattcgatgaaggtgaagttcctgtatatcatgtccctggagtacctatcatatttatgcacgtcggccgtccaagtggtgaaatgcatgtagaatggcttccagagaaagactaccaaagcgcacatgcatatgttttaagaaattgtgactattttaaaccatttgagaggtatttttaatcactattcgtttgtaaattttcactaagatcacttcgatttatttttctttgtttgtaaatatagtacgttcgaggattgtctttctgcgaaatatccatgcttgtccgaacaagaactctacgcgagaagagctgaagaatatcattatgtgttaaagaatatgtaagtctacataaatttcttgcattcgaaaagtgagaatcatatttatatgtattaatattatttatctattatctaggtaacatattggaacactacttctccattttctacttgggttcaagaaattgtgcaaggacctttgaacaaggtcaaaacttggcaaatgtatttcacaagaggatatatgtttcatacgcaaaattacggccctggacgaaagacatgtaactatgggatatgtgttaaaggtgaaaattacgctgattcatctaatgaagcggatttctacggtaccttaactgatatcatagaactcgaatatgagggcatcgtcaatttgaggatcacactttttaagtgtaagtggtatgacccaaagattgggagaggcactcgacgaagccacggtggcgttgtagacgttatatctacgagaaaatacaataaatacgagccatttattcttggtacgtaattttgaagaggtcaaatatgtttctctgttaattattaatattgttgtttgatatatgtataacttgtgtatacaagatctaaagcagatcaggtttgttatattccgtatccatatacaaagaaaccgaagaacatttggctcaatgttttaaaagtcaatccgaggagaaacatttctggagaatatgaaaacaataatccgactcttttgcaaacagaaatgatgatgctgttttactcactacaattgaagatcttgtattagaaaatccggtagaaagcttaaacctaataatccttgattacgatgtcggggattctgaactagaagacgaattccgatgtaatttatcgtcctcggacgaagatgaagtagaatatgaagaataataaatgtgtgaagtatatgtttaattatttgataaaacatttgaataaattatgctttataatatatcattgaacatttaatttgttcatgaatattaaatatgtaaaattatttcaatttcaaaagtataaggtgactattatgctactacttggcgactaaattataatttggtgggcttccaaataacgaagcccaaaaccgatagagatgtaacaataatacgactactcaacgactaccctttgctttgttgggtttctaaatatcgaagcccaaacccaataaaaacagtgacgcttatgcgattaattagcgactacagcttaatttgttgggctaccatatatcaaagcccaaatccaatatactatgtgacaattatgcgactattacatgactacgttttaaattgttgggctccgaaatattgaagcccaaacccaaatcatttaggtgacagatttgcgactactttgcgaccacaaacgaagttgttgggcttctaattctcgaagccaaaacctaataaaaacggtgacagatttgctactcttttgcgactacagacgaagttgttgggcttttgaatttcgaggcccaaacccaaatcatttagtgacaataatacgactacaatgcgactactacaatgttgaaaaccctaaatcgaatcatttctcattcctaacacttagccaaattcttcttcatctctcgatctctcttcttcttcttcttcctctgaaaccctaaacttcttcgatctgttcatcttcttcttcaatcttcttcaaacttcttcaatcttcttcaatcttcttcatctctcgatcttcggatcttcttcttcttgttcgatctctcgatcttcttcttcttcgatccctactcttcttctttgatcttattcctcttcttcatttcttcgatctgcaacttcttcatattctcttaatcgatctcgacagatctctcttcttccaagcagatctctccgtcgatctaac

SEQ ID NO: 8046 - DNA, 3000 bp, Unknown
  misc_feature (1)..( 3000): cDNA_ID_3088544_gDNA_ID_1621186_Annot_ID_174432 3000 nt of promoter + ATG
gtctaacaagtctaatcgaatcctaaccaacatgtacttctctacaagcttacacaacattctagattacatacctaagttccacaactaaatccaccaggctttgatcgctgggtctcatcaaacaagctaacattcaagatccttctagactcattcctgtactatataccatgataaatcgaccattccttataattttttttttctttggtgttctttctctcccctagacttattctttttgagagaaaacacaggggaactcgcatactggatcgacaccctcaacatttttccaacctttgtaattgatcattccaaataatgtataatagtggggtcataggaaacatttttttccctatacactgtctgaaaatcctatcaatctctcattatctttttcttcttataaggggagaggaacacattcttttttatcaaattggtctcaatatcaggtatgaacaaggagtcaagatctatgaatactaaccgtttgaagaggtaaaatgaagagcagtgagattagctccagccttagtggttgtgttggaaactaggatatcctcaagtctgttagtttgccatctagattttccaatagtcggtatgaacaaggagtcaagatctatgaatacaaaacgttttttttttttaaagactcaataaacttaaaaacgaaaaataataagaatcaaaaataaaagcaatgttagtaagaacctccccagacttaaacgacactgtccccaatggcattcaaatccgaagaaggcgggaaaaagaaataaaaaataaaagaaaataaaacaaggggaaaagaaaaatcaaaccagtgggttgccttcaactaagcgcttgttttgagtcaatagcttgacttggcggagttcaagatgtggtgtagtggtggaggattgttgctgcctcctggccttctcaggcggtctgtagacagatctggtcggagcagctgcaggtgtcgatcgacactcagtggtgtgtcgatcgacactcttctcgtcacctgcaagaacaacaggagaaacaagctttcaaagaactctaggcttgttatcttgtgaagcagacttcgaagaatctaaagaattagtcgaaggtaaagcaggagaagagatagatgagaacttatcacaaagggcctgaagtggtgtgggctgaagaggttgtgcagaaccctctgtctgtgaatcccgagggtgtcgatcgacatgagtggtggtgtcgatcgaccctgttgcattacaactctcattggcgagctgagctgattggagcgttgtgtgtggctctgttgtgggattctgagcagtcttagaaggtgtgtatgtgctagagtcaatactactgatagtcttcgtaagctctgaaccatccatgccaaatttcatctccaaatcataaacctttagagagatccgacctctcttcacatcaaacctagcatcagctgtagctaggaacgctctttcaaggataagaggatcctttggttccttctcatagtcgaggaccacaaaatcagcagggataacagagttaccaaccttaacaggaacatcttcaaaaattccttcagggattcttttggaacgatccgcgaagaggagagtgattctagtcggcatgtagttagtcatgcctagtctctcagcaacagactaaggcatgaggttgatacttgatcccagatcacacaaagagcgactgaacttgcttgtggaaattgagcaatcaagaacgaagctacctggatctggaagcttctcagtggtctaatcaggagtgatggtgcagatgtactcaacaatgtccactctctgtgccttaggcagcatgattgcaccaatgtcccgtgtcagcagtgaggcttcatctaagctaataccattgtcaacaagtcgcttgacatacatgttgagtggagcagaagatgtctcagatgcatccttaggaagagaatggaggatcttctccattatggatgtgcacttagcagcatgaatctccttcttagaacgacgcttcctcggataagggacacgaggagtgtaaatagactaaggctgcattggtattcgcacctcacaaggtgcagtccggatccagtgtcgatcgacattagaggggtatcaatcgacaccttcataaggaatcgtctcagagaagagcgttccagggtgtcaatcgaaactggaaggtgtcggtcgacaccaactctacagctgcgagcttgatatgtcctggtttttattaatttctaacatagttttaaaattgtttttagggtatttctagtctttttcgtatgttttgagtcatttcaggtacatttacacatctgggagctatggagcataataaggaattttggaagcttttcagcaatgaagattatcaaagacgtttttcgcgtgatggtgtcgatcgacaccacacctatgtcgatcgacacccccccccccactctctcgcgagcagaggaacatcatgattgcattaactagaacaaggttcacgaaccaattggactgatacaaagaatgcattcatgaatcacttattcgatgaatccgtgaaagaggcacttcgtttgcaaatctcttcattcactcaggctccagccgagtcccttagagcagcttggctccgcttcaggtcttattagcgagaatatccccaacatggcttccaagataggcacctcatcaatctattctacaaaggaatagccaagccataccagagtcaactcgatgcagcaagctattgtaacttcatgacaagaaccactagtgaagcattactcctcatcaccaatgctttaactagtctttcgacacaggaagttgacagagaacgaagaatttcagctgagattgccaccgcaagcaaagagactcttgtttcagcaaattctgctcctatccaagcccccctccaccctccttagacaatagactcgattccatg

SEQ ID NO: 8047 - DNA, 3000 bp, Unknown
  misc_feature (1)..( 3000): cDNA_ID_2165947_gDNA_ID_1621186_Annot_ID_174457 3000 nt of promoter + ATG
ataaagtctagctcttttggataaacctcaatgatctatttatactaaagtgttggaaaccctagattcactagaagacaagagatttaaggcggtttgggcgaatactcgaccttagggatcgagtaaagagggtgctgcaaagtcgacgcctttgtgtctatgctccgactgatcaattggtcgagtagatgcttcatcctctcctatttgtatgctcagatgtctggttgagtggggaatgaggaggatccgaagacgctttgatagctcaacaagtcttgtagagatggtcacccttggtcgagtaaatgcttcgagtagtggatcgagtaggaggggcgagtagttgaatctgctgcttcatctgaggttgccttaatcgagtaggagggtcgagtaaactgcagcctcctttgtagcatcctggaccgagtaaagaggtcgagtaggatgatgcctcttctgtagctgccaggaccgagtgaatggatcgagtagagtctttttaagctccttttgcacctgaaaacacaccaaaacatgcaatgcgaatgcaagatgatccgaaatgcctaagtatgcaaaacaagctaaaatggtgcaaaatgatattatacaatgagcaaatgcaaagctaaatgatgataaacatacacctaaaatgagtaaaatacagtgttatcagtgatgccccaaggaatcatcaccaaagacaagggatagtgtcaccaccagttcagaacaacaactttgagatcaagagtggtctcatctcaatgatccaaggaaacaagtttcatggtctacctatggaagatcccctggaccatcttgacagctttgataggctctgtggccttactaagatcaatggtgtcactgaagatatgtttaagctcagactatttcccttctctttgggagccaagacacaccactgggagaagactctgcccccagactccatcaactcatgggacgattgtaagaaagcttttcttgccaagttcttctctaacgcttgcaccgctagattgaggaacgagatctgaggtttcacacagaaaaacaatgaaacattctgtgaagcttgggagaggtttaaaagctacaccactcagtgcccccatcacggttttaagaaggcttcattatttgagcacactctacagaggagctttaccaaagatcataatgcttctcgacacaacctccaatggaaacttcctgaacaaggatgtagaaaaaggatgggagttggtcgaaaatctagcacaatctgatgggtgatacaatgaagactatgatcgcttagtgagaggaactggaggtagtgaggataatcaaagcaaagatatcaaggctctaaatgaaaagttagacaagttgttgctggctcagcagaagcacatacactacataactgatgaagagcacttccaaatgcaagaaggggggaatgatcaaactgaagagctgtgctacatccagaaccaaggagggttcaacaaggagtacaacaactacaagcccaacccaaacctctcctacaaaatcactaatgtagctaacccccaagatcaagtgtatccacgacaatagaatcagtccaagccttttgttcagtacaaccaaggttatgcccctaaacaacagtttaatggaggctaccaacagcagaatccaccaccagggttcactcaacaaccacaacaagccccaacagctaaagatcccgaaattaagcaactcattcaacaaatcattcatggataagcgagtggcccgatggcttttgacaagaagatagctgaattacacaacaagatcgattgttcttacaacgatctaaatgtcaagttcgaagctctgaattccaaaatcaagtatgtggagagtcaatttgcatcaacctctgctccgaagcatcctcagcaacttctagggaaagcagtccagaatcctaaggactatgctactgcgaatgctatcaccatccaccatgaagatgagtctccaccaagtaatcaaaccctccatactgaggacagtatgattcaagaatgggggggggggattcaactcaaattgctgcacctgccaccaagcaattcatctggactatagagcacacaactttgctaaatactcaccattcttgaaaaaagttcaaaactgaaaaactcaggaaagatcagaatcaagagatgattagcagtgcctctacccaagaaacatacaagaagaaagtcatccaagaaaagcttgatgatcctggttcattcactctgccatgctctctaggaccattgacattcaataggtgcctttgtgatttgggagcatctgttagccttttgcctctctctacagctaaaaggctaaggatcatggaatacaagttctgcaacttagctttactcttagctgatgattctgttgcacatactaatggtctaatagaaaatctgcctgtcaagattgtaaatgttgagatacctacagattttgtggtattggacgtagatgaagaaggcaaggatccccttatcctaggcagaccattcttagcttcagctggagcagtcatagatgtcaggaatggaaaaattgatctaaaccttgaaaaaggtatcaagatgagatttgacatcagcaaggcttcacggaaatcaacaaccggagttcagaattttgggatttaggacatggatgttgatgaaaaaacagaagtaggaacctcaccaaaagtcaactatacttcccaactcagcaagctgaagcgaacttttgaccacaagaagagggcaatggaagagttagctcagactgaagatcctacagaagatgactagtatgcgatgggaaaaaaatttaaatggcaaagcagagtcatagaaggattgtcttcaagggtgatgaagctgaaagattaactatggatgtataaaaaaaagagttaaaaagttttcaaatggtattgatccagagaagatg

SEQ ID NO: 8048 - DNA, 3000 bp, Unknown
  misc_feature (1)..( 3000): cDNA_ID_2165930_gDNA_ID_1621186_Annot_ID_174452 3000 nt of promoter + ATG
ggagataacccggccaacccgtctaatcaggtccctccgcgacctgccagcgaattggccgagctccacgcaatgatcatgaacttgatcaacttaaccaaaaaccaagaaattgcgcatcgcaacctcgccgcaattgtgggtcagcagagacgcgactccactcgcatggtacatgaggtagagcgcgataccgcgggtaaggaggttccccccccctcgcgaaactaggattcctgcccaggtccccatagatctgacaggtaccgtctcccttgccgatcctactccgagaactcgtctggatttcgcttcgatagacgtctcacatcctatcaaccggtaggtcgcctttttacaggcacctgcgaatgctctcgtcaaaaacctggcaacaggaaacgaaacaagcacaacgcctgccttcccaaggctaccggtcccaactttactatcgatgggctgttcgccccctaggtacacgtggacgagaaaccaaacaaccgcatccagttcccgcattcccgggagctcaacgcaacaacagacctctatcgctaatccgccatccgtttcccggataccaggaagcgacctccttaacagtccaaccgatccccaagcaccggtcgatccgcataacgtcgtggatatggaaacattccgcaattacgcagctcaaacaaatgcgaacatggctcaaatgcattcgcgaatgcacctagcagtgagtgatgctcccgacatagatcgcgtgatcgaagataccatgcgcaccctgttcacgaataggatcgctcgtttttgcctccgagacgtcgggagactccgtttcccggagtacgacggaacgagcgacccaaaggctcatctgagatccttccgtttcgctataacatgagcgtacctgacagacgaagaaaatgaagcaggtcattgccgtttcttcgtagaaaacctcgtaggtcacgccctcgaatggtttgctagcctcgaagggaactccattgataccttcgaccagctcgccaccgctttcttaaaacagtattcggtacttatcgaacacaggacgtctgaagccgacctctggagtctcactcaacttcagaacgaatccctgcgatcttacgtcaaaaaattcaaagcaatcaaatcgaaaattgcgaacctaaacaaagaggtagccatagcagcccttcgtaacggtctgtgcactacaacaaatatccacattcttatcacgagagaaacgctataaaatgtcattaatagcgttttcataaacgctgtcttatgcccctgttatggtaaaccctccatatacgatagcattttttccgtatgctatgatatagtattctaccatagcattagtaaaatgctttcatttatcgactataatagcgatatatataggctatgatctataatgtttttgatgctgtaatattcagtgtcatgactctaattttatgcggttgtttgaatctatttgcatttggtggaacctgtttagttttcaaaatatccaatacatatataataataaacatccaaaaagtatacaccatttcataaaccaaaaatcaattcatacttaacacaagtctcaatccaacacttaaactaatatgctaacttctatatactacttttgccaatgaagttattgatgagatcatgcaaattccttacttcgttttttagatattggactccgttcttcaagtaagttagctcagcttcataggttgttgtagtctcttcctttctcttaggttttcgaaaaaattgctaccttttctcttaggttttccccaaagactgttgtcttcatctatctcactgtcctcaacgacgagattcattatatcttctgttagaacatgaaataaaacaagtaagatttcggcttcttgaacacaaacttattaagtcacattattagtaaacaaatctttttactcacctgaaaactcaatctgcgaatgagacataactttagcctgagaagagactaattccatttcctttctacctttactttctccaagaaacgcaaactcaagaccatcacttgtatccatcatcggtgactcatagacacaactcgaacaccattgacttagatcaggaacttctgagaattctgaaaacaaaaatgacaaacgacataagtgaaatcaatccagctaatctagctaaccactaacaatccacaaaatgatgtttttgaaaccaaaccaataaagcaagtctgatgctaccttgactatcacccatctctcaattctctatattcgaaagtcaagtctttttctctgtctccttggtcttaaccaaaactcagtctcctagtagcttaattgaagctaagtatattgtcaatattgaagcaagaaagaatatgtatagaggaaaagaaacttaggaaggaatcttgatactcacataaagccataatcttcaagtattacctgaaacaagttaaccaagtaagcaccaaacaacataaaaaacaaaacgaaatcctttttatgctacatatgctaacaaagagaccttgcttaatgacctaagatactacaatatccacggctgaatgcaatgtcgaaccatacacacaacataattcaacatgaggaagaacacttaagatgttatagataaagtatttgtaattagatttatgaatcatagtgatttgagatagaccacaaccttggagaagagagaaacgaacccagagaaagagatgttgagtcgtttcttggtttttgtctcacagtcaattcgtcgaacatcttgtgtgcacaaaaacacttcaaaaacgttacccttttgagctgcagattcaaagaaagaggagagacaaaaccaacagaggagagacacaaccaacaaacaaggattagaagctatagattcaaagggaaaagagagacaaatcaacaaaccttttccaactaaagcaatctctaactgaaacgtgagagg

SEQ ID NO: 8049 - DNA, 3000 bp, Unknown
  misc_feature (1)..( 3000): cDNA_ID_2165821_gDNA_ID_1621186_Annot_ID_174425 3000 nt of promoter + ATG
tcatcttcttggtggatggtgatagcatttgcagtagcatagtccttaggattctagactgcttttcctgggagttgttgaggatgcttcagagcagaggttgatgcaaattgactctccacatacttgattttggaattcagagcttcgaaattgaaatttagatcgttgtaaaaacaaacgatcttgttatgtaattcagctatcttcttgtcaaaagccatagcgccagtagcttgtccttgaatgatctgttgaataagttgtttaatttcaggatcttgagctgctagggcttgttgtggttgttgagtgaacgctggtggtggattctgctgttggtagcctccattaaactgttgtttagggacataaccttggttgtactgaacaaaaagcttagactgattttcttgtggtggatacacttgatcttgggggttagctacattagtgcttatgtaggagaagtttgggttgggcttgtagttgttgtagcccttgttgagccctccttggttctggatgtagcacaactgttcagtttgatcattccccacttcttgcatttggaagtgctcttcatcggtgatgtagtgtacctacttctgtcgagtcagcaacaacttgtctagcttttcattcagagccttgatatccttgctctgtttatcctcagttcctccagtttctctcaccgagcgatcatagtcttcattgtagcacccatcagattgtgctagattttcgaccaactcccatccttctgctacttccttgttcaagaagttttcatttgaggcagtgtcgagtagcattctgatctttagtaaagctcctctgtagagtgtgctcaataatgaagccttcttgaagccgtgatggggacattgagtggtgtagcttttaaccctctcccaagcttcacagaaagttttattgtttttttgtgtgaagcctgggatctcgttcctcaatctagttgtgcgagcattagagaagaacttggcaagaaaagcttttttacaatcatcccacgaggtgatgaagtctgggggtagagtcttttcccagtggtgtgccttgtctcccaaagataagggaaatagtctgagcttaaacatatcttcagtgacaccattgatcttggtaaggccacagaaccgatcaaatctgtcaagatggtccagggggtcttccataggtaaaccatgaaacttgtttccttggatcattgagatgagaccactcttgatctcaaagttgttgttttgaactggtggaggcagtatcacttgtctttggtgatgattccttggggcatcaccagcaccaatgtttcttggttgatcaacattaggtgggtcttgaacatcaactggtctgtttctgttgatccataggagctggtttttgctgatcacagggtgcctttgctttggtttcttgtaattcatgagctattctgtctattctgtctttgaaaagtagtaggtgtgtagaacctttggatcgagtttgcatgcacaaagattagtacctataccacaaaaacaagcagacgaaatgatgaagcatctctacaagacttgttgagctatcaaagcgtcttcggatcctcctcattccccactcaaccagacatctgagcatacgaataggagaggacgaagcatctactcgaccaattgatcagtcggagcatagacacaaaggcgcagactttgcagcaccctctttactcgatccccaaggtcgagtattcgcccaaaccgcctcaagtctcttgtcttctagtgaatctagggtttccaacattttagtataaatagatcatttggggtttgtccaaaggatttatgctttatctttcagtttttctttgtgtttatgaattttgaaactttaattactcttaatctatttcgtttttgcatttgattgtttaagtaaagttgtttagcttgtttagatctacattttggtatgattttagtaatttctgggtttgtgttcttgagaatgttgcttgagtagtgattagggttcttgaggacggattagattagggtaatctcttggttagttaggtggttagtgtttaggtttatacccttctggattcgcttggcccctatgcggttttcgctggctaatgtggagattcgatcaaagacgtccagcgtccaaaagacgttcaagtggatgtctgacttacgaattctagagatatgtagactcggccaagggattggtttgtctgcctattggctttggtagattttttcttaaaccctgctctgctatgtttcatcaacaagagttgagattaggaagtggtagagttatgggggtctctgtcacgagagtggattgacccagtttttgaatctatcgtcatgaaaatctacctttcgcctattagccatttgatgaacactagagttacccttatcaatgaatccatccttagaacttctattagattgattttcatcccctgttgattgtatttttatttacctattatttgtatcctctatttgcatcccctgttgattgcattttagttcttaattttgtcacctgttagttctactcgacccaatgatcgagtagggctgttaagttctcatttttacttgtttgaatcctgacctaggattgttactagaaacccacaatctttataatctggcttgacttagtagtttttgtacacatcatgattgctagcaatacagtggactggattgacaccctctataactgcatcgacatgtttgtgttttagaggaattgaactgaacacagcattcagcacataagcagacctgaaaaacctgcttatcaatttggcgctgttgccaattcattgttgcattgttacattcaagatatcagaaacttttaagatcaagttcttttacatttatcaaaatactaactcatcatttcgtctgcttgtttttgtggtataggtactaatctttgtgcatg

SEQ ID NO: 8050 - DNA, 3000 bp, Unknown
  misc_feature (1)..( 3000): cDNA_ID_3088548_gDNA_ID_1621186_Annot_ID_174429 3000 nt of promoter + ATG
gttgttgctgactcgacagaagtaggtacactacatcaccgatgaagagcacttccaaatgcaagaagtggggaatgatcaaactgaacagttgtgctacatccagaaccaaggagggctcaacaagggctacaacaactacaagcccaacccaaacttctcctacataagcactaatgtagctaacccccaagatcaagtgtatccaccacaagaaaatcagtctaagctttttgttcagtacaaccaaggttatgtccctaaacaacagtttaatggaggctaccaacagcagaatccaccaccagcgttcactcaacaaccacaacaagccctagcagctcaagatcctgaaattaaacaacttattcaacagatcattcaaggacaagctactggcgctatggcttttgacaagaagatagctgaattacataacaagatcgtttgtttttacaacgatctaaatttcaatttcgaagctctgaattccaaaatcaagtatgtggagagtcaatttgcatcaacctctgctctgaagcatcctcaacaactcccaggaaaagcagtctagaatcctaaggactatgctactgcaaatgctatcaccatccaccaagaagatgagtctccaccaagtcatcagactccgaatactgaagacaatatgattcaagaagggggggggattcaactcaaattgttgcacctgccacccatcaattcatctagactatagagcaaacacctttgctgaatactcaccattctggaaaaaaattcaaaattgaaaaactcaagaaggatcagaatcaagagatgattagtagtgcctccaccaaagaaacatataaaaagaaagtcatccaagaaaagcttgatgatcccggttcattcactctaccatgttctctaggactattgacattcaatagatgccttaagaatggaaagattaatctgaaccttgaaaaaggcattaagatgaaatttgacatcagaaaagcttcagggaaatcaacaacaggaggttagagttttgggattcaggacatggatattgacgaagaaacagaagctgaaaccccaccaagagttaactatacttctcaactcagcaagctgaagagaacttttgaccacaagaagagatcaacagaagggttagttcagactgaagatcctacagaagatgactggtatgagatgagaaaaaaaattaaatgacaaagcagagtcatagagggattatcttcaagggtgatgaagctgaaagatcaactgtggatgtttgaaaaaagagtcaataaattttcagtgagtattgatccagagaagatggaaactgcactagctattaaagaggacgaagatttctcaacagaatggtttgcacaagaagatcagaaaggagttcacttagagaaaagaagcttggagagcaagttgttgagtgagtaggaaatccctattctgacttattctccaggagtgcctaaaccgcccaccaacccctctactgaagaagaacacttgattattaattctgctgctgaagaactcctggagctttgggttggatataaagctcaggaggatacaattggaaaattaactcataagatggaagagttaaatagcaccattctggaacttcaagaaatggttaaaggctaccccagttttgaaattgaggattggtcaaaggagcctggtttagaagaagaagactactctgttgatcagaaagaagcttattttgaagaaaaatcaaatgagtactcatcttaccatatgtcaagagaggatgcaaagtatgattcaggcactgaaaattcaaccattgaaaatgaggacttctctgttcccctcttcaaccttttttctgactaagctctgtaagagtcaagcttaatgacttaaaacaagctcacttggaaggaagtcccatgtctatccatgtatataactttctattttccttgttaattttgatgtttttgtttaagtgtttcaggtttattttattgaccctgaggaagtcaacggtcgagtaaattcaaaacaagtaaagaatcatctcaaccgttgatcgagtaaagtgaggaggagagctttaagccgttgatatgaatgaccaaatgagagaagcatcacaaccgtttgatcgagtggcttcttgaggtttattctggtccgtttgatcgagtgattaaaagcaaagctttctccaccgtccgatcgagtgaagaaaccaaagagaccaccttgtggactccgactttctcgtgacccgcctccattgaaacgctgctgtctctttgtcttcttgtccccccccataatcgctttggtcccccattgcaattcttgaactcaacaacctcatctctccacctcccataccaaagcaatctcaaattcttatatctctctctatctctttctcttgcatttcctctttctatcaaaaactcaacaaaatccatctattttcttcatcactcaatgacaaacaggcgcacgctcctgtcaaggatccggaatagagctctctccccattgaagaggtacccaacaccttcttcgtatgtagcagctcgaggactttctgaaccatcacccatggggtcgagcaggagagaacaagcaagtttcaagatcgatcacagcgaatcaagccaagaggaggaagtgatgcaagaagaagaaacttttagctctcccgttggaaatactcgatcccgaagtaagtcctctgcaaggaaattctccaggaacaaggcagacatcactcgaggaaagaagcccgtggggaggaggttggaactggtagatgaagattctaaggaagaaatggcttcaccaaaggaagctgatcaaacagagagaggaggtgatgatgatttggaatcagagaagtctgcaactcgaaacgagtcctacaagctgctgaagcacaatgattttttaggaactcgatagcctcatcccgagacc

SEQ ID NO: 8051 - DNA, 3000 bp, Unknown
  misc_feature (1)..( 3000): cDNA_ID_1810214_gDNA_ID_1621187_Annot_ID_57441 3000 nt of promoter + ATG
tggtaaaatagagaacaatgaattatatttcacaagatcttccttttcaaattatttaatttaatctttgcatatttagacttgcagcaactgtcaacaagtcggacacaacaaacgttcatgcaagcgtaaagcagtgccaaaaccacccaagaaacctcaaggacgaccaaggaaaaaacagaaaacaatggatgaagagaaccttatcactcagccaatacaatcttctcttcaaagttaatgtttgacaagtctttactttagaatatcttgtccctctgaaacaattgtttttttttgtgacaaatattgttgtgttgcaacagcttcgatagttatgttggttggatttatttaagcatgactctttggattattttaagttgttgtgtctttctttcagcttctaaaatccaaactaattaagcaattcaaaatcatttagaacgtttttttgtaataaattcaaaacagttttaaagaacataatgtggtttttgcgctaaatacaaatgtctcgttgttgttttttttggaaattaatatcccattaatatttaatttttgtggggttaagtttattaacaggttttagttcagggtttgttttactaaaaacatagtttagggtttaaaaatggatctggccaaagttgagggtttttttcattaaattctcatatataaactctaacaatcaaatcttctattcttttttttcggatctaaatcatctctttatatttactttctaaacatactaactaatacatatatttctttgcaatgatcatcaattgtttcaacacgaaaactaatctgttcgattgaccatgtcatgaaagaaaccatggcatattctttctctgttatatatcacttttgtcgtaattgtttcagtataattctcgaatccccaattttttagaatagtttgttgataaaattttatttactacagtacaaacaaaatattatttctagttccaatccttattcaaactagaattggtttcttttttttgttacaacaactttctctatatatattgtaaacatttcttttcacttgttttgcttccagagtgaagagaacagaaaaatatcgagatggctaaccaagaagaaggaagcatcttgaaagctcttgacgttgctaagactcaatggtaccatttcacggcggttgtagtcgccggtatgggtttttcacagactcatatgatctcttcgtgatatctctcatcacgaagctacttggccggatctactatcaggttcctggctcctcctctcctggaagcctccccgacggcatctctgtagccgtgagtggtgtggccttcgccggaacgtttctcggacagatattcttcggatgtcttggtgacaagctcggacgtaagagagtctatggtttaacactcttgatcatgactatttgctccattgcttctagtctttcctttgggaaggacccgaaaaccgtcatggtaactctctgcttcttccgtttctggctcgggtttggcattggtggtgactatcctctctcggctacgatcatgttcgagtacgctaacaaacgtactcgcggcgcgttcatagcatcggtttttgctatgcaaggagttgggatacttgccgcaggaggggtttctttacttgtctcgtatcttttcgagattgagtttccgtctcgggcctacatattggacggcgcagcctccaccgtcccacaggcggattacgtgtggaggatcatcctaatggtcggagccttaccggctctcttgacatactattggcgtatgaagatgcctgaaaccgctcgttacaccgctctagtcgccaagaacgcggagcaagcggctttggatatgaataaagaaattttcacagaagtggacgaaaaaagatttgctctcaccatttgtcaaagtgagaactggttttcacggtttgtcttttcattcaatttcggaccaaattaccctgggaaaacttaataatggcacaaaccaaaccgtgcagcagttcgtatcggttcagttaacggcgtaaaccaaaccctacagcagttggtttcggtttagttgatgcggttcagttttgaaaaagacaaaaaaaaaaaaaactgaaacgaagaaacccgagaaaacgaaaaagagaagagagtaacggagagatttgagagagaatcagaaagcgaaacgaaattcagtatccattgcttcaaaattcgacataacttcgaattgttgggtagttgaattgagccactgaactcccacatccggggaagtgaaagttactgtttttcccggcgaagccaagagaaagttactgtttattccggcgaaatttgaacctccggcgagatagcatctttagctatagctgggaataaagctaacgacgaagtcccgaggaagcagcatggtccagggaaggagaagcgggtattaagagtttccccgcggagaaaacgctctgcgacaaaggcaacggaggaactgggttagaatctctaatttaccgtttgttgtctttgggtgtatcagaattgtaaagcttgtttgattaaagggttagaacttgtcggaatttagcatatctttaggatgaaaaattgagaagtagaattggaaatgtctgtttccgccaaaaatatgattttgagttataatctggaaaatgtctgtgtacgtacactacttcggtttgcttaacagtatatgacttttaattgcaggtagtccaagtgttgctccgactgaagatcttacagttgaagagttaccaccaagactctttgctctagaccggtacccttccgagacgaagatgaacgcgtactctaaaccagagatgtagtttcttctcgattctccatttggggaactttttaaaatacccaaaaacaaggcatctttcaatgctaagcttgtccttggactaatatgccgtcagttagtgacaaagaaggtgaatgag

SEQ ID NO: 8052 - DNA, 3000 bp, Unknown
  misc_feature (1)..( 3000): cDNA_ID_1810210_gDNA_ID_1621187_Annot_ID_57442 3000 nt of promoter + ATG
atatttgagtgttgtttcaacgaaacaacttactcatctaattggtaacatttcaatcaaaaacggcaattggttaaacgtaagaaaggcgataaatttaattgatgagaattttttttgaattataaacaattgacatcgtaatctagataacaacaatagttgcttttcatgtaaaaaataaaggaaacgagagaaacacggatagacgcgcgataatcaaaagatagataaagggagagggtcattgttgtgagcgagaagaggtttgattatgacacaataagacaaacttggattatatgataagaaaaaataaaggtgagaaaacagttttcacatgacctcgacaatatttggtttatatgtagctcaaatttgatatcgaagtttctggtattattgtcttgaggtggaatggtgagaagtattatggtgacgtggaactaagttctggtagaaagacatcgaatttcaaattagaagatcaaacgaatgatgttgtttcggataatcaattcaaaggcttatggagctatatgattaggtaaggttagtaaatttaattttgtttctctgtttttaactaaaattttacatagaagaaagtagaatgtatggaagaggaagaaactaacgatgacaatagtcataaatatttgacaattaagatgacgagaaggaatacaagagtacgaaaacgatgaatgtgaagagaaatacgaaaatgtatgtattggctgctaattgaatatgagaaaacaaaattgatttatgattttttatatcaaatttgattttagacaccatagaaaataaaataaaaaactcaaactttggatccaaaacctaagaaattcatattcatgtggttaaagctctaaaccaaccaagtttgttgcaatgggttagagaccgaaaataaatcagtgagtgctcaagtagcgagaagtaagataaaaacagctctaacctgagttcattagcggaagactaaaacagatccaagagagtcaaagtgggatttagaggaagtttgtgaagaaaatgtaatttgtgttgtttttgtttttgttttttgaatacaaggaagttttgagaatctgatataaagcccgtaattatcccatgctcaaaatcaaagcatgtcatattagttttgtaccaagcgtcaaattaaactgtaaaatactctttgacatgtgttttcaattttataatttaactgttctatttttaattttaacaaatattaataaacccacacgtagcgtgggttcaagacctaatattatctaaaagagtgaaagatctaaaaatctgacaaatcctaacaaaaggcgagaatgaagcaaaacaaaaacgaaaataaaaatctaaacaccaatcttctccttaactctctccggtttagtttctccggtaagctcctcaagcgatatccccttaggctccagaattgcaaatttcgtgatcagcaagccagcaaaatgtataacgtcttactcatacctaaagccttaaccaaagcagcaaacccgaaagaaccgaccattgcaccggctttacctgacgccgcggagataccgtgacaagtcgacctaatcctcgccggaaaaatctcagccgggacaatgaacgtagttgcattaggtccaaaattggaaaagaaaaaggtgaaagagtagaaaatcacaaaaccaatccggttagctggtaaagtccaatggtggtacggtacggctaaaaccaacatgaaaacagtcatcatgccgaatccaatgatctgaatccagtaacgtcccagtctgtcgattaaactatagtggcaatgtaaccaggaactgtactgcaacaagcgattatggtttgagccctgacgatcatgaagagctcctggagtgcgttcatggttttagccgaaggtaaccatccaaaggtggtgaagctatccttctggaactagttttggctgtagaaaacgatgtcgaggaggaaccatgtggtagctgttccgaataggttaagaccgtgacgacaaaggaatttcttggagaacaagccaatctcgtctttggaaaccctagcttggtcatgttttgcggaagaggcttcaatgtctacgttgagtaccttattcatatgggtaaattgcaggccacacccattgaccatgttttattttcatggattgtcaaagtcaaatgtggttttcaccatttgtcttttcgcctgcaaaatgacgcttctgcccttgcgcttctctcttagtaactgttgaaatgtacggtttagtttagcaggtttagttacgtatactgttccggttcagttgaagattttttgtttcacgttgacgcgattcggttccgttacaagtgagattatttccattattccgaagtgacatcaacatttaatgccctcaaaaagtttagatgtgactattgtaacaattaatgcaaaatcatcattacatcaaataatattaaaaaaattattgataataattaataaaaaaattgttgagataaagaagatgaacccaggaacaaagaattattgagaacgtacattgctgctgaagaagtgttgatcttgtttttgtaccaagtttggagccaaaataagcattgctcgtgtaagtaatgaagttcttttaagaagttttttgttatgtcatattagggtcttgattgtgttcgaactccatttttttatcagaaaatttgcaaaatctatatttgtttgtttaaaatagtcaaatgataattggtatttaggtttataaatgtgtagtatcgatattccatttgttttttatatgtatagtatttttcagttgcatttaatgtgtgtctcctgaatttatgatgcaggtgggttatggatattcccgtatttactatggtcggtgagtggaaatgcaaagaaggagaatggaaatttgaacctgaggaaggcatctttggtcgttgtgtacgcgtttaggaaaccatg

SEQ ID NO: 8053 - DNA, 3000 bp, Unknown
  misc_feature (1)..( 3000): cDNA_ID_1807395_gDNA_ID_1621187_Annot_ID_57443 3000 nt of promoter + ATG
tgttatgttgctttcacagttatattgttacccggctactcttaacaaaactgatcatatttaatttttatttttttttgtaattctttttatccatcaattttccgtaaaagatatttcgttgatgctttgtgtcactgacctattgctcccaattttgttattcaataccgtgatagatacacaatcattgtgaatttgtgattactcttcacaaccacgaaggagaagagaggagaaaaatatgatacataccaaaataataagcatatacaaaaatacttcatatatcaaaaaactcgcaaaacgataagacattaatcaccttagatatgcttgttctctaaatctgttacgtaagagattaaattcaaactaaacgataagacattcccaattttcttttactcttcttctttcttctctaattcttttcccatatctcttcctctccacctctgtctatcacttcatcgatggaagtgaaacaaacaacggcaacgttgactcgttgagtccttgacatagtgatcaaaacagtggcgatgaaaccgaatatggcttgagtgcacgatggatatgacacgttgacggaggattcacttctctctcgaagctatcatggctatggatttccatcacgtatgcaacgcatacaacctaaaacgtaacgatgacttaatattttacgtcagtcatcactaccaccatcatcgccagcataatcacactttcgacgacaaacacaaatctatcacttctattatggaggaaataaccaactttttgcaatgacggtgattttgtttttcatcctccagtcctttagaattgggttaaatagcatatttataagagattgttaccgaaaattacgaaaccgacttccttatatttatagcagtttgtaacatagctaggtattaagattttacatatgaccgcatattctaaccgggctaaatttccttttccaaaaaaagaataattaattttgttacctattctcgccatgatttttcttttaagtttatggtagatatcaatttttgtttttctttttgttaagttattttgagaatttatgctaaatattgatgtggaccaataatatcatgtttttaaaatcctatgtggacacctttaaaaccaaataacctcaacttttatatagtatagattgttgctgggtgagttttttcctaaaatgtgacagtttagtcgcaccaaccgttgaaggtagttccagtggtgcaaataaggaaacaactataaatggttttttacaaatatctgatttcagtagtagaagactattgttagttgttacctcgactattattctccttcaacttttttggtcatttcaatagctttacctttttactttaatattctattttgtgttttctgtgaatatgattttagttttcaaggattcccttatttttcgccggcttttgtatttcaaaactgcattttaagtgggtgattggttcgtctgtagctgtaaaaattttgcggtaggtgtgatgactttagctttaggttttattgttgtagaaattaggctgtaaattttattaatataatattattacttaaataaattgattgtagaaataaaattttggttgtatgtatttttaaacaagaaaatattattggtaaattgtacttatatgttatattatattatttacaaatatcaatttaatatatatattaaaaaacaatgtgagttatatatatgtcctaaagtagatatttacctactatttatattcataaaactaaatttaatatatatatatatatatgaaaactataaaaaaaaattttaaatgaaaaataaagtgaaaagaaatgaaaaagatatcgaccttttaaagaccactttaaaaaaacttgatttaggctgtaagaaaaaataggaaagctacgacataaaatagaaactctataaattaatactcgataaattaataaacacgatatattaataaattttgccggtcccaagtcgggacaatgtaaaaattaaccaaaatcgataagataataagataataaattttttgaaatccctatgtaaagttatagtcccactaatattataaattaataatcataaatcttaagtatatattttaagactaatttttatatgaattttttgttcaagctacaattacaattcgttttaaaatacaactagtatgatatctgttgtagtcacataactatttgcgtatttgatccgttatagttgattttgtaaaatcttttatttgagaaagcattgctaagaattgtgtaaagagaaattggattaagcttcatgtttacgtttacgttcacgttcacgttaatattgtagatatacatacacaatatcttgccaaaaaataaattaaagaagtcaaagaaaaataaaaacctaacataattatatatgcaaacaacaaagcatatagataattaaattaataaacattttcaaaagaatatagtattgtattttacacaaacatttctataaattaatatttattaacttatacgataaattaatatttattaacttatacgataaattaataaatattaatttataagataaattaatatcactataaattaataaaatttcatggtcctaacattattaatttatagagtttctactgtaattgtttcaattctgaagctatagtttttaatggttttacaaattttcaacaatctaaccaatcatgtccaaaagtcgtatcatatccttatattttttcattgtattatttttaaaaatttgtaaattttaagaccaaaaaacaatttttttttgttttatcagaaaagcaaataatcaattgcctgattcattttcgtagctccaccgagaaaactccgagtggccgaaacagagatttcgcagaggaaccatcactgattgtgtcaccgaaccattgatcttcaagttccgatccaatttcagat

SEQ ID NO: 8054 - DNA, 3000 bp, Unknown
  misc_feature (1)..( 3000): cDNA_ID_1810195_gDNA_ID_1621187_Annot_ID_57450 3000 nt of promoter + ATG
caaacaacaagaacaaagcaacaacagtaaaaaaaaacgcagcagagtaaattctatgacaacaaaagggtccctccaataagaaatcaattatttacttactttaattcttcaacaagtaaaaaaaaagagaataccttttacacaattctgatcagagaatctacaaaacttttatgtaaaaattcttcaacgaaaaagaaaaaagttttgttttttctcttcttacgactctcgggaaagagttaaaagtattaattgtgaaaactaataaagttttttattgtttgttcgatggcaaataggtgccgtggaaattgggtattactatgactaagtgtgtgtgtgacatttttgacattattgaagataatggagagagttttacttgtaggtgaaagaaccgacacgtgtcggtgaaaaagtgagagatagtgtacacgtgtctgtgtagatgttgttgtgggatctcttaccgacgttgacttgttgactgtgtcctagaattcagagacatatagatgagagaaagtctttaggaccaaagttaaaagcccatttcgaaagcacaagtgtgaattgagaaatgtgaaatgtggacttttcacgaatcatcttcggtccggtgaagtgaaagacttttcacgaatcaaaatacaaaagcccgattcagaacatacagtaggataaagatttaagggattttaattatgtgacgtttaatatataattttgcgtaaaagtaaaatttatataataaaaacagttaatatattattattttattttttcatttttccacttttctattttactcaaaaaaatgcagatccatgcgaaaagtttattattatctcgtcaagctagatttcatcattttatattatctggtcaaacttttgttcaaaaaatcgttaggcgctagtcgggcagtaagagtggacctagcgcctaacaaaaaaatcagagattatacaaaaattaatcagggattagttttagggttgtttaatatttttaaaacatattaattcattataattaagaaatttatataatattgtttttaaaattatattaaacatatgaaaataagattgtaggttcaaatatatgatttttcatacaaattacgaacataagttggatattttaaattttaaattttctttttagaaaaaaaaaatttgggataggcgccctctagacggatttaggcgggtctatacggataaaaatcggatcaacgattaatcttctcgatttgaaaaaaattgtcgtggatcccatctgattagcgcctaggcgcccggctaggcggccgattttttgaacaaagggtcagactagggttccgaatagagaacagaccacacagtatcgtatacttctaatagtaacaaaaatatctacatatatacatacaagactagtctttaagggagccacatgaaacatttgaatatgaccccatttttctttcaaaaatttacaccaaaacttatttgcaaataggcctccaaaaatattcagttctaagaaaaaggcctccaaaatttaaaatattttataataatcccaaaatatataacttgttgctttggtctccgaatagtcgggaccagccatgtatgtatatgtatatatttttgttactattaaaaccacaccgcactttatccgtagttgaatcgcacgtcatcattcggagcctagatgtgataattttacaatacagagtagaactcgaatccgttttatcataaaattatggtatttattttagtagattcttatattttataaatattgatttactagtgtttacactttacgtctaatgatttgctagacattcatgtatatcacaaatgtttaaacctaacatatgggaagaaaacaattgtagagttatattgttctaattattttcctttgatacatgaaataaagtatttagagtatgtttttagtaattttatggaggcatttattttcttaaaaatatcacgcagtagtttcatctataactaaatttatggaagtgtttctgaatcatgttatttaatctttttttagtaagcttattattttattttaatgtatttttgcttatattttaaatattgtgacaggagaaaacatatcacaaagtcctcaaaaagcttgaattataggggcttttgtacgggagggtacaattcagcccaaaaactaatggtaagacacatttcggtgggcttgtgagagtaggtacttataaggccgggaaatgatgagcgtacccttgagttggatggcgaaattgtttggcgggataagttatgtttcgaaatgtctgcccgctgacttgaccggcggtactattttgcactgttcgtggctatgtggacgccgaagatgcacgagggcaacccaacttgtgaacgacgattaagggccttatattgctggatatatttaagggttgttgtgtgcgtgtacattattgtgatgatttttccaaaccctagagaaatcgtcgacggcagaaggtgattgcacagaagaagtcagtagacgacgaatagtaaagattccgacgaccaaacgctgctgctatgagcccacatgtaagtaatttggaatcagatttgtcattgtagtatagtgtgtgacatgtaatttatggcttctattatagtttgtgccttatagtttgtgccttactgactagtttgtgacttgtaatttgtggcttgtagtatagtttgtggctggtagtatagtgtgtggcatgtaatttggtgcttctagtatagtttgtggcttgtagtatagtttgtgacttgtactttggtacaagtgatctgatttacagtttgtgaaacaattgaacaggggggagacgtagcggtctgtgttatagctggaggttgggactgttcagagaagggagtgtggaaatttgttgttgctaaagattgttacgctcggaccgtatgtatgaatgtggcaatg

SEQ ID NO: 8055 - DNA, 3000 bp, Unknown; identical to SEQ ID NO: 5304
  misc_feature (1)..( 3000): cDNA_ID_2106101_gDNA_ID_1621187_Annot_ID_57451 3000 nt of promoter + ATG

SEQ ID NO: 8056 - DNA, 3000 bp, Unknown; identical to SEQ ID NO: 5304
  misc_feature (1)..( 3000): cDNA_ID_2106101_gDNA_ID_1621187_Annot_ID_174502 3000 nt of promoter + ATG

SEQ ID NO: 8057 - DNA, 3000 bp, Unknown
  misc_feature (1)..( 3000): cDNA_ID_3047390_gDNA_ID_1621187_Annot_ID_174498 3000 nt of promoter + ATG
agagggcaaaagagatggctcttaacgatgtcgcatctctcaccggcttaaccacaataaacctttcaagacacctagagaatttaagtaaaaaattgttcactattggaaacagtatacacaatactccggtgaaacgagtagacatggttttgggagatacacgtgtaagttttcatattatagcgtattatatttacaaatattaaaacgctagtagattgtcaactatctgaagtatagtagaatacatggtcacacatgtcaagtaaactaaaagatatttagctacctcacgtatatggattgcatgaccacatatacgaagtataggggtgtcaaaatgggtcaaaattcatgggtcaactcaactcaactcaacccatgaacgtaatgagttgaaaatattgactcaaatgagttgatgggtcaaattagttattgggtcaattggtttgatgaataaaataaattgggttgtaatggttaatggtttcaatggtttacccaattaaccattaagttttgtaaaattgaattaaaccaactaaaatctctaaatcaatgtccatttaagttgaaccaacacatctaaaccaatttaataaaatcaatatttttccaaatttcttaaatatacaagcgatgaaattgagaagaagtaaactcgtaatttttccaccaaaaaacacaaaaccgtaattttctctccaaaaacgaaaacccgtgattttcccaccaaaaatgtaaacccgtaatttttccgccaaaaaaaacataaacccgtgattttcccgcaaaaaacgtaaacccgtaattttcccgcaaaaaacgtaaacccatgttttttccgccaaaaacgtaaacccgtaattttccgccaaaaaaacgtaaacccgtgattttcccaccaaaacataaacccgtaattttcccgccaaaaacgtaaacctgtaattttcccgccaaaaacgtaaacccgtaattttcctggcaaaaaaatgtaaacccgtgattttccgccaaaaacgtaaacccgtaatttccccccaaaaaaacgtaaacccgtgattttcttgctaaaaacgtaaatctgtaattttttcgcaaataaagtaaacccgtaattttcccgccaaaaacgtaaaccattgattttttcgccaaaaacgtaaacccgtaacaagtggaatccgtaaatatcctaagtttgatgataatgaattaataattattaataattatttattattattttataataattattaattaaattgttacttaaatggacccatttaacaactcaacccatcaaatgaaatgagttatgggttgaccttacccatttaacccatttaacccattaatcatttaactttaaactcatttgattatgagttgagttgagttgggttacccattttgacatccctaacgaagtatatgacgtcatgtagttaacatcaaaaggataacatcgctggacaatgggtcattattgaaaaattttctgtgtctcagaccatgggagaatttatggcgatgaagcaataattaccgaataaaaatcatttactccatgatttataataccaattaaatagtttataagttattcttttttattttttatttaaatttatctgtatatcaaatttcatttttcgtgcataaaattttgtaccaaactacatcatttcacatatgtaaaaaatatccctcgggattagttcttttgagtttaattgattttggttgataatatatatattatatatatatatatcaatctccattataccaaagttaaaactatatattaatattattttagttgatattagtaaaggttaatataaatacaaattaatatttttagttaataaaatactatattagcaaaaatctgggataaataatttgatatcttgtcaacattttgatacttcgataaataatgtattaatgtgttatttctttttgtcattatctacaaaatgtctaatgtaactaaaatctatttgataaaatgatgtgtaattttaatcataatgttttacaaaatgtctaatttaattagatatgtttaaaattaaatataaattttattaaaataatattaaaatattaattttatgtggatgagataatcattggggctcactaatggaggtaaaattgaagtatgagtttttctaaataaaacattcaaaaaatatagtctaatataattgagatatcatgtgggtatctcaccaataaagatgatctaagcgttgtctaacaaaacattataaccacctaatattaaacaaatgtcaaacttcgacattacaacatttagaatattcccaacatttttatgcattaaattttatatgtatatttaatccgggtcaaatggcacccctttctccttagtggatctgccacttaacatcattcattttcaataggtttgtgaaggcaagacttgtccccttaacggcaaataagattgaaaacgactatctcttgtcacacacttcgttatgtcacgagctatacggttactttgactttgaggcatcactaccttgaacttatacaccactagaaacttcgaactaggttgtgtatatggccaaagtatgtccgagaacgggcgcagggttattcagagtttcaatagatcatgtcagcttcgaaagaatccacaaaatataacacaatattgccgtaatcttgttaagggtatgtagaaaagcatcgtagcccacgcagcaacaccacatacaataaaacttgaattagtccatgaagaactcactatttacattctttgggcttattattgggttacaaaaccatctttgggcttattattgggtcacaaaaccatctttgggcttattatcagtgatccataattattcctttggaacttttttttattaaccctttatttctcatttgctctcactatcgttcgttacgtctctgtaaatcactgagaaa

SEQ ID NO: 8058 - DNA, 3000 bp, Unknown; identical to SEQ ID NO: 8053
  misc_feature (1)..( 3000): cDNA_ID_1807395_gDNA_ID_1621187_Annot_ID_174480 3000 nt of promoter + ATG

SEQ ID NO: 8059 - DNA, 3000 bp, Unknown; identical to SEQ ID NO: 8052
  misc_feature (1)..( 3000): cDNA_ID_3047399_gDNA_ID_1621187_Annot_ID_174477 3000 nt of promoter + ATG

SEQ ID NO: 8060 - DNA, 3000 bp, Unknown
  misc_feature (1)..( 3000): cDNA_ID_2154966_gDNA_ID_1621187_Annot_ID_174465 3000 nt of promoter + ATG
gacgaaagaataaagaaacaaccggaatgatgatttttaatgagataaaagaaaaaagaaacaaattaaatctaaattttttttatatgaataacttcatcaaactaaacggtctaaattcgagttttagtttttagttaaacaaaaatctgaattttctttatacttctaggaaattattttgtctacatcagtttcgtcaatttggtttcatatttcttctaaagcctagcaaaaactctaaaagaaaattcaaatttcgatcacctatgctaagtaaataattttaatttattctacctgcacaaataccatgtcatatgaattactttcactctattatctatgtttatcacaataaaccaaaataatagaagaacattaaataataaatttttattataatttttacaagaaattacaatgccttatttgataccactcttagtgcaacgacaaacaaattttttacacctagcaagatttttaccccttctaaaacaagcttttccgcagtcataacaaaaactcattacgccttgaagaaaagagtgcccgagatgtatatccactagatattgatcaattgaaggactcactgctggactatcaagatatgttgtctcttttgaattcattgttttggtaattatcgatgtacctataaaatttccaaaacatattgaaaattattatattaacatttaagaaatgaatatatatatatatatatacacataagatcttaattaaataaatttagacttacatgaggaagaaatgactagaagagttaaaaacaaaataattgtcttcattcttaatgtaagatttaataatattggaaaaataatattttaaatatcttttaagttttgtttttttcttctaatgaagttattaaaaactagacaatgtgatatttatatgttcttattaaaaatatgttacgaaaaagtaattgttctagtaaacgttttatttttttattaatgaaagataaggaaacacttatgtttggaagagtggtttcatttctaaagttttttattttctttacaacatttactacttataacagtacattcgagaataattcgcacgtaaatgtcctaaaatttggtttatcagactttttttaaaagaagattcttattaaatttactaggactagaactttatataagatctaaaaacaatattaaaatttgattagttttggtgatattacatgtaccgttaagtatattaaaaaaattttactgcctttttgcaataatatttttttatgttggttatttttaaaaagacccattttcttgaacaaaatgaccaaattatccatcatctaatgacaacatgtaattagaaattgaattttttttgccaaaatttacttttcccacaaaaaaaaagaattcacgccaaaattattttttccttgccagaaaaaaaagtttctcgcaacaatttttttcttccgccaaaacaattcacgcccaaatttgcatttaaaaatttttgtaaatttttttagaactgttttaatacctttgtaaatcttttaaaaaactttacaaaattactcagattagtaagttagtccagggtctctaaggttttactcttactgctattgattcccaaactatacctaaacaagcaacaagcaaaactcgaaacaacaataaatgcactaaaagacttaaacgaacaaacttctattccatcctagtttttaggcctctacgaattcagatcatccctcaaggcattgccacacactcctaaacacgaaattctaaaagagatcgcatccctcaatactacatcgtcatgttgcgcccggtcaattgcaaagtagccccgagcctttgtaagctataatgctacggagtttcacgcaaagaacagcagacggatcggaagacatgattcgactaatgctaattagctatccactcctaaccaagaacaaataaacaacaaaaagttcccaagtaatcggacagcaccacagttatgttaccgtaaatcggacaagataactgttatctttgtcggaatttgggcagcataacgtttataccatatttgaacataatgcaatcataatataaaacaatgaatcactcaataattatcgccaagtatgatctactaacctcctaagtttcataattatttaaaataaataaacacattaacatgtgctacaacacatgtccggaacttacgaaacttataggtgctccgcgcatccttgggaaacagctattcctaccccttgaatccattggtatttttctcctatttggttatctaacataccataatcatacttgattagggactaatcggcgattgctaaaaataaactacgatcggaaaacttaccgacttccaaatcagaacttttctcaggattccttagcgaaactaacttagagcgtttctagggtgaggaatttctaatgggagtcgaaggtttatatagagagctaaggcagtttactaagctacttcgccgttaggtcctccactaatcatgtctcttccgacaacatgtatcactgagtcacgattgtcaacaccaagcagcgtccgttgattaacaaccagactgggagcatcgtgaagttgacaccctgacatgagtcattgcccttgtcgacattacccgcatgcgagacatggtcgtttctctcccacatattgtcgtagcaacttatgtacctgctcgctgtcgttaagcaggtcgacgaggtgtccgattgtcggccgcacaataaccgcacacgccggcatgggtcgagcatatgtccaccgcggtcgggcacacgccatcgtgggtcgagcagatgtccgccgcaatcgagcatacgctagtacgggtcgctcacacatcgctcacagaccgttcatggtaaggtctttgattactttcttgtcccaattctaaaatccgttcgtgaatcatttccaattgcatcacaaagg

SEQ ID NO: 8061 - DNA, 3000 bp, Unknown
  misc_feature (1)..( 3000): cDNA_ID_1810226_gDNA_ID_1621188_Annot_ID_57455 3000 nt of promoter + ATG
gtgatgccccaaggaatcatcaccaaagacaagggatagtgcctccaccagttcagaataacaattttgagatcaagagtggtctcatctcaatgatacaagcaaacaagtttcatggtctacctatggaagatcccctagaccatcttgatagctttgataggctctctggccttaccaagatcaatggtgtcactgaagatatgtttaagctcagactatttcccttctctttgggagacatggcatacaactgggagaagactctgcccccagacttcatcacctcctgggatgattgtaagaaagcgtttcttgccaagttcttctttaatgctcgcacatctaaattgaggaacgagatctcaggcttcacacagaaaaacaatgaaactttctgtgaagcttgagagaggattaaaagctacaccactcagtgtccccatcatagtttcaagaaagcttcattattgagcatagtctaaagaggagctttaccaaagatcagaatactactcgacactgcctcaaatggaaacttcctgaacaaggatgtagcagaaggatgttagttggtcaaaaatctagcacaatctgatggatgctacaatgaagactatgatcgctcaatgagaggaactggaggaactgaggataaatagagcaaagatatcaaggctctggatgaaaagctagacaagttgttgttggctcagcagaagcagatacactacatcactgatgaagagcacttccaaatgcaagaagggggaatgatcagactgaagagctagctgtgttacattcagaacaaaggagggttcaacaagggctacaacaactacaagcccaacccaaacctctcctacagaagcactaatgtagctaacccccaagatcaagtgtatccaccacaacataatcagtctaagccttttgttcaacacaaccaaggttatgtccctaaacaacagtttaatggaggctactgaatagtgtgtattttgcatgttttgagcatccatttgtcatcactttagcatcatatcatcactgttttatacaatttctcatcatttgtcatcactttacatgtttaggatagttttgcatgcatgttgcatatttgtgttgttttaaggtgattcgaagctattgacgagctaattggaagaagcggacctgatcatgcaaaaccactcgacccccaggtcgagtagacgcttcacaacctcagcagaccactcgaccccctggtcgagtagaggacatcaccacttcacctcaccactcgaccacgaggtagaatgtcttcatctccatcacctgaccatcactcgatcacctcactcgaccccgaggtcgagtgtcttcaccaccattaccagacaaccactcgatctcaccactctaccttgaaatcgagtatcaccatcaccaccactcgactacatactcgattaagagcttcagagtctttttcattccgcactcaaccagacactcgagtacaaggaagaaaagaagactccagctattcactcgacctcctactcgaccacctgggtcgagtacagttcttaatccgtcctaatactgcgtcgttttaagtattagggtttcagaatattttgctataagttgcatgtacttcacattttcgcaaacaagtttttttctagttttattctgcagacactgtgttctagaccttttgtaatccgaatttctctttatttattcagtattcagtatttgttttggatttcttttactgttgttcattctgttatcatcctgctgttacactgttgttatcatgttttcaacctgttcaacgtttatgctttctgctatgatgtctaagtagtgaataggtttctgaggatgggttagagtagtgtagaattctcagtatgctaggtggttgagtattgattgatagatcccttctggattagttgttcttaatgcctattgctttctgatcaactggaatttgagcccagacatttccgcgcccaaaacgtgttcgatgaaatgtctgaaccattaattccagagattcgtgaccctgtaccaaggtattggttggagggagtgttttggctttaacttgttgattcgtaatgcctgttaggttagctctcgtcaatggtaattgagtctgggactaggttaacttgagggtctctattgcggtggcacttagatttggttaatgaatttattgtctagggataatttattgagcatgtcaatcacctgtaaactgaggaaacgaaactactcaattaccccatcctcgggaattctttatcttattgagttctttgtttacactactgttgtttactgcatcttgtcatctgttgcttaatttctgcaattctttcttgttactcaacctcatactcgaccacccagttgtctggcaacagactgtgcagtcgagtaactgtgttatactttctgtctgttactcgacctcacctagtgctctgcaaaagttgtgttggtcgagtgttttattgtttctgcttgaatttttgttttctgcatgttcatttagaactgctagaacacaccaaaacctgttattgcttggcttgacttagtgacttctgatcacatcttgattgttagcatcacacccatttggattgacaacctaaaatactacaacgacatgattggtgttttaggataattgactgaaaaatctattatcaatttggcgccgttgccaattgggtgtttgtttgttacatttgagatttcagacttgcttagatcaagttctttttcaattttcttttcagttactaactgtgtgtttttcttgttgtcttcttgatccaggtacacctctactgtatgccaactcgatcaacaggcaatcagaacctccttttcaacgagaacatcgaccgaatagctcgcgaactcagagaaaggagaaacacagtcaaccttgtacctcagcaaccactcgaaatg

SEQ ID NO: 8062 - DNA, 99 bp, Unknown
  misc_feature (1)..( 99): cDNA_ID_3047579_gDNA_ID_1621188_Annot_ID_174518 3000 nt of promoter + ATG
cagctcgaagacgaatatcagttagtaaaccagcacgagcaggaaaatttcaaccagctcaaaaccatgaggaaagtgagccgggaattgaaagaaatg

SEQ ID NO: 8063 - DNA, 3000 bp, Unknown
  misc_feature (1)..( 3000): cDNA_ID_1810286_gDNA_ID_1621189_Annot_ID_57461 3000 nt of promoter + ATG
tttccatggcaaacaagctatcatcatcatcatcatttctcttagcaccaattctcctggttccactcaatttgctacttcttatctcatgcctctcattggctaatctctcaatccgcctttcttcagcaagaagatccaatccatctcctttggaacctctctcaatccctctcgatgtatcagagacacgctgatacctcaccatctcctgcttcggattccctctcctgaaactctcatcttctgacacaggcactaaagattcatcactcttactccatcttacatctttggctattctctgaactctcctttcttcaacaacaagctccaattcatcaccttttgaacctcttgcaatccctctggatgtatcagaggaacggtgatgctcctgcttagagtatcttctcctaaagctctcatctttaggcatagtcactgaagattcaccactattactccatttcacagccactgaagattcacgacttttactccatcttgcatctttggctattctctgaactctcctttcttcaacaacaagatccaattcatcacctctcgaacctctttcaatccctctcgatgtatcagaggaacggtgatactcctgcttagagtaccttttcctgaaactctcatcttcaggcacagtcactgaagattcaccactcttactcaatttcagagccactgaagattcaccactcttactccatttcaaatctgtagccactctatgattttcaatttctccattcctcttgaaaactctctcattacgtttatcacttacaatctcctgccttgagtatctcttcctgaaagtttcatcttttagctcaccactcttaatcttcatatctttcacttcataaacactatcaccattcccacctccaccatcatcttcctcaactttcaatctgtcgaatttcttcttcttccttgctgttttaaccgattccatgatttgcaggtactgatcaaaactgggtttgaattcaaaacctttatcaccgggtttttgcaaaccaacctccttcgtgttcaaattcaagcaaaacattacctttgaattcaatttcctcgaattaagacgaacgactcgtcggcaattatagtatggctgatgaaacaatggtctccagaaagaattccgactttcatctaaaagcgatgcatttacgaaagcattcgtcgaaatcgtcaccgccatttttgtatccttactaaagctctactgatttttttctgcaattcactcgaagttcgaaattatcatcagaggcaaatcgtcgttgaaccctatcggctatcgtcaacgtccgacgtggctaagcgaataaaactacttgacgtttctttaaaacaaactaacgaggtgtagtttttatgaatatagaaacgggacgttgttttttatgtgtgacagatcgtacacattccaacttgttattgggcttaagcctgcgtttgaggctattgcaatattgcatgctttatttggttaaaccgtggtagttttgtgtcttcggtccatattaaatattgaatgggccaaaaatgaaataaaagacaagaacaatgatctttttgttataaaatataacgctaaaataaataataatattatatttgatgtgaatatgaaggaaagagccgtaagagaaatgaagagcgaaatagatttttgttattcttattttctcgttatttacaataaaacaaataactatatatataagggagaaatttggtgagctagtgttttggtgagcaagacttattcaaagatggataatcattcacgtttctaacacatttttctttacgttactaaaggctacacaaattcattataaagcataaacacacttggaaaccataaaatgagatggtttatagtgttagtatgagttgaaaccaaggcaaaagatgatggtgataatagaatccattattttcttgctagaaaagggtcttcaacggttaaatacaagagaaatgatgtaaagcaagtataatgagtcatgactcgtgttaattaaaaggttaaaaagtatatgttggacctacttcttttgatgtggtaataattattgctttgtagcttttttcctcatctcatgtagtatttctagaataaagcaaatcttattctcatgatcgtagattgctaagaataggtttaatcttggtttttatttggtacataatgctgggagggatgatttttttggacaaaccgcataaatccgttttggtatgttctgttttggctgaaaatggtcaaagaagagtcacggatggttattaaggagagaacaaaagcgacttctcatagaatcttaccgttggaaaatacaacaaaacgtcacctaaatgataaaagacaaataaagaatttaaagtaccaaaagactcaaagatatgaccactttcatttgtttcacccatttagcataacaacatcaacatgcaacatttgattaatgtgaaattaacaaaccaagagttttggaatttgttttttctcctacttatgtgtgccaaataaatgaacttctatcatattatagtacttaagaatgatattatattgaatagaccaaaaatgaaatagaagacaagaaagatgatcattttatatgttagtaaaggctacacagatgcattttaaagcataaacacacttggaaacaataggaaactacaagtgagaacaagttaaaagtcttccaccgatctctgcagttgcattaataaaaacattcagtaaccgagaacgcttttttcttatttcttctagctaaaagtattctcagaagaccattgtactctaaaacccacttaactctctctctttctctttcccctttcttcttctgagatacgcttctctactccactgccatggagctctaatgggtctctgcaattttcattcttttcctcttttcttctgagaatttcagctcaagaaccatg

SEQ ID NO: 8064 - DNA, 3000 bp, Unknown
  misc_feature (1)..( 3000): cDNA_ID_1810282_gDNA_ID_1621189_Annot_ID_57462 3000 nt of promoter + ATG
gagtggataatatacacttacgtgccatgcccttcaccatcaaatggtgaagcatcatcctgagatgaattcaagactcctctactgagagcagactcagcaaaatggcgtgctccaatgagtttcctattgcaagaaccgggcgggaaaccaatggtaacttcacagacgccagtaaagtgaggagggaccgaatatgtatgccccgagattttgtcactgaaactaggatgagtgggatcaattccagtatcaataaagcctataacaactccttctcctgcatattcagagcctccatcacggagccaagctccacgaggcaaacctaagaactgtggtgtgtgagtagttgctttctcgaccagaaagtccagaaccacattttccacttcttctctagctgcaagtctatcagcctaaagaaaaaacaaaccagttttcaaactcaagagctcataacaatgaacaaacactaacatttagacattcatatactgtttccaagacaatgtaagtacctgttttcgagtaagaaccgcggaaaacccattgataagatagtggtaactataaagcttaaggtaattctcctttctcaatacatttctcagcaatgaatcgtgaactctaataatagaagcacttcggttcctatatatgtataaacaaagagattataatcatactatagcataaaggtttcagcttgaaggcattagacattaatgttaatagcttcgtttaacaacataaaggtttcaacttggagcacgaattcaacaggcatgcctatatatccgtttagactttcaggaaaagaccaaagacacaagagacaagtaatctgggacccaaaattgacgaatttcaactaatgtcggtctatgaagattgagaaaaagaccaaaccctcccggaaaaatcaacagcgattccacgaagaaatcaaaccctggataaagattgaaactttgaagaacaaaaagaaagaatggtaacttttttctacatacaatgttctgtaaatttgggacgaagtagcggtaaggctgtgtttagagtcactcgattctctgccggagaaatgaacagatggacggtccttgagagtaacaatgtaaacagcagaagaaacggttgcgttttggtcagactcagccaaacagaacacagacgacgaaaccaaacagagaaggaacacaaaacgaacaagagaagactcatccatggttcttgagctgaaattctcagaagaaaagaggaaaagaatgaaaattgcagagacccattagagctccatggcagtggagtagagaagcgtatctcagaagaagaaaggggaaagagaaagagagagagttaagtgggttttagagtacaatggtcttctgagaatacttttagctagaagaaataagaaaaaagcgttctcggttactgaatgtttttattaatgcaactgcagagatcggtggaagacttttaacttgttctcacttgtagtttcctattgtttccaagtgtgtttatgctttaaaatgcatctgtgtagcctttactaacatataaaatgatcatctttcttgtcttctatttcatttttggtctattcaatataatatcattcttaagtactataatatgatagaagttcatttatttggcacacataagtaggagaaaaaacaaattccaaaactcttggtttgttaatttcacattaatcaaatgttgcatgttgatgttgttatgctaaatgggtgaaacaaatgaaagtggtcatatctttgagtcttttggtactttaaattctttatttgtcttttatcatttaggtgacgttttgttgtattttccaacggtaagattctatgagaagtcgcttttgttctctccttaataaccatccgtgactcttctttgaccattttcagccaaaacagaacataccaaaacggatttatgcggtttgtccaaaaaaatcatccctcccagcattatgtaccaaataaaaaccaagattaaacctattcttagcaatctacgatcatgagaataagatttgctttattctagaaatactacatgagatgaggaaaaaagctacaaagcaataattattaccacatcaaaagaagtaggtccaacatatactttttaaccttttaattaacacgagtcatgactcattatacttgctttacatcatttctcttgtatttaaccgttgaagacccttttctagcaagaaaataatggattctattatcaccatcatcttttgccttggtttcaactcatactaacactataaaccatctcattttatggtttccaagtgtgtttatgctttataatgaatttgtgtagcctttagtaacgtaaagaaaaatgtgttagaaacgtgaatgattatccatctttgaataagtcttgctcaccaaaacactagctcaccaaatttctcccttatatatatagttatttgttttattgtaaataacgagaaaataagaataacaaaaatctatttcgctcttcatttctcttacggctctttccttcatattcacatcaaatataatattattatttattttagcgttatattttataacaaaaagatcattgttcttgtcttttatttcatttttggcccattcaatatttaatatggaccgaagacacaaaactaccacggtttaaccaaataaagcatgcaatattgcaatagcctcaaacgcaggcttaagcccaataacaagttggaatgtgtacgatctgtcacacataaaaaacaacgtcccgtttctatattcataaaaactacacctcgttagtttgttttaaagaaacgtcaagtagttttattcgcttagccacgtcggacgttgacgatagccgatagggttcaacgacgatttgcctctgatgataatttcgaacttcgagtgaattgcagaaaaaaatcagtagagctttagtaaggatacaaaa

SEQ ID NO: 8065 - DNA, 3000 bp, Unknown
  misc_feature (1)..( 3000): cDNA_ID_1395054_gDNA_ID_1621189_Annot_ID_57464 3000 nt of promoter + ATG
aaaataggaaacttccaaaggagattaatgcaaacattcataaaaaaataaaggggttatatccttctccaagtaacagaagaatatgcacattcacttcattctaagttggaaaagaatcgttctttatggaatatttcagatgaacttcaggtggaacagaacagcatccaccagaagatagagataagtgaatctagtacataccagggtccttctgttttgttgccaatgtaaaagctgttcctgctgagttctcctaggtgcagaaggaggcttggagagtctatcatgttctgctgcaggctttgtactcctgtcaacaagctccgccttaaaatctggaaaatttttgctttccagagacttgctcaatccaaaatctgaaagcttgatatggccgtttcgagtaatcaataaattatcaggctttatatccctacaaaagcaaaggaagaaactagagttaaattatcaccacgtatcaactgaaagctaatttacaagcactgtaggaaatccggaagcttgatatgattctagtgatagtaaatgtcaagtaagatgcaaaaatggaaaaaagaacaatatgaaaagcttcaaatgccagttgttcaaacctgtggacgtaattatgcttatggatagactcaatagccagaattgtctgcgcaacataaaaccgagtctcatcttcccgtaaggtatcctttcgcatcagcagtgtcatcatatcacctccagggaggtattccataataagatacaaatgctcatcatcttggaaagagtaacaaagcttgacaatgaaagggctatccacttctgcaagcacatttctttcagctttaacatgttccacctgatatttaccgcataaagagaggattagcgtatttacgcagatgttaatgaattaccaatttaatcacaactaaactctttgatttggagagatgctatcagatagtgcattacctgccctcgtcgaagcatctcggatttctttaactttttcattgcatatacgcttccagtagatttttctttacaaattctcacctggacagaaatgaaataatattaaatcaatacaccaagtaaaatcactaacagaagctttggttcatagaaaaagaataatagctagttatcagtacttcggtagccagtaagagagctaaaaaagaagcaacatcaaattttatatgtaaagatgagacaagatattagctaagcttacaaaaaggaagtgaaaaataagagaggcaaccacaaagaacacataaagagatatacctcaccgaaagcaccccggccaatgatgctaagcagttcaaagtcatcaacccccattttctgtctttgtagacgcatatactccatttcctttttctcaaagttctttaatatatccatcttgtcttcaacagtaacatcagcatcagctaggttttgttccaagatgctccgactgtattcaagagcgagctgatatcagaaggttcaatctaaaccagtagcagattaattcctaaatcagacccaaccatcagtactagaaaataagactactctgaagttccatttgtaacaactaaagcacaagaagtaaatattggcatcacaagaagaatcccgagaacgtaccgctcttttctttcctggagactcttcttctgaattttataatgattctcgatatattgcttcgctgcagcaactttctgtttagtagcattagatggtgcatcattcataggaggtctcccaagattcttcacatttccctcttgtccctttttagtagggcttgatttatccggtttctgctgccgtatctggaaccagctccttgtaggctccgtagccatttcaatccaatctaatgcaaatcacttcataaaacctgcagaaaatcaaaacaaaattccaaaacccaaatgcttcaaaactaaatcaaattgatgacaaattcttgtctaacaacgctggtcaacacctaaaatctcaccgtaaattccggaaacaatattaaaactttcacttccaagttaattccacacgaatcgattttaatcactcttgacatagagatacatatacatctagttctggattgtggattgcacgcatgcattcgaatcaaaacttgcttataatcaaatagttacaaactccaattccaaacaagatacgcacaaacaccatgcgagattgaagaagaagaaaaacgaaaagtcaaactattcacaaagaaaaagtaaaactcgatcggggaagatgacaaatttcgcgaaaggatcaaagaaacttacatcaacaaaacaacaaatcagagagattttgattttagctctcgcttcgaattcgaactgttgcttacacgcattcacttaaaacggaatttttttaattaaaagatctcaaaagggagagcaaaaacggattacgaactaataacgttttttgggcaaagcgtattttatcttgaagcagtaaacgccgtttaagttacagtcacgatgactcggtggctgattaaaaccaatactggtaaaccggcttttaactattcccgggtcatttattggggaagctaaatgacacgtgtcagtaaattgttggatttgtttgtcgacataacgtgacagcacgattgaacggagtggtttgctaacgtcattagaacaactcccgcgcgaattggataaaaacgcgttttattggtaagacaagattgtcaccgtccgtatgtaggagacgtgtaaagagaagcagagtgtcgaactaattgggtcatcgaaaagcccattgggcctaaaatagataacaatgagtgtcaattgtaacattcaaaatgtatggggctttatgtacatcttaaggcgtcatatttttttggttttgattattcacacttcagttttctttattttggagttagacacggatctgtgagatctagaagaagaagaagaagaagaagctaagacaatg

SEQ ID NO: 8066 - DNA, 3000 bp, Unknown
  misc_feature (1)..( 3000): cDNA_ID_1810274_gDNA_ID_1621189_Annot_ID_57465 3000 nt of promoter + ATG
tcgttttcaaaagtctgccttttgtctcatcagttatggagattctggatttcaaggaacaagatctgtagttctgttggattcgaaactcaatgaaaacaaaagcttcagtgagaaatcaaagtaaaatgcaacatatccaatggaaaaaactgtttatctatgataatttcaagatagggtcggtaataatatgatgttcttctggtagatcataaggcaaattgattccatggactttgaggtacttcaggcgaaagattgaagtgctctctcgaagttatcttcagctgatgctgctcgcttcacaaggacgtgttctggatgtgaaagtttcagctggctgcaaaaggattggaaatggaggaataagtcagcttactgatgcacttgttgttatgcagaaaatgcaaaaggtcatgaatatttatactttaggtagcgagaagatgatttcccgacgtgaagactgcatacaacgaggtttgcaagagtttctgggtctttagcatcctgcaatgagaataaacatctatgatttcaaacttgtccattttataataaacggaatagttgaaaagtttagatttggtgtaaggagttttcaagtatcctcatagatttaaatcgagtgagcatttccgatgacatgatattgagaatgggttgtgtcgatacagatttaaggaaagaaagagtaggttcatcactcaccttgttgagtgcttcaagtagtagagtctcagcttcttcaaaattacccatatgcatgcagcaaactgctttgccgttcaagatcaagcttgtcattgggtacttctcagagaaatcctggaagattagataagcttcctgtatcttggaaccaccctgagatcataaagaacaatttcatattaagaaacacattaacaaacttctctacactatatggaaaaaagaaatggatattcatatcatactactgccagattcaaccacgcgctcgcgagctgagtgagtgtgtggtcttcatcaatctgttgcatcactctcagttgtttctccgcaaaatctgatctgtgcatctttatgaatatctggacattcaaagcatgcctaaaatatgcagaaacaacaatcatttatcgagtaaacgaaaagagatcgctgtgacaagacaaaacaaatcgaaaagctcacagatccatggttcctccagaatgagtgtgcttcagagcctcattatagtcttcctcatgcatgaatatagtaccagcaatcaacctgataatagcattgtttcctacagttggatctgccaaccattccctcaagctcgaaatggttgattcctaaccaaaatcacagaaacaactacgtattcaacaatgcagatcactaaaataagatcaagatatattcaattccggatctctgaagctaaatcatcaaaagaatcctagaattctactaaagttatctgaaattccgctaagcaaacgttacagaagatgaattgaaacatctcaaaatctcttgaattaccttgttttcaggactcgatagatacatagcaaggagtttcactgcctgtagaggagtagcagcggcttcatcgatctcactgatgacaagctacgaagacgaaatttgaaaaacgtaaatcagcaaatgatcaaaacaaattgaaatccaaatcgaaaaacacgagacggaagcaaaacctggtaacttccgagagcgatgtaagcgcgatggacgagacagtctcgctcgacgatatcttcctgcgaaagattagggatctcgctgttgttgatcgcagcttgataagcacccaagtagaaatggtttctcaaattgaagagatgatctggtcctgccatggatgccattgtcttagcttcttcttcttcttcttcttctagatctcacagatccgtgtctaactccaaaataaagaaaactgaagtgtgaataatcaaaaccaaaaaaatatgacgccttaagatgtacataaagccccatacattttgaatgttacaattgacactcattgttatctattttaggcccaatgggcttttcgatgacccaattagttcgacactctgcttctctttacacgtctcctacatacggacggtgacaatcttgtcttaccaataaaacgcgtttttatccaattcgcgcgggagttgttctaatgacgttagcaaaccactccgttcaatcgtgctgtcacgttatgtcgacaaacaaatccaacaatttactgacacgtgtcatttagcttccccaataaatgacccgggaatagttaaaagccggtttaccagtattggttttaatcagccaccgagtcatcgtgactgtaacttaaacggcgtttactgcttcaagataaaatacgctttgcccaaaaaacgttattagttcgtaatccgtttttgctctcccttttgagatcttttaattaaaaaaattccgttttaagtgaatgcgtgtaagcaacagttcgaattcgaagcgagagctaaaatcaaaatctctctgatttgttgttttgttgatgtaagtttctttgatcctttcgcgaaatttgtcatcttccccgatcgagttttactttttctttgtgaatagtttgacttttcgtttttcttcttcttcaatctcgcatggtgtttgtgcgtatcttgtttggaattggagtttgtaactatttgattataagcaagttttgattcgaatgcatgcgtgcaatccacaatccagaactagatgtatatgtatctctatgtcaagagtgattaaaatcgattcgtgtggaattaacttggaagtgaaagttttaatattgtttccggaatttacggtgagattttaggtgttgaccagcgttgttagacaagaatttgtcatcaatttgatttagttttgaagcatttgggttttggaattttgttttgattttctgcaggttttatgaagtgatttgcattagattggattgaa

SEQ ID NO: 8067 - DNA, 3000 bp, Unknown
  misc_feature (1)..( 3000): cDNA_ID_1810264_gDNA_ID_1621189_Annot_ID_57469 3000 nt of promoter + ATG
actgacggagatggacctggtcaagctctagcggaagaacttgcacggcgtttggggaaagaaagatgttggcttgtcaaatggccgaagaaaagtgaagatgaacatttcaaagatgcaaacgaggttagtgtagattatatgtaaaatttatgaaattgcttttgtggttactctggtcttaatgaccattacttggatgattttcttaggtgcttatgtctaagggacctcatttactcaaggaagctattctaaatgctgagccttaccctttgaagtcatgaagtgtgtccaagtcatgttcttcatatttgtcttattaatttttcggaactagcattaagagtataatttttattttctttctaattttgcatattatacacattctaaatttaattattaaccaagaaaatatattaattgaactttttgatgaaacagagtacatagcacttttggattaaaaaaccaacgaatttacattagttaagaagacaattaactaatggttaaactctaactaatattgaaactaccaaggaacaaattagaaacagacagaacatagacaaatctaattcatcagatttgttgacaacaatttgttaatgtctcgagaaatcttagggtttgtcaagatgcattcttcggcttttaggacttgaaccatttcccttggaaccacacacacttcttctgtagatagcttctcctggatttcttgagaaccaagcaaaaactgcatttctcttcccacctttgaactatccagagtctgcaaaatttaaacaagtatcgtataaaaaaaggaaggaaaatactgcaaggaaccatttggatttagggtttatcttatacctgcattttggtctgcttcagttggagaatctcaatttgagcctgcaagaacttgacatatttagctgcggcattgaacatttcggcagtgttgtgtttctggcttccagggattagttttcccagctcttgagtcttctctgtgattcttcttctcctctttcgtgctgcgatgctctgagcagatagctctcgcttcttggtgtcgccttgttcagtccacccaaccttgaacgtcgatgagaaatcaggagcttgaaacttggaaatgttggaagcttctgtgatgtaagaatccaagaggtaattagattcagggctaggggaaaaagggtcgtgactgttgaaatggaagctggagtcaatgagtttctggtgttttggcgtgtggaaggaatctaattcctgtgactcgttgaagactcgggtcttagggctaggaaggaagatttcttgagatggaagaaacgactcgtagaaatgatcatagtgatcaaacccgaagagagacggtgaaagagcttcgtcgggatacaatggctgatgttgcggttgctcttggaagaagaaactgtcagtttcagggataatcatatccacatcagggataaagcaatcctgaagctggattacatctgagttggagaagtagcttaagcagtccatagttaagaaatagatgatgaatttttagcaaatgaagaatgtgaagcaatcaggagcagttacagatggggaggttttgagtaaatggtttaattaagacttaattagctttaattgctgctaatcaagcttagagagagtaaacgcagaaaacaaaggaaaggacaggagaagatatatgagagaagcagggattctgtcttttgttttcttttgagtgaagtaagacaattcaggtagtaagtttgtaacttgtaacttaactgtcacgaaataaatatgaaagagagagggagaagttagggttttggcgaggattaaggaagggctatagtgggttttaacttttagatttagcttaacaacctcctaaatattaggcctcgtttattttctttttcttaattccatttcaagaaatatatacttatattagcttgacgttattttggtacattttattagttcttcaaagatactagattaggaactaaaaaaaagtttaaaatgaagttagagttctacagcctctaaagcctcagtaggctactaccaatcagcccaaacaattttaatttgccaataacttttttattcgtggaatttcacgaaatatatacaaaaaatatataatttctttatattataccacgaaagcatacaccacatttcacacttgaatcccaaagagaaatcagacactactttctaatgaagaattagttatctagtaccatagaaatgtaattcacaaaccgcatttagtttatcctcatgaacttatgtttagtagtataaattcgcaaaaacatatattaaaattcattaattctacaacatctaaaattcattatgtatattagttcttagtattatataatagcatattgggctattacatttattttttactattttaaaacaatttaagaaaaatgaattaagtaagtaatttgtgtcatattttagcgtttttcttttatcggtggcgcgatttactcggtaaaagaagagctactacggttttagcggctaaaaatgttgagattggtggttccacgttgttctctctgactttgccgccaagtttcctatctcaactaattaaaaatgggccaggcccaatcgctcttctacgtgccacacacgctttgactttgttgccaaggtttttcttaaggaaataatgggtcgaaataaatgctaacaggcctaaagtaacaattaatgggcctttttgcttcgaagcccatttatctcaaagagagcgaaatcaaaatcttccttcgtcttcctccataagacacggatacagaggagggaaagaagaacccctaaaacccttgagcaaccactatgaatggataatagctgaagagcttttactcaaatcgatacttcgagatgcgatttttgcttcgtttaccacaaattcattttcggaaactctcgtgctcgatgtctgtactc

SEQ ID NO: 8068 - DNA, 3000 bp, Unknown
  misc_feature (1)..( 3000): cDNA_ID_1810260_gDNA_ID_1621189_Annot_ID_57470 3000 nt of promoter + ATG
aaaatattttcactgaataccctctttcctttctgaaacatgaaagattaatattcgttttgataggacggagacagagtatgtcagccagatgcttacaaaaatcaaacgcttttcccaacaccactcctgccatgtctggtttgtcgctcatccaaaacagttgcaacattgggatggcggtgcaccaaacctttacgatattagtggcagcgcacattttataaacaaatgtgacaatggtattatagttcacagaaaccgcgacgaaaatgctggacctcttgatctagttcaagtgggtaccaatcccttcatcttcatctgtaatgtattattttaaaaatggccttcttattgtgtaaagttactaacctttttgtatgttttagattggtgtgaggaaagtacgaaacaaggtggcaggacaaattggtgatgcatacttgtgttatgacaggtacataaacttttcaactaccttcttatttctactaatctaacttaacggactaaacaagttttcacaagaacttatgatagtattttgttactttggcatcgaaaactagctgaagttattccgaagtacccaaagcgtagagacctttgcctagaacaccaaacctttatcaaaactctgttcaaagttacaatcgataattctactatgttggttcagtaatgaaatctttattcgacaggacaactggttcctactcggattctccagtgacgcctggaatgccagagaggagatcacccaagcggtactgatcagtttggtgaatttaaaggccgtcaaacacggtggacatagcgtatcgataacatttgtcaactaaattttatcccttttgggttaccattggtgaggaaaaagatgatcttgtgagattcttacctttgtgttttaacagactgtcaagattcaagaacaagattatgtctctactatgtaatgtggaattatgaatcatggtgtttctctattgtgtctggtaggtctgatccaaaatgtgactgaattcgatttttgtacagctctgtgatctttttgtgctctgtctgtttctgtagtttgttctgtttctctctgtctctgtctcctccttttgttgcggctgatttggtgttgtgaattagctgtataactgttgacttcaactacctctctgttataattatgcaaactctttgcaaattgattcaattatttccaatgttatactgctttgtgttacgtctatctagttgatttctttgagtattaatctaattgtcacgcaaatattttataatagaatcagttgcggcggtgcactataaatgtcgatcatatataatcattgcgaacgtaattaatatagggaatataggtgaaagttgtggaaatagtttattctcgtcaaaggatatgaccaagaccaaaattattggtattatctaatttatcaatccattgtttttttttcacacatttgcttattctgatatatttagtattgtttttaattatacatcataaagacataaacatcatagacaaaacttttattgagaacttatataaataatcattttttgtgtatgttaatcacatatttacattaggaaataactaagtttagaatttttcgaccaatattcaaatcacttaatcatctgatttacatgcaaacatttgatgatatgaaaccattcatatgaaacagcaactcattaatataaaaatataatgattagtgtctttgttggcatattttggtgtcaacagctaaaagagacatttacttaccaataaaggagaccgtatatccaattccgactgtttaatgaaaatcatgatatattaaggaacaaatatttgattgagaaccgttacaacgaagagattcttctccactatcacattatacatggtactttctaattatattaaaatgggacgtaatttagaattaagtgataactctgtaaaattagaaaggaaacaaaacaaaataaaaccatattaaaatgaatttcacacaaaaagtgactttggtagtgaatatatccgtccgttgcgccgaacatactctgtcgaatagcaccacgtgtcgtgtaaacagatcagcatcgacgaccgttgagagaacatgagaagcgaaacgtgggacctcaccaatatctttgtttattaatttatatttcttggtgctacgtaaaatatttgttctgcgattttgagaatttgccaggctggcaaattggggccaggttggatcatccaacggctgtggttggttcttcatgtttactggtagggtccatcatgtgaccgttgctaagggcggtgtggaccacctctagtcctagggttttttccttctctgcataaagctcccttctttgttcctcctcctctctcttctcttatttattcacaaccccccattaatctctttctctgctgcagcttaaactttaaaaaacactacaagaacaacttcttcaggttctataaagagattccgaagaagaatcttttccagaaacagtgtaagtcttatcttcttctttaggttggtttctctctttttctctctttagaagctgttaaattcgaatcctttttgggttttagttctattgtctctcttgatttctcgatttttatatagataaacttagaaagcttcgaatttgagctaggtttctctcgccttcaggaaaaaaaaaaagaaagtttcaatcttttcctcctgagatttagttctgcagagttgaaattggattctgtgttatgttgtttgagttcgtttaatcgttagggtttatacaagaattacgtttttgattttagatctctactaatcaggaagaagaattaagcttgtttcttttagatctcaactaattcaacaaggttaattagttctagggttactactttggtgaattgtataattggtgactaaatattgtttgaatcgattctgaatgacaggctttaag

SEQ ID NO: 8069 - DNA, 3000 bp, Unknown
  misc_feature (1)..( 3000): cDNA_ID_1810256_gDNA_ID_1621189_Annot_ID_57471 3000 nt of promoter + ATG
tcagtacggtgggttcaaaacagtagacgataccgaattctccaacgaaactgtctctgaagttgttgttaagcctggatcatctgaaaccatcgaaatcccagctcctgaggtataattagaaaaccaaaccctaccttattcctgaagttgttaaaccctatctttctaattatggttttttgttttgtggttgttttcatagactgaaggtacattggtatgggacatagcggttttgggatgggaagtgaattacaaggaagagtttgtgccaacagaagaaggagcttacacggtaatagtccaaaaggtgaagaagatgggagcaaatgaaggaccaatcaggaacagtttcaagaacagtcaggctggtaagattgttcttaccgttgacaatgtctctggcaagaagaagaaagttctgtacaggtacagaaccaagactgaatcctcttcctgaagtggaggatttcatgtagtctctggatatataatattcttttctaaatttaaacgtttggtgttattatttatttttgagtgatatgtaagagaaagagatactcccattatttcattgatattcaatcttttgcttctttctttttttggtaaggtcaatcttttgcttctttggtatgagatttttcctctcttccctatttgatttatttgattaaaactgtatggataaataaatatgttcgaatattcagagttttacatgggctgagtattggcccaatggcctttcagagtaacaccaaagaagaaatatgtgatatgttttgtatggttgttctgaaaggttttacagtgagaaaaacagttgaacaaccaaaagaggaatggtttgatgattaataatttttcttttgatctaacattcattatattataaaccccaaaaccgggaaaaaattgaaattcggatggaaaaaaacataacaactctatccatagttaaatcttttttttgtttgtcatctctatccatagttaaatcttagttcttacttatgagtaaatgtccttagactactcatgttacgatcgatgatgcatgtgtgtgaacttaccttaatggatatacgcggcgaaaacaaagactgccacaaaatctactctttgtgttgttattggtacacatcaatggatgaagaatagtggctcgaaccgcttcattggccagaaaaatataagattagctactacatttttttctaaagtaaaatcaattttgttttttgggatcaatttttgcagaattctatgtagtgattacgacaccacacgcatgcatggcatcatcagagaaaaagattatagatgactagacgcactgatccttctacctttttttctttaaattgaatgattttaatataaacaatttgtaacttgtaatagatttgcacttctcctcctataaatgcgttcgtcaacatctttgctttcgtacggtaaaacaacatctctcgttgaaacaaaatgtgtttgatcattttaaattttctaataccttacgtcttttattttaatttctataagaattgtctgtatggaaagtttttttaagatttttgttgcattttttttaatggacagcttagtcatgcttctctctaatctatagactaacatgcgggtaacatataaatggcttatataaatatattcttaacaaaaaatatcaatattcttttcagcatatcagtgttataattaatttagaatccacgtctagtttatattttcttctttatttgcggccccaataatactacttttggtcaacaatatgaaagtcaaaccagccgctcaaatgtatccttcatgagttcatgttatatttcagtcaatacttttcatatttaaacacttattataattacgtaatatttttttgcccaaaaaaaaaaattacgtaatattcaacatctctaccttgtagagttccaaaacattgtcacaaaatatttataaagaatttattttaactaattaggtcgttaattgtccaagggtttttcatagttgatatagttctgttcaaatatagccatccttaatcgattcatgggatcgtaaattactacttcgagtgttgtaaaaaaaaatgaaacttctacattacaaactcgaatttaatgcatctggagtgatactataaaagtagggatgctctcaggtcgcatttgagagacacagaaatgattttaatggaattaatatattttcagtttttcacaaaaaaaaattgtgtttataacaactgcagattcaatgctgattttatgagtctcacctatagaatttatatttctatattcatagaggcagtataggtgttgacccaacatcgaaagaacacttcgtaaaaaattctttggaacaaggctgaaaatttactcccaaatttagctatccgatgaagataaatcatttaccgtttattaaagaattatcgagattttagtccaaaccaaaagagattatgagcctaagattttgaatttgtattggtaaaagaaattgaacgaaaatttcagaaaaaaatattaataaattgaacgatagagttcacttactacatagtcaactagtgcctagctataatagtttcaaaagacaaaaaaaaacaaaatcggttaactacttccgtgacataattctcattttgatttttgaatccagtctaatttgaaaagtatattcaaaatctttaaatccattaatgataacttttataatacgttgacacacgcaattgtatatacaatattcttgaattttaaatgtaaattctagaatatattgcgatcaccacactaatcaaaatctttgggacaacttgaacccacatttgacttttcttggtcaaatattttggcatcatgcatgatcttctctataaaaaccaaaaggcctcaacgacattcataaactcagtcattatatttatttttgttgtatttcaacgttcaatctctgaaa

SEQ ID NO: 8070 - DNA, 3000 bp, Unknown
  misc_feature (1)..( 3000): cDNA_ID_3075806_gDNA_ID_1621189_Annot_ID_174544 3000 nt of promoter + ATG
acgacaatcaacattttcccgccaaaacgcaattcaacattttcccgccaaaaacgacattcaatattttctcgccaaaacgcaattcaacattttcccgccaaaaacgacattcaatattttcccgccaaaacgcaattcaacatttttccgccaaaaacgcgattcaacatttttcgccaaaaatgatttcacattttcccgctaaaaacgcaatttaacatttttccgccaaaaccgacattcaacattttcccgccaaaaaggatttcacattttccgatcaaaaacacaattttaacatttttccgccaaaaatgatattcaacatttttccgccaaaaacacaattcaacctttttctcatcaaatatatatgtaatacagaaaataaatacaatttaaaatatatttataagcaaattatagatacaacatacatataatagtatattagcagttaaaataaactctaagaaaatgacaaacaccaagttgggtacccacgggtagtctcaaaacaatcagtttttttcgggctttacccactaaatcaaaaacccatctgggttttctaaagttgggtttttggtgggcaggtttattttgggttcaggtcgggttgggcttttttacccaccacaacatctctagatcttggagtacatataccatccagtttagttagaatatattattatccggttcaattgactggttaagttagaacagttctatataagaaaattgttttacactttactctttaagaaataagaatcgaaaatcttaacaaacttttcttaatagctcagctcaattcttattttgtaatatggtatcagagtcaggtttcaatgtgtctcgattgtagaccatccgtggatgtccagtcccacaaacttcacgtttcagatgtccagtcctgagcgtgagggggtgtattagaatatgtcctacatcgagattttgataatttatggagcaatatataagtatgtggtaaacctcaactcttgagctagcttttgggtatgaggtagactcatactaatatgaaatcatatttttatcatctgttagaaaacactagtccttttaggaaataccaaaatctacaggatgtaaacataagggatagtggagaatctatttaaagtgaaatggagttggtaaattgaggcttagtactacataggtcagtttgttgacttctaaagtggctttgcattcacaagtatgaatggtcaagcttagcgtttggtggtgcgatcaataaaagattaattatcattagtattaatgtattatagtatcactatacatctcttattaagtgctatacatcacagatacccacaaaacaatttgtaactcaatttaaaggtagtaattttttataaagagatttcataaatctaaatgaaaagttaaaggacagaaagtaatcaaagttgaaccaaacaaccataagaaagaagggaatctggttattaacatagctaaatttgttagttagtgtattttctagaatccaatatttatatatatatatatatatatagctaaataattgatgatttttgaaagaaaattttcctaaataaaactattactatacctccccaacatcaatccggctaatagttacttaatttcatgcttaattgttgataaaataatattttgtataagttatacatacgatcaaaactaataatacatataagggtttttaatatataacaacgccattctaaaaaaattgaggcgacaacaaatatattctacggactatatagttttgaaggttaaaacctatatatacttgctaggaaaaaccaatttataatatttcgaatggtgtaagttttttttccaagtaattaagtaagagttgtaggctttctatttatggatcatccactatttttctacttggccactcactataaacgtaaaacatattaaacgaccaaaagtaatttagattctatcttaagagttaagactacactgttacataaaatattttccactcttaaattttctttctttgctaaaaaatttaaagttgacaaaaatatctaaaataaaccataataactataccatttagttacagaatatttttgattgagtaggattatgcaacttaagacaactctctaagatttattgtatattttattcaaatataaattgaagaaaatatattaaatttttgagccacaattactggagatggtggtgtcagtatctttgaaataatgaagaaattgtcccctctaaagttaaaacccacaaattatgacctactttcaaacaccatatatttctccataaacttggggtcttaatcaattaattataaaaacagattgtacattaacattttccttttttcattgacacgaaaattttagaaagaggttatccaatgtcaataatgtttcatttcagattcggctcaaaaatagaaaaatatacaaataatttgaattaaatataataatgactttttcttcgaactcacagtacataaggcaacaagtgtcagatttgatgcatagagataatagcatttttcgtagtttttgttaaatataagtataatacaacattccaaatttctattacagatttttaactggatcggataattagatcggcatatttttcaagctttcagcaaaaacgatcaccctaaaattattttttttgatggaatgatttgtttgaggatattgaatatatacactccaattccaaaaaggctataaagtatgaattaaacaatcaagtagtaatagccattattaatgattcgaaaatggtaaagaaataattaacactaaacaagagtcaaaagaacatgacgtaaatattacatcaactttacgtataaaccccttccctctctctatttaaacccaacacatacatatgaaactcctcaacaaacacaaaaacctcacaaccactaaacaacacacaaaa

SEQ ID NO: 8071 - DNA, 3000 bp, Unknown
  misc_feature (1)..( 3000): cDNA_ID_3047461_gDNA_ID_1621189_Annot_ID_174541 3000 nt of promoter + ATG
taaaaatccatttgataatatagtggtccaccaaaaatctttcaaaatatttaaaaatcacgtttgttcacttcgacaaaaaaacaatttgtgatttacttgagggttgctagctctcccaacttttgttattggttgcaatttctttatatgaacttagttttgtttgtacgtagttgcctaaataaaacactgaaaaacgtacaaagactacaaagtattactaattccgtaattactcaaaaatttaatatatgtgatcagtgcaattgatgatatagttagacaccgaacaaccatctgtcaaactcaaaagtcaataattttatataatttcctagtttcaccagccggctcatgatccgcatgcaaatcttgaaatattcttgatagcacaataaatttattaaattctttgtatggggttcttatctccatattccatgttttatgtgtccttgtattaaatattgttaacaagagtcgagacatattaaacatgtcatgttccactattactaacttatcgtagataatgcttgccacaagataccgaaataaatatatcatgttagcacacttctttggtttggtagttggatcgggtcatttccgatttaatctgtcgatttaagtgcaactaaagaaaatattcgatgtcgaccaatagaacaaacatgggctatatagatatatataacatttggtttttattttattttgttaaagaaaacatttggttgctattttcacatggatcattataaattttggttttggatgctattaatctacaatcctcgtatagttatttattttcttctgtaacctcaaacatatatctaatgtgtgaactgaaataaaataagatataacccacttaacaataccaagttcacatgttagctacgccataaagtttcaaaatactaagacttcacgctcgcatgctcaagcagcaagcacccacacaagtagtaacatatatatctatattttatttacattgtgctaaaatatctcttctagataagttttaaaacgagaatcatgagaaaaaaataatttataacaaaatttgttgatgatgttaggatgtagatcaatgttttataataatgatgttgtaaaaaaggcgataagtgtactttcaatcttgtttatcattaatatggcctttatcaaagtgtacactactaaaaaagacactgcaaaaacaatataatgagaacaagaacatttggaaattcagttcactataccttcttaatctgaagaatttgaaccactttaatagaacacttgtgatattaccttgaaatttataaatcaaagttaatatacagattattctttctttaatttgttaatggactatacaagtcaaagatttaccaagacatacatggctaattgtaattaacaatctcgagcacacaatctacttttgttataaattgccgcatctatttatgaagacaccatgaagcagtaaaactaaaatacatctacaacgacggacatttaaagatgtttttacttgatataataatcaccatgttaatacggaaattacatgatattgagttatagataaaaatctagtagatacatcctaattatatatagcataataaagctttaaattgaaatgttgacaaggagatgcatgaatttaaaggcataggccatagcttagttaccatttttgtaaacgaccgtcttcgcaaccacttctttttctcgttgacctgacaaaagcttcaaattatagttattgtggattgactttattttacatagtgtaggttttgtttatcatcacaaattattttaacaatcaccatctctaatcttttacgccattaatattaatattttcataatatattttagcagtcagatttataaattgtacctatttattttgttttaaacagtaggttaatgataataatattaacaatttacaaaaaattatgtattaaaataacatgattattttttttttgtcgtttttgttacgctgaaaaattacatacccaatttaaatctcacttccaaaagacataaaaggattgttttttactttgtgaaaattacatattgacagtcctattttgatgggcctaaaaatggcccaatagtaattagtttgggcagcagcatttcacctctgcgacggtcggagctcatcttcaatcataacttcatcttcttcaagcaaatcaactaaactctgatcaatccagaaggagcgaaagagaactatagatcggatgactaaattcccaacaaaccatagtttatccaaaattttccttggactaaaccggaatttccaccggttcagaattaaaccggtacggtacacccaattcagcaacaacaaacaaaaataaaccagaatctcccgatcaccgcactggttacattcccggcgccggaaaccgcctctactaccgcgtcgcagcgagtaagcatgtcttctgtcttcttcctcttatacttttcattagcgttgaaattaaggtttgaatatactcgaaataagattggataaatcttctgcaattcgaagaaattcaacgagagagagattgctgaaaaaaaactaacctaaaaagcacgtcacaaggccggcgagatatcttcaacaatggtcttcttctctttcgataaacaacaaataaaaaaattccaaaaggaagtaagaatagtcgtctctctgacttctctttaaaatgataagtcaaagtaaacaaattgatgccacggtgcttcctctttagcttgtgaatggtgtataataaaaactcttccttgctctgactttgtctttcccattttaccaagtctttctttttgtccccaccatagttgcaattcttgattttctctcaggttttgaatcttttgggtcatttggtctctcttctgctgttttcctctgaagattagagctttaccagagagataacttgttggagaagacaaatg

SEQ ID NO: 8072 - DNA, 3000 bp, Unknown; identical to SEQ ID NO: 8069
  misc_feature (1)..( 3000): cDNA_ID_1810256_gDNA_ID_1621189_Annot_ID_174536 3000 nt of promoter + ATG

SEQ ID NO: 8073 - DNA, 3000 bp, Unknown; identical to SEQ ID NO: 8068
  misc_feature (1)..( 3000): cDNA_ID_3047469_gDNA_ID_1621189_Annot_ID_174535 3000 nt of promoter + ATG

SEQ ID NO: 8074 - DNA, 3000 bp, Unknown; identical to SEQ ID NO: 8067
  misc_feature (1)..( 3000): cDNA_ID_3047473_gDNA_ID_1621189_Annot_ID_174534 3000 nt of promoter + ATG

SEQ ID NO: 8075 - DNA, 3000 bp, Unknown; identical to SEQ ID NO: 8065
  misc_feature (1)..( 3000): cDNA_ID_1395054_gDNA_ID_1621189_Annot_ID_174529 3000 nt of promoter + ATG

SEQ ID NO: 8076 - DNA, 3000 bp, Unknown; identical to SEQ ID NO: 8064
  misc_feature (1)..( 3000): cDNA_ID_3047485_gDNA_ID_1621189_Annot_ID_174526 3000 nt of promoter + ATG

SEQ ID NO: 8077 - DNA, 3000 bp, Unknown; identical to SEQ ID NO: 8063
  misc_feature (1)..( 3000): cDNA_ID_1810286_gDNA_ID_1621189_Annot_ID_174525 3000 nt of promoter + ATG

SEQ ID NO: 8078 - DNA, 3000 bp, Unknown
  misc_feature (1)..( 3000): cDNA_ID_3047461_gDNA_ID_1621189_Annot_ID_57476 3000 nt of promoter + ATG
ttacattcccggcgccggaaaccgcctctactaccgcgtcgcagcgagtaagcatgtcttctgtcttcttcctcttatacttttcattagcgttgaaattaaggtttgaatatactcgaaataagattggataaatcttctgcaattcgaagaaattcaacgagagagagattgctgaaaaaaaactaacctaaaaagcacgtcacaaggccggcgagatatcttcaacaatggtcttcttctctttcgataaacaacaaataaaaaaattccaaaaggaagtaagaatagtcgtctctctgacttctctttaaaatgataagtcaaagtaaacaaattgatgccacggtgcttcctctttagcttgtgaatggtgtataataaaaactcttccttgctctgactttgtctttcccattttaccaagtctttctttttgtccccaccatagttgcaattcttgattttctctcaggttttgaatcttttgggtcatttggtctctcttctgctgttttcctctgaagattagagctttaccagagagataacttgttggagaagacaaatgggaggtgtttgttcttgtgtattcaaagatgatgataagaagaagaagttgagatcaaacgatgatgataagtcaagagggttttctgggaaacttaagtctatgagaagaagtaaaacctctgattcttattattcagataattacggaggctcaagacggaaaagttctaagcctgatgaggttgttttcaacttttctggcgagcttggtccgatgcctccattaaggaacgattccaccaaggtttttgttttcaaaggcttctttaggatatgcaacttctctagctaaagatttcatctttgtattgatgagaatttggttcttgtttttttctacagtttatgcagaggaactcgtttatgggacgggctggggtaatggggctagagaaagctgttgaagttctagacacgctcgggagcagcatgactcgtatgaatccgagcaacgcgtatctctctggtgttacatcgtcccgtggtggcaaagtcactatattggcttttgaagtggccaatactattgccaaaggtgctgctttgctgcaatctttgtctgaagagaatctcaagttcatgaagaaagatatgttgcattccgaggaagtcaagaagttggtttctacggataccacagagttgcaaattcttgctgcttctgacaaaaggtttgtgttttataatttatccccatttgtttctgtctttggttcgttttctttcttgatttattttctttttcctgtagggaggaactcgatcttttctctggagaggttatcaggtttggtaatatgtgcaaagatctgcagtggcacaatctcgatcgatattttatgaagtaagtttagtttgtgttgaacaagtccttatctaatgctttttagtcacttacatgccagtggattttcattgtacacgggtctataacgtttcaggcttgacacagagaactcacagcataaactgctcaaagatgatgcagaggcaaggatgcaagagctcgtcactcttgccagaatcacttctgtatgtttccatgttgaagtttcaatgagctgttgtaatctttttctgggagatttgaaactaacttgcattggctttatcaggagttatatcacgagttgcaagctttggataggtttgaacaagattacaggagaaagcttgcagaagtagagtctttaaacctccctcggagaggttggtcttactatttatttgatcagtcttagctctttcaagaacacccgatttcattttctttttctacatgtaggagagggtatcgtcatcttacaaaatgaactaaaacaacagaagaaactcgtgaagagcttacagaagaaatccctatggtcccagaatctggcagaggcaagtggttattgaattgctgtgtctaagtgtgtggtacatatgctagttattctaatatcttcttttgttgcagataattgagaagcttgtggatgttgtaagttatatacggcagacgattgtggaagtttttggcaacaatggtaatgtttctttgtaccgctggtcctcttataatgactccacttctggaaaaccaaatttcaactatcattttcttaaccaacaataggtctaagagacaatgaaggggagcagggaagagaacgattaggtgaagccggtctttcgttacactatgctaatctaatacaacaaatcgataatattgtaagcctaagattccagattctcaccagtcttattctgatatatattctctggttgaaactgatccttgaaatttctaggcgtctcgaccatcgtcacttccttctaatgtaagggacacgctgtacaatgcattacccgctactgtcaagacagctcttcgtcctcggctacaaactcttgatcaggaggaagaggtttgtccaaaaaagatctctgtttctcaagtatatcgtcaggcattgtttggttctgtttcttgttttgttacctaacttgagtgtttctgcagctttcagtacctgagatcaaagctgaaatggagaagtcgcttcaatggcttgtcccgttcgctgaaaacaccaccaagtaagtattccttcaccatcatttttggtttaatatgtttctccttgttcattttggtcacattcaattttcacagagcacatcaaggcttcggatgggtaggtgaatgggcaaattcaaggtaagtctctatcagctactgaagttttaaattttgaatcttcaaactgatctagcaaactacgaattggtaatttggaatacaggatagagtttgggaaaggaaaaggaaaaggcgagaacaacgggaatccaacacgacttcagacgcttcatcatgcggataaaccaatagttgattcatatgtactcgaactcgttgtatggcttcatcgactaatg

SEQ ID NO: 8079 - DNA, 3000 bp, Unknown; identical to SEQ ID NO: 8070
  misc_feature (1)..( 3000): cDNA_ID_3075806_gDNA_ID_1621189_Annot_ID_57478 3000 nt of promoter + ATG

SEQ ID NO: 8080 - DNA, 3000 bp, Unknown
  misc_feature (1)..( 3000): cDNA_ID_2165617_gDNA_ID_1621190_Annot_ID_174558 3000 nt of promoter + ATG
tttttgatatttttcctagtattgttatctttataagtggcttaattcatagaacttagatgtttgagagaaataattttgatatttttattaggggaaaatctctgacatgtgttgcaagtgaatatacttgtgatttgtttgtgcgtttgtggagggaacttggtctataccttggctatgagtggactttcggtatgaattctacaacctgtgtgctttgattttggaaaggtttctgatcatgaaggtaatttaacactcttctcattgtatctttaatttatatagctaatgcatataataaaaacataaatattttaggtcgtcaatgtataatctcacataatggtgcttcaagaattacattcaatcaaagttacccagagattaacatggatcgcatcacataagaacatttatattttcattatcccttaactgtttagtgtattatacaaaattttagtcttagctatttatttcttttttgttttcctactgtttcaggactaaattctttgaacggatgcaaccagctgagctaggtaaagttgttgatgagaactgaagacatcaagaccaaaccccttttcatcattattataaaatcttctctattatgcttaaaaaatgtactgttaaaacttcgtttatgtttttatttcactgactatgcatgatttctgtaaaatattaactttgattatgcttcgttttatttaataattactaaatcactatagttccgtaaacttagataaaaatttaactgttttgatattgttattcttatttataatttggatttaaattatttagattttgtgttgattgtaacacaatgtatttgaaatggaacttttgatttcaaatttaaactaaaatatgagttagatatgcatgtattaaacaaagaaaataaatatgcaaaacttagagtttattaaaatatttgtccagtgaaatatgccattaaaacgttagagaatcttctaagttagaaacatccatgatttcaacgatgagtttcttaatcaagcatcccataatttttgttacaatttgcacaataatagagtagataaactaaagagtaaatttggaaaaatgccctacttatgagttttcgattgaaaagtacctttaaacaaaaaactatttttaatatataaatttacgaaatttgtctaaaaacaaattataaaaagtatattatatgtacatgtatactaatttaatgctaatctactaaattattcgtgaaaaatatttgctaatgttttcagtttgtgtttatatattgttaatacactacaaaaaaatttgttcattgatagcataacgttatatcacggattactcaactgctattgaagattatttacaaattttgttttcgtataacagcgttttatcaacgctattaaatagatttactcatatagcaaggttctaacgctatgacagaattcctctaacccgggaaactaaaatgactcataccgcgaaacacttaaaataatttttttttttctgtgaacagacatattttccctctgagctccagaaaaccctaagaaaataaaaccctcaaacggacgactcgaatcctggagccaccgattgaactcgccaccgccgttgttgaagtttgccgccgtcaaagcaggagccgcaacaacaatcccaatttcggccctaattgtccgattaaaccatctctctgaatcccaaatcgaaggcatgtctctctgaatctgtagatttatttcatctctttcgttaacctagttagttttcttttagctgtcgttaatcctttgaactgttttggttcttaatcactggatttatgggtttctctgattcgattcaggaaagtttttatcttttgcatgtccgtgttctttgcaaaattagaactttatgcttatgtggtttgatttaggcgtagctggataaatagaatgcacaattttgctttcggaaattttaaatttttagattttaacaaaacttctcgagatttacaagtgtttgttgacattctattacagctatttgtattgacttgttcttcgaatctttggatctttgagtgcttgtaatgacatggtctctgaatgtttagattatttccacaacttgtcaaacacattcttgcataaacaaacacatgaaactagatatactcattctattttttgtttttgcaagtgctactgtgtaaataatgggaatgtgaagctgatatttggctcttattacgcgacaggttagtatcatcttgatcatcactgtttctttttgtcttgaatatcactgtggctttgtgtatggaacatgactgtttctttttgtcttgaacatcactgtggctttctgtattgaacatgactgtttctttttgtcttgaacatcactgtggctttgtgtattgaacattactgtttctttttgtcgtgaaaataattgtggctttgtgtattgaacattattgtttcttttgtcttgaacatcactgtggctttgtgtattgaacattattgttttttttttgtcttgaacatcactgtttctttttgtcttgaacatcactgtggctttgtgtattgaacattactgtttctttttgtcttgaacatcactgtggctttttgtcttgaacatcactgtgaatatgagtttggggctgaatataaagtgatttagatatgtttcaagagtctttcatataatttgaaatcattcttatggtattaaaggttttaaaacacgctttcaatttataatggtggaaaaggattgggtgcatctactcttggccagtaggaaaatctggagatcttacctctctttttattctccttttaactcttcactaaagagttgatcatataatattttttttttaattaacctttaactcttctctgaagagttgatcctgcttatgagagaggggttacaaagtttgtacgagatgtggctgcagct

SEQ ID NO: 8081 - DNA, 3000 bp, Unknown
  misc_feature (1)..( 3000): cDNA_ID_1810344_gDNA_ID_1621191_Annot_ID_57485 3000 nt of promoter + ATG
tcaacttctctcgactaataaagttaagcatatatccctatggaccagacatgttggaaacactcctacgtttacttggaaatgctccaaaactaaaagagtttttggtagattatgtacgtatcatcctcctcctcctcttcttgctttaatggactatctataatctatactattcaaatttttgcttatcatatatagccctcccttattgcttctcagaaatttgtctataatcccgaggatctcccatggtcatggaaacaaccgagtcatgttcccgaatgcttgtcatcacagctcgagatattcgagtggagagactatggggatagaataatagaggaagaattcttgacatacgttttggccaactctaagcgtttaaaaaccgcaacaatctccctgaggttaaatcttgaagatccagagttgatcatcgaggaaataaaagaccttcctagggtttcaacaacatctcaccttttgttcaaatgaaaagtctacagaagctcagtgaatgtgcaagcttaattagccttatctgctataagataccccaaaataattgatgttcaaggtttctttttctttcttttaaagtaaaaacactatttacggtttcttgatagtgttcctttttccaaatactggataagttgcagagggcttagtttcctagtttacagtcttaacaataacatcatagcctatgattcatagggtgtttaattgtttattcacatatttctgctgggtcgctcttaatgagtcttttcttacaacatcataaaacaaattttgggtttaaagtcaaacattgactcgctgctggccctctgatgtttggaatcttacttagttcttgaaattgtatggggaaaaaacaaccaatgttattgaaaaatggtcaagcctcgttggacagctgatgtgaggaatatcgaaacatgtaaatggaataagtggtctatagtagtcaacgttatacttgtcaacattcgtctgaagttaaccgtaatccgtgggcagaaaacaaacaaagtaagtgtttggtcatctcaagtctcaacatatcccattaccattatccaaattatcatatatacatattctagttccaaaaagtttagattgaactaggaaaaaagaagaagaaggaaagcgtggaaagaaaaagcaagtctctcatcctctataaaatattccatttatttcattcttgtttccaccacagtggtgcatttgatatctttgcatgaggaatgtcttaagtggtttgtctgctttcctctgtttttgttcttttgcagatcaagaggcttcatcttttgcttactgtcaaggagtcagctatggatgttccatccaacttggaatctcgaaggcgtcttacagtactttcttttcaaattcactattaatgggacatgcctgctgcacccaagattcgcaacatgctttccttctcgtaggttccaggcacaattcaagttaatttatggtcgtcttctcataggcttactatatcttaacatcttccattttgcgttgtcacagggtccttacaccatacttccgttgattgataggtatgatagttaagctcaataaatgaccacacttgtgtttctttttgttgatgattagggtttttgggtttctttgatcttaagcataaaggacaagctaacataacccatgtcggggatggctttgcatttagaaatcttagatggggcttttgtgtccttttacttgtgtgttaccgtgatttaaaatcatcgacaagtcaacacatatatacttaagtaaagagatcttctacccgcaatttgtgacaatcaacgtaaatatgttctcttcgagcccaatgttttggcacaataactgtatccctgtaagattttcaaaagaagccagaacagaataatacaagcacagcagttagatagaaaaccatggagcgccgttacatgagaagtaaggggttaccctcagaaaaagaaaaagaaaggaccacttccgttccattgtataaaaatccagacatcaccttcttcttcccctgtaggttaatctcactgtccagttgcaaaacagagcatgaacagtaagctttttgtttaagattttaatagtgagtgtgagtcatcacatgctgatctcgggttttactaatctctcgtcactttttatatccactaattgggccaattttcattttcagggcccattattataatatttataggcccacattctcttaaccctccatccagttcacattgcgccatgccttagcgcaaacgttaaaatggcgttgtttccaacttaaatccaaatccattaatgtatttatttattttggattttttttccgtatacaaactatattcaaattttgattttttttcgtcatccgctaatcttttcgttttccaaaagttaatgaagcaacaaaaatataattttaattgaaatgattgcatatagtttgtttcaattaagttctaaatacattatcgtagtgtaatgaaaaatatttttgattacaccaatatgctcataagtcataattaaaatctgaatttcattgtgatgttgtagactttttatttttgttcagagatgttgtggcataaatgactatatgggataatatcgttggctcgttgtggtatctctctaattttatctcattgtaattccattgctgcatctaactacttacttaagttgtgttttattttatttttataagataccccaaaatgattgatgttcaaggtgtgtttttttatttgtacaatgagattaataaatcatttatttttagtcaagaagcattgaagcaagagaacgaaccatttgaaagactcataaaccaaattgagtcaaacaaacgaatttcaaagaagtagtttggtatggacggatctggtaaaccggtttcggtacgattgtctggttatttttggttaaaattgattgggtatg

SEQ ID NO: 8082 - DNA, 3000 bp, Unknown
  misc_feature (1)..( 3000): cDNA_ID_1810337_gDNA_ID_1621191_Annot_ID_57487 3000 nt of promoter + ATG
tgcaacattttatccataaacaaacaatttaattggtgaataactaaaggaaagtttttgtcatgatcaattttctgattagggttttcactaatgaaacgtaaaacataattttttttctttaaaacatatcagtttcatacctacgcgtgagtgttaagaagatttttaaggtgaaagtattcgtatgcagaatgatgaagctttgaatagcgacatgatttgtatgaatatcattatcaacaatatgaaacacaagagacaaagttacttataaagttacattttttctgttgacctttttgaaatgtgaccggaaaatttcttctttctttttctccacagactaattcaaaagtcatgattatcagtaatataataaaacctacgatttaaattattttgactagtgaaaacgactttgctctaatggtcgataaatagagtataatatagatctcatgtttaactttaaaaccgactatagatgcaaaattctcaacatctcattatgtcaaacattgaactgttcgtggtggttatattattgtctattttcatagtttccggctgatataatactattttcttgactaacgaaggttgccgaccataagtgaaacattggccaattcatttgatttggggctttgagaatttctggcccatccaacccaaatctgttaaaggttgccgaccacacctttcaatattggccagagaaagtgtggcgatggcccagaaaatctcaaagccccaaatccaatgaatttctgctttcttgaccatataaccaaaactatttcaacaaattcttgctaaaatctgtttttggtcaaaactgtttcaacatggcatcagtatgatgattatgaacctactcaatccttggacaatgatcatgtgtctgatggttaatttggatataatttgggtgagtgttttctataagcatataatttgtgattgttttgttggaaagtataataatagttgacactatattgttagcatccaattcacaaacaattacacgagtggtttgtaactaagatctttttgctgatccttgggtatcctaagcaacctgaacattgcttttggatttaacatttggcttggtggaaccttctctccatcctttttggcgagctctctcttcccacctagatgttagctttttctgctcggcgagtgctaattctgctttttctcgagcttcttcgcatgtttccatacccgagttgcacttatctgcttccttttggtatgaagaagttaccttcttggcctccaatagccccatgtctgctcgtttgtgtttctctaaagattctgcttcacgcagcttcagttcctcggtaagaagttcagcatagttcttctcagtgtcttcgttcacctctggatcgtgctttgcacaatctacacattcaaaactagagaagtttagtacaaagactcgattgctaaaagacttttaaactgatacagttaacgaaataccattcacaattaactcaccagcaaaagaagcattactgagctctgcaagaagaaaggaaacaagtaaaaaaggatcaatcttttggaattggtaacatctgaagaagaatataaattcagcttagcgagaaacatatagtaacttaagaaatctgttacaacaagcattacaaataatgatgttgagttcatactacagtcttcttggggttcactaaacaaattctatcaatcaaatcggtctaaaagcaatcacaatgcatacaatccaaacaaactgcattgtttgttgattggctattatcagaacagtcgccagtaaacttcaacttccacaatccgagaagttaacaaatcataacttgaaccattaatgtaactcaaacaataggagcatcaacactgtggacaaataactgagataatctttttaagatggagaacacctaaacgaatgaaacatcattcaagtagatctacacttacttactacactaatcattctcagactcaaactcaagcacgaatcaagctcaaagcttacaaattcagtaacctcagcaccagattaaaaaaagccaaacttgaaaatccaactgatactactaatccttacttccaccaccagctacaacaccaaattttgatataaagttgctaaattcctacatcactctacaaaaaggagtaaactttagccacagatctgttgaaatcatgggcaccgatcaagctaacttctgtttacctttgggaatggtgacagcggaataggtagagcattcacaggggcaagaaggacaagaggaggcggaaacggcggccaaagcctcagtgagatgccagtagagaggcggaccaagaatgtaaccagccatgctcagccccagtaaagctagcccgatcttcagcgccgccgtgtgtctcgccatttcaactctagatccgccgatctgggtcttcgtaaagattagatttttcggcgagtttgaagaaaaacctcgtagagggattttagagctgtgtgtgtgtgactgtgagacgacgttatttagaaaaatcggtgctagagattttgacacacacacacttttgagtgactcttttgctctctaatttcgtcgacagttaaatagtaagcgtgtagatttaagattctcttttgcgtcaatgtctctccttcaaatgctcgacatgatcggtttggtctgatttgaattggttcggttcaggagattaccttttgattacaatcataatgtgaaattattctgtgtttgggcctttggttatagcgtaactccagccggaacctattgaatggggctttagttgctcttggtccaacatgctttttcctctttaggcctagctggaaccggttgggccggttggccgtcgacgtagaataagtctgactatataagttaataactaatgctgttttgaaagtaaaaaacctaaaccctagtattattttggttgctttcgatg

SEQ ID NO: 8083 - DNA, 3000 bp, Unknown
  misc_feature (1)..( 3000): cDNA_ID_1810316_gDNA_ID_1621191_Annot_ID_57496 3000 nt of promoter + ATG
agaacgatcgttcgttaattatacaattaatcatttattgttgaagagacagaaacaacatccaagagagagtccaaaggacggatccattacaaagacatgtgcaagagattttcttagtctcgtactcctttcggtcggtttctccaacaaatgggccttggcaacaggtaaaataatactattgggtctgttttgtaaaatcttacgttttctgaaatggaggatgttgatacctttacaatgggcctaaggtcccataaattgggctttaaagggcctctttttgatacttccttttttcattttatgtcttgatgttcgaaatcttctatgtaaacaaattttttttggttttaatgtcaagagaatatgtgtgtgtgaacaatttataatgaccatgttacattttcgtctcgtatgtttaaaattcttgtttttatttgaagttttcacataattatttgagggaaatattaaatgatctttttgcaactctaataaaacgttagtaagtggcatgctaaatatataaatgataatacaccaagaaaattgaaagtgagctaaatatatcattcctaacaaatagttgataaattctcaagttgatatattgtactagatattagtcataaatagaacctaactatgaaccaataataggtctacaaatgtggggccagagacaagagaagaagtcacgactttgaatcttgatgatcatggatgaatggatatcatgcatgaaaaaattaaaatttctatgatatggaaaaacgacaataatggacgaaatctttgtacgtcaaaatcggagacttagatcgttagatgcatgcaactaattaacaactccaataacttcaattgaaaatgtgcgtatactcactctcatgaacggtcttctcgtattgttaattcactgtaatccttttgcgttttgatacgcaacttcggaatgggcaacggtatagcgaggcttacgtatgctttggaaaaacattaattcatatattaatgttttatattccgtgagaaaatttcaatgttttggaaaattagaacaaattagaacaaattctcgaaagataaattgaaggcattatgatattttcgtacgttctttttacggaaagttctttaacggcatccaaaacgctttcgtacgtggccgagtgctcgcggcgcaataatccttgagaatcataaggtatattccctggaatgtaccttttttgtttttcttataaaaaaactatctggtgcattttgtttttatggagtaatttatccaattaaagtccagtgtgggacactaaacattacaaattttatgtctttagcttagttatcatctgtttttttttaattagaaaagagtagttttctggtgtgagtgttatgtggaagacaaatatgtgacgtggattctaataatgtattgtcgtgatgtggttctttttgcattatttcgttttgattatgtaatagacatatatttaaatggtgcgattatgcaccgaagaaaaacattcgtctccatttttctttatacgaaatttgaccccaaaaaaaaggtaaaacacggcgtccgtgttattatgtagtatcatgtatgacagaaatggcaactacagtagatagtttggaccgaattttattttcacacaattaaatagttatttcaaggcagtaacaaattggtggaaaaaaaaaaaaaaaaggcagtaacaaatattaaaaccgaatattggctaaaattatacatttcaaaacaatattatgaaattgtttaacaaaacaaaatgtgaaaggaacatagaagtaattaatgtactcagattacgatcccatagaacttaaataaaggtgcgtttatgaatgccagatgactcagattagtgattgttcttcccacttagcagagtaattgctctttgtcctttggaatctctctctctctttttatttctctgtgtttcgcttggaatctatattttcgctatttcctggaatgatgatatatatgtatgttagtatgtagtagtcaatatttttgtatattgtgaataagtgactttttcaaggtaaatataggtcagaaacttcaaattcaaaatattaaatattataatattggtgaaaatatatagtcaaaaaatgattttaggttcggttgataatttattcaatgagagtgatttacccgaataagatgattgtgtgtgagcaaaaagattccacaatgatgccaatttaagcttcaacaagtgctttcctattaacaagaacaatttatgtaatatcatttttttcgtttgttttgcaaaactgcaaagtcattttattttgtttactttaataatccttgaaaatgttataacagttatttcctcaaattagaccatcatactattattattgttattatcaaccgttgataaaaatggtagtagcatgtacaactaagatagaccgttacaaaattcgtgtattgttaattattatatagtttccgtatgttgctgttttcagctcaacttgagtaaatataaaatattaaactgtttattctaatattggattcttttgtgtagtggcaacttatttttttctaagctttttttttttacagattacggatttcagtatgaaattgtagatccaatcaactattttcacatatgctaaaaggtatctaaaaagtaaaaacacttaacagattataaacaaaaaagcttttaagataaatgtcacaaattctttaaaaataaacaaataaacagctattgacaaacaaaaaataaaaataaaaaaggagtccttgctgggtccatctcctttgcgttctttttcgtctgttgaattttgaacagagtcacaagtctctctccatataaacctccccaaggtcgacgctacgtaacgaccatctccattactcgactctcctcacctaaagattcaaccttttctctgtttcccaattcagagatg

SEQ ID NO: 8084 - DNA, 3000 bp, Unknown
  misc_feature (1)..( 3000): cDNA_ID_1810364_gDNA_ID_1621192_Annot_ID_57498 3000 nt of promoter + ATG
gtatagttattttatgtgatggtagagttagtgtcgtgacagatttaatggatagagataatgtatttgatatcgttaaactgtatgtggtgatagagattttttacagagttagtttgttgacaaagttattagtaatgacagtagatttaagcgagcgagtatgacaaacatatttgttcgagttatctatagttacgatagagatatacggactgacagactttaatgtacttaaatctatgagataatggtgattgacatatgtacttgacagtagagttaaagtcaaatttcatgtgacgacatacatattgttgttatgtgatggtagagttatattttatttaattactagaatagcactcaaaatttttgagttatgaatggcgtggtgatagatttacgagtttaatgattttttagacatgtcatttttctagattaagcatatgttctaagaatggaagatactattatacccttatccgaataagaggatcttctgtggatcgggcaagtagaggtcgtaaactgtagaaaacaattgaattatctgttctgtttggcgatggaagagatagtattagtgtgtgggaagtagaatttcaacaacaggcggtgggtatttagtgttgatgaacgaggcggatgtagggttctaagttcgaatcgaattaaagggtatggagatcttgttgcaatggtatatcaggatttcagtttggatagtagggattgtaaggttagtctaagttataaaatttgtagaacgatgcttattctcgacgatacacctcccgtaatagtatgtaacggaagacaattcgaaggttttctccgtcattgtaaaatgggaagcatatgactatgtgttacggtacaagctataggttgtgtggttggcgaaccagaagttgaaattgtcgaagagggttgctggataactgaggatgttcttgggtttagtcggcggaaaatccacaaaaacttggatgagttgaggataaagaaagcggaaccaattatagatgaggagtactgataagtgtgcattttacatgttttgagcatccatttgttatcattattgcatcatatcaccactgttttataccatttctaatcatttgtcatcactttgcatgtttaggataattttgcatgcatgttgcatatttgtgttgatttcaggtgatttggagctgttgacgggctaattagaagaagcggacctgatcatgtcaaaccactcgacccccaggtcgagcagatgctccacgacatcaaaggaccactcgaccccctggtcgagtagaagacttcaccactcgaccacctggccgagtaccaccatgagagtcactcgatcacttcactcgaccaccaggtcgagtatcatcacctccaccacctgaccatcactcgatcacaccactctaccaagaagtcgagtatcaccatcaccatcactcgactacatactcgattgccagcttcagagtcttttccattccgcactcaaccagacactcgagcacaaggaagaaaagaagactccagctaatcactcgaccactcactcgattacctgggtcgagtactgttcttaatccgtcccaatactgcgtcgttttgagtattagggtttcggaaatatttcgctataagtagcatgtactttacatttttattgatctaagttttatttcccagacactgtgtaatccggatttctcttaatctattcagtattcagcatttgttttagattttgtttactgttgttcatcctgttatcaccttgctattactatgttgttatcatgttttcattctattcaacgtttatgttctctacaatgatgtctaagtagtgaataggtttctgagggtgggttagagtagtttagaattctcagtatgctaggtggttgagtttgattgatagatcccttctggattagttgttcttaatgcatattgctttctgatcaactggactttgagcacagatatttccgcgctcaaaaggtgttccatgaaatgtctgaaccactaattctagagattcgtggccctgtaccaaggtattggttgcagggagcgttttggctttaacttgttgattcgtaatgcctgttaggttagctctcttcaatggtgattgagtgtgagactagtttaacttgaggatctctgttgcggtggcacttagatttggttaccgaaattgttgtctagggataatttattgagcttgtcaatcacctataaactgaggaaacgaaactactcaattaccccatcctcgggagtttctcatccaattgatttatttgtttactttgctgttgtttactgcatcttgttatctgttgcttagtttttgcgtttctctcctgttactcgacctgatactcgaccactcagttgtctggcaacagacggtgcagtcgagtatccctgttatattttttgtctgttactcgacctgtcactcgaccacacccagtgctctgttggtcgagtgcttttactattctacttgaatttctggtttctacatgttcacttaagactgctagaacacaccaaaacctgttattgcttggcttgacttagtgacttttgatcacatcttgattgttagcatcacacccatttggattgacaaccttcagtactacaacgacatgatagtgctttaggataattgatcttaaaaacctattatcaatttggcgctgttgccaattgggtgttttattgttacatttaagatttctgacttgcttagatcaagttctttttcaattttcatttcagttactgactgtgtatttttcttgttgtctcatttatccaagtacacctcttctgtatgccaactcgatcaacaggcaaccagaacctcctttccaacaacaacttctaccgcatagctcgcgaactcagagaaaggagaaacacaatcacctttttgccccaacaatcgaa

SEQ ID NO: 8085 - DNA, 3000 bp, Unknown
  misc_feature (1)..( 3000): cDNA_ID_1809065_gDNA_ID_1621192_Annot_ID_57499 3000 nt of promoter + ATG
caagtggtcttcagctttcgagcgtcccacttgtcggtagggagtaccccgttgaggatgtagtctcggattggttctctccagtctgccccccagtcgtgaggtgtctgattatcagggacttcgggactatttggaccagacaattcttcggtaattggaggcgggacaacctttggaacgtcgttttcgtcatcgagctgctgcaggtcggtattgttttcttgtgcttcaggcgggacaaaatttgatctttgagattttgaagctcactgcttacaccatccggctcctggggagactctgaggtcggacgtctaagggagggctctactcgaaataatgatggagttggtgcggtaactccatcaataggaaggtcgggatttgccggggtagtcagtacaacctggttctggtttgaagttgccccaacttcaacttgagagacgagaggtaactgaggtggcggagtctgctgacctgctcctgcctgtgaagtttggatgctcgaactgatgtctccttgaaaatcaaggcgtgagcgaactccagcggtacgtgacactccggcagacaggaagtcaactcgatctgcgtacgcgttgtgagctgtccttatttcagaatggctggtggtgagcgccgcgagctgcccactgcactgttcctgaaaagaaacgaacttatcagataaagaagttactgcggtttgctgtcgctcggtcttgtcggagagctcttgaagcagcttcatgatatcgtcaagggtggaggcttggtcgccggaactttcgttgccgctggtgctcatgatgattcaaccgaagctctaaagtaagaagtttagatgcccctccttctagcgccaaattgtggatgtcggaatccacaattaggaatttgtggattgttatgagggccttaaactttgttagtgaagctaagatcaaatcggacagtatttcagttaatcggaatattttgtatagtcattttctcgtcccttttacaaatgatgaatcactcctatttatacaaattaatcgaatatctacgaagtaaattaacgcttgaatcacgccgcgaatcatgtctcattaatgtttacgtttcacatatccacctcgcgcactaacgcattctcatttactccgcagatttccgttacgtgacgcttaaaaatgattcttcaaattgacctggctctggtgggcttattttggcccactccatatttgacaatcctggactcatcgttgaggctttgactcaggcccatttaaagaatgatgacggatctcgggccaaagcaaagatacgagatccgacatccacagttagctacatcaacaacaaccagggtggctacaaaggatacaacaacttcaaaaccaacaaccccaacctctcctatcgcagcataaacgttgctaatcctcaggatcaggtgtaccctccacaacaacaacaaggtcaaaacaaaccttttattccctacaaccaaggttttgttcccaagcagcaatttcagtggaaccaccagccgcaaccaccacatgggtttgcacctcagcaaaactgtaacgcccgcgatcctcaataggatcgttggctaagacttggtccgagagtagaaggtggagtctcggacaagcgagaaggagctggccataagctcggacaaaggggaaatcatgcgggctaagctaggatcgtaaagaaattaactgggtcagctcgcccaaagctcaagctcagctggaaggagtgacggttactcaggtcgagtgacagtccagctcgggcagctggacgagtgacggttgagctcgaggtagctggacgagtgacggttgagctcgaggtagctggacgagtgacggactagctgggcggttatgggcgaagagatacaactcttcggaaaggtgcaactcttcggaagggcgcaactcttcggaaaggtgcaaggaacggatgtgttgattcgggaagcatccattcgccccctatataaggaagggcgcccaggaccattctactcaccataacacaccgaaaacacaagaaactcaccattaaaactctctccctcttgggagaataaatagtcttaggattcggtagtcgggctgtggccgacaataaagaaggagggtcggatcgacctaacctcgagaaggaaggtaagggatcctagactttgagtctaagggttctaggatgtgaattagtagtcggatccttgaaaagatcgactagagggctgggtagtatccgggtcatgtgcatcctacacaagactcggtctgagtagggatcggctgaggccgagacgcggctcggcagaggaccggcgggtcttaactgacctgccgagaatcggctggactgatgcgcgatcttcccctctctgaattctctccacggatccgagtagtgtatggcatatagagcattgcatggacttgcatatgattaagtaaatgagattacttatggctctatgactttcaggaacgaatggtgatcgtgggaaggacttggcttaggcgcgagagactcaaggccgggatgatgggtggtgatagttcggatagtctagggatcgattatatgacttgtaatagcttatatgcaaactcataagttgtatcgaatcctttgcttgatcaataaagtatccgattgtttgtttactctatttgtctcatatattgaatcacggaatcatatggaacggattagactaggaaagaacctcataaacggttagggccgagtcacttagtggcttgggtcgagagaactcgtccggactttaggcagtccggatcggggcctttcaagttggtatcagagcatgcttggttctaggactaggtgttgggttaaggggtatcaccactcgtcggcttgagaatctcgcggtagttgctctttactcttttgcgattttactaggagttatgtggattaactttggaggtttcgcag

SEQ ID NO: 8086 - DNA, 3000 bp, Unknown
  misc_feature (1)..( 3000): cDNA_ID_2139789_gDNA_ID_1621192_Annot_ID_174612 3000 nt of promoter + ATG
ggataaatcagcgcacttgagcttgttcctcctcaagttcacgtcccacataacgccttaggcggttaaattcctcatcatattcacgcaccgtgcggttcccttgaactaggtcgaggtacgcacattcaagcctatcccaagcctccggtggaaagtacttcttgttaaactcgtcttcgaaatccgcaaaggaccggacctcgtcccctctgcgtttctcgacggttaaccaccagttatgggcgtctcgttcaaggaagtggaccgcaatgtccctttggtaatcctcaggacagcgggtagacttgaagttcctcttgagtctactcctccactcatcggccacaatcgggtccgtactgcccatgaagtgtctcgtgcccagccttgagacatgttcgagaagactcagatagtctcccctttttctcccatgattcggttgcggattcacttccacaacttccaattcatcgtccttttggttatccactctttggaccaccggatttgctacaatggccttggttaatgtggctagttgcgccatcattcctttcatcaaatcccactgttcttgggccgttggagtattgttccggttatccgtgttgtcccttgcaccgctactctcccgtgcttcctcatttatggacttcttcccggtctcaggtccgaccgagtctgtcccatcgagcatcgtcccgactctggttttctcgttgatcatcgttttctcctcaaccaaagtctcctcgacaatgcccttgtccttcttactctttcctgttttgctgctcttacccatctgcgaaacctccaaagttaatccacataactcctagtaaaatcgcaaaagagtaaagagcaactaccgcgagattctcaagccgacgagtggtgataccccttaacccaacacctagtcctagaaccaagcatgctctgataccaacttgaaaggccccgatccggactgcctaaagtccggacgagttctctcgacccaagccactaagtgactcggccctaaccgtttatgaggttctttcctagtctaatccgttccatatgattccgtgattcaatatatgagacaaatagagtaaacaaacaatcggatactttattgatcaagcaaaggattcgatacaacttatgagtttgcatataagctattacaagtcatataatcgatccctagactatccgaactatcaccacccatcatcccggccttgagtctctcgcgcctaagccaagtccttcccacgatcaccattcgttcctgaaagtcatagagccataagtaatctcatttacttaatcatatgcaagtccatgcaatgctctatatgccatacactactcggatccgtggagagaattcagagaggggaagatcgcgcatcagtccagccgattctcggcaggtcagttaagacccgccggtcctctgccgagccgcgtctcggcctcagccgatccctactcagaccgagtcttgtgtaggatgcacatgacccggatactacccagccctctagtcgatcttttcaaggatccgactactaattcacatcctagaacccttagactcaaagtctaggatcccttaccttccttctcgaggttaggtcgatccgaccctccttctttattgtcggccacagcccgactaccgaatcctaagactatttattctcccaagagggagagagttttaatggtgagtttcttgtgttttcggtgtgttatggtgagtagaatggtcctgggcgcccttccttatatagggggcgaatggatgcttcccgaatcaacacatccgttccttgcacctttccgaagagttgcgcccttccgaagagttgcacctttccgaagagttgtatctcttcgcccataaccgcccagctagtccgtcactcgtccagctacctcgagctcaaccgtcactcgtccagctacctcgagctcaaccgtcactcgtccagctgcccgagctggactgtcactcgacctgagtaaccgtcactccttccagctgagcttgagctttgggcgagctgacccagttaatttctttacgatcctagcttagcccgcatgatttcccctttgtccgagcttatggccagctccttctcgcttgtccgagactccaccttctactctcggaccaagtcttagccaacgatcctattgaggatcgcgggcgttacagttttgctgaggtgcaaacccatgtggtggttgcggctggtggttccactgaaattgctgcttgggaacaaaaccttggttgtagggaataaaaggtttgttttgaccttgttgttgttgtggagggtacacctgatcctgaggattagcaacgtttatgctgcgataggagaggttggggttgttggttttgaagttgttgtatcctttgtagccaccctggttgttgttgatgtagctaactgtggatgtcggatctcgtatctttgctttggcccgagatccgtcatcattctttaaatgggcctgagtcaaagcctcaacgatgagtccaggattgtcaaatatggagtgggccaaaataagcccaccagagccaggtcaatttgaagaatcatttttaagcgtcacgtaacggaaatctgcggagtaaatgagaatgcgttagtgcgcgaggtggatatgtgaaacgtaaacattaatgagacatgattcgcggcgtgattcaagcgttaatttacttcgtagatattcgattaatttgtataaataggagtgattcatcatttgtaaaagggacgagaaaatgactatacaaaatattccgattaactgaaatactgtccgatttgatcttagcttcactaacaaagtttaaggccctcataacaatccacaaattcctaattgtggattccgacatccacaatttggcgctagaaggaggggcatctaaacttcttactttagagcttcggttgaatcatcatg

SEQ ID NO: 8087 - DNA, 3000 bp, Unknown
  misc_feature (1)..( 3000): cDNA_ID_3047570_gDNA_ID_1621192_Annot_ID_174603 3000 nt of promoter + ATG
atttagttggaaggtaaaaaaaaaaacagtttagtcatgtaatgcgtttaaaaaaaaaagatcacttgtgtttaatagaaaccataatcccaaaaatatttaacttttcatttatattagaaaaatcaatcatctgctacataagataagagatataataaatacatggtaacacataccaaataaaataaagaaaatcagctatctggcgtatataaattgcatgactacatatacgaaatgtatgacgttatgtaattaacatcataaacaaagaatttaaggttaaccgatcaactgattgtggcgttgaccaacaaaaatattcaaaaataaacttttaatttatttttaatatattaaaaactatgatatgtcttgtaactgttaatttagttttaatgttttaaaaactatgatgtggtctgctacacttcagatagctgacgaatttttttttatatatattacacctacaatattaacataattatatgtttagtccaaatagaccgaacaacaattcacaaaattgaaactgaaatcggatatgaattgggtaaaaaaaagattctaaataattttctgataaaaaacaaagaaactatatcactccaaatctcttgaccatagtgtttgttccattccatcgtcaccatagtttagactttaaattcagtttcactttgactaattttagataaattaacatattaaacggaatcaacaacttccctctctcccttggcgactacagaggcgaccaacaaaaccagtttcctgtttcattttttttaacaggctgccggcatttgccggtagtttttttgcttttctactcctttcttcttttgtttttaatattgtgatgggagatattccccttaattggatttctgctcgtcctatcttctcctttcgaatggtgacggtgtttattgtcatgtttagaacagagacatacaattaccagtttcatgtaaacccgttgctatattcgaaatcagaaaaaattcatcccaccaatgtctctttacccatgtcatgtcgattcatttgaatcatggtgtatttccttatctaaagtttgttttcggtggtttctctcaccgacgtgatctccggttttcaaccgatgaagtttcttcaaatctatggtttggagaagtcatttgggtatttgatccaggaatcaatagacaaattcttttgagtgaaggaattggcatcgacaataatttcctcttctcaaacacatggtccgatgatggcgatgtactcgctgtccaacgatccgtttattcatgttcatggtctaatgatggtgatgtactcgctgtcaaacgatctatttattcggattctatggaaaaaagtaatcatggtcactaaccggcgacgatgggtagagtgttataaaatacatgatcgagatccatttcaagcaacatatccgtgtgttcgtttaatcaaagtgatgcagaaagcatttgggagtttcatctataagatgttagccttttacgagtatatgacgaggggacttaacagatttcatctgttgcttgtaaggcttccgtttggaaagcagggtcatttccatttttttatcaaaattgtacaatttcttttattttattcgtatttgagtggtttcatgtatcatgtattatataatatttttataatataatataattgattcggtgttaaaaaaaaaaaaacatattaaacggaaattgcgaacgttaatggaaaagaatatattttattattattataaatgctgtttggtacaggtggcttacaaaaatccaaagtgccgtaacttattagcttctctttcatttcaagtcaaaaagtccaaacctctgcagattttattcctaaacccgaccatggaagaatcatcaaaccaacaaatcctcaactccgagacccgacccgacccgattcaaaaaccaccggaatcaccagccaccaaactctcattcccgagactcttcctctggtttgatcaatcaaatcgcatcaaaactctgctctcatggtccatcttcttcctcctcgccgtcatcgtcccaatgatctcacacttcgtgctaatctgcgccgattgcgatttcaaacaccgtcgtccttacgacggtttagtgcagctttcgttatcgatcttcgccggaatctcgttcgttagtctctcagattggtccaagaaatatggaatccgaaggtttctcttcttcgataagcttaaagatgttagcgataaagttaggatcggatacgaagctaaaatccaggtaaattaaacgtatcgactaattatagtattagtaatctaatttcatgattaagaatcgtaatttttgggattaaaattggtaactagtggaataagaagcgattgtaaagaaccggttatttcagttttctttcaaaatcggttcatcagtcggttcaatttggagagattgaatcatatttggtttacgtctcggtttcggtacgcctaaaccgatcaattgcctaaaaatcaaaactataccgaaaataaaccgatttctacccaaaacatatattaatcccaaccaaattaacatattttaccctactttatcagattttaactgggaaaacccaaaaaatcggttcaattcggagaatttcattaaccgaaatactgagataaccgactcagtttggtttggttaactgaactcgcaggcctagaactttaagttttgacctgccattgaatcttaggctcaaatcttgatgtttttttaatcccaaccaatttaaccgattttacccgattttaaccggggaaaatcggttcgattcggagaatttcattaaccgaaataccgagataaccgagacattgaccgaactcgcaggcctagaactttaagtcttgaccgtgccattgcatcttaggctcgaatcctgatgtttttgaaagtctcctctgttttattgttgcagagatcaatg

SEQ ID NO: 8088 - DNA, 3000 bp, Unknown
  misc_feature (1)..( 3000): cDNA_ID_3087961_gDNA_ID_1621192_Annot_ID_174602 3000 nt of promoter + ATG
tttacggattcttggtggataaaacatggttgcgtatgatcttcagcatcgaacttgctcttcttctatggctgctcaaaaagacaatcagtaattttatatgtttctactctgaatccatattttcatttttcatcactttcctcttgtaaccgataacattcttcatgtttttggtttttggcagtgaacataacatgaagacagaatcagtgtcacacaacacacacgaagagattggtactaagatgtttttatttcaacaatggcgatataacagattctttttgtagatcttctatatatacaaatataaaacgtgtgtatgtaaatcaatgtttgatcctttttgagttatatatatgtatccagatcatatttattgattgtgtgtaaatactgatttttgaaacctatgtttggtctcattgatgaatccgggcgtgaaatgtatgattatggttttgtgatattctcgtaaattgtgtgataaaactttacgattaacacaaattatttagatactgttgagattagataaatactactattattatttttgtcacttacttcctaagtatcttattttccaattaactaaaacttatcctattatctaaatttaactttctcttcaagcaactcttgtatatatacgttggttctcttcagttcattgtaagtatcacaacacaataagaagtctattttattactctctcgtcactttttttctttattattttattacttctataatattatattatattagaatatataatataaaaagttgaaaacacacaacaaatttgaatatattatttaaaaattaaggtccaaaatctaataaaagttccgattttgttagccaaattactcattttaacttcccttcaatatcactttgttacgcaaacgactcgacaaccgttctctctcccaagcgatctgccattgaaggcaacttcacaaaacttcatcactttggccggcgtcggtctctctagcgtcggctattctcgtgtttgttattgcttttctctaatttctgcaaagttttcagtttcttgtggtaaataacggcaaaccgaaaatctcaaatttatgttctttgccacatcgtgacggtggtacatcattactatcgattgtgattcattcttcaatctggaaagcctatcaattcaacttgatttcacggataaatgcatccatttgtcgatgtttctgatcgtgtgttatatcgattcttttgaattttgattgtccttgtataaggtttgtatacggtggtctctcacaccggcattatctccagttatcaaccgatgaattttctctgcaatgtggagttatcatttgggttttcgatcccggaatcaatggagtaaccttgtcgcttgaaggcattcacatgtttcgaattgggtatggctttcgatctaagattagattattacttatcttcagtcttaatctgtttagagttgggacaacctatttttatctcgaaggcgaaggcttcctcttttcgatgacacgatccattgatgatgatgttatctctttcgcttggtcggaaagtttaggttctatgagaagagaaaccatggtcactaaacagcaaagatgcgaacgacatttcagaagtcatgtttcaaaaccatatctaacaacatatcagattttttacagtaatgcagaaagcatttaggagtttcatctataagatgttagccttagtctcttgcgagtgtatgaagaggggacttaaaagatttattatgttgcctgtaaggcttccgttcggaaagcagggtcatttccacttcttcatcgaaattgtgttcaatttcctttatttgttgcaatggttgtatttggttggttatgtatcatgtcaacttttatgatataatataattgatttgccgttaaaaaaaagaatatataatattcaacacgttatctgcacgagtgactctcgatccgctagcacgcacgactctagatctgcttttgaggtaacatttaaattatattgaataatttaaatcattaaaaattatatatatatatatatatatatatggagtaaaagactatatcctcttctcgattataatagtaggttttgcctcttggtcgtataataaaatttacatccttgatcataacggtaagctctacctccgcgatcatatgttcagatctatattttggatcaaatggtagtctccgcctccttgatcctatgaaaagctacgcctcttctacaatcatatgaaagagtatacctcctacaatgatttttttttaatttattatattatagcttataatatataaattatttttatgttgctttattatgaaaacaagcttttggaaaactttttttataataaaattttaatttgacaaattgtatcatattatttatatagttatcatgtcgaacttggcaaagcttgatataactgtctttgatgtttctggaaaaattatatgacatggacattatatgcaaaaatgtatctaaaagcaaatgggcttctcaaaaccctcgatctgtcgaaaattactttagaagagaaaaaggcaaaagccatgatgtttttgcatcactaccttcacgatggtttaaaagatgaataaatcacgagagaaaatctaacagatctctaggtctctctcaaagataggtttgatcatcaaaaatatgttatcttaccaaaagtcaaacatgaatgactaaatcttcggtttcaggattaaaaaagtgtaagtgaatataatttcgctttgttcggattcacttccaggataattctatgtggagaaaatgtttccgattatgatatgatcgagaaaaatttcaaaacatttcatcctacaaatgtaatcctatagcaacaatatcgagtgagaggatataatcgatattctaacttgatgcaagttcttgttgctgaacaaaataatgaactcatgatg

SEQ ID NO: 8089 - DNA, 3000 bp, Unknown
  misc_feature (1)..( 3000): cDNA_ID_3047579_gDNA_ID_1621192_Annot_ID_174593 3000 nt of promoter + ATG
tcaatttcaaaaattaaacatgataaaccaaataacagtttttcatctataactaaattcgattcaaattcagtattaaacacataggctctgataccactgaaagaattcgtaccggtttataacgatttataaatactaaaaacgaattcaattgccaagatccatgtaaataaagaatcaaatttagatcatagggtttgaatatacctggatattctgcagcggaaagatgaaccatattgttgcgaggttgttttagcaccccaagtgttgtgcctctaccgtatccacacgcacacaaactggattagatctggaatgctagttcctttgagatctaatctcaaaactcagacaaacaatttgtctctctattttatggttttatgatcaaaagtgtatctcacaaacgttgctaatatatcatatatatagccaaacgtttaaccctaactaattagggttaataatgggccaaagcccaataactctttttattgatccagtttgcttaggtgtgtgaccctgtaggtttgtataatattagtaatgagttataactcatagattataaccggtctctagcaaaacattataaccacctaatattatacaaatgtcaaaccttgacattacaactttagctagagtaaagtacaactgatttcaggacattcccaacaactgtttggctcgatattaatatgagacatcccaatgaaaatcaacattataatatatcaaaataataattattcttttttgacagatctaaatgtgtaactataatacaaagttactaaattacatatgttctacgggttaaatctaaaaacacatcaagattaaattttataattttaatataaaagttttttgaataaaaataaaaaattatcatgtggtgtaccacaagtcaatcctaaaagaaaaaaataatattagacttattaatacagtaaatttatgacttattaaaaatcgtacaaaaccttatcgaaaattattaattaacacaaacaacaacaaatattatacacaacaaatttttcattttataaaatacaaaaataaataaaatattaatccgcggtataccgcgggtcatatcctagttcactacaagagaacaaaacttttttcaacagattttccaacggtaaataaacggttagaaattttcgacggtttcttaatgatattccaacggatttctaacgacatgtttcctatcaaaacatcgtcgaaactttccaacggattctaaatgatcgccaattcgtcagtgatttccaacaaaactccaaccaaattaaatccgaccgaatatttccacggatttctgatcaaaatatctctgttttgacccctcgcatattcgtcggaatattctacacttttctgacggaattccaacaaactatacttggtcaaatagcagcccagtcaaatagccgttcggttaaatagccgtgcgtttagtttttttttataaaaaatcatcaaaaaaagcggtcggaaagccatctgaaactcgttggaaacattgataattctcatatttttattcttctacactcattcacaaaatcgtccaagcaataaaatataactagagaaatggcttcttcgaatccgtttaattattttcgatcatggatggaccagcccacgcgtgatccgttaaaggagttgctaatgtcggaatatgtagaaggtcttaaacaattcatggcatttgcggcaaaccaaccggtaaccatcgaataaaaaaaaatgtattgtccatgttgtacatgtcagaattttagagttcttcctgtatctcaagtttggatgcacttatatggggaagggtttatgccaaggtacaaagtttagttcatgcatggagaaaatgagtcaatggtgaattatggtagttgtaacgaacattatcctgttgataggttagtggaaccaaatccggaagtagatgcaaatgtaggtaccgttcagatggtgaatgattttttcgtgaaaatgtacactcgtttgatagggatagtgatagagtagaggaacctaatttagaagcaagaaagttttttaatatgttagatgcagcaaaacatcccttatataaaggatgtaaaaagggtcattcgcctttatcttctacaaccaagttgatgggtatcaaaactgaatatcatttatccgaggattttgtggatgcgattactgattttgtgaaagatttattacccgaagataatcttgcaccgggaacatactacgaggtgcagaaattggtagctggtcttggtttaccgtatctggtgatagatgtgtgcattgacaattgtatgttgttctggagagaagattcagatcgtttgacatgtaagttttgtcgcaaacctcggtgttggtgtcggatcccgcaccaggaacaccggtaccaaccaaagattgccacgtggacaagagaggcccaaaagaagtaaggcccataggcttctttaggcgaggagaagaacacaagcgaagtggtcggtccgcgagatggatgtgatgacgggatcaaaggtgtctggattaaagagcctttaggccggaaggcgaagcccatggagctcgaagtcaattcaaattcgaacgtttgaacaataaattcaaagaccgaaacagatacatttaagatagaataattgtgtgtaaatgagaattaagtgtaattcttaggtataaattatagggtcaaaggccatggaagacacacacatttttgtgcaaacttaccatacacattttcttacaaatctcatagttttcttcataatcaatagttctctacacttattttttgtcctcaagaataatctttctcactaaataaataaatacttgagtgtgtgaatccgacatccacattttagcgccgtctgtgggaacggaggattcttgagtcgtcagacttgtctatacactacatttccgaggtaagcaacaatg

SEQ ID NO: 8090 - DNA, 3000 bp, Unknown
  misc_feature (1)..( 3000): cDNA_ID_1810360_gDNA_ID_1621192_Annot_ID_57500 3000 nt of promoter + ATG
agctcggtgagctgatcgtgtactgacccagctgggtggtccggtcagctgacactcgagctggtggactgtggtagctcacgggtgaagaggtgtctcggccaaaaggtgtaaggtcgagcgggtaccaacgaacggttgcatcgcctaatagatgcaaggaacggatgtgaccttttggaaggatgcaaggaacggatgtgacctttcggaagggtgcaaggaacggatgtgatgcttcgggaagcatccattcgccccctatataaaggaggacgcccaaggcctttggaataatctcacatcatctcacaatctcacaatctcacatcatctcacaacatccaaaacaccataaaacgttcttaaaggagtcccaacacatcctagagttgttggtcggaaaggggatgcggctcggcgagtataactcgaccgaactgatgcacatgctacctcccgatccaacggttcgatggagtgtagaggatggagagggtagaccgttcgtcttagagacgaatcggatctagtagaccgatcgttggatcggatcggccagaccgatcgtaagacggatcggccagaccgatcgtaagacggatcggatcggccagacggatcggacagaccgatcgtcggacgggtcggatgggacaggccgatcgtctgacggaacgggtcggacagaccgatcgtcggatgggatggatcgagaaaagtgttcgaggaagcacaaggataagtgcatccgaacacacccaagggtcgcccatggatgcaatcttaccggtaaagggagaaagcaccaagaatgggtaaggaacgtgattcaccatataagatcaacatcgcggccgccttcatgtatctatctcctcagccatggtgaaaccgatcagagatcggtaagaccaaagggtgactcgacggataaccaacgggaaagtccacggtgggaaccgatggacaaaacagatgttggacccgcgagaaaacctaaggccgacggaagaaagatttcatgggctagcctacgatgatctagtggatgaatccacggacccttgggtgtgataaggatatagttcggatcgtatggatggatcaataagccaaaagctttatcgaccaccatagaccggacggataaacggttagtaaaccgtgggcggtcgtagtaaatgacaggatcggaaacatggatggttcgataagccaagggctcaatcgtccaccatggaaccgaaggggagtacgtttggaggacggatggaccaataagccaagagcttgattcggtcatcgtgaaccaagggaatcgtacgatccccaatctctatcgttgtacttagaccagtggggttggttggttgtatggctaagtaatgatagggattggttcatcaattcacgaccgatgacgagtcgttgaatgaatggagtaaggcgacaaacgggctaaggaatcaaatccgcatattggccaaggtatgtaacgatctagcttattagttaagatagacgtttggtaattgaccgtgaaagtaagataaaggaatatgcgattgtttggcttagaatggttagcgaacatatgcatgtcttgaccgagtaaaggatcgatcatagaattaaacgaaggttagaaagacttccgctgtgtaataagagagcaattatagaatttagcctcgtaaaggcaattctatgttgaatcgcgaaaaattaagaggttcggccggggagaggcgcgaacttgagtacacagtcgccggacaccgagacgtccgggactgggtctcacagaaatcatgcgggctaagctaggatcgtaaagaaatcagctgggtcagctcgcccaaagctcaagctcagctggaaggagtgacggttactcaggttaagtgacagtccagctcgggcagctggacgagtgacggttgagcttgaggtagctggacgagtgacggttgagctcgaggtagctggacgagtgacagactagatgggcggttatgggcgaagagatacaactcttcggaaaggtgcaactcttcggaagggcgcaactcttcggaaaggtgcaaggaacggatgtgttgattcgggaagcatccattcgccccctatataaggaagggcgcccaggaccattccactcaccacaacacaccgaaaacacaagaaactcaccattaaaactctctccctcttgggagaataaatagtcttaggattcggtagtcgggctgtggccggcaataaagaaggagggtcggatcgacctaacctcgagaaggaaggtaagggatcctagactttgagtctaagggttctaggatgtgagttagtagtcggatccttgaaaggatcaactagagggctgggtagtatccgggtcatgtgcatcctacacaagactcggtccgggtagggatcggctgaggcggggacgcggctcggcggaggaccggcgggtcttaactgatctgccgagaatcggccggactgatgtgcgatcttcccctctctgaattctctccacggatccgagtagtgtatggcatatagagcattgcatggacttgcatatgattaagtaaatgagattacttatggctctatgactttcaggaacgaatggtgatcgtgggaaggacttggcttaggcgcgagagactcaagaccgggatgatgggtggtgatagttcggatagtctagggatcgattatatgacttgtaatagcttatatgcaaactcataggttgtatcgaatcctttgcttaatcaataaagtatccgattgtttgtttactctattcgtctcatatattgaatcacggaatcatatggaacggattagactaggaaagaacctcataaacggttagggccgagtcacttagtggcttgggtcgagagaactcgtccggaatttaggcagtccggatcggggcctttcaaaaaccaaggtcctgctgctcccgatgctgaa

SEQ ID NO: 8091 - DNA, 2393 bp, Unknown
  misc_feature (1)..( 2393): cDNA_ID_2140236_gDNA_ID_1621193_Annot_ID_57503 3000 nt of promoter + ATG
aagcttgtagaagctcccaaagaatttgaaagctatggacaacttcttaaaaaatccattagtttttagtgaaaatctttacaaggaagtgatatacggtttcttgtataaataagctctaaaaaactaagaaaaaaaaaagaatttaaccaaaaataaaaaagacagaacatatttttgtaacttggaaaaggtagcaacggatgatctagtcccagccgataggtgtgaatttttgatgaccattcactaaacaagtaacaaacgttaaaattttaaaatatgatgacatcagcagacccaaatttcctaaaagtccttgcaactctaataaattcctattttctgattttcgttgaagaacgtaatgttgaaaattcaacaagaattgagtacattgtactcgtttgcaactcattgtgtgaggtctcgaatcctttgctcattttgatttcaaataaagctttctttcccttaattcttagattttgagatgggttggctgaggaagaagaagaagccaaaatccgatatagcgtccgagagaggggccaagttgttagaagagctcatcgaatgttgcgatggcaaatccaatcccatcaaattcttctctgctgatgagatcctcaaagccaccaacgatttcagcgactctaattttgttttacgattagaagttcccttcaaatggtattctggtaagaacgagaatcatcccatgatactaatcaagaaagatgttggctggtggagtggcttgagagtagatcgtttgtgccgcgacatagcagtttcatcgatggtgagtggtcacaaaaacttcatgaagttggttggatgttgtcttgagttagattatccagtcatggtgtatcatagtgttaagaaacattacaaattagaaataagtgaacagccatggaaaaagagaatgaagatagcagaagatatcgctactgctttagcttaccttcacaccgccttccctaggccctttgtatataggattttgtctcattggaatatcttattggatgaagatggtgtcgccaagctgactgatttctctcactgcgtctcaatcccagaaggagaaacatttgtccgggttgacagagacgtgggattatatagttactttgctgataattacgttaggagtggcctagtctcagataaaacagatgtctttgcctttggaatctttatgggtcataggcttctattaggatacgaatactatttcgagcattatcgaggagaagaagaagaaagtgaagatggatttgacagtctgatgaaaagacatgctcggaatttgctctcaacattaaaggaagacagaccaatggaagagattgcagattcaaagatgatagaaaagatgggtcaaatttcagaacaagagcgttgtcaaatgaaagctttcttgaagctatcactgagatgcaccggccctagtgaagaagttccaacgatggtggaagtggccaaagaactaaacaagattcaaagatctctttttaacgactcttcttctctttcttcaggtcaaacccaactcgactctgcccaagacatttcttccacagtggtcctctcaaattagacactgctaccaagtattgcctgccaggtatttcatgaaatgtttcaatgggttatgttgagctggtttcgttttttcaggaaaaaaatcgaacaatgtgctgaaaataacttcgattcttgtttgtattaaaacattatcaagtttcatttttgttgttgtatttataaatagtgctacgttacttttgattcattatattgtcccttagagtctgtgtatgtgtgtttggattttgatggatgcgtctgtgtttgttaattcaagagatatctactcgtgtattataagggaaagtctcccaagtcaataacaattctaaagtttacattgtgagttgggaaacatggttcattgacgtaagtttgcaaattccagcaactacatatgaacaatgcaatcaatattgaactgtgaactccatgattgtttggtggatttggacattcacatctatactaaagtgaaacattcatgacggtaaacttctcttggagctgtatcttgcatattaagaatcaaagaatatcagtgaattatgatcttcattgtcagctttgtcttttcaagagttctgatcttcagctttgagtaatttccgttttcaattccaataaaatatgttttatgaaaaaatcaatgttattcatcgaccaaaacgacgtaggatagagaaagaaaaatgggaacaacatccgagtagcctccgagaccacaaacatcctccaataagccaaaagaagacgagagaaggagaagagtcgaaatcgccattgaaatg

SEQ ID NO: 8092 - DNA, 3000 bp, Unknown
  misc_feature (1)..( 3000): cDNA_ID_1810432_gDNA_ID_1621193_Annot_ID_57506 3000 nt of promoter + ATG
gtatttgtagaatctgctgaaaggagatgacttttatcggattcggcttccatctaatgtggttagtccaccagggagagagtttgtgattgcatcagtgagagctgtaagtctatgtctacctttttggttgatttctttgtgattgttctttgattgtttgctagtgctttcccatgtctggaggtgtaaattacaggctttgttttaagtctatataaaagactctttgtaaccatggtggttttgttttagtttcactctttgaactcttagtaggctacacctttctagtaataatctaattctactctttcgagatatgagagcttgtttatataattggatcggtatgaaatggttagtcgttttgtaatacacttacagatttgtttctaggctagactgataaagacaacactcgtttagacacccttcttgctttttcccacttttcagtcagtttatgtgtctgttatagaacaatatacttgtttgattgcagagatgtctaccacgggatggcttggatgagcatttcattatacacatggtaatgcccttttttggtataaacttttgttgagttcaaagtttagtttgcgccttagcattttaactactacttgagtgtattacagagaaagttgggactatgaatatagttcaaaactgtgttcggcacagtttgtttacttgctaattgctatactgtctccgtttgcaggaaggtgctaacatcttggcagttagttatggttctcctggggcgtgtcaatatcctcgccaattgaaacttgtaagtgaactcgattatcccagcttctctttttatttacactctaactgagataaattggacatggactgatcctttcttgccttcggtctagaatcagataatactgatacaattatgaatgcggatgatgtaattgagtcattatctttccattcaccaatattttctgtgatttaatatattttgagtcatattctagagtacagtatcgcaccctctttctctactgtgcctaggtattttcagcataagtggactatctataagtgttctgtaatatgttgatagatccgcagaaacttttgtgaggaaatagtaataccgtcagaagattagatatgtgagagtatggtcttaggatcactgtaagcattccataatgttgtgattttgcggtgtggtgtgaagtaattagtgttgggtgactgtgccatgttctgtgagtttttttgtgctggtctctctaagtgtcactcatagtgatattttctgatagaatccgaccttgggttctatcacatctcttgtctgaacactgaaaccgtatattcatgaaggaaaaaggttacattatcgttagagcttctgactttgattatgtatgcgttctaatctacgtttttcgttttgcttactgtagccagcaaaatggtcgtttaactctcacacaattctgaaaagcagtgagcaggcgccaaggtagaataattattgtgttttttttttgcatcaaaatggcttaactttgcatgatcctggatgtctatattcgacttgtgttctatagatataaatatatttgtcagttcatcaagttatatcaatcaagaaataccattgcttctccaccctttagcccaataactaatatttttttatcttatccttacctgactgtttcacagaactccaatattcactgaggagattctaggcagtgagaatgtagagggagaagttgaaccaccaccagagagatcattttgggcgaaatatgtgagtaatacgataaagatcttttgatgattccttctttattttaggtcttgatgtaactttcatatgatacgcagtggatgtatttgataccgctgggactcgtagtgatgaatgccgtgacacaagcatcaaacatggctgaagaacctgcgggtggacaggcaggaggtgcacaagtgcaaccagctgccaggagaagatgattccacttttacttctcccaaagcaatgaaaggtagaccacgccgcaattactatgcacaaatttctcttttacctagcagtctttaaatcttatgatcctaggagaatacatttatatatttgtttggctatcttcgcagctgtggatttatattatttggttgtaacttataagtcacgtggaattaaatgaattcggagtttgcatggaaatatcaacaaggtttaggaagctgtctttgaagtgcgttataagatcaaatctgatttttagcttatgttgttgtagctgcagctggttagagatgatgattcaacagatcttcatgtaaaccatcttgccatcatttggttttatgtaacctttaattttaatcctcgatcggtgtgtttttgtactcaccaatcgggaaatcaaaaatcttgtcttcatgacatatcaagaacaaagacatttagcagcttccatatcttgttttgatcgcatttcacctgtccaaccacatgtttgtcaatttgtatttgttagtaaatttaagggaagtcaagtcgtttacaggccatgagagaaatcatttataaaataattataaactgaaaaaataaaatatataaagggtttattttctcaaaacccagtttttagggatgttattatggaaatgcgggcctaaacgggcctttagcaattcaaatattagcccatagaatgtacaacttttattttttatttttcttaatcataaacgacgcagttcttgtgtcgatcttcgctcatctcttctaccacgagcagactgtagccacggcgaccaaaaggggaacaaggatacgattacgacggaatactccgccggaaagttatttctcgtccttaacggtgccggagtagtgtagaacaggtcaatagttaatttccacgttttagtttggtgatttgagggattttaggctcttgattggttttggaaaatctgattcagggattgaacaat

SEQ ID NO: 8093 - DNA, 3000 bp, Unknown
  misc_feature (1)..( 3000): cDNA_ID_2107797_gDNA_ID_1621193_Annot_ID_57507 3000 nt of promoter + ATG
aatttgggccctgattatggctttgatgtggtgaggtgagaaaagtgtttaaccagtccggggttagaggtaaacccaaaagatcaccgctcaagattgacccgacgtgtaagtgtatgggttacattgagttaatcagtgttcttaatctacctttttattgtaagaacagaaaaactataccgttctccgacatttcaatcaccaatagacttggtgtactatagacattagacagcaatgtagagtttaataaacatgacctgtgaatataaatgcaaattgtccgatttaataaaagccaatcaatcacggggaaactggtatagtcaacactcttaacccacacacacatattgactaaatttatcaccaagacaactttatgatgtcccatgtgtgaataataaataacaattagtaattaatttacagatcttgcaggttacttacgctaacgcaatagagagagttggaacaaacatttgacataaaacatctcttacaataataacagtgtcagataaataaacatattcaaagatattgtctagtctctgcacttgaagatgaataattgcttttttactctttttcctctattttaaactaaaacacttaaagatcttatcagatcagaataaggcactaaacttgatccattttcttaacatgtcactcattacaaagacttaactttaacagcttcactatcaccaccatcaccatcaataccatcatcatcatcatattaaatactcttccaattgccagcttaaccaaacaatgactcttttccaaaatatgctaaattctaacttttaactttcttaaaacacataagaaacaaaatgatgaagtaaacaagagaatgaaaaaaaaaaaaaaagagagagagaaagacagatagagagaattgattgaacagagaagaagaaacaaatcttgcttgaagtgtgaacaagattctcaaaacaaaaaaaaccctagaaaattatgaaaaaatggcaaatgcaaaaagacaattaattaatgaggatgatgatgttgctgagatagtaggtaatgaaatttaatgaagactgaaaaataaattatagacaaaaaataagtagaagactcaaaccaagaacagatattcttctttttttcctccctttcacacttgaagatgaatcaagatttagattcacttgtttctctcccctggaatcaaaacattcataaccaaacatcaaaacatgaactgagcagaaactaagaacagagaagaataagaaacttacaaattacaatgaagtagaagatctcagatatggcaaccaaagcaattgcaagttttgggagtgaaagaacagtaaccaaagggtctattagggatattgcagttaatagcatagcaacaaggagaaggcaagcaaagacctttagcaccaccacaacaagtacaaactgaacatatctgaaaacttccaagtttccttcttgtttcattcattaccataaacttctcctcccccaatggcaccatcatcatctcattatctccttcagctggtaatacctcatttgcctaaacaaaattccaatcaaaacccataaagctcaaaactttgaattcaggttatgttaaaggtttgatttttaacaaaattagaaatacccagatgtgaaagaagagaactttagagggatctaagtaaagaaactaacctggtgactggaactgatgaagattgagaagagaagaagcaacaagaagacaatagagatcttcgattcttctaaagttctcattttttttttttttggtttgaaattttattttctttgttgggtttggtttattatgtggttagggattttgggtaaagtagcaaatgctacttctctctcgagctacttttttcaattattttggttataacatttatgatttttgtagagaaatgtttttgttttttttattgagggaagaaataataagtggggtctttaattttactattctttaatttctccacttcattaccacaccaatatcgaatcaactgatagagaaaaccataccaattgtaataaaacagattcttcttcttcttttcgaaggatctgattcttttggtgacaaatataatttcaataacgttgagtgtttttttcaattagcatttagaatagtgaagtggagaagataccaggcagcaaaatttataacccatacataagagcttatttggtcaatgacaagaatttaaaagtgtgtcgtacatgtagtatatagtctttgagttcatagtttcagtaaatttctttgagttcatatctctggtactgaaatctgataacaaataaaataaatgagtcatctcacaatatctaaaggaataatctagaaaatgcgttgccaaaacgtggttttgaaattgtccacaaatctgaaatctttgtaaagtagtaatcttcaatatccaatatataccggaagaaaaattacgagaatactattaccgtaattagtaaatcaaaaagattttcatatattctattaataaacttaatacaaagaagatcaaggtatatatctttaggtgcaagacaagcaaaagtaaatctacttgcaactctcattaataatactatgtaaagttgatggtgtaagagataaaaaaaacgtttgctttgaagaagataacaaggaaatctcaaaattgcttaatagtactaaattaaaatttgaaaccttcaattggttgggagctagattctgaaagcacaaatttgaagaatgccaagtcaaacggattaaacgggacttgtgaaactgatactactagataaaattcttgacaaagcccaagcgttagagggctcagataggcccactttacaaatgtaacgacgtcgttttgcgtatctcaaagtaaggaaatctctccttcgagagcaaagagaaagagcttgctaggtttttctcttactctgcaatacacagcaatg

SEQ ID NO: 8094 - DNA, 3000 bp, Unknown
  misc_feature (1)..( 3000): cDNA_ID_1841622_gDNA_ID_1621193_Annot_ID_57510 3000 nt of promoter + ATG
tttctctataatttttgtatatttaattaatgtaaatatacaaaattatatcaaatatattatttccttatatgtttcattttaatcattttttattaaaatgaataattggacacctagatagctaggccaaaacaatttttgacattccattgacttatttacccaaaatggaaagtgtgggtgattctggctgtttagatgcttagacataatcttactttctatccaactaattattacctgtaactgtaagtttcaattttaggcattttatattaattatattaaaataaaaataataacaaatagaaaaatgtatagagaagaaaatatcttaaattacctttgaaatatatattttcctttaaatggactttctatataaaaaataaatcacattacatatatgatacaattttccccctaaatgtctggttttatgccccccaaaaggtaaaatatctatatgggctgtctataaagataaatgattatcactttaccatcaatcacatgccaacacgtaagggtgaaagtaataccatatcctgaaaataaaaattgaaaatagtccagcaaagcaataagaaacacattttatctagtatataaacaatcgtcctcatgctaacaaagcaaaacacatataacaaaaacaatagatatgaagagaaagatgaagttatcgttaatagaaaacagtgtatcgaggaaaacaacattcaccaaaaggaagaaagggatgacgaagaaactaaccgagctagtcactctatgtggtgttgaagcatgtgcggtcgtctatagtccgttcaactcgatcccggaggcttggccgtcaagggaaggcgttgaagacgtggtgtcgaaatttatggagttgtcggtgttggaccggaccaagaagatggtggatcaagagacttttataagtcaaaggatcgccaaagaaaaagagcagctgcagaagctacgtgatgagaaccataattctcagattcgggagttaatgtttggttgtctcaaaggggagacgaatgtgtataatcttgatggaagggatcttcaagatttgagtttatatattgataagtatcttaatggtcttactcgcaggattgagatccttattgagaacggtgagtcttcttcatctttacctcttcctattgttgcgaatgcagctgcaccagtcggatttgatggtcctatgtttcaatatcataatcaaaatcagcaaaagccggttcaattccaatatcaggctctttatgatttttatgatcagattccaaagaaaattcatggttttaatatgaatatgaataaggattcgaatcaaagtatggttttggatttgaatcaaaatcttaatgatggagaggacgagggcattccttgcatggacaacaacaactaccaccccgaaatcgattgtctcgctaccgtcaccactgcccccactgatgtttgtgctcctaacatcaccaatgatctctagtctaagggatgtatttcgagtgaagtgtttgatcgtttgcatttgtgttttctccattttataagacaaaacttatatgtgatgtcttttttattattattaattgttggacaattcttgcgtccacacttatcttatttaccctttcttaagttccttattaaactttacattttttttaacaccatcaaaaactttctctttaagttgtttattacactttacatttattttacaccatcaaaaactaaggtcactaaataaaaaaaactatgaagcctcattttcccataggagcaatgtgagacatagacaaattgagtaaacaattacatcacttggtaaacaatttttttaatatttaattagtattggttgttattgatttaaattttatatcactttctaaataatttaaaatcgtatatttgtatcaagtgatgcaaatggatttagatttgtatcaattttagtgaactgatgccacataaactaatacgacatcgattattgcaattgatgttaaactataattcttgtatcgattgtaaacaagtgattcaaattaatagcattcaatttttttcatgcaactacttttttgtttgtagtatttgttggatagaacgtaatgttatggcttaacatttaaacggccagaactatccacactctccattttggacagatcaagcaatggaaggtcaacattgttttggcttaaccatctaggagccctatttatttgtttttaattacattttaagaaaaatgactaaaagaaaaaatacaatgaattaatatatttaggataatacagtattcaaatatttacattaatttaatatttaaaacagtataaagaaaaagaaacatatctaattagttttataggtgcttaaacatatacgaattcagtagttcttagcaaattttaactattgaactttgtgttcaaaataaccttcctatgatgtcaaatactgaaactattttagaactcttgtgagttatcttagcaccacattttatcacttataactctttttttattatttttaccaatagaaagtttataaccatgtttttataccaattgaatttcttatatttttcaaataattgtaataccaaaagatattcttagagtaatgtactttacaaattataaaagttgaaaatagcgatatatgggctccatctaatgatctcaatgcgggaccagcatgtgatatacgaatgtctatatacattattttctctgttttgtaacaataaacgagtaatgaaattatattttattggcttcaatttgtaacaaccaacaagaggtcgaatgagccaactagaatacagcccacgatcaataatcaaacctatgaaacttccttctctctttcttttaacatttccaaacactatatatactaatgtcacttacctcgattgtccatcaaacaatacatttgagatatcaatactcctgtgagaacaaa

SEQ ID NO: 8095 - DNA, 3000 bp, Unknown
  misc_feature (1)..( 3000): cDNA_ID_1810408_gDNA_ID_1621193_Annot_ID_57514 3000 nt of promoter + ATG
ttaatccaatttaaacatgacacatgacgacatcttatgttttactttacaatcacataaggtaacaaatttgaatgccaaacattataacaataataaattaccattgtaggagtaaattatatattttgacaataaaagtatataattgattatactagaaatcgactcactctaatactatgccatagtattttaattattttaaatgtttattttatttggagttttataattaaaatatataaataaataaataaaacttggataatattcttaaatattttgttattgaaatttctttacaacaatgtaaattttaactataataagtggtggcaatgttaaatgttaagtgacaaaatttggaaaataagttagatattttatattattataatgatttcaagaactcataaacattttgatgaattgcaagatttgcttgctaaagtaaacgccagaaaacattgggcagatacctatttttctttgattgtattggtggtgcatgtaaaattgctttgtaaagaacaaatctcatatttgtactcgttcctatctatgtatatcggatatcaacgttaaattttgcactttatcttttgcctaagtagatgacttttctcaagagtagccgaatttcctgtatagtatctgcattttcttaaagtgatttccttacttacagctagagactacattacctttatttctccagaaattgcattaacaaattcttgccaccatgggaataggttataaaaagtagtttagcaacaaaagccgtatacaatagtgatattgtgcccttcaaagaaaataaaaaagagagtggagataagaacgacttaaacaaaacgaaaaaaggctttggatataaagcatatatacaccagtttgttagtcaattcactttctctttatccgtttgtttagtttgagtattgaaatatcagtgacgttactaatgtttcatttagaatgatcgcatagacataacagaagatcacattttgaaaatgaaagttaccttttaagctcactcatggtgaagtgaaggcaatggagatcaaggtctttctacagtcttgcaactcccccaaactgagaaaccatcttgagtataattaacttttaccgaaataatgatagtgaatatgcatggtttaacttagggacctcaatataaagtgtaactaatatctatctgataatgaaaactaaactctaaacacatacatggaattatcaagcatgttaagctactatacacatccgataaataaccaagtgtgtaaaaaccacagagcagcaattgtctctgaccccatagaaaccaaaaatatatctacattacagagagttatacattcagatatcgtcatatatattgtaatgtattggctttattaaccgaggaatatagtcaatcatctttgaaacagaacattaaaattgaaaatatcaaatcacacaataataaaaatctacataattcatatattaatcccggtctttcaagctggcttcttcaattgtggttttaaaaccttcctccgatcaaaaccttccttcttaattcagttgtggttatgcttatctttttcttaatttgtgcaaatgcttattttctatttttcttaaataagtacatccgttataaaagagattaagaaactccagtaatttacaatttgaagaaaatgaaacttatggaatttatgtcaaaagggggaaaatgcgttaaaatattgtattagattttcaacagttgcaacttgcaagggtttttatacgaggactactttaagatatactgcattttataagatgtatgtagttccacttgttgatgtttgtaaaagtgacctagagtatgagaaaaaaaaaacactagtataaaataaaagtaaaaatgtttattattatcatcttgtcatcacaaatctggatagtttattacaagcaagattacatatgagattcaatacgtaaacttgatcgtggagtgttacaacgagtacaaacacattgcctgaaaatacattgtgtgatacggcaacccggacatgtatcgtgacaggtattgtcgttgttgcaagaccctccacgttgtattgttacatctccactcattcttgcttctccctccaataaacctatatataacatagtttgaatcattacgaatattatgcacttaggttccatattcgtttcttattacgaatatatatgatcatcttgatttgaattgatttgccttcttttttttcttacaaaagaattattttgtttctttggctttgttgttaaaaaagataaactatatgtaagaaaaacggttaacttgcatgtggacaataaagattatcatgaaaaataaagaacactatgataatgcgctgaagttaaatttagagttgaaagatggactcacatgaaagggacaataagaaggcaacaaacacaattttcctgaacactattttctccattcctgatagtattgattatcattatacaaacgtgtatatatacataagttaagctgatttgttgccaagaacattattgattctcatcaattttctgatttgtttaataaattgcaacggcaagtttaaggcaggagatttggaagattctcatagatattggacatgaaatctctatagttatgacttatgaaagaaaaaatctcggatcaacacgtttgacaatatttagtaaagatattctaagcatgagtttttacctaaatatataatcctgaacttatgtttttaaagctttctaaaatcaacatacgatatgtatttatcctcaagatttggacaatcctacattcaatgttttagtaaccgcgcaagaagtgaggtcatctagaacaaaagacagaaatgttggacctcaactttttgctatgagtaggctgattacaatatccagaaggaatcaacactccatttggttctcaggttaagaggtggtatg

SEQ ID NO: 8096 - DNA, 3000 bp, Unknown
  misc_feature (1)..( 3000): cDNA_ID_1810400_gDNA_ID_1621193_Annot_ID_57516 3000 nt of promoter + ATG
ctagacgtggaagctgaccttcaaggaagttgtaggacaagttcaagtactcaatattcttctgtctgaacaaagcttctgggatctctccatgtaatagattgtcagaaagatcgatcccaaccatagacaatagattgtagctgaaacttaattcatctttagcaacaacagctgctgatattttgatctctacttttcctggtggctcagcaaatccttcacctccaccggtctgaaaatctttgaagcgtgtgctgtttaagttatcgtctggtatgaaccaagagaatctgttgctggagtagtcaatcatttggattttgtcaaacttgaacaaccaagaaggaagtgttccactaaacttgttccgggcaagagaaagatacttgaggttggaccatttggtaatggcttcattaaggttccccgagaggttgttggaacttatatccacaatctctagagacttcagaccagctaaagtaagcgggatctcaccggatatatggttgttgcttatgtccagtatctttagactatccaacgcatcaagctcgggttgtatttcgccagagagattgttgttacttatcatcagagcaagtaactgaaagcaaccaacaatgttgagaggtattgagccggttaacgcgttgtgggaaagatcaatgacctggagatatgtcagattaccaattctagcaggaatatctccagttaaaagattgtgagagagacgcaatgcttgtaaactcttcaactctgtgatcctcaacggtatatcaccagaaaagctattgtgagagaggtcaagaagaaccaaacccaatttctcagttgtttccgagattctactaggaagacgacctgaaaacccgttgtgactcaagtccaacatcacaagcttctctgaaaacataagcctaggagatatctcgtagttgaagccattgaaagatagattcaaatgactcagctcttttaaagaacccaaacaagaaggtaatccaccaaccagagagttctcagctatattcagaatactaagagacggacgagaggcgtagaaacaaggtagcgtaccggaaaactgatttgaagcaagattaagaaccaccaatggctgctgaaaatctctgagtgtaccagtcatgttattgctctcaagattcaagtacttgagagacttcaaatacagtaaactctcaggtagttctccaacaaacgagcagaaactaaaatcaactctctcaagattcattgagaaattaccaaaccaatgagggaccacaccgcctaaatctctattctcacttagaacaacttctctaagctccttaagacttacaaatgtggcgggtatcgaaccaacgaatctattccgactaagattaagtgtcctaagattacgcaacgaaccgaagcaagaaggaatgtttccagagaagttgttgtgagaaaggtccaagctttgaagagaagagagcttacaaagagatgggtgaatctgactggagagattcagaccggataaagtgagggagagaacttttccggtcggattctgacaagctagacctgtccagttagaacacgatgagccgtaccatgtcgataagcttcgatttaggtcgtgaatcgaaactctgaatatcaataaagaagctttgtcttgtgggtcgagatcgggaagctgagattgagctagaggcaacgagggagagaagacgaagataaagaagaagagagtgaaatctgcaatctttatcatagctcagaggagaaagatgaagtttttaggtatagcggcagttgaagtaaattaagaaggtttcaggggtgagttgcagaaatcgcagagacctctctttgcaatggagagtgaagcaacgcgacctggaagtggaagtggaagataaagacagagagaacattctctttcggttccttttgttttagcctttcagacccaagaagtgattaattaatgcaaaattccaaaaatctacacttatttctaggaaaaacaaaatacaaagggtttgattcagtacgtaatccgtattgttaattactaattttataggtatttataaaaaaatcatatattttactaagaaattttaaatttagtctcaaatcttatgttattgaacctagaatttacttaaaatcatttcaaaataatatgattctttttttttggataaagttaccattcattcttgtaacgtttactataaaaaaaaaaaacagcatatgattccactatgaagaaaaattccaaatttaccggctcaaagaagaaagagtgtaaaagaaaaatcgaaaccaaatgtacaatttcactataagtcatacgatttcaactcgagtaaagagcttcaagtttgcatagtctcaaaaaataacatgttcgaagatgtcgaaaatgtccatgaaaccaacaatttaaaacaaaaccaggccagctttgtagctttaggcccattctaacacattaatttatgttttgtgcaactctaaaactttctctatataaatggtatctaaaccctagatctaatagtaagtgccgaagaaatctctcaagtctctctcgttgtctcaggttggtcagttctttctctagatttcaacttgtttagtcttttaagaggaaaaagcataaagctttctgtgtcatttttaatatctgagaattctaaaaaaaatgttctcttgtgtattgtaactcgattttcgtcagatcatttctgattatgggtatgttttgttttgctctctagggttgcaacattttgtagagaaaatgggttcatatgcatcagattctgcaatgttgaagacttggagaaagactcctccttcgtcttgttctcttgtcagactttcacatctttcttcactacaagcatatataactaagaaatgttgccttttttgtaaaaatcaggagattggttgtttacccaaaaggaaacgaagaggacaatg

SEQ ID NO: 8097 - DNA, 3000 bp, Unknown
  misc_feature (1)..( 3000): cDNA_ID_1810388_gDNA_ID_1621193_Annot_ID_57519 3000 nt of promoter + ATG
ctcggtttcaactgaaatatggtttcggagaacctgtgataactttgccaaaaccattcactaaaccataaccaggttaatacttatctgagtcagaacaagaattccgaaggtttgaagagctgaccaaagaacaaaacggtcccggttttgtcttctcggataaggaaaataaatggatgatcagccacaaaatctatcttcttaggaggtggccccatatcaagagcacaaccgtcatcttctacatcagcagttgcagccgcagcttcagcaccttcttcatcgatctcgacacaagctttatggtacattgacactgaatgcagtactcccacttgattcaaaacgcttgtagcagaaaaaccgaattcgatcttaaactttggaattctaaattcctcaagttcaactttgtatctcggaatgtgactatccaagaatccaggtgtagatgctattttcttcaagagataatccaatccatctttcttgtcagggagatagaaatacattgagaatttgcggttggtatcatcacggcctcgtcggtaaggaccttgaaaccgttataagctcttactttttgtgtctcgtagctggtcatgaatggcacagagactgtagtgccattgaccatgtggaagtctctgtcttttgtatagtacttttcaaatggtctcttccaagctcccttgaaatacaatgcgtttgcgtaaatcttgttggttcggcttgtcacagattcacgaggaagaagatctttgatgagattattggtgtgatcttcaacccatgaattcacctccttacgcacttcttcagccttcaaacaaaaaaaacacatattggatgatttttgaaaacagtctcctaattcgaattatgatttgggaatcaacatacattacgaactattaggtttccaatttgactggttgagtatgttctttaagtcaaacagctattacacacttcatctagaaacaccaaataacgtttctgcaaaaccctaattatatttcttcgaaaccctagtttcttttttgctgttaaagtggaaaattacctttgatcggaaatctacgggaacgtaaacagccttgaagaagttctcgaagagagccttgtatttgggatcaatcggtagtgatttctcaatccagaggccattcaccgccctcatctttgggccgccactagcgctgctgtcggcgtagacgatggatgatagttctcggaagacggatttgagctcatcgattgaagaagatctgaggaaggagaggatttcaccggcgactaagccacctccggaaccagcggcgtgcatggtgatcgcagagtttattgacgccggcgagaagatgacgttagattccgactcagaagataagacgtgcctcccaaggatcatcgcgacgtcgttttgcttcttcatagcctttttcacattcatctttggtctctccaactagatagagaacttgcaaaagggtggaggattatgcatggtctatggagggacagttatatatagtgaacaaatccattaagaaatttttaattattattagggtttcttggaaaactagtcactttgcaatccaggtgtataaatcaaacacttaaaaatgactactttgcaaattgtaaatagtaatatgactactttcccaaatatgtttgaaaaaattaaaatgattacttttcacttatctcaaattatttttacaatggaatataaatagatttttctatactaaacctctgtaaattaatactcgataagttccacttcaaaaaacgaaccaaaggtcatatttcatccatgcatgttcgaacatgcaaagagaacttactaataatgtttggtcccaaattcaagtattctctggttctctttgcatggatgaaagaagatggccatatttttataggaatgttcagaaggagaattcacaatgtggagaagatagtgctactggtttatattgaagtcaggttaaggtttatgatagtttcaaggacattgatgcggactaattggcatcagatagtcgtgcttccaagactaatatcaggcgtaatgggttttactaatacgattatgaaacagcctcaagaaaaaaggcaaaaaaatcgtattggagcaaaaaagtcgaagaaatatcacgaatatgtgttttcgttagcgaataaggcgttttcgtccaaaacgcatcgtgaatcttatttttcgtatttttttcagaaaatggctcacatatctgcttgtgtaataattttggttctgtagtcttgtataactttaacactttaatttcgatataatggaatgattttaaaaggaaaaaaaaataataaaaaagaagtaaataaatcgatttttattaaattagaaaacaatttaattttggattgaaaaaaattaacgtactagttcaaaacgccaagttaatatctcggatagtcctactttctcatgattcagttctttatagaccatctaaatcaatccgtctatggatctaaaatcgttcttgaaactaacatgatgaaacggtccctagataggttggccgaggcaaagaagaagaagtcagctcttaactctaaaaaccaaaaggaaaaaaagaagtcagaccttactcgttttgtaaagatttagtcagcgaagaagtcgactagtgttcgagtggggaaacacgttgtcaactcttaagtctaaatctttgaccccaaaaaagagagcaagttgtccactataattctgtcttcttatgcaactttcatttttggccacctaaagtttcaagcaaaacaacaaaaatgatcttttagaataattattataataataacgacgattaatgaactctatatatctcacaaaagaaggacatgtttgcaatcccaaccaagaagataaacaccttagcaaattcaaagaagaatatatcaaacatcttttgtttctaagaaataagctctctgatt

SEQ ID NO: 8098 - DNA, 3000 bp, Unknown
  misc_feature (1)..( 3000): cDNA_ID_2140111_gDNA_ID_1621193_Annot_ID_174645 3000 nt of promoter + ATG
ttaagttgtggtttccaggattggcggataccatttaaagagccaagtccagatgaagaattttacatgatttcaggtgaaactgaggacaccatagcggagggcagaattgtccaggccagtgttcggagattgcagaatggaagagccatatgtgtattagattctgggttaactgggatgcttatgaaggaagatttctcagatgatgggagagatattgttgacttggcggaccagctgaaagaaggcgatatcctcacatgcaagatcaaatcgattcaaaagcagaggtatcaagtgttccttatttgcaaagaaagtgaaatgagaaacaacagacaccagcataaccagaatgtggatgcatattaccatgaggatagaaacagtctccagcttgtaaaagagaaggctcgaaaggaaaaagagctggtgaggaagcattttaagtctcggatgattgtccatccccgctttcagaatatcacagctgaccaagcaacagaggtatgccaaacatttactcttctttggtacttatattgagttttgaatgcatttgttatatattcaaagaagtctctgtctctgagtttccttgttggtgctgtgtacagtatttgtctgacaaagactttggagaaagcattgttcgtccaagttctcgaggactcaactttttaactttgaccctcaagatttatgatggagtttacgctcacaaggagatagctgaaggtgggaaagaaaacaaggacattacaagcctacagtgtattgggaagaccctgacaattggagaggacaccttcgaggatctagatgaggtatatttaatgtaatggtgttgtcagtgaacacatttagttgattcttgaacatccgtcagctttttaacattcctccgacttttgtaagccttttttggatctaatttgttgcgtcagtaattgatgttaaccacaccatctcataactgcaggtcatggatcgatatgttgatcctttggtatctcatcttaagacaatgctcaactatcggaaattccgtaaggggaccaaatcagaagtagatgatcttcttaggatcgagaagggcgaaaatccttcaagaatagtttattgttttgggatttcacacgaacatccaggcacttttattctgtcttacataaggagcacaaacccacatcatgagtatataggtttatatcccaagggatttaagttcaggaaaaggatgtttgaggacattgatcggcttgtggcatacttccagaggcatattgatgacccattgcaagaatcggcgccatcaatcaggtctattgctgccaaggtaccgatgagaagcccagcagaccatggatcatctggaggaagtggttggggtagttctcagagtgaaggaggctggaaaggtaactcggatcgttcaggctcaggtaatgcattttaaatttgtttttttaacttgcatagaaaagcttgtgtggtcattgttctacttctcggggttatgttttaatttaacttctggtaatctggattttagatgccgagaagtatttatatattaacattatttatgttgtctccttgactatacttctggacgtccgctcttaagtaactgtgcaactgtattgtagggagaggcggtgagtacagaaatggtggtggacgtgatggacatccaagtggagcgcctaggccatatggtggccgtggacgtggtcgaggcagaggacggagggatgatatgaatagtgatagacaagatggtaacggagattggggtaataatgatactggaactgcagatggaggttggggaaatagtggtggcggtggttggggaagcgagtctgctggtaaaaagactggtggtggcagtactggtggttggggaagcgagtctggtggcaataagagtgacggtgcgggcagctgggggagtgggtctggcggtggtggtagtggaggttggggaaacgattctggcggtaaaaagagcagtgaggatggcggttttggaagtggttctggcggtggcggaagcgattggggaaacgagtctggtggtaaaaagagcagtgcagatggcggttggggaagcgagtctggtggtaaaaagagcgatggagagggcggttgggggaatgaacccagcagccggaagagcgatggcggtggtggtggatggtgaagaaacacaacctcggctacaaatgttggttgggtaattaaattacgaaggcaaaaggcaagacataatagtataaacacattagtagtaaattagctttctccctaaatgccttttacttttactttgattctctgcatttttgtcttaacctgtcggtattagtatcggtttatgtcttgtcccgactcttaacgttccaggaaagtctttttaagtcgatgcttacaaaattttagaatctcgttatcttgaatactttttgtttgtttggcttctgtttcacctaaattacataatcaagctcgtaaattaatgaactatttacttattgctgtaccggcatgttcattttggattacttatgattttccatcctttttgtttttgtgaacatgaaattacaattagccgttatcgatctaaacaattcatttcgaaaaaaaaaaaacattttcaagagaagaagtcgagagatagcaaaacaaattttattagttgttgccatatatacaactttatcctaaatattcattggataaaacattattgccttcatcaccaaaaaatttgaaacaaacgttttaaatatttcttctaatcgtgccttgggataaaattggaaggggatttagtggctaagcttaatttaccattttgccattattcctttttcgattaaaacgttttcccttccaaacgtcttcttacgagagagagagaaagtatctaaaattaagctttgtgtttgaaatcgaaatcgaatcgagaagaagagaatctcaatg

SEQ ID NO: 8099 - DNA, 3000 bp, Unknown; identical to SEQ ID NO: 8097
  misc_feature (1)..( 3000): cDNA_ID_2140103_gDNA_ID_1621193_Annot_ID_174642 3000 nt of promoter + ATG

SEQ ID NO: 8100 - DNA, 3000 bp, Unknown; identical to SEQ ID NO: 8095
  misc_feature (1)..( 3000): cDNA_ID_3047610_gDNA_ID_1621193_Annot_ID_174636 3000 nt of promoter + ATG

SEQ ID NO: 8101 - DNA, 3000 bp, Unknown; identical to SEQ ID NO: 8094
  misc_feature (1)..( 3000): cDNA_ID_1841622_gDNA_ID_1621193_Annot_ID_174630 3000 nt of promoter + ATG

SEQ ID NO: 8102 - DNA, 3000 bp, Unknown
  misc_feature (1)..( 3000): cDNA_ID_3047618_gDNA_ID_1621193_Annot_ID_174629 3000 nt of promoter + ATG
ctttgcttgccttctccttgttgctatgctattaactgcaatatccctaatagaccctttggttactgttctttcactcccaaaacttgcaattgctttggttgccatatctgagatcttctacttcattgtaatttgtaagtttcttattcttctctgttcttagtttctgctcagttcatgttttgatgtttggttatgaatgttttgattccaggggagagaaacaagtgaatctaaatcttgattcatcttcaagtgtgaaagggaggaaaaaaagaagaatatctgttcttggtttgagtcttctacttattttttgtctataatttatttttcagtcttcattaaatttcattacctactatctcagcaacatcatcatcctcattaattaattgtctttttgcatttgccattttttcataattttctagggttttttttgttttgagaatcttgttcacacttcaagcaagatttgtttcttcttctctgttcaatcaattctctctatctgtctttctctctctctttttttttttttttcattctcttgtttacttcatcattttgtttcttatgtgttttaagaaagttaaaagttagaatttagcatattttggaaaagagtcattgtttggttaagctggcaattggaagagtatttaatatgatgatgatgatggtattgatggtgatggtggtgatagtgaagctgttaaagttaagtctttgtaatgagtgacatgttaagaaaatggatcaagtttagtgccttattctgatctgataagatctttaagtgttttagtttaaaatagaggaaaaagagtaaaaaagcaattattcatcttcaagtgcagagactagacaatatctttgaatatgtttatttatctgacactgttattattgtaagagatgttttatgtcaaatgtttgttccaactctctctattgcgttagcgtaagtaacctgcaagatctgtaaattaattactaattgttatttattattcacacatgggacatcataaagttgtcttggtgataaatttagtcaatatgtgtgtgtgggttaagagtgttgactataccagtttccccgtgattgattggcttttattaaatcggacaatttgcatttatattcacaggtcatgtttattaaactctacattgctgtctaatgtctatagtacaccaagtctattggtgattgaaatgtcggagaacggtatagtttttctgttcttacaataaaaaggtagattaagaacactgattaactcaatgtaacccatacacttacacgtcgggtcaatcttgagcggtgatcttttgggtttacctctaaccccggactggttaaacacttttctcacctcaccacatcaaagccataatcagggcccaaatttgagtgcctacagcaaaaagattttggcccaataacaaaaaactgttttttaaaacaattacaaaattttcgtctaaattagattcaaaactgtatagtaaaatgtttgggactaaccactaaactacagtcacatttttgaaaatgatgactctaaaacaagttataattatttgctgcgtaatacccttgcttcatgggattacgtggagaagaagagtaagtatcaatcaatttattgctagagatttgcaaaagggggaatccgtgtgcagaggtgtctagatgaagccatgagtctacagcggagtttgaatttgcggtggatgagttacggtggagatgacattttccaaacattacaagccttaacacgtgtacctactgagattttgatagaacttgaaattgtttcccaaataaacctcttattcggaagttaggttttggactcaaaatggatgggatgcatcatgaggtatgagatatgtttcccaatgtagtctccggcgatgagattctttatcaccatttttatttaacgttaatacttaaatctttgtaagacagaaaaagaataagatgttagtcaagattagaataacgagacctaatttgtgaaattttccgtagctttttgtggataatagtttgtttagtaaaactgatccgaattaatgtgaactcgtaagactcctccatctcaatggagcggctaattagaacaactactaaattgtgacaaatctaaggttgtctcacataattcaagagtttaaaatatggtatagtcttagatatagatatcttataccaatattcataatttgctaaagctaactagacattcctagataatttaccgccaagaaaactaattaattggatatgtttttcttttctctataatttttgtatatttaattaatgtaaatatacaaaattatatcaaatatattatttccttatatgtttcattttaatcattttttattaaaatgaataattggacacctagatagctaggccaaaacaatttttgacattccattgacttatttacccaaaatggaaagtgtgggtgattctggctgtttagatgcttagacataatcttactttctatccaactaattattacctgtaactgtaagtttcaattttaggcattttatattaattatattaaaataaaaataataacaaatagaaaaatgtatagagaagaaaatatcttaaattacctttgaaatatatattttcctttaaatggactttctatataaaaaataaatcacattacatatatgatacaattttccccctaaatgtctggttttatgccccccaaaaggtaaaatatctatatgggctgtctataaagataaatgattatcactttaccatcaatcacatgccaacacgtaagggtgaaagtaataccatatcctgaaaataaaaattgaaaatagtccagcaaagcaataagaaacacattttatctagtatataaacaatcgtcctcatgctaacaaagcaaaacacatataacaaaaacaatagatatgaagagaaag

SEQ ID NO: 8103 - DNA, 3000 bp, Unknown; identical to SEQ ID NO: 8093
  misc_feature (1)..( 3000): cDNA_ID_2107797_gDNA_ID_1621193_Annot_ID_174626 3000 nt of promoter + ATG

SEQ ID NO: 8104 - DNA, 3000 bp, Unknown; identical to SEQ ID NO: 8092
  misc_feature (1)..( 3000): cDNA_ID_2140070_gDNA_ID_1621193_Annot_ID_174625 3000 nt of promoter + ATG

SEQ ID NO: 8105 - DNA, 2393 bp, Unknown; identical to SEQ ID NO: 8091
  misc_feature (1)..( 2393): cDNA_ID_2140236_gDNA_ID_1621193_Annot_ID_174622 3000 nt of promoter + ATG

SEQ ID NO: 8106 - DNA, 3000 bp, Unknown
  misc_feature (1)..( 3000): cDNA_ID_2105522_gDNA_ID_1621193_Annot_ID_174646 3000 nt of promoter + ATG
tatataattaagaaataaaattgacaagcaaatatgtgtgtcagtattatattgtgcattggaagattttcacacttatttggcatattatatctgcaggcgaaactggaacgtgtccgagtatatatatgtcaaatatatgaaaatatatatatatatatatatatatatatatatgtcacatgttactttgtgattacatgtttcgttatacttgaaatacatgatgaattatagtctgagtagggtgggtgatttacttaaagatttcataagaatgttttacttgagtcaatatcccaaatatattaacgttttcgtttgtggtgtgttataatcaaatagaaataaaactccataatgccgaggcttgacccgaattctgtatttcatagaatatttcttcagttaactaaattagtaaataatttttaaaaaaaactaaattatactattattatttatttctaataattttcttcactaattaacttattcatagacttacttttctactataaaacataagatttgtagagttatacttttgacatacatggtgcaactttcttaaacatttatattttgaatacggaggatctcacacaaaactccgattaatacttggactctatagaagaaacaagtttttattctattttacccacatggtcctcgactaatgacctatataaactagatttctataaatatcatgatggtacttagatccttgagatccctccctcgaggttgcaaaatagctaaaagttcacaaaatttattgtgaacatgttcgaaatttttttgattctaaggaagcttctttgtgtttatacactcaaaacttttgattttttttttctttcttcctgattaaaagacaaaacgcaaagagaacaaaaaaaaaacttgttatttgttaactagatttaggatcattttggaacaaaaaaaattagaaagcaaaggtttatttattggttacctgaaagacaaacaagggttgatcatctttgggcaaactctgaagctgacttgtaaccaattgagcaaaagctggatttggataaaccaaatctccaagttcctccaacgtgtagtcactcgccgccgtcacaaagccagctccagcaccgttacagtcaacatcaagccgtccagagctaggatccacgcggagtctcccggccaagaactcataagcgtccatgagtttcaccaacgcctttctcagcttctccgagaccatctccggtggaaactccttgttaggtcggaagaaatgaactgtttgaacgtcaaagttgagaatttggtcgacgttggataagaacatggattttctctcgctggtttcttcagatgggaaaatgagtgttgattctttgatcgtaaccttaagatcttcaagaagcaacggtggagattcttggtacgaagaacccattttgcaacccttctctctctctctttctctctaagttaattaggttttgagtgaagtttgtgatttgggtttcagacttaatctatattatatagactaacacgtagtaaaaggcgtttttaattttatcttggctttatgataatgtacgtgtacattatagtatgaaataatccatggagagtaaattattgatcccataataaatgtgactttttaataaaaaaagatatggtacggatcgttacaagaacaaacaaagcagtttcgtgctacgtagacgtcgtttttatccagtcacatgaaaacgttattctttaaaagctaaaattgtcactgttgtattattgtgttgtgtttatagatttgggaagaatgatgggctgcattggtgggtgtgagtagggttggtgatttatgttttttaaaatttgataggagaactttgatatgtcggtgtagctacataatatgcatgtgatatatcaacctttttgttgtgatatttgccaaactttgacttctccatttgtggtttatggaataatacgatttttacccatttgcagtatctcattacggttacaaacttacaatctacaattagtctagtttctaacctttttcttgccatattaaaaggcatgaactcaaaatatggccgaatccaagcccggcccgttcataaaaaagccgaaacatttgttttaggccacctaatataaaaagtttttagggcctcatgtgtaaaatttgtcctacaatataatttgtctagtgttatatttatttttatatatgtccaaatgtttatattattatcaacttgttatttaattttaaatatatcaattataagatttaaaactttttcacagtttaaaattttatatttttgataaaattaaattgtttaactaaaaattaaattaatctatagacaaacttttaaatttgaatccgatttagatttattttaattttatttatcatataaatttaaataattgtttaaacattttagccgatgtaacgtttttttattaattattaatgtatgtctattttcttatatttcgaattatcgaattaaatattctccactctaattataagataagttgaataaactttgttttgtttttagtctcgacttttttttctttacatttcttcaaaaagtataataatttttaaaaacattattaaaaaaaaaatatttctaaaacgcagagaaaaaattgaggcaaatctgtcagtataaacttgtaatttcatcgtctccgtcttcttcttcgtttatcagttcttcgtcgcctttcgcttatgaaaaattcacactggtaaagcttcttcctttaccaaacccatttctcttctctagctccttctgggttctcttttcgaagaaccctagtaatcgcgagaaccttcttccccctttctcttcgcaaaatcagaaatcataatcacaatctcttcgtttttttttgcagtttgcagggctaatttctgcgttatcgtacttctaatttgttgagataaacatg

SEQ ID NO: 8107 - DNA, 496 bp, Unknown
  misc_feature (1)..( 496): cDNA_ID_3047627_gDNA_ID_1621193_Annot_ID_174621 3000 nt of promoter + ATG
aagcttgtagaagctcccaaagaatttgaaagctatggacaacttcttaaaaaatccattagtttttagtgaaaatctttacaaggaagtgatatacggtttcttgtataaataagctctaaaaaactaagaaaaaaaaaagaatttaaccaaaaataaaaaagacagaacatatttttgtaacttggaaaaggtagcaacggatgatctagtcccagccgataggtgtgaatttttgatgaccattcactaaacaagtaacaaacgttaaaattttaaaatatgatgacatcagcagacccaaatttcctaaaagtccttgcaactctaataaattcctattttctgattttcgttgaagaacgtaatgttgaaaattcaacaagaattgagtacattgtactcgtttgcaactcattgtgtgaggtctcgaatcctttgctcattttgatttcaaataaagctttctttcccttaattcttagattttgagatg

SEQ ID NO: 8108 - DNA, 3000 bp, Unknown
  misc_feature (1)..( 3000): cDNA_ID_1810384_gDNA_ID_1621193_Annot_ID_57520 3000 nt of promoter + ATG
ttttggccacctaaagtttcaagcaaaacaacaaaaatgatcttttagaataattattataataataacgacgattaatgaactctatatatctcacaaaagaaggacatgtttgcaatcccaaccaagaagataaacaccttagcaaattcaaagaagaatatatcaaacatcttttgtttctaagaaataagctctctgattatgtcgggagcatcttctgtttcttctatttgttcctctaatgtatcattgatccctacgggacctcaagtgttcatcaatttccgggggaaagatttacgaaaaggcttcatgagctttcttaagcctgctttgaaaaaagaaaagatcaacgtgtttattgacgaacaagaggagaggggcaaatacctaatcagtctttttgatacgataggtgagtcgaaaatcgctttggttatcttttctgaaggatactgcgagtcacattggtgtatggacgagctggtgaaaatcaaggaatacatggatcaaaacagactcataatcattccaatattctacaggcttgatctcgatgtggtaaaagatcttacaggaaaatttggcgataatttttgggatttggtagataaatatcaacctgaaccaaaaaagctccataaatggacggaagctttgttctctgtttgcgaattgttttccttgatcttaccaaaacacaggtttttatttttccacttttatatgttcttattacttgataaattaagtgttatctgtttaactgtaacaatttctgttcactcattgacattttactctcttttctttgtatcatagtgacatttcggatagagattttgtaaagtcaatcgtcaaggctgttaaaaaagtgcagaagaatttcttccaacgaagaaatggagaaatagaatatcaagatttctcagtccctgcatgtaaactcactatcactatgcacgagtcaccaaagtaagtagtgcctctcttacgatttcatttaggaaaattaatgatattctgatgaaacatacattgcttcagtggtatgtcatgtgaaagtattgatcgaatagctaagttaaatcattttagctactagtatttccacaaagtaataaataaaaaaatgctaaaagcttgtgtagtagattgttaagttttacttttattatatttttagtacatctctatcatattttaacttgtataaaatgtctactatattttccttcatcatttgctttctaatttattattggaaaaagttcaacattttcttcttaaggatagattagaaactgtgacattaatttgcatgaaaagattagatcccctaggtctcgtttcctgataactttttttttttcatttcgatgtttctatttatgtacagtgaggaagccgttcaagttacggtgctaaatgaattttaccagatgaagaatcagtcaccagtgccctcatacgaggtcctaatttacatttgctgtcttgttagttgattttctttatatatgtttattggtatcatttcatgaactgacatggagatttatatatcgacagttcaaattttgggtcgaccttacgagaccaaagggtaacgttttcatgattgacgcaagagatctttccattgcatggtcagaggactccaaccattggacctggctccctctcccaaaccaaaattcaaagtaaaacttctcttaaaagtatttcttatataaattgaaagaaatatcttaaatcacgaaaatatataccttataacgataatatttctagatttattgtctaatactaagcacaatactttccagtgaatcagtgatggaaattgcatttttgaaaagtgctagctggctagacgtagctggaaagtttgacactcgatatttgaccccgaggacaaggtacgaggtggtgttcgtagtgaagttagaatacacattcgaatgggagacactagtgaagctaaagctagacttgccgaatacttgggagaaaccgcaagaacagagtgtggacatgtttgactacataagtgaccaatggctcgatattccagttggagagttcaccacatcgaagaaaaacgtcggggaaatctcttttgcaatgtacgaacacgagtgccaactgtggaagtcaggcctcttcgtcaaaggtgttacaattcgtcccaaatactaagtcattttataagcatgtatgttgttggtctgagatatatatagtggaaatgctcgctttgaaccataatcttagtttcacctcccaaatgtttgttacaatgttacttgtgtagatagtttgaccggtttcaaaacttatactctatttactctcttctgcattggttatcacatccataaccaccaaactattgaattctataactgaccaaacccaaaccgaatttttagaatatccgaacagttcccgactctctatcctattagacccgaaaccgaaaaaaaagaactgattgggacgagtatccgaatgcccaaacctaccaaagttgtaggcctagagataatcctatcgaaaaatgaccaacaacattttgcaaaatttgatattcaaccgattttaattaaagtccacaatagtcatccataaaaaatattgtttacaatgataaggtgcggttcgatactaactctattttggtattcggatgattgatcaacaacattttgcaaacattgaaaagaaaacgtaaatttcgtttcctaaaaaaaaaaaaaattcgtttcctcacaatataataaataatttacaaagaaaaaaacgaaaaatggcaatgtgactcactcaatcggtgactcgctatagtctgtgaagaaaggccaatttcgccataaagttcacacctttgatctcctttgtttctgggtttctcctaaatcatccaaattggtatcgaatttgcccttctccgattcaatttcttcacgatctcaaaacccagaagaaagaatc

SEQ ID NO: 8109 - DNA, 3000 bp, Unknown; identical to SEQ ID NO: 8098
  misc_feature (1)..( 3000): cDNA_ID_1810380_gDNA_ID_1621193_Annot_ID_57522 3000 nt of promoter + ATG

SEQ ID NO: 8110 - DNA, 3000 bp, Unknown; identical to SEQ ID NO: 8106
  misc_feature (1)..( 3000): cDNA_ID_1810376_gDNA_ID_1621193_Annot_ID_57523 3000 nt of promoter + ATG

SEQ ID NO: 8111 - DNA, 3000 bp, Unknown
  misc_feature (1)..( 3000): cDNA_ID_1810372_gDNA_ID_1621193_Annot_ID_57524 3000 nt of promoter + ATG
taccatcaacatcaacatcatcaaacagcctgtctttgatcttatcctcagcacttctcctagttccacctctactatcaaactcatcatcggatgattctccctggccatttccctgttccctttgagctttcttcaaccgcttatactgcctctgtcatggttcaagaaaaaagtcaaatgtattagtactgcacatatatttttagtgtatctacaaaatcctgatgtattgttatatacacaaatatgactaacctttttgaatttgacgttgttatcttgtagaagcaaataatcatcttcatcaagaccttcgtccctattaaaattatcataaatggaaggttagtcagaaagagaacagacctgctatagttcgtctaatggtaacttacatactcatcacaaacaatgtatgaaaatcacaaataaagactgctgagaattaagggaacatttcttcaaaagtatcatgcatgtcaacactaacatttagtttttcatatgttagaaaaggataaaatctaagagaatgagtaaggatataaaatattcactttttctttcgtttcttcttctttttctgcctctcctcatcgctatctttcctttcttcgtcttcttcctcttcttcctcttcgtcttcatcattcactatgaacccatcattctcatactcattcccaactacaaaacagatatacggatcccacatcatggaacaaaaatagcctgaatctaagttaaaaagcctagaaagaaaaagaaaaaaaaatactcaaacccaaggtgagagaaatgtgtgcagctcaaaacttgcagaaaccatgaagtctaaaaaggaacaaatcaagcaaccgtatgaaacagagaatatagaaacaagaagtggtagaaggagagactttgcagcagataagtaaacatctaagaaacaagatgcattcactttttttttttttttggttgccaaatccagacactgcatcttctaatggagcaaatgcagcagaatttctccaaatgaatcgattttaagacaaagaactgcatgcgcttcagtactaaaccaaaccataccactaatttccttcgatgcaatcagactctacagcttccagatttagggtggtaagcaaaaagaaacgaaagacgacacatttctcactgggagaagtcaaaatcaaggaaaaaacttataccgtcatcatcatcttcttcatcatcgttttcatcatgctcagctggatctccatgaactggctctccgtcgtcatcctcaagctcatgatcctctacgcaaaagagaaaaggattcaattttttcatacaaatcagaagaaataaacaaaaccctagtattattacggcgtttcacacagaaaaaaattagggtttgcgacgaagcgattaaggtaccttcatcgtcagagattgcgttcctcgccatgtttatctcaacaaattagaagtacgataacgcagaaattagccctgcaaactgcaaaaaaaaacgaagagattgtgattatgatttctgattttgcgaagagaaagggggaagaaggttctcgcgattactagggttcttcgaaaagagaacccagaaggagctagagaagagaaatgggtttggtaaaggaagaagctttaccagtgtgaatttttcataagcgaaaggcgacgaagaactgataaacgaagaagaagacggagacgatgaaattacaagtttatactgacagatttgcctcaattttttctctgcgttttagaaatattttttttttaataatgtttttaaaaattattatactttttgaagaaatgtaaagaaaaaaaagtcgagactaaaaacaaaacaaagtttattcaacttatcttataattagagtggagaatatttaattcgataattcgaaatataagaaaatagacatacattaataattaataaaaaaacgttacatcggctaaaatgtttaaacaattatttaaatttatatgataaataaaattaaaataaatctaaatcggattcaaatttaaaagtttgtctatagattaatttaatttttagttaaacaatttaattttatcaaaaatataaaattttaaactgtgaaaaagttttaaatcttataattgatatatttaaaattaaataacaagttgataataatataaacatttggacatatataaaaataaatataacactagacaaattatattgtaggacaaattttacacatgaggccctaaaaactttttatattaggtggcctaaaacaaatgtttcggcttttttatgaacgggccgggcttggattcggccatattttgagttcatgccttttaatatggcaagaaaaaggttagaaactagactaattgtagattgtaagtttgtaaccgtaatgagatactgcaaatgggtaaaaatcgtattattccataaaccacaaatggagaagtcaaagtttggcaaatatcacaacaaaaaggttgatatatcacatgcatattatgtagctacaccgacatatcaaagttctcctatcaaattttaaaaaacataaatcaccaaccctactcacacccaccaatgcagcccatcattcttcccaaatctataaacacaacacaataatacaacagtgacaattttagcttttaaagaataacgttttcatgtgactggataaaaacgacgtctacgtagcacgaaactgctttgtttgttcttgtaacgatccgtaccatatctttttttattaaaaagtcacatttattatgggatcaataatttactctccatggattatttcatactataatgtacacgtacattatcataaagccaagataaaattaaaaacgccttttactacgtgttagtctatataatatagattaagtctgaaacccaaatcacaaacttcactcaaaacctaattaacttagagagaaagagagagagagaagggttgcaaa

SEQ ID NO: 8112 - DNA, 450 bp, Unknown
  misc_feature (1)..( 450): cDNA_ID_1810491_gDNA_ID_1621194_Annot_ID_57526 3000 nt of promoter + ATG
aagctttaagatcattgattttgattttacattctaaaatgacggaatcgttgtatcggctgcttatttagggttttgggttttttgtgctgttggtagcttttaattgagtgtatttggtatttttggattagttgaaaaatggttgggttagtttgaatccaattctcgctgagaattttatgctcacgatcattcacataagagattccgctatctgaagaaatcgaagcatgtgaaattttcccttttcctttcgatgtctgcgtttcgctgcgttgtcatcttttgttcttgccatgggacttaaaactaatatccttatacttttcattgcagcttaatgtttaacggcatcaccagcatcttgaaggagtactagttttggttagattcgtcatacatgtgtttgaattagagtaatttgaagggctgttttgttttgtgatg

SEQ ID NO: 8113 - DNA, 3000 bp, Unknown
  misc_feature (1)..( 3000): cDNA_ID_3047687_gDNA_ID_1621194_Annot_ID_57528 3000 nt of promoter + ATG
agcatggcagattctcttataaaccataaaattagtatccccggcagaagtgcaatgaaaactttcatgaagtagtggatctgcctcttctgaagaagatccacctcaactccggcgttgcaaatagtctcaaacaagtaaggatctaagggaatgtcaacctagaaataaaaaggatatgacatggtgaatgtacatcattcatttccaaatacttgcaactataatttttttacttacaatatattctagagggaaaccttctttcatggtcacatacaatctctttaggtcttccgtgaaaacaacagctgcaacctgttatgaacacatacacagattatcgtgccaacataagctaaaaaaaagatctatcatcctatcacgtccagcttcaaattaattgctttggaaaaggaatatattcatcatattttaactcataatgaatataccatcacttgttatcatttaaaaaattcaactggatataatgacacttgccactcacaatcccaaagccggacaagagtataggttagagctgtacctcagaagaatcaagcttctgaaggaagtaggtatagggaagcttagggcgatatcgccaccatctctttgatatccagagagctctagttccctcagtttcagatgtccttccaataacatcttcgcgaagacttttctctacctctttcatatcaaattcaaccacatacttcgccgctgaggagtttaactgttctgataatttttctcgttctaacatttccttccaggttgcaagcctttcccgccaattacctacactgtctccaatttcacctatcatagaagaatgcaatagaggattagatggtcaaaagcacaggttaccaatgatagtagatgagggatctagaagtgctgctctgaaagaaacttgattagtgagataagattaggtcgtcaaaaacaaaggtttcgcacaataaatcacttcttgttatatcttcagcatgccactactaaacaagtatcacctaacgaatgtatactgaccagagacacccagatcttggcttagtttcttctttgcctctgtctgaatcctagcatttctaccaattattttcttgagagatccctctgtggtctctagatcgtcatcccacgcattttctccaacataagaactatcgtggacaagtgttccatcaggcgcttcaatgaacctttttaatttcaagcctttaggtgttgctttcctccacatatttctcttgaacctgaaacactagaataagtcaggacattctacaaaatcaaataaacagaagttcttttagtcttcccactcttgacgctttagatgcctcattagctgagtatttacttgttaaaggatgataccatagtttgaatatgaaccatattttaccatgtcccagtagagaaaattacaatcggaaactgaggattaggaagcacctacttttctatatttccaggagatggctcggggatcaaagcctccataaaagactctgttaactctcttctctctcgttctacccgaggagcttggatggcaacataaactctttgacaagaaagtaacagcgcaaaagcatatatgaacaaggcagcaactcgtttaccgtcccaattcctgatgtcctgatacaatacatcttccctcattaagaaacaacctaatacactagtatatgtcgctagaataagcgtagttgtagtctcctccaaaatttatgcttccgttaaatcaacaacaaaataaataaataccatacgtttgtccctcaatgttttagaacacaagcagaagtctaacaatacttgagaatcagaaatttgataattacgttaaaaagctgaaccagcttaccttccaatgctcccacttgttccaatcaataaacgaaggcactgtctcattcttaaagcgagtcagctcgtgatggcccttgtgcacactatccttaactcgagccacatactcattcactctcccacttgcttcttccgagtcaaacccaatttctgtcttcacagattctccaatcttctccccaatccgctcggcaccaaggcgaatagactgagccaatctcacccacgaaaagcctccatcgctattagatgaagacccactactactttcagacgcatagactcgaaagagctgttttttccgggtagctcccagtccatacttggcgggaaaccgaacaagaccaaaactttttgatcttttcaacaactgagtcgatgaagagataagcggattcggtttatacgaaattgcaatctccatgaatgaaatcacaagaaaaaaattaaaaagagaacaaaaccagacgcatttgaagatttttcccgattaaagagctctctctgagaaaattactgaaggaaaatggtgagtaccaaccattcagctcactcgactctccggcaagacttacgcttctctccggtaaggaggtttatctacactgatccgtcgttgagagtgtcctaatacttcgaaggagaaagatgacgcttaaactcaaagaggctcgaagcctattagttatataattgggctagcccattaaggtccatcagcccactatccgaaaaataatatatttaaaccgtggaatccaaggagagacacagtggcaaaaagggtaattatagggacatttcttggggtgttgtccaagctgcttttatataaggaagggatattgttctctcgcttctcgaaagatccattcaccaactctttataccagcctctgtaacgttcgatcatcttgtatttcatttcaaccactcatgtaagtatattctttcttcagattccgattgttttcttcgattaagttttgagctagattctctagatctgtttcaccgatttggttgatttctccgtcaatctgaactcgcggtgtgcatcttgttgtttgcagtgtttttagtttgttttacgaagaatcaact

SEQ ID NO: 8114 - DNA, 3000 bp, Unknown
  misc_feature (1)..( 3000): cDNA_ID_1838761_gDNA_ID_1621194_Annot_ID_57530 3000 nt of promoter + ATG
aatctatacacgtttggtatcttgatggatggattgtataagaaagggagaacgagtgatgcacagaagatgttcgacgatatgaccggtagaggaatttcgcctaacagagttacctataccattctcatttcaggtttgtgtcagaggggaagtgctgacgatgcacgaaagctattctacgagatgcaaacgagcggtaactatcctgattccgtcgcacacaatgctttgcttgatgggttttgtaaattgggtcggatggttgaagcatttgagctgttgcggctttttgagaaagatggttttgtgcttggtcttcgaggttatagcagtttaatcgatggattgttcagagctaggagatacactcaggcatttgagctgtatgcaaatatgctgaagaagaatattaaacctgacatcattttgtacacgatattgattcaagggttatctaaagccggtaagattgaggatgcattgaagctgttaagcagcatgccaagtaagggcattagcccagatacctactgttacaatgctgttataaaggctctatgtgggaggggacttttggaagagggtcggtccctccaactcgaaatgtcagaaacggaatccttccctgatgcgtgcacacacacaattcttatctgtagtatgtgcaggaatgggctggttagggaagctgaagaaatttttacggagattgagaagagtggttgttctccttcggttgctacgttcaatgctttaattgatggactgtgcaagtccggtgagctcaaggaagccaggttattgttgcataaaatggaggtcgggagacctgcttccttgtttcttaggctttcgcacagtggaaaccggagttttgacaccatggttgaatccggttcgattctcaaggcatacagggatcttgcacattttgctgataccgggagttcgccagacattgtttcttacaatgttcttataaatgggttctgcagagcaggagacattgacggtgctctcaagcttctcaatgtgcttcaactaaagggattatcccctgatagcgtcacttacaacactctcatcaatggacttcatagagtcggcagagaagaagaagcttttaaactcttttacgctaaagatgattttagacacagtcccgcggtttacagatcgctcatgacatggtcatgtcggaaaagaaaagtcttggtggcttttaatctatggatgaaataccttaagaagatatcttgtctggatgatgaaacagctaatgagattgaacaatgtttcaaggaaggggaaaccgagagagctttaagacgacttattgaattagataccagaaaagacgagttaactttagggccttacacgatatggcttatcgggttatgccaatcagggagatttcacgaggccttgatggtgttttcggttttaagggagaagaagatccttgtaacacctccgagctgtgtcaaactgattcatggactctgcaaaagagaacaacttgatgctgcaatagaggtgttcttatacactctagataacaacttcaagctgatgcctagagtttgcaactacctcctaagctccctcctggaatcaacagaaaagatggagattgtttcgcaacttacaaacagaatggaacgtgcagggtacaatgttgactcgatgcttcgattcgagattttgaaatatcatagacatagaaagcaggtgctgatagatctttaggtaatgaaatgattattaaaggtttatctacatccggattcataggcattagttttgtggagaagagaaatatgagttttgattcgaatctctttaccttaacactacattagaatagaaaaatctctggaaccggaagctctttgaggaaaaggaaaaggaaaaatatgaggtttatacgtaaatgctttgtatgctttattgttcatgaagtttttccttatctttattgtacactgatttgttttgtattatgatgttaaatttctttgaaataaagactaaacatgtctaaatctttctggtttccttccaagacctgttccaacatttttgaccctcccataaattatgtacacagcttgtttgtaagataagggagcttcctgaatccttttggttagacaaagagacatgaatcaatcataaatacctcttgattcttcgttgtggacttggcttatcagatattgttcgaatcacaagatttggccaaagtttcctgaagttgacatcaacaaaaagcatctgctgatttcaggctggaaagggccttttaaaaaaaatccccgggccatatgaccatatctgtctgacgtggcatcaccaagggctttcctaattcagtatctcagtgccaaaacgacaaaagatcacagtgaggccgactaatcatgggcctgaccgttgatccacgtgtctttgtattccacgtccaaatctcaacccttcctttacatatgccatgtcatcatctttttcaccatttttttgtgagttttatgtgtgagttttttttttgctgtcattaatttagaaacaataatctcgttgtatcagtatctctatttaatatgcaaaaatcagtcattagttttattttaataccgttgaaaaaatgcaataattcataggtgtgccgcagcagattttaacccatcaattttataggaacagagtgtgtcgtctctctacaacagtcgtaggcacattaatactataattgccttaaaaactccgttgagtagacaaaaagagtgcaattccaaagcatttcttattcttatagattttaaaaataggaaaaaggtgtaaatctgcgaacattttggattcttcacgtttgtttatattttgggttggctctacacctactctcagaagtcataagccaagcaaagggggttttagggtttttgaccgcgagccagatctctttcttttgtttctcccacttccgaatca

SEQ ID NO: 8115 - DNA, 1404 bp, Unknown
  misc_feature (1)..( 1404): cDNA_ID_1810443_gDNA_ID_1621194_Annot_ID_174681 3000 nt of promoter + ATG
aatctaaactacgtcaaagcttgttgcagagagaccctgagacttcaccctaccaatcctttccttgtccctcacatggcacgtcatgacacaactctcgctggctatttcatcccaaaaggtatctcatttttccccaaaatttatgcatttaggcgtatttgactccaactccttaaatgtagaatcaggaattctaactatatttatttttgcttgatttgagcaatattttcatattagaatatttgttcctttgatttattattttggactgaaaagtgaaaataagtagattgtgacatacgaatctttcaaattattattttatttgtttattaactttaatatattgattgtttgatgtggatcacaggcagtcatattctagtgagtcgtccgggtgttggtcgaaaccctaagacatgggatgagccactcatctacaggcctgagcgccatataaccggcaacgaagtggtgttgactgaaccagacttacgacttgtttcatttggaactggtagacgcggctgcgttggagctaagcttggaacgtccatgattgttacgttgttgggtaggcttctccaagggttcgactggaccattcctcctggtacgacggacagagtcgagctagtcgagtcaaaagaaaatctgttcatggctaatcctttgatggcttgtgtgaagcccagattagatccaaacatgtacccgaaactctggaccggtccagcttgatcataccggttaacggcaccacatttcaattgctattgtcatgtatgagtaaaatttgaataaagtttttgtcttgaggaaaagttgaagaggaatatagcccataacgttcataaaaggcccagcccagtattgttctgccgttttaatttgagcaaagtaagcttcaagtaaagaaacgggttgagtgcaaaaatggagaaattaacttgcaagttgagattagcacataagaagagtatctaattccatcttgttcacaaagtcattcttttagcattaatgatcctatatttatatcaaatctcataagatcttcagtgtataatatatagtttaatttttttctaggttttcgttcgaactcatgtgggttcagtaaataaatgtttaagtccccatctggccgcgtcaaaaatacttagataacaacaattagtggttgacatagaaaagtaatgattgttgccgcgtagaatgaaattaataaaattataaagaacagtgaagcaataaatgtttccttggcgtcttgaagagtagtcttcttaaatattccagcccaaaaaaaaaaagattctatccattatcaagagaagaaaaaaaatctgaattccaattcgaagaagaagaagaagaagaaaggagatgactatg

SEQ ID NO: 8116 - DNA, 3000 bp, Unknown
  misc_feature (1)..( 3000): cDNA_ID_1810451_gDNA_ID_1621194_Annot_ID_174677 3000 nt of promoter + ATG
tcataacaagtgtgactcttcgaaaagcccattttataatgaacaagtctttgattgagtagcttgaagtttgctctagtgtttcttttggacgtaacctcgaagatacggattccaagtaacctctatttgcaggtgaaatccgtttgagcacttcaatggcttctttgttcttcccttccaaatggagccaacgcggtgactctagggcaaagaaatagatgaaaatactgtggattcctgcaggaatggatgtgcatagatagagaactttccaagaagcgtgtcggacaaggtaagcgattccagacaacgacatgaaccctaacacaaacagagtaaacggaaccatagtagctcgcggtctccatttggtggaaattcgctcacttatcagaactaacgcgtatgtcccggtctgagaacgcgcgaatccgatcacaaactttaagaaggagtagatccatatgttggaggataagaaaatagagattccagtgagtgacattgcgaaactcgagaaaaaaagaagttgcttccgtcccaaggaaccgtcagggatcatagccaaaacgactccaccaacgatagaacccacataaaaagttgaactaggtagacttctgaggaaggagctggagcactcgagatcgaactctgaaatgactgatttacctttgaaaccaccgtcccaatcccaagctgaccggggaatcttacagatatcggtagttgccggattgcagatcgtgtggtcaagacagtgccacgtgggatatgcatctgtgaagacggtgatgaatatctgctgagagtcaaaggttagcgcgagcccaacgagaactatctgtaagaactgcgagaatccgaaatcagacaagcttttctcgaggatcttgtcgaaagtcagaggtgaagaagtgtcttcatcttcttcaatgtgggtgggcaacaatggtgccaacgaatccgccatggttgcttactttgatcgatcttgttgagaatgtgagaattattacatcaaaattaaaaacaaacaactagtacttttgaaaatatataatgtgtggtcaagagatctgatctttgatgatcaatgagaaattgtttttttcttgtttgtttttgtctttttgaacaaactgtttaagatttgtatctgtgcgggcctttttgtgttaaactatgaccaataataattgaagcacaatataaatacatagttgctgatgtaagtacatgcgacatatcaacatggacacttctgcttataaattcatactgggccgttaagtaaagcccattttaattggttactcaaattgagaagtctaccgctcacgtgtggcccacgataagtacgttatgcttccacatgttgcagagaattgtgaaacttgaccactcaactcttaacatctcgccgataattttttgtttttgttttttttgtttttgtcataattcgccaagaaattatgttatatataatataacgaataaagaaaggggactatcaaattgaatagtaaaataaattattataagcttggcttataagattatctatgttcatctaccgccaccattctcactggtgacttgccaccttgtgttgaatatgcatatattatatatacatattgttcaaatgtttattattcatttgatatgcattagggttatgttgttagtattatgttttaggtattaactaatcactatttcaatattttcaaataatcttatttatgtatgcataatttttttatccacatttatatgagattataggaaaattagtgctcaatgttttggtttctatgaggaatttaagtgagttcgaatcccaagacatccggagaataaaaggtgaaaaagaacaacaaaaataaaagataaaaattgtatttgatatagtatcttttaaatgggccctttataaaaagacacaacatctcttatttgacaaaaagaaaactacaaacagtattaaaaattcattaatccacagtaatatatatcactgggtgtagtgtcattttccaagaaagatcatacctagagatcgtaattacaattaaattaaaatgattagcctagatatcctcgaaagacaagacaaagatcatatgctaatcgagctaatatgatattcaaatttaaaggaccaaaaaagtgtgtgatcgaagactcaaaaggagagcccatagtgtacaaaaagaaactgcacggatcggatctattcacatgactcggattttattccatgttattagtcgctgttccacatttcctttccacgtatgactaattatagatacattgtctcttcaagatagatagataacatatttgcagaaaacaagttgggaaacacacacatttgtaacataactcttgattttccatacgacaaaataaaaccatataatacagttaaatgacaagacaaattcatataaaacttacataattttgtcacatatatagctgaatgctgaatatacaaaaatcaatatcacgcagaatacttacacggtttaccaattatataaaacatagtctattactattagacgcagattatataacatacaacaagtagccatacgtagtttcaagaattaattaaatttttaaagaaaccttaaaaccccaaataagttattttttattgtcaatattcgaactaattactataagcttcttcccatgaatttaaaattataatgttaaacttctgggaccgctagactgataaaatgtcccttttgtctctctctacacacatatacatctctatacatatatataaatacgccaataatcgctatccattacaaaaaccattgtgttagatattcaaacaaaaaaaaagaacgtcacaaacatcagactgatcaccatcactctttgattagaatgagcaactcaaagtcatactggagaaagcaaagatggggaacgccgccacaagccctaacaccgttaatg

SEQ ID NO: 8117 - DNA, 3000 bp, Unknown
  misc_feature (1)..( 3000): cDNA_ID_1810455_gDNA_ID_1621194_Annot_ID_174676 3000 nt of promoter + ATG
tgtgacaatgttttggaggattatgacttattaacagtcgatcgatttatcgaatttagtgttatatattaaaatattaattattcaaaaaaattggatcagttatgtttcaaaatagcgttagattacatggctctatgccaaagttgggattttatttttgtttgtagtttttttaagtggggaaaagataagaaggttagaaggaatatattcatttcggagaagaaatcccaaagcaccatcacaaaaagatgcttgaagttcaagcaactgtggcctctatttttttataagccgacttactttattgtcactaatttcatttctttctttctttaagctcttagtttgcttcaacaacaattagctaaaagttaaacattagctttacttggtttaactaaaaacaaaaactttggtttctttttttcaaagcaaaatacaatttagcttaaaatcattattgaaaacattaataaagaaagatgagaacttaaatgattttagggcggatgatttgctaatgctaatatgcatcatatcactatgaatcaattttgtagataatagtgatgatgattgtgaaaacacaaatatcgtgataatataagtaggaataatatatgtgtgtatctatactcaaaaagtggtaagaaaaaataaaaagtctagtaaactatgtaaatgtggctggccaagtttatacggttggcatctatcgcgggagttgtattttcattttttaatattgttggcgcaataagaatctatctttattcatcaaagaggagaagaatcgattccaattctcatgcaatttgaactttgatttaatatttaaattcaaaagttataaccattttcttattttatcttggtcagaattgtgtgcggtaattgattaatttaatttattgtacaaataattcgtttcacagccaagatttttaacatttctggcaaagaaaaacactgtttttttatttattccaagaaattaatatctgaaaaatgtgttaccatgtatagctgcacaatcgtcagtcctacaaaagccaaaaaaggttatagccccagcaagctttaaccaataaattaaaatggagaaaagaagaaaaacatatggtaaaaataaaaagaataaaagagctttaataagtagaagaagaggtccccaacgttaactctatctttacacattgatgcataattctccacatattaatagtccgtgtttataatatgtataactttaaaaaattgttccatattcttatgttaatttttttgttttaattcaatattcattgactggtattggtctacattttaacatgtacatgctttcccttaattaatacttaatatataacctctaataaatttctgattcaattcaaattttattcttagataatattctctcttttttgtgtgtgcatatcagcctcagccatattcattgacttattcttgttctatgtaaatatgctatgggacctcccactcatatatatttaggttgaccatttattttacatgcatgcaattgaatttaggggttaatctaaatcgttgcgtatatgaattatatatgattttagtttgtatattgaaaaatgcatcgtcgttctatacataagctagtttagtagctaatagggcaatattaacaaagttgattttctggtttgtagtgtccatacaagtaatttagttaattatctcgtttgttcacctttttgtttcttttttcttttgctagctagttaattgcggatgtaaactacatcttttactaatcgatgaatggaaaacgtttttgtcgtagacaaatattccaccgtacctaacggttttggattgcatgtatataataaatttgttccaaaaatatacggtctattaatttataacgaagctcatcattgcttagaattgtatattcacctcataattagccaaaaaggtttaccctaccataaatgataaaatccctagccttgtggaatttgtttcgttaagatatttgtatgtatgcctccaattacgatatatgacgatgtagacaaactataagtctagtatacgactctcctcgtgcggtcttaattgaatagaatacatagaactttaatatattcactttaaaagtttatattttcctataaagaaaatatttacaaatctttgattactatttactccaaatcaagcatgattaagaaaatagtatatagaacaattgtatgataaatttggatttaaaaattacttctaaattataaggtagtaaagaaaaagaaaccaaaaatataagaataatagatgtgcaatatctttgattcaggtgaattatattttaacttagatatctcaagtcattttaatgtttatatcaggaaataaagaaataaaaaccatcatgcaacaaatcatgcatatatattagatacatccgtaaccgctttttttcgtcttttttttttgtttttttcgtcgtcacatccataaccgttttgatatgagatctccgatgttcaaaattcaatttcccccaaagatatcaatttaatatctaatatatactattattttaagtttgcgcagtaatttaataatctgagacagacatgatttacttaatgtatacgtatagtggcttttacacacattttatattgaaagaaattcaaaggtattcaagctaagaggataaaaaacacaaatgaaaaagatagcgacagtatcttttcacaaaggaacgtctgtgtactagtctgaaactttagttctcttccttactaacgataaaacatatttaactaaaccataatttatttacaaacaaaacaaaaaagacgagagagagaaaaaaaagccgtcatctgatctcttcaaaaacgcatcgtattctctcacatttttgcatcacattcgtttcttgaatcccctctttcagagagagaaagagagtcagagagagagagagagaga

SEQ ID NO: 8118 - DNA, 3000 bp, Unknown
  misc_feature (1)..( 3000): cDNA_ID_3047667_gDNA_ID_1621194_Annot_ID_174674 3000 nt of promoter + ATG
caaaatcaggaaataacgtgtacatgtgtatatcaaccgaacaggtggaccgtagatatcgactcaacaaaaaactacttttatgagattattacaagaactgaagaacatatgattaaatctaaagactgaacaaaattctctgcttattttgcaatttccaactgtaattcatttacattattttctaaacaccatttactggctagtatcttaacaacaacaggacaaaacacaaacgtttgttttcaacaatatcaaaattataaacgaactatatacttattttcgttttttctcttttgttagctaagccaaaactacgccgtttgacgatggagggatcaacgcctgatgctcgaagggctctattactgtaaacctccagcacttctgttccacgaaaggtacgaggggtctccgagttgcctgaaaccattaatacagaagatcatttcactgtacacgttccaaaatctgaaaagtgtaataatgtcttaacaaaatgaagcatgcatgaccctgagagtgacgtaccttggcttaactagatacaatacggcaaatgtaacagccaagaacaagcaaatactgcctacagtcagataagcaatcccgaggaaatcattccttccgccgagccagctagttgttgacagcactagcttcttctgcccattgaagctgtaagtgttgtagttgttctgcaacaagaccgttatggtatcacccgcgtgtaggtctgtctcaatcttcccatacagcttcctaaacgttggcaaagccgcggttcgcatccagactatgaggtcttcttgctcactcaactatccaacagacaactcttacacttgttaaaatcctatcagaagaaggaatctaaattgatcgatattcaaggattttttaccggtttagaaatattaagagttccaccgcctattggtgctcctttctgaaaatttttagggaagacatttttcccaaacttgttttctctgtcactcttccatgagatacctttcttattcacaagaagttgttggctatttcttgaaaagctataagtatcgttgaacaaactccaagcaacaagaccacatggcacaattggttctccacccacattatcctcaggtgcacaggtcttcacatcatgctcttcttttggacttcttagttgtgcatcgtttcgacttttcacatacctaatcatatacaatcaaccagaggagtaactgtattaatgcagggaaagtaacaggcaaaagcgataactattactaagcagataaggcaaagtaccgtctatggttttggtagaaattctcaagttggtagtatacatagacaggatgcttcatagcttttgtcacctgaaaaaaatgaaaggctttagaaagagccatacctagaagaacagctaatatacacaatcatagaaggaactaaattgccatagaagaagacatgtaccgttattgttctcttacagatcttatctccttcaccctgtatgtaagcgaccatgttgtttctagaagatgttggaatacagtctgtgtcatatcgatcaacaatctcgactaccttcaagtatgaatgaaacatatcctcaataaaaccacaaaaccgaagctggaaaataaaccattagaaaaggcagaaaaacaatagcatgatgcacatactccctgagaagcaaataagcagatcactccaaggggaatgaagacaaccccagcgacaagaaatgtcaagatcacctgcaaatggccatgaacaataagaaaacagcaaaaagagtaagagtcatccttttccactattgtaacattgaacttacccatcttggagtaagaattggcttgcacgctggaagctcttgctgagtaaacctagaatctggtaaagaaaattggttccttgtgaagttaagaacagagaatccaaagcaaccatacagtttgtttaatgggagaacaatgtttaaagttttcgaacaaaagatttcaaccaatgtcacatcaaaacccaacaactaaacgtgagtttcaactacacggtgtaggacaacttgaaaaaccaagctgatgaacctatacacctcttgtatatacgaatctacatcaaacccagagtatacaagaatgctattagaaatcaaagaaacatgcaaaaacacatggtgatcgaggtatagcaacaccatcaacagagaaatttttgtcaattcaatacgaattccaggaaagaaagaaaaaaagaagacgaaatttctaaggacgatccatgactatacaaaaagttcgaccaaatcagaagattagaaggatagatagagatagaaagatcacattttggtcgcttggaggtttttttgacaccggaaatctcagacgatccgcctcctccgacggtggaagatgccgcggtggaactcatcaccgaagaaattgattagaaatgaaatctcctctacaactatattccgaatcgaatggacggcatgagtcgttttgggaagaacagatcctacgcgaatgaggggaagaatgttaggttaggcttatgaaacatatctacttggggaagatgtatagatcttttagatgaagaagcaaaactctcgacaaggaaaaaagaaagacgactttgacaaatgctgttatcatgggagggaaaaataaaataataataagccaatttttatgttattttttaaagggcaatttgggtaaagaataaaaaacggaagttttcgaacaaacccggcaaatgcggttaaactgccacgtggattacacgtcattaataattaacccactcgaatacagtcaaataacccacctgtcatttttgacggatccaattttgaagatattttacttgtaaaaaatctcttgacaacatataatttcgttgcctagtagcttcttcacagcttctgatctcactagtgttcgtcatctttgttcgattgaagtttgggaagtggtg

SEQ ID NO: 8119 - DNA, 3000 bp, Unknown
  misc_feature (1)..( 3000): cDNA_ID_1398634_gDNA_ID_1621194_Annot_ID_174673 3000 nt of promoter + ATG
attcactactagtggcatagatacaaataacagaatgtacacaaatatgattagagaaacctgtggactcgtaagcaaagcatccccaatttcaggagcatttcccatgaccacattaagtgccccctattgaaaataataatgcaaatgaaacatgaagtgttacaaatacaaaaaaaaaaaaaaaaaaaaaagagcaaaaccctaaagagatggtctgcccaaagagttcattagcacaaaagaaacttcgtaaaaaactagcctttaaaccacttaatcctacatcaatgggtccatacatcagatagtagccacattgacgacaatacaaactcttggagatgggctgatcaaatattcaaatcagattacatgtaaaacggaaagactactgtgttcgaacttaacacattattggttatttccctgacatgaggaaatccatctagatgtgaccagagacgctagttggttgtatagttcaagcctaatataaaagattaccggaggaactccagcttgaagtgcaagttcagccgcagcaagtgctgttaggggcgtaagttcagatggtttaacaaccaccgtgcatccagaagcaagagcagggccgacctacaataccatttaccatctacatcaaatttaatgaaaaaagttctacatactcactgggtactaggcagctatttacagaaagaagaaggtaaattggaatggtaaaaaaagcaagaccttccgagtaatcatggctaaggggaagttccaaggggtaattgcaccaacaacaccgacaggctgcaaagaaaatcaagagagtcaagcaattgagatgtatagtaaacacttgcgattacaaatacagccacattgcatggaaaaaaaagtacacgaggaatatccacatataaaatggaattcgcaaagcaaggttaaggttctccaagttcatatcacattgctacaagacttagaaaattgcaaaaaaaaattcttgggaaggtgtgggaatgcagagccaagtcacaggtttccaagcccagatagcctggcaattatttaactacgcacctacaagttaagcttagggtgcagaactatgtcactacaaaaaagctgcatgtattaaatatagaagcatgaatggggaaacctgttttagaaccaacagtcggcgatcagacagattcggaggaattatatcaccatatacacgttttgcctcctccgcatagtactcaataaaacttgccccatatgctacctgtaaactaaattgcagaatcatatattgcatttaagaaacgattgcaacagttgagacaagcctaaacagcacattcaatgttctcaaataaaaaatgaatcattaacctctccgatggcttccttgagtggttttccttgctccaaagttataagttgtccaagttcttccttgtgtgcaatcaggaggtcatacctgtgtttggtgaaatgaagtggctcagaaccttataatcctaaacatccccatccaacactacaaaagtaaaagagaacgcattgctacgggataaaagattgtaccatctccgtaaaactttactcctctctccagcagtcaatctgctccaagctgaatgtgataacatgtaagagcattagagcaaaatgttcagcgtgaatagaagtgaccatcaaacattgagcaggagagacggaacagtttaaggtagaattaagaagctcgaaaagaaagaagctaaagtaatgaagaagagaagcatacaagtaaatgcttcataagaagaagcaatagcatcatttgtctcttttgttcccatacatgcaacatcagctataatttcaccggttgctggattgttaacctgtcaggaagaaaacatgatgtcaacataaagcattccaaaataacatccccaaaacaaagagagagggtaaaaggcagagttgtatgaccttgattgtcttattgtcatacgagtcaagccacttgcctccaattagaccttgagttcgtaatagaccagaactcctaagcttttcagaaacgctttgtgcgtccatactcatctgataatcaattgaattaacagagtatcattatcataacgtattcacatttgttctttaacaaaaacatccggaggaaacccaattcacttttcctccatgagaccacaagatccgagaaatactagaaaaactgaattcagatatataaccattgttctgattttgaaaccactcgatccttttctccgtgagagactgcggacgaatccacgagtaaatatgtaaatacagaagaatcgattgagaagacagacgatttacctggcgacactgagaagagacgaggaggagggaggtatgtgacgagatgagctttcgacaaccgccgatggctacacgcgctgctgctcctattaccatcaccacttcccaaacttcaatcgaacaaagatgacgaacactagtgagatcagaagctgtgaagaagctactaggcaacgaaattatatgttgtcaagagattttttacaagtaaaatatcttcaaaattggatccgtcaaaaatgacaggtgggttatttgactgtattcgagtgggttaattattaatgacgtgtaatccacgtggcagtttaaccgcatttgccgggtttgttcgaaaacttccgttttttattctttacccaaattgccctttaaaaaataacataaaaattggcttattattattttatttttccctcccatgataacagcatttgtcaaagtcgtctttcttttttccttgtcgagagttttgcttcttcatctaaaagatctatacatcttccccaagtagatatgtttcataagcctaacctaacattcttcccctcattcgcgtaggatctgttcttcccaaaacgactcatgccgtccattcgattcggaatatagttgtagaggagatttcatttctaatcaatttcttcggtgatg

SEQ ID NO: 8120 - DNA, 3000 bp, Unknown
  misc_feature (1)..( 3000): cDNA_ID_3047671_gDNA_ID_1621194_Annot_ID_174671 3000 nt of promoter + ATG
agcatatatgcccattgccatacatatatgtatattcttctactatcaacataagttagacagatcaaaattggttaaatatggtaaaaatttgcacattgtctccagtaaagtgatcttctgtgacaacgaaagtatgcaactaaagtgcgaatctttatgagaaacagaaccttatatccttccacaggttaccttgcaaggattctttgaggtttttgttttggtttgtacacatgcacatgacacacacacacatacgcgatatatataaagaacgagagagcgaagagacaaatatttaacctatcttggtcctgtttctttgtcttcttactcttgagagtgtatagctaattggttttatttctcttttggtattcatcttaaaaccatggaatcatatcgagtcttcacaactatttgtcttcttctttgtctctttctctcagccaacttcttcactcattatggtaaaatcatctctgtctctttctttctttctctctatccaactctatctctaaaagcatttgatattgattatgattttcttatatagtagtagatgcaagaaaaagcgtgggatttgagagagagccaaagaaggtgatgatgatcaaagcattaaagcacacatcattgttacagaaaatgatgacacagctcaatcttgctcagcctttagactactcttcatcctccaacactcaaccttatggcgttagcacaactctcactctacctccttatgtttcacttcccccactttcagttcccggaaatgcccctcctttttgcattaatcccccaaatactcctccttcctcctcttatcctggtcttagcccacctcccggcccaatcacattacctaacccacccgactcctcctctaacccgaactccaaccccaacccacccgaatcatcctctaacccgaacccacctgattcatcctctaatccaaactcaaacccaaacccacccgttaccgtccctaatccacccgaatcatcctctaacccaaacccacctgattcatcctctaatccaaactcaaacccaaacccacccgaatcatcctctaacccaaacccacccgttaccgtccctaacccacccgaatcatcctctaacccaaacccaccagagtcatcctctaatccaaacccacccattaccattccatacccgcctgaatcctccagcccaaacccgccagaaatagttcctagccctccagaatctggttatacaccagggcccgttttaggcccaccttactctgaaccgggcccatcaacacctaccggatcaattccaagtccatcatcggggtttcttcccccaatcgtttatccgccacccatggcaccaccgtcaccgagcgtaactccgacgtcggcttactggtgcgtagctaagccctcggtccctgacccaattattcaagaagccatgaactttgcatgtgggtcaggagctgattgtcattcaattcagcctaacgggccttgctttaagcctaatacattgtgggcccatgcttcgttcgcctacaatagctattggcaacggaccaaaagtacgggtggctcgtgcacgttcggcggcactggcatgcttgtcaccgttgatccaagtaagagaaatatttgtttatcaactattatttattggtaatattcatttttttaaacaatgttattgaatggcaaacaggctttaacgggtgccattttgatttcttctgatgcatgaagacgaagacagctctcactttacattttgttggatacgaataatatcaaagaaatctagatataatatgtttaggtgggtcgctcacttgtaagttgaaaccaattaaagcttatttcttgggaatggcataattataaatcttatgctaaatacgtatattgcttttgctaatggaattaggtcttctagacttgtggtacgttgcatctacttaactactatcactaataattcctttatttatacacacatcccttttctcccacaatgatttagtagctttgaaataaagtaatatacgcattctcagtttctcaccacgacatctttttttatttatagaaaaacttctacgccggtctattatctcaaacacgtgaaatgtcaccctgctaggttttgctgttgattagcgttgttcactaattttgtactaggtattcaaaagaatcgcaactgcagatttaagtgagtatatatgaaagagtctcaacaatgtaagtgaaacagtttacgtaggaacaatgtaacttgatgtaccttattctgttatacgaaaaacattcgtacaatagaaattaatcgttacaaatgtgggttaattctaccgtgtgcagatattgcgtgagtactttaatcacttgaatattttggttcatgcattttgttcatggtgaactagcaaaaaattagttgctataaaacaatatggcctttttagtaaccaagtaattactggtctagtggcgttttgaagacatatgaactgtggtttcgaactctgtgggtgaaaaaaaaaaaaaaaattttgtattgatcagaaaaattcggcaaaatccagagacctaatgttaaatggatacaaaagaaaaaaatgaatataatgttcgttcagcatttttgttttgtattgtattctgtacctatggaaaattagtttttaaaccagaatggaacaaaaaaatcgaatatatgaaaaagtggtaaactcaaaatcggcaaaaaaataaaaacagaaaaaaggtgagaaaataggaaaaaggtaaaaaagtaaaaaaaaaaaaaaaaggaagaacccttccgatttgatttgattgggactatataaagggaactctataacatcatctctctcacaagtcgcaacgctccaacgacttcaattcaatttactttcgattttgtcctcttccaaaaacccttccgcttaaaccctaattcacttcgccggcc

SEQ ID NO: 8121 - DNA, 3000 bp, Unknown
  misc_feature (1)..( 3000): cDNA_ID_3047679_gDNA_ID_1621194_Annot_ID_174668 3000 nt of promoter + ATG
tacatcttcgatgatccgtggaagaaccgcgaaagtaattcccagaaatgtcatttttacgcttagtaggagttccatttctgagtctccattgatttctccgagtcgaataaaccctaaattagccggtagtttctcgttcaacatccgattattgagctatttcactgttagaaatggcttttgtcccgattgttctgtaccgagagaccctaattttgttggattgactacacaatgtcggagtattgtcaggaggttttgtagtgaaaagattggaagtagtgaatctagtggctggacagaggaggttgagtatttagatgagtcgggtagtgtactacacagtggtaagggaataagatcagtagagccagggcttgatgaccatgtaatggttggtggattgaagaagccttacatgaatgcttcttctgttgcaaagattgttgaagttgttcagaggtggaaatggggaccggagttggagactcagttagataaactccagtttgttccgaatatggttcatattacgcagtctttgaagattgttaaagaggttgatgcggcgctgagtctgtttaggtgggctaagaagcagccttggtatctgccttcggatgaatgttatgtcgtgttgtttgatgggttgaaccagggaagggattttgttgggattcagtcgttgtttgaggagatggttcaagactcgagtagtcacggtgatttgtcgtttaacgcctataaccaagtgattcagtatttggctaaagctgagaaactggaggttgctttttgttgtttcaaaaaggctcaagagtcgggatgcaaaattgatacgcagacatataataatctaatgatgttgtttctgaacaaaggtctcccgtataaggcatttgagatttatgagagcatggagaaaactgatagtttgttggatgggtcaacttatgagctgataattccaagcttggccaaatccggccgtcttgatgcagctttcaagctttttcagcaaatgaaagaaaggaaactccgaccaagctttagtgtgttttcttcgcttgttgattcaatggggaaagctggtcgattggacacatcaatgaaggtttacatggaaatgcagggatttggccataggccatcagcaactatgtttgtttccttgattgattcatatgctaaagctggtaagctggatactgctcttaggctttgggatgagatgaagaagtcaggtttcaggccaaactttggattgtacacaatgatcattgaatctcatgcaaaatcaggaaagcttgaagtagcaatgacggttttcaaagacatggagaaagctgggtttttaccgacaccatccacatattcgtgtctattggagatgcatgctggatctgggcaagtagactctgcaatgaaaatctataactccatgactaatgctgggttaaggcctggcctgagcagttatatttctcttcttacacttctggccaacaaaagacttgtcgatgttgctgggaagatactactcgagatgaaagcaatggggtattccgtagatgtctgcgctagcgatgttttgatgatatatatcaaagatgcttctgtggatcttgctctgaaatggcttaggttcatgggttcttcagggatcaaaacaaacaattttatcatcaggcagttatttgaatcatgcatgaaaaatggtctatacgattcagctaggcctttgctggagacactcgtgcattctgctggaaaagttgacttggtgctttacacttcgattctcgcccatcttgtcagatgccaagacgaagataaagagagacaattgatgtcaatcctcagcgctaccaagcataaagctcatgcctttatgtgtggtctcttcacaggtccagaacagaggaaacaaccagttctaacgtttgtcagagagttttaccaagggattgattacgaactcgaagaaggagctgctaggtactttgtgaatgtccttctcaactaccttgtcttgatgggtcaaataaaccgagctcgatgtgtctggaaagtagcgtacgagaacaaactctttccaaaagccatcgtctttgatcaacacattgcttggtctctcgatgtgagaaacttatctgtcggagctgcgctcatagccgtggttcacactctccacaggttcagaaaacgaatgctttactacggagtagtcccgagacgtataaagctagtcacaggaccgacattgaagattgtaattgctcaaatgctgagctctgttgagtcgccttttgaagtcagcaaagtcgtcttgagggcaccaggagagttggtgatggagtggttcaagaaaccgatcgtgcaacagtttcttctgaacgagatcccatcacggtctgatatattgatgcataagatgaacgtgatgttcccaagctcggctcctgagcttagatctatgtcacctcccaaaccactcatgtcatcgaaagcgttctaacaggggagacaaaagtcatgggtttttgtaggcgggttctctgtttcagatctctcattgttaatacttgtctgaaaatataatggaaatgatatttacgtctttaaatcattgttagttcatttttgttcgattacgtctttaatgtctccgagtaaagcttacgtccttatcctggataggaattaatctgtcccgagtattcctacgttcttatcctggataggaattaatctgtccatgtatccaaacatcacctctcagttaatatctccaatttacacgacgcgctaaaggtgagaggagatctcacttgccttcttcactcactctgcagcaacttcgagatcaagttaaaggtcagattccttaattctccatttcttatttgcttcgttgcagagaagaattaggttttcccgatcttcggattctgattctgattttcttttgcgattattggcttggcgataagaatg

SEQ ID NO: 8122 - DNA, 3000 bp, Unknown
  misc_feature (1)..( 3000): cDNA_ID_1025139_gDNA_ID_1621194_Annot_ID_174667 3000 nt of promoter + ATG
cattgaagaaaaacttaagaccaagctgaaggcctaaggcatatggctcattaatgtgtactaaatatatattatcggcccgagttacggctcgttaagaaaacatagaaatgatttaggcccaacaaataatgtatgttctatattataagcccatttattattacccagctaagtcggctttgaaaagagtataggcccatttaggtgtcacgctcattagggtttattgtaacctagaatcaaagctatataagccgtcttttccacaaatccatacatcggccaagcgagctcctcaatttttcttgtttacttgtttcctcatcttttagttattgttagaggttatcttaggatcgtagcctgtgatgtttgagattgtccgtaccatctgagtttctccttgacgattacctccactttctgaggctttagatctaagatcattagttttatttttacttcggcgatgatgatgaaacaagattaccatcaaactttgagaggtttttcgctcgttgatgtaaacttctttttataatctgagcctagtttgtttgtttgaaatcttatgtgttacatgttatatgaaatcgttttggtgataggaaaggcaacaaattagagtctctgattcacttatgtcaatagtggataaagcgctgtacgttgccgagatagatatggcgatattctggtacttggactagttttgatagttccatgtgcattcaaaagcccttacatgtttctctcaacttattcccattagtatatgtattttgatttggtaaaggcaacaaattagagtctctgattcacttattcaatagtggataaagcgctgtacgttgccaataattacttggtccaaagatctcccaatcggctttcagtcttattttagccgatatgatcgatgttcctaaattatagattttgttacgtgttttcatatagctgagctgaccatatcatgctatttaccaaatctttttgatcaattacctgacacattgacagacgatcgatttttagacactgaaatatgggccgaaattttgaaggagtaatgtctggtaaagcaatgtttgataatgttatggactgctgcgcttgtagcagttagatttcattgggttataagatcgaattcaatatcccctaaaaagattgatgtaaactgtagctttgtagcagatcataaattatttcataaaacagctttcgacgggaaagtttataattttgatataggaaccggataataattgtatcagtaattcttaatcgggctttggatagtcccttcctttttagtgaattcgaatcgaaatgcaaaaataatgaggctgacgcgcttaattttctcaaatatccaaaaatggccaatttcaaaaggggttacctacagatttgtggcgcgtggtaataactcgcttatagtgcaagtggttattttgttttctaatagttaattatttaccatacaaattgtcttctaatgtgggcttactaaatactttacggccttttcgttttcaggcctagggagttaggcccattttacatctttcttgtcggtttcatttttaatgttcgtatattcgagctcttttctcgtctgtacaatgaacaaagttttactgagaacaataaagatactcaaatcattcatagggtgatcaattcgtataaacttaaattttgttcgaggattaaagtataatttataatgcctattaaggttctttgataatgctatgagcccaattttacgatcgtcgtattctatgctaccatcccattggacaagtacgatgccatattagactatttagttcaattgtctaatttaattccgaatttaaaaggccttaaataaataaatatagtaaggtttgggcgaaggttacaaatcatttcactctttcagaacacaaaatagcccaaaacatgtttcgacgagcaaacttaaaatttgtttatgaaaaccgttacgcgtataagagtaaaaaattgtcgtaactgggctagaaagagctaacgatttacagatcttaggtgcaaaattacttttcgaattccttaaactacagagataagtcgagggagagttaaaacttagaagcaccaaaaaaaaataaaaaaaaaataaaaaaacttaaaagcatcacgcgctagttgacaaaaaaaaaaaaaaaaaaaacatcacgcgcttactttttcgaactatacaaaaatagctaatttcgaaagggggttaaacctacagatttgaggtgcgtgctgataactcgcatatagtgcgcgtggttattttattttcaaacggatacaaatatcgctagtgtgggctttcttaataccggtctttttattttttgggcttaggcccagtttacacgtgtcttatcattttatttttttatgtttttctatgcattaaaaaattccttatggcaaggacaataacaaaaaaaattcattaaagatcacatagtattgtaaatgtgagattaaacatgaaaattttattttccaaaattactgctttttaatgcataagattatacttttacggtactaatgtacaaatattttccttgaaaaatcatttactaaaaataattaaataaattcgtacgtcttttctttttggtcggaattagtacgtcttttctttcttttttggtggctatttattttgttcatattagatcaaacttaggagaaatataaatatatatagatatcaaataaaaagtaagaaacataaaaatattagaagtcaaaataaagaaaagaaaaaatacaacgcgaaggtttgattaccactcaaaaaacgagcagctgtttatcttccaacaaagcttcttcgtgcatcttcgctcttctcaactcgtcatcctctccctctgattctcttaagtcgccttgaaaaattaagacaaaacaacaacaaaagaacaagagaagctctaaaatccagcagct

SEQ ID NO: 8123 - DNA, 3000 bp, Unknown; identical to SEQ ID NO: 8114
  misc_feature (1)..( 3000): cDNA_ID_1838761_gDNA_ID_1621194_Annot_ID_174665 3000 nt of promoter + ATG

SEQ ID NO: 8124 - DNA, 3000 bp, Unknown; identical to SEQ ID NO: 8113
  misc_feature (1)..( 3000): cDNA_ID_3047687_gDNA_ID_1621194_Annot_ID_174663 3000 nt of promoter + ATG

SEQ ID NO: 8125 - DNA, 3000 bp, Unknown
  misc_feature (1)..( 3000): cDNA_ID_1807141_gDNA_ID_1621194_Annot_ID_57531 3000 nt of promoter + ATG
gttttcatacaaacaaatgttgtcgaccttgttttattattatattgtttgcttgatattcatcgtttttatagggcggtgccaagaaagttataatttctgccccttctgctgacgcacctatgtttgttgttggagtaaacgagcacacataccaaccaaacatggatatagtctccaatgcaagttgtaccaccaattgtcttgcccctcttgccaaggttggtaatgttgcacaataattttaccctcatttcattgctatgagattcattaaggtcaactaaactgtatttggcaggtggtgcatgaggaatttggtattcttgaaggcttgatgacaactgtccacgcaactacaggtctatataacttactctcctgctgcagatcactgaatgttgataacctgattacactaacctgtgtgttttggttattttttctttcagctactcagaaaactgttgatgggccatcaatgaaggactggagaggaggtcggggcgctagtcaaaacatcattcctagctcaaccggcgccgcgaaggtacacaaaaactcacatggttatcgcaagcatgtaattatcctaaatcgggaatcatatctgagctgtggttttttgatcaagtaggctgtaggtaaagttcttccagaactgaatgggaaacttacgggaatggccttccgtgtaccaacatcgaatgtttctgtggtggatttaacttgtcgacttgagaagggtgcctcttacgaagatgttaaggcagccattaagtatgcttcctaaaattttattgcccgaccagatatcgtcatcgaaacattatcgtttaatgtagaactcttaataacctctcatggtttaatgtaaacctctaacaggcatgcctcagaaggacctcttaaaggcattctcgggtacacagatgaagatgtcgtctccaatgatttcgtcggtgattcaaggttggtctctctccttttcttcatagtcatctgaatctttttttgtggttgaccaatgtggtgattccaatttggttataacaggtccagtatctttgacgccaatgctggtattggattgagcaagtcctttgtgaaacttgtctcttggtacgacaacgaatggggttacaggtacacttttgtttctcatcttatatttctcatcctagctaacagttctaacacttaaaaatcttctcccattttacttacagcaaccgagttcttgaccttatagagcacatggctttggtagctgccagccactaaatacacacaccagttcttgcagaagcttgagtctttctgctttttgcgtaacctgctctacaaagccggtttggatttgttcggttcaattaggtgccactgtgctaggtgttttgaaatatttggcttgaatctcgagcctttactctatttttgttctgttccagtatcagcaaccatgatttggtccaaaagactgaaaaactgtgcgacttacatctatgaataaggggctaagctagttgtactttaccaaaaatagcttaccagtataagcaacgtttggatacttcttgatagcgcatcgttagctttgcccgtgcttatgacaaaagatcactaaccactgaaacatattttttacaaatgaaaacagaaattgaacttgattagcctgtgtaaccatgtttcagaagaaagcttactcgttttttcatccgacgaaactcgtttggtattggcgattcctggaagggaagcatgaagatttatccattgagatggacaacctcatcatctatctcctctgtcttgtttctgatctctttcaaaacttgtttgtcttttctctatcatcaccacttaagaaaaggtggctgtttttgagttaacggaagtagactcactcaagtgaggctatagctaaggaaggacatgagttatttattggccaccatgcggataaggagaactcttgaagtaaggttactcatatattttcacttgccccgatatttcatggaaactacaacattttccacgaactattgtttattacatatgttttctaagactttatttattacagatatcgcctgaaatttcgtattattacaaaaacacacgtaaattttgtcaattccaaatatctccaaatttttgtttgttacatattgttccctcaagtttttgtttattacagattcccctgaacctctcatggtttgatgtaaacctaaaacctcaaaatcaaacaagtttgtcacagaaagatatatagtctccaatgatttcgtcagtgattcaaggtctctcttctttctctaaatacgtaacaactaacacggaaggcatttcattggctacaattatttcaaaatttatcttacaaaaaaggataatagagtgtgatattgttcatcagagacgtccacgtaagggtaaactaatcagtatatggacaaaaaggtacttgtttatctacaccaggaagaaaaacaataccagttttccggtccacaacttttgcatcaccatgcatccgcagccacgtgtgttcttatgaatattaaaatctacttatttcgttatacgacaaacgaaagatactgctttgttgcgtagacaaacaaacaaaatctcttgataataccagatattcttaattaattagtacgttttaaactcaacatacccataagaaaatccagttagctcatggtttcatgttttccaatagatatatgtgtatataattaaacgctttgcatcgtttgtgatttgcatgttggaaataataatgttttttttttgctaatcaaggtttgattaaggaaaaggagtttggactttggacctttctactacaaatacatgtggccctttttggccaacaccaaaagttccaaaaaagaggccaaaaaataagcaacaacttttgattctctcgtaacttcccccacaaaatcagcagagcgagagcgagagcgatcggtt

SEQ ID NO: 8126 - DNA, 3000 bp, Unknown; identical to SEQ ID NO: 8122
  misc_feature (1)..( 3000): cDNA_ID_1025139_gDNA_ID_1621194_Annot_ID_57532 3000 nt of promoter + ATG

SEQ ID NO: 8127 - DNA, 3000 bp, Unknown; identical to SEQ ID NO: 8121
  misc_feature (1)..( 3000): cDNA_ID_1810479_gDNA_ID_1621194_Annot_ID_57533 3000 nt of promoter + ATG

SEQ ID NO: 8128 - DNA, 3000 bp, Unknown; identical to SEQ ID NO: 8120
  misc_feature (1)..( 3000): cDNA_ID_3047671_gDNA_ID_1621194_Annot_ID_57536 3000 nt of promoter + ATG

SEQ ID NO: 8129 - DNA, 3000 bp, Unknown
  misc_feature (1)..( 3000): cDNA_ID_1810467_gDNA_ID_1621194_Annot_ID_57537 3000 nt of promoter + ATG
tggcttattattattttatttttccctcccatgataacagcatttgtcaaagtcgtctttcttttttccttgtcgagagttttgcttcttcatctaaaagatctatacatcttccccaagtagatatgtttcataagcctaacctaacattcttcccctcattcgcgtaggatctgttcttcccaaaacgactcatgccgtccattcgattcggaatatagttgtagaggagatttcatttctaatcaatttcttcggtgatgagttccaccgcggcatcttccaccgtcggaggaggcggatcgtctgagatttccggtgtcaaaaaaacctccaagcgaccaaaatgtgatctttctatctctatctatccttctaatcttctgatttggtcgaactttttgtatagtcatggatcgtccttagaaatttcgtcttctttttttctttctttcctggaattcgtattgaattgacaaaaatttctctgttgatggtgttgctatacctcgatcaccatgtgtttttgcatgtttctttgatttctaatagcattcttgtatactctgggtttgatgtagattcgtatatacaagaggtgtataggttcatcagcttggtttttcaagttgtcctacaccgtgtagttgaaactcacgtttagttgttgggttttgatgtgacattggttgaaatcttttgttcgaaaactttaaacattgttctcccattaaacaaactgtatggttgctttggattctctgttcttaacttcacaaggaaccaattttctttaccagattctaggtttactcagcaagagcttccagcgtgcaagccaattcttactccaagatgggtaagttcaatgttacaatagtggaaaaggatgactcttactctttttgctgttttcttattgttcatggccatttgcaggtgatcttgacatttcttgtcgctggggttgtcttcattccccttggagtgatctgcttatttgcttctcagggagtatgtgcatcatgctattgtttttctgccttttctaatggtttattttccagcttcggttttgtggttttattgaggatatgtttcattcatacttgaaggtagtcgagattgttgatcgatatgacacagactgtattccaacatcttctagaaacaacatggtcgcttacatacagggtgaaggagataagatctgtaagagaacaataacggtacatgtcttcttctatggcaatttagttccttctatgattgtgtatattagctgttcttctaggtatggctctttctaaagcctttcatttttttcaggtgacaaaagctatgaagcatcctgtctatgtatactaccaacttgagaatttctaccaaaaccatagacggtactttgccttatctgcttagtaatagttatcgcttttgcctgttactttccctgcattaatacagttactcctctggttgattgtatatgattaggtatgtgaaaagtcgaaacgatgcacaactaagaagtccaaaagaagagcatgatgtgaagacctgtgcacctgaggataatgtgggtggagaaccaattgtgccatgtggtcttgttgcttggagtttgttcaacgatacttatagcttttcaagaaatagccaacaacttcttgtgaataagaaaggtatctcatggaagagtgacagagaaaacaagtttgggaaaaatgtcttccctaaaaattttcagaaaggagcaccaataggcggtggaactcttaatatttctaaaccggtaaaaaatccttgaatatcgatcaatttagattccttcttctgataggattttaacaagtgtaagagttgtctgttggatagttgagtgagcaagaagacctcatagtctggatgcgaaccgcggctttgccaacgtttaggaagctgtatgggaagattgagacagacctacacgcgggtgataccataacggtcttgttgcagaacaactacaacacttacagcttcaatgggcagaagaagctagtgctgtcaacaactagctggctcggcggaaggaatgatttcctcgggattgcttatctgactgtaggcagtatttgcttgttcttggctgttacatttgccgtattgtatctagttaagccaaggtacgtcactctcagggtcatgcatgcttcattttgttaagacattattacacttttcagattttggaacgtgtacagtgaaatgatcttctgtattaatggtttcaggcaactcggagacccctcgtacctttcgtggaacagaagtgctggaggtttacagtaatagagcccttcgagcatcaggcgttgatccctccatcgtcaaacggcgtagttttggcttagctaacaaaagagaaaaaacgaaaataagtatatagttcgtttataattttgatattgttgaaaacaaacgtttgtgttttgtcctgttgttgttaagatactagccagtaaatggtgtttagaaaataatgtaaatgaattacagttggaaattgcaaaataagcagagaattttgttcagtctttagatttaatcatatgttcttcagttcttgtaataatctcataaaagtagttttttgttgagtcgatatctacggtccacctgttcggttgatatacacatgtacacgttatttcctgattttgattatcctttgtcgtaatgtaattggtcaaaaaagatttatttgtatggtaatgacttgtaataatctactatttattaagccagatttccagatattttcgggtcctacggtcgtcgtcagtcgtcaaggctaattcgtcgcgagtatgtatatttctctctctgtcgctttcatttttgattttattgttttcgtttcacaatctggaattgactctcactgtcactgttgatgatgatgacatctcaccaggttgctacgacgccgtttcggttgcttctggtttctttatg

SEQ ID NO: 8130 - DNA, 3000 bp, Unknown
  misc_feature (1)..( 3000): cDNA_ID_1810463_gDNA_ID_1621194_Annot_ID_57538 3000 nt of promoter + ATG
caatttcaggagcatttcccatgaccacattaagtgccccctattgaaaataataatgcaaatgaaacatgaagtgttacaaatacaaaaaaaaaaaaaaaaaaaaaagagcaaaaccctaaagagatggtctgcccaaagagttcattagcacaaaagaaacttcgtaaaaaactagcctttaaaccacttaatcctacatcaatgggtccatacatcagatagtagccacattgacgacaatacaaactcttggagatgggctgatcaaatattcaaatcagattacatgtaaaacggaaagactactgtgttcgaacttaacacattattggttatttccctgacatgaggaaatccatctagatgtgaccagagacgctagttggttgtatagttcaagcctaatataaaagattaccggaggaactccagcttgaagtgcaagttcagccgcagcaagtgctgttaggggcgtaagttcagatggtttaacaaccaccgtgcatccagaagcaagagcagggccgacctacaataccatttaccatctacatcaaatttaatgaaaaaagttctacatactcactgggtactaggcagctatttacagaaagaagaaggtaaattggaatggtaaaaaaagcaagaccttccgagtaatcatggctaaggggaagttccaaggggtaattgcaccaacaacaccgacaggctgcaaagaaaatcaagagagtcaagcaattgagatgtatagtaaacacttgcgattacaaatacagccacattgcatggaaaaaaaagtacacgaggaatatccacatataaaatggaattcgcaaagcaaggttaaggttctccaagttcatatcacattgctacaagacttagaaaattgcaaaaaaaaattcttgggaaggtgtgggaatgcagagccaagtcacaggtttccaagcccagatagcctggcaattatttaactacgcacctacaagttaagcttagggtgcagaactatgtcactacaaaaaagctgcatgtattaaatatagaagcatgaatggggaaacctgttttagaaccaacagtcggcgatcagacagattcggaggaattatatcaccatatacacgttttgcctcctccgcatagtactcaataaaacttgccccatatgctacctgtaaactaaattgcagaatcatatattgcatttaagaaacgattgcaacagttgagacaagcctaaacagcacattcaatgttctcaaataaaaaatgaatcattaacctctccgatggcttccttgagtggttttccttgctccaaagttataagttgtccaagttcttccttgtgtgcaatcaggaggtcatacctgtgtttggtgaaatgaagtggctcagaaccttataatcctaaacatccccatccaacactacaaaagtaaaagagaacgcattgctacgggataaaagattgtaccatctccgtaaaactttactcctctctccagcagtcaatctgctccaagctgaatgtgataacatgtaagagcattagagcaaaatgttcagcgtgaatagaagtgaccatcaaacattgagcaggagagacggaacagtttaaggtagaattaagaagctcgaaaagaaagaagctaaagtaatgaagaagagaagcatacaagtaaatgcttcataagaagaagcaatagcatcatttgtctcttttgttcccatacatgcaacatcagctataatttcaccggttgctggattgttaacctgtcaggaagaaaacatgatgtcaacataaagcattccaaaataacatccccaaaacaaagagagagggtaaaaggcagagttgtatgaccttgattgtcttattgtcatacgagtcaagccacttgcctccaattagaccttgagttcgtaatagaccagaactcctaagcttttcagaaacgctttgtgcgtccatactcatctgataatcaattgaattaacagagtatcattatcataacgtattcacatttgttctttaacaaaaacatccggaggaaacccaattcacttttcctccatgagaccacaagatccgagaaatactagaaaaactgaattcagatatataaccattgttctgattttgaaaccactcgatccttttctccgtgagagactgcggacgaatccacgagtaaatatgtaaatacagaagaatcgattgagaagacagacgatttacctggcgacactgagaagagacgaggaggagggaggtatgtgacgagatgagctttcgacaaccgccgatggctacacgcgctgctgctcctattaccatcaccacttcccaaacttcaatcgaacaaagatgacgaacactagtgagatcagaagctgtgaagaagctactaggcaacgaaattatatgttgtcaagagattttttacaagtaaaatatcttcaaaattggatccgtcaaaaatgacaggtgggttatttgactgtattcgagtgggttaattattaatgacgtgtaatccacgtggcagtttaaccgcatttgccgggtttgttcgaaaacttccgttttttattctttacccaaattgccctttaaaaaataacataaaaattggcttattattattttatttttccctcccatgataacagcatttgtcaaagtcgtctttcttttttccttgtcgagagttttgcttcttcatctaaaagatctatacatcttccccaagtagatatgtttcataagcctaacctaacattcttcccctcattcgcgtaggatctgttcttcccaaaacgactcatgccgtccattcgattcggaatatagttgtagaggagatttcatttctaatcaatttcttcggtgatgagttccaccgcggcatcttccaccgtcggaggaggcggatcgtctgagatttccggtgtcaaaaaaacctccaagcgaccaaaatg

SEQ ID NO: 8131 - DNA, 3000 bp, Unknown
  misc_feature (1)..( 3000): cDNA_ID_1810459_gDNA_ID_1621194_Annot_ID_57539 3000 nt of promoter + ATG
tattactgtaaacctccagcacttctgttccacgaaaggtacgaggggtctccgagttgcctgaaaccattaatacagaagatcatttcactgtacacgttccaaaatctgaaaagtgtaataatgtcttaacaaaatgaagcatgcatgaccctgagagtgacgtaccttggcttaactagatacaatacggcaaatgtaacagccaagaacaagcaaatactgcctacagtcagataagcaatcccgaggaaatcattccttccgccgagccagctagttgttgacagcactagcttcttctgcccattgaagctgtaagtgttgtagttgttctgcaacaagaccgttatggtatcacccgcgtgtaggtctgtctcaatcttcccatacagcttcctaaacgttggcaaagccgcggttcgcatccagactatgaggtcttcttgctcactcaactatccaacagacaactcttacacttgttaaaatcctatcagaagaaggaatctaaattgatcgatattcaaggattttttaccggtttagaaatattaagagttccaccgcctattggtgctcctttctgaaaatttttagggaagacatttttcccaaacttgttttctctgtcactcttccatgagatacctttcttattcacaagaagttgttggctatttcttgaaaagctataagtatcgttgaacaaactccaagcaacaagaccacatggcacaattggttctccacccacattatcctcaggtgcacaggtcttcacatcatgctcttcttttggacttcttagttgtgcatcgtttcgacttttcacatacctaatcatatacaatcaaccagaggagtaactgtattaatgcagggaaagtaacaggcaaaagcgataactattactaagcagataaggcaaagtaccgtctatggttttggtagaaattctcaagttggtagtatacatagacaggatgcttcatagcttttgtcacctgaaaaaaatgaaaggctttagaaagagccatacctagaagaacagctaatatacacaatcatagaaggaactaaattgccatagaagaagacatgtaccgttattgttctcttacagatcttatctccttcaccctgtatgtaagcgaccatgttgtttctagaagatgttggaatacagtctgtgtcatatcgatcaacaatctcgactaccttcaagtatgaatgaaacatatcctcaataaaaccacaaaaccgaagctggaaaataaaccattagaaaaggcagaaaaacaatagcatgatgcacatactccctgagaagcaaataagcagatcactccaaggggaatgaagacaaccccagcgacaagaaatgtcaagatcacctgcaaatggccatgaacaataagaaaacagcaaaaagagtaagagtcatccttttccactattgtaacattgaacttacccatcttggagtaagaattggcttgcacgctggaagctcttgctgagtaaacctagaatctggtaaagaaaattggttccttgtgaagttaagaacagagaatccaaagcaaccatacagtttgtttaatgggagaacaatgtttaaagttttcgaacaaaagatttcaaccaatgtcacatcaaaacccaacaactaaacgtgagtttcaactacacggtgtaggacaacttgaaaaaccaagctgatgaacctatacacctcttgtatatacgaatctacatcaaacccagagtatacaagaatgctattagaaatcaaagaaacatgcaaaaacacatggtgatcgaggtatagcaacaccatcaacagagaaatttttgtcaattcaatacgaattccaggaaagaaagaaaaaaagaagacgaaatttctaaggacgatccatgactatacaaaaagttcgaccaaatcagaagattagaaggatagatagagatagaaagatcacattttggtcgcttggaggtttttttgacaccggaaatctcagacgatccgcctcctccgacggtggaagatgccgcggtggaactcatcaccgaagaaattgattagaaatgaaatctcctctacaactatattccgaatcgaatggacggcatgagtcgttttgggaagaacagatcctacgcgaatgaggggaagaatgttaggttaggcttatgaaacatatctacttggggaagatgtatagatcttttagatgaagaagcaaaactctcgacaaggaaaaaagaaagacgactttgacaaatgctgttatcatgggagggaaaaataaaataataataagccaatttttatgttattttttaaagggcaatttgggtaaagaataaaaaacggaagttttcgaacaaacccggcaaatgcggttaaactgccacgtggattacacgtcattaataattaacccactcgaatacagtcaaataacccacctgtcatttttgacggatccaattttgaagatattttacttgtaaaaaatctcttgacaacatataatttcgttgcctagtagcttcttcacagcttctgatctcactagtgttcgtcatctttgttcgattgaagtttgggaagtggtgatggtaataggagcagcagcgcgtgtagccatcggcggttgtcgaaagctcatctcgtcacatacctccctcctcctcgtctcttctcagtgtcgccaggtaaatcgtctgtcttctcaatcgattcttctgtatttacatatttactcgtggattcgtccgcagtctctcacggagaaaaggatcgagtggtttcaaaatcagaacaatggttatatatctgaattcagtttttctagtatttctcggatcttgtggtctcatggaggaaaagtgaattgggtttcctccggatgtttttgttaaagaacaaatgtgaatacgttatgataatgatactctgttaattcaattgattatcagatgagt

SEQ ID NO: 8132 - DNA, 3000 bp, Unknown; identical to SEQ ID NO: 8117
  misc_feature (1)..( 3000): cDNA_ID_1810455_gDNA_ID_1621194_Annot_ID_57540 3000 nt of promoter + ATG

SEQ ID NO: 8133 - DNA, 450 bp, Unknown; identical to SEQ ID NO: 8112
  misc_feature (1)..( 450): cDNA_ID_1810491_gDNA_ID_1621194_Annot_ID_174661 3000 nt of promoter + ATG

SEQ ID NO: 8134 - DNA, 3000 bp, Unknown; identical to SEQ ID NO: 8116
  misc_feature (1)..( 3000): cDNA_ID_1810451_gDNA_ID_1621194_Annot_ID_57541 3000 nt of promoter + ATG

SEQ ID NO: 8135 - DNA, 1398 bp, Unknown
  misc_feature (1)..( 1398): cDNA_ID_1810443_gDNA_ID_1621194_Annot_ID_57545 3000 nt of promoter + ATG
aatctaaactacgtcaaagcttgttgcagagagaccctgagacttcaccctaccaatcctttccttgtccctcacatggcacgtcatgacacaactctcgctggctatttcatcccaaaaggtatctcatttttccccaaaatttatgcatttaggcgtatttgactccaactccttaaatgtagaatcaggaattctaactatatttatttttgcttgatttgagcaatattttcatattagaatatttgttcctttgatttattattttggactgaaaagtgaaaataagtagattgtgacatacgaatctttcaaattattattttatttgtttattaactttaatatattgattgtttgatgtggatcacaggcagtcatattctagtgagtcgtccgggtgttggtcgaaaccctaagacatgggatgagccactcatctacaggcctgagcgccatataaccggcaacgaagtggtgttgactgaaccagacttacgacttgtttcatttggaactggtagacgcggctgcgttggagctaagcttggaacgtccatgattgttacgttgttgggtaggcttctccaagggttcgactggaccattcctcctggtacgacggacagagtcgagctagtcgagtcaaaagaaaatctgttcatggctaatcctttgatggcttgtgtgaagcccagattagatccaaacatgtacccgaaactctggaccggtccagcttgatcataccggttaacggcaccacatttcaattgctattgtcatgtatgagtaaaatttgaataaagtttttgtcttgaggaaaagttgaagaggaatatagcccataacgttcataaaaggcccagcccagtattgttctgccgttttaatttgagcaaagtaagcttcaagtaaagaaacgggttgagtgcaaaaatggagaaattaacttgcaagttgagattagcacataagaagagtatctaattccatcttgttcacaaagtcattcttttagcattaatgatcctatatttatatcaaatctcataagatcttcagtgtataatatatagtttaatttttttctaggttttcgttcgaactcatgtgggttcagtaaataaatgtttaagtccccatctggccgcgtcaaaaatacttagataacaacaattagtggttgacatagaaaagtaatgattgttgccgcgtagaatgaaattaataaaattataaagaacagtgaagcaataaatgtttccttggcgtcttgaagagtagtcttcttaaatattccagcccaaaaaaaaaaagattctatccattatcaagagaagaaaaaaaatctgaattccaattcgaagaagaagaagaagaagaaaggagatg

SEQ ID NO: 8136 - DNA, 488 bp, Unknown
  misc_feature (1)..( 488): cDNA_ID_1810524_gDNA_ID_1621195_Annot_ID_57547 3000 nt of promoter + ATG
aagctttagcatttaaaattattggattgatattttggtggttacgtgatgaaaaaaggttgctttttattaaggtctttgagaatggaaataaaccttttaccttgtagtattgcaaatcttagttagtgtttatcatgtcaacccaagatagttgcaaaaaacccatatcatttcagttctcatattttttcaagagtggatttctacattgatatatcctataagctcttctgacaaattatttcttgcttatctctgggtttgttccgtccctctactttatgatatctggatcttagttacctcaatgattgcacttaattaagttatgagtcgatgctaaaggaaggtgtgatcaatttactatgaaatgtgattctagaagtgttttgaaacgggcataataaacaatatttttttcctaagtagaaaataaatagttactaaacttgtcgctgggtatctacaggttttatactcttatg

SEQ ID NO: 8137 - DNA, 3000 bp, Unknown
  misc_feature (1)..( 3000): cDNA_ID_1821667_gDNA_ID_1621195_Annot_ID_174707 3000 nt of promoter + ATG
tctctgcttctttgctttaatggcgcagatacagaactagggcttagggttttcctcaatggctttacttgttagtgttgatccaacctgaggatttgtatcatcaattttacagaatctcaccactgttagctcaggacatttcctgctgcaagaatctgtttacatatacttgtgtctgagactctgaaacagacaagttcacttgtgtctgaatcatgtaatttttgtgttagtctctctacaaatgattgattcttaaattagacgaataaaccagagaaaaatgttatacattgcatttatggactgagttgtgatgtacattgagtaggtgggaaggtgctccaagcaagtttccatgggagtttaagaagacagagacaatatatttcatggaagggaaagtgaaagtgaatgtagacggatacgacgaagaagaagaaacctttgagatagggaaaggagatgttgttgttttccctaaagatatgaaagttgtttgggagataactgaagctgtgaagaagcaatatagcttagaggagtagtgactttgtagagagaatttgagtcacattgatgtttgtttgttgtacttggttactactttgaactaataatatctatggaattgcaatgttgattaggattctgattatagaagtaagaaaactatatattatatacaatttaattaggaccccaacagctcaagtacatgactgttctaagagattcttcagccttcttagccttctcgctctcaccagaggaggtaacggctgcggagacagaagacgaagagaaccttttcccttgagaaacagatctaacgttgttccggagatgttgattaaccgaccggagtatgtagttccaccgacaaagacctagttggtcttttaatgcctctacggctccgatgctcactgccactgtccatgctttgcttgtagaactcatctttcttcagagaattaaacttctttgtgttttgtgttttgtgtattgagaattgtttttgttgatgatgtttagaaagtgaagtgaattggtgtgtttatgtaagagagaagaagccaacaatattgccgtgtagttggagttaaaactagaagctgtggccgttggttttggttgtttactactgtctggatagtaaaatgacgttgttagccttttaagaacgaattggataaggggtaatattgggattctggtagttcctggattaacgagtgccgctatcatgtgcacctggttttgagattgttcacttgtttgggtttcgtgttgtgtccaagttttgaaatatagtaaatgttttctttatctccttgtagaataatgcatgttggagatgaataataatataatatcaaaaatcatttgccgaccaaaaaagtaaaaaatatattaaacacaaaatgtaaataaataaataaaaattcaatcaaaagaaaaatggttttgcgatgacttactttttttttttttctttctttcatacagaagatgaataccatttaacatgagtattcaaaaaatcaaaagtaaaactagtatcatcaaatatttccgctaaattagtaaacatatttccgctcataacaattagaatgagaattttagaatgttggttctgtgacaaccacacaaatttccgagtttagtagatttggaattggtgtttttctttgcgatttactggtatgcgctcttgagcaatcgtatacaattagagtagtaatattattttacttttctgtaaattgctttaatccgttctcagttctctttataacttctgtcaaaaatttaaaatgatataaaatttaacattttactaaaaaaaagagattgtaaaaaagaatatagagatttgttttattttatcctttaatcagtcattttataaataataaatttcgtttcaagtagtacattaatttttaaaatttttatagatttaatatacagatcattctagtatacacaaaaattaggatctatattattatttaaaaaaaaaaaaagcagctcaagtcgatgaactaaacatgggcaaaatcgtcattgaactaaacattcatagtttcagcagaaaccaagaaaaccagcagctacaaaacccactttttgtctgcactttcaaactccaaaggcacggcactttttgtctgctttctcttcttttataaacaaaacccactttgattcacttctcattcatcatcaacaaacacaaaatcgaaaccaaatcacttaaacaagaaagaaacaaagagaaatgagctctgcaagcaaaacgtggatggttgctgcaagcatcggagccgttgaggcattgaaagaccaactaggcgtgtgtcgttggaactacgtgatccgatctgcgaatcagtatctacgcaacaacttaagatccgtgtcgcaagctaagaagctctcttcctcatcaatcgattataccaacaagaccaagcaagctgaagaatcgctgaggacagtcatgtacttgagctgttggggtcctagttaatggacaatggagggatttgaaaaccctaatcatagagttttgataatgtctcttttagggtttaaaacccttaaaaaggttaaaaatgtatagaatttgctctgtaaagtgactcttgagtcttgaactaatgattaatctcttttcataagatttgttcaaatcggatttttcagttactgcaactaagtaagaaagacttaaactttgaatataaatacagagaatttggtacgttgtgtgtgacaaagatttatttctgttgatataattaggaccctaaattggaggtttgttacagtcaaaagtttgtactgagtttttactacaagttagggattttgttaaatgcttatcccatttttcatgcagttctgttgctaattctccagcttaataaagagaggttaattttgtttggtttatgtgtgtgaacatttcttgtctgagtaaag

SEQ ID NO: 8138 - DNA, 3000 bp, Unknown
  misc_feature (1)..( 3000): cDNA_ID_1822266_gDNA_ID_1621195_Annot_ID_174723 3000 nt of
tccgtgggagtgatcaaagctgatgtgttcatcatccatatctgaatattctgtatatttttgtttatagaatgaatcctattgacattaaaatatataactttggatgagtctacgtatggccttttttgagatgttgctgacattatcatatactaaaataataaagtgcaatgtggttcactcgcaatagccgcattttgtcaccatttaagggaatttactatttttgtggtgaaattatgtaaattaccacatgttaaaaaaagaaaaaatattagatctcacaacttcatttgaactagggaacggttgacattgttttttttttaaatagttaagaaaatttggaaataattttgaaaagtaactttgacataaagaaaatcttgagaattgatcttttatttgttttcagaaatgattaattttatgatgatttttcttgaatcatagaaaagtcatataggaattgctccatgaacaaagcgacaagtttctccgtcatttagaagatctgtagataacatttgccaagaaaggactcacaatcacttctcaaaatgatccagctgacgagccattgatcgaaccatcttatagctgacaagacatttaatgaaagtcgcgcttacgtcacttacactcaaaacacgttcttctttctaagaaatcgtcaaaaaaaaaaaaaaatagattgcacgaaaatgccgagaatacaacttggaatgttttaactagtcccattaattcgatattttacctaggtcaagtaacactcttataaataatccttgcactctcgaagaaaaagaaatagggagtaaggtaattcaccagttcccaccttaaaagtaaacctaacttgctatatctaaatacaacaaaatttcactcatgaggaggagaacagttcacggatcatccaacttgttctctctcattccttctttcttattctcaaatggacatcatcgtgtttcaaagattttcagcacttattacagagacaatctacatttctacatctcattcattttgtcatttgtaatcaagtcattcaagttaaataataaaaagtgtgttttttctttcaaaagtttgtaatcttttgaagctttgtcaattcaagtttattggtgtgattccatagtcttgtttgattgcgtttctagtgtgtttgtgagattcaaacattctagttcgtgtgttgttgtggattcaacgacaaaacttccattttccatctctaccatcgttccatcgaatcattcaaaccgtaggccgagaaaccgagaaacataaaccttaggtaaattccaaggtttgcatcagattgctttgaccaaggctcataagtcattacttgacaccactctatctttcacgaatttaagaatttagagagactttgtgaccttttggatatggttagatctctgttattatttggttttgagagtcattggtaattgattcaacatctttatcacttaatagtgatactttttctatgtgtttttttttgttggttctatttggcttaccctttaagaattctagtggtcttgtatcttcctatatatctaataacatatggttgtttctatttcatttattttttatatttaccgcgacacgcatcagaaaacgaacttggcaacttaacaaattagctattaatcaatggacatgacatgtacatgccaaattaaattgggcttaataaaacacgtgttcgttggaaaaaattaaatatgttttgtatttttatagttaatagtgtaacgatttatcatgatctgcgccgaaattcacgctcagacgttatatttgagttctttaaattattatttataaaaagtaagtcagaatatgaaaaaaccggaaacatcgatcacattaacttaaaagtaataatttttcattttaggatatattttggataccgacagctttgtcactacatcgaacaattttatgtttttttagaatttgttaatatgatgataccatttgatatccaataagatacttatttactttatattattagattagaatcatctacaacataaaatctaattatttagatgagtattatagatttgttacctctcgagtttaagatcgataactcatgttgttgaaacaagaaacataaaagatagttctgaaatttaaaacataaaagagagtttgaaattgaaaattatatatattgtagaaagtttatgacaagaggagaaagtatgattcttttagtatttgtttctatataatattaagaggaaaaagtaaagttcttatagaatatattctttcaagcaatttagctacttccagctaaatcattaaactcctttgactagcaaattaaataaatttaaatcatataaaggtaaaaaaacacacataaaatattagttttaagaaagatgaaaacaagtaaaaaacataaacaaccgaacatgtgtcaattgttttcagcagtctaatactcgtgtgactggccaatttaatgactatgactcactttcaactacctaacggtttcaaaacatgttaaccttgttttttttctttaaacaaaatcccattagttgtcactttaaatctctattattatagtaattattacaatctttttttaagaaacacttagtgacccatattaagaaaaaaataactttatttttaaacccatatcttatattttgtatctatccaattccttcctattatgtaaatttaattctatattattatattttgttgtgacatcttctcataaaataaataaatagctatcacaatttgatagcacctgaatacttcacctgaaactttccccacctctctctctcatcttatctatcaccattgcttcatctccaaatcttgaaattctctgttttattttcaagaaaagacagaaagtgaaacaagtcttttttttttttttttttggtgtggaacattgatatttgagtgacgatg

SEQ ID NO: 8139 - DNA, 3000 bp, Unknown
  misc_feature (1)..( 3000): cDNA_ID_3071695_gDNA_ID_1621195_Annot_ID_174704 3000 nt of promoter + ATG
ctccctttgaatttctgcgcttttcgacagtcgaaaaactttgtttagataactccaaaacacacacaatcatgtcgaatttgatcccttacctttgtgtagtatctgcaacctttctctccatcagtaacaataagcagcttaagcttatcatgcataagagacaaaacaacatcatccttctccgcatctccacgcgttagaaacgttacctcatcatcgcttacctacacatcacgaaactcgaacactaagatcatcgaaaacacgagtccggttgttacaacaaaaacaaacataccttgataatatcagcctcattccaaatacttttgatgccttctatagcagcttcagtagaaggccaaagaggcaaccgaacgttcgggtcataagagagtaagactcccgcatctttagcggttttcatcgcagccatgtgagctgttctacatggctcagagatcaagctaatggaaccatagtggaaaatcttagctttcttgataagatccttgttgagttcagattctttcaagagcatgtccgcactagggttcctgtaaaacataaactctctctcaccatctttcttcaaagtcacaaaggccaacgcggttcttgcattggtatcaaagcaaacaccttcactgttcacaccgttcttcttcaatatgttaaccaacatgtgtccaaactcatcatcaccaaactataaaagacattacacaatcacatatcacttttcaccatcagttaatagattctaacataaattatacaaaccttgccgatgaaagctgatttgccaccgagtttggtgatggcacaagcaacattagcaggagcaccaccaggggctttgagaaaaccggtggactcagctaaagaaacaccagaagtgtcagggacaaagtcgataagcatttcaccaaaggaaactatcaatggagtattagccatctttactcagacaagaaatgttcacacacataaaccaaacaaaattaacctctctttattaagctggagaattagcaacagaactgcatgaaaaatgggataagcatttaacaaaatccctaacttgtagtaaaaactcagtacaaacttttgactgtaacaaacctccaatttagggtcctaattatatcaacagaaataaatctttgtcacacacaacgtaccaaattctctgtatttatattcaaagtttaagtctttcttacttagttgcagtaactgaaaaatccgatttgaacaaatcttatgaaaagagattaatcattagttcaagactcaagagtcactttacagagcaaattctatacatttttaacctttttaagggttttaaaccctaaaagagacattatcaaaactctatgattagggttttcaaatccctccattgtccattaactaggaccccaacagctcaagtacatgactgtcctcagcgattcttcagcttgcttggtcttgttggtataatcgattgatgaggaagagagcttcttagcttgcgacacggatcttaagttgttgcgtagatactgattcgcagatcggatcacgtagttccaacgacacacgcctagttggtctttcaatgcctcaacggctccgatgcttgcagcaaccatccacgttttgcttgcagagctcatttctctttgtttctttcttgtttaagtgatttggtttcgattttgtgtttgttgatgatgaatgagaagtgaatcaaagtgggttttgtttataaaagaagagaaagcagacaaaaagtgccgtgcctttggagtttgaaagtgcagacaaaaagtgggttttgtagctgctggttttcttggtttctgctgaaactatgaatgtttagttcaatgacgattttgcccatgtttagttcatcgacttgagctgctttttttttttttaaataataatatagatcctaatttttgtgtatactagaatgatctgtatattaaatctataaaaattttaaaaattaatgtactacttgaaacgaaatttattatttataaaatgactgattaaaggataaaataaaacaaatctctatattcttttttacaatctcttttttttagtaaaatgttaaattttatatcattttaaatttttgacagaagttataaagagaactgagaacggattaaagcaatttacagaaaagtaaaataatattactactctaattgtatacgattgctcaagagcgcataccagtaaatcgcaaagaaaaacaccaattccaaatctactaaactcggaaatttgtgtggttgtcacagaaccaacattctaaaattctcattctaattgttatgagcggaaatatgtttactaatttagcggaaatatttgatgatactagttttacttttgattttttgaatactcatgttaaatggtattcatcttctgtatgaaagaaagaaaaaaaaaaaaagtaagtcatcgcaaaaccatttttcttttgattgaatttttatttatttatttacattttgtgtttaatatattttttacttttttggtcggcaaatgatttttgatattatattattattcatctccaacatgcattattctacaaggagataaagaaaacatttactatatttcaaaacttggacacaacacgaaacccaaacaagtgaacaatctcaaaaccaggtgcacatgatagcggcactcgttaatccaggaactaccagaatcccaatattaccccttatccaattcgttcttaaaaggctaacaacgtcattttactatccagacagtagtaaacaaccaaaaccaacggccacagcttctagttttaactccaactacacggcaatattgttggcttcttctctcttacataaacacaccaattcacttcactttctaaacatcatcaacaaaaacaattctcaatacacaaaacacaaaacacaaagaagtttaattctctgaagaaagatg

SEQ ID NO: 8140 - DNA, 3000 bp, Unknown; identical to SEQ ID NO: 8137
  misc_feature (1)..( 3000): cDNA_ID_1821667_gDNA_ID_1621195_Annot_ID_57550 3000 nt of promoter + ATG

SEQ ID NO: 8141 - DNA, 3000 bp, Unknown
  misc_feature (1)..( 3000): cDNA_ID_1810509_gDNA_ID_1621195_Annot_ID_57554 3000 nt of promoter + ATG
atatcacgacttcaactcacggctgttcatatatactaatgtaagcatgctggatctcgttttaatattttaataccatatatatgaattatacatgattgacaaatcaatgatttatactcaaaatgttatatggttggattcagtcaggaggacatgggtgttataatcccttatgtccggtcggatccggaataatactagtcagtcatgaagttactcctggtttacttaccaagcacaacgatttcgaactctccataattaaggtcagtttttttccaaaaactattaaagacataactctgtgtgttttaggtatttttaagtatagtatggatatgtagtgttagtgtttttttggtgagatctagtgttagggtacttgtattccattcaatatatatatcttactttttactttttcatattagatattgcaaaaacatttgcataaaaataattaaacattgataaaaatagttattaaaattaattgtaagctttttgtctataatctttgccttttctatatggattttttttttttttttgaaatccatgaggttctgggccgaaacccataatcttctcagacccaaagccaaatcatttaacattagtttcgtcccaaacgtcactcgaatcggcgacctctaagtttcgcctagggtctttaccaattgagctaacgatacttggttttctatatggattttgttgagtacaggacaaaatatacgggcattggtggcttttgatgggtaacagtagcagctcaacttggaaagaaattgggttctggccaacacataggttcaaagaaagttttggtacaggtgtcgaatggggtggtgaagtctatagccctgcgtctacaagtcctcctatgggtaatagtcattttccgaagggagccccaaaatagactcatatgtccgtttgatcacgacttgggacgaaaattatggtttggacatggttgtgaaaaacacagagagattttcaaacagttgttataaagtgaaagatgcacagagtcgttttggccagatgtaggtcatcttatcgtttatggaggccccaggtgtacataaactttgttagtgcgtagcattattccaaaattgtagtatctgaaaatgttcaaaataaatcaagagaattacgttcttactatgaataaaaatatataagaaaaacgtaaagaaatttaaagaacatctttatattctttttttgttatcttgtttgacttggttagaaaggagaagacaaaagaactatttatatgttccaaattttaaaaacatcttacttattacatcatatatcattagaaaattccactacattaccttaaagatatataatattttctatagagatatagttctagacaaactttacttggtgtgttaacactcttaagtttttctagaacttagacttagttaattttgagtttggtccaataattaaactcttgatcatgatcccgtgattaaacttaacccaaagtcaagtttgatctcactaccggattatttgaggtgaatcaaaatataacaatataccatgtaattggtaggcaaaataaccaaaatttgaaaaatcaatccgaaccgaaataaatggttttatttggttatggttttttcttaaaactcatttggttatcatttttcttaagtttttggtttaggtttggtttggttaaaaaccaaatgatttttttttgtttttgattaaaattaagaataaccatatatactaatatattgtccaatttatattatgattagagtatcattggattttttctttactagacttatatacagtgatctcttagtaatatctgattattcttatattatttttattctacgtttcattttatttatgcatcaaacttatactttttttttgtaaaatacatggaataaccttaaaacccgtacccaaaccaaaaccaaaccaaaccaagatacatatagttttttatatgatttcaatttttacaaaactgaaaacccgtcataaattgtaaaaccgaaccataaccaaacttaattacatacggtttctttatggtttcaagttttttgtaaaaccaaaaaaaacaaactgaaactaaactgaaaaactgcacgcccaccctaatactatatttaaaaataaatctcaattaaaatcaaaaattaaagaaattaaagaaacaaaatacttatgattttaaggaaaatctaagaataattatttttatttattattttcatttgtcattctgaataatcacacaattagttttatacaaacattgattatgtcacatcattttatttatagtacatttttcttattttaatttatttataaatataatttatacaataggattataaatgcaagagaaaaaaatactatcttcaatttacacatagaaatgtattacaaatacttaaaataaatttcttattttcagattttttttagaggaaaagttacaaatattatgccaagcttgtgttaagaagttagcattaaagatatgaataaatgtcatcaatatatcgatgtaaatttaagaagaaattatgtttgacttgtatggtccacaaataattatgtcatctttgacttgtgcatggtcaaaaataacaataaatctcttaaaagcattcatggaaattagtaattacttagtttaagaagaaattttgtttgacttctgtatggttcaaagatatatatactatatttaggtttgaaggaatttaaggaaacgtatatgtattaattattttttctaacccttagctaggtgtatattctactctagtgaatcattcagaaatattacatttcttgtgagaaggtgattatcccaaatgacttcttcaaatctttctcctattactatatctcaataataactgtatatatagaagaaaaactaattatcaaatttctctagttcacaggttaatgaaaatg

SEQ ID NO: 8142 - DNA, 195 bp, Unknown
  misc_feature (1)..( 195): cDNA_ID_1822270_gDNA_ID_1621195_Annot_ID_57560 3000 nt of promoter + ATG
cttttggtgaatgtcagcctcttcgagaactagccaacctggtaggtatctcagcatttattacacatgcgttatccagtgaactcacatatgtataagaagattgtgaatgagcatactactagtccacctaaattgctaataaaactgttccaggtacttatactaggtaaccgagatgacatcgaagagatg

SEQ ID NO: 8143 - DNA, 3000 bp, Unknown
  misc_feature (1)..( 3000): cDNA_ID_1810580_gDNA_ID_1621196_Annot_ID_57563 3000 nt of promoter + ATG
atacgaaaaataatttttattggttttgtatattcaaaaacatattctatattcattagtttaaaataaaaaaaaaactaaactaaaaatagaataaaaatcattattaaattttaaaatttaaattaaaataggaaaatattattagagttaattaagtaaggaaattgcttatttttatattgacaattaaaacacttcaattatttctatacaattttttaaaaaaatatttttcaaccacaaaaattattagaataaaacataatacacatgaattttattttacaaacttttttgctgaaatcaacattgttagattttctatctttttatatattaaaaagaaaaattgcaagtttttggttgtttatgtgttattacgagaacttttcttaataatatttgttacaaaagggaactaaatagtatacaaaaataaatttagactaaagaatatgtaaaataaaattataattttctttaccatgcaaactttagagtaaagagtcatatactcaatttcatattgcttcctaatgaaatcgagtatatgactctttagtctaaagtttaataatgatttttattctagttttattttagttttgaaattaaaaataaaactaattattataagatttaatgcattgaaaatacaaatatatttttacgaaatatataatatgttttggaatatataaaagcaaaaaaatattttcgtatttttgaatattaaaaataattttaattttctttttgaatttttttttggtcaacgccggtcaacactagtcagtgccggagtcaactgaccggtttaccggaattgtatgtttatggtgttaactacatgacgtcctatacttcatatacgtggttatggaatacatctatttcgtgtagctggatatacaatagtatagttggtatgtgtgaccatgtattctcttatacttcgtgtagctagcaatcttttttcctttagtaaattactatgcataatagtaagtttactaaatgaacaattgattatgcaataaatcatatgaaacacaaaatatatatatggtgcttactagcttatcaaacacatagtagatatggagcttactatcttattcaaacttatagtaagtttttgcacaactcacatatatatatttactagtttatcaaacttataataagtttttgcacaactatatatatatatatagagcatactagcttatcaaactcataatatatttagagtttactagtttatcaaactcactagcttatcacacttactagcttatcaaacttaagaagtggcaacacaacaaaattaagttcaaatcatatcttttatttaaatttgttttttcatggctttaaataacattgtaaatagctctcattatcccaagaaaaaacaaacttatctttctctcatgagtaatcaacaacttctagtcatcatcgcaaaggaaaattcaatattatacaaggcccaatcaaagccttcgtagcggcgaattaaagagatcgatactatttttttagagtatatatactaactaacctttgacaacaaaagaataaagagaataaccatagataaaaagtatgagagagaaaataacttttacacctcatttatgacacttttaccctaactaaaccaaaccgtacattaattttttatttctccgaaaccatcatcaccttctccataaccatctccatcacaataaccaccacaagctctagtaaatcatttgactatagccgttcacggtgttggttttcatcaatttggtggttcaaccattgagctcttccatttatttggtctatataggatttacctatttccgatatcgtttctttttagaatctgagatttgctttcaccctcaaaagtttaagattttctttcaatgttatgttatcatttcatatatcatgttacttttatattaggcatgtattttgtctaaaagcagtgtatttatttgacatgatctgcactttttaaataattcatgtcctctattgtaatcacgtatcttattcctacccatccaaacaataagatatgtttcttttgaataatgcatgttcattttatattagacatgcattttctaaaaatacatggtattatataaaagatctacaccttttaaatatttcatgttctctactgtaatattattcatacctatccgaacaataagatgtatttcttctgaataatgcatgttccttttataattgtcatgtattgttttaataaaatattaattcatttagatactatgttgtctgtaaataattcatgttttttattcagatgttaatcaactctgatttattatcactggcattattgtagaaacaagaaaatagaaagatattttttagtatttattctactttaaaaaatgttatttatctaaattttctgacaaaaaattatttttttaattttgtttaattttatggttattttttatcattaaccttttttttatatcagctgtaatggaaaaatatatcaaagtaatattgacactattttttttttgaaattaaaaataatattgacacttgacagttcgaaattcaatacttttctaattataaatggaatattctgtacccgtccaataaaacaaggaatttttccgttccagaacaaatattcgaaatttttttaccataaaattcctttgaaaaatgtaagtcaaatttaatttattttaaatataattaatttattgtggatattttattttcagcaaattgacaaagacaaaagacaatttacttaaacagttctatctattacactcagaaattgacgcgactgatagataattccaattccagtcaaacaaaaccttcacaactcaattattcttccgattttggtttctctcttccaatcatccttcaagctcatctttttcttctacccaataacgaaagtctcctcctttactaatg

SEQ ID NO: 8144 - DNA, 3000 bp, Unknown
  misc_feature (1)..( 3000): cDNA_ID_2176125_gDNA_ID_1621196_Annot_ID_174752 3000 nt of promoter + ATG
gactggttgaaacgcagtgcctgcatttgtgactgcatgagtttacggaatcagacagttgcggtttcaagcattataaacctttttgaacgactggtttaacggttaaaaattggtgcatttttggaaggtttatgactggttaacggatttacgtttatggtagaaaaattacgggtttatgtttttagcaagctaattacgggtttacgtttttggcagaaaaattacgggtttacattttttttgcggcaaaattacggctttacgttttttggcgggaaaattgaaggtttaggttttttggcggaaattacgggtttacgtttttggcggaaaaattacggatttctttttttggcgggaaaattacgggattacttttttggcaaaaaaattaagattttatgtttttggcatgaaaattacgagtttatgataatgttatcatcaatgatgatatctatcatgactatggtatgttgatatgatgatgaagaagatagtatgatgatgatggtgatggtaatatgatattatgagagggtaatgatgatgatgatattgtgttgataatgaataaattgatgggttgatgaagccatttgaattttttttgattatattcaatcggtttagagattttagtacaactaagatgtcatttttgttttttaaggtctaattaaatttatctcttttctggtatggttattcgattctccaataatataagtttcaattttcaagttttgaaaaacaaacaaacatagcttttagtttttttatacttcttcaacgtatgaatcaaatatgcatatggaacatcaaaatcaaatatgataactccatataacatattcttaagaatcttcaatgactttaacctcaccagaatcagcacctggtgatttttaactcttttcacttttgttttttaatgactcttctaaaaagatgttcgtaatacaaaaaaattagcttccaaaacttataaaagctatatagatcttactttaaaaaattaacaaatgcattgagctcttaatcactttctaatgaattcttttgttctacatatatcatgaatcatgacaaataacattcaatacctacatacaacttaacaaaattacattttttaataaaaaaagcccgcgatttggttcgggtttcgccctagtactaactagagaagaaagagattttcgaagaaaaaatatggaacatgtgaaaagtttagaaggtatgacacatattgcttaaacaaaatcataagaggatggaaagagacactgtaagaaaaaatgaaacaaataaaacgagtgcttgcaaaaagatagggagagtgatagctctttgtaaaaaaattgtgaagacagaaattcatatacatattgaaaagaatgtgagaaaatatgagttgttaaagtaaagtatagataagcttatgaatatacttctatataatatcttatttttagacgagctatactaactaatgcagcgaagataaacaaaaaagaatagtaaatttacggatttcaaaatgagaaagtcgtcgaagttattttccataaaacaatttatttcatacataaaaagacgtcgtgatcctaaatatctaaagctaaagagagagtcatgagccaaaaaaatgttcttttgataaatgttgtaaacctaaaagttgtattaaagttatttttagttttgtatttaaattgtaactattgtcatggtaattttaaaattcaaagagtttataatattaacaacaagtagacatataaaaacatatcttttaaaaaatttctataataattttattcacacaaaaaaatattaaaaagttttacaaatagacccatgcgtagcgtggattcataacctaggatttagaacgactaatcgggagttgccacataaataattaacatatttagtatctaattaattaacatttttgaaaacaaccaatcgggagctgccacatcaataattaacatatttagcatctaattaattaacatttttgaaaatagcaattactttatattttaaaatgtaaaaacaaaggaactaacaaatattaaatttaaacttataaaataggaagctatataattataattatgtaataataaactcaaacccttataggattttatacaactaatccaacatttttttaatataacttaaagaaacgtaacaaggacgtggtttgatggtggtgtttttaactgtatcaatttgaatcaagttctcgaagatatgctcgtggcaactaccatgagaattccactttttcggtcatgtgacaaccacacaaatttccgagtttcacgagttcaaaatcggtgtttcaactcgtaacttagccttgaacgcataaaagcgaactgaatgaattagagttgtaatgttgtatttatttttgtagattgttttaatccgcttcttgctaatctctgtatttctgtcaaaaatcaaaaataatataaaatctaattgtctaccaaaaaaaaaatcattcatagtccatgagtagaatcaaaacaagatagattcaaactttatcaagatagataaataagctaagaaatgaaatagttcctcaaaactaaatttagtgtcaccaagaggcaagatcaaacttttcaaataagggaaagaagagaattgcaacgtgattaattgatgaggtcatagtaaaagtcaaaaatctgtgtgactcaaaacgggtaaaaacaataattgggatgtagttgataactctaaaaaaaaagggacaaaaatgagatttgcataaagtagagatacaaaattgagaagaaaaaaaaatcctcttcactaaaaaaaaaaaaacttccgttatcgatctctatctctctcttcccccacaagggtggcgattcgaggagtttccatggtggaacagaaaccctagagcctttatgctgccactaattatcactcttcactattgaattgggg

SEQ ID NO: 8145 - DNA, 3000 bp, Unknown
  misc_feature (1)..( 3000): cDNA_ID_3088172_gDNA_ID_1621196_Annot_ID_174746 3000 nt of promoter + ATG
ccatgttttcaaaggagaaggttacggtaatccaaccgatgaacgtcattgcgttaacagtgtttcgatcagttttaacccggcaaaatcttcctctataatctgaggatatgattgatcgatcatacaacatcttctaatcagattgtgttgttaaaattgtcatcatgtagtgaatatgcactttctgtggtggtcaatataatgcaacaaataataagactcattagatattggatggttactggtttctcttaatatgttatagaacatttaataacgatttaattatctaagggatcattactagtgtttcttaattataactctttagaactgaaaaaaaatattatagagatttcgttttgacagaaaaaaactcaaaccgatccattttactttccattttgagtgtgttgattttaaaaaatatgatacgtttttattactaatgaaaatagaagatattatttccaatagtggatctcatatgtgtatccatatcattattttcataattgcgtaaaatatctcgtttcatatatatttgtgtgagataatgggttgagattaggagtgggcattcgagtaagcgggtcgggtttgggtaaaatccaatcgggtacgggtttttcgggtagataaatttaggacccaatagggtaaatataaaatatcggttcgggtttaatcgggtttggctataaatttttgggccttattttgaaactgatagccggatttccgggtaaatacccagatttttcgggtaaatacccggattttcgggtaaaatttcgtgtttcaggtaaaatttagatttttgattaaaatattcgggtatttttgggttcgggtttggatcgggttcggattcggtttttcggatagaggaatttaggacccaataaggtaaatcttcgggttcggtttcggttccaattttttgggtcagtttcggttctggttgttggttccgattttttcccagcccctaattgagacgttggtttgtttgccaataatttgtcatgtggaaaagtactcgaatgtgtttttgattcactataaatggttgtcccgttttgagtttgataattcattagcatgtgactatatcatatatctatttattacactagaagcattattctctttttaaagcaatattctctgttcgaattaaactctagctatcttttacatacctactaatggatattttcatttgggatatcgaccaatcaaaaccacaaattttagctgatcaagatgggatctcaagtttggtaggtatggaaaaatacatacgtacacatccagagagcgaagaatttgtgatgaatttctaataaatatatgagttgttgagaaaacaatatttcaactaatcttatatttataatggtcccatgcatgatacaaacgtggtcgttatctcgtccatatgaccagtgaccacatatgtttcaatacgtgtttcatctcaatgcttcacaacctccatttgtattgttccgcacaacttaatgttatgtacaagttgaatatgcttattatgtagtaaaatgtaaaagacataaatcaattcattagtagtaaaacaatatattctcgttgtcatcagtcattactcatcatttggcaccaaaatgcggaagccaagccagctgtgaatggtaagtatattaatctctattcacatgcaacatgcactagtgtgtcagtaatttggtccatgacaatacacatgtgtgatctagatgtccttgcttcttcaaaggttacagcacaaccatatctagtatattactagaaagagaaaagaaattttgttatagcattcatctaaaatgatcagagaaaagaaattttgttatagcattcacctaaaatgatcagaacaaatctgaatgaaaattcagtatatatatatttagacgtttagattgtgcagacaaaatgtatttagtgctacaactgatgtgtaatgtatggactactttcataaaaagtgcagaataatatgcacggaacaatattattacaagttctaagattattcatatctacaaagattgatatttttaataataaataattcgagtttccaaatcgatttttaccatttttattttaaattgaaaaagcaaaacattcatgcaagaaaagttaaaaacaagttagtggaaccaacaaaaaaaaaacagtgttaatgaatgtcccaagtccgaacttttataatggtatcttttcccatgatttattcatgatttagacaataatagggatttacggattttgccattttttgctataatttttacgaatttgttattttgttaaaattttacggatatactatttttctatatattaaaaaatgttcacatttatgagtctttttttgcttaaatacacattttataagttataacaaataataaattctataaacaaatagaaccgattaatttaaatataataggtaaaacacatgttaaatcgtatttttatattataaatttttttttattcataaaactttagacaaaaattgcaaaatccataaatatcactaagaaaatggcaaaatccgtaattgattccaaaaatatgacaaacttttgaatcttttaaccaaaaaaagaaaacagaggtttttataacaagttcagtttacaattttcaacgtgtggtttctctattagaaccaaaagaataatatatatccaaacgtgcacaacgtgtcaatttttttgttacaaaatgtgaagaacaaaaaaaagtgtgaaaagctggttatgagttatggatctgcgcctataaatatacaaacatttctccatccactccatagccaaaccatactctccaaagtccaagctcacaatgaacacttcgtaagtctctctccctctctcaaaatgttctttttgtctgaaatgtaaacacaattttttgttgctctcgttgctcagcccaaaaatggaaatggaa

SEQ ID NO: 8146 - DNA, 3000 bp, Unknown
  misc_feature (1)..( 3000): cDNA_ID_3047723_gDNA_ID_1621196_Annot_ID_174744 3000 nt of promoter + ATG
gatagcccaacaaaaaaatcaaaatatactgaagacgaatacgacgaaggaaaataacagattaatgaatctgttcgcgtgtaaagcttaccaacattcggaagcaacatgtttttttacactttttcgtgctacttaagtattggttgtatggtttgctgaggtttaatgtatatgttcattgatacatttgtattattgatttcaaattaataaagaatgaagatgttaaataaaaaaatattgcgtaatacatttgcatatatttttttctcgaaaagtggaagcacgactctgttgcgcaagccatactcttttggcattctcttttcttaatgataagaagataagaattcgtgtcgtcttttcttttctttttcaaaagaattcgtgtaatggtctagtcacaaatccataaacaagattaggtttctgattaaaaaaatcttgtaatttttagaaataaatatctgatctcttcccaataacaatttttgtcccattagtatgtttaactcagcgatcacttaatataactcagtcgtcacttaagctaactcaaccattacagaacatatctcagtcgtcacttaatataactcagccattatagaacataactcggtcgtcacataacatatttgccaaaaaaaaagagaacataactcagcctttacagaaaaaatcaaaacattaactcagccgtaacataaatattgataaaaaacagaacataacagagccgaaaccgtacctcaccaccattcgctttaatatcttcagcaatgacctattctatagttgcacgggtacggctaccaccccatctaagcaacggaatctcatccgtgttaacaacgttcccaaaacgctcggcgatggtgatgattgactcatacgcccaagcctgcaacacgaaaaccagaccactgacggtgtacgtcttgccaataggcctcagcaactttatagaaacgacaagggcttcatatgctgcccgaccccatggataagtcttcatggcttcgtcgtcgaaaactcttttggcactctcaaatggtatcctagagttagtatgcaagccaaaaagtccaatggatagaagagtcaataacccaaaccatctacgcttttcaggaggccaagctctgcacgttactaagccctgcctaagttcatctagattatgaccttcaccggttggcacacgcaattcactgaagaacgctttgtagtcagcttcaggctcaaacttttctgtaggcagttgatctatatttaaacccgtgatatgatgaaattcgttcaatccaaaccggatgggtttaccagccacgatacaccaaagctccttcttcagtattctcagctgtctgcatagtagataatgtacggtcttaccagaccatagaaaatgactatcaacaagcttagcaattaatccaagctctgtctctttcagttctgcccatatttcttttcctattgattctctaattgcagggaactctcccagctttatattatgattaatgcctttaccctccagattagaatccccctcttggtaaagtcttggagggtactcccttgcttggtcttcagacatctgtataaccataaatcagccgtaagcattccataactcagtgataacataaaacaaactcatccacagataccataactcaggcaaaacataaatctaactcagccatagataacataactacgtcataacataaacctatctcagccacacataacataactcagccataagataaatctaactcagccatattttaacagaaactcagtcaaaccataacataacaacagctcagttaaaacataaaccagactcagctatatcaaaacagaaactcagccataacataaacaaactcagccgtcatataacagaaactcagacatcgatgtaaggttaaaccataactcagtcacaacataaaacaaactcagacacagatgaattgataaatcataaatcagtcggcaaacaaacaataactcagccgtcaaatcaaatagatcttagaaatcggccaccatatgtcaatcaacgacgacgttaaaacccagctttaaaaactatcgttacgcatcggaaaacgatttcagtgacgggaatcacttgcgattgaacttagatgtcagagtcttacttaatggaaacatactcaccggaacttagatgtcgaatgtgacttcgcgcttacggaaatgcgactgcggcgtctgaatttcggccggaacagacgagaaaagagcaaaacggcgaaagaaatcgatttcgttccgtcgagagagaaagaggaagaaagcgacagttttttttttttgggagatgatgaacagtaaagccaagaaataagaaacccaaacgttatgcggtttggagatgattaatgacgtggattatggtaatgacatggaatgatgacatgtataatcactgtttttttatttaatttttagttaaaaacgaattaaataataataattaattaaaactagttaggggtgttaattgtaattacacaattactaaaaacatctgagtaataaaaaaaagatgtgttctattttaggaataaacatacaaatgtgttttatcttaggaattatttcttaaaaaatcttgtaatttttagaaataaatatctgatctcttcccaataacaatttttgtcccattagtaccaaaaccatatttcaatttgggatttatttctataatatcaaacccgaattttgtaaaccgaaccgggacaggataatgggacaaatgagcacttgtattatcacgtgcattaatcattcaccagttttatagtagatcacagtggttcatatgtatctagacgcaaactttgaatcattcatcaacgcaatctaagtacaaatatagatctcactgcaatgtttcaagcaccaacctgatcatcatcaaaaccatttcatccgtagtggtca

SEQ ID NO: 8147 - DNA, 3000 bp, Unknown
  misc_feature (1)..( 3000): cDNA_ID_2105982_gDNA_ID_1621196_Annot_ID_174740 3000 nt of promoter + ATG
cgtgatcgattcctctctgctggaaatagaatagctgatcttctccaatcttagaggtactcgcttcgtgctctactttcgccgatggattctttacctgttattgttccagaccaaccacaaaacaaaagtggaaatcaatcacaaaagagcaaaaaactttacagctttctcatagcttataataaagattggatcattggcaatttacctggatgtaaggataggtatttgcagctgctttgtctccgataagcattgagtcgcaagtcgaagtatttttagcaccctcagctttggactgcacctgaacaagaccacggtaacaatttctcgaatgcccggccgaaattccctttgaaatgattctacttttggtattctttcctttgtgaatcatcttagtccctgtatcagcttgctgatagttattagtcaatgccacggagtaaaactcgccaacagaatcatcgccttctaaaaccacgctcgggtacttccaagttatcgcagaccctgtctcaacctgagtccacgagatcttggaacgatccccagcgcaaagaccacgctttgtgacaaaattataaatcccacctttaccttgttcatccccagcataccaattctgcaccgtggagtacttaatctcagctcctttcccacaatagagctcaaccacagcagcatgaagctgattcgtatcataagaaggagcagtacatccttctaaatactcaacaaaactcccttcctcagcaacaatcaaagtcctctcgaactgaccagtctccatcgcgttaatccggaaataagtcgaaataggcatcggacatctagtgttcttcggtatataacagaaagacccatcgctgaaaaccgcagagttcaaagcagcgtagtaattatcatcactaggcacaactctacctaaatacttcttaatcaaatccggatactccctaatagcttcagatatcgaacagaagataacaccagacttctctaaagtcttcctatgagtagtagcaatcgaaacactatcgataaccgcatcaaccgcgacattagccaaacgtttctgctctgttaaaggaacacctaacttatcgaaatactcaagaagctgaggatcaacttcatctaaactattcaaagttggtttctttttaggagcagagtaataacacatatcctggaaattaatcgaaggatatctattatctgaccatttaggttcttctagtttcagaaacttagcataagctttgaacctaaactcaagcatccaatctggttcctctttcaatttcgaaatcaaacgaatcgtctcttcagataaacctttagggattgtgaaggaatcgatatcttcaacgaatccgtacttcttatcgtaatcgagattttggaaatactgttgaagtttatcagttgagctaacggttgatgtacctgatgatgatgattcagaagctccgatgggacgagaatcgattccaacatcggctctgagtttgaagatcggtctcgttggatttagggatttgggagatgggaattttaaggattcgggttttgggtgaaacccttttggtgattttgaggaatcggaagtgggttgtggagagaagctggagataccgtttgcgagaagagacgccattgttgttggtgtggctcttaggagaagtaaaagaagattgtttttttttttttttttggagtcgtgtgttagaaaaaaaacaacgattaggaaaaaaatgaagaagagatgaaatgttaatatttatggaattttctgagccgtagattgaagatagtctcgtgtcagccacgagacgatttttttgttggattttcacttttcagctcaattataaaccacatacgttttccactaactaattataaaaaaaaaataacgttgatctcttctttatttgttaaaaatctcttttagatattagatattttttatacttggacaaaacaaacaaagatattagatattttataatccgatttacgggttggtttcttgtttttgttaatgaaaaaaaaaattagtttgatcttttatttcaaaaacttaataatattttattttaaaatttgttggttcattcatttcagtttagtttggtacactgaaatcagttttaattctttttttttctcatctgaattatattagaaactaaagtagaatacaagttgaaatacataagccaacagaccaacggaatattttgagaaacttagctgaaaaaaaggaagtaaaaccaaaaacatatataaggaaacattttaaaccaacgaaattgaatcaagagacaaaattcaaaagaaaataaaaaactatgggaaaaataagacctaaacttctcctaaaaaatgtgaacgccggaaacaccaataagatcggatagattttacaccgaagtcaaaactaatagtaaatcgacagagaggaaagcaagaagccgctgaaaccagagacataagtacaaacaccatcacacctcacccaccagaccgagatagcaaaatgtactagggacaaggcataaaccttgaagatctactagagataattaaagcactagacacaatcagtatcgattctacttgggttagctgattttcgagccataaactatttcgattctcagctttcacccccggacttttgggcccttaaatttccaccatcaactttcatattcccaaaattacatcatctactttcggattcatgcttaaacatacatttccaattgaaccattcatttaaccgggattaaccacaaatccgcgtttactgtaccgcgattgcgattaacccgactaatacccagacccgttaagaaaacgacgtcgttttcatttcgtttaactcatcaaaaagagaaagaaaacgacgtcgttttcattcttcttcttctgcaaaatcgatttggtcgattagggttcttcattcgacaattttataagaaa

SEQ ID NO: 8148 - DNA, 3000 bp, Unknown
  misc_feature (1)..( 3000): cDNA_ID_1810562_gDNA_ID_1621196_Annot_ID_174739 3000 nt of promoter + ATG
caggataattaggtgaaagctggactggtggtgcatccctttgcagtgtcccaaaagcattgaaagtgatagcagcaatcgtattcacttgttcttgcaactgtgagattatatccatcttccaaaaccttaaaagaccttgaacaagtataaaatttacagtaatcaatcacatattagacttttaacatatactcaaaagcaagatataacgttcagagaggatctaggagattcaaatggcacaaaattggtggtcaattcctgaatttatcaaacaagattctcaacaaaactagtgccaaagcataaatcacttaaaaccagttggatttcagagaggatcaaaatggcgaatcctcagggaaaaaattgacctaatcgatttaacgaagcataagctttaacgaagagacttacccgtcgacaagatttctccggcgacgcagagtctgttgggtgtggcaacgacagataatcgctgcgaattggggcgttttgttgttcttaataaacttcgttctgcgttttgggtttgggctcgaagatttttaaaatgggcttttaaggtggcctttcctttggatttttgggccctaattccatagaattcgtaaggaacgatttctgttgtttctttaaacctactgctttaattaattgacaactaattaaaaaaaaaaacactgaagtagaattgggtggctgatttttgagccataaactatttcgattctcagctttcacccccggacttttgggcccttaaattttcaccatcaactttcatattcctcaaaattacatcatctactttcgaattcatgcttaaacatacatttccaattgaaccattcatttaaccgggattaaccacaaatctgcgtttactgtaccgcgattgcgattaacctgactaatacccagacccgttaagaaaacgacgtcgttttcatttcgtttaactcatcaaaaagagaaagaaaacgacgtcgttttcattcttcttcttctgcaaaatcgatttggtcgattagggttcttcattcgacaattttataacagagactaatccaatactacaatttcactccaaaacctcaacaacacctacactcttccccaaagccatacaatagatgcaacaatcacaacagcaacccctacagtcttcaaagctgactttgccataacatgtcctagctcttccacattctccttcatggtcaagagttcaccctccatcttcttaatcagctcttcctccatctgcttagcgtttttattaaggagctccatattagccatcacgttcattctgaggtcactaatattctctacaactctcttacacttctcatttaccatcttaatttcgtccaagagagcttcatcaacccatttgaacaagtgctcttcattttctctctataaaacataatttccaatcatttactccttcaatcaatcaaatatatcacaaaatcgaaatgtgtaccttcattgctatcgcacaacggtagaatctccggtatggattctcctttgttttcgatgtgaatgtaatgatctcttctccacaccaacatttcgaggggacaccaggaggacagacacgaaatcctgaactggaagcggatgagtagtagctgttggtgctcattttcttataaaattgtcgaatgaagaaccctaatcgaccaaatcgattttgcagaagaagaagaatgaaaacgacgtcgttttctttctctttttgatgagttaaacgaaatgaaaacgacgtcgttttcttaacgggtctgggtattagtcgggttaatcgcaatcgcggtacagtaaacgcggatttgtggttaatcccggttaaatgaatggttcaattggaaatgtatgtttaagcatgaatccgaaagtagatgatgtaattttgggaatatgaaagttgatggtggaaatttaagggcccaaaagtccgggggtgaaagctgagaatcgaaatagtttatggctcgaaaatcagctaacccaagtagaatcgatactgattgtgtctagtgctttaattatctctagtagatcttcaaggtttatgccttgtccctagtacattttgctatctcggtctggtgggtgaggtgtgatggtgtttgtacttatgtctctggtttcagcggcttcttgctttcctctctgtcgatttactattagttttgacttcggtgtaaaatctatccgatcttattggtgtttccggcgttcacattttttaggagaagtttaggtcttatttttcccatagttttttattttcttttgaattttgtctcttgattcaatttcgttggtttaaaatgtttccttatatatgtttttggttttacttcctttttttcagctaagtttctcaaaatattccgttggtctgttggcttatgtatttcaacttgtattctactttagtttctaatataattcagatgagaaaaaaaaagaattaaaactgatttcagtgtaccaaactaaactgaaatgaatgaaccaacaaattttaaaataaaatattattaagtttttgaaataaaagatcaaactaattttttttttcattaacaaaaacaagaaaccaacccgtaaatcggattataaaatatctaatatctttgtttgttttgtccaagtataaaaaatatctaatatctaaaagagatttttaacaaataaagaagagatcaacgttattttttttttataattagttagtggaaaacgtatgtggtttataattgagctgaaaagtgaaaatccaacaaaaaaatcgtctcgtggctgacacgagactatcttcaatctacggctcagaaaattccataaatattaacatttcatctcttcttcatttttttcctaatcgttgttttttttctaacacacgactccaaaaaaaaaaaaaaaaacaatcttcttttacttctcctaagagccacaccaacaacaatg

SEQ ID NO: 8149 - DNA, 3000 bp, Unknown
  misc_feature (1)..( 3000): cDNA_ID_2176089_gDNA_ID_1621196_Annot_ID_174737 3000 nt of promoter + ATG
ctacaactgaatcattgtaacttctatcaaaatttgaaaatggtttaaatttaatcttttaccaaaaagtaaaataataataagtttgaaatgtttcctttttgtaaattaattgtttttgattaattcaaaaaaagacttttaaaatataagaaattttttcatccaaatagatagaaataacatattagttatctcatatcatatatttctctcaaatgttcatcgtattcatttgtagtgacaaccatttgcatcctataaaccccaaaaaataaatcattcgtcaggcccaatcatgtcaaaattaaaatacttgaaaaatacacaatcctatatcatagctgacgcatttatttcatacggcatgccggcaaaaacgtcaacagaaattaaataaaaagaaaagacaaaatttccaccggcaataagctttgaaaattatttcatatagtactaataataataaccaaaaataatgctgatatgaatgaaaaaacaaagaaacggtgtcataatgatgggacaagcagagttgagatctgtgtgagtgagtgattacctgaaaagtcaactcaccggcttaagaactcggcttttgccagctctctctttttaagccttctttaatcaatcatgaaacgatcctcttgtgtagttgcaataagttgctatttttctattgaattttgtattacaaaactaattcaacaattatttacaactaatttcctcaaaagagctattattcagaccagtttgtatatagtgtcaatagaaataagtgtggagttctttacagaatccaattaaatcctgaactattttaaaaattgtctctaaaaaatgacttgacatactaacaacaaaaagtattttaaggtagagattcaaattcgtcaaaagtaaccaccgatgggagatttaattgggactctagtcactgaaagtcgaatctggagatcaagacggcgaagaaattggtttcaagaggttagggtttgattaagagagaattgctaaaaaagaagaaataggttagttttttttgtagtttctcaaacataataagagtacttttgtcatttaccagatataacgcgtttgacgctgactttcattagcatctacaattgttagccgcaggatgctgagtttgctgcagctacttgcgtcaaccaaacgaacatacatactcagttacgtttgccaccgccacaacaacatgtgatgaccaaacgaacacgctaattatacacgacaaggatcctcttattcttcttgcgagtcatgatcccttttacaaatttataaaccttgtgatattatcttcactaatataaaacttcatatgggttgcacaagtttgcaaatatttctagctttcgaccaaaagcccaaaataatctacccctctgccaaacaaagtcttccaaaattttcttatttgcttcccattagaccatttgtagctatatgcattaggttcttttgaaagagaaagaaaaataagagaactgcatcatgttagtcttgatatctattcaattatcgtaccctaaatttaaaatatttcttaccaaaaaataaaaattttggaacgaaaagcgagaaaaaactcggcttttacgaaaaacaaatatctgatgacaaaaaaacaacaaaatacaaatatctttcaaattggtaagcaaactctttaacaattactaatccgagttagtttgttttcatatgtcatatcaacaaaatccatcctacatacctcagatttttagaaaaccgaatccggatttttgtagtctacaacttaaagacactattgaatctacaccatataagtatagtgaactgtaacattaataaacatgttcacctaaaaaagaaaagaaaagaaaagaaagtaaattatcaacaataatgaatacttgttttcttaaacgggcctaagtaacaagaaaagcccaatacgtgaaacataagtatattcactaggctataagcccataaaacatatgttgaatagactcacgagtcacaagtccccaagtctcaacagacggtggatgatgctccgagtctgactccggagaagaaaaagtatatgtgtgggattggtagttgccacgtgagtacgtgaccctgcgtggtagttggctattgattagtatttgttttgatgtccccagtccccacttttgttactgagctcgacgttttctttcttagtaaataattgattccaacctaaagcgttgtctaagatgactttagtttttataatattgtcgaaaacgaaaatatgttttttataaaatgcatgtttgttactagcatagctcatatacattatggtccgcagtaaaacaagattctgtttactctacttgaatttcaaccatttctcatgttgaaagttacttacttgaacttggacattgaacatatatagatgaatatccaaaacttaacacaccaatgattttagaatttcatgtgtctctcttattgcattatttaagaaaatttgccacttatgatatgaactaacaccagtactaattccccaaacatatttattaaccaattattttcacgcatttatttgaagattcgaattatgatttttgtcttttcttttgagtaagtttttttttttttttttgaacaaagagtaagtaatacttaaaaacaattccatgtccataaaattttactttatcaaaaaagaatactattaccataaaagaggtaacacaatctgtgttttaagttccactacttcaggagaccaacaatcttccaaactcaaatacaaaaaggtttgagactttttccaagatttgtctcttctttctttattctacctctaaaacaaaaatcctaatcgagttctctataatattcaataaagattataattcttcttttatcttttgataaaacttgtgctttcatgtgattgtgtttcactttgatttataatctcagattccaaaa

SEQ ID NO: 8150 - DNA, 3000 bp, Unknown; identical to SEQ ID NO: 8148
  misc_feature (1)..( 3000): cDNA_ID_1810562_gDNA_ID_1621196_Annot_ID_57568 3000 nt of promoter + ATG

SEQ ID NO: 8151 - DNA, 3000 bp, Unknown
  misc_feature (1)..( 3000): cDNA_ID_1810552_gDNA_ID_1621196_Annot_ID_57571 3000 nt of promoter + ATG
aaataaactaaattaaacatacaaaagataatctttacggctcggttaatggcaccggggagtccttcaaagaaagctggccagccgcatccggcgtcaaacttcgtggtggatttataaagaggagttttgcatccgatgcagctgaagattccttcctcaaagaacttgtcatattcttctgttcccggcgttctgaaatatttttaaccataagaacacttggattgaattgtattatgcatttgtatactatgtttcaaagtaagaactgaaataaatcaccccaaaaatcgtaacaaaagaaggagcaatctatacttggataaatctaaaaacaaagttctatagtaactgagaaaaccaataaaacacttaggtttagggtttagggtttaaggtcgttactgtttgtttgcgattgcgtttagtgtagttttttcttttcaaaataaatcaacaatcttaagcattctaagctaaaaagactttgttaattgaaaacataaacgcaaaacgcaaaccgtttgcagaaaccgcgtttgaaacaatcaaaacaaagaccaaaagcaagaagcaacactacacttgtttgatgtgcatctagatccaattttcccctaattttgttttcaagattcagtctatgattacttgaagcctaattacagtgcttatccttgaaaaggtaacaacatagtgaacctatcaaaaatcaacaatcttctgaatccaatctttcaaaatatgagtacataaacaacaaggcctaacttgagatcacaaactatgaaaccctaaacccaaatttataaagaaaacaaagacttactcagtgcccttttgacggagaatccgaaactgttcaggagaaagaactgcacgccactcctcctctgtttttttaaccaccgtcacaagatccgccatgacaaccaccacgaagaagctactacaacagagagtaaccagaagctgaaatattaacagaggcaagcaagcgtaatgatcaggtaggttcttgaatcattacagtgatctatttgtacataatttcagtgatgtatggttcctagttttgagtctagattcatatgaaactgttgtgaatctttagactggtgtatcatgcacgtgtcaatagagtctcacagatgcgtaacatagtatagattttgtattacaagacaagagtgtgttttattcaagttacaaatcatacatactacagactacagttgttgtcaaaatgctcgaggtgatgaatttaaatagtcatgaaagaaaaaatacagtacacagtatagacacacacactcatacaagattcttgttctgtttttctcccactcacttgagtgaaaaaatccagagaaagaacaaataatcttgttcggccaagatttacaaggaagacgctgcgggtgtgaacttaagcgaaacgctgttcacgcaatggcgttcatcggttggagtagcgaaaccttctcctttgaaaacatgaccaagatgtccaccacatgttgcacagttgatctctattcttctcccatctgggtctgtctgataaaccaacaaatgtaagcaaaatacacaaagaagagagagttcatttttgttaccaatttgatgaaaaaagtgtttgtgctctgagagtattttctttaccgttcgggtaatggcaccggggattccttcaaagaaagctggccagccacaaccagcgttgaactttgtggtggatttataaagaggagcattgcatcctacacaaccgtaaactccttccttgtcgaagttgacatattcccctgttcctggatatctgaaatcaacaaaacacaaacccgcaatataaacattcattccctattcaataagatatccaaatactagaaagaccaaaaccccaacgacgaactcagacatattaatggtcatttacatagcaatccattctaagacagaagctaataatagtaaaggctctataggaactgacaaaacctgacagagcaaccaagttctaaagtcgagctcttaaagtcgtagcacattcttggtaaaaccaatactcagatcttatctttaataagaaaaaaaaacaaactcatctggagtttaagagtaatgaaagatagtatccttgaagaactataacctttcatgtaagcttatcctaacagctcaacatctataatagcaggaaatttgtattgtttccaatcactcaaaagaatagactttatcctaacagatcaacatctatagcagaaactttctatgtaatctacacagagagaagatctaatcatcaacatagtgctcatcatcaagacacacccctgaaaaataaatgttccaacaattggcaaaaaaaaaaaagttcaaacctttattaactctgagaatcacaaattaagcgagttatgaaataaaaaccctagatttctaaaaccaggattcctaatggaagatagttaccaaatttgctcaaattttgaaagctaaattgaaccatgaaaatcgctgaggaaaggttaaaaactttactcagtgcccttttgacgaagaatccgaaactgttcaggtgaaagaatcgcacgccactcttcatctcctttctgaaccgatcccggagccgccattgccaccgtcgaagctacgccggaagagaggcaaatcgaatcggattcaacgattgacgattgaagaagaagaagtagcgtgaatgataaaaagagaatctttgaattgacgatgttcatcaataaatttataatctttgaattgaagaatccacaagacaaaatcaaaatttgacgattcttcttcaactaatcttgttaatttacatgattacccctaatttatatgattgattaaattatcacccctaaggtttaaaattggatagaacaaccctgtcggggtttttgttcagggttttataaacttgctcttcttcatcttctcaatctcacttgaaatccgaacatg

SEQ ID NO: 8152 - DNA, 3000 bp, Unknown; identical to SEQ ID NO: 8146
  misc_feature (1)..( 3000): cDNA_ID_3047723_gDNA_ID_1621196_Annot_ID_57574 3000 nt of promoter + ATG

SEQ ID NO: 8153 - DNA, 3000 bp, Unknown
  misc_feature (1)..( 3000): cDNA_ID_1810547_gDNA_ID_1621196_Annot_ID_57575 3000 nt of promoter + ATG
tttcaaaggagaaggttacggtaatccaaccgatgaacgtcattgcgttaacagtgtttcgatcagttttaacccggcaaaatcttcctctataatctgaggatatgattgatcgatcatacaacatcttctaatcagattgtgttgttaaaattgtcatcatgtagtgaatatgcactttctgtggtggtcaatataatgcaacaaataataagactcattagatattggatggttactggtttctcttaatatgttatagaacatttaataacgatttaattatctaagggatcattactagtgtttcttaattataactctttagaactgaaaaaaaatattatagagatttcgttttgacagaaaaaaactcaaaccgatccattttactttccattttgagtgtgttgattttaaaaaatatgatacgtttttattactaatgaaaatagaagatattatttccaatagtggatctcatatgtgtatccatatcattattttcataattgcgtaaaatatctcgtttcatatatatttgtgtgagataatgggttgagattaggagtgggcattcgagtaagcgggtcgggtttgggtaaaatccaatcgggtacgggtttttcgggtagataaatttaggacccaatagggtaaatataaaatatcggttcgggtttaatcgggtttggctataaatttttgggccttattttgaaactgatagccggatttccgggtaaatacccagatttttcgggtaaatacccggattttcgggtaaaatttcgtgtttcaggtaaaatttagatttttgattaaaatattcgggtatttttgggttcgggtttggatcgggttcggattcggtttttcggatagaggaatttaggacccaataaggtaaatcttcgggttcggtttcggttccaattttttgggtcagtttcggttctggttgttggttccgattttttcccagcccctaattgagacgttggtttgtttgccaataatttgtcatgtggaaaagtactcgaatgtgtttttgattcactataaatggttgtcccgttttgagtttgataattcattagcatgtgactatatcatatatctatttattacactagaagcattattctctttttaaagcaatattctctgttcgaattaaactctagctatcttttacatacctactaatggatattttcatttgggatatcgaccaatcaaaaccacaaattttagctgatcaagatgggatctcaagtttggtaggtatggaaaaatacatacgtacacatccagagagcgaagaatttgtgatgaatttctaataaatatatgagttgttgagaaaacaatatttcaactaatcttatatttataatggtcccatgcatgatacaaacgtggtcgttatctcgtccatatgaccagtgaccacatatgtttcaatacgtgtttcatctcaatgcttcacaacctccatttgtattgttccgcacaacttaatgttatgtacaagttgaatatgcttattatgtagtaaaatgtaaaagacataaatcaattcattagtagtaaaacaatatattctcgttgtcatcagtcattactcatcatttggcaccaaaatgcggaagccaagccagctgtgaatggtaagtatattaatctctattcacatgcaacatgcactagtgtgtcagtaatttggtccatgacaatacacatgtgtgatctagatgtccttgcttcttcaaaggttacagcacaaccatatctagtatattactagaaagagaaaagaaattttgttatagcattcatctaaaatgatcagagaaaagaaattttgttatagcattcacctaaaatgatcagaacaaatctgaatgaaaattcagtatatatatatttagacgtttagattgtgcagacaaaatgtatttagtgctacaactgatgtgtaatgtatggactactttcataaaaagtgcagaataatatgcacggaacaatattattacaagttctaagattattcatatctacaaagattgatatttttaataataaataattcgagtttccaaatcgatttttaccatttttattttaaattgaaaaagcaaaacattcatgcaagaaaagttaaaaacaagttagtggaaccaacaaaaaaaaaacagtgttaatgaatgtcccaagtccgaacttttataatggtatcttttcccatgatttattcatgatttagacaataatagggatttacggattttgccattttttgctataatttttacgaatttgttattttgttaaaattttacggatatactatttttctatatattaaaaaatgttcacatttatgagtctttttttgcttaaatacacattttataagttataacaaataataaattctataaacaaatagaaccgattaatttaaatataataggtaaaacacatgttaaatcgtatttttatattataaatttttttttattcataaaactttagacaaaaattgcaaaatccataaatatcactaagaaaatggcaaaatccgtaattgattccaaaaatatgacaaacttttgaatcttttaaccaaaaaaagaaaacagaggtttttataacaagttcagtttacaattttcaacgtgtggtttctctattagaaccaaaagaataatatatatccaaacgtgcacaacgtgtcaatttttttgttacaaaatgtgaagaacaaaaaaaagtgtgaaaagctggttatgagttatggatctgcgcctataaatatacaaacatttctccatccactccatagccaaaccatactctccaaagtccaagctcacaatgaacacttcgtaagtctctctccctctctcaaaatgttctttttgtctgaaatgtaaacacaattttttgttgctctcgttgctcagcccaaaaatggaaatggaaatgaaa

SEQ ID NO: 8154 - DNA, 3000 bp, Unknown
  misc_feature (1)..( 3000): cDNA_ID_1810543_gDNA_ID_1621196_Annot_ID_57576 3000 nt of promoter + ATG
attagtcacgtgtataggaaagtgcagacgggttagctaactatgcttttttttgtcattagagttttattctttggaggttgttcctattgattttgtttctgttgtaagcgatgatgtgcttaggttgggtctacgtgactaaggcaagtgtctatgtagtttttttttgaagttttaataaaatttagatagattttttcccggtgactagaagcttcatcgagataggagcgatactacgaataaggtatatggggcagagtgccctaccaaaaaaaaaacactaaaaaaataatgaagatatgtggagtttaatgtagttattttgaaaagaaatgtgattgaatcctaactatactcatctaaccaagcttataattcgtataattcgtataattcgtattgggctgcatgtttgagaaagactgaccatattttttagtatcataaagttcgatcagtaaaaataagaaatgatagcttagttagattctagtaatactatcatgttttaattgtttatatataacaattgtatcttacgtaatataattcatataacaattgcatgttgtaaaattataaaatatcttttcatttaaaagattcgactaaatacatatctcaaaaatgacatttttagtatttattaaataacaacaattgtttttaaaacacatgcaatttgaattgaatgaatgaaaataacacaacatcactagaatataaatcactactttagaaaatcatagtcaatgacatactttttaaacaatatttttgcaggaggagagagctggattaagatatgagataacttgcacaaaatgtgatggacatctaggtcatgtcttaaaaaatgaaggttttccaacaccaactgacgaacgccattgcgtcaacagcgttgctctcaagttctcttccgctatcacatctcagtgataaacggatccggtttagttctccggaatcaactctatctatctatgaacgttgattactaagagacctttctacttctgttagaatgagaacgttgtgttcttcaattcatcgcatttatgaactattataaaattgaatgttttgtgttttcattatttttagtaatgcttatgtacgtatcattgaaattgtttgtgtcatatattgtgccatttttctattgagtgttaatgtattatcgtatttaccaaaattatatatagttattgtctaagtctgcgaatcatttgccatttggatacacatgcatgtctaaacaaacgtacacatggggatgtgaccgaactatttttttgtttgtttgttcttttaatatcattgacgtttttaccttacttctcaattgttcttctttttccgtaatcgacaccgtagagtttcgacgatgacatgacgcggccaaattcaaagcaattttaatccattcagttcttgtctatgattagatgccttgagttccttcctgtcatcaaaacgaatttaactagatccattggattttcaatatgttggtggcggagatgtatttttttaatcgcaaacaaaagagataaagtttgtgaaattggtagagaatgtgttgatggagttgacagatatggtgatggagttgatggagaatgctttgatgaagaaatcacggtgttgatgaagtaatcgcggtaaaacaaagtgatggagacaggaaaaaaaatgacggaaacgatgatgaacggtgtttgagatagggtaaaattgtcaataaaattttaataagtatccaatcctgtaaacccaataagagagtgtcatttttcaaaatttttggccccaaatatatctgattgtataaaagtccctaccaatcacaccctatgttttccgttattgttttagtcatatataccatattcaaattttatgtaaattttatgtaaatatgttcttcaaattttttaaaaaatcctggctgacccggtccaagtatgtcagttagctaatagttgtgtttgttagtcggagaagtctatttagctatataccacctttcatgatactattactatcccctgttgttttttttactaatacgttattgggatgagatgccatctaaaaggggaacttctccaattctgttcgttgggaccactccagattttacaatcccggcttatgagttttgagaccactctcacttattttatctacattttgtaagagtgccgtgtttcatacttagttatttctctgataacaaacaaattggggttctgttcttaaaatatataaaagcccgtgaggcccaacaaacggaaagtttggcccgtgaaagaaagaaaaacaaaacttatttattgaaaaatgacacgtgcagaatcatttactaaaccagacaataaccggttaacggtttaatagttagcaacagaagaaccaaaggattgtcttcttccacaatcagaatctgtctgtgtggcttgtaacgcttcaatgtcagtgaagtctttagctatatccacaaaaataacataacaagattaaaaaaaagagagaatattttatctctctagacttgacaatttccctctctttctcactccctatacctgtatatgtatatagaatcgtatatatctggagaaatacacgaggtgttctcgtctctgacgacgtggtctattgtcttcctcagctttagtcaatttcttctttcggaaacttggttctgtgatattatccaaacttaaagtttgagtctttagggtttatgggtgacaacaaaagtacatgcctttaggctttagttttgtgggtttcatctcaaaatggcaattagtactatgttagggtccatctcttgttgcccctctcccaaggtatttccttccttgtgcttacttgtgtatctgtcgactgaaaaacctctcctttatgtatttaagtttatgtgcaaagccttaattggtgattgaatccttagttctgatttgatttcaggggtatgag

SEQ ID NO: 8155 - DNA, 3000 bp, Unknown
  misc_feature (1)..( 3000): cDNA_ID_1810536_gDNA_ID_1621196_Annot_ID_57578 3000 nt of promoter + ATG
tcttacgagttttgtttccattaactctatctttcgtatctgcaactttctgcaattgcactgatcaattatgaatttacccaatttgatattttgaactgatgggtttcgtttcttttgatgaatcagagagcttgctagggttcttggtgagaaaggcgttatagtgtttgctgatgttgaacatgtcattcaaaaaagtaagagtctttaattttttgaattcgttgttctgtattttgcttaagttttagtctactctagtgtcgcaagtagtttctaatgtttggtatgtgtgatgatgtttttttttaagatgatcgatctttggttgaagtcttcaagttgtttgatttgatccataagctcactactgatcacaaaactgtgacaaggatcacaagagaagtaaaaccctaattctaatttccattcattagcttgattttagtaattctatagacttgactgatgatcttatcttgacaggttgtggaagattttgctttagagaatgtggtgtatcttgagttacgaactactccaaaggtacacaccttttggcatattttttgcaagtggttaagttatatgaatgatggagattgtttgtttgtagaggagtgattcaataggtatgagtaaacgttcttacatggaagctgtaatccaaggtctaagatctgtcagtgaagtcgatattgattttgttaccgcatctgattctcaaaaactgcacaatgctggtgatgggattggaagaaagaagatttatgttagacttcttcttagtattgatcgtagggaaacaacagagtccgcaatggaaactgttagtgtttcaaaacaagctaagctactcagaatacttaaaagactaatgcagaaaacatttgatactctccttttttctttaaaggttaagctcgcattggaaatgagagatgtcggggtagttggtatcgatctttcggggaatcctcttgttggagaatggtaaactgttcttagttctcctctttatcttttgcttcgctttatgagttggttttgaaatcttccatgttcttgtaggagcactttcttgcctgcattacaatatgccaaagacaatgatcttcacatcactcttcactgtggagaggtattaactcttgaaaatccacttaaccgattttcaaatgtttatgtttcagattgtctactactttctctatcttagtgctttgtaggttcccaatccgaaagagatccaagccatgcttgattttaaaccgcatcggattggacatgcctgtttcttcaaagacgaagattggacaaagttgaaatctttccggattccggtaatagatttgcatgtaccattattctctgtttcttataatctctttaaccaatttcaagagtttgctatgttttgcaggttgaaatatgtttaacatccaacattgtaaccaaatcgatatcttccatcgatatacaccatttcggttagattttctctttccgctgcttcgttttctacattcctccttgttcatttaaaatcaaagcaatcttgacaagatcttagtctgatcttaacagctgatctttacaatgcaaagcatccattgattctatgcactgatgattttggagtattctccactagcctctccaacgagtacgccctcgctgttcgttctcttggtgagcttccagaacctgagctcaaatccaacagttacagagcttttctgatttttgagaattgtgattaagtttagattcacaaagaaactacatttccaaataatctaattttgtttcttctgtgaaggtcttagtaaaagtgaaacctttgcattggctagagcagccatagacgcaacatttgcagaagatgaagttaagcaacaacttaggttcatttttgattcagcctcgccagagcacgtttagtgagactgttgagtgcttcagattttaccggtttacttcattttgttggtttataccaaaccgaacaaaaggtgttttggttcattggttggttcgaaaaaataacattcatctcgaatattgattgtaataatataattataatttaaaattttcaaacttttgttctctgttaaaaataaaaattgatttcaacaaatataggcataggtctggccattcggatttcggatcggaatcagatcgaatttttttgaattcgcataatttggatgaagaagtttattatccgttcggattatatgactatacagtttggtttcggtttggatgatattggattcagatcggtttcgcaacagtttttgagaaaaaaaagactaaaaattgtttaattttaataataaatcgtttacttttactaaaatttggtttaagtttgcaaactttgtataattataacaaatataactaaaacaaaattggatatcaaagttatttcagatatttgtgttatttattattttttggttataaattataactaaatataactaatatttttaaatatataattttatttcggattagcggatatcagttcgattttcggttcagatatgattcggttcgaataattcagataagaaaattcgttatccggtcagattttttaactttttggttcgatttcgaaaccgaatttttcggatcggtttcggatttctgattttatgctcagccctaaacaaacatttgatccaattttccgaatcgggctgaacgttgctaatccgatttcttattccggttaatatcccgattcggtatagctataccgaatgatctcaccacgtgtacataaagcatccacgtgtttcatgaagattacacgtggcacaagccagcagcgaaaacctagtcgcctctctgatacatcttcttcctcctttccggtgttaaaggaatcaaaacaaaattcaaattcctaactaaacagtaattaaattaaaattaatgaggaagacgaagctgctttgttgatgatcaatg

SEQ ID NO: 8156 - DNA, 3000 bp, Unknown; identical to SEQ ID NO: 8144
  misc_feature (1)..( 3000): cDNA_ID_1810528_gDNA_ID_1621196_Annot_ID_57580 3000 nt of promoter + ATG

SEQ ID NO: 8157 - DNA, 3000 bp, Unknown
  misc_feature (1)..( 3000): cDNA_ID_1810684_gDNA_ID_1621198_Annot_ID_57596 3000 nt of promoter + ATG
ttttctctattagtggagtttcgtgagtgagtgatcttgtgccatcgggattttgatcgttcctacttaaatttgagccggtatcgatctaaaatttcaagtaaacctagatttgaaaatcggatgctttaatctggatcactcaaatgtcgttgatgtagacatattatcacaacttgacgtttataaatagccagaatgaaataagaagatcgcttgaactttaagaactaatcgggggtgataattgagcagctaggatccattgtccttaaaacgttgtttatttagttgaatatgtaacggctatggagatctataatccggttttacatttcacatactctagattagtttcatataacggctatggaaatctttaaccatctatctaccagtatgcataagctaatttaaccttttaccaaaaaaaaagtatgcataagctattagatcatagcgtagtgttcattttgcagtagtcttgtccttgaaccgtactacatgagtccaccatatgattttttttttctcggctatggagttctagttcctttagtctattcttaatttgcagaatatctaggaagagttgctaattaattcccatgtttttggtattcaacagaaacattgttcaacagagatattaggaacaatcattcacaaaatgagaaggtaatttccgtatcaacagttactggatgaatctttatcttttctacttccactgaatagctttttctcccaattcagtgtactctctgattaaaatcgtgagtcattttgaactatatcattctcctttccagattttaatttattctaaaaacggtagaaactcagaatatgtagatcttcttttttttgtacaccaaatagataccttaaagtcagagtatgttttgcgcatatacatagattgtgagtgcttcgctaaagaatcagccgagacatttgctgatctgggaataaaactacaagagaagctagaaagcctattaatgcagataaatatgtcactcagaatatgtagataaatagtttaatttgctgacctttttggttctatgatttgaaattattctctgagacatattcttgattgatcaagttctttttcaccttttatgtccctctttttcccctataattcaaatcagattcttcttttatgatattacatctagttctttgttttttgaaattgataagtggagggataacaacgagactggacatggaagaaagttccaaaataaagtagctcatagtctgaggataataatctttaaatgtttctttggaaccttcattttcatttctttattacttttgtttcttgtctgtgctcgtttcaaatcgagtccattgcattacaaaactctctttcgggcctttgtgctctgccttaattttcttttgttatttactcttttctttgtcagaacaacaacaatatctaggcaaataaaagaggtttttaaattctataatcgttatcatagtttcattatttctatatgtttagacagaaatgttgtcttgattgaatcaaggttcctttcttagaaaaaaaagaaatgcatgtcggctttcatcttacttttaattggaataagtaaactaaaatctttattcatcacatgcatttgcatgtatatatatatgtatacgttatccattgcttttgctaggttcatgttcttttttttgtgcaataatggcttaatttgttaatccagcttgcagattgcaatttgactgcaaagtttccccacttccataactatatgtatgtgatatcaaatcaattcattatgacgagcgaactcttgacaactatctttgtcagtactctgctttatttggtcgtttttattttgcatgaaaaaggtcaaaaaaagctttactcatttggatattgattagtattacacaaagtcttagtttggatatattttctcaaatgtttccactgctttcaacattcatttgctttggggataagtcaaataccttgacaattaactaattccctaactaaatatctcacctttgtttattagtgcttttttggtgaattaagtgtttttaatttatcccgaccccattgtgatcttgttctgtcacatttaattacgtatatttagtagttttattactaccattttgatagacatatattcatgcatgttaagtaccaaacaatttgttgacagtttaggtatggcgtgtttggaggatttgaaaagttgatggagctccaagagaagatccaagtggctcatgtttcttcaggttactttgctttcatgttctattaacataaataatctctttggttggttccttatttttttcttctttatcggaaagttacatattacgttgtttcttagccacgcctgatttgaattaaaggctcactgaccaaaacatccaagcccaacttttgctaaagcatataagcatatacctatgtcagtttccggcgacttttcttttttgctcttttttgaaccaaaacaaatttctagctaatgtagaaatttatactttttaagaaaattactggacttgtaacaccattagtaataagataagatgagacatttgttttgtttatatgaaaatatagtcagtaataactgttttttatgttctcttttcaacttatttttaattctttttggctttcaactttgcttctttttgataaaagacacatatattgttcctaatctttattgtctttaattttgaaaaatgccacaattaaattttgaattaaaacttcttttaattgcccctttaatgttctccctgactcccaaatctacacgaaacactaggaatagagaaaaaacaaccctcgggtaaagacagagcataaaacacttgtagtgtagatataaaagacacacctcagagaagagaagagcagagagagagagagagagagagagagaaagaaagatccaacttccacaaagaacc

SEQ ID NO: 8158 - DNA, 3000 bp, Unknown
  misc_feature (1)..( 3000): cDNA_ID_3088685_gDNA_ID_1621198_Annot_ID_174794 3000 nt of promoter + ATG
aaatttcaatcatatacattcaattttactatacattttaactatttcttttatcataataaactgccttttaactctatacactccaacttattgatgatatttgaattttaaatagtaactcatatttttttcagtatttaatttagtatttctttaaaataaattttaatcttacaacttcgattttacaatacaatttaaatattattttttatcataatagaatacaatttaattcgattgtatacaattcaaatacaatccaaattttcaatacaaatacaatttaattctatacactccatcttattgttagttttcctttttaattaataaaattataagttaaatttttagatatagaaatataaattagtatatgtaaatatgtttatttattttttaaagaattttttttgacatatgtcaacatctcaatgatagacctgacacgtgtcatgatctcgtgagttagtaactttcaaaactgtactttatataataagatatatgcttatatgtttcatatatatatatatatatatttattagatcgacaataacattaaactatcattactagtttacttttttaaatatgattttaataagtatcatataaatgtacaaagtgtatacaatacatgtttttatatatatatatatatatatattttttttatatataagcataaatatatagacgaacaaacaatgtagacagacctaggcacctagctatgatctatgcatacggacgaaccctattatacgtacgcatgattattgaatataccttcaaatataaacttgtgagcgtaaggttattatgttttcaatactgacgaatgacgattgtgattcatgttttgaaaaattaataaagtttaaaccatcgaatgcgtaaaccaattattcatcttttaccttaggaaaaagctggatatcattatcatatatttattaagcatattaaaccagaccaatgatttaagtcgaaaatgacagctttcaagctttgcttattggccaataaataacaaactaaaaaaagaagaaattttttaaaacgaactggtgaagtctcgtgttatcacgtgcatggagccagtcagacagagacatcatcaggtgcatgatggaccacggtagtccatttcttccctacaaccatacacgtggcctttttacatttaacagtcaaacatctggtcaacaacactctcatctgggcttccttacatcaaaccctactttttttttgtttatcaaaggcccaattgtatataagtgaaaagtttccaatgggcctttcaaggattattcccagcccaatatttctggagattaggtttatttatcatcgccaccaaagaaatttgagccgaagcttcataatcgtagtctgaggtatttttctcgatcctcaaacatttccaacacctaaaggcttattcgttacagatttctcaccaatcttcggatttattgtgctcgtacgataagcatatattagtaaatttagtggctatttaggaaatttctcgtttgatttcttgttgttgttgagatttgaatctgttgtttatggtttttgtgattacttggttttgcagagacaatgtcgacagtcggagaacttgcttgcagctacgctgttatgatccttgaagacgagggcattgccatcactgtatccttaaatctcttgacattttctgaatctcatgtcctagctattgttgtcgctatatcttgttttggttggatccttttcattatcgagacaacatggtgtgagtgtttattttaggtttatggagctctcttttgatgaaatagtcagtaccaagattcatgtttgctttggcacactcaattgttgggcatgtgttaaatgacctatctgcaaagttgttggtttagggttaggaattaggattcttttttactggatttaagaaacgtgtttgttctattagttttgatatgtaggttcaatgtttgggttaggtatccttaaccctattattgatagtctgataagattgcgactttggtcaaagcggctggtgttgagattgagtcttactggccaatgttattcgccaagatggctgagaagagaaatgtcacagaccttatcatgaatgttggtgctggtggtggtggaggcggtgccccagtgtctgctgccgcacctgctgctgctggaggagctgctgctgctgcccctgctaaggaggagaagaaggtacaaatttaaagaaacaaaaacattatattgttatatcttttagctaggtttgcttattgatactctctatgttgtttaattgtttgtaggacgaacccgcagaagagagtgatggagatcttggtttcggcttgttcgattagttgtctcctttcattttacgtttcatatgttctattgctttagttgctttgagattttaagttttgtcatttcgacactactacagtttactcttatatcatgtactggagttagcaattggctcacgaccttctttgtagttcatgagagttatcttatgctcaaaatgcattggagcttattgaatttgacttttggattcagctgcgtcttctttcctaccaaatctcagtctatttataatttgatcttgaaatagaaaagaagaacaaaaaatcaggaaagatatgaacatctgttacaacttgataattcagtggatacgcaggtttcatgaaccatggtttctcagaagttttgtaagttttttactgattatactaatgttgtcaaatgtataaaaagtaaaaattgaaccttctgcataatccagaggctttcattttttttttcttttcttcttgtgatggactcgttttagctgaaattagaacgtcggttagtaccggcggagaatgttcggagtcgagtcagtcagagagttctgataataccaaacggctactttgaagttcacggctattaagaagtcgcac

SEQ ID NO: 8159 - DNA, 3000 bp, Unknown
  misc_feature (1)..( 3000): cDNA_ID_1393284_gDNA_ID_1621198_Annot_ID_174793 3000 nt of promoter + ATG
gctcttaatgctcttcttgcctatataattcaaagttaaatccaaaacctgtttgattactaattaatcaaatgtagttaagggagaattttgctcaccaaatagcctctgaaaccagtttggattacaacagctgcgtaatcttctcttgcggtataagtacgtcttgtaagatttggtaactccttcgttgtcgaaggaggatgagtttccgatgcggcggagacggtggccggcggtgtagatgcgtcgtacctctgttctgtaacagaggataaaacggttgggttgatgatcgtcgttgtttctgtggatttctgcgccggagcgtcttttccgacgccggaggtcttcaccggagagtcatgattcgtagattttctaaataaccaacgtctcttctctttcttctgcagaaacagagcatatgaattatagtaatatacaaaacagagaaacaagaaacagagcatgtgaataaaaaaacaagaattaagaagcaagatctcgagactagagaaagtatacgaaccttgtcttcatcttcgtcgacttcattaccatgagcattgttgttgtgttctttcttggtgggagatcggaaagctcgtttcacggcagtgagccaagaagaagaagaaccgctcttcttacccattggaggttaggtaggatttaagattctcaacagagtcaagacatggtagtagtagtagttatgttcctgttttgggacatagaagagaggatgagagatttggtttagattcttgcgcagaaatgaggaagagagagaggagagtggtgggtggatcttgggaaacagaaatgtcaataaatttggaaggttgcttaagggagacttctgactctgaccacctctttaactgcgaccatgacagcgatgactcttcctcttcatttactttctccacttcatttattttgttatttttgtttaactcatttcactaaactagttatatcacattattattattatatcatgtacctacttgcatttgttgtacattcaattctagaagatttgttgctgttaaattgaaagatagagttttgttgttttgagagttaattttaaacaaatacaatataaactaattctatttcattatgcaaaacaattcttctttcccttggttcgattatgcaattatatttcatacattctaatttttgggttttcttaagatatgcatgaatattattctacttatatatatatatatatactagataaggcccgcctaagatataaatttattcaaatatgtattgataatatttaaaatttgaatggtaaatagtgatccacacttttctaatgttaaatttagtaatttttgaattaaataaaatttcaatcatatacattcaattttactatacattttaactatttcttttatcataataaactgccttttaactctatacactccaacttattgatgatatttgaattttaaatagtaactcatatttttttcagtatttaatttagtatttctttaaaataaattttaatcttacaacttcgattttacaatacaatttaaatattattttttatcataatagaatacaatttaattcgattgtatacaattcaaatacaatccaaattttcaatacaaatacaatttaattctatacactccatcttattgttagttttcctttttaattaataaaattataagttaaatttttagatatagaaatataaattagtatatgtaaatatgtttatttattttttaaagaattttttttgacatatgtcaacatctcaatgatagacctgacacgtgtcatgatctcgtgagttagtaactttcaaaactgtactttatataataagatatatgcttatatgtttcatatatatatatatatatatttattagatcgacaataacattaaactatcattactagtttacttttttaaatatgattttaataagtatcatataaatgtacaaagtgtatacaatacatgtttttatatatatatatatatatatattttttttatatataagcataaatatatagacgaacaaacaatgtagacagacctaggcacctagctatgatctatgcatacggacgaaccctattatacgtacgcatgattattgaatataccttcaaatataaacttgtgagcgtaaggttattatgttttcaatactgacgaatgacgattgtgattcatgttttgaaaaattaataaagtttaaaccatcgaatgcgtaaaccaattattcatcttttaccttaggaaaaagctggatatcattatcatatatttattaagcatattaaaccagaccaatgatttaagtcgaaaatgacagctttcaagctttgcttattggccaataaataacaaactaaaaaaagaagaaattttttaaaacgaactggtgaagtctcgtgttatcacgtgcatggagccagtcagacagagacatcatcaggtgcatgatggaccacggtagtccatttcttccctacaaccatacacgtggcctttttacatttaacagtcaaacatctggtcaacaacactctcatctgggcttccttacatcaaaccctactttttttttgtttatcaaaggcccaattgtatataagtgaaaagtttccaatgggcctttcaaggattattcccagcccaatatttctggagattaggtttatttatcatcgccaccaaagaaatttgagccgaagcttcataatcgtagtctgaggtatttttctcgatcctcaaacatttccaacacctaaaggcttattcgttacagatttctcaccaatcttcggatttattgtgctcgtacgataagcatatattagtaaatttagtggctatttaggaaatttctcgtttgatttcttgttgttgttgagatttgaatctgttgtttatggtttttgtgattacttggttttgcagagaca

SEQ ID NO: 8160 - DNA, 3000 bp, Unknown
  misc_feature (1)..( 3000): cDNA_ID_3088681_gDNA_ID_1621198_Annot_ID_174792 3000 nt of promoter + ATG
ttttgtttctttaaatttgtaccttcttctcctccttagcaggggcagcagcagcagctcctccagcagcagcaggtgcggcagcagacactggggcaccgcctccaccaccaccagcaccaacattcatgataaggtctgtgacatttctcttctcagccatcttggcgaataacattggccagtaagactcaatctcaacaccagccgctttgaccaaagtcgcaatcttatcagactatcaataatagggttaaggatacctaacccaaacattgaacctacatatcaaaactaatagaacaaacacgtttcttaaatccagtaaaaaagaatcctaattcctaaccctaaaccaacaactttgcagataggtcatttaacacatgcccaacaattgagtgtgccaaagcaaacatgaatcttggtactgactatttcatcaaaagagagctccataaacctaaaataaacactcacaccatgttgtctcgataatgaaaaggatccaaccaaaacaagatatagcgacaacaatagctaggacatgagattcagaaaatgtcaagagatttaaggatacagtgatggcaatgccctcgtcttcaaggatcataacagcgtagctgcaagcaagttctccgactgtcgacattgtctctgcaaaaccaagtaatcacaaaaaccataaacaacagattcaaatctcaacaacaacaagaaatcaaacgagaaatttcctaaatagccactaaatttactaatatatgcttatcgtacgagcacaataaatccgaagattggtgagaaatctgtaacgaataagcctttaggtgttggaaatgtttgaggatcgagaaaaatacctcagactacgattatgaagcttcggctcaaatttctttggtggcgatgataaataaacctaatctccagaaatattgggctgggaataatccttgaaaggcccattggaaacttttcacttatatacaattgggcctttgataaacaaaaaaaaagtagggtttgatgtaaggaagcccagatgagagtgttgttgaccagatgtttgactgttaaatgtaaaaaggccacgtgtatggttgtagggaagaaatggactaccgtggtccatcatgcacctgatgatgtctctgtctgactggctccatgcacgtgataacacgagacttcaccagttcgttttaaaaaatttcttctttttttagtttgttatttattggccaataagcaaagcttgaaagctgtcattttcgacttaaatcattggtctggtttaatatgcttaataaatatatgataatgatatccagctttttcctaaggtaaaagatgaataattggtttacgcattcgatggtttaaactttattaatttttcaaaacatgaatcacaatcgtcattcgtcagtattgaaaacataataaccttacgctcacaagtttatatttgaaggtatattcaataatcatgcgtacgtataatagggttcgtccgtatgcatagatcatagctaggtgcctaggtctgtctacattgtttgttcgtctatatatttatgcttatatataaaaaaaatatatatatatatatatatataaaaacatgtattgtatacactttgtacatttatatgatacttattaaaatcatatttaaaaaagtaaactagtaatgatagtttaatgttattgtcgatctaataaatatatatatatatatatatgaaacatataagcatatatcttattatataaagtacagttttgaaagttactaactcacgagatcatgacacgtgtcaggtctatcattgagatgttgacatatgtcaaaaaaaattctttaaaaaataaataaacatatttacatatactaatttatatttctatatctaaaaatttaacttataattttattaattaaaaaggaaaactaacaataagatggagtgtatagaattaaattgtatttgtattgaaaatttggattgtatttgaattgtatacaatcgaattaaattgtattctattatgataaaaaataatatttaaattgtattgtaaaatcgaagttgtaagattaaaatttattttaaagaaatactaaattaaatactgaaaaaaatatgagttactatttaaaattcaaatatcatcaataagttggagtgtatagagttaaaaggcagtttattatgataaaagaaatagttaaaatgtatagtaaaattgaatgtatatgattgaaattttatttaattcaaaaattactaaatttaacattagaaaagtgtggatcactatttaccattcaaattttaaatattatcaatacatatttgaataaatttatatcttaggcgggccttatctagtatatatatatatatataagtagaataatattcatgcatatcttaagaaaacccaaaaattagaatgtatgaaatataattgcataatcgaaccaagggaaagaagaattgttttgcataatgaaatagaattagtttatattgtatttgtttaaaattaactctcaaaacaacaaaactctatctttcaatttaacagcaacaaatcttctagaattgaatgtacaacaaatgcaagtaggtacatgatataataataataatgtgatataactagtttagtgaaatgagttaaacaaaaataacaaaataaatgaagtggagaaagtaaatgaagaggaagagtcatcgctgtcatggtcgcagttaaagaggtggtcagagtcagaagtctcccttaagcaaccttccaaatttattgacatttctgtttcccaagatccacccaccactctcctctctctcttcctcatttctgcgcaagaatctaaaccaaatctctcatcctctcttctatgtcccaaaacaggaacataactactactactaccatgtcttgactctgttgagaatcttaaatcctacctaacctccaatg

SEQ ID NO: 8161 - DNA, 3000 bp, Unknown
  misc_feature (1)..( 3000): cDNA_ID_1810672_gDNA_ID_1621198_Annot_ID_174776 3000 nt of promoter + ATG
aggctaaaagcaagtgatagaaccaaatcttgattggaatctacaatgtatctagagaatccttatgtcgccatggcaagcaagaaagagatcaaggaaaaataagatcgtgactaaacattggccaatgttctgtactttttggtgaatattatagaatatgtgttcacctggaaatgctggtgtcacaagctttcctttttctcttgagaggtttaaggccaaggttcagagctaaatcctcaacaggaaccttgatcacatcgtttctaacaccgatatcagtagcatacctactcatacaatacatcccagcagtgacagttgctacaccaacaggatttggaatcaacaatgtgagaggtgacgagagtagtgcagctagaggagcacctatgatagaactggcttgaccacttctcccaaccccgttcttatccagaatgagcaatcctgtcttgcagtagagagcaaaatcttcgcagttattctggaagacattgtagttaccaaatccgttttggagaaggtgcattgctctatggatgactgtttgaagcgggtcagatggagcagttgtgcacgtgccaccgcggaatctggtgaggaaaatcgatgagctgactccataatcaaaacggtagagagaacctttcttgagaaagcagtctaggcaagaaagtactactccactctttggtcgtttatatccacagtcaggatatgtaggacaaggagcttctgaagaatcattaacctctgaaactgaagaagacgaagaagaagaagaagaagcgagtgtaggagatatcaagctgtgctcaggtttgaaatgaaccactttgcaaccaccaacaaatacgcctacaaatgtggaaaatttagaagaaaacaaaatgctttcttcagttgaaatgtcaacaaaagcaatcaaaatctatttgctaccaccattgactatagaaggacaagtcatcatcagtacgattgaatccagagaaaacaaaagatgagactttttgaagatccgtttcaataaagtcaaaaactttggcatgagggaaaaagacctaataacaaaacagagtttttgacacaataacccaataagaaaccaaatgacggtttgtttcttcatctctgcaacggaaagaggtaacataaaccctaaaatttacacaaagaagatccaaattgaggaaaaactatggatgattcatgccaaaagctcattgatgatgaaatcaaaaggaagaaatcgaaggtaccgtggtgagaataagcgaagacggctcgataagtgtagatgtgatcaccaggtttaagctcgtctctctcgactttgttcgtgagtacacccattgcttcgtcttcctcaaaataaaagctttccctttggcttgtggaaattgcagtgtacaagtagattcttacgtcagcggcagagatatgattgggcgatcaaaccggagactgttgaaccaatgccgttacagaatcttttgacggcgttaactgttagatgacgacaatcgctgtggagggtaatatggtcaatatacgaaaaggcttttgtgaacacgacgccgtttttaaagtgtccctggaatcttattcttcctttcttggtgtattggactcatattgggcttaaagaaaacgctctacggcctaaatatcgaaaagcgtattatttatctatcaaccaattgttattttgctcattgccaactaatgaacaatgcttagaattaatcaaattttctaatctgaacgaaggaagatataagtaggagttttatacaatcgataattgtatacttaattattattataagctatattggttaatgagtttctttggagtgagtatataataagaaaaatatatatagagccgagcgtagtggaggtagatcaggcaataatggaagaaacttcgaggaacttcgctttttgttgtaaccacaaaagcgaatataacaattaatacggtttgagtaggcttgcagattttcagacagcactcctactgacagatgtttgaaaattaaaatatttattgcgattattataacaacactgtagtaaggaacttttgggttatttcattggtttattaaagtctttaatcgttgactttttaatttcattattatctgtaaactcgtattttaagtgattttaataataataatttgaaagtaaaatggaatatcccccgatatcaagcgagccgtacgggaaagggaaagtcaaacatgtaataacagttttaaatgaagggtactacagtcttttcaaggggttaataacgttccgttttctttatggacagccaatcagatgggaccacgtatatcactattaccaaaccttcgcttttctggaaagtggaaagcaaaaccacagagagaagagaagaagaacaaagcaaaatatattcaaaatttaagcaataaaggcaaaaattaaaagacaacgagtttcaaacacgaaaccacgacttgtccaaatcaagatttgtcctttttcctttttagtggtagaacgcgaatcaaatttgggaataaaattttacttcttactttttcaaaaattcttgggtcttcttcagctttgtctccaagcaaacttttagtcaaatcatttttttctttcttgatggactttctttcatgtttgatatttcaatgacgaaagctctaactggtttttcttggaatttaggtaagaatttatactctgtttctctctctgtttaactcagttcttgttttgggtttctgggtttgtattttttttagatctttgattatttattatgttctatgttgtaaaagatatcaaaccgtcaataaaaactgtaactttatttgttgtttaaaaattgatatttcattgtttgattgaaatttttctacaggaatttgataaacggtttctcacatacacaagaagaaaataaccgttttgagttaaagtaaagcttttgaacca

SEQ ID NO: 8162 - DNA, 3000 bp, Unknown
  misc_feature (1)..( 3000): cDNA_ID_2123402_gDNA_ID_1621198_Annot_ID_174762 3000 nt of promoter + ATG
aacaattggtctccggaagaacaaagctcattattcctccttagctatgtaagtgaaaaatattattgtttaattttgatttttatgcaaataaactctcaaagtcttctatttttacaattttactctctacgtccaaaataaaaaaatatacaaaataatcatatgaagtcaaaactaatacgcaatatagccgatttttgcaactttacatatattgtaaacgttttcagatatagttgaaatcttcatctcaagggcttcaatttgatatattatttatcgaaattttaaaatttggtaatagcgaaaaaagctatattgtgtattatttttatttcatatgattattctgcatttttggacgtgaatgataaagttgcaaaaatggacgactttgacatatattcaactcatgtataggtgtggaaatgctggagagaaggagaagtgttgaacattgtggatccaagtttgattgaaacaagaggtctaagtgatgagatcaggaaatgcattcacattggtttgttgtgtgttcaggagaatccagggagtagaccaacaatggcttctattgttagaatgctcaatgcaaattctttcactttaccgagacccttgcaacccgctttttactcaggagttgtagactcatcgtcaagagacaacaatcatacaagaaacccgcgtattgcgtctttgaatgatgttacaattacggagttagatcctcgttgattaactttgtaagagacaaaaatgattttttctattgctttaaagtttacttcagaatgtatcagtatgatttttggttatgttgtaaaagacttgttaagcatgagatctcaattggtgttgttttcttgagtaatcaagaactgaatttgtgatgataaacagattttgaagagttcttttaggtttctgtttttgaataatttaacaaaagaaaattaaggcagcacaaaggcccaaacgacagttgtgcaatgtgatggagtcgatttgaacgagcacatagacaagaaacaaaagatgaaagaagtgaaaatgaaggttccaaataaacttaattaaagagtttatcctcagagtcagagtgtaagctactttattttggaaactttcttccatgtccagagtctcgttatcatccctccacttatcaatttcagaaaaccaaagaaccatggagggaatcaagagagatcataaaagagaaatcaaatgtgaattatagggaaaaagaatgatggacgacataaaaggggaaaaaagaacttgagcaatcaagaatatggctcaaagagaatcatttcaaatcagagaacaaaaaaaggtcagcaataaaaccattaattgatcaaatctacagattctaagtttccatggtagactatgtagtacggtttaaggacaaggatactgcaaaatggtttacacttccatgtgttttttcaagaaaataactttgatgcacatatagcaagaatacacattcactttcgagatataatgatccgcaagtactaaaagaaagataagaaacaacatacattaagttgtatacaattttacgagatcaaaggaaataaaggatatttaagcaagacatatggatgaaaataatatgtttagcaaatgagtaaagcaattaacaaattcaaatcaaataaatctatcccaaatcgtaaatctaagttaagcctataaaaaactaaaagctagatggaatatttagaagtgagaagatgaaacacaatgagaaaaataaggaggcaaagtcaaagactaaacgcaatgagaaaaaaaggaacgttggtattatgttgggccttaaacgtacattagcccatagctctttattgtataatgttttattattattatactgttgggccttaaacgaacaatttggtttatacaattcggagaaacgtttggataacgttcaacgtctagaatcaatatcatgatacttttatatttaatgcagggaattataactatactagatagacggctgtaagatgtaaatataattttttatcgataatatttaaattttaaatagtaaaataataatatatacattattcttatatataattttgaatagtaaaatagtagttttatgcattttattttattatacacattcaattttattgatgatatttgaagtctaaatagtaatctacacactttttctttattataatttagtatttagaagaaaaaaaacaaaattttatcttacacattcaattttgtaatacaatttaactatctatttcataaaaaactcgattttaattctacacacttcatcttacttgataatgatttcatgtcaaaataatatttatatgagatcaaatctatattttagttaatattaaaaattattaacaattaacaaaacataattaataataataaattttttgttaataccatatatattaaaaatttgaccaataacatatataaaattgttttgttaatttgcttttggttaagaaaaataaaatgtaatattttttagatatagacatatgaattagtatatgttaataatgatttattttttagttttctatttctttaagaaaaaaaagttaattattttcttacacgtgtcaacatctgatcgatagacttgacacgtggcataatcctatgaattagtaattctaataagatattattctggtcttacgattggtagacgagttatatttaatacgctttacatcaacactcaaatctactttgaatgaaaggttctaatgctgctacacagctaacctactttgacgtagtcaaaaacacgtcacgtctaattttcaaagaacagaaaatttcaaagtgacgaagacttattaaatttggtttcgttgataaaatacatataaattatgtaaaagtttaaaaccatgaacaaactacaacattcataatcataatcagcaagtccactttagagtcatg

SEQ ID NO: 8163 - DNA, 3000 bp, Unknown
  misc_feature (1)..( 3000): cDNA_ID_2173159_gDNA_ID_1621198_Annot_ID_174759 3000 nt of promoter + ATG
tttcaaattacctctaaaagcctttccatgttcctgagaaccaatcgatagaaaaggttggcctctgtatctttgaaccgtcgcattttgcttctccgataactacagttaaagaccaacaatttctacagtgaccactgaaaaactcaaaatcgagatgatcacaatctctactctatacagtgaatcaaacatagaacaaataggcaaagtcgcaaccttacaaataaagcgctcatcttcaccaccaacggaagcggcagcaacagaaactgtctcatttttcgccggagccaccgtctccggtacgagtgcttcaccgggagtcgatagcaaaaagacctcaagaacatctctgactagcttcttgtgattggttcccgataagtcgataccgagtttagccgaagcgtcaagtcggagtttgaactccgtcatttggtccatatcagattcactgagtatgctcttcactgtttcctcgattttttgtgtagcgacaatctccatagtttcaccagaatcaagcaacgaattctccatttcgcccgaaaaagaagaaaaaaaaggataaagaaaaagatttcgcagtagcgtcgagttttggttgttggccggcgttatatttagggttcataaatcgccgggggaaaaaatttggccggagtgtgaaaaaaagaggttctaccgagaattgaactcgggttactggattcagagtccaatgtcctaaccgctagaccatagaacctttttgctatagctgttgcatttaatactttatatatgcaaatatatatatatgagttttttttccttatctatatatcttttctgttttataatacgatatatgaatacatgggtgagatacgaatacgattgagaaatatatgggtgaaatacagtttttcttcacgaagccgataagatactaagagtcgaatccttctagaaactaaaccgacagaaagcaaattatttttgaaaattaagctcaaacaaaagaggctaaatataaagatagcaaggtaatagtcattaacatttgttgtgaataatctagtttgggctaatgttaatcttgttttacttgtcttctcactgcattgcagcttaagaaattagtattgcatgctgcgagctcagactcagccagagggctaacccaacagattttgatgcctaaaacatctttaagctcatttaaaattcttaagcattttaaatctatttataattaaagtctcaaaaaaacgaaggtaaggttcgaactgtccacgaaagagtcactaatctatgaaacaatcactagactacgaaacatttttaaaatttgatgccctttaatattatctataattttaggcgcgtaaagcatgagtttcaccaactttagcccagggccggccctgctcagccataagagaagcaaaagatgtaatgcaaaactccaatacgcagtaatgataacaaaaaaaagtttgttcgttaaagcttatcaatgcttacaaaacatcaaaaccaacttgacatgtgatggcagtaacaaaatcgagaaggcgatgctaaaagtaacttcataaactagattgatcaaaagtactcatagcttcggaatcaacataagacaccaaatatgttcaagtcacctttaaaagcaagttaatagccaacaaacaatgtgcatttcacatttcgcttctccaataactaatgcctaacaatttacagaaaacatcacttctttcctcgacaatccattgtattattttcgtgaaatgtcatcatagaagaagcacttaaaatgaaaattgggttggcccatgaatttgaattctctaacccaagaccaaaacccataaaagttatttacgaccatcgaaccacttttttttttttttttttaacggcaaacatttttctattaattagcccaaatgggcttcataaacaggtacaacttgaggccaaaagcccactaattgcaaacattaaatagacaatatgatgacacatgtatgcaatgtggagattgcagcgtagatcaacgtttcagcacatgccccgtcactgcttcgccggagaaatcttccgccggtcagcaaatgattcagctcctccatgaaactttctacccacatttagttgtaccgaatgccttttgccaaggatcaccggaaatagtctattggagttagtttggtcaccggaaatttaaacttcagctgattaggattagaatattccttggaggaccattaaaacatgacgtgaaccccaactcgtcatactcttctccaatcaaccacaacaccttgatctatcatccatgaagaaccgatgcccttacgcttttattagcatagcgaggaattttccttcacatggaagagtaatcaagcatccaatgaacacatttccatctaaaaacctccaagaattaaacatcttctaaaattgaaagtgttgatttacaacctgcaaaaggccttataaaaaaccggcaaagaaaaccgaaagaaactccgaacaattcggaaattaaaaccggcaagataccggaaacaaaagaaaagaaaaaaaacttaaatgaaatccgatttcaatcggagaaaatattaaacagagttttcctctctctcaaagataccagagagaaccacttggttaattaaagaaaatctattttaaccggttgtttaaaaaatagttaaatttggaaagaaaacagaagttgaaacggtagaatagtaaaaagtaatgaaacgtcttgttccctaattaataattacttacgattcacgaagtagactttaaagcccatactaccctctggactgtggccacgtcactctcctttaactactttgatagtcccaaagctgcgacggcgataaatcgatgaattaacgacgttcgaagaaactccagaggtctcttcattttccttttgtatactggtaaaaattggtggtctcttctttgtctccgagtatg

SEQ ID NO: 8164 - DNA, 3000 bp, Unknown
  misc_feature (1)..( 3000): cDNA_ID_1810680_gDNA_ID_1621198_Annot_ID_57597 3000 nt of promoter + ATG
tcccaagttttggaaacatcactatctccgctttgaaggtaacaatgttttcttcttcatacccactgacatttttcttgcttaagaaacaacaactttgtttttttttgttttataggttaaatgtggtggtcaattttatcatttagttgactctctcattttgaacacggctttcccaagcaaagaaacgtttctagttgtcgatgtgctgagggttgaggagaagggtaagatgctgaccggagaaactccgttgtcaaaccctaatttacttgagagagagaccaagactattaaggatgttgataaaactaaaaagaggaaactgaaaagtttggatagtgccaaaagaagtcgtaagaaactatctcttgtggatcagtcaagtggtaaaggagtggttgaaccttttgcaataggaaaaggtaacctctgtttttctctttattatggtctatgaactctttagttgttgttattggagagtattagacagtagttgagttaccttttattgtatgatctgattttattaagacattgaaagaggctaggtggtcttactcttgaactagtgatagaaactgaattagctatgttgcgtgggaatcacaaattaatcataagcaaaactactaaaaacgaaatttttagcttataacaatagttgaattctgtttttagagtggcccttaattaatatatgtatatttatatgatcaatagaccttgaaaagggagaaaaaagtgttgctacggatattgcacttgtggatgatgagaacgagagtcacaaagatgatgatgttcgtgtagtagaaggtaaacgtttatgtttacagctaaccttacggattttcatttctagatgatgttacataagccttgattagttccaactgctgcaattaatcatttaactgcttaattgttagacatcaatcaatctgctgatgttgagaacgaagggatcaacaaagatgatggtgttgatgcaacttctgaatcttttccaaactcgacaggagaaaagaagccagttaccaatattcttgtattaatggcgcctgtgccaaacagtaatttcagttccttgttgaatattcattttattttctctaatcatatataacgtgggacgtttctattaactcgtaaattgctgaatctgtgtagagaaaaaggttggtacaaagaacaatggtggaaaagatgctgatgacaaggcctcgactaaagaagttactgaagtggcttctagctcaaggaacgttgaccacgatgttgttatgggagacttgcaagagaatgtggagaaagttgttaagaaatcaacaaagaagtcgaagaagaaacagtcttcggacgttgtggaggaggcttaagtatttgtcatctgagataaacaatgctcgattatgagcatcattgatctcatttctatcttcttttgagttgctgaactttaatgctagcttgttctagtttaagaaacttgtttcctgttttttctaatcgtgaggttttttggttttctaatgcatgatgtcattaaggctttaacatttcacaatctatgttgagatgaatgtttattatgaattaatatcgcttgtacttggtttttcttatgaggattttcttaacgtcaatgtatctaatgctaattgggatattgtaacgatgaacaacttaataattggtctattacaaggtagagtcttccattgaaagcagctattgttggtgaaagatttgatgaaaaggattcaaaggtaagctcatcctagtttcagcttgttgccattcttcaaggttgggttgaataagaggagattcagaggtaatatactctgtagccctctagaaagcagaaccgatatgtttaagattgcttgttggcagagtataaactatccttttgtttcccttttcagtatgagacagtctcaggttttgtctgtgaggccttaagagaatgatgaacaagacgaaggtaaacacgagcgtcaagatcagaaggagaagcaccaagtttatagactagaggtacatagattcatagtactacttctctttgcactaccacattctgcaaaatgcatattttattctcttaactgttcagacagatactagcagggaatgccagagaagtgagtgcagtccggttcgaacgagttaatgatatggatcaagtgtgatttgtgaaaggcccgagatggttcccaagttcgtaagaaaatggagaagtgaggaagattccgatggtaatctccaagccaagagaatcatgcatcgaaacaaaagtttagttccatatattgtaaagagaattaagtattgactctaataataaatttgattaaattaaatgactcatttgcaataattacgtagctaaatgggcttcacttaccattatacggtccaatgaacactggctccgagttttgccaagatataaacgattcatcttcttcgtttcatgaacagaagaaacagagcaagtttacacacagagagttaaaaccctaaaccttttcgtttcccaggaacaatggctaatcgcgaaacagattcctcaccggagattcgctgcgtctttgtagaaaccaacctcgacactcgtctcgcgttacctgtgcataaagatgaaatcatctccgatttcaaaggtctctcttctcaaattcatcactgaatcggcttactaaaacttatagttactgcgtttctctgattattgtggtttttggtttatagacaaagtactcaaggagcataaacaagttttcccagaaattggagaaatcaatatctctgcgatgaaggtaattggaatttgctactttgtttcatacattaggaacaattaattgatgagttgctttttattttatttttcaggttaaaagacgaagagagttttatcatttctcagaatctttgaatgtgtgtaaggcttttgatggcattagtacagactggtttatg

SEQ ID NO: 8165 - DNA, 3000 bp, Unknown; identical to SEQ ID NO: 8161
  misc_feature (1)..( 3000): cDNA_ID_1810672_gDNA_ID_1621198_Annot_ID_57600 3000 nt of promoter + ATG

SEQ ID NO: 8166 - DNA, 3000 bp, Unknown
  misc_feature (1)..( 3000): cDNA_ID_1810664_gDNA_ID_1621198_Annot_ID_57603 3000 nt of promoter + ATG
taaataaatctcggtcttcatttcatcttatcttaaggtgtggcttgttgttgttgttgttgttgttgttgttgttgttgttgttgttgttgttcatatatatatatatatatatatatatgtctcatgatgattaattgtacgcttatgcccgatcataaaaatagaaaatcatcatcttgtaataatattaaaataatatgtatgttgaacaattaatatttagttatttactatactcaatctcttctatgagttgacttgtcaattgaaattttataattttattaatgatttggagaagaaagtaattttacatttttccatttttattttaaaaatcatttttattttaaaaatcactttagttcaggttttttgttgctaaaatgtaaatattcataagaataaaaatgtttaggtttacagttatatattttagacttatagacttggtcttatggcaaaaaaaaaggattaaaacatggaaggaaaaacaatcagtttgtcgactcaacgtatgctatgaagcaaacaatgttagagaaaaagataaagtgatacaagattttgaagttcctccaaagtgagttacaaaagatgaaatttggcaatgaaaatttataaaaacttcaaaagtggaagcctttcactggaggccaatggactgattctatcggctttgccaaactattctacaacaggttaatcatttggagaagaaagtaatttagtggttatttcacatatataccaccattcatcaatataacttctatgttacgtttccgttcataaagatatgtgaaaacgaagttcctgtaaatgaatgattaagttaagaaatttattcgctaaatctataaattcatctgatcaacattgttgtctacgcaattgttgttcattaaatctttacggtcacaaaaataacaacctcatgatatgttagaaaaactttaatcatacacttgcaaaaaaaagtgaagcaaaatctaccataaatatgcaattgtgcagtggtcttctcctcttaattttgtttgaagtacgtatattcgaaactttatttcgattataatttttcgtacgattctttataagtaaagcaaaataatgatggattgaagaatcttgaaaatggaaagaaatggacgagaggcttttgaccatttgtatggccagaataacaacactcactaccaaatacaataacgtgattttgtttaatagattagatgcggtaggaatatattattcttcgtgaactaaaaccatgttttataacgacaaaaaaaaacccatgttttataagtttatgggccaaaattgggcttttgtattataaacatgtttacggaagtattcagctaagtatatataaaaaaaaacaattacactaatttatttaaattttattattacctacttacaattagtaaaatttaaaattaacaaaaaaaaaacttttacttacttttagttattgttttaagaaaaaacatcattaattaccctacttttttttttaatactaggaggttctaagccaaaacatcttaattattatattgtttatatgtctaataatatccataaatgtattaaaaaaacttaaaacataaactaaagggtaatagatcataatattattgaatggagtaagaaaatgtataaattataattcaaaaagagaactataatctgcttttctacccaaatgaagtaaaataagacatcaatttgcatttcaatggtcagttttaaaggtaaaattaaagacgttaaacacgtgtaatgtaaaagagatcactcatgagtcatgaccaaccatattcttagtttatataagtaattcacaccccttaaaaagaaatatagtctataatcaatcatacttagcatgaaaacgatgatcaagtttctgctgttaatactggtgatctctcctatgtcgatatgcgccgagaaggacatgatgataaatgaatgccacaatgcagacgtcccagccatatgcatgcaatgtcttgaatccgacccaaactccattcacgccgaccatataggcatagctggcatcgtcataaactgtcttgaatcccacctccatatcatcaccaagcaagttttcacttacaaattataaccaatatacagaaatatcctctaatatatcaattttttcatttgtgtagtaacataacgaatttatcgtcaaagaaagataaaggtgaagtgaaaacagctctggagatttgcaaaaaagacttgtcgacgaatgcatctacaatactgtcggaagccaaaacaagtttgaaaaccggtgattatgataaaaccaacaaatcgataaagcttgcgcttggctttcctctgagatgtatgttcaatctcaaacgtgtcaagttcacgtctccccaactatttagtcaaatcaatatctatgctcaactctctgacgctgctatgaggatcattgatcgcttctaataagtaataactccttattgttttctatataactcaacttcgatcaatgcttaccccaatttgaataaatcatttcctttatgaaatttataaagtcacatatatccatttgttgtagctctcatgttttttttttcttttcaaatttgtcaaaataagttttcgtttgaaccatcattcaatataaatctaaatgatatattgtcttttttttttttttttttttggcaaagaatgatatattgtctatttcatcaaagttggaccactatacgataaattgttgttcttataacgttaaagtaggaaaacagttcagttttcacgtgactaacttactactattggaatatttatcataaactttaattcacgaaaatcattaatgaaaatttgatattactactataatatcgtcttctctattaatttagaatcttattcatccttttccacttgtcttctctaaccctctaaattctctttggtcgggatcactggaaagaa

SEQ ID NO: 8167 - DNA, 3000 bp, Unknown
  misc_feature (1)..( 3000): cDNA_ID_1808523_gDNA_ID_1621198_Annot_ID_57606 3000 nt of promoter + ATG
agagagattacaagcatggccaagagttgctggtcctcccgtcgtcatgaaccctatcagtcgccagaatttcatcgtcaagtcacgtcctgaataacttttgatgccttctcgtgcatcgttctcattcgttatggattcattttcgaatatctgctcttttgtgtttgatttgaggatcggctgattgctctagctggttatagtaataatttgtgttgatgcgtaacacattattcggatcaagcttttccccgatgcataacttttgtaaggtttgttgattttgacgataaatgaaatcgagccaaaaagaaaaacttctaagacattattggtttgtttggtttggaattttgttatcgctgattctgtaaacatttttaaaactgttacttttcatctcaagccttggaattaattatcacacaaacctggaggcaaactatcaggtaaacgtgattctaaacccggttcatacaccaaattgaaccggtgacactaataccatacaacaacatttaacattgtacatgtgaatgtgaaccattccacatccatctaggaactgaaactcaactgtctcagaacccttttaacagagactaactcataaaatgacaaaaccttttttttatatcatcgtgaagaaagtaaaaatgaaaggtagaacctaattgatatcaacaagaagcatcacttattcttcctctatttcattttccttcagtttttgcatcaccaccgccatgtctagcggctgagccaccttgcccatcagctccactctggctcatattggtcccatccggtttacctcctccactagcatcgttaggacccgcttttggtagagaaagaaggtgaaaatcagtaatgtgataataagttccaaactgctgtaaaaccaaatattaccattgtttgcggcaagagcagtttcatggtggtgcatttgatgttgcagtccgttgttattattcaaacccattggtctaatccccatgtgcccttgcatagcttgttgatgtaactgttgctgcggatccagaaactgatgcgggctaccaaattgcaatggacctctaggagggaaaatcccaggaggtatttgttgagccattcccacagcttgatgttgctgcatgaagtagcttggtggtggctgcattgatgacggattaggagccatctacagaaaccaaacacacacaaactataagaaccaaaatgttttgtttttcaactgatcaaaacagaaacttactgcttggggagtcatggctcctgatgttagtgtagctgctggtggctgaggttgagcatccgcaattgcagcgagatacatcaaattcttctggagaagagcttgatacctaaaagaatcaagcaagaaccatgttttattattaatattctatttaccatcagtaaagctaacatagctcggtcttggtatcgagaatcccacacttactgagcacattctgcaagtttaccgaggttctgattttccaagatcgccattatcagcttcttgttctcatcaagatactgcaagaagcagcaataagtgactcactgtgtcaacatgtcatcttcacaatctgattttaagctttcaaatctcatatgcatacaaatactctgttttcactcaaaaaaaaactccaaactcatgattgtacatccaattccagtaacaaaaaaaagttaaagcggaaaacaatgacactttaaaacaaatcatactcaagaaggaaagttcattacaacagtttaaactactcaaaaacatcattacacaaccaatttcaaagctacgataaacagacattatgactaaacaacagaaagacaaaaaatatagaaagtaaagtagtaaccttttggatctgttcggtggtgatattattggtgggcggaaatgaaggaagaaccatcggaatcatctgtggagattgctgcatcttttataattcaccaatcaaaactctgaaacagtgaaaccctaaagtttcttctcacgattattacaaaacaataattctgagtgatagaattggtttaagagcccaatgcaaaacaaactgatgcaaaaatattcaacaaacgaatattttggattatccttaaatttaagacttttgatttgtttgaatttcgccgacgaggtttctgggaaatcgtaggacaaaaaagtcccccaaccaattaatttgtctcccccaccgaatgtacacgtggcaccttgtctgatttttcgtcagctctacgataaccaaaaaaagacaacatttgtagctgttattatttattgggcctgttaatgggccttataaagaattatgaaagcttctgtgtcaagaagaaggttactttaaatctgtatcaatatcagctccacgacggcgattcgtcgttgtcctccgaaccaagcaaactccgatccctcaccgtggctccggatattttacggcggttgttcccggctcggactcgaagaattgtccggattctccctttgaccaggctggagatgaaccttttccggttctgctccggtctgaaagtcctcggctatttcatgatccttcttgtcgtcgccgtcgttggtgtatcttactacgccgtcgtagttagcacatggtggccgatcttgatccgcggagaccatggagctttatccgccctcgctgccttaatcatctttgttttccatttcctggtaatttccaagtctcataatttcagattaggttttgtttctggaattgtaagtctaggttttctgctacttaacccctaaaccttaaacttagggatgtggcatgaaacttatgtagccaagagaatgagaaatgcaatgtagttatgaagcatgaagcagtgtagatacataatcattgtttagaccattgattgttagtaaatgtttaggctccctgagtttaggtttacaattatacttctgatttgcttggttctttgcagctgata

SEQ ID NO: 8168 - DNA, 3000 bp, Unknown
  misc_feature (1)..( 3000): cDNA_ID_1810656_gDNA_ID_1621198_Annot_ID_57607 3000 nt of promoter + ATG
cttacaagacgtacttataccgcaagagaagattacgcagctgttgtaatccaaactggtttcagaggctatttggtgagcaaaattctcccttaactacatttgattaattagtaatcaaacaggttttggatttaactttgaattatataggcaagaagagcattaagagcattgaaagggctagtgaagttacaagcactagtgagaggtcacaatgtgaggaagcaagcaaagatgactttaaggtgtatgcaagctctagttcgagtccaatctcgtgtgcttgaccaacggaaacgcttgtctcacgatggtagtcgcaaatctgccttcagcgacactcaaagtgtgctcgaatctcgttatcttcaagaaatatcagacagaagatccatggtgagtgatctctataagtttcagaacaccattgttgctctgtttcaacgaccatttttgctctgtttcagcaatcagctatataaagctaacattttgaaatgccttttttgttgttgtgtagtcaagagaaggaagtagcattgcggaagattgggatgatcgaccacacacgattgaggaagtgaaagcaatgttgcaacaaagacgagacaatgcgttgagacgtgagagtaacaatagtatatcacaagctttctctcaccaggtaatagatatgaattcatattaatcgtttgtttgttttcggtaatttgattcgtttcggtgtttgatttcggtgaaaggttcggagaacaagaggtagttattctacaggagacgagtatgaagaagagagaccgaaatggttagacagatggatggcttctaaaccgtgggataaacgagcttcaacggatcaaagagtaccaccggtttacaaaaccgtggagatcgatacttctcaaccgtatttaacccgcggtaactcgagaaccggtgcaagtccaagccgtagccaaaggcctagttcaccatcaaggaccagccaccattaccaacaacacaatttctcatcagctacaccatctccggctaaatctagaccgatacaaattcgatccgctagtccgcggatccaaagagatgatcggtcagcgtacaactacacatcaaacacacctagcttgagatctaactatagtttcacagcaagaagtggttatagtgtttgtaccactactactactgctacaaatgctgcattgccaaactacatggcgattacggaatctgctaaggctagaatccggtctcagagtgcaccaaggcaacggccttcaacacccgagaaagaacgtatcagttcagctagaaaacggctttcgtttccagttccaccgctgccgcagcaaatggatggtcagagtttaaggagtccaagtttcaagagtataggtggctcacaattgggtgcattggaacaacaatcaaattactcttcttgttgtactgagtctcttggtggtggtggagagatatcacctgcttctactagcgattataggcgatggttaagatgattccataatccaaccaaatcaaccggtcatgatttttttcctcccttttttttttttgttatatataaataaaaacaatttgacaaaaagaaccataactttttcagtttttattgatgatctttgagattggtgtgtaattttgtttgtgtttatgtttgtgtgtgtgaatttgtagcttataattggaagtgtttactaactaatctctatataaatatgtatgctcatatttttatctataaatgttgcaattaggatgtgaacaatagtttatcaatctgtcatggtatctttgttaattatatggaatctttttagtataaaataacgaaaattttcactggccttatttgtttttacatgcaaagtgaagttgttaagaaaaccataaaaaaaagctgcaactttgcaacttgagatccacgagcaaggaacattacccatgtgacatgattcctacatgatcagtcttgtcttctacgttatacactactactctatatccacctaaatataaattaaatgcttctgaaatggaataattttaaaacagcacgtagttttcatatcaccaaagaaaacggcagggctggcaaaatcacgaattttttaaacaggtataataaagaactagaaaacactaggcccaataaaaacagtgggcttaaaaagcgttttgatttagggttaatgtgtgcgtaacatgtgatcatagcccacgagtgggtaaggagtgtcttcatcttcttctaccggagatcgagaaatagccgacgaagttttgttttttgagtaaaacagtattcgtcggacaaccgaagcgaaatccctaatttcccacaacacgaaataccaatttccccaattcgaaaacaaacacggtctggtatgccgagaaaattctccatttctacttttcttatacatttgttttggttgtttcatataaatacttctcatcttcttcgattttgttaccctcccccaaacaatataaaaaaaaaaggataaaccctagtttctttctcagactgtttcaagttcagatttttatttctgagcttaactggtgagtaatttgctttctggagagatgtgtgagttacgatctctaatttcattggttgcttcggttatggcttgattcttctctctgttatcaatttggatctggaatcatatatatacatacacaaaaactctgctctttttcaaagttttgatttttatctcatttgacgcttgtttcgtgatagcaatgaactacaattcttctgtatctctgccactaaaagaacctgaatttagtttgaaccatcctttcttctccacatttttttaaacgaaaaagagcagttctcatatcacccattataagcttttttttttggtgtatggtcctatagcatttttttaacagtgattacctgagcttcgtggttaaaaaagagtatggttattggatgaccagatg

SEQ ID NO: 8169 - DNA, 3000 bp, Unknown; identical to SEQ ID NO: 8160
  misc_feature (1)..( 3000): cDNA_ID_1810653_gDNA_ID_1621198_Annot_ID_57608 3000 nt of promoter + ATG

SEQ ID NO: 8170 - DNA, 3000 bp, Unknown; identical to SEQ ID NO: 8159
  misc_feature (1)..( 3000): cDNA_ID_1810649_gDNA_ID_1621198_Annot_ID_57609 3000 nt of promoter + ATG

SEQ ID NO: 8171 - DNA, 3000 bp, Unknown; identical to SEQ ID NO: 8158
  misc_feature (1)..( 3000): cDNA_ID_1810645_gDNA_ID_1621198_Annot_ID_57610 3000 nt of promoter + ATG

SEQ ID NO: 8172 - DNA, 3000 bp, Unknown
  misc_feature (1)..( 3000): cDNA_ID_1810641_gDNA_ID_1621198_Annot_ID_57611 3000 nt of promoter + ATG
ggaacagtcctctcggcatcacctttgcctgatgaaaattttggaagctccttggtgtcttctaaggggggtaactctgcagttccatccagcagtataagtagcatgatgggaggtgttgttggggttggttcgacttggaagctctttaatgaggattcaacttcggtggaagaaggtgttgtcatatttgccacctatcaaactggactagtggtaaatattccagatatttgttcatagtcaatttactggttacgcttctggaaatgatccttttctgtttttgtcaggtaaagctcattccaaatttggaggtgtatgcacaacttcctaggccagaaggggttcgggaaggttccatgccatacactgcctggagacgctcaacaggtaattcttctcctggtataactgtgtactttacatgtactgttttacgtaggtaaaattttgcagaaaattattcgaaggaggcagaagatagggtttcttttcttgtcattgcctgggatcgtcgagttcaggttgccaagttggtaaaatcagacataaaggaatatgccaaatggtcacttgacagcccagctattggtgttgtttggctagatgaccaggtgtgtatactgatataagttttttctaagcaaatacatattcatgagttttcggcttttctctgcatattcagttgctggtgatcccaactgtgacgggccatttgtatctgttcacaagagatggtgtggtaattcaccagacaaacttttcagtggctggttcttcagggaatgacctgatttcctatcatacgtactttactaatgtctttggaaatcctgagaaagcttatcacaactctatgggtgtcagaggggcttcagtgtacattctcgggactgcacatcttgttatctccagacttttgccgtggaaggagcgggttgatgtgttaaggagaggaggtgactggatgggtgcatttaacatggcaatgtcactcttcaatggtcaagctcatggagttgttgacctccccaaaactgtggatgccataagggaagccatagcacccagtttagcagagttgctactttcctatgtagatgaagtattttcttatatttcaatagcattttccaatcagattgaaaacaatggagtaactcatgagccaagtagtggaatcaataatgtcaatttagagatagaagaacaatacaatcgtgttggtggtgttgccgttgagttctgtgttcatattaacaggatggatttgctctttgatgagatattttccagatttgttgctgtacaacaaagaggtatatttttcacatctagatgtattaccatcaacttccttttttttgtgctacattttattaaggaacaggggtcagtatcattccaactatataataattgtttaaaagatgttactacgataggatagtaactacttttctataggttgtctgattctgtatctttatttttttaaatccttagagagctttggtccaccgatcttgaaatatcttattttggtatctcctttgggttggtgtttttcttatgcatgccgatttctataatacatacacatacgtgttgtgctgtgtgtttgcatgtatgttctccattacttttagtttagttcttctgtaaatggtttagagtaattgtatagtttgctaaatgaaacagcataatactttcatatggataaattgcaatgctgagtataatattttgattccttgaggttagtaagtaagatataaacgttctttggaaactgctttccttttccacctcagtttggtactttgatctttgtttaaatctattgatgacaattaattccttgtgtctaatgagatataataatttctcttgatgactagatacatttttggagcttttggagccttatattttaagggatatgctcggatctcttcctccagaggtatcttttgtgaaattataagatttcctcaagagtgccgttgtattttattttatgatttttttgtttcatctcagatcatgcaagcgctggtagaacattatagtaggaaaggatggctacaaagaattgagcagtgtgttttgcacatggatatttcttccttggatttcaatcaggtcacgtttgtagacaatttcacgtgttctgttcggtccttttcttcaataagttgatgtgttgatttagtattatggttgaattttgatgttttcctcattgacacttaggtagtcagaatttgccgtgagcatgggctttatggggccttgctctatcttttcaacaaagggttggatgatttcaggtcacctctggaggaactcttgattgtcttacggaacagtgagaaacaaagggctacagccattgggtatgttatgttaagtcgttgtactttgttctggctgaataaaaccttacatgcaaaactgaactcgagagcctagaattcaaactgctcattcatttctacctaacatgcaactaatcctagagcgcacctatgcatatatctaattgcaatattattgttgtgtaagaaaattttgatttcctttatgacgcaatatagttgtctgaactaaggtatattttgcggccacataaatgatgagttctttttaactctgtttctttttcaggtaccggatgcttgtttatttaaagtactgctttcttggtttggcttttccaccaggtaggattctgttatggtttcactgcatgttatgatctgcaatcgaccttattgtatccagtgacctataactttatataggcattttcctctcacaaacttatttggagttttatctgcaggacatggaactctaaatcctacacgatggccatcacttaggagtgagctgattcagtttctactggagaaatcaaatgcccatgattctagtacatgtgtaacatctcgattgaattatttgaacctctaccatctgctagaa

SEQ ID NO: 8173 - DNA, 3000 bp, Unknown
  misc_feature (1)..( 3000): cDNA_ID_1810633_gDNA_ID_1621198_Annot_ID_57614 3000 nt of promoter + ATG
ctcatctcaaaccaaagtagaaagggaaatctactttaacattttttctttaaacttgacccggagacccaaaacccgtctaacttcagagctggtgtgagtcttcaagtcatatgggtcctgaggtctctccccaaaagttaagtatcttatctactaatctctcactgttctctgagtcattccggaggaaattcgtatctactatacatttagtaccgaattgatgtatattcagtattggatagttaaacttgttccttaagaaaaaaagaaatcgagttcatggactgagatttgcaaacgaggtcttatcatatcttcttgtaaaatacccgggttctgttctcaaataatttcaggtatcaggtattacatgaaccgaaattgatatccgtgagtattttttattacccgaacatatatatacatatgaggacatatatactgataacttgagtttgtgaattgtttaatgattggattatggaacaagttaaaaacaaggtttatttcttgttttttattattgtaataaaggaaaacttgttataattttatggatagttttatatatgtttgggtatatctggacaaggttttggtaaataatattgaaacccaaaataattttggttatttattgggttcttcaacctatacccgaagagaacctatagcttaaataatacgtataatcgaaccagtcttaaacttctaaaccgaacccgaaagactcgatccaaacccgacccgaatacccaaatttcctcaccttagactaaaacaaatggactcctcccttatcaaaagaaaaagaaaaacaattgggctccttgactctaaaaaacacaatgggcttcgtgagataatataatgagtccattagtcatctataaattcagtgactagcgaaaaacatgagaaacatatcggaagcttcttcaccaacctggaaagagaccaccggtaacgtctccaacttatttccctcttctttccatttttttttcaatttacttcttcttcttcttctccagtttcttctatcggtttatttttcaattccatcttcattgtttcgcagacccatagataggctttgatttagggattttaatttcaatggctgcgatcgcgaatccacgcttgctgcttaattattcctgcgaatgacattttcttaagtttaacctttttattttctgttatgttgtttgctcgtttcgaatgaggtcactttttaactcgttcatggatttagcttctaaaaattgatctttttttgcagaaatatgaattaggcatatatatatatatggttttagaggtcaatatacattgtattattcgtttgcttcattcttacaaaagtagagctaaaaaaacctgagcttttaagtcaaagccttattcaaaaatgtttttgctttctaatttctaaagcttaagcattgatgttactgttttgtgatgttcaggtggactggaatcagttttggtagagagcgttgttaaagtttcgtccattaacaggctgaagagttcttcctcaatctgtgtaaccaccacttcgtgctcctcctctatctgtttctcattccagtctcgtctttcgatttctctagcacatgcttgtctcctctgctcacttgttccgcgttcaagctctgattctctctttccctgcaaccatccttttgcctcgcataccaattggttctcaaagtgttgagtttcgtggaatgagtttgtcctttgcatcaattcatctctgaaatagtccattatcagatgttcttcgtggatccaaatggcgtgtctttctttgactcggttccatagctgtgctgccttctcttcaacctcatcattgtattcatcttcactctctctatcaacagtatcacaattctcatcatcatcatacttggtatctgtctcttgtcctccttccatgcaagatgcttcatccattgagccccattcatccaaattgaaaggactaatgttggccaaagactcaaaccgctgaatcgtttgcatgagcttttgtttggttcctgcaaaatcatttacataacgtatgtttcagaacttcgaagtctgaaaaaatctaagaagagaacttgcttcgattgcaatgaaggaaatctatactcactttccacattgtcaaggcattgactgaaagaagagtctgatgtttcgtcatattcctcatgttgaatctcaaacactgagacagggctgttgtgctccttttcacactgtaagttctcctgaccatgatcattacatattaggccaaccaaatcatccaactagtaaagtgcatagggtaataatttcagtatgttaaatgttactcttataagactcattcattaagttgttagattcgtagtcataaaggaattaaagggtacatgctattatatgtaccaaggacaaagacagcttctgttttgtcttcatgtgaatttatattaacaaacagctgcacgtgcatttagagacagcatgggcgaccttacggttgaagcaaagtcaacccataagatctctattctcagatcacattgtcactttatttctttcttaattttgatttgattctgttttctctttatttatgcatgtagtagtcaaagtatgtgattaattaatgttataagtacgagtttctatttctcttaatatagtattcttacctcaggtcccacttcagtgtcggctagtattactgctgtgcaagaatcttcgccgacgcagtgtaagttgtttttaacactctgtttttcaccgcactcctcaacgttacttccccatgatgatggtaaaaactccgatgtaaaatccaagtcagaccaactgctgcaggatgtgccgctggtggtggaggatcctgtggttgttgtcgtgttcttggttgtgtactgatgaggttcaaaatgtgatatgtcctcatgcaggtccttagacgagtgccatcgcacg

SEQ ID NO: 8174 - DNA, 3000 bp, Unknown
  misc_feature (1)..( 3000): cDNA_ID_1810752_gDNA_ID_1621199_Annot_ID_57618 3000 nt of promoter + ATG
aattgtttaaccttcgccatgcatctttaagaaacgttatcgagagaatttttggtatatttaaatctaggttcttgatttttaaatctgcaccaccgttttcttttaagacccaagcagagatagttctttcatgtgctgccttacataactttcttcgacaaaaatgtcggtcagatgaattttcaagtgacgaagaagatgaaacagatgttgacaatgcaaatcagaattctgaagaaaatggtggtgaagaaaatgttgaaacccaagagcaagaaagagagcatgcaagacattggcgagcgaccatagctgcagatatgtggagagatgctactaatattggtagccaaagatagtaattcactttttataaagttcatgtatttgtctttctttggtgttgatggagacacttttcccgtgtttgagctgaaagatttatttttgaaccctttacactttcttttattattattatgaacgagttcttgtcgtgaaatgatatatgacatgcttccgggctaatctcatcgacataattagaaactgagaagttggccatgggaaaatggtacaagacatacaaatacagaaatgacaatgatgtcagcatgacacttgaccataacgttttaaattatgttctactcatatcggtggtggaataattataccttgacctaagaagtatgggtttatatgtattcttttgtaaacgtttaatactattaattatgaacgagttattctacctctatcatctatgttacagctaagcttttggagttatactgtaaaacattgttcattattcaaatcatatcaattaaaataaaaagtacaggatcatatcaattagaatattactttgatcatcataatattctagttgctactaaagaatagaatcatattacttagaatatatattaccatgatcatcataataatatcacaatctttttgttatattaacgtatatctttacgatcgcactatctctataaatgtcacgtacatctctcttctcattctctaagcatacaagctcattcgactgcaaagaaaaaggttcacttgttcttacttttttcttttgttcttatttacagaatcatatgttggaagtgtgatattgattaacttttgaatagttaacttttgtttcccgtctcactatttccttgttttttgcattgacgtatggttattttttattaaaatattgcaactttttcatgttttaacgtatatttgtttttccaatttgtcataggtatcactatgggagattcacaacccaaaaaaagaaaaaagggggattataatccgtggtctccagaggagactaagctgttggtgcaacttcttgtggaagggatcaacaataattggcgtgattctaatggcacaatcagtaaattaaccgtggaaacgaagtttatgccggagatcaacaaagagttttgtcgttcaaaaaactacaatcactacttaagcagaatgaagtatttaaaaatacaataccaaagttgtcttgatcttcagcgttttagttctggttttggttgggatcctttaacaaaaagatttacggcttctgatgaagtttggagcgactatctaaaagtaagtatcacattttcttttttaagtgaacatggtcgtacttacatattattaatatgtccctttgtttttgtaggcacatccgaacaataaacaacttcgttatgatacatttgaattttttgacgagttgcaaatcatatttggggaaggtgttgctactggaaaaaatgcaattggattatgtgatagtacggatggacttacgtacagagctggagagaatccaagaaaagaatatgtggatgattttgacaacgtgtatgagtatgatactacaactcatcatgagtcatcggagcactacgcaccatttatgtctcatggaacttcagaaagtcctaagcttcccccacgtaaaagaacaagatctgagagaagtacttcacaaaaagaagaaagtcctatgatggttgttagcagtaaaattttggatataatacaacaaagagaagagaggcaacaaaatgaagtggcacagaaaaagaataacgtttgggatgctataaaagaaatttctgacttggatgaatgtattcgttacaaggcacttacgaaaatttatcatttgggaatacaagacgttttcgtgagcatgtcggtggaagagaggctaggatggattcaaaccattatggaataatttgagcttaatttttattttctttgtttttaaagtttttaatttggattcaccaaaattattatgaataaattctttatcttattcccaaacttcaaaactctagaaaacttgaaataaaaaaataaaaaactggtcaaagttttgttagatttcgattagattataaaatcatttgttatagagttcatatctattagaaaaccaaatgacatcatatatcactgaaaatagacttccacgacagaatgaatagtgattcagtttaaatgaactcagatgttttaaaatctgataaacttcaactctaatggagttgacttcaacttcactaaccaataacaccacctaaacttataaaattcagaaaaataatcataaaccggaaacaaagctaattatggatggaagagaaacgtaaaccacgttaaaccaaattatggtttaatcaagaaaataaacgaaacaaaatcaagagaaaaattaagattacatcgaataaaccaatcgaaatttacaaagattgtttctgatatcacttcataaccgaatataaactttaagagataaaccataaaccggaaataaagctatttaaccgaatcaaaccgacttaaatcgatttaaccggataatctaaggtctaaaataatgagactgtcactgaagtttgtagatacggcgaggttgtggccggagaaattcgagaggaagaagcaatg

SEQ ID NO: 8175 - DNA, 3000 bp, Unknown
  misc_feature (1)..( 3000): cDNA_ID_1810748_gDNA_ID_1621199_Annot_ID_57619 3000 nt of promoter + ATG
atctttgacccatttagtttgtagagttaatgtaaatgttgactcttaaaataccattaattttcttattgatattgtaaagtttacttagtccattcttaagataatatatacttaccaatcttgttatatataaaatataattttttgaagttagtaactcataagattttgccacgtgtcatgtctattgatttttgacacatgtaatcatattatctatttttaaaatataaaaagaaaaatattagaaaattaaacagtgttgaaaatataataaaataattagaattaactttttagttaaactttataagtgaaatatatatatatatatatcttatataaacaatttttaaaatgtaaagaagataattataataaattttatgtatcttattaaataaaaattgaaaatacaagtgtatatcttaaataaaataaaaaatgtctagaagataattatttttatcttattaaataaaaatggaaattaaaaatcatttaccaattatttaatttgaaactacttattctaaaagaaaaatgattacttttttcttcaaattttaataaggatttaagaaattatataatattattatataaaatacaataaataagaatttttcttaccatcaatcctagaaagatagagattttaaatactcacctctacataaacaaagaaatagtctcatatattctcaccaaacaaagaaactcttcaaaatcaccatcattgcttcaaagtcattttattgataaagctttttttgggttacctatttctcaaacaatattcatatgtgttattggtgttttattgataaagctttttttgggttacctatttctcaaacaatattcatatgtgttattggtgtactacatttggtatgtattaagttttaaaaaaaaaatatttagcatggatattaattaataaacaatgactattgaagttcaaaataacaatataagttattaaaattaatttaattggactaatatatttatcattgtataatgtttttattcgttaaatgaaaacacaaaattattgacgaagttgcagtaaaaaaaaagaaaagaaaaattattgaagaagttatgagcttctaagaaagaatttttgaatatttaaagagaatattagtatagttatacttatgtcttcttctaagaattttaacgcgtatattcataagtgaaaacaccataaatttagaaaatggttgatagaaattatttttgatgactcgacgagaatgttagttaatttttttttatagtttactcattaattttaagtcatttaaaattagtttgacatgaactaaaattaacttttgagattacaacatatagataattattttagtattaactatgatatagatttggtatgtatacattttattttgatacaaacaatttaacacttatcgattaagatgaagagtgcagaatcaaattcagtttattatgataaaatagatggttaagttttaaaaatagaatgtgtaagattaaactttggtttttttaaaaaatattaaattaaatatagaaaatgtgtgtgcgttactacgtagaattcaaatatcattaataaaataaagtgtgtagaattaaaatttatttattattattaaatacatagttaaagtgtatatcaatatgaaatgtacaagattgaaaatttgattaaaaataatattactaatgaaatattaggataaatatagattactatttagaattcaaatatcatcgataaaaattatatttatattttatgtcggtctattgagacaggtcttatctagtcagtatataaactataattatttttcttttttgttaagctactagacgagattgaagcttaagcatattataaacaccataaaataaaaatattcaagacatgccttgtaaatttacagaaatgttgttgaattacttaaatatgtaaattgaaggttcacttaatttattcagatgttgattatcatttgcaggtctatactattgaagacagatagaagccagactatgccagaaattcaaaatctgttttattgtattgtgaaaactgaaaagtagtacaagtgagataattttgatcgaatcgccaaattttggtaaaaagaataatataagtaaaaacatggactaaagtagaaacaaaaaacaacacataagaaattactaaaaaaaagatccaccactcactttctcagctgaggtcttcctctctaaaatcaaaattctcagttccctcttcactccaaatttagggtttctcagtttcttctgaacgtctcctcaccttcctcgctttcgagattcaagcttctgggtttgtattttttgtccttcttctaggcttttactttctcccttgtacgactcgtgatcccaattttgtatattaacattggaaattatctcgttttttaacacttgttgttgttgttgtgtatcaccgtcgtactttttttggccgattagaagttttagttttgatttttgtttagaattttgcttccgagaaaagggggagaagaaaaatcggtgcttttacataattgctattgtgtttaaaaattgaaacttgattttaagttgtcagcattgatattgtgttttacatcgacatgactttatgcttccttctttgtatttgcaggtctatactattgaactttactactcatagcctacatttccaatgtgtcctgtgggtagagaggcttgtgatgaaggatgaattacatttgtgttaatgatttggcttttcttgtcttttttatggtaagctgagttttctgttttcactgccagctatttttgggattgggaagtgatatattaacaatgtatctgccatggacttctgtgtttgcaggaatgagatattgggtctttgatgtctttgttgttctgatatccgaaatttagctgattcaagaggtttcttggttgaaaatg

SEQ ID NO: 8176 - DNA, 3000 bp, Unknown
  misc_feature (1)..( 3000): cDNA_ID_1810740_gDNA_ID_1621199_Annot_ID_57621 3000 nt of promoter + ATG
ccggcttatatattaacgagtcacaagactcacaactgagttgtgcatgtgaaccaagtggtagaagactttttttgttccaaaagtaaaagcaaacaaaatcatccaataattgacttaaatctcaaacaggtcaattacatccacgtgatatgttcttggtacttaagttttcaatgaaaaggatttggcacatcctgccaagctaacattttttgtctgtctttttcaattttcagttttcattttttcatgtaaaagatatgtctcgtgagttttcagttttcatgtaaatgatttggcacattctccaagcaaaatttttcattcccttttcatttttcatttcttttttcatgtgaatggtgtgtcaaaaaaaattgcagtagtaaaaccataaacaagtaataatttttgtaactgatttaaatacatagtatgatattatgttattaaatcaatttttaagatgatatttgtgaaaaagagaaacacgacgtgaatgattttttttttttttcatggagtgaatgatagtacattatttactacttaaaaaaaaatgtgataataaataaacttctttactaatttgttatctgtcatttttgcaaataaataaccaacatatgttcatttactgcatgtactcataataaaaactctttagactagaaatattttggtgttgttgacaaaaatagaaatatttcgatgtattatatgtttgaggaaaaaaaagagttggaattagctagcaacatattccattgctttctcctatccatatcaaattcagagccaataagaatctcacttttttaacagcaagaaccatatgcttgaacaagacatacatgtttatctatcaaagcttaagggcttgaaaactaattcatagtagagaagtctcattttgatcaaaatgtatgcaaagaatctcattttgatcaaaacttatagtactttcaacttgttaaatatttggatcctttgggcaaacattatttttgctaataacatctactctcatttttttctgagcaattacttttcgtttcttaaatcttcatcacttccacaatttggcatttgtgatgatttaatcacctccaggtcctccattgattccaatttggcatttttgatgtatcgctatacaatttttcattttatataacaagatggatcgttggtaaagattatcccaaaaaactaacttctatattttttacttagattttttggttaattcataatctcttcatattttttatttatttatttttgtcaaaaataccattaaattaagttagataatttctccagatcaaacatctagaatatattagtttagtctcctctccatcatcaaaattcgaattgtaactttgaattgattgcatcaatggtgtttcttttacggtaactatcagataatagttaagaaaataaagagttaattgaaaactatatctatttgtaaggcattgtaaataaattgccaccttaagtatgataaacgacaagttagacgtgaatttatgcgtaactaggagagaacccctatgctcgtgaatttgttaatatatatcaatcactctgcttgcattttcttgtacatatttttatgttatttcgttttctttatggtcttagtgtttctcttccatcttagtgtatttcaatcgtatcttaggaatgaaaatcaacttcaatgaacaactaaaagtggttcttttagcagtatagaaaaatggtaagccataaatgattagaaaagatgtaacagtacaaaataaaagttaactttagtggttatgggcgttattgtgtgtaccaatcaaaaccataactatttgcatttttttttttgacaaagaactatttgcaactattactcattagtctctactttgaacttttgttttgttgatatataattgaaaacaaagaaaaatttgaagggattgttgttgatgtcgccattttttttcgaaatattttgaaataggtattttactaaaatttgacggatatattatttttaaaaatgtttgtatttaagatttttttgtaaaaatatatattttatataaaatattaaatcctaaaaataactgagtaaacccaaacataacgaataaaaggtatgttaaatcacatttttgtaacgagaaaaaggacaaaatccacaaactattctaaagaaggcaaaatccaaaaaatatcatccaaaaaagacaaattcataattgattcaaacttgaaagctaaatgttgaacattgacataatgctcttgatttgacattcagaaagacaaagcatgttatcccatatgacatgtcagaacaaaaagtaatactatgttttttttacttagactccaagagaacaaaataattagttttctaaattactatattaaacgaaatagtaatgattagcaaagatttggtagttaaaattggaaccgaacgaatttaagcagagatttatctgtgttttaaccacattttcgccagtaattaaataaagatattaatttaacgaaaattgaaaacaagtctctgtcaaaagctgcgaaataaggaagacacaccgttgaagcactcgtcgtacaaaggttccttttttcttttttcttctccttcgctttagggtttgattcttccttctccaccactccttaatttctgccaattgcgaaaaagaacctgtctttctcgtcttgttgtttcaaaaccctaattttcttactgttttctctgttcagtctctggttctgtacggagacgacaaaggtactgtttttcttttttgtttttttctgttactttctttggtctttctctgtttgtgggttttctccggcttggaatttgtaaaaaggagaaagctttatcgatttaaaaggtgattaactgattttgctttgttgggtttgtctcttttatagactctctgttccgtggagttgaagaaattgaacggaatg

SEQ ID NO: 8177 - DNA, 3000 bp, Unknown
  misc_feature (1)..( 3000): cDNA_ID_1810732_gDNA_ID_1621199_Annot_ID_57623 3000 nt of promoter + ATG
tcttccatttcgagaccatctaatatccattcggtccccacaaagtttcgggcagcggcaatcgcatgtacacacgggtacttgtcaacatcaaaacgtcggcaagaacaagttttccttagcaagtcaacataataagaaataccaccttcaccaatgacgctgtattgacgttcgaagctgttaagctcggtcaccggcatcgttttcgcaattgggcataaggagtgtatttcgttctccacaaccggcacaagaccccttgttttagaatatttaacagactccttcctatgtttgttaaaccattctgaaattttctcaattatcgcatcaagcaaaggtaaaaggaagtatttccttgcacgctcaaacgtactgttcaatgattcacacgcattgctcgtgtctatgttatacctatccccttcaaaatagcacatagcccaattttccacaggagcccatcgatccaaatacggaccgacattaggaaatcttctcctaaatcgagcatactctctcgtgaactcaaactgagtataaacatgtgcgcatgcaatgaagttagccgccgcttcttccttctcagttttcactcgtactttaacgttttgagacaaatgccaaacacaatggccatgtctcgcgtttggaaacacttgcataattgatttgatgatgctctgatgtctatcactcacaaaaaccaaacctggtacatctggtataactgttttcagcttgttaaagaaccacgaccaactagcatcgttctccctatcaattacagcagacgcaatgatataattgtgatgattaggatcttgggctgttgcgaaaactagcataccgccgtatacggtcttaagaaaagtggcatccacaataacaactttcctcataactttgaacccttcaatgcaagcacccaaagcaacgaataagtacttgaacttttgttgtgcatccacttccacatatgatattgtcccgggattcacctcctttaatacgtgcagataagagtacaagtcggtgtagcttttttcaggactaccacgcacatcactaacgtgttatcttttccctctccatgcggtagcatacgagcaatgcaaacccattcttccccgagcaatactcattatgcttttaggtggtggagtttgaaactcacctcgataatcctcatacaaaatagacgcgattaatcgtggtgtgccggtatgtttacaattgcctgagttcttatcagaccgcttgcatgtgtgcatcttcctgtgaactctaacactaaaacaatctgaactctttacttttgcacatcgtaaataccatcgacaacctgttgttttagattgccgacatcgtaacatgagtcgctgtggatctgacgctatagttgtagtcgcaaaacaatacttatttgcagctctgttaaccaaatcttgcacggcctccttagaaacaaattcttgatgcaattcaatctccgttccatcttcccattccgtaacactctgacttttctcactactctgacttccttcaccaacacatggaagctcataatactcaattctaccatcaacaccattatcttcagcaacatccatccggctatccacatgctccctatcttcaataactacattctccatagcctcttcaaaaacccggctatccgcattctcaatagcctcttctacactattagcctcttcaataatcggttcagcattaacacaattacctcctgcatcttctcctctaaaaattgtcactactccaccattctccacatcaaatgcattcaactcctcataattaataccaactgaacttcttctctctacccttgaattttgttccaccctctcagattctttatttactacctccacgttcaaagctggtctaattcccttagcattcactaccgttagataacctaaaaagtcatcatcatctacaatagatgtctctctctgagatgtgcatagaatataactcaatttcaccttccttgaggtttcatctattccaatcttcttgcatatcttttctactaacatagagtatgttacctttgacgtcctcaacaatacaccgcttaaagaattgtttgaaatccactcatgctattctgaataatacccattgtcaaattgtatgaatgtgtgcttgttcttcatcgtctcctgtaattacaaataaattataaaaacataattacgtaatcattcagatgtagacataattgtacctatattataactcactaataccatttgtaccacctgtcatattgtatctcaataaaacacttgtaccgcttatactattatatctcagttttaccatttgtcccagttcgtcaattctgggtttcacaaatcgtaaatttcgattgaatactcactaaattctctgattcaaaacgataaaacagcccagaatgaacaatacaacaattttatgttatgaacaactaactccaacaagaaattcacattaatctacaaatcaaaacgagatcggatttacttttgccgttgaagaggaagctcactttgggagcagattatcggcttggaagctacgacgatatcggaagctaactcgccggtgaaattagagctcaaatcgccggcgaaatcggagctcaagtcgccggcgacgaagtcggaaaaaatcacgtccgaagtcgtcggagagaatcgcgggagcaacgaccgtttttctatttttttttttactaaatgatttactctttattttgaattctccctcagttattcattaagatgtaattacgcatggtcgagtggtactcagaataaatggatggtacttagaatagattttccaaaatgatggcagaatagaacgtggctctataaatacataaatcccagcagtgtttgccatcagctacaaaatagtaattcacgctccttgaacaatccgccatctctctcgatcagatcgataatg

SEQ ID NO: 8178 - DNA, 3000 bp, Unknown
  misc_feature (1)..( 3000): cDNA_ID_1810728_gDNA_ID_1621199_Annot_ID_57624 3000 nt of promoter + ATG
tggcttttctcttccaaggaaactatgcaagcggtgcagaagcattaactagaacgttcctaatctcgggttttattgttgctcttgatttgcttctcaaggtatctctactttgtctactcttataccttctcatttctgaacaaatcttagatatggtgaaatgacaagtttaggatcttccttttgcttttgccaaactttctgatatgaattaggccttaccatttctgtagtccttacgggttttaccttcattcaggcaatttttctctttggatttggagtgccattgtttattgacaacaatgaaaatggaaaaacgttcaaatggggcttatggatcattcataagcttctactcactggcgtttatgggatggtgttcttgatgtacaactctaggtggagagaaaaattgcctggtaagttgatcagacgcttctatcttcccataatagcctccactggtttctttctatttatcatcattcatgtcttcttgtttctaacagcaaggcctgcattctacaactacataatcatcatgttcgccttatacagcctttacctagttgcatctgcgtttaccgcaaacaacgcgcattttggtttctggtaactcttatctgaaaccatcccaacagagaatattgtcttatgttcagcttgtatctgccttttaactcaaaatacttgcaggttatatgggatcatgagtgtttgctaccacgcattataccttcctcttctttacataacgttcctcgcagactttttccaggtaatcatcatcattcatcttctctcactgactctctcactctctctaaaatgcaaatgggtttgctgcaggaagaagatttgaacttggagaatgtatactactcagagatgaaggatgctggatttttcgactctgattgggaataggactagggtaacaaacatcttcctcattttctcaatctgtaaatacacgttgggtaggatctcctagaagtcatggctgctttttccggctttggcgggttacattttagggtctagtcttttgtatgtctgtactttttcctcatgtttctttctcttttataaatccaaaatgtcttgtgaatctctttgttccttaagctgataatctaaaagaaagttttgtagtagtctaaagattgacataataaaccactagggcaaattaagacatacaacaaagcatgacacaattgagcaaacggcaataacaaaagacaaaagcctttggttgtttccttaactaagcagtcttctcttggacgagttcttcaatgagttcagcagcctgttggactgttgcaatctcctttgctctctcttccgccattgttatcccgaactcttcctccaaacccatcactatctcaacctgcaaaaagaaagcagaatttgttgatgatgatgtccaatgagctctgagatacaatacaatgagatgatatttaccgtgtcgagagaatcagctccaagctcggtaaatttagttccggcagtgactttttgatcatcggtgagcgacaattgcttcttgacaatctcagacactttctctactgtctcttgcttgaccttaaaccacatatataccacattaccaaatatattcaaacagcctcaagaaagtcgaagaaatatagagttaaatcaacatactgcacaagaaactgcgagacgagcaggcatcaaacgtcgtaggctgaaggagagattattagtcttttcattgttgaaaatcgtagcctgtttgttgagacagaaccttgttgttgtagcctgttttcaccatgcattaacaacgacaaagaaagcaatgaggatagtttttctacaaccatagctaagggatttgtgttgcaaatgtatgatcataaaaatcaagatgttatgaactctttattgatagtatcaaaatatggttatcgaggcaaatgataaatcgatattaacgagcaaattaatgtatcgttagcaaaaaggaggagaagagagagatgtaccgagaaaggagcttgcatggagatggaggagcagaaacttgtcgccattatcgatctgatcgagagagatggcggattgttcaaggagcgtgaattactattttgtagctgatggcaaacactgctgggatttatgtatttatagagccacgttctattctgccatcattttggaaaatctattctaagtaccatccatttattctgagtaccactcgaccatgcgtaattacatcttaatgaataactgagggagaattcaaaataaagagtaaatcatttagtaaaaaaaaaaatagaaaaacggtcgttgctcccgcgattctctccgacgacttcggacgtgattttttccgacttcgtcgccggcgacttgagctccgatttcgccggcgatttgagctctaatttcaccggcgagttagcttccgatatcgtcgtagcttccaagccgataatctgctcccaaagtgagcttcctcttcaacggcaaaagtaaatccgatctcgttttgatttgtagattaatgtgaatttcttgttggagttagttgttcataacataaaattgttgtattgttcattctgggctgttttatcgttttgaatcagagaatttagtgagtattcaatcgaaatttacgatttgtgaaacccagaattgacgaactgggacaaatggtaaaactgagatataatagtataagcggtacaagtgttttattgagatacaatatgacaggtggtacaaatggtattagtgagttataatataggtacaattatgtctacatctgaatgattacgtaattatgtttttataatttatttgtaattacaggagacgatgaagaacaagcacacattcatacaatttgacaatgggtattattcagaatagcatgagtggatttcaaacaattctttaagcggtgtattgttgaggacgtcaaaggtaacatactct

SEQ ID NO: 8179 - DNA, 3000 bp, Unknown
  misc_feature (1)..( 3000): cDNA_ID_3047806_gDNA_ID_1621199_Annot_ID_174834 3000 nt of promoter + ATG
aactttgtatgttgaaatagtaatccaattttaacgaaactttttattttgtaaagattttgatgggctttttaaaacaatttctacgacgtggacagactttggagtttgtatgattaattagattcagatcctcacgtagattgaataaacaataactcaataattgatccttctcaaattttaataaaataaaaacattttttaataataaaataacaacattacaaaataccaaaatatgtagggtaatagtttttgctaatatagttattatattattactaaaatataaattcacatgttaatatttgttgttgacaaaaacaaaaacaatgatattacaaaaaaacaaatagggtgattaaacgctagaagatccgtaaccattttgatgacaaaaagatatggtactaagatgaacacgtttttgagaatattcaaaacaaattcatttccgaaagattatcaattttcaagcatacagtatgatctggtaaactataaatggtagaaccacgataattaactagtcgattctatatgttatgacatagacttagctaggagcatatccggcagaccggcactaatctaatgatttcatgagttgttattatctaaactaattaacaattaatagaatgaaatatagttttatatttaagtttttttttttttttttttttttttcggaatatcaggaggttctgggccgaaacccgtaatcccttcaggcctgaaaccacaacatgtaatattagtttcgtcccaaacatcactcgaactaacgacctctaagtttcgcctaggatctttaccaattgaggtaacaacgcttggtcaagtttaaatcattgttgctttctgtgagattttgatccctataacctaatttatcttatgagaaattaaccttttttgataaaggataaggaaaatagtaaccttgtataaaaaaattcattgccattttcatatatatatatatatatatatatatatcctaaaatgtatatctctaataaaattagaagaaatgataccaaaaataaaggtgaaatcatgataaaattttgtttttttttgttttggttcattgagtttgccattaacgctttttttttataaataatttcgtctacacaaattcatccatataatattttcttttactgcatcagagtttcactatgtatttaggttttttatgaattttaaaaaagttcagcatcaaggtgaagaaaattccaaaaaaataaataaaacggtgacccaaaaaaaacttgttgtcttcaaaaccaaaagtactcgacaaatcaaatagataaatcatgaatcttagtacagtcaggttttatcgtctacgataagttccacaataaatccaaacactaaactgttcagatctcagatagtaactttaaatcaacggctataaattcgccatttgtactttcatttacacaacagagaataatacatacactctatctctctcctattcgtaacttatatttctctctctactgtgtttagaaattggaatcttctctcttctctatctccctctctcttaaaaagggaccgtacacgtctctctctatttccagtaaaaaatcgaaatttcgtataatttcctcagtcccgtaattttctccttttttttcttccccaattccttcaattttcgaattcgcctctctgtttcgttcctcgtagacgaagaagaagaagaatctcaggttttagctttcgaagcttccaaaattttgaattttgatcttctgggctcttttgtaaatcagactgaagatatttagattacccagaagttgttcaaggtaaagcaattcagatcagatccaccaattttttttttttttttcatttgaagtttttgtgtttgttgtttgttgttgggagatatttgaaatctgggttattaaagttccgacctaatttcatattgtgctattaccaaaaataggaaattttgagaatttggttttatgttgtcatcatttaataatattagccttttgtgggatttgtgctttttgttgtttgtatcaaaagtctcagatttggattcactttttgtgtgttttttatagtcaaagctgattcatgctatacattacacagcttcactgtttagtctcagctctgttttcttgaaaacaggaatggtttcagtggacagcacggaaagataaaagagacttttttttccagattttgctgatccaaaatctgaatagttgttcatgttcttggatcaaatctggaaagaggaagtttgttggatctagaagaagataacaatgttggattctctagtgtcgaaactgccttcgttatcgacatctgatcacgcttctgtggttgcgttgaatctctttgttgcacttctttgtgcttgtattgttcttggtcatcttttggaagagaatagatggatgaacgaatccatcaccgccttgttgattgtaagttcactcaattgaaaagagtaattactgagttccaacttgaatgacatttgagctatttggttgcaggggctaggcactggtgttaccattttgttgattagtaaaggaaaaagctcgcatcttctcgtctttagtgaagatcttttcttcatatatcttttgccacccattatattcaatgcagggtcagtctttttttttacatccatttgagccttttcctctatgttgggatatatcttttaatgtaggacttagtttggtagggtctcatgctatatgatacgtttagttgcacgggttttacctacaaaagttacataaaacagattgaaagaaaaaacttagttttgaaaagtatgcattatgtgattctaggtgataaagttagtacaacgctttaaagatgttgattagtaagcttaagctctacttctataaatacctgtcatacatcaactttttctagtacttgtgattgttataaagaaaagagggcatg

SEQ ID NO: 8180 - DNA, 3000 bp, Unknown; identical to SEQ ID NO: 8177
  misc_feature (1)..( 3000): cDNA_ID_1810732_gDNA_ID_1621199_Annot_ID_174827 3000 nt of promoter + ATG

SEQ ID NO: 8181 - DNA, 3000 bp, Unknown
  misc_feature (1)..( 3000): cDNA_ID_1810748_gDNA_ID_1621199_Annot_ID_174816 3000 nt of promoter + ATG
tcagactataccgagacaacaacattagtaagttttggcatgttggtaaatattattgctctcaagtcttaagaaaatataatcaagttaaaaaagaaagattaagggggtgttattggttagtggattttaatagagttaaactctaacccaaatctaatgttattcattcattgattttaaatccattatttaaatcaagtgttattagttcttatacttacaatatcttcattaaaagactttaaaattaagtgttattggttttcatatttctaatgtttatattactagagtcttaattctaatgttattggttctcatattcacaatgattagttcaagtttcatgttattcatgtttgatagattttcacaaatacttttatttgaaaagatttgaatgaatctcaaactgatttcatgtgtaaattatagcaatcaaaatattgccttgtatcttgagattttcacaatcatacagtctcatgagaatattacatattgccttgttcctttgccaaaaactttctttttccttccacatctaggttcacgttacatctcggactttcttctctccttcttctttcttcttccctttcacggtaaagtctatctcttttcatcattatagtagtcatggctcgtgaatttgcttgagaacaaagtcacttttatcacttttgatcatactattatatatatttttattgtaggttttataatggaacgaaatctttgtgaggaagatgattcagatgtagatattatgttattgatggtggttggatccgttgatgcttatgaaagtcaaatcccacgtccgatgcgacgacaaatcacaaaaaagggacacgcttatatacaaaaggctttgaaagatgatcctattcattttcgtcaactatatcgtatgaatcctgaggtttttgcggaattatgtcatcttctccaaatgaaaacaggtttgaaaggtacaccacatgtatgtgtcgaggagatggttgctacctttttgataacagtgggccaaaattcaagatattgtcacacaatggacactttcaagagatcaaaattttcaacaagtattaatttccacaaggttctcagagctttaaacatgcttgcaccaacattgatggccaaggttacaaatacagtgccctcaaaaataagcaaaaccacaagattttatccttacttcaaggtacatatctttttgtgtgaataatatttcttgaagtcttatataaacagtttttaatttatgttaggactgtgttggagctattgatggcacacacataaatgcaatggtacaaggtcctgaaaaggctagttatcgtaatcgaaaaggagtcatttcacaaaacgtattagctgcttgtaactttgatcttgagttcatatatgttctaagtggatgggaaggttcggctcacgattcaaaagttctacaagatgctttaacaagaagaactaatagattgcaagttccagaaggtaatagattacaagttctaaaaggtgatttatcatatgataatttatttctaatagtgtgcttccatgtttcaggaaaatattatttagcagattgtgggtttccaaaccgacgtaatttcttagctccactacgaagtactcgttatcatctacaagattttcgtggtgaaggacgtgacccaacaaatcagaatgaattgtttaaccttcgccatgcatctttaagaaacgttatcgagagaatttttggtatatttaaatctaggttcttgatttttaaatctgcaccaccgttttcttttaagacccaagcagagatagttctttcatgtgctgccttacataactttcttcgacaaaaatgtcggtcagatgaattttcaagtgacgaagaagatgaaacagatgttgacaatgcaaatcagaattctgaagaaaatggtggtgaagaaaatgttgaaacccaagagcaagaaagagagcatgcaagacattggcgagcgaccatagctgcagatatgtggagagatgctactaatattggtagccaaagatagtaattcactttttataaagttcatgtatttgtctttctttggtgttgatggagacacttttcccgtgtttgagctgaaagatttatttttgaaccctttacactttcttttattattattatgaacgagttcttgtcgtgaaatgatatatgacatgcttccgggctaatctcatcgacataattagaaactgagaagttggccatgggaaaatggtacaagacatacaaatacagaaatgacaatgatgtcagcatgacacttgaccataacgttttaaattatgttctactcatatcggtggtggaataattataccttgacctaagaagtatgggtttatatgtattcttttgtaaacgtttaatactattaattatgaacgagttattctacctctatcatctatgttacagctaagcttttggagttatactgtaaaacattgttcattattcaaatcatatcaattaaaataaaaagtacaggatcatatcaattagaatattactttgatcatcataatattctagttgctactaaagaatagaatcatattacttagaatatatattaccatgatcatcataataatatcacaatctttttgttatattaacgtatatctttacgatcgcactatctctataaatgtcacgtacatctctcttctcattctctaagcatacaagctcattcgactgcaaagaaaaaggttcacttgttcttacttttttcttttgttcttatttacagaatcatatgttggaagtgtgatattgattaacttttgaatagttaacttttgtttcccgtctcactatttccttgttttttgcattgacgtatggttattttttattaaaatattgcaactttttcatgttttaacgtatatttgtttttccaatttgtcataggtatcactatg

SEQ ID NO: 8182 - DNA, 3000 bp, Unknown
  misc_feature (1)..( 3000): cDNA_ID_2156241_gDNA_ID_1621199_Annot_ID_174815 3000 nt of promoter + ATG
gcttgtaactttgatcttgagttcatatatgttctaagtggatgggaaggttcggctcacgattcaaaagttctacaagatgctttaacaagaagaactaatagattgcaagttccagaaggtaatagattacaagttctaaaaggtgatttatcatatgataatttatttctaatagtgtgcttccatgtttcaggaaaatattatttagcagattgtgggtttccaaaccgacgtaatttcttagctccactacgaagtactcgttatcatctacaagattttcgtggtgaaggacgtgacccaacaaatcagaatgaattgtttaaccttcgccatgcatctttaagaaacgttatcgagagaatttttggtatatttaaatctaggttcttgatttttaaatctgcaccaccgttttcttttaagacccaagcagagatagttctttcatgtgctgccttacataactttcttcgacaaaaatgtcggtcagatgaattttcaagtgacgaagaagatgaaacagatgttgacaatgcaaatcagaattctgaagaaaatggtggtgaagaaaatgttgaaacccaagagcaagaaagagagcatgcaagacattggcgagcgaccatagctgcagatatgtggagagatgctactaatattggtagccaaagatagtaattcactttttataaagttcatgtatttgtctttctttggtgttgatggagacacttttcccgtgtttgagctgaaagatttatttttgaaccctttacactttcttttattattattatgaacgagttcttgtcgtgaaatgatatatgacatgcttccgggctaatctcatcgacataattagaaactgagaagttggccatgggaaaatggtacaagacatacaaatacagaaatgacaatgatgtcagcatgacacttgaccataacgttttaaattatgttctactcatatcggtggtggaataattataccttgacctaagaagtatgggtttatatgtattcttttgtaaacgtttaatactattaattatgaacgagttattctacctctatcatctatgttacagctaagcttttggagttatactgtaaaacattgttcattattcaaatcatatcaattaaaataaaaagtacaggatcatatcaattagaatattactttgatcatcataatattctagttgctactaaagaatagaatcatattacttagaatatatattaccatgatcatcataataatatcacaatctttttgttatattaacgtatatctttacgatcgcactatctctataaatgtcacgtacatctctcttctcattctctaagcatacaagctcattcgactgcaaagaaaaaggttcacttgttcttacttttttcttttgttcttatttacagaatcatatgttggaagtgtgatattgattaacttttgaatagttaacttttgtttcccgtctcactatttccttgttttttgcattgacgtatggttattttttattaaaatattgcaactttttcatgttttaacgtatatttgtttttccaatttgtcataggtatcactatgggagattcacaacccaaaaaaagaaaaaagggggattataatccgtggtctccagaggagactaagctgttggtgcaacttcttgtggaagggatcaacaataattggcgtgattctaatggcacaatcagtaaattaaccgtggaaacgaagtttatgccggagatcaacaaagagttttgtcgttcaaaaaactacaatcactacttaagcagaatgaagtatttaaaaatacaataccaaagttgtcttgatcttcagcgttttagttctggttttggttgggatcctttaacaaaaagatttacggcttctgatgaagtttggagcgactatctaaaagtaagtatcacattttcttttttaagtgaacatggtcgtacttacatattattaatatgtccctttgtttttgtaggcacatccgaacaataaacaacttcgttatgatacatttgaattttttgacgagttgcaaatcatatttggggaaggtgttgctactggaaaaaatgcaattggattatgtgatagtacggatggacttacgtacagagctggagagaatccaagaaaagaatatgtggatgattttgacaacgtgtatgagtatgatactacaactcatcatgagtcatcggagcactacgcaccatttatgtctcatggaacttcagaaagtcctaagcttcccccacgtaaaagaacaagatctgagagaagtacttcacaaaaagaagaaagtcctatgatggttgttagcagtaaaattttggatataatacaacaaagagaagagaggcaacaaaatgaagtggcacagaaaaagaataacgtttgggatgctataaaagaaatttctgacttggatgaatgtattcgttacaaggcacttacgaaaatttatcatttgggaatacaagacgttttcgtgagcatgtcggtggaagagaggctaggatggattcaaaccattatggaataatttgagcttaatttttattttctttgtttttaaagtttttaatttggattcaccaaaattattatgaataaattctttatcttattcccaaacttcaaaactctagaaaacttgaaataaaaaaataaaaaactggtcaaagttttgttagatttcgattagattataaaatcatttgttatagagttcatatctattagaaaaccaaatgacatcatatatcactgaaaatagacttccacgacagaatgaatagtgattcagtttaaatgaactcagatgttttaaaatctgataaacttcaactctaatggagttgacttcaacttcactaaccaataacaccacctaaacttataaaattcagaaaaataatcataaaccggaaacaaagctaattatg

SEQ ID NO: 8183 - DNA, 3000 bp, Unknown
  misc_feature (1)..( 3000): cDNA_ID_1810720_gDNA_ID_1621199_Annot_ID_57626 3000 nt of promoter + ATG
actctattaagaccagaacactctgtttgcttgaataacaaacaatttaacaataaccaaatattttgtcatttcgacatatgtaaggaacgtgagttggtttatactctataaggaaaagagttaccaatgaacaataatttcctaattaaaaattagtaaacgttaaaagtatttttttgtcattccgacatggcctcgtttttttcctcgaaaatttagaaataatcatattatttttacttacaaaatacatatatatatatatatatagatatatataactatagttagaacaactatattgtcgtgaataggtaaatttgggaatcgtgatgatatataatttggatccgtagattgtaggtgatgcatttttgtacctaatctttaattccaaaataagtggatagctctatatgaaatttggccctactttatttgacatgaccttttaaatatttgaaaagccatgagacaatttatttaattttcataaccgtgataataaaaacaatttgtttgtaagaacaattacataacaacatttatctaaattatgagtctcgtcggcggtatgtaaaatatgttaatattatcctttttctatgtaatagaataatagattatctttcttggttggcactaaattgcacgttaaatacttgaaaactttgtatgttgaaatagtaatccaattttaacgaaactttttattttgtaaagattttgatgggctttttaaaacaatttctacgacgtggacagactttggagtttgtatgattaattagattcagatcctcacgtagattgaataaacaataactcaataattgatccttctcaaattttaataaaataaaaacattttttaataataaaataacaacattacaaaataccaaaatatgtagggtaatagtttttgctaatatagttattatattattactaaaatataaattcacatgttaatatttgttgttgacaaaaacaaaaacaatgatattacaaaaaaacaaatagggtgattaaacgctagaagatccgtaaccattttgatgacaaaaagatatggtactaagatgaacacgtttttgagaatattcaaaacaaattcatttccgaaagattatcaattttcaagcatacagtatgatctggtaaactataaatggtagaaccacgataattaactagtcgattctatatgttatgacatagacttagctaggagcatatccggcagaccggcactaatctaatgatttcatgagttgttattatctaaactaattaacaattaatagaatgaaatatagttttatatttaagtttttttttttttttttttttttttcggaatatcaggaggttctgggccgaaacccgtaatcccttcaggcctgaaaccacaacatgtaatattagtttcgtcccaaacatcactcgaactaacgacctctaagtttcgcctaggatctttaccaattgaggtaacaacgcttggtcaagtttaaatcattgttgctttctgtgagattttgatccctataacctaatttatcttatgagaaattaaccttttttgataaaggataaggaaaatagtaaccttgtataaaaaaattcattgccattttcatatatatatatatatatatatatatatcctaaaatgtatatctctaataaaattagaagaaatgataccaaaaataaaggtgaaatcatgataaaattttgtttttttttgttttggttcattgagtttgccattaacgctttttttttataaataatttcgtctacacaaattcatccatataatattttcttttactgcatcagagtttcactatgtatttaggttttttatgaattttaaaaaagttcagcatcaaggtgaagaaaattccaaaaaaataaataaaacggtgacccaaaaaaaacttgttgtcttcaaaaccaaaagtactcgacaaatcaaatagataaatcatgaatcttagtacagtcaggttttatcgtctacgataagttccacaataaatccaaacactaaactgttcagatctcagatagtaactttaaatcaacggctataaattcgccatttgtactttcatttacacaacagagaataatacatacactctatctctctcctattcgtaacttatatttctctctctactgtgtttagaaattggaatcttctctcttctctatctccctctctcttaaaaagggaccgtacacgtctctctctatttccagtaaaaaatcgaaatttcgtataatttcctcagtcccgtaattttctccttttttttcttccccaattccttcaattttcgaattcgcctctctgtttcgttcctcgtagacgaagaagaagaagaatctcaggttttagctttcgaagcttccaaaattttgaattttgatcttctgggctcttttgtaaatcagactgaagatatttagattacccagaagttgttcaaggtaaagcaattcagatcagatccaccaattttttttttttttttcatttgaagtttttgtgtttgttgtttgttgttgggagatatttgaaatctgggttattaaagttccgacctaatttcatattgtgctattaccaaaaataggaaattttgagaatttggttttatgttgtcatcatttaataatattagccttttgtgggatttgtgctttttgttgtttgtatcaaaagtctcagatttggattcactttttgtgtgttttttatagtcaaagctgattcatgctatacattacacagcttcactgtttagtctcagctctgttttcttgaaaacaggaatggtttcagtggacagcacggaaagataaaagagacttttttttccagattttgctgatccaaaatctgaatagttgttcatgttcttggatcaaatctggaaagaggaagtttgttggatctagaagaagataacaatg

SEQ ID NO: 8184 - DNA, 3000 bp, Unknown
  misc_feature (1)..( 3000): cDNA_ID_1810708_gDNA_ID_1621199_Annot_ID_57629 3000 nt of promoter + ATG
cgaggttgttttctctcttcattttattcttcttctacttagccgaaaaagaatgaaacttggtggtctatatgtatgctctttggtgtggcatgagaccctttggtaattggagaagtcgtgatattgttaattacgaacttgttgaatttattccaaagtatataatatttaaggcagcaacttgtttttttttacatattctaatttaaccaacaattaaagtcaaccgttgcaaaggaggagacttcgtctcatgcataattaacaataacataagaatcattgaccggattccatgtgaccactcaaaagagcaagacactcataaacgttctcagctcgtaaatgagacctgtcctcagcaaagaaatggcacactttgtcactcatctcaatccaactgcagcccggtttcttcctcaatcccatttctttcatttttaatctgactcgtcttgctgcatcccatgactcaccagaagcatacaaattgaacaagaccatgtaggttgatgcatcatctggataattctcaacaagcaatcttgcgattctatctcccaatgaatgttccaggtgcaagcaacaagcagagaagagagtactgagaagctctgcattgtcacttgtctctggtgtttgttgaataatttcataagcttcaagcaaccgacctgctcggccaagaatgtcaatcatgcacgagtaatgttcaataataggctcgattccgtactttgatctcatttgactgaaaaatttgagaccctcatcaattagcccagcatgaccacaagctgacaatacagcaagaagagtaaccccatcaggttttagaccaaacttctgcatttcatcaaactggtaaagtgcttctctgggttgaccatgagatccatacgcagagatcattaccgtccatgatacaacatccttctttggtatactgttgaaaatcctaaaagcctctttttcattgccgcatttagaatacatgtcaagaagcgcactcaaaagcaactcgtctgtttcgagcctgctctcactaatggacaaatgaatctgtttgcctttctctaacgcagccagttgcgaacaagcaggtaaaacacttgtgaaagttaccacgtctggcttcactccaacactcaccatttggtcatacacttcaacagccttaaaccaattacctacactgatataactagaaatcatgacattccatgactcagcaacgtccttctgtgtctttgaaaagacggtttcagccaaatttgcttcaccacacttgaagtatagatcaatcaaggaacagttcacatagatatctgcatttacaacgcttctaatcacataaccgtgtataaattttccatgtaggagattccgtgagcgagagcaagccatcaaaatgctggtcaaggttgtctgactcggtcgagttccttctatgatcattctattcaaaatctcaacacatgacttactgtctcctttagcgacataacctttgatcatagaattccaagcaaccaaactctttctaggcattttctgaaaaacctccctagccacctccaagcagtcacatttcccatacatatcaacaagggcagagtttacatactcatctaactcaaaccctttcttcacacattttctatgtatctccttccctctctccaaccacaacagccttgaacacgccgatatagccaccgtcaacgaaactgaatttggttcaaagccagaactttccattcttccaaacaactccaaagccttctctgcctctccactttgataaaaacacgaaataaccgtgttccaagatgctacatctctctcaggcatttcatcgaacacttgtagtgaattctcaaacaagttaaactttgcatacataccaaccaaagaactcgccacaaccacatcacaaacatacccactcttcaccacaagagtatgaatcatcctaccaagaaactctctacccaacgcaccataagccttaatcacattcggaaaagtaaacgaatcagggacacaaattgagcaattcaacaacctcttgaaaacctcaagagtgtcatgaaacattgagttctttgaataaccagacattaaagagttccatatgtaaacatccgatcgtatatcgaagttctcgaagacgtgtctcgctgagcaatggtctttacaagtaaagtagacattgatgagacttttgcataaaactacgtctcttcgtaaccccaacgtgagtattctctgatgcacaagcttgattcttcttagagacttggtgctattggtacactctcgcaataaagacaacaactttgaagattccatttcaagttcacatttttttttgtcgtgagagattgaaatgtgatcagtcgctgctttagctaaattataaaggaaagacatgattcaaactacgacgtcgtttatactaatgggccaaacttaattaggcccaaaatgatttatttttctaaattagcgatgcgttttaaaaccctaggttacaaaaacgcgccgttagcaataaaaacgcagcgttttgagaatctctgaaccttcttcaacaactataaaaaccatcttaaaccctagcagaatcgcggctcctgattttagctctctctaaagctgtagttgtgcgttaaccctctaaggtactgaatctctctcgccctctctttcttcgttgttatggcaaataagcttccaaaattctaagactttgacaaagtatagttctgttctttgtcggattttcaagaatttgaacagagtatctgccttaactattattctgatttgtaaacttcgaaacagggaaaaagttttaccttgaatattgtttcgtactagcttaatggctttagctcgtaaaacactaacttgcaagtttggtgactttgagttgattcaagggtttctcttaatcttgttttttcttcttttcaggagcttgtaaaaatg

SEQ ID NO: 8185 - DNA, 3000 bp, Unknown
  misc_feature (1)..( 3000): cDNA_ID_1810780_gDNA_ID_1621200_Annot_ID_57633 3000 nt of promoter + ATG
gttgagaataaagtaagataaccaagggctccttgctcatataagcgcaaatgttttaatttcatgtttgtaatcttacagagtgatataatttacttgttaagccatcaagaaggagatataattttgaagttttccagaaaagaaattgtaaattcgaaattaagaaatcacaaagaagaaaaatatcaaataaataaacgaatatcacgtatcaaataactctcgtgatatgcccatatatattttaatcatgttaataatcaaaaggctcttactacactgaaaacacatgaacatgagtcaacgcctcaacggaattgataattttggtggttcttaattaagcaccgattgcaaggaaagggtcatttctctcaatacgattacaagaaaagagtcatttttatctcgcatatatgttattaatgagtggttgccattacaagttatgaacttttgactttaggaagcccaccaaccatcagctgaaaactaggattagcggggggaatttgattaatgtcaactgatatcctccaatttctctttgagaaaagctcaagcaaagtatatgactctttgggccactcaaaagatctttaatcaattaacttgaggacatgtactttaacaacaattgacacatatagacacgtacaagagttgcacgctattgatacaaggaaattttggtctagtatgaggtaataacgtctcaacgagataaggttaaaattatttagacatgcttgggaaaatatttttgttagtagaaatttgtagagtaatgaaatttagattcttatattgaaatttcatccaaataaatgacaagaggtgagtcaacaccaaaagggcgtgtgagtatgagagtcaaagatagcactaactatacgatgcgggaagtcagcagtttagtcacacgtgtcaacctatgatttaaggagagttggtgtatttgtcacagaatcattaaaatttggtaaagttagaaatagaggggccagtgctagtgttgtttagtcgttacaacaaaacctcaacggtttttgtttgcaactttaccaaaatgaataccctcatccacaaactcttttctaatcaacaaagtattgaaattttcagttacatactagtatttactatttacatactagtatttttgggctagtagaagagtgtatttgaaaaattagaggagaaaaaaagtcagcgtggaggaataaaggtgtgagatcgcatgttacatgtttgatcaacggctcttcacttcatcattcaatactcttttttttttctttttttttggctcaatctgtcaataaaataagaaaaacataactgataattatatatatttagaggcttatttgtatttatgtttacacaacagacaggtcttttatttagccgtttctgatattaaaaaagaaagtaaactgctttcgttgatattcttaagtatcccattaattcttttccttaaaaagaaaacattaacttgttgttgggacttcgtatattagcttaagtgttggtggaagagtgcttgtaacctactccgacttcttcttcttcttcttcttatattctccctctctctctctctcctttttcttctatttctgctctgttttggtaaattgaggaaatggaagagaggcataagtgcaagttatgttggaagagcttcgctaatggaagggctttgggaggtcacatgaggtctcacatgctcattcaccctctccccagtcagcccgagtcatattcgtcttccatggctgatccagggtttgttcttcaggacagagagagtgaaaccgagtcgtccaagaagccctcccgcaaacgatccagacttaaccggagatccatctcatcattacgtcatcaacaatccaacgaagaagggaaaagtgaaaccgcaagagcagcagatatcaagatcggggttcaagaactcagtgagtcgtgtacggagcaggaaccgatgagttcggtgtcggacgctgcaacaacggaagaagacgtggccttgagtctcatgttgctgtcgagagacaagtgggagaaggaggaagaggaaagtgatgaagagagatggaagaagaagaggaataagtggttcgagtgcgagacttgcgagaaagtgtttaagtcgtatcaggcgttagggggacacagagcaagccacaagaagaagatagcagaaacagatcaattaggctcagatgagttgaagaagaagaagaagaagagtactagtagtcaccatgaatgtccaatctgtgccaaagtcttcacatctggtcaagctctcggaggtcacaaaagatctcacgcttccgctaataatgaattcacgagaagatcaggaataataattagcttgatagatctaaatctcccagcgccatcggaggaggaagagatggcctcgtcggttttttaatgcttgatcagattggtcaaactatagtaattaccacctttgattccaagtaatgtagtaaaattctccaagtgtacgtattgaggacaaattttgatgtggtcaaagaacacaagtgagttaggtaatgagggaaatcatgtgatagtagtcgatttgtgtgggaaaatggtaaagcatgaaagcgtgatcgagtgacgtggtttgttgttgctcaagtcgtgtgtttcgttatgccaatgaaataaaaaaagaatacccaaaattacttatatactcttaaagagggaattttgccgactaagagacagagagaccaccgtaacttttggacaacaaaaaagctctaacgagtcacgcctttagattgcactttcttcttcttctttaaaaaaaggaaagaaaacaaaggtgtaattgcagtggagttgttccccaagtcacagagagaaatcacaggcaattttggttatcccttaaccggtccatccatatctgaaccgtcccggtacaaagatccgttggtttctggttttgagatg

SEQ ID NO: 8186 - DNA, 3000 bp, Unknown
  misc_feature (1)..( 3000): cDNA_ID_1810768_gDNA_ID_1621200_Annot_ID_57636 3000 nt of promoter + ATG
atccacttctgtcttggggatgaggaagttgtaggaagatccggatcccgagcccggtcctgtctggtcgtaggagaacaaggaggctggcggagcggaagagtggggatggtagatgggatcggaggcgccgtaaggagtggtggtggtggtggacccgtacaaggagtggtggtgatggtgatgatgaagaaactggttgttgctgttggtctgaccgtagagggtgaggtgatgctgttgttgttggttagagaaggaagagaggaggggaggagaaatggtgatgtgacggtggtcgttgttgtaatgggagatggggtcgaaaaaggagaaggatgaccgggtcgggtcagagtccgggtttctttcatctccggagagaacgatggaggaaggattatcccattcgtagtccaacatgttgcaatcccgaggaagatctctctctctttctttcttttgtttataaaatcaagacggagtagtgaaaaagagagagagaggctaataaaggaaagggggaggagacatgtcggtgcggaataggttatggaatggttttaatggactgaaagcaaagcgacgtactacacctctattagaatcacacacagagacacactctctttctttttttccaataaaccctaactttctatttgtgggggtggatttccttctctctctattgctctctctcccaccatctctcttaaaggtccctttttaaaattcattttttttttgatcttcttcttcgtaaaaaaaaaagagagatagctgtctgtcttgtcatctagctacttaaaaaagtgaagatggagaagaaagaaaactcacatgggtcgtgaaagcagtgtgtgtgtgagtgtctgtgcccttttttactaaaaacaatttaaattattatttaccaatcatctgcccctttttactactagtatttttcaaagctttctaatttgtaatcttagtagtacctacgtaggattaatttgaatatcgaaaaaacgtaactcactacttagcaactgttgatggagcctctaattgaacttttgtttgacaaacaaattaaacacacaagtatgtatagacagactcttactatgttattttttaacagcgtattgtatatatggatgatacatatatagcccccgcaggactttaaaaaaaaagaaagaaaagggtctagctagtattggtggtgatcgtgtggttaaggaaaaagaagagtaaaaaacgcgtttgttctacacttatttaattatgtcgggacccgcttctgttcccctgctgggcctctctcttacatttgttttcttttttactagcgataaataagatatgagaatgagataaatcatcgtagtcagttacaagtttatacgtggttttttttaagaatagagagaaataaaatatctatttcaattaaccacaaaaaaaaaaggaggaaaaggccaaaaaagagagagagataagaggcaaaaacggtgttggggtttcgaaagacaggatggcaaaagtgtaaataggtagcaagttggaggttgatcgttttagggaagacagaatgaccgatcgtatcttgctaacgtacacccactcacccccaaacaacaaattactattattcgccaactctctctctctcttctttctctacctcacgcgctgctatctctacttaatcgaacggtcccgattaatcggatggtgatcacgtggcagcacagggaagagagtagggttagctgagcatagacgagagagtgaggttttgtaattggtaatggcgtgggtcccctatttttaggtgctcaaaggctgccatcgacgttgacccccgaaaccgtacggactcctgtctctattatccttgcccctctctctctctcttttttttttttctaaaacaaattataaacccgaaaaccaaattttctattttcatatttggttctgggatatatatttatatgcataatcctgtcttctacttttttgtttttgttttaatacagtgtacaatattgaaaataggaatgctgctcctactacaacttattctgatgtacatatagtacgctgttaggaggcttttttaattcactcaaagtagtcaattgatagtgtacttatgtatctactaaggcagttatcacaattaaagtaaactaactcctaattataatgaaaagctctcaatcgctctaacgataagctatctttctaactataccaaaataaattaagaagtccctacatagtgtgtatactgtaacatccataatttattcaaccgattccgttggtatccgaggaattaacagtgtattttattaagagtaaaaaagactgtgcatatatataaaaatagagaaaaaggcaaaataaaaggaggaggataatgttacaccaaacttgttgccttgtcaacatctctctcttaatttgagagatacccacttattgcactttctcactcattacccccacctcctttcttccctaattactgcgcaagtattatgcatatgcgattgttttaaactagtccgcaaattgattcccaatgaaagggaaacggaatgtagtagatcatccatacaccacgtcttgtgttggtgcagttacaagtttacttcagggtttaacattattttaaaatctgtatgcaatcaaacaatctatcttcaaaaacttactgatatgctatggatgatgattaatagctaggacttaattatatgctgttgcttcttctccttttttttttaaagtttaaaacaaaacaaaatattgtgtcggggccacctctataattgggcctaaagtaaagttatctagaacaaagaggagcccatttagattgggccttagagagttatagaatgaagaagaaagggtttgttctcttggtccgccggaaggggtggaggagcggcggacgtgtgccgccatatttcgcggcaactttcttctgcaatg

SEQ ID NO: 8187 - DNA, 3000 bp, Unknown
  misc_feature (1)..( 3000): cDNA_ID_1810764_gDNA_ID_1621200_Annot_ID_57637 3000 nt of promoter + ATG
cttttttaatttgctctctccgtagtctaattatacataatttaatcacacagtctcgaaagagtagtatgattatagtaagtcttctaatacctctcgtttaggtggaactaacacatgacatctttgagaagcttgtaccttcgtgtggccgtcttaggcgacgtaactccgcctccatctccagcaacgcccttggctacttgatcgtgacggttattgttatgcttgatccggtggccgggcgaatattccgatctgtttgagaagtcattttcatatttaaccgaagaagaaggcttctttgaagaagaaccgccatgtctagcaacgttgctcagcttccggtcgtcgctgcggcaccagtcgcaaatctcggtaggctccgcaaactggccgtagtagttgctacaataactatatatatatatacacacatatatgatcaattaagaaacccattaatagccgtgaatggtcactctgatatacatatgcatgaatgatgaaggaggactacttacgagtgttggaagcggcagcggcagtgaccgcagctgaagagcttgtcggagaaaccgacatcaccgcacatgcaacacactctctccatgatatatcttcacaatctttattatttatatatatcgacccttgtatatatatgttaggccgtgatgtttaaagtaattatacaactatgcgtgttagtaaaaatgtacaggtagactagagagtttgcttgccgtcgttttcacttttcggttttagagagaaagccaaccttaaaatggggagtttttcggaaatgactgttttctccttccttttgtgtttttcccctgtcttgtcattttctagttttttcactcttcgtgcacatatggtggatggatccttctccatgcctacggaaagcgcaatgcagtgacttgtggtcttttctttctttcaaattataggctttcaaataaaataaatgttgtatatcacgtatcatcaaattcattagaactcgatcgaccatcagtttttttaactttataacgatgttgacgtgacgaaacgcatgctgctgtgcgagtgagagagtgttaagcgatgtgaacaacagaacaaacagtttgcgacaataattaacaacaccaattttttcatccaacttagtagtagtgctgctttttctcccttttcacataaagcggaaaaaatatattgggattatctcttggtggtgatgtatagatcgcacactaacatgtaagttagtgggagttcaggcttgaagatctagttctttagcgagtcttcgttggtccggcggcttattatcaacgtacgtgtacatgatgagctctagctatagtagggtccaacttgtcgccaagactgattaattcgtcatatactagttaattactctaaacgtatagctaaagaagaacattatatatagaatattttgttaactatgatttgtttatggtgttagacatataagtttgtttaatgtaacttcaaattatgttgatggatagagatggatttaatgaggagggttaggttatatacaatttggtacccatttattgtttgctttcccaatatttattgcggtttgcatgttttataaaaactggttaatatatttttcgggagattaaatataaggaaactttgatgcgactcgacgactttgagtgtaaaattgattaaacgcaccagtcacatgatatggaggcaatcggaggggaaacaaaaccgacggcgatgtgaagttcccggtggtttcgctaacttggaacctaaacggtcggagagggatccacgtggcagaattcaggagatatttttggagtttggttggccatgttaagcacatgccctgtcttcttctccctatctctcatcctttgcgttgcttcctcttttcactgatactatattttttatttccacctatcagtcatttaccatgtacattagtacgcaacgcacaattcggtgccaaattagagtttcagggtctcacctctctctaatctgtttgtataaactttgaatggagggagacttagaccatgtacatgggtgatatttttagagtatcatcagtttaaaaattatttttatattaaccaaacaattagaatgagcttgattagtatcattccaatgatttttttgatattactatcatttacgtggcatctcctgattggtcgcatttgtcaaaaataagaaaaaaatatttatctattaaacaaatattataaataatactaaaattttttaatgatagtttgttagtatcacctataaccatgctcttaataattaggatataaaacatgtgaatgagagaagtggaccctagtgatctttgtttgtagtggcctcaagattttactttagtcccaaattcggaggaaattatttttgttaattaatcatttattctttcttttgttctacctcattccaacttacaaattcagtatccaattcataagttgaaccaaaaggaaagacatcattcaacccaagattagaccaactgtctttcgtgacacacttgcaattaatatgattcttaaaaaatgttaatgattttgtttggaaccaaaagacaataagttagcagtcaaaaaagcagtaaatgtaattagaaagaagagacatggtaatataatagatattatggatggtgtgacgaataattgatctaataatcatttcagacaagtggacaaccctacctcctgagatgatctttttagcattctatgtatgtactggttaaaaaaaggtttcagaatcaaaatgatgatgatcgtatatttgaaaagaagccaatgatctctactttgaaagaagagaagatgaaaagaagccaattatgaagatgaagaaagggcataacagaagattgagtgttatcctttgttgaggagtgcccaacacaaattaaagaatgcttcttttcctttgttggatata

SEQ ID NO: 8188 - DNA, 3000 bp, Unknown
  misc_feature (1)..( 3000): cDNA_ID_1810788_gDNA_ID_1621200_Annot_ID_57639 3000 nt of promoter + ATG
aaattgtacgcctacctctttctctcttctttaattagggctcttcttttttttttgttgttgttgtggatctttgagcctagataatatttttaaaggtcttgtgtcaaaaagggatatatgaaagacgactatgttcatctctttgtgaaaagacctgttcgaagatctcccatcattaatcgaggttacttttcccgttgggctgccttccgaaagcttatgtctcagtttcttctaagcgggacaagttctaagaaacagatactgtctctcggagctggctttgatactacctattttcagttgctggtgcgtcttctttttcttctcctttttgttagcttttaccaaattcaccattcttcggcttattccagggatctctcgcttcttctcttctcattttgtaggatgaggggaatgggcccaatctctatgtggaacttgattttaaggaggtactactggatgagcgtgctgacaaaagtatccatcatgtgttttgagtctaatgcctaaatggatttgcttcttacgttaggtgactagcaagaaggctgctgttatacaaaactccagccaactcagggacaaactaggagccaatgcatctatttctattggtaagagccttttttccccccatgtattattatgtagaatgatccttttcattatgatgcatttcagcttgtgcactcatatttttcttcattccgcttctactagctactaactcaaccacccccttttactttgtaccgttagcgtctagtttcagttgcttactcttaactcgttgggctgtttatctctacagacgaaggacaagttctcagtgatcattacaagttacttccagttgacctgcgcgatataccaaaattaagagatgttatatcctttgcagatatggatctaaggtatccatgaataatttttatttattttacacactgttatcttgaaccttcaaccctcttcttctacccgggtttaagatatatggtaacagatacttactggtgatagacctacttgatccctaatatcattatcagtctgccgacgtttattattgcagaatgtgttttgatttatctggaccccgattcaagccgtgccatcgtcaattggtcgtcaaaaacgttttcaactgcagtatttttcttatatgagcaggttagctcaactgtgattttccttgtctgcataatattgcagatacgaatcttattgcttatgtgtctaacccgttgggtttctgtttgcagatccatccagatgatgcatttgggcatcaaatgattagaaatttggaggtaagaacgtgtactctactactctagttacagcgacatcttcattagtaaagcttttttgagatttttgtcaaaatatggatactagtatgacactaaaatattctagtattgccacatgggttcatgttgtactgatcaattaccttcatttaaacttgttctgaaagcttaacggtgtttctgttcttcagagtcggggatgtgcactcttaagcattgatgcatcaccaactttacttgcaaaggagagattgtttcttgataatggatggcaggttcgttttgcagttagaatattatgattaaagcagggctaactttcatgtataatttctgatataaggactctcatttctttaccctcttctttattctggtgtttcagagagctgttgcctgggacatgctaaaagtgtatggtagttttgttgatactcaagaaaaacgcaggtcagtactgtacgttttgttaaaactgtgtaagggcgttatgttattcatacctagtatctggctgaactctgtcaagaaatatctaaaaaatgctgttgcccgtgacttttgagctttccaatgttttttagatgaacctcttacagtcttactatatatatcctgttttttgttttttcttctctctcactctctctctcactatcctgttttggctctcttgtttcttcaattcatgagctttcattagaaagcctacttctcttggaatatatcttaaatgagaatgtcgtgtttctaggatcgagcgattggagttgtttgacgaatttgaagagtggcacatgatgcaggcaagtctgtctatacctcattaactagatgttgcacctctatgtatgtatgggaaagcataaaaagaccaaaagatgattggtgttgaatatcaacggtatccattatatatttttgatgatgcatgcgtcagatcttgttctagtgtgtaggtagttgagcattatttaaccgtttatattcaacaggaacattactgtgtcacatatgctgtcaatgatgcaatggtacgtacatgagtctctacaagtcattgtactttttagattctggaatgtttttttgattaaaaaaatgcagggaatatttggtgatttcggtttcacaagagaagggggcggtgaaagaatgagctcatcagcgtcatcaccttgaaaaggaggagggtttgtattgcattgaatccccggaacttgcaactggtacgttagttaatacagttggaggaaaacccctggtggtgggtagaatctgatagtgcttggtttacctaatttgtaaggaatgatgattgattgcacaaagttagaaaggcctttctctgggtgctgagcagaaaacgaaggaaacacgaacttgtctgcgttatctgtgcttttgatttagtttaggctcatggtcgagatatgtgggccgggcctccccttgttttatttttggttgtattttctaataattgtgcaaaacaaagaaacctcacctcggtcaagaaacgctctgaaatctgaactctgaaggttgtttttcttcttctttcggtggtgaaaaaattatctttatgaaaagacaaaaaagtttttgaaaaaaggaaatttttttcaaaaaaacagactgagagagagagagagagagtgtgttgttggcc

SEQ ID NO: 8189 - DNA, 3000 bp, Unknown
  misc_feature (1)..( 3000): cDNA_ID_1810822_gDNA_ID_1621200_Annot_ID_57640 3000 nt of promoter + ATG
gtccaaatgatggcgatggtaaagaatgtcgtgcattgacttgagacgagtgaaacggtttcagtaaaacggagaaagagtgtgactctaaatactttgaaaacctacctgaacgttgaagctctcttccaccttagtatatggtgccatgaccacatagattgcagctacagatcccagaatcaaatcatatcctgctcccaccaatcgaaagtttcagttatataaaaaaagaaaaagagatcatctggccgcctaagaagacgaaacgaagaaattaccataggattgaagaaacttggccattttcgaatccgtcggcatcgtctctgtatcggggaatcggaaatcaggcagcccggatacacacacaatttcgatggaaacagaaaaactaaaactgggccttaacttttcgggttacaaatgggttctggcccaatatgtaagcccattaccttttttcttttgcggggacggacttaaagaagggcaaaggacacggagaggtaatctcgatctcgagaaagaaagaaaaaaagagaaggcatggccgcggaagaagcgacggagttctacctgagatactatgtcggtcacaaagggaaatttggacacgagttcctggagttcgagtttagagaggacggtaagctccgttacgccaataactctaactacaagaacgatactattatccgcaaggaggtatttctcacccccgccgtgctcaaggaatgcaagcgtatcgtctccgagagcgaggtcctttttctctctctcttccgatttgcttctctcttgttaattgtccgcgttttggtcaatcgacgctataatagccaattagggttttagtgattttgcttcgatttttgtcgatctagggcatctttcctgactagtgttgtaggtttagaaccctcttcgttgttaatgctattatctaggaataatggatgattttgtacaacctgacatgtgattatttgtctgcgggtagattctgaaagaagacgataacaattggccggaacctgaccgtgttggaaagcaagagctcgagatcgtcttgggtaatgagcatatctcattcgctacatctaagattggatctcttgttgattgccagagcagtaatgatcctgaaggacttcgcatcttctactatcttgttcaggtctcctctctttttcttccaccccttgccttaccatcttttcttttacctaatcccttaactctattggactcgattatatatttaggactctgccttttaacgtattcactgtctcaaactttaacatttagggtttggctgttaacactcatcccttacatggttctgtagtttttttttttttagtttctgtatttatttgtgctctaacatattccttttgaaactttcatggttgcaggacttgaaatgtcttgttttttcgctcatctctctgcacttcaaaatcaagcctatctagagaagaaaatcagtttgtgacatgtcaagacgcgatgaatttgttgggaacatgaggactttgtgactgaagtttggttgtttttatgtctctggttctctgttttttttttttgttggatttgggtgaaagtgggtatgtaagatgttctacctcaacttttggtccttttttgtgtcaacatcccatgtgaagaacctttcatgaaccacaacctatcttctaaaaaccatatacttgctgttttcttatcacaaatcattcactctccctaatgtacatctacatatgatgcatgtttcttttccctcaagccaatttaaactaaggaatgtgatctatctaaaatacaaagtatcaaaaactagctggattagtcgataattaggattgtttccattctaaaaaaacgccctcggaccattcaaactgctcctccaaaacccgtaaatctggttttgcattgaagatatcaagagtagctttttatgaatcgggaagaacaatggaggattcatttgtcagtgtcaggcggattactcacagcctagacagaggacgcacctgccattcatcctcaggttaagcacgcactagtctcctttaccttgttgtagtgtgttgcagagagtcacatgcatatttcatcttgtggcaggatcaggtgcatggttagggcggggactggcttgtgtttgtgcacagaaaagggatcaccactctcgttattcctttgatctcacccctgctcaggcaccaactagcatcagctagttagttagttaccttttaagatggtcggggaaacattagtagctggttagttagttagttacagcagctttgggttaagagagataaacgcgaagccatatatattgacaattggatggtgtataatttattgttagaaaacgagtccgcatttgatattcgatattgcattgcgttcaaggtgatggatgataagtggctcacaatgcgggattcctacatggatttttttttttttttttttacatggattttaacgtagcctttctcctccatatagctttgactttaagagatcaactcagtcttcagagactgagtgtaagtaaatttgtgtttgtttggcagacggtgctgaaatcgacaaggcatcaactggagagagagcttctactggaagatgggacccgagtccaagccttaccttgttttaacctcctcctccagaaagagttagagtatatctcccaacttaaaatatagatgtcaatcaaaaagcaagcaacaattggaaaaatgaatcaagaagactagtatagatccaacatctgggaaccacaaaacaatctccaattgctgagtggatcgtaggaagggccaatttacaaccctaaacttgtgaaagaagaatgaattttaatcttggcgttattgggcctccgctcctctggactctgtcgggcttgatccattttcgttgctgagtggatcgtaggaaccctaaacttgtgaaagaagaatg

SEQ ID NO: 8190 - DNA, 3000 bp, Unknown
  misc_feature (1)..( 3000): cDNA_ID_1808065_gDNA_ID_1621200_Annot_ID_174886 3000 nt of promoter + ATG
atcgctgagtgatgacgatgatgataattaatttcgaaagcgataacgttttgggagatttggaggagcttaccgttgtgtgaggagcgtttgaggtttttggaagaagctctctcgatgtgttccgcagagaaaagctaaagaatgtgaccttatcggtaatttgtttaatagttcaaattattttcacttttactcctctatttctttagtgtttctttttagtgccttcaaattttgaaaactaacaaactcaaccccaaaccaaatccagttaccaagttgcagcattacacttcatattttcatggaagactacattaggtggaacattgaattagcatagcgtcacgggagctcaagcgattctctgaacctttcttcgcttgtaagtcaaggaaaacaaatggtcactattggcttctcgagcatgattgtcttcgctcaggacccccagcggttttctcagagccttggcttccctctgaaagttattactagacgaaatcctcttgctctctgttgtttcagagcctctgtcaacagtcctaggcttaaaaccaggagacttcaggtggtaccggacatattcttcttgctttagaggtatattctgttctgtgatggagtaatttgaaacacggagagcactgggaacagtgtgtgttggatcatgaaacaccggttctgtaccttggattgatctttgtgtagtttccaaataggttaagaaagggtctgggatagaacagccaagagttccgtagggtggtttctcaaatgtcgtacctaagtatggagacgctgcaaatctagtactctttgaaccggtttcatggatttgcaggagattgtttcctggagctacatagggtttcctgaggatggcagaagaagatttagggactaatttgagaacaccctttggcaaagtctgatgatgatggccagcagaaactaagctggaaccttgataccggaatactccttccttggttatctttatcttgagactgttcttggagctgccactgcgagggaaggttaaacttttcgatctatttctttccacgggtttcactacattgggagttttgaatctacatgtagcactatccatttccttagatggaactctattgaggtccagtagcttgagattaccggtttgagttcgtcctgaccaaatgaggagccttgagtaattgcccaatttatttccatactgaacccacaccctttgcatttcggtaaatgtcctgatcagcttttcatgatagaactttaaagagtagtaatactttctcctcttgacaaacataacaccttctttgaaacaagctacctttggagtaaacaatccacctagcaaattcttgtaaaacttatcctctggattcccaaaatataaattggcaccatcaagaagttcctgcatcgtcaaactgaaagtctgtggatccatatctggcagaaaacatgagaggaagaatctttcttcttcagtcagaagtgagttccaagtctcaacagacaatattcccgttaaatctggtagatcgtagagctcgtatggtatgttacagagctgaccttcaaccaaagctagctcacagtttacttgcgcaatgtcgtaatcatcagagtcatcatcttcagagtctagcccaactgtttgattcttattcatctgtagttaaccacttactacccttaaaacacaagtacttcaaatctccaaccacaaactcagtagaaaggaacacaagcaggagatacctagatagaaaatgttaaagactcatcatcagcaattcacattacaagaattctactacaatacaatggacagcgagaagctgagtatgttactaatcagaaatcaaacgaacataaatagcattttactcactgatttcagcaacaacaacactaaaggctatataaaacacgaaatatacattgtgagatcaatgaagcactcaaaaagaagaagatacacaacaccagaaaatctcccagatcggatcagctacaaagcttaaacgtaatcgatcgcgaactcaatcaataaccaaaatcaaaagctccaacaaggcaaataactagagagcgaaaacccttggatttgacaacaaaaatgtgcagacaatttgaataaaaaacaagtatcatacaaatctcagcacaaatcagctccaatgagtttcaaaaacctaccggaactaataaaaaaaaagaatctcgagatattcagagaaatcgatcggaaagcgtaaaagacgaggagcttaccggctctaaagacaggtgaaattagcagattagggtcgaagaaaccatatccctttggctacagatacgaacttcatcgccttcaaagattctctgcttcctttctagagatttctatggcttttcgatcgatgcgacagtagagtagagactagagagactaattactgttacacttgtattttgatttctttaattaaagccgcctaaagtaactaatgccttgattactttaattaataatcatttttaaattgtgatttataatcaagttagacattacttcacaaatagtttgggcctggaaacgtataggcccatgtaaactttaataaaagaatcaccttgcaggtaagtataatatcctgatattattatttacttgatagaatgggcctataataaaagaaatcaccattaaagaattataggcccatgatatcaagtaaatatcaagaaatgatgattaatgatcaagttagacatcattacttgatattttggtaagtaggatcaatcaacggtcaggatccttttagtaaaatcatgtgtcattttcagtttgtctaaaagataagcctttcactttctctctctgtcttattagaaaagaaaatttgtaccgtttccaaagtctgagccaatcattgtgttgattctggaattctttgtgggaacgagaaatttgtacaagggagattcatc

SEQ ID NO: 8191 - DNA, 3000 bp, Unknown
  misc_feature (1)..( 3000): cDNA_ID_2125069_gDNA_ID_1621200_Annot_ID_174885 3000 nt of promoter + ATG
agtacccgttatgtacttgtatactcctgatttgtaatgtgcaaagtcctgaagaacaaaaagatacatgaaaatgtggacttcaccaagatataatcaatatggtttgatcaatcaaaaatctttttcattacctcgtaaacggtaaaagcaacctcgacaggtccattcttgtaaacctcagccataatgtcttgagggtcaggattgattctgtatgcgccgacaccatagtgttttgattcaccccatagctggtttctgcttacacatttcctctcacattttggtgtagggtaagtgggttcacatcccgggtgagagcaaccagtattgtcaaagtatggatcacactgaagaaccaacagcattacaaaagttcaatacactttgaccacattgccattattatttgttctttgctgagaatttacctcttgggttactacaccgtggtacttaaagtacaaccatgcacccattgggaaaccaccattacaaccaaaaccgcaaagtaatccacaacatgctatgacatcattggcagataaggaaacattctgcaagggaagaagagcaattacattaaaaagctgtagcaatcgtcaatcttggcttgatggagaaagttgtgttaccaagttatatttgatgcagaacctgtcggacagtgattcaacagcaccaaatgcccagcaagaaccacaatgacccaaaagaaaccaaaaccataaagttatcgtcgaccagagtaacacattgttcaatatataacccactcaaatgaaatgatgtttcacctgatctttagtgcaataaagagggagataatttgaaacaaaacataagaagagtcagtaaatcattgggttaatgacagagatagtggaagctaagagattaaaaccgacctaagatccttcgaatactggtgcaatgtgaccaagcggttctagcatcaaattctttaggaagcttcaacgataaatcatgtcttacaataggtacacctaagtatgccgtctttggtgtttgtataacaccgaggagtcgcttaaactctgcaacctgcacatacatacacaaaaacacaaactttcaggaacaatgataagtaacgtagctcttaaagagataagagcatggaggtgataataaactcacggtggcatttgcaaaccgatcattgaaagcagctttccaaccagcgtttggattctcattgacttcctttacaatctcattctgcaaaagttgatcatcaacgtttaggcaatctaaaagagacgaaaacaatacagataattgtgtggattaagatcaaaacctgaagaatcagtgaggtcagtttctgcttggaaagattttccgctgcaataccctgagattaagagataaaccagcttcaaaagtttaaaactttactgatatagaaacaattacaaaaaaccatatatacatttccccttcatatgtcttagattgatacgcagagaaaaaaatcacaaagtttgatttattttgtttttttttaacttgtagctcaagagtccaacaaatcgatcttagtaagcaattttaacacacagattacgaaagtttaaagtacctgcaagttgaaggatgaaaataagagcaagaaaacagaggctaataagtgaagtctgatacaacaactatcagccatgatgaatctcccttgtacaaatttctcgttcccacaaagaattccagaatcaacacaatgattggctcagactttggaaacggtacaaattttcttttctaataagacagagagagaaagtgaaaggcttatcttttagacaaactgaaaatgacacatgattttactaaaaggatcctgaccgttgattgatcctacttaccaaaatatcaagtaatgatgtctaacttgatcattaatcatcatttcttgatatttacttgatatcatgggcctataattctttaatggtgatttcttttattataggcccattctatcaagtaaataataatatcaggatattatacttacctgcaaggtgattcttttattaaagtttacatgggcctatacgtttccaggcccaaactatttgtgaagtaatgtctaacttgattataaatcacaatttaaaaatgattattaattaaagtaatcaaggcattagttactttaggcggctttaattaaagaaatcaaaatacaagtgtaacagtaattagtctctctagtctctactctactgtcgcatcgatcgaaaagccatagaaatctctagaaaggaagcagagaatctttgaaggcgatgaagttcgtatctgtagccaaagggatatggtttcttcgaccctaatctgctaatttcacctgtctttagagccggtaagctcctcgtcttttacgctttccgatcgatttctctgaatatctcgagattctttttttttattagttccggtaggtttttgaaactcattggagctgatttgtgctgagatttgtatgatacttgttttttattcaaattgtctgcacatttttgttgtcaaatccaagggttttcgctctctagttatttgccttgttggagcttttgattttggttattgattgagttcgcgatcgattacgtttaagctttgtagctgatccgatctgggagattttctggtgttgtgtatcttcttctttttgagtgcttcattgatctcacaatgtatatttcgtgttttatatagcctttagtgttgttgttgctgaaatcagtgagtaaaatgctatttatgttcgtttgatttctgattagtaacatactcagcttctcgctgtccattgtattgtagtagaattcttgtaatgtgaattgctgatgatgagtctttaacattttctatctaggtatctcctgcttgtgttcctttctactgagtttgtggttggagatttgaagtacttgtgttttaagggtagtaagtggttaactacagatg

SEQ ID NO: 8192 - DNA, 3000 bp, Unknown
  misc_feature (1)..( 3000): cDNA_ID_3047856_gDNA_ID_1621200_Annot_ID_174883 3000 nt of promoter + ATG
gaaaattgttataccaatgtatgtttggttcattgtagcaagaatcagtttcattctttactggcttgtaggattctgcaatcgcggtagtctatgcagagaacagcggaagatgcagcaagaacgataaggacgaaaaggtttgtgttttcgaatctctgatttgatccgacttggagagagactgactgttaaaagttgcttacctgctctcggttcaggctcttccaaatggtgaagcgtggatcccgaacttggttaaggcgataactgatgtagcaacaaaccagaggaaagcaattcatgtagacaagaagatggtagatggatcttactctgatgataaaggaaagaaactcatccctcttatcataggcgctcaggtaagaaagagacacagtttgatttattgtcttgttcgaatttggtaaacaagtgaaatcctttcttctactttgcagtatttgatcgttaagatgattcaaggagcaatcagaaatgatatcaagacaagtggaaagccactttaagaggctctgaagaagaggttttgttgtgagcaaattacaaggagaagaagagtttttcgattgttctttcttttgttagattttatctgcaacattttcttgtttccggctttatctttgtctgtaatttatggagatttgttcaaagaaaagattgccatgctttctggttaaatgaaatggatgtttcccaatcataatatcaccaaaaaaagaatatattatgttctgtagataagaaaaacaaatgatctgctaaagtctgttttgaatcaaacaagtcttttagctgatgggattaattgtttgcatcctcgggtgattacataaacacagatcaacagaaaactcggcataaccaaggccgcttctatctcccacaggaagactagcattggtagcctgatgtcaatgtctgttagatcatcaatcactgctgcttctgttccattataaacagtttattgagaattggttcggaatcatcatcatatccatctcttatttcctaatactaatagacatgagtgtttgtttgtaacagaggtttaagaaatagatcgtcccggtcccacataatctaacaaacttaccgtttagattagataatcaccatcagatctcacagttgcaatatgatgaaaatagacggtccagatttctcgaacgttctcaaataagaaaaaggaaacaactgttgaagataaaaggaaagtaggaaacaatcgaaatttggatatggtaatagtcattttgacatgtgcaatctttttaatatgttgtagtacctgaaagaagctggatgggctcaaggagaccgagtttttgcttgtaccagccaagacctttagctgtcccgatttgtttttggatcatatcacaagctgctgcatgaggtattgctttcttcatttacttttttttttagtaattgattgaaagattttttcaaccatgttttgttttttttgtaagtactaaatttttaatttttgtgacataacatccaaacagaacgtgccaaaaaaatttgataccatacgcgaaaatatgatttaatattttaataaatattataaacataacaaaaaaaataattaatatttaaagtttaataataaattaagcaaattttaagcaaaacataaataatttagaacaaaaatatgaccaaaaacgattaggttgattataatgtgtaaactagtaaaatgtgctagtgtcgttattatgttatcaatcaaacggtataatgcatgttgttaacaaaacaaaacatagttttattgacttctcaaaaatgacctttgaaataattacgacaaagaatatttttatttttttactaacctttctattatcgaactctttcgttgtaaaaatgtctcttgtcgccggtagtgtcaagaagacggacctttgaaatacttctcaaaaaagacctttgaaatattcaaaggtatagcaggtggcgagatagcctggcttgtgagagaggagctttccgtcttctttgttatgtgtatattttaataaataatttttttgttatgtttacattatttattaaaatattaaactatatttttttgtttatagcatcaaaattcattggcacgactctgatgacgagacaccaaatatccatataatggtgttgcagttgcttcgttggaaagacgataatcaacctccggccaagataatcttcatatcaaactcgctcagtatctatcacttctcttggttttttgcttaaaatccgctcagtatctgatgaatattataaaatttcttcattgaattttggggtttgaacagcaaaagtaagaatctgatttgtctgaaaattaaacatttgcgttcaataaatagcatgaatttgatttgctataatttcgtagaaaaagttggacaagaagaagaagaagaatacaacgtggttaagcaatttgaatccctatattttgtaggcatgatataaacattgctgtaaaacgataatatataatcggtgtgatacaacaagaccgtgtcatgagaaaccgacatagcccagcctgatacgcggttctccttctccaatcattaatatccctcttcttccctgcaattactctttattgtacttaccttttctcataaatctacaaaaaatacaagtacgatttaaaacgttatgatcgttgtaaacttccatgaatggccaaaacaaaaataccaaaatctaccattggtcaatagactaatttttctttatttcattgcaattatgaagaaattacattgtctttatttcactgaaattagatatttacgaaaccaacggttcatatttttttttaacttatgaataaaataataataataataataatcaagtactgccaaaaagaataaatccgatagaaattcattataagatgagaaaaaagatctgttgagagaattcgaaagaaaaactcaaatg

SEQ ID NO: 8193 - DNA, 3000 bp, Unknown
  misc_feature (1)..( 3000): cDNA_ID_2125058_gDNA_ID_1621200_Annot_ID_174881 3000 nt of promoter + ATG
tcagatatttgattcatcaaaatcaccaactagggtttacaaagtccatgcttttcgatcattgatcagagagctttcaagaaatatttgcaagaaaatggcaatggctccagtaataaagctggtcttaggttcagttgcctttgccattttctggatattagcagtgtttccctctgtaccattcctaccaattggtcgaaccgccggttctctgttcggtgcaatgctaatggttatcttccaagtgataaccccggaacaagcttatgcagccattgatctcccgatactcggtcttctctttggaacgatggttgttagtatataccttgagagagctgatatgttcaagtacttaggcacattgctttcgtggaaaagcagaggtccgaaagacttgctatgtagagtctgtcttgtttccgctgtttcaagcgctctgtttactaacgatacatcttgtgtggttttaaccgagtttgtgttgaagatcgctaggcaaaagaatctcccgcctcacccgtttttgctcgctttagccacgagtgcgaatattggttcttctgctactcccattgggaatccgcagaatcttgttattgcggttcaaagcaagatcccgttttgggagtttcttcttggtgtttttcctgcgatgattgttggtattaccgttaacgctatgcttcttctcggtatgtattggcggttattgtcagatcataaagaggatgaagaagaagtacaaaatgctgattctgaagttgttgcccaagaagatgtccaatctcataggttctcgccagctacattttcgccagtctcatccgaagattcgaacttgagaatggatgccgccgagactctcagaaacagagcgggttcagcgggtgagagcgagttaataagctgcaattcaaatgcgtcgagagaacaacacaacgacgcagagtctcaaggagagagcaataataccaacaatatgttccagaccaagagatggagaagagttttatggaaatcaagtgtttatttcatcacattaggaatgctaatatctctgcttatgggtttaaacatgtcgtggaccgcaattaccgcggctctagcactcgtggttcttgatttcaaagacgcaaggccgtctctcgagaaggtgaaaaccaaattttcttaaactctttagagatacaattcaaagatcttatcaaagttgtaacttttgcaggtatcgtattcgcttttgatctttttctgcgggatgttcataaccgttgatggattcaacaaaactggtatccctaccgctctatgggacctaatggagccatatgccaaaattgatcaagccaaaggaatcgcggttctagcagttgtgattcttgtcctctccaatgtagcctctaatgtaccaaccggtaatgtcattatttttaaagccaaacatgtatggttggctccacgaacaatttcttgattcaaaaggaaccacaagaccatgcgaatgattattttttcttttttttttaatcgtttgtagtgcttttgttgggagcaagagtggcggcatcagcgatggggagggaggaggagaagaaggcgtggttgttgctggcgtgggtgagcacagtggctggaaacttgacgttgcttggttcagcagcaaacctgatagtgtgtgagcaagctcgtagagcagtgagccatggatacactctcactttcactaaacatttcaaattcggtttgccttcaacactcatcgtcactgcgattggtctcttccttatcaagtaaatcatagctcactctgcatatatgctttcttttttcaagaaccagtgtttatagctaggttttatttccacacttatgtaatttaataatagttataatatccatatttgcatcattgaaaaacaaacagtatcacaactatgggtctgactggtagtcttctatagaagaaaaatagtgagaagaaaaagaattcttctgtgttgtacttaaatgtaaccagtcagataaaaagtaattggttttgtttcttcccaattcttcaaaaagcaataaaaagtaattggttttgtttcttcccaattcttcaaaaagcaacgtgaaaaggaagaattcatcccacttcaaatacatgagagagaaaattcttctgctttttgctttttcttttcttcacttttcttcgtttatttttcatctcatttcgtccattttttatcagtcacaccctatataagtaagaaaatggtatagcatttttcaagttgaagtggttcttctactccgcagatgtgtgtatgtagagctgaggaatttatgaatgtatatgtaagcgcccctctttttttttgtcttttgtaatttaatattcacattgtattgtatgctatgttccatactcggcaaatccttatatttgtggctggttctttttatttacgacttctacgaagtttcctatatacaaatttcaatgtggtttactttttgtgatcttatataagcttcaagataaattaaccattgacgttaacgttaggagtaactgtcacatcacatgactaagcgcactttgacttaagtgggtagggtatcaagaagatgatctggtaggaaagaaattatgtgacccaacatctgcattatggggtccaaaacctgtccgtaaaatagttgacgaaatctaccaaggatctcaatttttttttttttttttttttttaggatctcctttattgtgccttatataagcgcacaaacccatcttgcctgcttagagcatgaccagcggtagttttttaaatttggttctcaacagttaagatatgctttaaatccctttgttggacttgctcttatgatataaacttgtagacgagcgggcgaagagcgaccatagagaaagctctctacttcatattttgatatctttccctctcttagttttgatctgaacctttttgtagctgttgaaaaatg

SEQ ID NO: 8194 - DNA, 3000 bp, Unknown
  misc_feature (1)..( 3000): cDNA_ID_2125031_gDNA_ID_1621200_Annot_ID_174872 3000 nt of promoter + ATG
tgggatcctctccatcgtttccatcatgggatacattacttacattgacttcatgaacaacatgggacattgcaacttcgagcttttccctaagcgtctcttccacctcttccctcccctcaagttcctctgttacaccccctcgtacgtcgtttgtaaaaacactactatttatttggatttgaatatatgcatgcatttataacatggcatcaaatatgttgaaggtttcactcgctccaccacacgcagttccggaccaactactctctgttcatgccaatatacgacttcatctacgggacgactgataatttgaccgactcactatacgagaggtcgttggagatagaggaagaatcacccgacgtcatccacctcactcacctcaccacacacaactccatctaccaaatgcgccttggtttcccgtccctctcctcttgccccttgtggtctcgacccccatggtacctcacatgcttcatgtggcccttcactctcctctgctcatttgccctcacttcagctatccctttgcgcacctttgtctttgagcgaaaccgtctccgtgacctcaccgttcactctcacctccttcccaagttttcctttcacgtaagcattttacacgcatgcatatgcactttccctctctctcgctctcttgacacaaacgggtttacttattatgttgtacttcacaccactattttccaaactttcacacacaaaaaaaacattgattctcacttaacttgtacgtactacgtaggaaggacataaccttttatacaaaaagaaaattaaaacaacctaaaaatgaacaatgaacattttcttgtgggtataccttttgtaagttgcatctaaagtttattaataattttgcctcataaacatgcggcggtagtataaatcacagcgccaccatgagtccatcaacactatcatagaggaagctatccttgaagcagatgaaaagggtgtgaaagtaatgagtcttggcctgatgaacaatgtaagtttatttacttcaaatccccctaaatatatatgaatcactattggataagtactgtaactaattacacacgctggcaaaagaaaaaagtaactaatcaacacacaattaattaatgagagggaggaactaaacgggtctggagaaatgtacgtgcaaaagtatccgaagttgaagataagactagtggacgggagcagcatggcagctacggtggttatcaacaatattccaaaggaagccacggaaattgtctttagaggaaatctcacaaaggtggcttcggctgttgtctttgctctgtgccaaaagggcgtcaaggtttgtgaatatatgagggaattggaatatatatactcagcttctcatatcaaacaaaaaataatgtagtaatgtgtatatataggtggtcgtgttacgcgaggaggaacacagcaaactcatcaaatctggggttgacaagaatctggtactgtctacaagcaatagttattactccccaaaggtgtggttggtgggggatggaatagagaacgaagagcagatgaaagcaaaagaaggaaccctctttgttcccttttctcactttccgcccaacaaactccgcaaggactgtttctaccagtccactccagctatgcgtgttcccaagtctgcccaaaacatcgactcctgtgaggtacatctttgaattcttatagatatatctgtaacttttatattatataagctgatagatgtgttcatctataatgaatgaatggttgttatatatatatagaactggctggggaggagggtgatgagtgcatggaaaataggaggtatagtgcatgcacttgagggttgggaggagcatgactgcggcaacacttgcaacgtcctccgtctccacgccatatgggaagctgctcttcgccatgatttccaacctctcccaccatctcctctatgagcttttttcatattcatacatctatgtcccctttcttgattatatctacttcccttccatcattgtttgctgtttactatgtttttctatcgacaatatataagtacccttgttacccttggtgccacgtgcttcatatatgttagaaagggcaaaaaaattcgtcgtatgatatgcttagttaaattttataaaactcaataaaaatcttcagaaacagtgctatgatcattacatcttaactaagtgatatatatctgcgtgcctatttaacaaaataaacaaaaaaacaaaacaaaatatatttgggtgcatcatcaaatcaaagtagttgcaaaaactggacgaggtttttacttaaatggtccttaccccgcatggtccacttgctacctaattaaggattggtagggtgcgtatacgtatataaattgtggcggtgggagatggagttactaaaaacgaaacgtacaagtattattcatagctctcgtataaggggttagtccttagatctagatattttcacttttctttcatttatgtcggagcaacagacactagctggcgcttcaacgtgcatgatcttgattggctagtaaattccaagcatcaatacctaacacatgcccaacttggttcattagtattctttcattggtaaaatacccttacctttcaataatatccagaaataaatatatgaagccatccatcaaccggtgcatttcctcaaggcatggatatgatatcagaacatcgatgaaggtgggagggggtaattagctgagtgtcataaatgaggatccatgtggagatcatcgaatggtagtagtacatgtttggtcttagctggccccaccacaaggaattggactggtgggaagataggggtggttacgtcattccacatatctaccaattaaggagtttaatataaaccttgctatataatgtaccttggctcacaagagttgaagagacacagtgacgacacaaacatattacattcgacggtata

SEQ ID NO: 8195 - DNA, 3000 bp, Unknown
  misc_feature (1)..( 3000): cDNA_ID_3047871_gDNA_ID_1621200_Annot_ID_174871 3000 nt of promoter + ATG
tctctcgccacgagctcaaaggctgcatcaacgacgccaagtgcatgcgtcaccttctcatcaacaaattcaaattctccccagattcaattctcatgcttaccggtacagagtatttctatcttttcaaatgcctatgtttgctactatactactattccttggattttgaatacaattttccttggcctcttcaatctgataaacacacattccaagttaccatttcgaaccactttgataaaaatgtgttgcattccatagctgactaactaattgttcatcatggatggttttcattctcagaggaagaaactgatccatatcgtatcccgaccaagcaaaacatgaggatggcattgtattggctcgtacagggatgcacagcaggcgactcacttgtcttccactactctggtcatggttcgcgtcaaagaaactacaacggtgatgaagttgatggctatgatgaaacactctgtcctctggattttgaaactcaggggatgattgtagacgatgagatcaacgcaaccattgtacgccctcttccacatggtgtcaagctccattcaattatcgatgcttgccatagtggtaccgttctggatttacccttcctatgcagaatgaacaggttattagtccctcaaccgcttctaaaagggatgttgcttacctctctcgttatatttaacatacatccatttttttttttaattgaaacagagctgggcagtatgtgtgggaggatcatcggcctaggtcaggtttgtggaaaggaactgctggtggagaagccatttcaattagtggatgtgatgatgatcagacttcggccgacacatcagtaagtagaacgactctaatcatacgtcttgctgttgtagttggttcctcctctcatgattaaaacacatacacaggcgctgtcgaagatcacgtctacgggtgctatgactttctgttttattcaagcaattgaacgcagcgcacaaggcacaacctatggaagccttctgaattctatgcgcaccacaataaggaatacagggaatgatggtggtggtagtggtggagttgtgacgactgtgctgagcatgcttctgacagggggaagtgcgattgggggattaagacaggtaaaattctttcttgctctcttgtgttgatacagatcgataaatgttttcttaaatctgttttttgacaggagcctcaactgactgcttgccaaacattcgatgtctatgcaaagcctttcactctctagtaaaggacaagtcactttttatgtatagcgagtgtgatttgagaatccgtccatataaccaccttttgtttcttatttttatttttctttcaaaagaataaaggaaaacattgatttggtgattcgataacaaaatgtgccatctattctttagtctttacaaacaagcagcaaatggtttgcctttcagaatcaaaatttaaggtgtttctcgaatagacagaaggaagagaagagaagtcccagaaagctgttcagaaggcgcatacaaatcatgtgtgcgttgctgctgcaaggaaaagcacttccgctgtagcagcctgttctttgtttgataccccggccgttatcttccagtacaaaggaggagtttttcacaccatcgctaaagagaagacaccaaaagaaggtacctttatgcaacctagccattcccactccaacctcggtatgcgacctgtttctgagcaccgacaacgcactgctatctctaaagagaatgtctgagaaagcgacttctggtgctgcatacttagagctgcagccgaggatatggccagttatggtaccaaaagtggggagttctacaccacagtttggggcaaacacctgagtgaagtcgtcttcagggtgttcacagctgagagtgttgttgacattgcaattcccctcgcagagctcaacatactggagggccatgcagccaagaccgggactctcatttagtttgcctagtttccgagctgttctgttctggttcaagatgctcaccatttcatgagctgagtttcctgcaaccattctaactaacacttagtccgcctaaaacgaatcaacataatataaactgtcgaatctggttctgactaaagaaagcgaactcgagattaaatcagagggagtggctgtaaattcaaaataaagcctggccaaatgctgaacgagaaatccaagtctatattcgcatatgttatgaggggataaagcaaggagttaccgtgcaatttggagctagctagcactgatgagagtgacagaaacagtaaaatcaactccaaaatgctgatttcgttcttcatatcgtgttttatcctctgaattcccagcgtaatagctcgagctggcggattttcgaaaaatcgagaaaaacaaaaaacagaaaaggagaaagtttttgaaaggagatgagcttgatggagatgttgactggtccctgaataaatgaaaaatgtgttgcattatttctattattgagaagaaaaaaaccaggcattttggttattgggctttgatttgatgttgggctctcaaccattgaaattgaatgaagaaagaaggaaagtacgtgacttgaatttcatttacttcattaaatgggcggcgttggggccggtggaggtgggccaatgacattgatgtgtaaacagaggtaaagccgaattttggctaaggcgaatcaatgcccattggctcctctccttacatatttgaagtttgaggtttccttccttttcttaaattaaatgttgctgtaacatttctactattgtaaaccggggctccaccaccatgtgcttcttcaacactgtatcatcagagcccacatggtcatgcctctatataatactttgtattattattattcttatgtcacattataaacaagtacctccaaattgcacttccttcaaacttattcgacagtagactagctcaagtacctttgg

SEQ ID NO: 8196 - DNA, 3000 bp, Unknown
  misc_feature (1)..( 3000): cDNA_ID_3047879_gDNA_ID_1621200_Annot_ID_174868 3000 nt of promoter + ATG
ttcatcttactctactagtagtggtccttcagatgtcctagcaatctttcccatgacccatctagcgtaggccttactaggttctgcttatgtttttaaattttgattttgcagtcaatctggcatatggtaattggttaaagggaaatttttatccagctttgagtttcctggtatgtattatctttgtggtgacatattttctcgattatagatttagaaaatcggtcatgctatccagaactatggggtttgctgacatctctgttatccgataatcagatttttgccactgtaatcttcagatgcgatacgatgttactgcttgggcctattggtcttgaacttttattggtgagctggtgacgaatattaaatagtttgggttctcaacttctgtatatgtataattggccgtatactttaccgttccatctgatgcgggtgctttatgtttgtcaatgacagaccaaatcgatctccttctggaaagcacttaagtattgtgttggaaccgctctgttggccgtaggttggttaaaattcctcttctttctgtgatctattttgctttttcccttcagacactaattcccgagtctattttctgtggtcatggaataatccttagcacaggtcttaccattttcgttgactctatcatgtggaagaagtttgtctggccagaatttgaagttttctggtttaactccattctaaaccggagttctgattggggtgtatccttcaaaaaaattgtttcctcaattgatttatttttcatatgatgcataatgttctagcatttttctactgcctgattaaaggattgcgttctgtacaatgataaccgtttggaatttccaattcaaagtttaatattgtggcacttgcatttgtatgaaatgatgtgttgtccttgaaaattagttgctaaactagacacattccatacattggtacttcacctcagcactcccacggtctttacttgtagcttatccactttcattggtaaataccagacttcctaacatctgtgatagtgtttgtcttgttcctttctagttaggatcgctaattgtatctctacaaattttcttatttggtttctttttatgcagcttggtactttagttgacagaagggttccattctttatagttccagttttatcgttcgttatactatactctaaacttccacacaaggtattcagatggattacttatctcagtagccatcaacgtttcttaaccattttctgacatcggcttacctatctttcttgatttatgaaggaactccgatttatcattagttcagtgccaatgttcaacttgtctgctgcagttgctgctagcagaatgtatgagttctatcagatgtttgctagctaagctttcaatcatagctaggacgttctttgattctgtatcttaagagctctttggagtttggatacacataatttctgtatgccactttaaattactaccaatgcgggccgacctcttaatataatccgattttgttgtacagctacaataataggaagaaaacgatttggaaactggtgaatatggttatgctagcgttttttgcaatcaggtagaaatagtaaacaattatctttgctatgtaagagaaggaaagagatttgctagtctactaaacctggttctatagtgcagggtgcacggttgtaacattcatggcatcttactacaattatcctagcggctatgctttaaagcgcttgcatcagattggtgagtgacttattctgttattggggtttgttattaatgcagcagcattgacttggctatcaaacaagaaacatctgctggtcagcgtttgttttgtggtgtctatctacctctggttgataatttgcctacaatatgattaattgacttggtgccttccatggttctcaggccatcctgcaaatgtagctggggaagagtgggttcacatagacacttttggtgcgatgaatggaatatctcgcttttgtgaagatgattttccgtggaggtatgttagctgtactacctcgttttagggttggtaaaagtaaaggaaatatcaatgtacatggaaaaaagttgccactcggaagcacccatttgtgcgagatgaggcatctgtttgtttttcatgttcattttcttggatacgaatatcactttgttggaaaagggatcattctacattgcctttgaatacatagaagaggtatctgtttatctatttaggaggatataaaattttgttgtgcaatgcagatattccaaagaagaagagatagtagtggaggagttgcgaaaccgaaatttcacgtacctggtgaagtgagtatttcatcatatagtagaaagcaattcatagtaaataaaaaaagataccactggtggtcaacatgtaacactgttgtcatgcttggtgcagcgagcattcctctgtagatggatacaagtgcttattttatgaagaaggctttgagagacttgagctgcggcgaggtttccctcccattgtcttggtaaatcggtgggcgtggggctagtatttcatcaaaataggtgcatggaatgtaatgtaatgtaatgttgaattgcaggtaaaaaaagccaaagtatacttgcaccgggagatgaagaaggaagatccttttcataagaaatggcctggatgttaggtaatcctacaaatagagacaatgttttgggtcgatgtaatgtagcattcctcagagaggacatgatgtaatgtaacaacggagatgcttgttactgacttactgtaatggattcaacaaattcatccagaagcatcatcggcctttgggctttgagttacgcgtcacaattgaatcaattggtccttttaattagttttaccaatatacccctccgtcttttcccccttctcgtttaggaaaaaaaatcattagcttcgacttatccgaaacctaacgagtaacgacgagag

SEQ ID NO: 8197 - DNA, 3000 bp, Unknown
  misc_feature (1)..( 3000): cDNA_ID_3047883_gDNA_ID_1621200_Annot_ID_174867 3000 nt of promoter + ATG
gcaggagcttgaaaagatagtcgctgcaaatcccaaaacgctaattaaaccctaggaaccacccggagaatcaaatatataacagaggtaatttcgacccaagtatgtgtcgatggagaaaggaacttactactcaggattcatggttttcgatctgtgggaggaagagcagcgagcgatacagagccagagatctctctctctcttttctgattttctctcgcgatttacaagaggaggagattcagtgtttgggccttgaataataatatgagcgaaggcccaataatgcaaaagattaaaattcattcttctttcacaagtttagggttcctacgatccactcagcaacgaaaatggatcaagcccgacagagtccagaggagcggaggcccaataacgccaagattaaaattcattcttctttcacaagtttagggttgtaaattggcccttcctacgatccactcagcaattggagattgttttgtggttcccagatgttggatctatactagtcttcttgattcatttttccaattgttgcttgctttttgattgacatctatattttaagttgggagatatactctaactctttctggaggaggaggttaaaacaaggtaaggcttggactcgggtcccatcttccagtagaagctctctctccagttgatgccttgtcgatttcagcaccgtctgccaaacaaacacaaatttacttacactcagtctctgaagactgagttgatctcttaaagtcaaagctatatggaggagaaaggctacgttaaaatccatgtaaaaaaaaaaaaaaaaaaatccatgtaggaatcccgcattgtgagccacttatcatccatcaccttgaacgcaatgcaatatcgaatatcaaatgcggactcgttttctaacaataaattatacaccatccaattgtcaatatatatggcttcgcgtttatctctcttaacccaaagctgctgtaactaactaactaaccagctactaatgtttccccgaccatcttaaaaggtaactaactaactagctgatgctagttggtgcctgagcaggggtgagatcaaaggaataacgagagtggtgatcccttttctgtgcacaaacacaagccagtccccgccctaaccatgcacctgatcctgccacaagatgaaatatgcatgtgactctctgcaacacactacaacaaggtaaaggagactagtgcgtgcttaacctgaggatgaatggcaggtgcgtcctctgtctaggctgtgagtaatccgcctgacactgacaaatgaatcctccattgttcttcccgattcataaaaagctactcttgatatcttcaatgcaaaaccagatttacgggttttggaggagcagtttgaatggtccgagggcgtttttttagaatggaaacaatcctaattatcgactaatccagctagtttttgatactttgtattttagatagatcacattccttagtttaaattggcttgagggaaaagaaacatgcatcatatgtagatgtacattagggagagtgaatgatttgtgataagaaaacagcaagtatatggtttttagaagataggttgtggttcatgaaaggttcttcacatgggatgttgacacaaaaaaggaccaaaagttgaggtagaacatcttacatacccactttcacccaaatccaacaaaaaaaaaaaacagagaaccagagacataaaaacaaccaaacttcagtcacaaagtcctcatgttcccaacaaattcatcgcgtcttgacatgtcacaaactgattttcttctctagataggcttgattttgaagtgcagagagatgagcgaaaaaacaagacatttcaagtcctgcaaccatgaaagtttcaaaaggaatatgttagagcacaaataaatacagaaactaaaaaaaaaaaaactacagaaccatgtaagggatgagtgttaacagccaaaccctaaatgttaaagtttgagacagtgaatacgttaaaaggcagagtcctaaatatataatcgagtccaatagagttaagggattaggtaaaagaaaagatggtaaggcaaggggtggaagaaaaagagaggagacctgaacaagatagtagaagatgcgaagtccttcaggatcattactgctctggcaatcaacaagagatccaatcttagatgtagcgaatgagatatgctcattacccaagacgatctcgagctcttgctttccaacacggtcaggttccggccaattgttatcgtcttctttcagaatctacccgcagacaaataatcacatgtcaggttgtacaaaatcatccattattcctagataatagcattaacaacgaagagggttctaaacctacaacactagtcaggaaagatgccctagatcgacaaaaatcgaagcaaaatcactaaaaccctaattggctattatagcgtcgattgaccaaaacgcggacaattaacaagagagaagcaaatcggaagagagagagaaaaaggacctcgctctcggagacgatacgcttgcattccttgagcacggcgggggtgagaaatacctccttgcggataatagtatcgttcttgtagttagagttattggcgtaacggagcttaccgtcctctctaaactcgaactccaggaactcgtgtccaaatttccctttgtgaccgacatagtatctcaggtagaactccgtcgcttcttccgcggccatgccttctctttttttctttctttctcgagatcgagattacctctccgtgtcctttgcccttctttaagtccgtccccgcaaaagaaaaaaggtaatgggcttacatattgggccagaacccatttgtaacccgaaaagttaaggcccagttttagtttttctgtttccatcgaaattgtgtgtgtatccgggctgcctgatttccgattccccgatacagagacgatgccgacggattcgaaa

SEQ ID NO: 8198 - DNA, 3000 bp, Unknown; identical to SEQ ID NO: 8189
  misc_feature (1)..( 3000): cDNA_ID_1810822_gDNA_ID_1621200_Annot_ID_174864 3000 nt of promoter + ATG

SEQ ID NO: 8199 - DNA, 3000 bp, Unknown
  misc_feature (1)..( 3000): cDNA_ID_3047890_gDNA_ID_1621200_Annot_ID_174863 3000 nt of promoter + ATG
aaagaaacctcacctcggtcaagaaacgctctgaaatctgaactctgaaggttgtttttcttcttctttcggtggtgaaaaaattatctttatgaaaagacaaaaaagtttttgaaaaaaggaaatttttttcaaaaaaacagactgagagagagagagagagagtgtgttgttggccatgggatgcacggcctccaagctcgacagtgaggatgctgtccgtcgctgcaaggagcggcgccgtcttatgaaggacgccgtctacgctcgtcaccatctcgccgccgctcactctgactactgccgctcccttcgtctcactggctctgccctctcctccttcgccgccggcgagcccctctccgtctccgagaatactcccgctgtttttctccgcccttcctccagtcaggacgcgccacgtgtcccttcttcccattccccagaaccccctcctccgcccatccgcagcaagcctaagcctactaggcctaggaggcttccacacattctctccgactcctctccttcttcctctcctgccaccagtttctatcccactgctcaccagaactctacttactctcgctctccatctcaagcttcctctgtctggaactgggagaatttctaccctccctctccccccgactccgagtacttcgaacgcaaagctcgccagaaccacaagcaccgtcctccttccgactacgacgccgaaactgaaagatccgaccacgattactgccactcacggagagatgccgccgaggaagttcactgcagcgagtggggcgacgaccacgaccgtttcactgccacctcttcgtccgacggagatggggaggtcgaaactcacgtttccagatccggtattgaagaagagcctgtgaaacaaccacatcaagacccaaatggcaaagagcactctgaccatgttaccacttcttccgactgctacaagaccaaattggtggtaaggcacaagaatttgaaggagatccttgacgccgttcaagactacttcgacaaggctgcctccgctggggaccaggtctccgccatgcttgagatcggccgggctgagctcgaccgcagcttcagcaagctgaggagtaagtctcacactctactaactagatgtagatgatgatgcattgaaacccatctcattctcttactctctctatatttgttgtctgcagagacggtgtatcattcaagcagtgtgttcagcaacttgagcgcaagctggacctcaaaacccccattggcagtcaaatacaagctcgatgcatctaccctgaatgatgaacaaggcggcctcaagagcctctgctccactctagaccgactcctcgcttgggaaaagaagctttatgaggatgtcaaggtacattccctgtttttgttttcggttttcggcttaccaacggttacgaaataaacttgtgaattcgaatttaggcaagagaaggagttaagattgagcacgagaagaagctgtctgcgctgcagagtcaggagtataagggaggtgatgaatccaagctagacaagactaaaacttccataaccagactgcaatcactcatcattgtttcttcagaagctgttttaaccacgtctaatgccattctccgcctccgggacactgaccttgtccctcagcttgttgaactctgccacgggtcagtcttttttttgtagttgtgtttgtgtttcattgttccttgagggctgctggttcggtctaggcttgtttatatgcttctgcaaactcatgtgaacccgaattaggcatatgtaataccaaacccattgctgttctgccagtgggggattttataggtaagttcgaaataaaagtagggaggatttgtatgtgtctctaaccaccttgaaatgcagattaatgtacatgtggaagtcaatgcacgagtatcacgaaatccagaacaacatcgtgcaacaagtccgtggcctgatcaaccaaacagagagaggtgagtcaacatcagaggtacaccggcaggtgacgcgggacctagagtcagctgtgtccttgtggcattcgagcttctgtcgcatcattaaattccagagggagttcatatgctctctccacgcatggttcaagctgagcctggttcccctgagcaacggagacccaaagaaacagcggccagactcatttgccttgtgcgaggagtggaagcagagcctggaacgggtgcctgacacagtggcgtcagaagccataaagagctttgtaaacgtggtacatgtgatatcaataaagcaggcggaagaggtgaagatgaagaaacgcacggagagtgcaggaaaggagctggagaagaaagcatcctcactgaggagcatagagaggaagtactaccaggcatactcgacggttgggataggccctggaccggaggtgttggactcacgggacccgctatctgagaagaaatgtgagctggcggcatgtcagaggcaggtggaggatgaggtaatgaggcacgtgaaggctgtggaggtgacacgagctatgactctcaacaatctacaaaccggcctgcccaatgtattccaggccttgaccagcttctcatctctcttcactgaatctctccagactgtctgttctcgttcctactccatcaactgattatgtccaagtttctcatttatttttaagctctcattacgttggtatcatgtaaatttgaggattgattaaattgagtcttgtggttttgtgaggactcacaatctttctcatttaatacatgagcagacacggcacctaactaatggcccaaaggtggcccgccaaattgaatacaagggtaagaaatgggccaagaaagtgagagcccaaaagaggccgatcgttcgtttttgactcaatggccgttgacgttgacatcgtacgccgcacccaacgaccgccaaacagcaaacaacaacactttcccctttctctctctaaac

SEQ ID NO: 8200 - DNA, 3000 bp, Unknown; identical to SEQ ID NO: 8188
  misc_feature (1)..( 3000): cDNA_ID_1810788_gDNA_ID_1621200_Annot_ID_174862 3000 nt of promoter + ATG

SEQ ID NO: 8201 - DNA, 3000 bp, Unknown
  misc_feature (1)..( 3000): cDNA_ID_3047894_gDNA_ID_1621200_Annot_ID_174861 3000 nt of promoter + ATG
attagttaggtgaaaacatgtttgagaaatcggcggggattgtgttttcatggtcataaaacatgaccataaacactgaaagagattatgattatgctgagggagtgtgagaaatcggcagggattgtcatcatatagtactagactactagtactttgtataacgttctcaggaacatgtttcggtcagaattccgatggtgggatctagtcgatgacgtaataaacaacactttcatgcccgcctaagaggcagctgtcgcagactaagcaggtttcaacatgtgaggggccaaggcgctggctagtggtcaaaagacggaacactgagaatatctgtatcattccatatgatccaagcgcctagctttgctcaagtgtcaagactattgattactgaatactaaattcaaagccatttttcttttaatgggcagagagacaccaaatttgctaatgagggaaatcaaacataacaaggggttattgtgagagagaacagaggatcttatacaagttgaaaatccgcaaccaaataatcataatctactctcggtaaatggaatgtcaatccgcactgaccatttgctctctcttgctcctctaccttgttacaggatgcctcctcctgcgttccaaagttgaatgtgtgtatgttatatcatctcctttgtacttatcatctcactcatatctaatattcgttacctctttggtcggatcccatcttcttcgtagtccatcactccacttggttccccaaacatctccttattccctctgatgtcaacatccccctgcccacaacgtaagtaagactatatcgaccaccacccttcccaatcatatttcagacacaaaaaaccaaacgaaccttgtttcatttcatttaacaatcagacaataaccaagtactaccattccaaacaattcatgtcctctaatgactttaacacttcactaacagccgttgtgattgcgttccttgtttgtttttaattaaagaaaacttcataatatatgtttacatccaacatgtaagatttcttgttccacgaaagaacggttaaaaaagcccgccacagttggctgatcgattcgtttgttattaagaaacataactttttaatctatgataggactggacttggaaagctcaaagacctagaaagatttttttatcaagtctctcccatccccgcttacatagacctaagctattaataagaagaaacccactacaattctctgaagaaatataagacagaatagctgactggactctaactcatggtcacaagacagtaaccaagaaagaatgtaaccaatattagttacataatatacttagtagggaaaagtgaagccaataggactccaagcgcgactgaccttcatggacagagacttcttcacttcttccaccccttcttctgcttccttacgatgttttttgtccatctcactcatattgtccgcccatttgatcttgtcttgaattgaaatgagcagattctctgacgtgttcaacctagacatcaatttgggccaacacataaaagagtaggacgtcattagccatgtattctaacatcacgtacaagttcttataattagatatagaaggcaaaaaatcctggatctaagggaagaagaaaactaccagttggacaatgtgtgtaacatattccctagttgacctggccttagatccctaccagctgcaaacggaacctgcatggttgcaagagatatatgatgtttagaagggggggctcgtacgtttagaaacaaagcacaatggttaaaataggaaaaggaggcccaaaccaaaacacacctcaaaacatctttttaactgatccagttttcccctaactataccctgcaaagtgtaaaagaaaaaaaatgagcaccatgcgttgtcacagttagttgtcaaatagagattagaagactgctaaagagtactcaccgcatacatgcattcattgataagaaagtcctcgagttcgcgaacattggaaacatctaactcgaccattagtgtatcatagggcaatacctataacaagcagagtgagagagacattcagttaggcaaacagcaggggaaaaagataatggaacagagtagatagcaggagcaaatcatgaacctaagacaaatataccttgttagactcagcaagggtgaggacagtgagctgcttaagcttaagaatttggtcaggggacaagtgcggaagacgggtggcattgcctagtgtttcgatgaaagcaagtcaagaggagagaatatgacaaaagggaaaacgaattgaaatagcatatgacaaaggggtcatacatttgtagtctccccaggtgccatgggcaaacaagcgtagtagatccaggtacacagaatctgtggttccttcaagctgcacaattacgattaatcagctactagtatctatcaagttgttatgatcagcgaagaacaaaagcatgtaaaaccctagatcgtgaaaagcataaagtagtagtacctgggcaacattgggtagagccaaaatctcggagaaggcgaagagagaaggatgcgatgtggcttcgatgatgagcgggcccagagcctcggatttgcaagtagaagctcgcttcacgagctgatcaatgatctcggcttgcttctgctcgatatccatcttccaaacaaatcgatttccggtggtttagggttttctttcttaccacactaataacgaataaaatcccaaacttcttctctctgctccttccttcttccgtttttatattactgttttttttatgtgaccgaccgaattcttctagaatcttgtttaataattgggctcaaatttcgtagtttctgggccaaggcctactaagagaaatattagaaaccgcgtctggtgagcccaaacaatcccggggaagagagagactattgaatattcttcttccttcattttggctgagagagcgacgacg

SEQ ID NO: 8202 - DNA, 3000 bp, Unknown; identical to SEQ ID NO: 8187
  misc_feature (1)..( 3000): cDNA_ID_2124996_gDNA_ID_1621200_Annot_ID_174859 3000 nt of promoter + ATG

SEQ ID NO: 8203 - DNA, 3000 bp, Unknown
  misc_feature (1)..( 3000): cDNA_ID_2105410_gDNA_ID_1621200_Annot_ID_174856 3000 nt of promoter + ATG
gttgaagtagcgatcctggagcttgacgcagccattagaccttctctcgatggagaacaagaaattgcgagccacattgagattgcgagctcgaccgaggaactctaacatgaggaagaaagactgctctttgtgagaaaaccccttgttggaaacccagtcaaagaaccggagaccatccgcagggaccttgatgagacgcagggtttggagaacggtggttctggagatggtttgggacggatgaagagatgatagtgaagactcgagttcgtccgaccacgggttagagttcacggcacgggccaaggacctggcgagttttgatttggtggacctttcttcattggtaactttggcggctcggagaactggttgagacttggagacaaacaaagcatggagtttaggtacagaagataccattgcagaagaaagttgccgcgaaatatggcggcacacgtccgccgctcctccaccccttccggcggaccaagagaacaaaccctttcttcttcattctataactctctaaggcccaatctaaatgggctcctctttgttctagataactttactttaggcccaattatagaggtggccccgacacaatattttgttttgttttaaactttaaaaaaaaaaggagaagaagcaacagcatataattaagtcctagctattaatcatcatccatagcatatcagtaagtttttgaagatagattgtttgattgcatacagattttaaaataatgttaaaccctgaagtaaacttgtaactgcaccaacacaagacgtggtgtatggatgatctactacattccgtttccctttcattgggaatcaatttgcggactagtttaaaacaatcgcatatgcataatacttgcgcagtaattagggaagaaaggaggtgggggtaatgagtgagaaagtgcaataagtgggtatctctcaaattaagagagagatgttgacaaggcaacaagtttggtgtaacattatcctcctccttttattttgcctttttctctatttttatatatatgcacagtcttttttactcttaataaaatacactgttaattcctcggataccaacggaatcggttgaataaattatggatgttacagtatacacactatgtagggacttcttaatttattttggtatagttagaaagatagcttatcgttagagcgattgagagcttttcattataattaggagttagtttactttaattgtgataactgccttagtagatacataagtacactatcaattgactactttgagtgaattaaaaaagcctcctaacagcgtactatatgtacatcagaataagttgtagtaggagcagcattcctattttcaatattgtacactgtattaaaacaaaaacaaaaaagtagaagacaggattatgcatataaatatatatcccagaaccaaatatgaaaatagaaaatttggttttcgggtttataatttgttttagaaaaaaaaaaaagagagagagagaggggcaaggataatagagacaggagtccgtacggtttcgggggtcaacgtcgatggcagcctttgagcacctaaaaataggggacccacgccattaccaattacaaaacctcactctctcgtctatgctcagctaaccctactctcttccctgtgctgccacgtgatcaccatccgattaatcgggaccgttcgattaagtagagatagcagcgcgtgaggtagagaaagaagagagagagagagttggcgaataatagtaatttgttgtttgggggtgagtgggtgtacgttagcaagatacgatcggtcattctgtcttccctaaaacgatcaacctccaacttgctacctatttacacttttgccatcctgtctttcgaaaccccaacaccgtttttgcctcttatctctctctcttttttggccttttcctccttttttttttgtggttaattgaaatagatattttatttctctctattcttaaaaaaaaccacgtataaacttgtaactgactacgatgatttatctcattctcatatcttatttatcgctagtaaaaaagaaaacaaatgtaagagagaggcccagcaggggaacagaagcgggtcccgacataattaaataagtgtagaacaaacgcgttttttactcttctttttccttaaccacacgatcaccaccaatactagctagacccttttctttctttttttttaaagtcctgcgggggctatatatgtatcatccatatatacaatacgctgttaaaaaataacatagtaagagtctgtctatacatacttgtgtgtttaatttgtttgtcaaacaaaagttcaattagaggctccatcaacagttgctaagtagtgagttacgttttttcgatattcaaattaatcctacgtaggtactactaagattacaaattagaaagctttgaaaaatactagtagtaaaaaggggcagatgattggtaaataataatttaaattgtttttagtaaaaaagggcacagacactcacacacacactgctttcacgacccatgtgagttttctttcttctccatcttcacttttttaagtagctagatgacaagacagacagctatctctcttttttttttacgaagaagaagatcaaaaaaaaaatgaattttaaaaagggacctttaagagagatggtgggagagagagcaatagagagagaaggaaatccacccccacaaatagaaagttagggtttattggaaaaaaagaaagagagtgtgtctctgtgtgtgattctaatagaggtgtagtacgtcgctttgctttcagtccattaaaaccattccataacctattccgcaccgacatgtctcctccccctttcctttattagcctctctctctctttttcactactccgtcttgattttataaacaaaagaaagaaagagagagagatcttcctcgggattgcaac

SEQ ID NO: 8204 - DNA, 3000 bp, Unknown; identical to SEQ ID NO: 8186
  misc_feature (1)..( 3000): cDNA_ID_1810768_gDNA_ID_1621200_Annot_ID_174855 3000 nt of promoter + ATG

SEQ ID NO: 8205 - DNA, 3000 bp, Unknown
  misc_feature (1)..( 3000): cDNA_ID_3047902_gDNA_ID_1621200_Annot_ID_174852 3000 nt of promoter + ATG
ccgcagcctcacctcttcctaattgttataatttacatttgggttataaacatattgtaagcatgaaatgagagtattatttgttaaacaacatctatatagaatagatgcatgtgactaggaatgttggaaaaagtcaaaagttgcaccacgtgtcgttaaagcaagtgcttagctacttggaaccacatgaacaagaagacaccaaacccgttacttccactaaaaacaagggctttcttctttttaattcacaccaaaacactttgaacacacacatgcatggagccatgaactcaccatgcattgatttcgtaatgttcagtcgtggacaacacgatgaggacaacatgtcacgtcgtcctccgtggaagagggagagatcgatgtccactcagcatcatcatcttaacttgtctccaaacgaagacgaagagcttgccaactgtcttgtcttgttgtccaattcaggggatgcgcatggtggtgatcagcataaacaacatggacatggtaagggcaaaaccgtcaaaaagcaaaaaaccgcccaggttttccaatgcaaagcttgcaagaaggtgttcacgtcgcatcaggcattgggtggacacagggcaagccacaagaaagtgaagggttgttttgcctctcaagataaagaagaggaagaggaagaggaatacaaagaagacgacgacgacaacgacgaggacgaagatgaggaggaggatgaggaagacaaatcaacggctcatatcgcaagaaagagatccaacgctcacgaatgcaccatctgccatcgcgtcttctcttcgggacaggccttaggaggccacaagcgatgccattggctaacaccttccaattatcttcgtatgacgtcgctccacgatcatcatcattccgtcggcagaccgcagccgttagatcaaccatctctcgatctcaacttagcttgccaagaatattccgtcgatccaacggccatgagcgtagggatgatcgagagagatggtggtggcaataatcacaacgctacttcatcttcgtggttaaaactcgcaagtggtgattggtcttgacgactgactaatttaattaagttgctaattatattcttttaactttcattcgtttatattctttacatatatacaattaagtgcatgagtttatatatagagtttatggatttatatgaattacacttggcgtcttctgcagatttagagagccataaggagttctagtccaatatatacaaagatataagtaagaaattaagtttcacaactagttaatatacaagatagataattgtatcattttttattattatatacgttgagaataaagtaagataaccaagggctccttgctcatataagcgcaaatgttttaatttcatgtttgtaatcttacagagtgatataatttacttgttaagccatcaagaaggagatataattttgaagttttccagaaaagaaattgtaaattcgaaattaagaaatcacaaagaagaaaaatatcaaataaataaacgaatatcacgtatcaaataactctcgtgatatgcccatatatattttaatcatgttaataatcaaaaggctcttactacactgaaaacacatgaacatgagtcaacgcctcaacggaattgataattttggtggttcttaattaagcaccgattgcaaggaaagggtcatttctctcaatacgattacaagaaaagagtcatttttatctcgcatatatgttattaatgagtggttgccattacaagttatgaacttttgactttaggaagcccaccaaccatcagctgaaaactaggattagcggggggaatttgattaatgtcaactgatatcctccaatttctctttgagaaaagctcaagcaaagtatatgactctttgggccactcaaaagatctttaatcaattaacttgaggacatgtactttaacaacaattgacacatatagacacgtacaagagttgcacgctattgatacaaggaaattttggtctagtatgaggtaataacgtctcaacgagataaggttaaaattatttagacatgcttgggaaaatatttttgttagtagaaatttgtagagtaatgaaatttagattcttatattgaaatttcatccaaataaatgacaagaggtgagtcaacaccaaaagggcgtgtgagtatgagagtcaaagatagcactaactatacgatgcgggaagtcagcagtttagtcacacgtgtcaacctatgatttaaggagagttggtgtatttgtcacagaatcattaaaatttggtaaagttagaaatagaggggccagtgctagtgttgtttagtcgttacaacaaaacctcaacggtttttgtttgcaactttaccaaaatgaataccctcatccacaaactcttttctaatcaacaaagtattgaaattttcagttacatactagtatttactatttacatactagtatttttgggctagtagaagagtgtatttgaaaaattagaggagaaaaaaagtcagcgtggaggaataaaggtgtgagatcgcatgttacatgtttgatcaacggctcttcacttcatcattcaatactcttttttttttctttttttttggctcaatctgtcaataaaataagaaaaacataactgataattatatatatttagaggcttatttgtatttatgtttacacaacagacaggtcttttatttagccgtttctgatattaaaaaagaaagtaaactgctttcgttgatattcttaagtatcccattaattcttttccttaaaaagaaaacattaacttgttgttgggacttcgtatattagcttaagtgttggtggaagagtgcttgtaacctactccgacttcttcttcttcttcttcttatattctccctctctctctctctcctttttcttctatttctgctctgttttggtaaattgaggaaatg

SEQ ID NO: 8206 - DNA, 3000 bp, Unknown; identical to SEQ ID NO: 8196
  misc_feature (1)..( 3000): cDNA_ID_1807508_gDNA_ID_1621200_Annot_ID_57642 3000 nt of promoter + ATG

SEQ ID NO: 8207 - DNA, 3000 bp, Unknown
  misc_feature (1)..( 3000): cDNA_ID_1810818_gDNA_ID_1621200_Annot_ID_57643 3000 nt of promoter + ATG
tctctcgaagaagacggcagcaatcgtgtgctccatctcccaggtttatggctacggcacggtggactacgagagaaggccgattgtccagtggaatgccatctacaagaagatttcgctgatggagaagccagagcttggcgctgcttccgtcttgaatcagtgggagaaagccggccgcaagcttaccaagtgggagctctgtcgggtcgtcaaggagcttcgcaagtacaagcgtgccaaccaagctctcgaggtccgtgtcctccttgtatttgccctcgctttattttgtatctttaacactacttacttgatcgcgtatcgttttcataggtgtacgactggatgaacaacagaggcgaaaggtttcggttgtctgcaagtgatgctgcaatccagctcgacttaatcggcaaagtgcgtggcattccagacgccgaagagttcttcctccagctccctgagaattttaaggaccggagagtttatggttccctcctcaatgcctatgtgagggccaagtcgagagaaaaggctgaagccctgctcaacaccatgagggacaaaggttacgccctgcacccgcttcccttcaacgtcatgatgactctctacatgaacctcagggagtatgacaaagtcgacgctatggtcttcgagatgaagcagaaagatatacgtctcgacatttactcctacaacatctggctctcctcttgcggctccttaggatcagttgagaaaatggaactagtgtatcagcagatgaaatcggatgtttccatttatcccaactggaccacgtttagcacaatggccacaatgtacataaagatgggtgaaactgagaaagccgaagatgcactgaggaaggttgaagcaaggattactggtcgtaatcgcattccgtatcactacctcttgagtttgtatggcagccttggtaacaagaaagagctgtaccgagtctggcacgtctacaaatctgttgtcccgagcattcccaatttgggttaccatgccttggtctcgtcgctggtgaggatgggagacattgaaggggccgagaaggtatatgaggaatggcttccagtcaagtcttcttatgaccccaggataccaaatcttctgatgaatgcgtatgtcaaaaacgaccaactagagacagctgaggggttgttcgaccacatggttgaaatgggaggaaaaccaagttcaagtacgtgggagattctagctgttggtcataccagaaagaggtgtatttcagaggctttgacttgtcttagaaatgctttttcggctgaagggtccagcaattggaggcccaaggtgttgatgctgtctggtttcttcaagctctgtgaagaggaatcggatgttaccagtaaagaggccgttttggaattgttaaggcagtcgggggatcttgaagacaaatcttacctagctcttattgatgtggacgaaaacagaacagtaaacaacagtgaaatcgatgcccatgagaccgatgcgcttctaacacagctacaagatgatttgtaatctgatagtcctagatctttgctttaaaaaacgaatcttgtaaccggagtcaactgaggaaatgcgaaatatgtataatgtacacaagagactgcctagtgaaacatgaatgtaagagctgtgtccctttttgtgacagctatttggaattagtgttgcttagggaactggattagcctttgttctcttgtttgattgttgttacttgttaagactaatattggagaggttaggttgtgctcttttattttgggccggacggataaaaggcccgatattgaatatataagtctgagagtctcaaaggcccatctccattaagatatcttcgcggaatcggttgtgagagagagagacggtgatcgggaaatgtcgacgaaaggcgcggcggcggcgtaccctagcgcggctcggatatctgattctccatgttatcttcagtactctgcttctctcaaatgtgagtcatgctcctgatctcaccctttgtgattgtttcttcgaggataggatttgacatgttatcttcagtactgtcaagttccataacgaattagcattgattagatctcatctatttcattatgcttcctcaaggtgattagattagtgggttgaatcccatgtcagtgattcgatttaggtcccatcaattgataacgtcgggtttgattcctgattgtttatgtgtttccgttttcattagttatgcctcttagcttgaccccttgatttcttatcaggtcttgaagaatttggatcagacaagagtaaatgccaggatcattttgatgtgtacaaggaatgcaagaagaaagaggttgttgttgtgaatgaatatttaggcttttggcgtttccaacttctttgctgctttacctatgtgttattttgtttctcagagggaagctcgactggaacgcaataagacacggtcgttgttctcgtgaatgcagatcctcgaataccaatgatgtctcagaacatcacctagctagtagtatcctgttgtttcatttgcaatggctgtgtttgtatgatctatctaagtaaacaagtggaaagtgtttgttaatgttactttttactccccattggtgaatcatggtgtatacctgttaaactttgagagcaagtggttatttatttagttagagagttagagcttctccaccaccatattgaataagaagatctttctctcattcttttactttactctggcgtctgaaacagatccagggattccagtagtgaattgggcttaaaaactgttatatgggctttcgaaagtaaaaggttcggtgagctgccaaagaaaagtcagatgcctttaatcgcatttgacgacgattctttacgtgcgccattgactgcatcgtcgtcttcctcacgcgatttggtaatccgattcgtcttcatctgattccctcccttccgagaataata

SEQ ID NO: 8208 - DNA, 3000 bp, Unknown; identical to SEQ ID NO: 8195
  misc_feature (1)..( 3000): cDNA_ID_1807678_gDNA_ID_1621200_Annot_ID_57644 3000 nt of promoter + ATG

SEQ ID NO: 8209 - DNA, 3000 bp, Unknown; identical to SEQ ID NO: 8194
  misc_feature (1)..( 3000): cDNA_ID_1810814_gDNA_ID_1621200_Annot_ID_57645 3000 nt of promoter + ATG

SEQ ID NO: 8210 - DNA, 3000 bp, Unknown
  misc_feature (1)..( 3000): cDNA_ID_3047856_gDNA_ID_1621200_Annot_ID_57650 3000 nt of promoter + ATG
tttttgtaagtactaaatttttaatttttgtgacataacatccaaacagaacgtgccaaaaaaatttgataccatacgcgaaaatatgatttaatattttaataaatattataaacataacaaaaaaaataattaatatttaaagtttaataataaattaagcaaattttaagcaaaacataaataatttagaacaaaaatatgaccaaaaacgattaggttgattataatgtgtaaactagtaaaatgtgctagtgtcgttattatgttatcaatcaaacggtataatgcatgttgttaacaaaacaaaacatagttttattgacttctcaaaaatgacctttgaaataattacgacaaagaatatttttatttttttactaacctttctattatcgaactctttcgttgtaaaaatgtctcttgtcgccggtagtgtcaagaagacggacctttgaaatacttctcaaaaaagacctttgaaatattcaaaggtatagcaggtggcgagatagcctggcttgtgagagaggagctttccgtcttctttgttatgtgtatattttaataaataatttttttgttatgtttacattatttattaaaatattaaactatatttttttgtttatagcatcaaaattcattggcacgactctgatgacgagacaccaaatatccatataatggtgttgcagttgcttcgttggaaagacgataatcaacctccggccaagataatcttcatatcaaactcgctcagtatctatcacttctcttggttttttgcttaaaatccgctcagtatctgatgaatattataaaatttcttcattgaattttggggtttgaacagcaaaagtaagaatctgatttgtctgaaaattaaacatttgcgttcaataaatagcatgaatttgatttgctataatttcgtagaaaaagttggacaagaagaagaagaagaatacaacgtggttaagcaatttgaatccctatattttgtaggcatgatataaacattgctgtaaaacgataatatataatcggtgtgatacaacaagaccgtgtcatgagaaaccgacatagcccagcctgatacgcggttctccttctccaatcattaatatccctcttcttccctgcaattactctttattgtacttaccttttctcataaatctacaaaaaatacaagtacgatttaaaacgttatgatcgttgtaaacttccatgaatggccaaaacaaaaataccaaaatctaccattggtcaatagactaatttttctttatttcattgcaattatgaagaaattacattgtctttatttcactgaaattagatatttacgaaaccaacggttcatatttttttttaacttatgaataaaataataataataataataatcaagtactgccaaaaagaataaatccgatagaaattcattataagatgagaaaaaagatctgttgagagaattcgaaagaaaaactcaaatgcaaagccatcagaatcgaagcaggctgagcttgattctacggtctagattcatcccttccttctcttcaccactctccctcttcgtcgtcctcgctgctgttcctcttccgatctacttttccggtctactctccggcagaaacaacaagccgctttcagttatggttcgtcgtcgctcttcctccactttccttcttttttttgtttgttctgagatttgattcgccgattgtgtttgtttgtttgtgcagagactcaactccaacttagcttcttcaatggtggaatcgaatatttcttgtaccactttcaatatcttggctccgatttataaacgcgttgatcaaaaggtttgcttctattcttctgatttcttcactctttaccttgttgattctggaatcgacgacattggttgattgtgttgggtgttattaacagaatcatagcactcgagagagcgatttccgcacgctttggttagctcgtaaccagaggattttagatttgttactccatcaacgctcttcagttatctgtctccaggtacacactttgtctcttagaaagagtcaaattttgacttttttttttttttgttaagctgactcttagcaattgtgactgttcgtaggaagtttgggttgggaatgaggaattagtgaacatgtaccaccaccagctttcatcttcaggctacactatttatcagttggctagaacaaacagtcgtggtgatggtaagattctttattttttatcatgtttttgattgaatatggtctctgtccagagtcattagaaagttaagaggctcaatgttactgcttgatatgcttcagtaaatagtgtagggttgtccaaatctataccttttcatgacttggaaactggtagttcaggatctttctggtgtcaaagtgttcttgttggtgtttatatgatcttaacgtcgttgttagtaggatgccgtattaaaaggcaatcttatggatggagtagaaatattgtctaaaattcaaagtcaatgctatatgtttggactcctctagctgatcgcatgcgatgaaagataggcttcttcgcttttgatgtctcatttgtggacttgaatatctttcttacaggtcttttaacagccattcataaggaccattttaaagttgtaaattaccgggagctgctctttaacgattttggagaccgtgttgctcagctcttacatgtcaaaacagttattccctttccgcttaatggaaagcaagacgttcaacaagaagttattatagtgaacactcacctcttgtttcctcacgattctagtttgtctattgtaagactgcatcaggttggtcatcctttccatcattttgcattttgagaccgttcaccttgaatcttgtgatagtttaatttgattgcttcttttcacaggtttacaaaattcttgaatatctggaagcttaccaaaaggaaaataaacttaatcacatg

SEQ ID NO: 8211 - DNA, 3000 bp, Unknown
  misc_feature (1)..( 3000): cDNA_ID_2125069_gDNA_ID_1621200_Annot_ID_57651 3000 nt of promoter + ATG
cagaatcaacacaatgattggctcagactttggaaacggtacaaattttcttttctaataagacagagagagaaagtgaaaggcttatcttttagacaaactgaaaatgacacatgattttactaaaaggatcctgaccgttgattgatcctacttaccaaaatatcaagtaatgatgtctaacttgatcattaatcatcatttcttgatatttacttgatatcatgggcctataattctttaatggtgatttcttttattataggcccattctatcaagtaaataataatatcaggatattatacttacctgcaaggtgattcttttattaaagtttacatgggcctatacgtttccaggcccaaactatttgtgaagtaatgtctaacttgattataaatcacaatttaaaaatgattattaattaaagtaatcaaggcattagttactttaggcggctttaattaaagaaatcaaaatacaagtgtaacagtaattagtctctctagtctctactctactgtcgcatcgatcgaaaagccatagaaatctctagaaaggaagcagagaatctttgaaggcgatgaagttcgtatctgtagccaaagggatatggtttcttcgaccctaatctgctaatttcacctgtctttagagccggtaagctcctcgtcttttacgctttccgatcgatttctctgaatatctcgagattctttttttttattagttccggtaggtttttgaaactcattggagctgatttgtgctgagatttgtatgatacttgttttttattcaaattgtctgcacatttttgttgtcaaatccaagggttttcgctctctagttatttgccttgttggagcttttgattttggttattgattgagttcgcgatcgattacgtttaagctttgtagctgatccgatctgggagattttctggtgttgtgtatcttcttctttttgagtgcttcattgatctcacaatgtatatttcgtgttttatatagcctttagtgttgttgttgctgaaatcagtgagtaaaatgctatttatgttcgtttgatttctgattagtaacatactcagcttctcgctgtccattgtattgtagtagaattcttgtaatgtgaattgctgatgatgagtctttaacattttctatctaggtatctcctgcttgtgttcctttctactgagtttgtggttggagatttgaagtacttgtgttttaagggtagtaagtggttaactacagatgaataagaatcaaacagttgggctagactctgaagatgatgactctgatgattacgacattgcgcaagtaaactgtgagctagctttggttgaaggtcagctctgtaacataccatacgagctctacgatctaccagatttaacgggaatattgtctgttgagacttggaactcacttctgactgaagaagaaagattcttcctctcatgttttctgccagatatggatccacagactttcagtttgacgatgcaggaacttcttgatggtgccaatttatattttgggaatccagaggataagttttacaagaatttgctaggtggattgtttactccaaaggtagcttgtttcaaagaaggtgttatgtttgtcaagaggagaaagtattactactctttaaagttctatcatgaaaagctgatcaggacatttaccgaaatgcaaagggtgtgggttcagtatggaaataaattgggcaattactcaaggctcctcatttggtcaggacgaactcaaaccggtaatctcaagctactggacctcaatagagttccatctaaggaaatggatagtgctacatgtagattcaaaactcccaatgtagtgaaacccgtggaaagaaatagatcgaaaagtttaaccttccctcgcagtggcagctccaagaacagtctcaagataaagataaccaaggaaggagtattccggtatcaaggttccagcttagtttctgctggccatcatcatcagactttgccaaagggtgttctcaaattagtccctaaatcttcttctgccatcctcaggaaaccctatgtagctccaggaaacaatctcctgcaaatccatgaaaccggttcaaagagtactagatttgcagcgtctccatacttaggtacgacatttgagaaaccaccctacggaactcttggctgttctatcccagaccctttcttaacctatttggaaactacacaaagatcaatccaaggtacagaaccggtgtttcatgatccaacacacactgttcccagtgctctccgtgtttcaaattactccatcacagaacagaatatacctctaaagcaagaagaatatgtccggtaccacctgaagtctcctggttttaagcctaggactgttgacagaggctctgaaacaacagagagcaagaggatttcgtctagtaataactttcagagggaagccaaggctctgagaaaaccgctgggggtcctgagcgaagacaatcatgctcgagaagccaatagtgaccatttgttttccttgacttacaagcgaagaaaggttcagagaatcgcttgagctcccgtgacgctatgctaattcaatgttccacctaatgtagtcttccatgaaaatatgaagtgtaatgctgcaacttggtaactggatttggtttggggttgagtttgttagttttcaaaatttgaaggcactaaaaagaaacactaaagaaatagaggagtaaaagtgaaaataatttgaactattaaacaaattaccgataaggtcacattctttagcttttctctgcggaacacatcgagagagcttcttccaaaaacctcaaacgctcctcacacaacggtaagctcctccaaatctcccaaaacgttatcgctttcgaaattaattatcatcatcgtcatcactcagcgattatttaccaaaagaatttttttgctgaagggtttaggagtgatg

SEQ ID NO: 8212 - DNA, 3000 bp, Unknown; identical to SEQ ID NO: 8190
  misc_feature (1)..( 3000): cDNA_ID_1808065_gDNA_ID_1621200_Annot_ID_57652 3000 nt of promoter + ATG

SEQ ID NO: 8213 - DNA, 3000 bp, Unknown
  misc_feature (1)..( 3000): cDNA_ID_1810889_gDNA_ID_1621201_Annot_ID_57654 3000 nt of promoter + ATG
ttaccaatcgtcatttaaagacatcatcaatcttaaattttatttaaatacaatgatgagtgtgttataaatgaacaaagaaacataatcatagtgacttttcatgcgattaataatgaaaagtttgaacttaactcaaagtcgtctcattagctttaatttttttttatcttccacaaatatagggtatcagaatcacttataatagaatgaagtaaggattgacaaaaaaaaaaaaaaaaaaaaaaatagaatgaagtaagagcttctttttaattaaaaagacagcctcatatgtactgtgcatactaattattccattcaactatttgttcacgggctttttcttcatttcctccagctttttatctctgcatgcctttgttttcttattgctttttcaaaatgatatatatttgataagtttcaataaacgggtgcggatgtgaccaaatcgacatttgactacttgagcgtgacacgagtttgttgtattggattatctcaaattttactggatattcagaagaataaagatttcacactgttatgtttactcctccattatacacacaaagtaacgctttaaaattttgaatttgcagcgaaaaacaagttttcattttattgagatatgtacaatgatatacagaattttcatataatcacacgcttttttagagaaaatgaaatcaatgaaagatattgtacgttatgtaaattcgcgtgactgatatagaaaaaaataatcgtgaagaaagaattaccgaagttcatgtatattgaagaaaaacacacacacacaaaacgccaatacattctactacttgaaggtacagtttcatttgatacgaatatttgatttgttactgttaggctgtcttagactgagtctgttgatatgtcgtttctacttcctatttaatgaactcctttatatcttatcaaatatatacatcactaaactttaaaacttataacttggaccgttgttagtgatacggtatattctaattattaattttctgaagaatcgtacgtggtacatgccatccaatttcacaaattcacaatagttaaccccattcataaagacaacaaccaaaattcaaacttagaattggtggagaatcactagagataaaactaatcaattgcctacctgttctacctaacaaattcactgtcaaactcaaatatatactataactttatcaaaacaaagttagaatcaaatcatgtaaacttgaacgtatattagaggcagagctataatagttgataaattttaaaggtatcttcataaatactagagtttctgaaattgaatgaataatacctaataacttggtttaaatggtggtgttaatcgatatatacattattcgtcaatgatataatccatgtttttgaatgttaggaccaagttgtacacataactttaatagtaataatatatcgtaagtaattgtcgaatagcagtaaactaataaataaagaaatggtgaagtatataacgagttggattttcgctctgaagaaaaggaacacgattgggaactgcccgatcttactgtggcagcatagtactagcataacaataggtgatagaaagctagaaaacaatcccaagcttaaaatgcttcaagtaatcatatattatgacactctcattctattgagtccctcggttgatataatagctatttcacaataacaatcactttcgattcacatatttaaaatgcataaatttgttcaatttttttctcgttaaagatttttgttttcaaaatttttaacttgtttatattaaattttttaaagttttatttaaatattttaataaaagataagaagtattttactaaaaaaatttaacgcatgataatatctcataaccacccttttacttattggagctttgcaccttactttaaaggtattaattaaatttaattggtccgatgtttgctttttgtttttttgtcgttgtttgttgtgttcttatttttttctttcggttagttgtgttctttagaaagtgttaaggctaatcgcatttaatatctcgaagactacttattaaactaaaaattaaaagtcaatgttgaatctgcatatctactacaccggggacaaaatggctgtgaattaaatccgattcgaagcacgagagatatctgcccaatcgacctatttattgaccctttcatgtttcctcttttaaagtctgtcatgtaatatacacacacgtattatgttaagatatcaaaggaaaacctatttaattttgttcattttcaaaagaacaaagaaaagagatcagatataatagattgatgtgatcaaaattagtgcttttaaaaattattgaaagttcaacgagtttcaagtaaagtagaaaatccttgtaataatacctgttccaacgggcaaacctgcagctatgctaataacgcttgacgccttttgacctctttttcaatctttttttctccttccatgtttatttattttaaataagattttcgaaaatgatacattttcaagctgtaatgtaagattttattttattctgttaaaaaaaaaattcaccaatgatatttttctaaattatccactttaaatgtttattattgacaaaaactaataattaaattgctactttgatttaatgtaacaataaaatactagtattaaacaaatgaccttgacctggacatatgtgctttgcgtggtgttaacggcgtcagctgccgttatctccatcccaaaatatatacaagggaatctctttctctctctcacaccattcaatcacttccattttttcaaaatctctcttttccctcactcactctcactctctctctctccttctctcgcttgaagaacaagcttggtatatttgttacaacgggctaattaaccaatctcttttttcacaaataaaaagaagaaagagaggagtcattttttggggttgatatcttcgaa

SEQ ID NO: 8214 - DNA, 3000 bp, Unknown
  misc_feature (1)..( 3000): cDNA_ID_1810854_gDNA_ID_1621201_Annot_ID_174915 3000 nt of
ttcttgaaggtttcatctctgactatgcagaaattgataagattatttaaagaagaatacaataaatcagaaagtcagaaagcaaattaggagaggaatgaaagatattagaggcaagaaatcaattaattaatgctaaagaaggcaaaatttaagacaaaatatagatgactaactgaaaattcaacatacaggatatattaaattataaaaaaaaaacatcatgaaagtgagagttttataaagatgctaagaaaactgaagtgtaatggatccaatgatactttaaacaaataaatttgtgtacatgaattaatggataaaataaagaaaacagcagaaatgatgaggttttcgagacatacactgggatataggaagaagcgacgaaaccctagagggagagagagagaagagtagagcggtgtctggtctgagatttgtttctcggaaaaccgctgatggttttgtgaagcgcggttttgttggcgagcaaaaggtttgaaaggtaggtgcaaatcttggaggaagagagatgagagagtaatgacagagagaattgagagggtgcaatgaaattaaatggtgcgagagggacacttaattatcctacacgcttatatatatatagagagagagagatatgttacaatttattttatttatgttacaaaattatgtgttgtttttcatcttatatacaatgtcaacctaaaataattttattttttatttatttaaaatattataatgtggtgaggaatgacggctaacggtctatgagcctatgagacttacatttatctattagatatgtagttatttttaaaaaatcattagcattattcataacttatgcatatgcaataaatcaccacttaacaaaattaactatattaaaaaaagatttaactatattgaaatttgctttaatacagttctccatttacagaaaaagttagacaatagtccccatttgtcaaggatacaattttaaaagtaattttctgaaattttaatactcttagattatttataatatggaaaaaaattatatagttttttaactaaaattcaatgacttgttatagttaatatttatctttatgagatataaatttaatttttactttcaaaaaatatgactattatatttttaactattttattttattattatttcatatctttgttataaatttaattgtaaagaaggaaaatttcatgattcttcttccacatggcattttcttaaatattatagaagtttaggttgtattattgttagtcagacagaagttgattgagtgatgtatttattttatttcatttaaaagaagaaaatctaaaaatcatcaccttaattttgagttttgtttacgaaacaattgttttttcaatttaaggaagtcaatgaaatatcacttttttcacagtaagacttcattttacatgcctagaaatattaattactttgtggcccaagcatttataactataacgtgcaattaagctatttaaaatacggatcacccattaaaaaggtgataatttgtaaaagccatgcattcatcttaatttatcacgcgaatatatagagaaatatactgcgtatttaattacctagttcttaagctttgtttttttttttaaagtccttatagctatagctttaacactcaagtttttcttttcagtaagtttatactttacctagattctttaaaataactatatataaaaaaacaataacccaacttatttctgatttttactgtatatatgtaggtacagatatatagatggagttatacgtacgtacgtatgcgatagggtggcgaatagtttcgacgcattaaatgtgtacacagaggctgcatgggctttaggccatttactgctctcatgcctctcttgcactttaacctcctcttccttcttcgtactctcctactaaaaaaaactagtaattcaacgcctaacattttagttttttcttttttttttttttttttttttagttttttcttttttcctgctacatcactaaaagttaattatttcaaaaaagaattgctacaatactattcacattttaagtttgtttcatcctcgtaagtctcaaatatttatttttagtttatttcttttttttgtcaaacttttagtttatttcaattagtgttttttctgccaatatgatcaaatctgagattcaaaatggaattcttctgttgaaaaaatggatgcttttgtaataaattcaagatcgtagtttttttttgtttctgggcttcgtatatgggccataagacggaagtaaacttttggcccattatatattttatccccaacgagaatggcaaggccgaaagtctcattctccgagagtggaaagttagttaaggaaaatgattgatttttttgttttgttttgcattagtctataggacgacttgtttcacaagaaactagccgtatattgtaatatccaatcactgaattgagcaacttggatagtttacattgagaatgcaggaacgtggattccacaaactataacagtttattatagtttttaacttttgagagctaaggactaataaaaaaattccccaaactacatcttctccaaagtcaatagcttttcaaagcgcaaaagatgatttgaagctttcttaatcgttgcatgatttcgatttcttctaattgtggaaatttaatatatttaattgcagcaccagcagagatcaagaagatagtggaggccatgcaatgtcctcctcgagctcctcttgtatttcaaccctcattaagaaacagaggaaaaatgcaaatgggattatctaaatcttgtttggcatttctccatggactatttcaaagccgctgggtgatctataaaaggcctgagaatgtctccttcatcttcatctccaaagctcgttctcaccttacttggcaaacactcaacgaagaaaggagagagagacggtaatg

SEQ ID NO: 8215 - DNA, 3000 bp, Unknown
  misc_feature (1)..( 3000): cDNA_ID_1810854_gDNA_ID_1621201_Annot_ID_174913 3000 nt of promoter + ATG
taagcactgatccatcacaaccctacatgtacatgtatatatatccgtcattaattagtttcgtagttattcagaatgttccactatataaagaaaaaaagaaaaaaaaagagggaaaagaagagtttactcggacaaaacagtcatggaaatgcattctaatgagagcagcagcaagagaaggagcattagaaacgtggtttgaaacaaaatcttgaacaatcttttcagcattaggacaagaattggcatagaaattcatctgcaattgagcttggatcggtccaacaattcccacaagaaagaaagagactgaaagagctatagctatcaagcaattcatctttaaatttgttggtttaatttttgagactctctctgtttgggaggattatgttgtgtgatgtattgagacgttaacataggtttatatagaagagtttgcatgtttggtagtagaagtgggtccatctaagctaactaacatgtgctctttttctactttatttttctggctcataatcagcgccacaataaaaatttgagaaatttttattcataattacaaaatggttttttaatactcttactaatgaagagataatgttacacttcaatgaggcaatttggaagagtttttttataaaaaaaagttaattaaagtttacgtctttccacttatatttattttcctgtaatttgtaaaactaatttgtaatttgtatgttctaaaacacgtagcgaatttgttttctaatatatattaaccaaaatatcaaaaatatactctgatactaaaaatatcaaaagtattagatatggtaaaagatggtgaatgtttggtccataaatcaagctatagtaagttagtaacatagaaagtcttgattttaatgaccgttatgatgtcataatcaacgatttttgtttttttatataccaaaacgcaatagattgtgttgagcgttatgatgtcataatcatcgatacaaaaagtcaagccaacagtagattttagtgagttagtaacatagaaagattagctgaatgtaattaaaagtatcgagtgttctgatgtcataatcaacaactgtaattttttttataacataattgagattatatggaatcttattttggattcatttattttagtcgcgatcgagtactagaatattggtaatcttgaatactctaaatttttggatgatcaatcacctcaagacataacgtactttgatttttcactgaagaacaactcgtttttgccgacatcttcccatccaaaaaaaaaaaaaaaactcgtttcgagagtgatattttttttaattccaaaactacaatacgtactcgacctaatccgcagtagtacaactaaaagaaccgcaaaagaacaactgctaatgagcaagagagtattccaagattattaaccttgttttatattcttaagatcttcttttttttttaagttctttaatgtataatagaagtatataggattaactgcgacttggtagatagactaatttcagatgctaagatataccatatggtaatgatcctagtaaaattacttttgttaaacatatatgtacgaacagtaggacacgtatagtcatgttttctgatagacgattagtgttgccgttatatcattatccgaattaatcttgtaatgcatgtttttaagtgaaataaaatttcaaattacaacgtagtttaataatataagtcataaccgatacaatagtcactagaacataaaactaatatatatgtccaactttacaacgtatactctttttttggaatttttgttttgtcctaaattggtgtttcttatatcttgatgcctaatctttgttttgtaacatgcgcaatgatattaaaacattatattatactaggggaggagaacaaattaaaatttcacacaactactctatagaactgaattattcataaacggacgagagcatttcaactgctcgaaatattttcctatcatcaggagtggcgtttcgtcagattaccacgccaatttatttctttaagtctgtcaaacgttggcatcttctaataaactgatatatatatatgtggattctaaacaaacaaaaaaaaaacttgagaggatatttttagattttcatcctggaaaaataagtgaggctagagaagattttgatgaaagaaatctttaaattttaaactcttttggaaatatcttgaaaaaggattttccctgtaatttataagcggaaacaattcggaccggggccaaaacatgttagaaatatgtggatttgcagatttctgttcgggtcggccggttctgcctagttgtctagttgactaaggttttgtggacgggttcgttatttttctagcgactaagtaaacatgccctcttccatgacctggcgtctagaagaatagtcacggaacgtgtgttccacactcgttatagaccgtattcaactattcaatttttcccaaagaaattacttaagaatttaattagcaagttgggtcttagtaactgaaaacagatacatatttctaatgttattttatgagttgtcgtttgaacaatgtccactaaatgataacgtgcaagacattcgtgaatgtctaatgtgaaaaattccgttttataaggcgaaatgaccattattttatcttataaacaatagtcaattgtgtttcataggaaatttaatatattcaattgaaacaccagcagagatcaagaagatagtggaaggccatgcaatgtcctcctcgagctcctcttgtatttcaaccctcattaagaaacagaggaaaaatgcaaatgggattatctaaatcttgtttggcatttctccatggactatttcaaagccgctgggtgatctataaaaggcctgagaatgtctccttcatcttcatctccaaagctcgttctcaccttacttggcaaacactcaacgaagaaaggagagagagacggta

SEQ ID NO: 8216 - DNA, 3000 bp, Unknown
  misc_feature (1)..( 3000): cDNA_ID_3047930_gDNA_ID_1621201_Annot_ID_174912 3000 nt of promoter + ATG
ttctttgcagatttcagaagaacggaaccatcacatccctacatgaatcattacaaaagagtgttaggactagctagttttttcatatcccttggttaacagtctcgaacaagtgaaccaagcttactctgacgaaacaatcatggaaatgcatccttagaagtttagcggcaagggttttctggcgagaaacatattgtactgtgacaccacgaacaatttcctctgccttgggacacttagaccggtagtagtcgaggtcaagcaactgtggaatggcgacagaaactccaaccacgctaagaagaaccacaagggcgagaatgttcttgatcgccattaccgtctctctctcctttcttcgttgagtgtttgccaagtaaggtgagaacgagctttggagatgaagatgaaggagacattctcaggccttttatagatcacccagcggctttgaaatagtccatggagaaatgccaaacaagatttagataatcccatttgcatttttcctctgtttcttaatgagggttgaaatacaagaggagctcgaggaggacattgcatggccttccactatcttcttgatctctgctggtgtttcaattgaatatattaaatttcctatgaaacacaattgactattgtttataagataaaataatggtcatttcgccttataaaacggaatttttcacattagacattcacgaatgtcttgcacgttatcatttagtggacattgttcaaacgacaactcataaaataacattagaaatatgtatctgttttcagttactaagacccaacttgctaattaaattcttaagtaatttctttgggaaaaattgaatagttgaatacggtctataacgagtgtggaacacacgttccgtgactattcttctagacgccaggtcatggaagagggcatgtttacttagtcgctagaaaaataacgaacccgtccacaaaaccttagtcaactagacaactaggcagaaccggccgacccgaacagaaatctgcaaatccacatatttctaacatgttttggccccggtccgaattgtttccgcttataaattacagggaaaatcctttttcaagatatttccaaaagagtttaaaatttaaagatttctttcatcaaaatcttctctagcctcacttatttttccaggatgaaaatctaaaaatatcctctcaagttttttttttgtttgtttagaatccacatatatatatatcagtttattagaagatgccaacgtttgacagacttaaagaaataaattggcgtggtaatctgacgaaacgccactcctgatgataggaaaatatttcgagcagttgaaatgctctcgtccgtttatgaataattcagttctatagagtagttgtgtgaaattttaatttgttctcctcccctagtataatataatgttttaatatcattgcgcatgttacaaaacaaagattaggcatcaagatataagaaacaccaatttaggacaaaacaaaaattccaaaaaaagagtatacgttgtaaagttggacatatatattagttttatgttctagtgactattgtatcggttatgacttatattattaaactacgttgtaatttgaaattttatttcacttaaaaacatgcattacaagattaattcggataatgatataacggcaacactaatcgtctatcagaaaacatgactatacgtgtcctactgttcgtacatatatgtttaacaaaagtaattttactaggatcattaccatatggtatatcttagcatctgaaattagtctatctaccaagtcgcagttaatcctatatacttctattatacattaaagaacttaaaaaaaaaagaagatcttaagaatataaaacaaggttaataatcttggaatactctcttgctcattagcagttgttcttttgcggttcttttagttgtactactgcggattaggtcgagtacgtattgtagttttggaattaaaaaaaatatcactctcgaaacgagttttttttttttttttggatgggaagatgtcggcaaaaacgagttgttcttcagtgaaaaatcaaagtacgttatgtcttgaggtgattgatcatccaaaaatttagagtattcaagattaccaatattctagtactcgatcgcgactaaaataaatgaatccaaaataagattccatataatctcaattatgttataaaaaaaattacagttgttgattatgacatcagaacactcgatacttttaattacattcagctaatctttctatgttactaactcactaaaatctactgttggcttgactttttgtatcgatgattatgacatcataacgctcaacacaatctattgcgttttggtatataaaaaaacaaaaatcgttgattatgacatcataacggtcattaaaatcaagactttctatgttactaacttactatagcttgatttatggaccaaacattcaccatcttttaccatatctaatacttttgatatttttagtatcagagtatatttttgatattttggttaatatatattagaaaacaaattcgctacgtgttttagaacatacaaattacaaattagttttacaaattacaggaaaataaatataagtggaaagacgtaaactttaattaacttttttttataaaaaaactcttccaaattgcctcattgaagtgtaacattatctcttcattagtaagagtattaaaaaaccattttgtaattatgaataaaaatttctcaaatttttattgtggcgctgattatgagccagaaaaataaagtagaaaaagagcacatgttagttagcttagatggacccacttctactaccaaacatgcaaactcttctatataaacctatgttaacgtctcaatacatcacacaacataatcctcccaaacagagagagtctcaaaaattaaaccaacaaatttaaagatg

SEQ ID NO: 8217 - DNA, 3000 bp, Unknown
  misc_feature (1)..( 3000): cDNA_ID_3047934_gDNA_ID_1621201_Annot_ID_174911 3000 nt of promoter + ATG
tctacctcctcatctcggcctcaagacttcaatctaaaaactctattcatgcatacttctcatcttctgatcaagatcaatctcagagcccgacaaaaatcgagcacatcgtctttgggataggctcaagcgcgatctcgtggcgtgcacgtagagaatacgttaagctttggtgggatgctcagaaaatgagaggctgcgtctttgttgagcgtcccttgccgtcttctcaaaaccacacagattcatatctccttcctccggtttgtgtttcccaagatacttcccggttcaggtaatttagttcaatttgtttattgttttttagtcagaaaaaagtttcaacttctgtttcatcataaattaaaaataagtatagtttgcgatttattagtttaacgtctattaaagatttaaagtataggatatataaatttaaaatattgaattgtgacatttttttgtaattttatatatgaaaacaatttaaagacagaaattaattagttgatattcctactttattccttaatcaatttaacttgcaaattagggtacagttaaatcgaatcggcctaatgagacaagcgtctacaggtacacttggagaggcggtgacagaaacgcgatccgaatcgcgcggtgcgttctagaaactgtcaggctattcaacacctcctcagaagaagtaagatggtacgtatttggagacgacgacacgattttcattcctgaaaacctcgctcgaactctctccaaatacgaccacacatcatggtattacataggatcaacctcggagatttatcaccagaactctatgttcggacacgacatggcgttcgggggtggtgggtacgctttaagcagctcattggctaatgttttagctagaaatttcgattcttgtatcgaacgatatccacatttgtacggaggagactctagggtttatgcttgtgtgcttgagcttggggttggattgtctaaagagcctggcttccatcaggttttaaagtctatatgtacgtaattaatagttattagtaaaaaaaaaaactgattagagatatttgtttttatttttgaagcagtttgatgtgagaggaaatgcattgggaatattgacatcacattcaacgagaccgttggtgtcactacaccacatggctcacattgacccaatctttccaaactcaaccactttctccgcggtccgccaccttttctccgccgtacaactcgaccctctccgtatttttcaactatccgtttgctacgaccgttggtactcttggaccatctccgtctcttggggatatactgttcaggttaatacttttttacccttttttgttcaggactccaataacgtaatgttattaattcaaaatttaaatgtttgtttcaattgttagattgatggcaggcatttgtttctacgggatgttttgcgggcacaagagacgttccgaccatggcaaaaatcaggcggattagcaagtgtttacacattcaacacaagagagattcatcgtgatccttgccaacgacctgtcactttctacatgcaacatgtttcttctagtagccatgatggaaccattaaaagtgtttataagcaagcttacgagaattgcacctacgatcctgttacatcgcctcgcaaaattcatgagattagagtgttttcaagaagactcgatcccaatatcagacaagtacttcattctatcttttctatttttttatttttttttaaataacaaaatataggatagattagtagaattttttggccatagtgaaaatcttttttttttttttgacagcaaagtccattagagaaaatcattttctagattagtatatatttgttaaaatatcaattactatggtttctttacgtatagatacttcctttcgattttcgtatagaccaacaaaattaggaatattggggttagtagtggtcaaagttgctatattgagtgaactttttaaagtagcaccctaaaaatatagtatttcgtaagaaaatttgcttcttacttattagatttaagtttgttttatcataacaaaataaatgttttgaatgcggtagttgaaggctcccagaaggcagtgttgtgatatattaccaacttcttcaactggtggcaacataatggaaattggactgcgagagtgcaaagaggatgagctcatctatattcatccctaatttcaccgtaactaattatattatacctttacaatattgccatccattaattttgaacctaaaaatagtttttttttctttcctttttgtaaatttaacattaagttgttaattggctggttgcctttcaacatttggagcatttgagattactttgtgacaaaaaactgaacatgacatgaatataatctagggtggaccttcactgaaattgatgaaaatgacattatacttaaaattaggctacctaccaaattcaccctagatttaatatatttctattggttacatctttactttaagatataaaaactaagaatgataatttacttctattacaagctaagaatcctagatatctcagtcgctcacttttgcagttgattccctttacgattagcgtgctacaatcgtatcaagtcacattcacacactcttgtttattttgttcaaaaaatgaagaagaacaaaatagtaaaccgaaaataatgctatttgaaatataaatgcgaccgtattgatgcgggccaaatacaaatccggttaaaccagttaaagcgaaattggaaagtaataggaagtgattaaggtaaattaattaagtagtattaattagcgtaacattagctgggggattagacgactttgccaccgttgttaataccttccttgccttctttctttcgttaccatttgcgtgatccctatcttctttatcttcgccctccggattcttcaatattactaaatctgccatcatctcctcgatttcg

SEQ ID NO: 8218 - DNA, 3000 bp, Unknown
  misc_feature (1)..( 3000): cDNA_ID_1810866_gDNA_ID_1621201_Annot_ID_174908 3000 nt of promoter + ATG
atcatggctcatatctctcttcttgttggagcaggggttatgtcacttttagctaaatgggcttaaatgggcctaccattatgcaatatggaattcaaaatgactctactacaaccaattcactaatagatgacacgttatatgattcacttatagtttatagtctttgtttttttttgacacaaacttatagtttatagtcttgtttcatacaaattatatacccttctcgtttcttgacaattattggtttcaaaattttgttttttgtttcattttatcgttttatgtttttagtgtaaacttgtaaacaaaattcaagttttagtttcctatagttaaagagaaaaatttaaagtgtattaataaaatgtatggtcaaatatataaatcccttattggagtgaattttattttcaagatgacggttacactgccaagtgccaacgaaatgttagtagttcgattcttctaagtaggtgaacagaaagttggaaaaatgttccggtgtgaactttactgatactgataaaaaaaaaaaaaaaaaaaatctttactgataaagatctcaaaaaaaaataaaaaaaattgaacgttgactgtttgttgacaaagtaaacgttggccgtatctagatatcaaaattataagatatcatacgtgtttagatgaaatttgacaaatagatggagattagtatcttactgacttttacagttactgaaaaagaaaagagtgaaataggatagtttttagagtatctttttaaaaaatatttttacattctagagatcctaacattactaattagctatgatttttttaatcactttggacaaattcagaaaaaaaccattatccttttcttttgtcatccgaaaataatccattatccttgttaatcgcaatggataatgtaagaaaagaaaagaaaacataatatttgttgcaaaaaatagaattaaatacgttttgtgactgacaaaatactgttagaaaagcttaacagactgtggataaaacacaacttaaccaaaactgaaacgttttatctattacaaacaaaggaaataaaaataaaaatcatatggaaaagaatcgaaaatcaagcaaataaaatccatttgcattaaatgaaatcgaaattaagcaaattataaataatatgtaaaatccagtcagaaatataattaaaaaataaaaagagtaattaattaaaatgtttttcatctccggcagaacgagaggaatcatcttcttcttcttcaaccgcgattgattctcacgcgcgcatgaagacgacgatctctccaagtgttaaccgccgcgcgccgctttttccggagcggagaaggatcgacggaacccaacggtggcggccgtctctttctgccatttccgaagacggatccaccaccgtattcgccggagaaactcatcgctcttttggtaaatttgtagccagagaaacgacgtcgttttcccgcagatatacgacactgaagagcgcctggtataattcatgatttttctattttccaattcattttatttgctgatgttttgtagatgatgatgacattatcataaaatatttgtttgatagtatatatgagaaatatgaattttggttgaatgcgcgcaggagaaacgcaatcacataccatatagcatcgccagggtttgctccttctccgttcatgtattaaaaggtatagtgtgtattcttcttcaccttctgtaacgtcaaaaggtttttacgtagaaccctaatttaaacgaattaatttcttgtaattgtttcgggagccttaattgttatatttaaaaaaaaaactgttttatatttagcggacccatatgtaaatagtgctttttttttgaacaattcatgatttttcatatggttttaagttttaacgttagagaagtttatgtagtgttatgtagaggctatgttgttgaacttttctacagtttcgatcttatctacaaattatattgatccaagttaatcttaccccaaaaagatagttcaaagatgttggtggacatttcatcacgatagatgtcttattttgtgtgtttggattttgggggttgtttcatgtgaaattctcctctctgcatacaaatatcatcacataatggttaggaaagggctcaaaaagccaaagaaataacttgtctgaaaattatcaagcattatctgatttaaaatgcttgaggctctaaatccttcaagtgttgttttgcttgcctgatcctccgtgtcagtttatttttaagttccacatgtttgatactgaagctaataatttatcgctgttagggtaacatgtgtaaatgatacattatcatcatagatattatgattctatatattacaaatgatgattattctgataaatatgtgtattgttagaagtagaatatttcacaaattttgaattgctaaattgattttagatattattatgaattcataacgtttgtgtatttattttgtatttttcatttttgtattgatttatatatataatttttaaaagactacactaataataataactttgttaacaagagtgaaaatttattttggattgattgttttttgtaattttatcttctataactactgtgaaatagatatctataggtatttaaatagattttggtgaaagatattattgttttgttactttaattatatctacttatttctattggacaagtgtgacgatttgattagtattagatccatgtaaacatgtataagaatcttataacttataaattaccccacatgtcataatactgtaaaacaacaattaaaataggtttgtttagataatatttctatttaaacttaaaaaaaaaacctttcacacaagattctcaatttaacaaggaatctgatcgcttcttcttgattaaccctttttctttaacctcttaaaacaagaaaacaagaagacaaaacttgttttataatagaga

SEQ ID NO: 8219 - DNA, 3000 bp, Unknown
  misc_feature (1)..( 3000): cDNA_ID_1810868_gDNA_ID_1621201_Annot_ID_174906 3000 nt of promoter + ATG
catatgttcaaaaacttaatgagactcaagttgctctattaattaacacgtcttttattgatggagatcaatggttacagttttctgacctttaaaggaaatatatcaaccaaaactcgttggaatatactctttttatatatcttgaatcggaacattatgattggagaaagtgcaatttttaccaatgatttaaactgaatcattgcaggttaaagttcaaaatggttaaaaaattatttatatatatatgatacataacctccaaattataaagattacaatcgaattgaaaagtctctaggaacaaattagaaataggtacattaattgttgacgacaacgacgactatccaattgtgactacattaattttactaaaccgataaaatagatccgggttcggactttaccggttcggttcaatatatcaacatacgacatgcgatcacaacggagagcaccgccgccggagtattcgcctccgatatacgatctgttccacttagattcacactcgatctctcgaacagacgaagaaatcgtctatctctcttctcaacagatttcctaatttttgtctctatggattttgtttccgtaaagaagatacatctttttgtgtaaattgtcttgtagaaagaaacattgattcagtagagaaataggataaatcaatctctgtacttaaaacaaaagtatcatatatcattcgtcacaaccacacaaagttgttgaaactcagtttcaaagtttgaacgattaattatgcagtcttcaactgctgacttttgagaagattattgatttgtctcaggaatacaaaattgtcaaagtgattcattataaatggccccattcattaatcatccgacggctttcacgttatatagggtttggcactcatatatcgatgggctatatgctacttgtctcgtctaacttggaagaagaaaaaaaaagttttatcttctaatgaaccaatggatatcaaaacttggattttgaatacatgcaaacattacttgagtaaagtatcaaaaacttcattaccgaagcttatgatatagtaattgaattcgtactattgccataataataataaaaaattcatgtactaccacaattcaaagtagagacaaattactatattaaactctgaaggtatttgtgtgccgttgacacaaataaaattatcttagtatgtttttattttgaggcacaaattaatgatcaaatcgttaaaagatgaattctgggaagtatatactgagtggatattttcatttttgttggtagataatatccctcaaatcaaatcagcagtatttcttttcttgtaaaaggttttcagcatattagatgagatccacaaaaacaaatatctacacatcataaagcaataattctttgccaaaaaacaaaaaagcaataattaatttcgctaaaaaaagcaataattaaagaagttagaaattcctgagttttggggaaaacaaaactcgtgatttttaaagctcttccaggttggacgagatatatagtactgtagtctcttgtgattttttgtgctatatttttgtgtattgcgtcgcatatgtatgaccatgccgcatggtatgcagcaactacaaaacattcaattttaatttgtacgaagtccgaatgcagtaaacatatgtactatgtagtaatgtcacacgattctgaaataaaacatatcatggtcaataatcaagatgacatcgatgccattttagatgattttagctctggtttattaagacttgcatcttttcaaaaaaagcaaaatatctatgcgtagacctaaaggtaacaggatagagatttagatagaattattaaataatacgtaagacatacatgttaaagtccaaatcgaggaaagggaaattgggaaaatagagtcataatatcgacataatcagacgtttgagtcggttgacttcacatgtgcttaagtaaagagagaagggaaattgtgttttagatagttccgtacaatttatgtcgacattctctcgacatatagttaagctctttattttagtgtttgttaagatataatcgtattttttaaagtattcacgagaaaaacagtttcatagttacacgtagcatgtatgaacgtagtagaggatctttctcacttttaaaaatctattccctaaagattcgatttttcttttatttcatcccctcaaagtagctctcaactatctataatttaatttttaacaaaaaaaaataaaaaattagtagctccaagactaactatttgtagttttgtaccatggctaaaatttttaaaacaacatgttcgatggccgcatacgcatttcccttttcttatcaatttaaaattaattattgtttagattcttcgcgaatttgattacacagatcacatgggccatttgatcatcatgaccaaaatgattgcgaataatcgattattatttgtttatgttcgaatgaggatagacaaaaaattctgctcagtttttgacaacctcgagtaagttattttagaatcattttcttgaatcacatctattacaaattatttatgaaatatacaactaacgttcattcgtttttatttaaaatttaaatgttttaatttatttcgagggacaaaaacaaatacgggcctagtgatttttcatgtattttcttctttgaattatggagtcaaacttgtttgagttctacagagaaaaaaaagcaaattaaaataaatattgaatgtcatattaaagtatataatataacaaaaaattaaagaaataagtcttctcttagaacagcacctgttaaaatataactatataactgtgtaacacacactttgagataaatacatcgatcactcccaatctccccccgtattttgtcctttattcttccattcttcgcgtcgtcatcatttatcattatcatcgagaagagattcaaattcaaaccctaatcgataag

SEQ ID NO: 8220 - DNA, 3000 bp, Unknown
  misc_feature (1)..( 3000): cDNA_ID_3047937_gDNA_ID_1621201_Annot_ID_174904 3000 nt of promoter + ATG
aaatgtgccattagctgagtaggcagtgtcgttccacgcaatggctgtaatgtcgaagccttgtccttgcaacgttatgtttggtttagtcttcggaatcaccactttttcactgccatgcaatacttatatatcatttacttatatagatttcttaattgttattgtagtaactaaatcgacaacatactagtacatgccggagtttatccaaatcacgttccttctttgactgaaattccccactgcgtccacggccgattgcaccgtcgtgaaattgcagcaaccgttcttatccacgcagagataggatgttgtgtcggtgtccaatggaggtatatttttagggaaatcgtcgcatattgatacctttcttttggtatccgaaggtttatgccggtggtggtgatgatgatgatgatgatgatggtgatggtgatcacataaggatttcttgaatgaatatgatattgctttgataccaaaagcttcaggatgtgttttaaagagagttttagatgccagaacggcaattattgcgatacctatggatatggataatgagattattttcatacctgaataatagaagataattctgtgaaactttgattggttgatttaggggtttgagagggaaaggataaaaggaacttaatgaataagatgatgcataagagagttatttatacgaacaaatatgaaatatgaaattgcatgaagtgtaaggatttgttggaatgccttgcaaattaccctttgctaatgtttgctttcttacaaatattaaactatctcgatccacctaccaaaaaggctcatagcctttactagaataaaaaaaagtgaatatcaatttcgtttgtataatatatttgagaacccattgtcaatatatatactctgagtactttatctcacatgtaaacaaagaaggtgataaatgatatatcatttttcatgtttctaactaataaagtgattatgctagctatatgtataatgtgcaacaaaaaattaagagaaaaaaaatagtcatctacttaaagcaattttatagaatgccatactaatcatttatcaaacaaaatctgttcagctctgatgttttgttgttataatgtttcactatgcaaaaagaaatacagcaaaaaaaacgtaagttagaaatgattcgttattactgagtctatacaactataattcaataaacctcattatttggaagttgagtacacatgcatttaactttgttgattgattatctgactatatatatataccgtccagtgtccacagccttatgataactaagataaatagaaatgaagcatctaacatcccatgtgaaaataaatcttgtgtgaaattttatctcgcatacacgttcaccatataagattgtaagctaatgaatataagaagtgaaattaaaggtcccaatatttgcaagtatatattgtgtttttatcgtttcactagttatgtagtttctttttgataccccgatccaaattttgtaattacgtagaaccattatggtctatttattagtctattgattgtcttagtcaataacgcatatgtatcaccgaatatggatcattaattactgaataaaacacccaaaaaacttgttagcaaatgaaccctatgaataaaagaaggggcataatggaaatttagataactatccttcaatgatatacaaagagacccactccctctccacattttctttttcaaataaaaagactctctctctcccatttacatctcttcatcttcttctctttctgcattttgtgactaaatttgttccgatctccgaaaaatatgaaatcttattagaaaaataccggaaaagaaacagattagtacattcgattcagcaccttcaagtaagcatatccacacctcttctggtcttttatgatattttttcttatctttttttaaaaaaacttatataattgatctttgatccaagttgtctctgtttttcaatttcgggatttggaactatatattgtaggatcgtgacaattccgaatttcagatttcgatcgatcatcttttcaagtattagtggtaaaactcaacgtctctttgagaaactcaaattctttgtttatattaatcgccgttagttttccatattggattgtactattaaaaatttaatggtatgtggtaaatctttgatttgatttctttcaagatttaggtgcaactttcaagagatgtctttattgatgtaactggttttgtgagtcttttagcttagtcgaatttatttttatttttgaattttattcgcctgcaagatcattcaagtgctttaatatagtgttcattttttttaatttatgataatgttttttttttaatcaaatttttggttagaattccacatgttcttataagagagctactagtttggtgagcatttaatatgtgttttttttttatttgttgggtagtttttatttattgacatcataaagtttgatcacattgtaatttagatgatcataaacctattagccagattaaaaacttgtgaaaatacagacgttgacctttatttggagatcttccaaaccttctcaattctgttttctcttattatatttgaaagaatgttgttggcaataataaatccaccattgaatatcgtattattgaatataaacaatgtatatatatgctctctgtcgtcacaaggagattatcttatcttgttagttattttatataatctctggggaaatggttttcttgcaagttagggctttatttttcgctttaaacaatgaaattgttgcggttggattgttcaactgaacttgatcatatttcttgttgattattgagactttaacgtgtgacatttcattcatatatacaaaaagtatactctttaacaccaatttaaagccttaaattctcagcggttgcagaacacaaaataagaggaattgcttgattatagctatg

SEQ ID NO: 8221 - DNA, 3000 bp, Unknown
  misc_feature (1)..( 3000): cDNA_ID_3434222_gDNA_ID_1621201_Annot_ID_174902 3000 nt of promoter + ATG
ggcggcagtggtgtggatcttgttttgagttgtgtcgataactatgaagcaaggatggctgtcaaccaggtagctgttacttctttctcgaaaaggcttttttgttacaaattccacagttcttacttcaccatcgagcatttttgatcttacattctacataattcaattagttgggaatggaaaatatataaaatattctagattggctctgatttgagtttattcttatgaaatataggcatgcaatgagttacgtcaaacatggatggagtcaggtaaatagtatgctaataattatatgtacttctttttttcatttctcttttggctaacaaaaaaggtgatattttgtgcaggtgtatccgaagatgctgtttcaggtcacatacagctcttggttcccggagaaactgcttgttttgcttgtgcacctcccctggtatgtttttttccttcttatatcactcttacaactctaacctataatgccctgcattaattagtgcttgaggaatgtatcagtggaatatgggtggttttaaggattctgtgatccagggtattgttaatactactttttggattttctctaagcaatctctttactctgtggtaggtcgtggcatctggaattgatgaacggacacttaaacgggaaggggtctgtgctgcatctctgccaactactatggtaaatttcataccaccttacaatacagttcaaaatttggctatgttgactatttatcaagttttctgctattgcttttgtttatttaagcgctatctatatattttaagactcttgtttgattgtcaattcagggtgttgttgcggggcttttggttcaaaactctctcaagttcttactaaattttggtgaagtttctccatacttggtataggctttgcttcctccagctctcctcacagttaacactttatagtttatcacagaatgattataatttgaatcagttaaagcttactagttttatgcccgttacttgatcccacagggttataattcactgaaggattttttcccaaccatgaaaatgagaccaaatccacaatgctcgaatgtagcttgtctagagcggcaggtaacctgattaaatgcaaccacaaaactatctcagcttgtctttgttttgcgccttttgtttccatccatgttctggtgaaaaagttgaaatcccaaaatgcagaaagaatatatgcttgcaaaaccagaaagggatgctgctgctaaagctaagatggaagctgatgcatccacaactatcgatgaaggtccactccatgatgataatgagtggaacataaggtaataactcagtgaattagttaaaaatcaaaatttgtatttttgttatcatattttctcctttccagccatatttgcaacaagaaatctgatgtgtatctcatgtctttttatcagtgttgtcgatgatgaaaatgagaaggatactacaaaagctgcctcaagttcaggttacttaaacttgggactctatgtgctatccatgtgaaaatgtatcaaatataagtcctgttcttctgactgttatctaaattgatcctgtgttatgtgtagatacattacccgaagggcttactcgggagcttccagttgcagatgagtatgagaaagcaatagccatagcctcagggtcaggagaaacagaggaggaagatgaccttgaagatctgaagaaacagctcgaagctctcaacgctgcttgagtctttatgagggagaaaaaatagttgttttagcatatttatacatgaaagaggctacaagtgcaattgtgtatgcaaaaagagtgtgttaggattggtaaattggatctcatggacatataaacgtttttgatgatgacttctcccgtttttttagttgttaccaaagacaaaaagatacaattttgaagatgtttcatggatttattgtcataatcatccgaactagaacttagaaattcaaattagaaaaagattttgtccaatgatgatgatccaagtttggtttgtaatgtgtaaaccagcttttttggaggtaagatattaattgcgcggggaaatcaactagatgacgtgtgaatcgcgaattacaattacgtttttggatggagaactgtcttttttttcctttttatatccctaaaatacttttttgtacattcatttatatcaggaaaaacagagttgtaaccaaattattacagagatattcaaagatatttcaacctatcaactaaagatgacgtgtatattgagaatggcaattgcgtttatgagtgggaaaccaaattatttcattaacatgatctttaggaataccgctaataagagattactaatcactatttgaggttttaatttaaatctttgtagtcctgattttgaatatttcgttttagctaaatcagctccaatttttcccagttatcgtttgtcgaattcatattactgttaatttagttaacttccgaagactattagtacatgattcttcaacaaagcaaataaagaaaagaatcttgatgtcgttctctcaacaattcaacaaaacttggtctcgacgactcgaccgtgtgagatgtttgagaagtcagaacaccacacgtgtcgacataaagcccgcaccacgcacgcttttcgtctggatatatccaaattactttacagaaatcatttgtattgtttgttaataaaaactttgaaccactttgattactatattatttttttggaatttattctggtgacattaatgttctatcctccacgcggttctcataaaccgacttggcttctttatttttcctttatctttctctatatatttacacacacacgcatttgtgcagagatattcaaagattagaaacattcttgatagatacaaaaaacatttttcagacacaaaatcataaaatctttgcctttagtagatcaaagttctttacattaatcgttagaag

SEQ ID NO: 8222 - DNA, 3000 bp, Unknown
  misc_feature (1)..( 3000): cDNA_ID_3047543_gDNA_ID_1621201_Annot_ID_174930 3000 nt of promoter + ATG
tgacttagtcgaagaaaacgttcattaaatggttcccgccaatggcccaacggccccaaacgcgtagaacgtaacatgcatggggatccatattaatggcttcttcatcccacttgcttatttctttcgactttggaggtttcatttacctattatataagggaatgttcagttccagtgactgagatatcacaagcaaacaagagaagacattttattgttatttctctctctctctccttgtagatggaacttaagggcgttacttgtttgcttctttctttggttttgcttaattcgtgtgtggaatgtgttttgggggatggatctgtggtgggtcctgcgaggtttagagacgatgattgtaggtggggccggaggtgtgctggacgtggccggtttggacgcggtggtggtggagggttcggcggtgggagaggaagtggtggcggtataggcggtggtggtggacaaggtggagggtttggagccggaggaggagttggtggcggagctggaggaggacttggtggtggaggcggagctggtggtggtggtggaggaggtattggtggtggttccggtcatggtggtgggtttggagccggcggaggagttggtgggggtgctggtggaggaattggtgggggaggcggagctggtggaggcggaggaggaggtgttggcggtggttctggtcacggtggtgggtttggagccggaggaggtgtaggcggcggtgctggaggaattggtggtggagggggagctggtgggggcggagggggaggtgttggcggtggttccggtcatggcagtgggtttggagccggaggagggattggtggtggagctggcggaggagttggcggtggaggtggaggtggaggtgggggcggcggaggcggtggtgccaatggtggatccggtcacggtagtggttttggtgctggaggtggagtaggaggtggagtaggaggaggtgctggtggaggcggtggaggtgggggcggcggaggcggtggtgctaatggtggatccggtcatggtagtggttttggtgctggaggtggagtaggaggtggagtaggaggaggtgctggtggaggcggtggaggaggcggtggcggaggaggtggtgtgggtggtggatccggacatggtggcggatttggtgctggaggaggactcggcggtggtgccggaggaggactcggtggcggtggtggtgctggaggtggaggaggaggaggtttggggcacggtggtggtgttggtggagggcatggaggaggcgtcggcattgggattggaattggaataggtgttggggtaggtggaggctctggtcaaggttccggcagcggaagcggtagtggtggcggcggcggtcgccattaatcaaagctcttattaccaatctcacgtttagtgtcttgacaatactacttcttgtcattctatttctcttgtattgtttcaagactaaacaaaaaaatatgtatgatacatttttcacttcaagatgtgatttcttctatttttgtgtaagaatgttttcaaaaaaaaaaaatctaataagaaaatattgaatacggattgatcttaattttggacttaatccgttttctttctttttctctgaagacatctagtcagttttctaagaggaacacataaccaacattgtttcaacaatatatctttctttttgcaaaatacaaatttcaattgaattaacttgtgtaacatatgtacgacccatatttcagttttgaggtcctatcgtcagatatttctctacgaaagcaacataataatagttttagcttttattgctgtattggctacgttgacttatttaaaatttgagtttgcataaacaataactttctacaatgattttgcataaacaataactttctacaatggattttgcataaacaataactttctacaatgattttgctatagctatcgtcattttgtgtcaaccgcttgtgtctactttcaatattgattcttgaaacttgcctaatccttaagaaccttaacaaacacatgaaataacatctcatggtcacggtcacttccgacctttaaatagaacaacaaccaaatctcgtcatggactcatggaacattcgaaattttgccaatgatgaaggagactgacgtcgataaagccgtcatctaaatgtctaaagactctaaactcaacatgcatgttatagtgcttttctatctacgcaccaatgtctatttcatttttttttctttttttcagtttttagtttaatgatcgaaactatatggtattttaagttttttttttctttgaaatataccatatactccctccgtcccactaagatgaaatttttagaaatttcacattctttaagaaatattgtataaagacaattttaacctcttaatatactttaaaaacaataataaatatttatctaattatttagtaagggtaaaacgggaaaacagttttaaaatttgcattggaaatataaaacttctatctttgtgggacaaatatttttcctagaaaatttatctttatcggacagaaggataaagtcaaatagatcataaagctatagtttccatcattaattaagccattattataatacagtatctactaaaagttttggtagttatgtagagattgtgattttgcgtctcacattacacatgtatcggtttcacataatgtctataatatacgatacctaagttaattttccatttagcattgcttctccaatttaatttgatacaagatcttttggttagattgctgcagtcacaatttgctaatcgaaccgataggttagttgacacgtctgtataatgtcgtgtttcccgccgttctggacaatcaacaaaaaatggaaaaatagaaccgaccactttatagaacatagtaaccctaaacttaaaattttccaattatcctcaattttgcgaattaggacagag

SEQ ID NO: 8223 - DNA, 3000 bp, Unknown
  misc_feature (1)..( 3000): cDNA_ID_1810839_gDNA_ID_1621201_Annot_ID_174926 3000 nt of promoter + ATG
tgatgtgtgtcattgttctatagtgccacgaccgggggaattctagatcgagctatagaagctgaggacaggaagcatggagatttcttgagactggtatagttctgaatatagttcactgtttaacaagtctaaggctagctcttatcttcattctcattactcacttgttttttataggaccatgttgaagggtacctagagttgtcaggcaagacgaaaacttacttttctacagcattttcgatgtgggatgcagatttctatgtcaaagtagatgatgatgttcatgtcaatataggtaagttctaaaatcaacgaattgaattggttttctttatgtcattttgcataccttatactggcaatactaatgggttcaatgtttcactgaaatgtctgcagcaactcttggggaaactcttgttagacaccggaaaaaaccacgggtctatattggttgcatgaaatctggccctgtcctctctcaaaagtaaagcatcttccagtttcctccttcatatcaattttgtattcttgttaagtcatctttgttttatggagcagaggggtgaggtaccatgagccagagtactggaagtttggtgaaaatgggaacaaatacttccgtcatgctactggacagttatacgccatttcaagggacttggcttcttatatatcaatcaatcagtaagatgaagatgagattacattgtatcatagctcatttgttaactcatgtaactcttcgttcttatacatgttaaatgtttcaggcatgttcttcacaagtatgcgaacgaagatgtttcgctaggagcttggtttatcgggattgatgttaaacacattgatgatagaagattatgctgcggaactcctcctggtaagtcttaagctcttttcatctcctgcttgctgtgataccttttaagatgcttcaaaaatcaatgtacatattttgattacttagacagaaaaaacgtcaacatctttggtgttggggacctaactacaataatatctgctttaaagcaaaaggcttaaaaatgaagagaccttaacctatctaaagagatgactcgtccctatcaaaatctctactgatacaaagtcttaccaagaacctaaatgatttaagtttgacaataacatcaaatctttcaacctgaaacatactgaaaatatgttaaaagattcagttttggtatttgcagattgcgaatggaaagcacaagctggaaacatctgtgtagcatcattcgactggagctgcagcggaatctgcagatccgcagatcgcatcaaagaggttcatagacgttgcggtgaaggtgaaaaggctctttggagtgccacgttttgacatataaacagaggaatggtaaaaacataacggttttgctcagcccccaaaaacagctcaaagatcagaggaaggtcgtccagatatacaattccaagagatatccacttttgtattcataggtacatagaatagaagaggcaggaaggattagagataagtgtgaaaacctctggcaagaatcgcaattgcgtattgtgattgtggcgtttccattttggtataaggaaactgaacactacagtgaacacccctgctgctttgttcgttttgggtggcttgaaaatgaagcaacttgtggatttttacatcaaatacaaaacactatgccctgattcttttggatccataaaactattgcatagacagaaatcggatactgtgtaataacctctctggaaatcattaggcgcagtaaactgtaaaacttaacaatgtctctaaaattactttgaaaagtataaaacttgggaaagtaggataaagttagagacttttatttgttggtcttggtcacatgtcaaaacagacactttggttctattggtttgggtttcggtcgtctgaggcccgaaagctgcttcttactcgaaagtcgaaacccttgtgagagaacttggtgatgccgaagatggtaactccgacgagtactggaaccagtttattgagccattcgcagaatctgagggtcaagtggtctcttctctctcattgctttatcttaattaaggtctggttctcttttactttatcgattcctctccatgtgtgtctaccaaagttttgattttttgttgttgttggtgtctgaatccgagtgtgaagtagtcgtacaccctaatcgaaatttccaggatcaaacttagtgaaattcacttgttgatctacgtattgaaaattacgttcagagaggtcgaatcaacggattttttagttgtaattaagctttaactgatcaaaattaaacaacttgaagaagaatgtggacaaaaaaaaagaagagaaattgataagaaaaagtttagtattaattttagactaattaatcttcttggagtgttttgtttctctgttgtttaacgaatgtgttcactgttttgcatttggatctacatttgctacttagttttagtatcaacgggatcttatcgatgaattagtatactcatgctcgacacatgtagagatgatagtactggttttggtgaattaacttattttcttgaagaagaatatacagagaggcatttgccatatagagaacccaaaatggaagtaatttcggttaatccttaggagctagccgtgtgtccctttgtatcttcccaccacaaattagataggaacactcgttttggttagaaatctctttcataaataaattctatcccgctaagattctctcttgttctttagaaacaaaaataagatataatattactaccaggaattgcatggacaagattttttccagattaaaagatattttaccagttttacttgtagactttccaggtattgagtaatgtaatacacgtatctacatgaagatgaggatataaatatccatttatgagaaaagaaaaaaagggacaaacaaaagttggcaagtttaactaagtgaaaagtct

SEQ ID NO: 8224 - DNA, 3000 bp, Unknown
  misc_feature (1)..( 3000): cDNA_ID_3047945_gDNA_ID_1621201_Annot_ID_174899 3000 nt of promoter + ATG
ctgaattgacaatcaaacaagagtcttaaaatatatagatagcgcttaaataaacaaaagcaatagcagaaaacttgataaatagtcaacatagccaaattttgaactgtattgtaaggtggtatgaaatttaccatagtagttggcagagatgcagcacagaccccttcccgtttaagtgtccgttcatcaattccagatgccacgacctaccacagagtaaagagattgcttagagaaaatccaaaaagtagtattaacaataccctggatcacagaatccttaaaaccacccatattccactgatacattcctcaagcactaattaatgcagggcattataggttagagttgtaagagtgatataagaaggaaaaaaacataccaggggaggtgcacaagcaaaacaagcagtttctccgggaaccaagagctgtatgtgacctgaaacagcatcttcggatacacctgcacaaaatatcaccttttttgttagccaaaagagaaatgaaaaaaagaagtacatataattattagcatactatttacctgactccatccatgtttgacgtaactcattgcatgcctatatttcataagaataaactcaaatcagagccaatctagaatattttatatattttccattcccaactaattgaattatgtagaatgtaagatcaaaaatgctcgatggtgaagtaagaactgtggaatttgtaacaaaaaagccttttcgagaaagaagtaacagctacctggttgacagccatccttgcttcatagttatcgacacaactcaaaacaagatccacaccactgccgccctctttgctaggacaaaatgacttgtttgtcaagctggacgtgaaggtttcaaagccttgcactgttgttatgttcattgtgaaactctagcagaagaaaaatagaaatagcataaattggtgactcaggaattctgtaggtgggaagctaataatgttccgcagtaaacaacataaataaattaaccaaaaagagcctaaggatacatacatacatcatacaccatagacctcccatttaatacgtaatgagtctaaatcgaacacatccgtttgggcaaatccatagactttttagtttccagtaaatatgatgtaaaaatggccattgaactagttttaacctcatcatgtagaaaacttacttcaagaactacgtcagggtttatttctgcaagggtttggacagcagcatcagtctttgtcataccaacctatagtcacaattatccggagatcagaaacaatacgaaagggacgaaaatatgtattgcagaactcaaatgagaattgagtacctggtccggtctaaaaaacagtctgttcatgttagctagttcgacagtgtcatagtcatacaacaaaagacgaccaataccacatctggtaagcatctcagccgcaacacttccaacaccaccaattccctgtcatttagatcatcctttccttacttaatgaacaaacttatagctaaacaaggaaaatatcataaaagaaaaaacaaggagagaaatacgtacaacaatggcgacggaaaactctctaattctctcatagttgtccacaatgcccatccgctgaagtgccataagcctactgtaaggattactatctaccacttccgagcttagttcctgcaatagattgaaatcagaaacgttttacagaagataactttaaatgaggagaatttgtcaatacaaggcaaagaccttgactttggaacgccggtgaggattacatttagacagagtggctagattctcaacatgtgatcgcagctgcaaagcccaaacacattttcaggagaattcataagcaatgcaaacaacaaaaggctaagtgaaattaattcggagattccagattcaaatcaatacaaagatatactcgtaaacaccaatgcatgtgaaaattcccaacggaaaaatcataatccatgaaacgcaatttgagtattaattcctcgaggaatcaacagtattggaagaaatcattcactaagcaaattcacagcgttaagaaaaacgagatcggaagtaaaaacccaaacaccttgttgatcagagccggatctgagagagatttctcgagaacgtcaagatcatcgagcaatgccttgaatccaacctccatttttcagctctcttaggatgagaaatcgaatctgcgatgctgatttgggagagagacactccggaatttgtacacaaagtcacaaaggtttaaagccaaagacgttattgatttcaccaaacaaaaaaaaacaaaaaaagttgaccgcaataacaaggaaggaacataaatttatccggtctgttttaaagattgtggatcacactgggccttcaaaatagcccattagttcacgtatacggttgcactctcctagaatttttgtcacgtatcttcagggaacgcttaagatgacggatgacgaacgagccaccgccacggtagctttagaaagcccgtttaaaaaaatttgtagatcaaaatgaatatttgtagatcacaatgggccaagcttgggtcgttacgaagttgataaagactaacaaaacaaaaaacaaaaaaactaacatctcctatagcctttgattccttgtcacgttatgaaatgacacgtggttcttttggaaccggtttataaataaccggtaaaccgaagagaagaaccaatagaatgcgccatatcacatccaacaaaacgggaacctgattttggtcgcataccttaaacataggagatcgagattgatggatcctttctcaatccatccaaaatcttcagacccaatgctcttcttcatctaatttcctgtctgacggacacatcttgtagaatcagagaccagtttcttcagtagagactcgacgagaagttgcacctgaaaattcatattcagattaggggtttattgattcgtagcatgcgaaagagatatg

SEQ ID NO: 8225 - DNA, 3000 bp, Unknown; identical to SEQ ID NO: 8224
  misc_feature (1)..( 3000): cDNA_ID_1810885_gDNA_ID_1621201_Annot_ID_57655 3000 nt of promoter + ATG

SEQ ID NO: 8226 - DNA, 3000 bp, Unknown; identical to SEQ ID NO: 8221
  misc_feature (1)..( 3000): cDNA_ID_3434222_gDNA_ID_1621201_Annot_ID_57657 3000 nt of promoter + ATG

SEQ ID NO: 8227 - DNA, 3000 bp, Unknown; identical to SEQ ID NO: 8220
  misc_feature (1)..( 3000): cDNA_ID_1810875_gDNA_ID_1621201_Annot_ID_57659 3000 nt of promoter + ATG

SEQ ID NO: 8228 - DNA, 3000 bp, Unknown; identical to SEQ ID NO: 8219
  misc_feature (1)..( 3000): cDNA_ID_1810868_gDNA_ID_1621201_Annot_ID_57661 3000 nt of promoter + ATG

SEQ ID NO: 8229 - DNA, 3000 bp, Unknown; identical to SEQ ID NO: 8218
  misc_feature (1)..( 3000): cDNA_ID_1810866_gDNA_ID_1621201_Annot_ID_57662 3000 nt of promoter + ATG

SEQ ID NO: 8230 - DNA, 3000 bp, Unknown
  misc_feature (1)..( 3000): cDNA_ID_1810859_gDNA_ID_1621201_Annot_ID_57664 3000 nt of promoter + ATG
gctcttgtagaatcccttgaacaagggttgtgcctatgccaatcatgcttttcaaatcccaatgtaatctcgcgttttcttcttcttcttagaaacgatgctagtgattattcggcatataattttccactggatcttgattcctcttcttcgtcttgttcatcttcttttatcgatcgcaattgggaattttcccttggttccttacctctcaataatgaggactcatcatcatcttttgaaatccttcaaatatttgaagatcatacaaagaattatagtgatcaacaagtgttgacgcttcagcccgattatttggacataattcctaaggtatatacttatttatttttattttgttaaagaggggttttgttcattgttatgagatatatatgtttgcttaactcgttccattgtttcctgtgtgtcacttttacgcaggatagttcatgctcaggcttcaaaagctacgaaactaaagaagatatagagaatgttttgatgaacacttttgatggcgccgaggcagcagtattagacctaaaacaatataaccccgaggaagatttgatcctcacggagctaatcgatgaattagcaagagacaattcagagaccacgccgaccaatgtaaacatcagctttaattctgtcgcatattaattatctttaattatggttgacttatttatatatttttgtttcattgtgtaatagactttaccaacttcagcatctggtatgtcatcggatatacataaagattacaacactgaagctttggctaatgcaagttctcaagattattttataaaccaaatgattggctcaaaagcaaaggaagagaccaatgatcttgcaatactccctaacgctcttgttcaacttgactgtggacaatcgcagttgatacttaccgatgagatgttaccatgggagaatcaaacatttgtacctgttaagggatttagtccgaaagatcgagaagaggccaagaaaagatatttcgaaaagaagaagaaacgcaagtaggtattacacctcattatacttataggtagataactccatgcaagtgtatacgtacttacaagttcaaatttataacaatgcaggtttgggaaacaaattagatatgaatctcgaaaatctacagcagatacgaagaaaagaatgaaaggaagatttacaaaagctggtgctgattatgactatgacccacgagctaatgatattaacaaagggaaaatacaaacatgagctaatgataaccaagctcaattgtgatatccaaataaggaaaataaaaagatggttgcaataatatatatgatgatcatcatcattatggttccatgattttttggactttgttttgccaagggtgttttgtagttcagtggttttgtctgattggtcgagatatcgatatccactggatgcacacgcttaaaggactgcaaaggttcacagagaggtcaaaacgatctctagttctctactatagtgttttgattccactctatagatttttttccaaaattatttttttcttttattatttacatttatttatttcttaaaggagctttattgcagttactgtcaaattattttaccaaaaacaataactaaatttttcggtaagactctaaccgaaagttaattcggttcgtttgatttggtttttgttcggttaaatttggtttggtttggtttttgtttgatcgattaagttttgaatgaatttctgtgggagttgcttctcaaagacttaaacctgcaacttggcaagttttttttcttcttctcaaaccattgtcttcatcatatagctcttttaaaaataaatgtgacaataatcgattggtggacatacagtagaatgctaagaaaaaaatagccgattggagaagaagcaagaatatataaaccacctcttttgcaaattaaagatacgtgtttgtcatggccttttaatttttcctaataacaagttctttaatcatttctcacgaaacaaaactcaactgtcttagaaatatattaatattccctgcggctcggatcttgtgacactgcacatgttgaggacagctaaatttacgttactaaacgttgcttgtttcgtctcgtctcaatattttagtgtgtaataagtaataactatatatggaatataatatatgagcatttaaaaaaccatcgaacaataataaataaaaaccaagccttaattggacaagtccgatttaaaatcttacaattgaccaaaataaagttaggaacgagatctagccatcatttactaaacattaaattaatgatttacttttgtcatttattatataataattatatcatcataaatctagcagatggagtatttgatactcgttatacaaaacataacatgtatcttgcattcttgctaattaatgaccaaaagtagaaaagaattctatattgttatggcaaaattaaaatttaaaaaacgatctctattgtttctttttgttaagtaaaaatgtctctattgttaataaaaaaaaactcgctttttcgtttaagaattttttttattgttgtatggaactaagtgaattgagaataatttgacatgtgtcgagtaatagattcctttaccaaatatataagcatctccaattaattaagatgtacattactttaatttgaaaaaatacaaagtacaagaaacgtattactagtataatttattagactccttctttatttacgccttagcttccgtgcctaatcacaatactagttatttacatatagtttagtcagcattaattccttacactaaaaccatttttaacatgactccattgctctccctctgatcaaccctcctcctccgccgctgctacaaacactttaatatatattgccaccgtcctaccatatatatatagtccacttaagatctttccactcatttataacccaaatttgttctgtttcataaat

SEQ ID NO: 8231 - DNA, 3000 bp, Unknown; identical to SEQ ID NO: 8216
  misc_feature (1)..( 3000): cDNA_ID_3047930_gDNA_ID_1621201_Annot_ID_57666 3000 nt of

SEQ ID NO: 8232 - DNA, 3000 bp, Unknown; identical to SEQ ID NO: 8215
  misc_feature (1)..( 3000): cDNA_ID_1810854_gDNA_ID_1621201_Annot_ID_57667 3000 nt of promoter + ATG

SEQ ID NO: 8233 - DNA, 3000 bp, Unknown; identical to SEQ ID NO: 8214
  misc_feature (1)..( 3000): cDNA_ID_1810854_gDNA_ID_1621201_Annot_ID_57668 3000 nt of promoter + ATG

SEQ ID NO: 8234 - DNA, 3000 bp, Unknown
  misc_feature (1)..( 3000): cDNA_ID_1810850_gDNA_ID_1621201_Annot_ID_57669 3000 nt of promoter + ATG
acctacatatatacagtaaaaatcagaaataagttgggttattgtttttttatatatagttattttaaagaatctaggtaaagtataaacttactgaaaagaaaaacttgagtgttaaagctatagctataaggactttaaaaaaaaaaacaaagcttaagaactaggtaattaaatacgcagtatatttctctatatattcgcgtgataaattaagatgaatgcatggcttttacaaattatcacctttttaatgggtgatccgtattttaaatagcttaattgcacgttatagttataaatgcttgggccacaaagtaattaatatttctaggcatgtaaaatgaagtcttactgtgaaaaaagtgatatttcattgacttccttaaattgaaaaaacaattgtttcgtaaacaaaactcaaaattaaggtgatgatttttagattttcttcttttaaatgaaataaaataaatacatcactcaatcaacttctgtctgactaacaataatacaacctaaacttctataatatttaagaaaatgccatgtggaagaagaatcatgaaattttccttctttacaattaaatttataacaaagatatgaaataataataaaataaaatagttaaaaatataatagtcatattttttgaaagtaaaaattaaatttatatctcataaagataaatattaactataacaagtcattgaattttagttaaaaaactatataatttttttccatattataaataatctaagagtattaaaatttcagaaaattacttttaaaattgtatccttgacaaatggggactattgtctaactttttctgtaaatggagaactgtattaaagcaaatttcaatatagttaaatctttttttaatatagttaattttgttaagtggtgatttattgcatatgcataagttatgaataatgctaatgattttttaaaaataactacatatctaatagataaatgtaagtctcataggctcatagaccgttagccgtcattcctcaccacattataatattttaaataaataaaaaataaaattattttaggttgacattgtatataagatgaaaaacaacacataattttgtaacataaataaaataaattgtaacatatctctctctctctatatatatataagcgtgtaggataattaagtgtccctctcgcaccatttaatttcattgcaccctctcaattctctctgtcattactctctcatctctcttcctccaagatttgcacctacctttcaaaccttttgctcgccaacaaaaccgcgcttcacaaaaccatcagcggttttccgagaaacaaatctcagaccagacaccgctctactcttctctctctctccctctagggtttcgtcgcttcttcctatatcccagtgtatgtctcgaaaacctcatcatttctgctgttttctttattttatccattaattcatgtacacaaatttatttgtttaaagtatcattggatccattacacttcagttttcttagcatctttataaaactctcactttcatgatgttttttttttataatttaatatatcctgtatgttgaattttcagttagtcatctatattttgtcttaaattttgccttctttagcattaattaattgatttcttgcctctaatatctttcattcctctcctaatttgctttctgactttctgatttattgtattcttctttaaataatcttatcaatttctgcatagtcagagatgaaaccttcaagaaaacaataaagaggaaagattaaaggttagtattcccttgcctaccaaaaaaaacagaaaggtttgtattctcttcgtatatccttattttcattatacgtttggttttatatataaacacgtgtatatactttatagtagtagtatacatttacatattaatgtgtgtaataaaaacgtttaaatacgatgatgatgataagaaatagctggaaaaaattaatacatcacccaggccttatgtcacgttggttgtaagttgtataataactatatgttggtccgtcgcacaggtgcacagatataatactatttttttcatttcaatttttttttctttcttaatcgccaaatagtagtttacactttttcctgaagagtttttattttttgaaaatctactaatgattatatttaattaaattttgttttgttctcacgaaaatattgtttttttaataaacaggatagagttgggaatttatttgtacctactttttcccattttatttgctttgaacaaatgagtccaacatttctcttttcgtcttctctttcctatcccatctaaatcaaaactgatcaaaatacctcgaaattttaaattaaatcaccatccatcaaagctattatagtgtagaaattttaaagttttttctttggacaacaattgatttccatctacactacatatgatatgactcttgaatcaatcatagtttttatttcagtctgctgattagtttttttcttttcttttaaaagggtaaaaaatcggtagtttcgaataattttgagtatgtgaaaattcattatttttgggttggttattcaataacaaattaatttgtgattgtgatgtcttttttatgcaaggctcttttttcttgctttcaattagtgggtcctttgtttcctacaatcatctccaattcttctgtttgcttatatcattttgtatgatcttcaagaagaaagataaacgactccgaagaaagatttaagttattgttgttcatacaaaaagaaggttgtaaagttgttgacgtggacaaaagtattgccatatttttccagcctcgaagaaatttcccttcttcttcaaaccctaaattttgacaaaactctctacttttttttgcttctagggtttgctttcagtttccggagtataagaaaagatgttcgagccaaatatgctgcttgcggct

SEQ ID NO: 8235 - DNA, 3000 bp, Unknown
  misc_feature (1)..( 3000): cDNA_ID_1810843_gDNA_ID_1621201_Annot_ID_57672 3000 nt of promoter + ATG
tcttccactttcactttcagactatccggtatctgcatcttcaccgggtgtgaaaacccgagatttagcaccagctcctttccgtctactgttgcacgataaccaacacccacaagtataagctttttctcaaatccctttgatactcccacaaccatgttatcggtaagcgtcctaaaagtcacacagaagttaaaaaaaaagattagagaacaaacgatcttttaacctcaaaaaagttaaggacttcattggatgacaagaaaagatgagaagtttgtaacctgaaaaggccgtgcatttggttggctcttctagtttcgacggtttttttgacccttaagaaaccggattcttcctttgtaagctcaacttcgcgtgggtaagttaaagccagctctcctaatggacccttcactttcaagtcttgaccttccaatgcaatggttacattggaaggtacagcgatcggttgctttcctatccttgattctttgcactcaatggtcttactggagtaacccacttgagcaaaaggtgtgcttgagaccttgaacacatttctatctcccaaaaatgctgacctaaaacaaaggggaagttatctatctatcttcagataaaacatgtcaagaaagtaaaactctaccagatatatatctaaaccaatacacagaaactgttattggaacaaagataacgttagattaaggaagagaaacattcttgtagaactttcagtttccatggctaaaaacccctctagaatcctgctttttacacagtgagttccgcataacacattcaaattcccaaaataaaaatccacaatttcaagagtccataaccaattcaacattgccatcgatttaaaaagataaaaataacccattcaaagagattccttatacttgggaggctcatgaacacagtttatagagatttttgagtagaaaatgccaagtaaagaaaacgaaaccctagcggaatgaagaagctctatggtttgtagtatatgaaaagtacctgggttgaaaagatgagacgagtgaggaagccattgataagatttgatgatggagctctaagctctgctccagaaggaggatgaagagaagaagaagagcgttttatccagaaaagacttatccatcgtcagcttctgtaatcccctctttcaaatcattactttcacggcccattagctcactattttcggcccattacttttaaccatccttctgtgggacaattcattatttgtgtaacccatttatctatattgatcatggcctattatctcactgtttctaggcccattattataataactgttcacaaaatttacccaatgaacgtggagtttggattagattaatgaagtcaatagattattagtagatgcgtttggatcaaaattgtgcatctttcccgattaagtatgttttcaagtcgaatcttttaaaggcatggattttaaactactcttaacagacaaatttaaaaatgaaatgggcccttaccctcagaaaaatccaaacaacaaattgagaagattcaaagaaaaaaaagatgaactgtatatttattttcctggttcacatttcatttggtcaagatattcttgttctaaataaataaaaagttcgataccgacaagatatttgtggattcagtggcatattttattttgtgttaacaattaacaaatgaaaatttcaataaggaactatgtaataacaaatgcagctcttataagttttttttaataacattccttaatgaacactctaaagacaaaaaatagtcgaccatgtgtttcatgcaccttttatcatatgaaatcaatagtacaattactttactatttatgtctgaaaatatctttttcttttcttttttttttgtgtgaaattgatttgacaaccgttgaggagacttattctttgacgaaggcggccttggagcaattaggtcgtcactcctcacattcacattttcaattattattttgcctcatgtcatacgtagttaccctaattaccatttaactatatccgttgtaaccaaaaagaaaaatgcatcaactaccttaataaatgatagttaccaataagagccaacgtaaaaatttgatttatcgaatagtatgaggacacaagtaaagcatcgatcatactaccccacaccttggcctacgtcttcactgaccactccagaaatagcactccaaaacaaaatttacaaaatttcataaaataccaaaaaaataagtaatgataaggaagaaaatagggaaaaaaaaggagagagaatattatgaattattctttgcttgagctcagaaacagttcttcttctgcttcttcgacttcttttctctgtctttcttctttatgcttagtgctaaatcactcgtttacttgtgaagattatggatctctgattaaagtttgtttctcgtatttattccaaggttgcttcttctttttctcaattggatcttttaatttttgtttttctttatgttcttacatatataatctttagttatttgttcattgaattatttattacactttttgcttctttctctgcgaaccatctttaagacggccctcttacacttcattattttcagttcttacttgcacatgtaaagcaccagtttctagaatcaaagggcctcatataaatacattattttatacactataaataaatatacagacacaaaaatctgtatacaccaatctctctacagaatctaactcccgatttcttggttggttttgccttctttcaccagatttctggaccatcttttttgtcttttgttataatctcaattttgattcaggttgggcattgtttatttcgcaggtgttactccaaataaatcaaatggttatatgagaccaggacaaagaaaaactagtgcttttgctggaaattgtgataaagatgggatttttggtgatgataagagaagtttccatg

SEQ ID NO: 8236 - DNA, 3000 bp, Unknown
  misc_feature (1)..( 3000): cDNA_ID_1808486_gDNA_ID_1621201_Annot_ID_57674 3000 nt of promoter + ATG
tattaaggtagttgatgcatttttctttttggttacaacggatatagttaaatggtaattagggtaactacgtatgacatgaggcaaaataataattgaaaatgtgaatgtgaggagtgacgacctaattgctccaaggccgccttcgtcaaagaataagtctcctcaacggttgtcaaatcaatttcacacaaaaaaaaaagaaaagaaaaagatattttcagacataaatagtaaagtaattgtactattgatttcatatgataaaaggtgcatgaaacacatggtcgactattttttgtctttagagtgttcattaaggaatgttattaaaaaaaacttataagagctgcatttgttattacatagttccttattgaaattttcatttgttaattgttaacacaaaataaaatatgccactgaatccacaaatatcttgtcggtatcgaactttttatttatttagaacaagaatatcttgaccaaatgaaatgtgaaccaggaaaataaatatacagttcatcttttttttctttgaatcttctcaatttgttgtttggatttttctgagggtaagggcccatttcatttttaaatttgtctgttaagagtagtttaaaatccatgcctttaaaagattcgacttgaaaacatacttaatcgggaaagatgcacaattttgatccaaacgcatctactaataatctattgacttcattaatctaatccaaactccacgttcattgggtaaattttgtgaacagttattataataatgggcctagaaacagtgagataataggccatgatcaatatagataaatgggttacacaaataatgaattgtcccacagaaggatggttaaaagtaatgggccgaaaatagtgagctaatgggccgtgaaagtaatgatttgaaagaggggattacagaagctgacgatggataagtcttttctggataaaacgctcttcttcttctcttcatcctccttctggagcagagcttagagctccatcatcaaatcttatcaatggcttcctcactcgtctcatcttttcaacccaggtacttttcatatactacaaaccatagagcttcttcattccgctagggtttcgttttctttacttggcattttctactcaaaaatctctataaactgtgttcatgagcctcccaagtataaggaatctctttgaatgggttatttttatctttttaaatcgatggcaatgttgaattggttatggactcttgaaattgtggatttttattttgggaatttgaatgtgttatgcggaactcactgtgtaaaaagcaggattctagaggggtttttagccatggaaactgaaagttctacaagaatgtttctcttccttaatctaacgttatctttgttccaataacagtttctgtgtattggtttagatatatatctggtagagttttactttcttgacatgttttatctgaagatagatagataacttcccctttgttttaggtcagcatttttgggagatagaaatgtgttcaaggtctcaagcacaccttttgctcaagtgggttactccagtaagaccattgagtgcaaagaatcaaggataggaaagcaaccgatcgctgtaccttccaatgtaaccattgcattggaaggtcaagacttgaaagtgaagggtccattaggagagctggctttaacttacccacgcgaagttgagcttacaaaggaagaatccggtttcttaagggtcaaaaaaaccgtcgaaactagaagagccaaccaaatgcacggccttttcaggttacaaacttctcatcttttcttgtcatccaatgaagtccttaacttttttgaggttaaaagatcgtttgttctctaatctttttttttaacttctgtgtgacttttaggacgcttaccgataacatggttgtgggagtatcaaagggatttgagaaaaagcttatacttgtgggtgttggttatcgtgcaacagtagacggaaaggagctggtgctaaatctcgggttttcacacccggtgaagatgcagataccggatagtctgaaagtgaaagtggaagagaacacaagaatcactgtgagtggatacgacaagagcgaaatcgggcagtttgctgcaacggttaggaagtggaggccaccagagccatacaaggggaaaggagtcaagtattccgatgagatagttcggaggaaggaaggaaaagctggaaagaagaaatgatcttcatttttcattattatctacttacttatctcttcctttcaatgtttatgtgtatttgctcaaatttgtttagaaatgaagatgtttgtgttgggattcttgagtaagtttttaaaggaacccattaattgtttttgatgctctgacaaaaatttctttagtgctttgattgaacaagaacttgggcacaaagtgcctcatcggtgtgattctattgttatgtttccttattgaaccaaaccaatccaaatcggacaaaaatcatggtagataaactttttaaaacaattttttaatctattcttcttttttttaattacaaattttcttattttcttatatctaaaaaatcgtaacagtaagatattaatatctgtattcttaatttggtagataactttttaaaaaacgaaaatttcctataagaataataatagtcggaaataaaacaaaaaacaatatcatggtgattattcttatttgcttatatcttcttctttttcacaatttttttttaaaaaaaatatttacaaaattttcttatttgcttatatatataaaaaatcagtaagatattaatatcgattttttaatttggtagataacttttttcaaacgataaatttcctaaaaacaataaaatattcggaaataaacaaaaaccctgattgaagaaaagtctttttgtttatcagttcaccggaggcaaaaatcgtctctcgcttgagctgcgaag

SEQ ID NO: 8237 - DNA, 3000 bp, Unknown
  misc_feature (1)..( 3000): cDNA_ID_1807609_gDNA_ID_1621201_Annot_ID_57675 3000 nt of promoter + ATG
agtctcctctttcaagcaaagcacctaacttctaccatcctctcctctctcacactaccaattcattgattctccaatataccaaattaaaccaaacataaccgaccggtcggaagatttgggttagtgattgaactaaaaaggtaaaactcaggtaacacgacccgtacctttcattatgattatatggagagcttcaatgtccatcggttgccaacggtgaatacttaaattaaatgacactctctcatttctctaaattattggtggccatacatctgtgtgtataataatgtacaagtatattaaagcatgtgtctacttcactttgatggttatggaaaatttaagtcttgtggcttcctctttggtacaccaaaaatcattatatcaatcggttggctaacgtaagagacatgaaaattgcatcttcttctttttaaaaaacaaaattgactccattttttttttctttttgcaaaaaaatgaaaactatctttaaaaaaaaattgctaaaattactgccatataatttgttacacattgatctaccacctattaaaaaattatagcttttttaggcattgcttttgagaggaaataatgtgcaagtgcaacatatctataacataaaaatctgaaatatatgtgtgtatatatagacaaacatgtttgaaataaaccatgtggtttgattaacagctaataatgacacaccatacacgttatacttgaccatcacccccattctcaatttataagaccataaaatagttttccgtatgcaatgaataaaaaaaaatcaatgatagatctgaagcttattaacataaaatagaagtggataacattgatccaatcaattcattgcagtctctctgtttgttattcaaaacagcaccgaccttttgattgctcacatgccatgagcacagccatcgatggaatattacgtgaaggaaacaaaaacttgaatatatatttttcctcacgattgagttcagaaacctggttgagaaaaagaattagagtccacctaaacatatacaaaattcagtattatatagtatatttaataaaaatagatatgtgcgtttcagttacaacatatatatgtgttccctaggagtgaaaagatgtcttttgaattgattttcataataattctacgacatagggaattgaaaatttgtagtggcatcaaccgataaactgacttttatataatctaacgtaaattggttaaacacagagagcatctttacactttttttttttttttaaaccaaataaattaacaatgaccagtattgtcggaaaaaataaaactatccattaaaattaagatgcagaaacccccaaaactaaacctagggacagaacatattatatatatgtcaaagggggattattaaaactcaagaacaaatcgatggccaaagtcatgcatgtggcatcattatggacagaagttacacaaaactctcaaacatacatcaatggattgtaaaacgttaatgatgacacgtggaagaagctcgtgaggtgagacccactatagtcattatattttgggatactgattttgcagtgagccttgtgatgcaaaacagaaagcatcacatgatcgttagtatgtacagtcgcagaatgtctaatgaattaaaatgcatttatttattttttaagtgatcatttgaaatttaaacgtgtttgacgtaaaacatcctagttgtgactaaagacaaaaacacaaaacaaaaataaagtgatagttttgcataaataatcgatttcttttgttggaataacacgatagacatacaaaagtggagtcaatgggtcgaaaaatggacgtgaagccataaacgatggccatcaaaacataaaatagttgcgttaaactaaatctaaacgaatgtgatgaagcattattgatgggttacactatacatgaaagatcataaaactaacggtgttggttcgtaaagtgcacgtgaaaatgaatgtatacccttatttatatttcaacgattgaattttcaattactatttaccaaccaatttaactcaccacctattatgaccatgtggcgaggaccagctctataagctaaaagtcagagtcaaccaattaaagtgcctctaatttcaatatctcaaaatccctacgcatagcaatagacataccgtatgtgacatacctattaacgtatatatatatatagctaggctatttacatatcacaagctggaagataaattaatttcatctgatatgttgttttatatcaacaagttttatctaatctattatagagacctagatttttttttttttttaatctattatagagaccaaaaaccgtgatgccatgcttcattttgtttgtaatggtgatatagtaagtaaaaaaaaactccaaatataaagcgaattttgttttgtttttagtgacataatgcgttttgtttttatcatagttatgtttaatttactagcattattaatcggtaacggtcacaaataaagagatggtggtaactaggtaaattatatttggtgaaatactatatgacaaaaaaaaaaggttaatacatagtagtatttgataagagggacattttggtaaatatctcaaaatattggtcagtttattaaataggaactagagagacggttaagaagtcgttctgatttcgtctttcttctctgtaaagtcgtttctctctccaatttttttgttttcctgcgaaaatcaaagagactaacacagagagcttattcaattttctttcgatctgtgaaatctcagattttgatttggaaagttgtggagatttcagctgttcttctttgttgttgggtctatttctgggtttcttcgagctgatttatagagtttggttctccgatgatagagctaatctgcttgagatagctactgtattgagagttcttctgaggatctttatttttctttacatcttgtgaggaaa

SEQ ID NO: 8238 - DNA, 3000 bp, Unknown; identical to SEQ ID NO: 8223
  misc_feature (1)..( 3000): cDNA_ID_1810839_gDNA_ID_1621201_Annot_ID_57676 3000 nt of promoter + ATG

SEQ ID NO: 8239 - DNA, 3000 bp, Unknown; identical to SEQ ID NO: 8222
  misc_feature (1)..( 3000): cDNA_ID_1810825_gDNA_ID_1621201_Annot_ID_57680 3000 nt of promoter + ATG

SEQ ID NO: 8240 - DNA, 3000 bp, Unknown
  misc_feature (1)..( 3000): cDNA_ID_1811021_gDNA_ID_1621202_Annot_ID_57683 3000 nt of promoter + ATG
tccttacccacaaacgattcatagtaacgtcaggctcattatccacagaataatcacaccaatgtcatcactatctaaattagaaaatgtaatatcaaacaaaattggggaatcgaaattggttaaattaacagaatttgcactggtctgattatttatactctgattattaatataacacagaaaagcattactctttttcttacacgcgtttatgttttcaaaaagaaatatttatccgattacaacaattatatggagtcataacactgtaaacaatttgtacaccacatttttagaaaataaaaatttaacttgattacaacgtggaaaagtcaacactttccgagctttccttttataaaaggaggacggaagactcgccgtctcaaatgcttccacaaaacaaaacaaaacaaacaagaaatcccaacaaacaaacaaacaaaaaaagagagaaaaagaaaaaagagaggtgaaaactcgtgcaacatggcagaaccaactcagccgcttctgaccgattccaactcgtcatcaccgagatctctcgacgacacaatcgagagttacattggaagctttgggtgggctcagtttcttcaagcggctttagtctcattctccggtgttttcgacgctcaacaaactttcatctctgtgtttacagactccgaacccacgtggcactgcaccgactcgaactcgatctgccatgaatccatctccaacatctgtatcctccccaaaaccgcatggtcttgggattactctcctcacgtctctgttatatccgaatggggtctccaatgcgccggctctttcgtcaagggcttaccggagagttctttcttcgtcggatgtttaatcggaggtttggttctctcaacacttgctgattcttccttgggtcgtaaaaacatgttgtttctgtcctgtctcgttatggcgatatcaacgatgctaacggttttctcaccaaacatttgggtttacgctgttcttcgattcgttaatggatttggtcgagcgacgatagggacatgtgcgctcgttctttcgacggaattagttgggaagaaatggcgaggacgagtagggataatgagtttcttcggattcatgcttggctttttgtctcttcctttgatggcttacatgaacagaggaagttcttggaggattctctacgcatggacttcgattccaacgataatatactgcgttcttgttcggtttttcgtttgtgagtctccaaggtggcttttcgttagaggccgtagagaagaagctatttcgattctcaaaagggttgcttcgattccgtctactgatgtaagcagtggtggtgcaatatctatgagtttttcgagcttaccttttgaagaagatgaagagaagcctagtactaatgttaacatcttcacgaccatgaaggtgttggtagagaaaagatgggcgcttaagagattatccgcggtaatggccattgcgttcgggattggtttggtctattacgggatgcctttagcgttatcgaatcttgatttcaacatctatttaagtgcagcgtttaatgcgttgatggatttaccagcgaacctcatcacgcttttcctagtcgataaactcagtaggagaaacgcgcttatcggatttacggctttaggtggagtctctagcgttctcatatttgcgttacataatatgagaattggaaaccacggggcgttacagttggcgttagagctaatctcttactttagcgcgtgttcggcttttaacatggagatgatatacacgatcgagctgtttccgacatgtgtgagaaactcggctatcgcaatggctagacaggctttggtgcttggtggagttttcagccctattatggtagcagctggtcggaaaaacgcgttctggtcgttcggattgtttggtcttgctataggtttgttgggattgtttgcagttggattgccagagactagagggagtgatctatgtgacactatggacgaggaagagtgcaaagaccggcggagtaaagtcgccgttaataatgtcattgcatgaaatggtgaagaatttgaaaacacatgtgaaattaatgtagatttaatttagtatttatcacttgattacattaagacttaccacatatctttttttttggttagttgaaaagtgtttctaagaatgagccatcaaagcaccactctgatgaaacaatctcattttacagtttacacctataacacatggatttcttgaataacaaaataattcaaatttgtctcgtttggatattgatgccgatggttaaacgtttggctgtttgatttttgttagagataattgtgtttctgttctaattttcacacgttgtgtgaaaatgaatcgttccaatcccaagaaagtatattcattggggttgttggtagttggctgtttggtaattgaatgggaagaacaaaccagacagaaatttgtacacttcttggtagatatgtttaaaaggtttaatttacaaataggcccatctatcagcccttttgtaacccttttaggcccaactaagtggtctcaaagttcacaaacccaaaacttatgtggatttattattttaagcccacacaaactaacgaacggtgagctggcaagtcacgtgatgacacgtgatccatcaacccatcacttaccattaccccaaccggtacggaagtggttttgtatcttcctacttcgactcctcttgggtaattataattagttttagatgaaccaaacaatcccaaaataatattagaaaaagggaagaaaatctgaaaccaaaaaaaacgagaagggagtcgaagaagaacctttcgcgctctgacgaaattcattacttacactggatttatactttttttgtcttcctctctcaattatctccttcaacgccacaagatcctaaggcctctcacggatctctcttaagatcaatcgccgcggctc

SEQ ID NO: 8241 - DNA, 3000 bp, Unknown
  misc_feature (1)..( 3000): cDNA_ID_1841710_gDNA_ID_1621202_Annot_ID_57684 3000 nt of promoter + ATG
ggtctatgcaggcgcgagcaatggttctcttgcggataacggtattttgattagtggttgccaaacagatcaaacttctgcagacgcgagtcctcaaggtcatcctgaaatggcttatggagcattcaccaatgctgtgcagatcatacttgaggagacaaagggtatgattacatacaaagaacttgttttgaaggcaaggaagcttcttaagaaacaaggcttttctcaacgaccaggactatattgcagtgatagttttgtgaatgctccgtttatttgttaaggattgtattttggttcaaaagctttcttgttgaataagttatgtgacttgttgtttgatgtttttttttttttttttcggtttagttacaactgtgtttaaaatttcacatttgaactacagtaaaacctctataaattaataatgttgggaccgagaaaatttattaatttagagaagtattaatttatcgataaattaataattattaatttattaatttatagaaagattaataattattaatttatagaaagattttacaaattttgtaatttttagaaaaattcgatataaaagtagttttttctttataatcaataattttttctaaaactaattagaagcaaaaaacaattattaagtttaaaaaataataaaaagttttttcgatgtaataaaaattttagaattaaactctaaaaataattaactgaaatgaaagaaaaaataatactagagtcatattttaataaatcttttacatataatattgatatatatatatatatatatgtatatattggtaaatttacataattattaatttataatattgatgggactatatatttatataggattttcaaaaaagttattatcttattaatttattgatttgtatcaatttttacattggtccgaactcgggaccggaataatttattaatttatagaggttattaatttatcgagtattaatttatggaggttttactgtagtttgaaaaagaaaaaaaatatatatattcacaacatttagtgtgaaatttacatggatttagttaaaaataattaattctttccttaagtttaagttttaaagtgaaaatcattattattttttaaaaatgagttgaagtttcaaatccatattacgtgaaaatatctccgaacttcgaacacctcaaagcttacagaccaacttagtacgggatgcgtaggcgtggttagttttcgacgtttttaaaatataacacttagactaatttttaaaaattaataatgaaattaacatggttttagtttaaaattataaattatttccttaaagtttaaattttaaattggttttaatttctaagtgaaaatcattattattattttaaaatgagttgaagtgtcaaatctatattacgtgaaaacatccccgaacttcgaacaccacaaagcttacgaaccaattaatgacgggatgcataggcgcggttagtttcgacgatttcaaaatttaacacttcaactaatttttaaaaataataatgaaattaatattattttcttaaactttaaaatgtaatttagtgataatcactattatttctaaaactaaattgatagttgaactaatttttaacaaataaaaaggaagaaaataaaaataagaaatgaaaaaaggaataccttgttggtagcaaagaaggcccatacagccaaccccattccaaagtcaaacgtgagcccaccgttcttctgtacctccaccacttgcacgagatccaatttgacgaagaagattcattctttgtgacatcgacgaaacatgactctgatttttttgtttgtgtgatcttgttcatcctctctccctcgatctgatcggacagatttttgattgcaatgcgaagaagcaaacatgggcttcctctgttacttagggtttcataggagtattggcgttttgtttcgtcagggatcgatagattgattttcatcttaagagattctaaaatcaatttagtgtgagaccccttctcgattggaaacgatgatgaaggagacgtcattcattcaaccacgatgatgaactcgaactcaggggctttgcttcaatgttgattctgtataatcatcggcgatcatgcattataaatagaaatagatgataaattgtgtatcatcgacgaagaagaagaagaagaaggtgaacagagaattttgatttctcaagaatgaagaagaagaagagaatgcgtgagggttattttgatttctcaagaatgaagaagaagaggaagcgaatgtgtgagagtgtatttataagcaaacaaggttcttggtttattcccattttctcttaagcgtgtctttgcgatttgatatactttttattaatataaccgttggggatcatatttattaatctaaccgttgggattatagaggaaatttaaatttagatccggtttccatttttttgatgactttggtttgttttcctattactaattttgatttggttagctgagagcctgagactgagaggctttgttgatgacccttttgtcttggagatgacaatgagcatcaaacccaggcgtgttaattaaacggctccgtttacaagttgggccgaaattaggcctcttgttgggcttaaacctgattagtttttcttataaataacgtttttttttgttttggtaagaataataatgctcatttgtgagtcagtgactagtcgtcgtgcaataacgtgacaataaacaaaaaatcaaacaaatccaatgccacgtcagacaatacattccaattcgtggaaacgcgcatatcaatcaatgaaatgaatgaataaagaaataatcttagccaaaagtaaatataatatataagatcgatctcacttttggtcggaataagaagctattggatcgctgacagataatccgatcagattcagagagttttatcgatcagatcattttttctcaatg

SEQ ID NO: 8242 - DNA, 3000 bp, Unknown
  misc_feature (1)..( 3000): cDNA_ID_1810996_gDNA_ID_1621202_Annot_ID_57691 3000 nt of promoter + ATG
gtaaagaggtttgcaggctgttacatgctttgctcataaaattgaatcatagtctcagtggcactctagcttttcgaatgggtgacagagatgtattcttgtagctgtagtgccaggaaggaagaacttcttacatctgcttgaggattcagaggtatgacagattgctaaatcattctattctcttctttgttgtccacttttctagggtatcaaatttgttgtttggaactcaccttattggctgaattgcttgttccaggaagctactaaaagagcccaagaaaaagcttttgaacgcatccggattctcgaagaagattttgcgaaggctaggtatatttatcatcctcttgtcttttgtctttcatttcttactgggcaagtgattatttttgtgcaaaaagttttgtttgataaactagggtacctctgggtatgtaacacattttctagttggatagtcaagttgagagctaggacccagactatactagcgaaggaaataaagtgtggaaagcgtagtatctagtgtgaaacgtgtttgcagatgcaggtggattgctgaaaatactaatctgagcttatgtgtttgcaatcccagtgtcgatgtcctatagaagttataatcgtacgtcttgatacatagagaaacaacatgaaaaactggattgtatcttatgcagcatatccatgaaacgtaaactgtagttattgatttttgtcattgtttcctgtaaatttattttactgaacattataaactgcgttgttttcatctttcccctttggatttttaggagtgaagtaattgcaataaggtctgaacgggataagttggcgatggaggcaaattttgctagggaaaaattagagggcatcatgaaagaatctgaacgcaaggtgatttttatcacaaattcatatcatcagaagcttgtggtttcttcaaaattttcaccttatctctgtttatcttagagagaagaaatgaatagcgttttggcaagaaacatagagttctcacagctaatcattgaccaccagaggaaattgcgcgagagctccgagtctctgcacgcagcggaagagatctccagaaaattatctatggaggtagtataccatcacccgttaagtttatgattttttttgctttaatactaacagtcatctataggtctcagttctaaaacaagaaaaagagctgttatcaaatgctgaaaaaagagcgtctgatgaagtctctgctctatctcaaagagtttaccgtcttcaggttggaaacatgagaggagtgcaatttgatcttaagctgtgcgtactctttttttttttgctgacctgttgttctgcaggctaccttggatactgtacaaagtacagaggaagttcgtgaggtaagaaaacgacctttgatattagtttactaattctattctgcaataccgattaaaaatgttataactttatcaaaatactcaggaaacaagagctgccgagagaaggaaacaagaggagcatattaagcaacttcaggtctatataatatttgataagtctttcaaaattattatgtaagaagagtagaagttaaccgatgtgttggatgggttgtcacagagagaatgggctgaagccaaaaaagaattgcaagaagaaaggagcaatgcacgggattttacttcggaccggaatcaaactttgaacaatgctgtaatgcaggtagaagaaatgggaaaagaattggctaatgccttgaaggctgtctcagtggcagagtccagggcttctgtcgctgaggtactgtttcaagtctattttacctttcttaataacttagaccatgaatacatgaaccaattccatactgcatcgaggtggtgcgcatcaccagcatctttcagtgtttactctgtccgtctcctaggttgcataccctaattgctttcccaggtcgacattaaattcccattttctggtgctacttttgcgaagtgagtctttgcatgtggtttggcaattggttttacgacttgtgaataggcccaaaccaatttctggaaaatcactacatcgtcaatccactagatttttcagctgtttgccgtccattcacatattggcatatgatcatttttgcctgtttactattattgactattactttacatgtgtaaaattaggctagactttctgatttggagaagaagatacgatcttcagatcctaaggtaaatgttttgatttttctaatcattgaattgtggtgtttacttctaacagcaaagtcctggatggaatttgctattgcgagtttgtaacgattttcattttttcacttttagactcttgatatggatagtggtggaattgtctctctttcggataaggaggtcagtgaagtccttcatttttttttcccgcaattttaaattctgacatggggatttaagttccgtaattatggtattgtttgaaatttcctggttgcaatctatctgtaaaaggctgctcttgttattattctggatgttgtacataagattcaggcaggatttaggataggatctgcagtacgtattactgagttagttgaatttgatcatgtagagttaaggctttcgcataagctattgtttgagttaccttttacttgttgctatatggcaatccaatatttggttgtgtaaggtagtctgttaatctttttttttgctgtggtgattatttactctagatgtccatcgaactgcgtaccgcaaaggaagaaattgaaaaattgaggggagaagtagaatctagtaaaagccacatgctccaggtacttcctgaattggctaagttagtttcgatttcaacatgactattaattgaccttgtgaaccatcatgcagtacaagagtatagctcaggtgaatgaaactgcattaaagcagatggagtctgctcatgagaacttcagacttgaggtatttgtgattatgtttggatgaaaca

SEQ ID NO: 8243 - DNA, 3000 bp, Unknown
  misc_feature (1)..( 3000): cDNA_ID_1810992_gDNA_ID_1621202_Annot_ID_57692 3000 nt of promoter + ATG
aggtcccaaattgaagcaatgaatatccaaatgtccactttgaagaatgacctggagactgaacatgagaaatggcgtgttgctcagagaaattatgaaagacaggttggttaaagctctctatttcaagaaacattttgaccatcatgcatattcacgttgacgttggtttttattatatgatgctagaaactgactagattttattacccatcctgttgatccatttcatgaaactgttgttttctgaatactctattttactgcacctttgtcatatatccgaggatatcttcaaatattttctgaattgtgttttacattacattaaatcattgttaggtttttcataacttaaggtcttactgccatcagctaattctgttcttctctctttccatagatattacaactatcactctttttgtttcctacttctttttggagtgcaggttattctgctgtctgaaactattcaggagcttacgaaaacatcacaagccttagcagcccttcaagaggaggcatctgaactacgtaaattggctgatgcacggggaattgaaaatgtaacttctacttgtacacaactttttgtgattcaattcttcctacaattatagttgattcgtgaaacatcaatttctattttcttggtgtttatcagtctgagcttaatgccaagtggagtgaagagaaattgatgctagagcagcaaaagaatctggctgagaaaaagtatcatgaacttaatgaacaggtggccactgctctctgatctcttacgttgtagcttttatttgagcagccttattatttagtgtgttcaggatagtctttgacgatagtctttttccaattctttatgggtcaataatgcttaatcctccatgtgaatttgtgtagactttaattcatggtcatgttacaagtactcacgtatcttaattgatctctacatcagaacaaattactccatagcagacttgaagctaagcatcttaactcggctgagaagaacagccgttctggcacaatatcatctggaagcactgactcggatcaccttgaagattcgggtttgcaaagagtagttcattatctacgcagaaccaaggaaatagtaagagaacttcctttgcaggattgcttttcctttctttatgccccttctttgtactgtggggttatctaagtcatgtgcatcctttttgacaggctgaaacagagatctcactaatgagacaggagaaacttcggttgcagtcgcaagtgagttgttgtctcctctcttatgcctaatttgctacgacatcccttttaagcgacaacctttctcaatacacacatgcaaagcgaaaacctcctctattattcagagttgtggctgcggtatgatttttttttttgcaatttgtttgtctagcttgagagtgcattgaagatggcagaatctgcccggggttcacttactgctgagcgcgccagtacgagagcctcattattgaccgacgatggaatcaaatctcttcagcttcaggtaaagttgggtgattcgatatctgataacatatgaactaatgatctaattagtctttgtattggttgggttgaaacaattttcatttgctgactttaaattctccttgcaggttagtgagatgaacttgctccgtgaaagcaacatgcaactcagggaggaaaacaaacacaattttgagaagtgtcaggtttgtatggaacctttctttatgtctctcaaatgaccaaaccacattacaccacctgattttgttagctgtcttagagaaagctgataaaaaatttaaaacatcaggaaatgcgtgaggtagctcaaaaggctaggatggaatctgaaaatttcgaaaatctattaaagacaaagcaaacagagttggacttgtgtatgaaagagatggaaaagctaaggatggagacagatcttcacaaaaagagggttgatgaggtacgtcatatatgtatgggctcatacttacaattactttttgttactggttcatacttacaattacttgatgctttgtgaagttgcgggagacatacagaaacattgatattgctgactacaaccgcctcaaagatgaagtgcggcaattagaggtatgcttataaagataatatgacgttgtctaaatttctgcaatagtgggtgttttccaagggtgtgcatggatatgatatccctaccctttcactatatttgttgtcgtgaaattagttacaatgttaatggagatgataccatgtctgctgaaggtggttagttcttgctccttgatccctactggttaaagaacataaggtgctttatctatttgatattgggatggtcaatgaaccatgtgtgggatgccctttgagagagcctctttgtctcctagtttgggactactccctatcttgtaacctactctttaaatttcctccatctcgctggaacaccccaactatatgttgatttccacagttgcattattgatcattaatcgcatatagaattctagtgtacggtaattctcaattttgctgatgagaatttttggtgaagtcttagtgatatttgttaatattgtgtcattttggtttcgataatttgttgaatttgaattctgggcgtcccactggtctttagccctgcttttcctctaagttcttatatcaattgtgacgccatgatatggtttttaggagaaactgaaagcaaaagatgctcatgctgaagattgtaagaaagttctgttagagaagcagaataagatatctcttttggagaaggagctaactaactgcaaaaaagatctgagtgagagggagaagaggctagatgatgctcagcaagcacaggtagaatgagaattgagaactatctcgctgagttcattttagcttttacatgttgaagaagtactatcctatgtagatatattcatctgtctctgttacttattgtaggctact

SEQ ID NO: 8244 - DNA, 3000 bp, Unknown
  misc_feature (1)..( 3000): cDNA_ID_2992432_gDNA_ID_1621202_Annot_ID_57693 3000 nt of promoter + ATG
caagaccagatggttctattgaagtcgtcattgctcagagcacaggtctcgtcgaagtccaggttaacataatccaaatttccattagatccgtgtttaccataagcttccaaaatcattacttatgttttgctgaatctctgatcacagaaaggaacatacaatgtagatgaacaatcaatcaaactcaaaagtgatcttgtgggaaacgcttcaaaggtttcagattaattctctttgttattatttattcaatgtctctgtctctacacacaacatttttgtgtttctaattggtgatttatggggttttttttctccaacaggtgaaggagataagtagagaatttgaattggttgatggaaaactatcgtatgtggttcgtatgagtacaaccactaaccctcttcaaccacatctcaaagcaatactcgataagctttgaatccaagttcctgtgaaatcgaaacctgacacgaccgatgtgatattgagatgctttgattttgatatgtagaatcactctgtttagtaacaacatttgatactctttgtaagattttggttaccaaagtgttttgttatgttttgttcttgtaagcacaagtaagaagaagatgacaatttgagagttaaatgggcttttattaaaagaggtaaataggcccattggcgcctatatacgttcaattttagcatctgacgcctcaatattaatgatattctaattgactacaatagctttcaataattacaagattgtccccatatttattttctttttatactattgcatacacattttagaaattatgagatgagcaccgaagttattatcgaagcaaagtcaacaaattgaagtaagattaattctctacaattatataagatttggtttaataattgtaagatgcaatcttataaacttaattagacatacgtaatcacatataacaacagaaattttaatacaaaaaaaaaaataaaagacggaaaagaaaacaaaagaaagaaaatcatatagatgtgaagcagacacgtttaggccacggcaatgacaaaacgtggcaccttgtaattctcttaagctccataattttggcttattgtattaaatagttccatatggtgtttcttatttttttttggcctatttggctttttatgtggtgttgacaattataacttgatccctaagcaatatctactttggatataatacaaatggagcaaaaacacaacactttcatttttgaagaaaattatgtaaggtgattgtgtgtttattagtagtcccaatctaatagagagaaattaaattctaggagtgatcattttctaggatagttaaaacttatggatgactttcatatgagtttagatctggattttggtggggggacataagaaatatagatgcatatgtaagtgtacacaaatgaatgggccacttgacacctaatgatacaaattttcaaagaaaactcagattgcaataatggaagcatatcaatagtagtatgagatctcaatctacaatcttcaataacatttaaaaaataaaatccaacaacaactgtagcgtataggaattgttcatctcttttcatcaaagaatatttaaaattttgttagacaagaattaattaatgatttatatggttgagaaaactttttaaaaagttgtaaaactcatcgaataataaatcatttttaatggaaaatatagtttttatttttattgtgtggtattgctcggactcaaggatacatggagagagaggcagagtcaaatccaatttttcaactatcttatatgatattcttctgtgctttttatagtttgcccgaccataagaactggtcctaactttcattttttttgtttccatagaatatgtattcctatgatttttttttatagaattaattgtgttagttaatgccaaattaagattctcttttttaaaatcactttttgaagaagcacttacaagagagttgtgttaagaatagattccagatggaaaagttggcaagaaaagatgttttaagtttttgccttgtcgtctaatccaacggtcgatcttcgttcatatcaagaatccttatgacgtggaccattctcttccctccatctgtacctcttcccaacctctattttttaatttacatcgaaaataaataagaaggattgcaaaagaaaaaatagaaaaaaaactctctgttcttctttcttcttcttcttcgtcgtaagccattaccatttcttctccctctctctgtttttctttgttgcgtatctgtacttagttttcaaacataaaaataaaacatatctttagctgatgttgtcttcttcttgataaacagattttctacagctttttttctttctaatttaataattcttgagactttttaaaaccctctgcgaaacagatgattcgagttttggtttcttcatctgtgttttgattttttcgtcttttattcttagtcaaacacataaatttcttttactactcttcgtagatgacttctcatgttccaaaacatcctcgtaaatgtactctttctctctttctttcctacacacacgtgtttaatctgtgttgttcttacacgtctttttaacttttgcgtttgaccttttatctgaatcctgtgtttgtgtgtctgtaaatatatatatgtgtgtctatgtgtatagtgctctgtttcttgtgattagactcatatgtcttattttcaatattaactataaatatataagtcacgcctagttattagtttttatcggtacgactaaatattcagacatcagttcacgtttcaaacctgtctcttcacatagttaagaaaataaaggcatcaaaaagattactagtaatgtttgtgtctactttatacatacatatgtcttgtttctttgtgtttttcagaatctgatctcttcgggaacgtttgtttaatttgtttcagcctttgaagatatg

SEQ ID NO: 8245 - DNA, 3000 bp, Unknown
  misc_feature (1)..( 3000): cDNA_ID_1810985_gDNA_ID_1621202_Annot_ID_57695 3000 nt of promoter + ATG
ttttattttttaaatgttattgaagattgtagattgagatctcatactactattgatatgcttccattattgcaatctgagttttctttgaaaatttgtatcattaggtgtcaagtggcccattcatttgtgtacacttacatatgcatctatatttcttatgtccccccaccaaaatccagatctaaactcatatgaaagtcatccataagttttaactatcctagaaaatgatcactcctagaatttaatttctctctattagattgggactactaataaacacacaatcaccttacataattttcttcaaaaatgaaagtgttgtgtttttgctccatttgtattatatccaaagtagatattgcttagggatcaagttataattgtcaacaccacataaaaagccaaataggccaaaaaaaaataagaaacaccatatggaactatttaatacaataagccaaaattatggagcttaagagaattacaaggtgccacgttttgtcattgccgtggcctaaacgtgtctgcttcacatctatatgattttctttcttttgttttcttttccgtcttttatttttttttttgtattaaaatttctgttgttatatgtgattacgtatgtctaattaagtttataagattgcatcttacaattattaaaccaaatcttatataattgtagagaattaatcttacttcaatttgttgactttgcttcgataataacttcggtgctcatctcataatttctaaaatgtgtatgcaatagtataaaaagaaaataaatatggggacaatcttgtaattattgaaagctattgtagtcaattagaatatcattaatattgaggcgtcagatgctaaaattgaacgtatataggcgccaatgggcctatttacctcttttaataaaagcccatttaactctcaaattgtcatcttcttcttacttgtgcttacaagaacaaaacataacaaaacactttggtaaccaaaatcttacaaagagtatcaaatgttgttactaaacagagtgattctacatatcaaaatcaaagcatctcaatatcacatcggtcgtgtcaggtttcgatttcacaggaacttggattcaaagcttatcgagtattgctttgagatgtggttgaagagggttagtggttgtactcatacgaaccacatacgatagttttccatcaaccaattcaaattctctacttatctccttcacctgttggagaaaaaaaaccccataaatcaccaattagaaacacaaaaatgttgtgtgtagagacagagacattgaataaataataacaaagagaattaatctgaaacctttgaagcgtttcccacaagatcacttttgagtttgattgattgttcatctacattgtatgttcctttctgtgatcagagattcagcaaaacataagtaatgattttggaagcttatggtaaacacggatctaatggaaatttggattatgttaacctggacttcgacgagacctgtgctctgagcaatgacgacttcaatagaaccatctggtcttggacgaaagtaaccactctcggcgtgcatcggagctcctgattccaatttccatgtcttttgcgtatacgctatcaccggctacacaaagtgacagagtaagcgtatcgcgattttggtatgcagattggattaaggttaaaaatgaatcggagatctgatatggttaccttgccggaatgtgagaaacggatctcttcgccgtagcggaaagacggtatagtaggatattcaccttctccttgtcctctccatgttcctaatagatacgacaacggcgctacaaaagggtgcaccggcggcgattcccctgggttttggagttgctgcagctgattcatcgccggtattagcaattttctctggacagatgatacatacatacatacacgtgataattggtaaatatgctaaagcaggctacaggcccaataatagtaggctatgttctgggccattgggcctacattatattataaaaaaaaaacataaatcgatgtatgttcaattaatggtcgatctctaacaaatttaaaagttgaacttaacataaagtggattcgttgaaaaacagtaaatatattgtggactcaaaataaaaacagatagaggttttctaagattagtattttatgggtaattatgtttatgttctactatctaaacgatactgtattatgttgtgaaaatatatatttttattcaaggtttctatttatgaaagcattgatattataccaattgatatagtttttggaagatgtattgatagtcaattatttttgtcgggtgaagaaaaatatacatagaaagaaaagagataattaaggggacatcacaattttctttgtcttgaatgaaattcagaccatttcctccctccacttctccactttctttggaactcataagatactttttctccatccatttcttttcctctcttttcttaattaatcactgtccttttgtctctattttccacctgctttcttcatttcaagacaaactcctatgttcaccaaaaaaacaaaatattgaacaaaaaaaagaaacacacacattaatataaaaaaaactaatcaataagctatagaagattgttttctcttcttgctcaaaatcctttatggcatccgaaaacttcagacgtggaaggtaaaaatgctgcaatcttttgctccatatcttttaatttttctctgccaaaaaacagtaaatatacatgcgtacgtacctcgacgtgcagaccaatccttttgctagattctattcacaagacatgaggaagggctttaacattcgtgacaccaagtaatgtcctcatatggatgataaatgaactcaacccatattgacccttttttcacataaaaataaagctttaatctttctacattgaaacaggtttctctgatttgggagactcgctggcg

SEQ ID NO: 8246 - DNA, 3000 bp, Unknown
  misc_feature (1)..( 3000): cDNA_ID_1810979_gDNA_ID_1621202_Annot_ID_57699 3000 nt of promoter + ATG
aatcatatacagagaggcgaaactgagcaattcacataaaacttcactacctaatttatgattacaaaactcataagtccaatttcaaactttgataagaaaagcatcgattgacatagacctcatcaacaattaagcaattctctatagtctattcaacatttcaaaagctcgaaaacccagtagaaccactgtcaaatcatagaaacaatccaaacgctcgaaatcaatccagacactctcaaacccagaagctaacgagtggtcaaacgaatggctaattgagaacagatcgcgaatcagatatcgacttacactgagaaaggtggctggattaaagatcttttgcggaagagaaggagtaatcagtcggtgactagcagccaagaaagttctggagaaaagggtcgaggccatatccacctcaaatattctctcgataaaatgcaacagagatgatgggttgagttagaaagacgccaaaactatttgctgtcagattgattctcttcaagtactaaacccaaaaaggttgcaactttgcaaacgtttttatcaataaagaggattttgtcactgccgccacgaacgggtctggaagagagacacgtctagggcgtctttggcgtttcgtttcaccaaacgtgcttcttcgcgttttgtgttttgatatttttctattccggtttaactaatctgatctaaaccaaaacatgaaccgattcaaaagtatccattgataaagctggaaaattctacacaatgttacatctttaatgaacatatccaaagaaacaaaagatgaaaaagagattcaaaaggggaatcctttacggatgtatttcttggatttctcagctaaacgtttcatgtttttggatttctcgtaaaactccatcagctcggttgcaatatcttgtggatgacacattacataaaccttcaagaaccgtttctcgctcatccttaccgctctgaaaatgctcacttcttttatcaatggctttagacgcatttccaagactctcttaacgagatccgcacgaggttttagacgagactcgaggttgaggagaagcaaacaagggtgcttaaccacggaatgagctggaagtttcatcgaggctatgacgaaagtcatgtttctctgaactttctcaacagagagagagagaaggattgggcattttccatacaggtgccaaatctcttcttccgagaacccaaacttttccaagtttctaactttctcttcgattgtctccatcctcgagaccccgatgatgactgcaacatatttaaacatcttggattctctggtgactccagttttctcaatgtattcaaacttctcattgttaaagtttgttcttggaatcaacgtgggtcgcgatatcaacattgcgacaagatcctgttggctaaagcccaaccctttgtagtattctatcgcgggtttgatcttgtcatcgaggtcatacaacatgagtgacggattccggataatgactctgcgcaacacctcttttgaccccaaaatctccatgaagtagttgatcctttcatcaaggacaagacggcaactaaagaacctaggacgacagttaagaatcttcacaaggtctgaagacgtgattcccagtggcttaagaaggcttaacttaaactctaactgagcaacattggctctctgcaaagcaggcctacgagtaaaaagcttggatatttcatcatcatcacaaccccatcttcgtaaaacttgtaaaggactactagtaatatctctcactttctctttttcaccaacttctccaacataatcaaatttttttctcctagacgatagatcagaatcctcaatgcattcttcagattcattcaggcataacgtcgaacacctggtggtaaaggtagcagaaatgagatttctacaaccagcctttctgaccaagctcgaactagtaaacaataatctgataacagctaagaaatttctcttcccggtcgaatgcatttcaagggcgtaatcgagagtttaacaaactggagaaataaaggagcaaattttctctaagaatcaacaatggctctgcctcaacgacacaatcagcgacatttacacgcgtatttcagatgcttcttccatccaattttccgaaatagctagaaaaaatggaacaattaccagtacacgaagcttgtgatgaacgagcgaagaaacaaactccgaccaacggaggagagtttgtcagagaagaaggaggcgatggagagagacacagccaattcggaccaggtttgagtccgagtcgggcgtggaagcgagagagagtaggggactaggggtagtaaataaataatgtggttcaaactgaaaagagatataaaatattggactattatgtaagatacagtaactgtgaagttgttaaaacgccgccgttttggtttttttgtttctctcgttttctggcgtcagactctcaccctttgtgcaagaaaccttgagagcttaaaaattcttcacttgggtctcttctctctctcttctcttgcgaccattccgttcgatccatatatcaaaggtatgttgctttgattgaatgggtttcttttgttgaatttaaattgataactttaaatatattgaatttggggtttaagaaaagttttcaattttcgtctctgagtttgagctaagagctgatctttgagtttgagtttgtgtttgatttgattcactcacaattcttaattagggttggtatatcttgtctttttcatcgttttccttacacattgcccatggcgatgagactcttccgggtttttaagctttgtcagatttgaacgcttcagtctacttacttgctcagacgtggtttcttttcatttaagtttgaacattgttgatgaagaacagatttagcttccacgtttctaaatttccagagatgacactatttcgcattttttgcagcttgatttagttggttttca

SEQ ID NO: 8247 - DNA, 3000 bp, Unknown
  misc_feature (1)..( 3000): cDNA_ID_2993610_gDNA_ID_1621202_Annot_ID_57700 3000 nt of promoter + ATG
tggagtgactgcgtacttagtaaaacagcattattagtgagagttcatttttctcgtgttacactgtatctacatgatgatcacgggactatctattattcaaaagttggtaattatacactgagcctgattacagaagactcgcagacaaaaactaatataatcaattcctcctatgtataccttaagctaattcttaattaacaagttgcagatttacaatcttattttagtcaaaacactacctaatattttgccactttataactatatattcttactcctccaaagtatttttattaagaaatacataaaactcttatcattaccgctgtaaattcctaagaccatttcaattaacactcgtcgacatgtagtagtttcttacattagcgaaatttatttcagacaattttataagatatgtcaaatctgataatatttttaacacgagatgctagtttccattattacttgatgtcaaaaaagaagaaaatattatttaaggattttggtttctaaaaacgaatgtgaaatattcatgcatcggtgttagaaggaaagataagttgcatgcatcataaggatgccaaatgaagtaaaaatgagaaaatggaatcataccaaataatcaaccataccacagacagacaaccttttcccactcaacaaatctgatttgacatttatcaattcctctgtttacatattcatcttttctcatgtcaagatcacacactcttacctctcatatatataaaacagaaccaaattatctttggtaaaagtgaatctcatcaggaactgagtgatataaagttatatatatagaggagagagggagtgagagggagtgagagagagagaatggggaagggaagagcaccttgttgtgacaagaccaaagtgaagagaggtccatggagcccagaagaagacattaaactcatctctttcattcaaaagtttggtcatgagaactggagatctctccccaaacaatctggtatgtcattgcttttgtcatcacaatcaaagcaaaagcctcttcaattgttttttcttttctttatgattctgaatgtatatatatgcaaaaatgaagggctattgaggtgtgggaagagttgtcgtctaaggtggattaactatcttaggccagatctgaagcgtggcaacttcacttcagaggaggaagaaacaatcattaagcttcaccacaactatgggaacaagtaaatcatcagctaggattattattgtgctcatacatatatggtggatcaaaaaagtgatttgatattgacattaagctttctgcattttgatcaggtggtcgaaaatcgcttctcaacttccaggtagaacagataacgagatcaagaatgtgtggcacactcatctaaagaaaagactggctcagagctcaggaactgcagatgaaccggcctcgccttgttcgagtgattctgtttctcgtgggaaagatgataagtcatctcacgtagaagattctttgaacagagagactaatcataggaatgagttgtctacatctatgtcttctgggggttccaaccaacaagatgatccaaagatagacgaactcaggtttgagtatatagaagaagcttatagcgagtttaacgacattattattcaagaggtagacaaacccgatctgctggagataccatttgattcagatcctgacatttggagtttcttagatacttcaaactcatttcaacaatccactgcaaatgagaacagctcaggctcaagagcaacaacagaagaagagtctgatgaggatgaggttaagaaatggttcaagcacctagaaagcgaactcgggttagaagaagacgataatcaacaacaatacaaagaagaagaatcatcatcatcatcactcttgaagaactacgagctcatgatacattgataaaagatatttattttggatatcaatatgacaatatgtatgatggaaaggtagagagatagtagagaaaatgtatttcctatagttttttaattggcattatttttagtagcctgtagataaaacagagctggtcaaaagatgcacactatactaaaagtctaaaactatatatctggaagattctttctttagtcttagagaatcttgaagaaaattattgaagaatatttggtaggattagtttagtaatctcaatcatctaacaaccatcttgaaactggaaacgacaaaacatgaagaccagttactcttgtttggagatatattaacctcaacagctattttttttgctgaagaagaagtaacaataactatgaacttatcaacgaattaaggcaagcaactgaattagaagaagctaatctcaacaatgttgcatctccgaatgttttcttgaatttcattggagatagacaaaaagttggaagcttaatatagatagatctcagttttgtcttccatggcttctgataaatcttagttttcttgaaattgaagaaatattatatgatcttgataagaatatataggtaacttgaagaagaaattaacttctactttcaacttctttatcactggttcaagtgaaggaaaattgagtcaaattgggttgggatacccattttaacactccggtttatagtttgaaagtttaaaccgattggtttaatttgattcgaaagaatctggttcttataactattaaatataatgtcggttcatttgtacgatactttacaaaatatgaggtttcgtttgcaattctatatagattatcaggtttattttgcatttattcctaaaaccctaaaggggaaatcttcccggtctttattcgagacgacgacgacctataaaggccaatagcaatggatcgggtcaattaatctcgggtcgggtcatttctttttcaatttcgcggttctatctctctctgtttgctgactcgagattttcgagtttggtgggataattgatcggattcaatg

SEQ ID NO: 8248 - DNA, 3000 bp, Unknown
  misc_feature (1)..( 3000): cDNA_ID_1810966_gDNA_ID_1621202_Annot_ID_57704 3000 nt of promoter + ATG
aaaaacgaacatttaatcgtataatatttaatactagtagtaatcaattgaattttttttaaaaaatactattatataacgtgccgcatttaattttgccccatagactttaaaacaatttctacatttcggcccttaaatattggctccgtctatataactctctctgcgtttacacatccccccattactctctctatctctcgatgattcttgatatggctgctgacgtcagctctctcgtacggttactaagcggttacaaagatgatcgagcggtggttaaagattctgccggagccaaatcctcggcggcgctgatgactcgtgaccttcttggaaacggcagaggaggaggaggcgatcggtctttagagcttgacctcgaccttcaagtccccaccggttatgaaaaacgcctcgacttgaaggttcgtgttgaattgatggatcctctttagtctttcctttagtggttttggctgattagatcgtatcattgttgttttttttaacagtcagggaaagtgtatttgcaacgatgcaattcaacgagctcgtcgtcaataacaaacgcagaccaaaccaatcaaacagtaccaacgtttcaggatttgaattttcctcctccgactttgaacaattctcctttgttgaacctcttcgacgatacaacgccggaactgaagctacttccgtcgtctcgttcttctcgtccgaacactagtaatttacagagtgtatgcacactggacaaggtgaaatcagctctagagagggcagagagagatcctgctatgttcaagaaacgtcaatcaccggatgatacggtttacgatcattataggacggaggctgtagcgtcaccggtggttgccggatgtcctggttgtttatcgtacgtgttggtgatgatgaataacccgaaatgtccgaggtgtgataccattgttcctttgcctacaaatcctatgaagaagaagcctaagattgatctcaacatatcaatctgaatgttttggagtttatattggaacatttttgtaaatgatagataacaattcagggggtttattttgtaaaacttaagaaagaagaaaaaattgatggtaaggaaggaagattagaaggatgttaatggtgttttttgtaaatgcgttagttgaacaacaacaagaattttatttagaaacatagtaattcacggaataaatgagtcaattaaatgacgacaattaatgttacaattatcttattttctacttttgaataaactcgtagtccatggttggttggaaggtagtttgaattcattgtatatgtccatctaaatgcactgtctttttatgaaaagaaaaaaactattattaatagtgttatttgtcaattttgttatatattttaaaaaactccttgataatgtttggcttgaaattgtatccaaatgcctctcttatctgagtggttatgatttcctgaaattgatgactactaattactaaatgaaatgaggaagttgtgtttgcatgcatgcatgatatcttcaacaaacatgtttctcaacccaattaaagataaattttcaatctctgtgtttggacaaaaattgattataagaaaaaggcaaaaataaatgtgacaactgtttaatttttttgaaggacattcaatgttgtaatttatgtgaggtttaactttttaaggtcattcaaagttatgctgacctaacttcaaatgcttaggtcaacagagcacacatattcacatactatacgaataactgcaagtctgcaactaacgtaataaatcgcggctattaaaatccgatatgcatgtagacatgtagtagtaaacttatcttattagtatttttttaaaatgtcaacgaggtaaggaaatgtagaaatgcaaatactcacgacgagcatatattacatggacgtaatttctccgatattatactacgaccgacgagtagatgagttagatttattacgatagaatttatactaacggtggacctgaaataataatatttcgtaggtagtatagtttttgcattaaacagttttgtatgtgtgtggcattaatacattactccggatgggatacgtatcgtatagattgtatggtttgatattcatctttatccataacaaaaaaaatctagctagtgtatatttttcgtacgttacaagtttcgaaaattaggtttacgtctataattatatgacaaacatattttaaatatctaagtctcatcttcaatggaaactagtcctaaactcctaagttgatgtacgattttttttctcgttaggtggatttcagattataggaaaatgatatagaaaaagaaataagaaaaaaagaagagaaatggagaaactcatcctaatagaaacgaattcaattaatgggatcgtgacctctaataaattgtaattaatgctcctgctacatttatgaactttggtcatttcctttacgaaaacaatgtaaattccacgtgtcaacttatttgccatctctccattaattgattttggcatatttgtttcatctcgtgcttttcaggaaaaccaccaaaacaaaataagacgagaaaaacgatatcgtatgaaaatgtgatttctcatagttacatgtaattataagtcatacgtatatccgaaaatgtgaacaattcattatttgtccatgtttttcattattgaagcacgtacgacaacgtttgaccagcacattttttggcccaatatgaatccccatagagagattcttttttggcccaattaaacagcggtataaataaatgggcctagcccatgttgtttttatttttatactattttattatttccaccctcttcacaaaaaccctaaaccctaatttgaagttgttcgattcgatatccttgtgtgtgtgtgcagacagttttcattttccaattccattactgcctcttctttgttgctggttctgagtcagtggtgata

SEQ ID NO: 8249 - DNA, 3000 bp, Unknown
  misc_feature (1)..( 3000): cDNA_ID_2992336_gDNA_ID_1621202_Annot_ID_57709 3000 nt of promoter + ATG
cgtttctatattaggcactgataaaagttgtgatatcagactggaaaacaccaattgcaaaaagatatctagtcaaaagacaaggcctaatgtgaaagtttcactgaatgcttttaagtttcaacaaagaagcatagcagatgaaggggttaaactcaatgttcctacactttactaaaccgggaccttctttttagatccccatgtgttcacacagtaaaatagcttgaccataaaacactatgagaagtatagtgattgtagaacagtcttactggtttgaactgtggctccttgatatcttcctaggagcctattagttgacactagctagaacgtcaacacataacacaacaagggcatctctttatttctttagctgaaaaggggtctgcaacaagccataacttatggggccttggggaactagagtaggaagatgaccttctacgctgccagttaaacatcttcccctgttcagaaccaaagaggagattacagttttaagttttaactataactgagtatgattacaatggacaaacactactcggtaaggagctacaatagcagaatttacatactagatcttggcaattcgataccaaaggccattaagtcatagttgactaaagtttattggagctggtagaccatacgtttctaaatcaaaataacacaaagcaggatcttggatcatacttatgaactaggagtctaatatgtaccgtagtagctgtgcaatcacaacagataatcaaatctaacactgacaaatatacaaaggtttaaccattacctgcggggtgatatcgaccttgaacgcgaacgagcatgctattgcctacaaattggttatcggccacgtctgcggtctgcggattggataccttcttcttggaagggacctgcatgtgtgcattcaagaaataatccatcaaatgaaaactaatacaatgtaggcagaacatctataaaattgaaacactaatgcattgagttgcatacactataaataaattgatctcatcctctaattactacaatgcagctctttaaacacaaatttatcgtcacctaagaggagaacgtcttagagcaggactgccacggatccttcgagggtaaccctccagctgacagataaaaggtgagacagtgaactgaaatggtattgaacctcagacgaggaaactgaaaccgttttggaggagaacggccgctagaagaggacactggcctgcgtatgggtgatccaccactcataggcagaggtgattatcatatttctcaatgtcagtaccaacattatcagattttaaagcatctccctttggatcacttgaaacatacaccatccatgtacagctgtggtttctcagcatcagctatttttgccttgaattcaacatatgcatctcctcttgaaagattagcctgttaatgtcaatcgaaattatgagtaaagtacttaggaaacaaatctgcaaaccagccaagagcaattgataagaaacttacagctcgatctatcgcaagttgaacatgaatgatttcaccaaaatcgcctgcacataaggaaaaaaggaacatcactgaaattggatttaagcgatataacaacattcgagcattgatttgacaatttaaatgtgtaattgtaatgagtccacttcgtataagataaccaaattaccaaatccaatctctaattaatcaaattggagaagaataagaagaagacgacgatgatcttgaactggagcgggagcgtgagcgggaaatagaccacgaaagactcgaatcttcgccatggccagattcagattctagcgcgcttgtaaggttaaccccagacccaaccctaacggctacctgtcgatttacacacaaacacacacgagtccgcacgtgacaagtcatgggttgggtaagttaactataatgaacgacaaataaataattaaacttactaaagcaaattatagtttgacaaaaatagtcttaattttcagattattagttggatatgcatagtttattcaacttttctcttaatatttttattacatgattttttttatttttggagatttatcagttttttttgttttaataatagtttttagataatttggaaaagcaatgatctctgcatcatcaatcataaaaattaaaaaaataaggcctcgtcgctatatcttctctctagggttcgctgttgctttttcatcttcttcttctccttctctgtttctctgctttcgtcacgaaagggcgatatgtattgtttctcagtaggaagctcgttactctgattcgattcgattctcaatcctttcatcaaaccgttttgggacttcggattttcatattaaggtagcgtatccgcttagggatccaattttctccgagaattgtctccttctacaatctgattctcctcgatttttccagttttcaaagcagtcaattagggtttgtagactaattcggatttggagacggtagcggttatggacgcttttggaatcgggagtagtttaaatcaagctcccgtaactcaggatcttaagaaatttggagataattctacaggtttgttcttcttttttctcggatttgttttgtttctgctcttttgaattcggcgtcttgttctctgttagattgaatctggatctagttggttcttgttcttcaactgtttaggagtatataaaacttgaattgcctcttagttgattcgttagaccttggtcttcgttagattttatttactttcattgtcttgtactcccacgaagaagattagggaagacttagttgctaatttaaatcgtgaaatgagaaaccatattatgcctgttgagattctctccgattgagcaatttccggaagaatgtttcaggtttagatcaaacttgcatcagagtcttatagtttcatctcttgtttgggcttgtctaactgaaggtttcttttgtgcaggtaacaca

SEQ ID NO: 8250 - DNA, 3000 bp, Unknown
  misc_feature (1)..( 3000): cDNA_ID_2127813_gDNA_ID_1621202_Annot_ID_57714 3000 nt of promoter + ATG
agtgaggaatagcatctagatcaagaataatcgcctttctgaatttcaatccttagataagtttcactatcagtttggtgagtggaatacacttctattgatagatctcaaatccagaaatagagattacaggaaaaggggaaaatcaaaagacattattaccatactaaggagaacatagagcaagcaagataaggaagtcaagctaaggaagcaactccacattatcagaagcaaagcagctgaacccaatttggcgctgcaatggaaacccctaaaaatgcagtctttccaataaagaactgacaactgaagcaatcctaatagcttcccacatccactacacaccaatggccagtgacgctccacaagccctcctatcatctccccaaagcatcgcatcgcagaacaagcatcggagcacatatgtttctgagattgcatccatttccaaccttgcttaaccaacccaatatcctccatcgctaaaatccaacaacttcaatccctagcttagctcaacctcgagttaactcacagagacagaaaccgagatcgacaggggtgagaacataaccaaagagactcatctctcgacgaaactagctgcttctcatccatgaatgacttcgataagaattcacatagaaaaccccaccacgtttcggtaacttaattcaacagatttgccgcataaacttcagagagaagataaacaaatacaacaacaacaacaacaacacagtgttgcaagaagaaaatccggtcacgctgattcgttcaacgcaaatcccttcacatgcaagtttccccaaaaacaacagattagaaaaaaaggcaaagcaaagctccgtaatatctgaaacaacaacaacagaaaaaaggaatcttttctttcccctttattagcaaaaccagtctttgcttcattcaaagacattccctaaattacccatcaagctcccacttttaaaaaccgatctttgatcggatccagtaaaaatcatagtaattttccggcgaatagaatgcttcgtcggagatttcaccaccaccgacaagtagttccccggagagagaaatagagagagtggtaaacaaaagtaagaaaatgggcttctttagttaaagtcgattggagagggggacactgtaagattaaagcttgagaaaccctaaaagagaaagacaaactttcaaaaagttcttcgaggagagagagacgacaaagtttcgcgtatatagagagagagaagaagacaacaagatataatccattgagaagaaggcaacagtataattaagtcgttaatcattattaattagcattgtttttggctaattaattagcgttattagtcgttgttaaatgaccttacttacttactggagtagtctaattttttctgggtcccactttacttccaagagtgtgaaatcacctgcggctggtcctactataccataaagtcaaaaccggaccggttcagttctgtaaatgttgaattctaagcaatggatttaagtatttaaccgaaccgactctttaaaaaattgctgttcgacaagtttatacaattattactgttcaattcttcatttggcattatatgatatatcgatttagttgtgacttttgagcatgtgtttttttttctgattctaaagttgttttggaaaagattgtttgttttcatttgacattatatagttaagcatgttctgttatctgtatacaaatcatcgtgcttgtggttttgggattatgtgaagtaatacagcaaagatgcgtaatttattttaagtatcaaaattattctcttatccacattgtatatagtcaaaatatatattacagactgaattaaacagacttaataataggcaaaatgtacatatatttgcattagaagatttcaatatatgtgttttttttctttcagaaaggtcatttgactcataagttataacagctagcttatatagtccttagtccttactcatgaaaaaagaataatttgttttgttatttggggtctactactaacattagaagcagacgtgggatttaatttgatttattaaaattgtggtgggtaatatttagactgaatctatgaaatcgatagcttgtaaccttactcactctcaatttaattatattagttttgtttctcatcacgactgagacgtgtaacgaatatatcgactgatcaaccactagttattaatttaaacgactttaatttgtattaatatcatatcttaatgacttgagtagaagaataatagaataagcatagaaaacattgaccaaatccttgtgtacgatacaatcatgtattatatacagatttatttgttactagtaaatatgattagaacttgcattagacaatggtcaagtttgttgatgtttccagttatggagaagccataatttgagtagcattagacattgattaatcaagaaaagaaaaataatatcatctactagtgtcaacactacagacgcagcgagcgagcaattatagacgcagtatctaaacgctgatcggtgtacgaatttgcggttcatttcaacgcttggcaaaattcacaacgtggaagacattgcgagtttacgacaaactagtggggttgttttaagtaaactaaaacttgtaggggttttctcaaaaataaaataaaataacttgtaggggtcacaaatgaaaaataaaaagtattgaatatcctacgtggcatttgtttttttcatctcctacgtggcattacgaaatgaagaaaaaactgatctgacggatctgcttaaccagttgaagataacgttagtaaggaagatatccagaccaaagccacacaacattagccacgtgtcataaccacaatcacttaccggatcttctctccctcgtatttgaagccacacaacatgaacattagggtgagaagagatcgagagaagaatagtttgatcatcttgtgagaaaaataatg

SEQ ID NO: 8251 - DNA, 3000 bp, Unknown
  misc_feature (1)..( 3000): cDNA_ID_1810928_gDNA_ID_1621202_Annot_ID_57715 3000 nt of promoter + ATG
aaaaatgttatggaggatgataattctaattcacctgtatccatcgacgttagctccatacttgtcgacgtacttgtaaacaccgtatccctgcgattatacgtcattgtttagagaacccaccaaattattattaaaaaggatattaaacaacaccgttttcagttactacaaaccttgccctttctgccggaggcgtcgacgccgtccctcaagtccatgctgccgttaattcctacacacacatcgattaacggaaataagctatacatgaacggtaacgtgtatatgttgtaaaagtctgtgtaataataatataaacgaaccgaagggcttgtcggtcttgatcttcttgacgccactggcgacaattttgaaggagggacgagctcttgtgagcgacggtaatcctctagccgccgtcttctccaccgtgaaaccagctggtttcaatgtcaccgaagatagcatcactgaagcagccattatttttctcacaagatgatcaaactattcttctctcgatctcttctcaccctaatgttcatgttgtgtggcttcaaatacgagggagagaagatccggtaagtgattgtggttatgacacgtggctaatgttgtgtggctttggtctggatatcttccttactaacgttatcttcaactggttaagcagatccgtcagatcagttttttcttcatttcgtaatgccacgtaggagatgaaaaaaacaaatgccacgtaggatattcaatactttttatttttcatttgtgacccctacaagttattttattttatttttgagaaaacccctacaagttttagtttacttaaaacaaccccactagtttgtcgtaaactcgcaatgtcttccacgttgtgaattttgccaagcgttgaaatgaaccgcaaattcgtacaccgatcagcgtttagatactgcgtctataattgctcgctcgctgcgtctgtagtgttgacactagtagatgatattatttttcttttcttgattaatcaatgtctaatgctactcaaattatggcttctccataactggaaacatcaacaaacttgaccattgtctaatgcaagttctaatcatatttactagtaacaaataaatctgtatataatacatgattgtatcgtacacaaggatttggtcaatgttttctatgcttattctattattcttctactcaagtcattaagatatgatattaatacaaattaaagtcgtttaaattaataactagtggttgatcagtcgatatattcgttacacgtctcagtcgtgatgagaaacaaaactaatataattaaattgagagtgagtaaggttacaagctatcgatttcatagattcagtctaaatattacccaccacaattttaataaatcaaattaaatcccacgtctgcttctaatgttagtagtagaccccaaataacaaaacaaattattcttttttcatgagtaaggactaaggactatataagctagctgttataacttatgagtcaaatgacctttctgaaagaaaaaaaacacatatattgaaatcttctaatgcaaatatatgtacattttgcctattattaagtctgtttaattcagtctgtaatatatattttgactatatacaatgtggataagagaataattttgatacttaaaataaattacgcatctttgctgtattacttcacataatcccaaaaccacaagcacgatgatttgtatacagataacagaacatgcttaactatataatgtcaaatgaaaacaaacaatcttttccaaaacaactttagaatcagaaaaaaaaacacatgctcaaaagtcacaactaaatcgatatatcatataatgccaaatgaagaattgaacagtaataattgtataaacttgtcgaacagcaattttttaaagagtcggttcggttaaatacttaaatccattgcttagaattcaacatttacagaactgaaccggtccggttttgactttatggtatagtaggaccagccgcaggtgatttcacactcttggaagtaaagtgggacccagaaaaaattagactactccagtaagtaagtaaggtcatttaacaacgactaataacgctaattaattagccaaaaacaatgctaattaataatgattaacgacttaattatactgttgccttcttctcaatggattatatcttgttgtcttcttctctctctctatatacgcgaaactttgtcgtctctctctcctcgaagaactttttgaaagtttgtctttctcttttagggtttctcaagctttaatcttacagtgtccccctctccaatcgactttaactaaagaagcccattttcttacttttgtttaccactctctctatttctctctccggggaactacttgtcggtggtggtgaaatctccgacgaagcattctattcgccggaaaattactatgatttttactggatccgatcaaagatcggtttttaaaagtgggagcttgatgggtaatttagggaatgtctttgaatgaagcaaagactggttttgctaataaaggggaaagaaaagattccttttttctgttgttgttgtttcagatattacggagctttgctttgcctttttttctaatctgttgtttttggggaaacttgcatgtgaagggatttgcgttgaacgaatcagcgtgaccggattttcttcttgcaacactgtgttgttgttgttgttgttgtatttgtttatcttctctctgaagtttatgcggcaaatctgttgaattaagttaccgaaacgtggtggggttttctatgtgaattcttatcgaagtcattcatggatgagaagcagctagtttcgtcgagagatgagtctctttggttatgttctcacccctgtcgatctcggtttctgtctctgtgagttaactcgaggttgagctaagctagggattgaagttgttggattttagcg

SEQ ID NO: 8252 - DNA, 3000 bp, Unknown
  misc_feature (1)..( 3000): cDNA_ID_4359968_gDNA_ID_1621202_Annot_ID_57716 3000 nt of promoter + ATG
gatttggtttattgagttgaggttcacctgaatttactattgcagggagctgctgcagctgttgttctgaacttgggttgcactcctgggctctttatcgtaggactatttggaattttgattttatggatgtatgcaaacttttggatcactggaacattgtttatagtcggaggtaagttttgattttttccctgatcagttctgttcttatgctcttccactgttacaatacagccactttagattagtttgttggctgggttgagtctttccggttattggtcaatgagtatttttatgcatgatctcgactatttacatggtattgatttctctatttttgtttgattcaggctatttattctccttaaatcatgctcgcgtggtggttcttgtggcgggcttatatgcgatgtattgtgtcaaagtcagacttggatggcttggtcttttcctctcaataaatcttgctttcttgtccaacgatatattaaattgtcttcttcaatggtgtgacaatctaagtgaaaaaccacaacacgaggaaccaaagaaaccgaaagaaacaatcatagaagaagactattcaagggaatttgagtatccttcagttcctgtcgaagatgaaaccgagacaaagattcacgagaataagtcttctgctaaaccaactgcgccttctactgttgttaataccgtaaaggaaatttctagtgttaaaatagtcaaaatagaagagtcaagttcagctgatgaaatgaagagaatactgaatagtttgaatcattatgaagcattgggggtccctcggcataaaaagatcgatgctgcggtgcttaagaaagagtataggaagaaggtttctcctcttttccaatgctgagtaggtggttaatgaaatctctctgaatgttaatgaagtgtgttcaatatgttctaggcaatgttggttcatcctgataaaaatatggggagtccattggcaagtgaatcattcaagaaacttcaaagtgcttacgaggtagtcgaattacttataatcttgaatttgtatattttgaagttcttggtattttgatatatagacatgtaatggttgtattatctttttcaggttctatctgatttcgtaaagaagagagattacgatgagcaactacgaaaagaagaatctaggactaggagtgtttgtcagacatctcatgcttcttcgcatcaggtttagttaaagtcttttagcttctctgtaatatcttttggcgtgtggtctcatgttccatacattattcctattttgataagcagagtggtcctgattatcgatcagatgagtcaaggcggatacactgtacaaaatgtggtaattcacacatatggatatgtaccaataggacaaaagcaaaggcaagatggtgccaggtgatgaatccaaccaactcagaaacagttaaagaatattgttcttgcattttcgttatttcaaacctctcttacagataatctaatttgttaaatgtaggattgtggccaatatcatcaagcaaaagatggagatggatgggtcgaactcaaagggacattacccttcgagagagcacataaggtataaaaaagcttctttctcgccttgtcaaatgttataatgaatttggttttgcctcagtatcctcagctcaatcactttctttttcatgtccattaagattgaaataccgcgtgcttttgtttgcgcggagagcaaaatatttgacgtctcagaatgggccatttgtcaggtcagttctcttaccggttcctctgcggattacttaaatgcgaagatgacttgagatacattaacatgttttgattggattaaatagggaatggcttgtagaccaaacacgcatagaccaagctttcatgtgaacatggttgggttagaaaagacaacacagagatcaaactcaagtaggttcccatgggatctagatgtggagatgatggatgaggacgaagaagagtttgagctatggcttcaacaagctcttgcttcaggtctcttctgcgaaacctcaaaacgtagaaaaagctggagccctttcaagttgggccagatgaaaagcaagaaacagtggcgaagaacttccacttgattcaaatttgatcgaaaccataaacaaaattttcatatagctcaccacggtgaatccaaagccttgaagatcataatttttttaggggagtctttctctgtaaatagtatctgtcgattgttcttccaaaagaaaaaaaaaagaatctttggatttttcattgtggtaaactaaagaagctgtttttcttttttctttttctgaatcaatgtgtagatttaaaggtggttcatttgataagaagaagcttaaaaaagaaatgttaatggttactaaatttataaagtttgaatttttaataattctgtcccttttaaacatgagaaaataaaaattgagaaatcgaacccaaatttactaaagttttccctcctctgtatgttgctgacgaatcaaacacgtcgacctccaatattttttttttttaatttccttcaaagcttcgattttgaccttctgggttaatcacggaagagtttcctttttgggtagccgccgcaatttttcccggcagaggaaaaaaaacccctagaatctgggaaattgacgacgaagagggatataggtttggaaattttgggtatttaatttgatttttctttttctcgttccattcagattcaaaaacaaaaaccctaaccctaaaattcgtgttcgattaatttcgttgtctctgttttgttttctcttcgtgtaaacctttttttttcgagttttggcactctgagctatttgagtattacagattaagcttcgtcctgtcttattggagcaacatacatatatatatatatatatatagatatctatcatctgtatttataggcacacttgtaagtagaatagtgaggaagaaggtaat

SEQ ID NO: 8253 - DNA, 3000 bp, Unknown
  misc_feature (1)..( 3000): cDNA_ID_1010644_gDNA_ID_1621202_Annot_ID_57717 3000 nt of promoter + ATG
cgtattgcttccgtagaagttgacaatgaggtgaatttccattttgttctaacttcgaaacattcgaccattttaaccattgttactatcaggtggctccagtgccaagtaagaaaccggcttcagaaataccaacacctcaatttgttattgtggatacatatgaaagggattattctccgacttttggtcagcctgcttcttatctacgtgcaagaggaggtaccaatttcctctgatttggttttgtattcattggcaatgaaggtggtttctttgttatgtgcagactataagtttgtctgtttgtttatgcagctcggtctgagcttggagaatttgtggagtatgatcttgacaatgaggatgaagactggctttatgagtttgataaggataagaaagaacttccacctgaaaagtaaagtaaccaatccaactatccttatagctcttcttcttcggatttatcatcatcatcagtatttttctgttatcttgtagctgcatcatgctgatattttaaacgttgaggcggattgggttattcagactctctgcgtcttttagttttgtactgttgctgaattagtttgctttattcactagaaattggattctgctaaaattgttaaaaccaaaactcttagtgaaatagataccgaaagaagaatcgttccatttgatgcacaacacaaatgtgttaaattgtttgatacaggcttgagatcatcatttttaaactagaggtgttggatcacaagacgcgggaaagagcaggagttattacacctactctcggctctccagttcctgtgcttttgcagtttgatgctgcttctgatgtatacctttacttttggattatatatctcttgttattataactctacactcattttagaagcagtacaaaacatttgaatgattagttctgattcttattgcaggtgctgcaagtactgtccattaattatggaaccttccaggcgatcttcaactactggaaagaaaaggtttgaaataaaacttatgtgattgttacaagttttctggatacagacgttatgttgcataggttaatgatcttattttacggggtgagataagacggtttaatagattatttgattcgtgaaacctatgcatagttcttgtgaatgacaaagcagttccacatatggagtacctttggctgataatacttatgcatatgtttcgttttctgttttttatgtgaacttagcgtaaaagatggcagaagcctatcttacggcgtttacaggtttgtattatttatttccatttgaaacgatcaaggcctatgttggaaaggcatcttacctcgattatttagttaatgttttgcttcattgtttggaacagcctcccccaccggttaatgacaccaatccctataatgtgtttaggccaagggagaaagttcacagactccacacaagaagggtaggctgtcttttttatgcatgtgcgacattttttctattaaaatccaactggagaaagaaaaatagtgataaggctttacttcatcttcagatgcagaggagagaaaacaatgtgcagtcatttgaaaagcttcgacaggtgagtgaggcacctgaacctttatggttctttaatttcctgaaatctgagcaatttacgtttacagtgccttcttttagtttctctctggacaacattgttttttctgcttgttaatgatctgttagtgattcttttatggttttctattggattctgaatacatgggatatgttattatcaggttagacgcaatctaggccaagcacagagcattctggaggctctcattaaggtgttctatatgacagttttagtgtttatcttaacaagcggattgcattctccaaagttgctaatttgatgttacccattccgtagagagaagagaagaagagggatgtcatggacagtgaggttagccttcagagaatccaactccaatacagggtacttacttctacttcctctaaaactctctgttttccgttttccgggtctaaaattgtttttttttttgcagcatgaaacagagctcttggaagatagcttggctatgcctggatttcaacccactacaacatcatacaaatttggctcaagcgatgatgaactgatggactctgatgatcacaccagtactcgtgtacgtacaagacctgcggttattcctagttctcgtttcaccaacttaaatctgaatgcatctcatcccggaggcatcaaacaagaagttagaagacgacagtcacagcatggatggcttcacagactggtaaaaccttctcttacaacacctaagctctctctagctactataatcaatcatttaagcaaacctgtaatgattttgttccttaggatcctaatgaaccggtaatgctattcacaaaaccgctggttcccgataaactggcagctgcagggattgttcctccaacaccggattcatcaccaggtcaacctccaagtcggtttcaggggaggattgggcgtggtggccgaattattttcgatagatggaatccgttgatgcaatctcacattaattgtggaaactcttattacattgctccaaatcaccggtctaccaacttcgattgagatattttcacaatcttgctttgtaaagaattttccatcaccaatggtgtatgcaataacgattctcagctaaataagttttagcactttgtaactaactggttattgtgtgtatttctgtttattttcggttaaggaaagaatctgtttaattcaaaatccggttctatcggcggtttggaaaaccaaaaactattgtaccagggaccaaattgtaataatatcttcaactcaaaggacaaaataggattttagggctctttattgattttaatcggaagttcaggtttgctcatcaatcgcagtgaagaaggaaggaacctaaatcggaatttgggtgctccatca

SEQ ID NO: 8254 - DNA, 3000 bp, Unknown
  misc_feature (1)..( 3000): cDNA_ID_1810920_gDNA_ID_1621202_Annot_ID_57718 3000 nt of promoter + ATG
aggaacctaaatcggaatttgggtgctccatcaatggcttcgattttggctcgcaggtcactgaatactctccgtgctcgacatctcgtatgaatcttgttcgctcttgttatttcttcattttgtgtcctttagttagagttatttgaatgcctagaaatgggaatgtctcctggagttttgggagcttaagatgattctattcactctctgtgttttgttttgtgtcgacgagattctggattttatctagctgatcgatgaaatcatgtagggagatttgaatttgatcatggttcatcttaagggctttcgttttacttatggtttccttattctttttcgcatttaatttttgtgacgaaagccttttcgcaagtcaatttttttttgtttttttttgcgagctttaatcctttcattagcttgatatggtgtgtatgttctgaatacctctctgattacttctcgacattgataggttttgtcagggcaagctttacagggatctcatctgtctagactgcagtcccgtggtatatcttatggcagcaacaaaggtatattttctgctcttgtttggttttctttggtaaatcaggtttaattgtgaatctaccccttttccaacttgtattacgagattctgattcatatatgacttatggtttgcgtatgtaatattcagatgatgaagaagcagagcaactttctaaggaaatctccaaggactggaatactggtaatccatatgatctagacaattttactttttttctcctttcttcttttcttgtacgtctatcttccttggtgttttcctccccgagtattagtgattcctgatattctcaaatttgtagtctttgaacggagcataaacaccctgttcctcacagaaatggtccgcggtttgtcgctgaccctcaagtacttctttgatccaaaagttactgtgagtgatatcttttctagtcttccaaacttagattgaaagaaatctgtgttactgaagctctttcgtgtatgcagatcaattatccatttgagaagggtcctctgagccctcgcttccgtggtgaacatgctcttcgaagatatcctaccggggaagaacgctgcattgcctgcaaactctgtgaagctgtgagttttgagatcgatatgaatccttcatttaatttaacgttctctttgttctgatatggtactctgagtctatcaaattcatcttagtaattaggaaagctatttgagtatgagtaatatttactgtttagtctctagagttctgatgaaatggtcatattagctgacaatgatctatttagtgtgtataaaagttcaccacggattgtaattcttgtgagggatacttgtccttttcatcaggtatgtccagctcaagcaatcacaatagaggcagaagagagggaagatggaagccgcagaaccactaggtcatcatccctttagttctcatttatcaaccatctgctttctttattaccctttcatgatgatttgagctgtatcgtacaggtacgatatcgacatgacaaaatgcatctactgtggtttctgccaagaagcttgccccgttgatgcaatcgttgaaggacctaactttgaattcgcaaccgagacacacgaggtctgtttttcacattttctagaccctaataattttcgaggcatgcttattgaaatttttgttatattctctatgataggaacttctctatgacaaagagaagcttcttgagaatggagatcgatgggagacagagattgctgagaatctgaggtcggagagtctctaccgctgaaccattctacaacagtctctgcttcattcaacttgtttttcccggggaaacattttcgttgcttctgtttgaaaataaagacgagatcatatgcgtgtgaaaactcttttgtaatccagattttgtgctgtgtaattgaattgtttgtaaccaacctgactttgattttcggttcatgagttccggttattaggtgttttcggttcggagaaagagcatttaatttggtcaaagactgaaaacagataagtcttaagctacaagggtatatctgtacattaagaaatatttgatcggacggacaagatcatgtcttttttttttttacggcggacggacaggatcatatgcttatagtttatcctaatctgtccgatctaaacataatgcttgtcgattttttcatttatttgccttttggttgcgccaattatcgtattcagacagcaaaattaatattttaatgtgtattttttgttgagttactattttagaaaaacaacgaatccctagaaaggaaagaaaaaaaaaaacaaaatccccaaatcgagcgagtccaaagaaaaatcccaaattcgacgaacctacaagcccagaacatcccccgatttgggaaaacctgaattcattcgcttttgatttgccatcttctttctgggatttgtctactgcttgatcctaatttctgacctcgcttttggtttgagttcacacgtgccgcatcggctgttcaccggctttgtttcattgtgcagactccaatcatcgtacaatctgtagcaaccggttggtctccgtcaaatttctccactttgttgccaaattttactcctttttgtatcaattcaaagattgggggtgaatttttagggtttatcattttgttcatttttggtaactattttggggtttaattacttctttagttgatactatgattgatactatctcccaattaatatgagatcaaattgtgacaatttcagttctctgattacaccaagtttttttagcaggacattctctaaggtgctaaatcaggagatgaaatttggatactgtgacttctggaggagaggaaagttatgcagtgtttgttactgttaattaccagaagaactaggacaaggcgacggagactgaagaggtagctatgaatgttcaggctcac

SEQ ID NO: 8255 - DNA, 3000 bp, Unknown
  misc_feature (1)..( 3000): cDNA_ID_3047988_gDNA_ID_1621202_Annot_ID_174988 3000 nt of promoter + ATG
caaaccgcatgggctatgatgggtttgattcatgccggacaggttcaaatattttcaatcttggacttgcatttatttcaagtacaacgaaattatcttgaaacccctatcgtttcctctgctgtatctatacaacaggccgagagagatcctacacctcttcaccgtgctgcgaaacttatcatcacttcacaacttgaaaatggggactttccgcaacaggtaagtttcaaacatccccttttcgatcgatatatgaatatctcctgaagcatacataagttttgagatttagaataatgttacctcctttatcgtacctttctattgcctagtacttcatactctgtaataataaaaatcagatcgaatattgatgtcatggacctgaactcacttttcttgtttctaacgatagtaaatataaaattgatgtgtatatgtaatgagtttaattattctttgttattgtcgtgtctttgcaggaaatattaggagtgttcatgaatacatgcatgctacactatgctacgtacagaaacatcttcccactatgggcactcgcggaatatcggaaagctgccttcgcaactcatcaagatctttagctctttcttaatagtcaatctttaaaagagatttggctcttctttaataatattatacacaattctgtagatatgaaagacaaaataatattattaggagacttgatgttcttaatctgagagactggggttgagatttgcgttaagcaaaatgtcaggagatttgatgttcttttgcattaaagacggtgaacagttatgatcacaagaaaggtaatgaaagactgttttgttttcgtttgtgtttttgtctatctaagaacataatcgatggctccagtggttcccaagacagaattttttttttcattagtatatttctaattaatcaagagttgaaacatacacggatagagcttcctgagaatcagctgacacatttgctgatctaaacttctactaatatatagtctttacacgtcatcattcttttcgtttttgtgtcatatgaaattcattccaaactagcctttgtacacagcacaacaacactcacaaatagagtgctactaccataacaaacaaacaaaaagacaaatctattgcttcatgaataactaatgtttattgctcacaagtataaataaaaatctagttgaataatcaaagatgacatgaatttatttttatttgattctgtatacataaatacaaaaaggtaagtatttgaaatatttaatgatgaatccacaacaatttggatgagatgatgtagatatttttatacgagagaaaactctgctgtaaaaccatcgattactaattggaatttagttacgagaaaaacaacaatagatattaattacttttattttattatcttagttatgacatgtgacttggtatgtacgtctggctaatctttttcctcgtagaatcccatgcttcctacttctcaccataactataaggcattgctttgctttctccttatctttatctatcttaattaattaccacaaaaatatcttatttgattatcctgatgatgcttactagctagcaaattttggtccattcgatttagagcaattattggatgtgactacgtctacctaatctcatcacaattagcagtagcacagcgacacttctctgacttgcaatcgaccaattattgatttttatttattcaggtacgtgttctcaaatgagaggataagaaagggaaatggaaaagatccgcttttattcagtagcaataatttcgtctagcacaatgttagaagacttgatgttcttatgcatcattgtccatagacggtgaacatgcctcgtgcaagtgcctacacaaaacaacaattcctgtcataaaaagagcacttgcttgtgttttccgttttattgttttacgcttttgttaaaaaaatagggatattgtactttttgtgactttttgtctattcaatacaatacttaaaactaaatgaaattttacactattatagaataatggttgaaatcgaattttgtattaatgatattttcttacaataggacgcttaccttttcaacattttaagcttttgaaactctagtttcccactatattcgttttaccatgcagtgtaagtgtgtaacaatgtccgattgcctagcaaaaacatcaagagcacgagattctttgtaaaatataagtatataggttccaaattgtctttcacaaaaggaaattccgcacgttttttaaaaataaatggtgttttaaaaaaataaaaaataacacatagtttgaaagggagatttttttgtattactgacaattaaaaaaaaagggaagtataatataacaaaaccccccaatatgcaaaatcaacaatttcaaattggaatttaattagttattacgataataacaacagcagattaatcaattttattaagttaccctagtgacaactagcaagcaagttttgtccattcgtttttaagcaaagcatgtgactacgtacttcaacctattctttctttgtttacatacaggcctatatatatgtttcattctctatataaacattttttttttttttaataaacatacgtacatgaaactcttcgaaagtatcgaattaacattctcaaaggcaaacatagacccagtacaaacagagccgtgccaagagacataagcgaaactttttttgtttatattttagtacgttggctttcttctttatgtctagtctcatcggacgaaggtagttggcacaccgacacttctctaacttgcagtcgatcaatttttttatttttattcaggtacgtattctcaaatgccttctttaattagtggttatctatccagctgctctttcctttacgtttcatcagtgtcagaaatcaacttgatagaatatcataactatctatagggtcatcgtacgtcgttatg

SEQ ID NO: 8256 - DNA, 3000 bp, Unknown
  misc_feature (1)..( 3000): cDNA_ID_1810909_gDNA_ID_1621202_Annot_ID_174986 3000 nt of promoter + ATG
ctttttgtctattcaatacaatacttaaaactaaatgaaattttacactattatagaataatggttgaaatcgaattttgtattaatgatattttcttacaataggacgcttaccttttcaacattttaagcttttgaaactctagtttcccactatattcgttttaccatgcagtgtaagtgtgtaacaatgtccgattgcctagcaaaaacatcaagagcacgagattctttgtaaaatataagtatataggttccaaattgtctttcacaaaaggaaattccgcacgttttttaaaaataaatggtgttttaaaaaaataaaaaataacacatagtttgaaagggagatttttttgtattactgacaattaaaaaaaaagggaagtataatataacaaaaccccccaatatgcaaaatcaacaatttcaaattggaatttaattagttattacgataataacaacagcagattaatcaattttattaagttaccctagtgacaactagcaagcaagttttgtccattcgtttttaagcaaagcatgtgactacgtacttcaacctattctttctttgtttacatacaggcctatatatatgtttcattctctatataaacattttttttttttttaataaacatacgtacatgaaactcttcgaaagtatcgaattaacattctcaaaggcaaacatagacccagtacaaacagagccgtgccaagagacataagcgaaactttttttgtttatattttagtacgttggctttcttctttatgtctagtctcatcggacgaaggtagttggcacaccgacacttctctaacttgcagtcgatcaatttttttatttttattcaggtacgtattctcaaatgccttctttaattagtggttatctatccagctgctctttcctttacgtttcatcagtgtcagaaatcaacttgatagaatatcataactatctatagggtcatcgtacgtcgttatgtggaagttgaagataggaaagggaaatggagaagatccgcatttattcagcagcaataacttcgtcggacgtcaaacatggaagtttgatcacaaagccggctcaccggaggaacgagctgccgtcgaagaagctcgccggggtttcttggataaccgttttcgtgttaaaggttgcagtgatctattgtggcgaatgcaagtgagttctttttttcctcatgaaatatcttatactaatcttcgccttttttgttgttacaactaccaatgtttattttatttggtttgattgtatgtacagtttctaagagagaagaaattcgaacaaggcataccacaactaaaagctactaacatagaagaaataacgtatgaaacaacgacaaatgcattacgaagaggcgttcgttacttcacggctttgcaagcctccgacggccattggccgggagaaatcaccggtccgcttttcttccttcctcctctcgtaagtttcttcatctctctctatatacctttttgacgatactctatcttatatttctacgagagagataattaatcttcttaggaacaaaggtaaggttttggcgctttctttattacttgcatggaaatatcaaatatggaataaagaagagaaagacttactatgtttacgaggagattatggacaccaagaactttttggtttggttatccaaaacaaagaatttgtttcgcaaaaatcaaaagactaaaacgagagctagggtggaatttgaacgacttttttttatttttatatatagatattttgtttgtacattaccggacatctggaggaagtattcgatgctgaacatcgcaaagagatgctaagacatatctattgtcaccaggtatatatacttttagttgtgaaggtcactaatctcgaattaatgtactcttacatgagattatatatgttttgtctttttgcagaacgaagatggtggatggggattacacatcgaaagcaagagtgttatgttctgcaccgtgttgaattacatatgtttacgtatgcttggagaaaatcctgaacaagacgcatgcaaacgagctagacaatggattcttgaccgcggtggagtgatctttattccttcttgggggaaattttggctctcggtaaaatcttttgagccatgtatattttgttaacttaaatgggagatgttgaatgcttaaggttctatatataaaccatcagttggttttctatatctagatacttggagtctatgattggtctggaactaatccgacgccaccagaactcttgatgctgccttcttttcttccaatacatccaggtttgctatgttctgctgattctatatttgtgtttcgttttttctcttcaaataatgtttgtcctgctccaaaaaaatttgaaaacacacagggaaaattttgtgttatagccggatggttagtatacctatgtcgtatctatatgggaagaggtttgttggtccaattacacctcttattttactcttgcgcgaagaactttacttggaaccttatgaagaaatcaattggaaaaaaagtcgacgtctatatgcaaaagtatgtatgcttgactactttcaatcttgaaattttatttttcttggaagaaaactccacaaacattctgccattccttatgcaggaagacatgtattatgctcatcctttggttcaagatttgttatctgacactcttcaaaactttgtggagcctttacttacacgttggccattgaacaagcttgtgagggaaaaagctcttcagcttactatgaaacacatacactatgaagacgaaaatagccattacataaccattggatgtgttgaaaaggcaaaccattttaagaaccctttaataaaagaagaattatatgttaatatatattctcttaatattgtacatttttataaattaaaactgctacttttttcccaatataggtactgtgcatg

SEQ ID NO: 8257 - DNA, 3000 bp, Unknown
  misc_feature (1)..( 3000): cDNA_ID_2127829_gDNA_ID_1621202_Annot_ID_174985 3000 nt of promoter + ATG
tgtcacgtccttgccccctccacaggaaaccaccaatccagaaaatctccttgctagccgtatctattacatcaaagcaaacgcattacaagagctccaaactctagccagcagttcgaagaacggtaaaaggacaaaacttgaatcattcagcgcgtttctatggaaactcgtggcagaacacgctgcaaaagatccagtcccgatcaagacctcgaaactcgggatcgttgtggatggaaggaggagacttatggagaaagaaaacaatacttacttcggaaacgttctctcagtcccatttggtgggcagagaatcgatgacttgatcagcaagccactatcttgggtgaccgaagaggttcacagattcttgaagaaatcagtgaccaaagaacatttcttgaatttgatcgattgggttgagacttgccgaccaacacctgcggtttcaagaatctacagcgtcggatccgacgatggacctgcgtttgtggtttcttccggaaggagttttccagtgaaccaagtggatttcgggtggggctcaccggttttcggatcttaccatttcccatggggaggcagcgccggatacgttatgccgatgcccagttcagtggacgacagagattggatggtttacttgcaccttacgaaaggacagttgaggttcattgaggaagaggcttctcatgtgcttaaacctattgacaatgattatctcaagatttgaaaaaaaaaacctaatctcttagttttcaattatgggtatataattcgtgtgtttaatttctccggctggtttttttttccttgttttccattttatgtgatattatgtttgcctcttgggacttcgtatttgaattcttgtattcgttacaagattatgcaaccgtacaatgtactatatatctgtcaatatttgaatcaaatttatctctctgatgtgtttgttggattactttactaacgttgctcaatctataatacatttattaatactggaattcttggttcttttgccaacaacatatatacattcaatatagatgatgacacaacaacaatacaaaatactattctatggatgatgaatcaattatatggaaatcacgttctcacactatatataatactgtcatgatacctcgactacacgcatttggtgtcattggaatgatcgatcgcgtgcactaccaaaattcgtgtagccgccaaagcagataaaaccaacctccattatattgacgagtattgaccatcaaaactttctttcacaagtttattaaaaaatactcgtcacttatccgtcaattagtgtttattgtagattcttctatttgctacttgcaatttacctatcgtacaaaactgcgtgatatacaatctgttcatatccaatatttatgaaataaatcatatatgtaaacattaattatgatatatgcattaataattgaatacttacaaaagttgtttgtgatgtatagtattgatcactatagtctatagatggtactagctaactagagcttggttcttgtgtggttgtaccatttagggtttagtcaagactactctgactgtaattgataacactgatagctatttatagtttaattatccaaaatttggttgttcatcttcctagttgttgtattttaccaaacaaatattaagcagatttaactactaaacctagacccacctctacgaatagaaatttaatgttttaactaaaataagtattgcttctttctatatactggtggtttctatatacacgtgtatactgcttttgaccttttgtcactaatcacttttttttttcttttctcgtcttgtcactaatcacttaatcactataaacaattcgtttccaaacgttcatgaaaagtgcagattatatatattatacctttttgcaaacatttataaattttaacatacgttatgaacaaaatatacgccaaggaactaaataaacatatacaaaaacatttccatcgtttttacgtaatttctattaaaaaaatcatatttcagaatactgtatatatataaataatcttataaaagagtttaaataattttatacataagtataagatgtgtataggtacatgtaaatgttaaatataaatactatagtatagtccactactgttaaagcttcaatgggtgtgtaataagtagccttgttatttgtcaacgtggaagaatttgtgtagtaaagtaaaaaactgtgtgtaaaaattttgttgtcgttggggaagattagaaatatgtggttttagtcaaagtcattcttaacaactaaatgtccttttttgtctctctctttttttcttttcttttttcaaaaccttattttgtcaaccaactaaatatcctttatagcatttattatcggaaaatattcatgtacttattaactaaaaatttaataaatttatttctcaaaaaatataatctaataaaccaaagtattgatcagacagaaactaaggcattaatcagaaacatatcaagtgtattccaaaggcttcgagtttttaagaatttttaggatcgctcacattaagcgcattaagcgtgtgacagggtttgtgtgggcttatatatgagagtacatattagcctaacactcagctaagcccaagtatctatatacttccacaatttccaaaaaaacaaaacaaatatttaataattggttaattgaattttttaaacacacgcattttcaccgtcattgcgcatctttcgttctccctcaaagatctaaaataaatcaaaattagtaaacaattgttcagcaaaagttaatggtcgtgaatggtcattcttgtccaaacctcaacaatgtctctatccctaaatccaatcacaatggcacattatctcaaaccctcgtcgtcttgtccgtgaagcaaaccaaaaagcacaacactaactttggaaacccattttctatctttcttgcaaatcaag

SEQ ID NO: 8258 - DNA, 3000 bp, Unknown
  misc_feature (1)..( 3000): cDNA_ID_3047995_gDNA_ID_1621202_Annot_ID_174984 3000 nt of promoter + ATG
aatcgcagtgaagaaggaaggaacctaaatcggaatttgggtgctccatcaatggcttcgattttggctcgcaggtcactgaatactctccgtgctcgacatctcgtatgaatcttgttcgctcttgttatttcttcattttgtgtcctttagttagagttatttgaatgcctagaaatgggaatgtctcctggagttttgggagcttaagatgattctattcactctctgtgttttgttttgtgtcgacgagattctggattttatctagctgatcgatgaaatcatgtagggagatttgaatttgatcatggttcatcttaagggctttcgttttacttatggtttccttattctttttcgcatttaatttttgtgacgaaagccttttcgcaagtcaatttttttttgtttttttttgcgagctttaatcctttcattagcttgatatggtgtgtatgttctgaatacctctctgattacttctcgacattgataggttttgtcagggcaagctttacagggatctcatctgtctagactgcagtcccgtggtatatcttatggcagcaacaaaggtatattttctgctcttgtttggttttctttggtaaatcaggtttaattgtgaatctaccccttttccaacttgtattacgagattctgattcatatatgacttatggtttgcgtatgtaatattcagatgatgaagaagcagagcaactttctaaggaaatctccaaggactggaatactggtaatccatatgatctagacaattttactttttttctcctttcttcttttcttgtacgtctatcttccttggtgttttcctccccgagtattagtgattcctgatattctcaaatttgtagtctttgaacggagcataaacaccctgttcctcacagaaatggtccgcggtttgtcgctgaccctcaagtacttctttgatccaaaagttactgtgagtgatatcttttctagtcttccaaacttagattgaaagaaatctgtgttactgaagctctttcgtgtatgcagatcaattatccatttgagaagggtcctctgagccctcgcttccgtggtgaacatgctcttcgaagatatcctaccggggaagaacgctgcattgcctgcaaactctgtgaagctgtgagttttgagatcgatatgaatccttcatttaatttaacgttctctttgttctgatatggtactctgagtctatcaaattcatcttagtaattaggaaagctatttgagtatgagtaatatttactgtttagtctctagagttctgatgaaatggtcatattagctgacaatgatctatttagtgtgtataaaagttcaccacggattgtaattcttgtgagggatacttgtccttttcatcaggtatgtccagctcaagcaatcacaatagaggcagaagagagggaagatggaagccgcagaaccactaggtcatcatccctttagttctcatttatcaaccatctgctttctttattaccctttcatgatgatttgagctgtatcgtacaggtacgatatcgacatgacaaaatgcatctactgtggtttctgccaagaagcttgccccgttgatgcaatcgttgaaggacctaactttgaattcgcaaccgagacacacgaggtctgtttttcacattttctagaccctaataattttcgaggcatgcttattgaaatttttgttatattctctatgataggaacttctctatgacaaagagaagcttcttgagaatggagatcgatgggagacagagattgctgagaatctgaggtcggagagtctctaccgctgaaccattctacaacagtctctgcttcattcaacttgtttttcccggggaaacattttcgttgcttctgtttgaaaataaagacgagatcatatgcgtgtgaaaactcttttgtaatccagattttgtgctgtgtaattgaattgtttgtaaccaacctgactttgattttcggttcatgagttccggttattaggtgttttcggttcggagaaagagcatttaatttggtcaaagactgaaaacagataagtcttaagctacaagggtatatctgtacattaagaaatatttgatcggacggacaagatcatgtcttttttttttttacggcggacggacaggatcatatgcttatagtttatcctaatctgtccgatctaaacataatgcttgtcgattttttcatttatttgccttttggttgcgccaattatcgtattcagacagcaaaattaatattttaatgtgtattttttgttgagttactattttagaaaaacaacgaatccctagaaaggaaagaaaaaaaaaaacaaaatccccaaatcgagcgagtccaaagaaaaatcccaaattcgacgaacctacaagcccagaacatcccccgatttgggaaaacctgaattcattcgcttttgatttgccatcttctttctgggatttgtctactgcttgatcctaatttctgacctcgcttttggtttgagttcacacgtgccgcatcggctgttcaccggctttgtttcattgtgcagactccaatcatcgtacaatctgtagcaaccggttggtctccgtcaaatttctccactttgttgccaaattttactcctttttgtatcaattcaaagattgggggtgaatttttagggtttatcattttgttcatttttggtaactattttggggtttaattacttctttagttgatactatgattgatactatctcccaattaatatgagatcaaattgtgacaatttcagttctctgattacaccaagtttttttagcaggacattctctaaggtgctaaatcaggagatgaaatttggatactgtgacttctggaggagaggaaagttatgcagtgtttgttactgttaattaccagaagaactaggacaaggcgacggagactgaagaggtagct

SEQ ID NO: 8259 - DNA, 3000 bp, Unknown; identical to SEQ ID NO: 8253
  misc_feature (1)..( 3000): cDNA_ID_1010644_gDNA_ID_1621202_Annot_ID_174983 3000 nt of promoter + ATG

SEQ ID NO: 8260 - DNA, 3000 bp, Unknown; identical to SEQ ID NO: 8252
  misc_feature (1)..( 3000): cDNA_ID_2127821_gDNA_ID_1621202_Annot_ID_174982 3000 nt of promoter + ATG

SEQ ID NO: 8261 - DNA, 3000 bp, Unknown; identical to SEQ ID NO: 8250
  misc_feature (1)..( 3000): cDNA_ID_2127813_gDNA_ID_1621202_Annot_ID_174980 3000 nt of promoter + ATG

SEQ ID NO: 8262 - DNA, 3000 bp, Unknown
  misc_feature (1)..( 3000): cDNA_ID_2127795_gDNA_ID_1621202_Annot_ID_174966 3000 nt of promoter + ATG
agatttctctcttgtaaaggaatcgtttgagccgaagaacgagtctcggaaattgaacaacaaacggaaacgggagagtttgcctgaagaagctaagaatgttccggaaatagacatggttaagctcagcaagaaattgaaagagaactttactattcttcgggatataaaagaggacgagagagtgagaatggagttgttgcagtctgaagagaaaaaaccattgaagaaacagaacaacgtggtgaagaagaaacttaagaaccctaaatccaaaaagcaaatttgaaaggctttttgttttcccgctttaacggttatatactttgcttaaattaaacgcttcaatgaaatttttcgagtacaattttgttaaagagtgaaatcaacaagaagagtatttttcattttattcacatccaccctggtaatcctaaaaacttgtgtttataagttatgatgttctcgtatattttcaggattatttattcgaactgattcttataaagtggtaccaacatcgtataaaaatccatcgtttatacaaaacaacgtagtcttacatgtgccatagagttgaaagatacgcaaatcatcctctaatccactaacagttcgccacaaaccgtttactttgttataaaaatagagatggagatctcagctaatgtatgttgtacgctgtgaacagcaaattgttccccacaaaaaaaaaaagtccagccgtacaacggtacaagaagatacggccatgttgagaccttttgttctagaccccattttaatacacctataactataagtctctcgtcgttactacaagatatttgctactttatactatatttttttcgaattatcataggtcttcaattaataagtacaaaaattcaataaaaaatatgtgtaatcattatagtggatttacatcttttcatagtgtattatccacgcaagactcacatcgcatcatatatctgaacttttcaatcaattaaatgttaggtgttgggacgatatcatggatatataattcatattgacttcaaatttaaaataattattattattatatagttgatgatgatccgtagtacggtacgtgaaataacttgtattttgtcacttcaattttatttcacagtacaaattaaattgataattttgagataaaatcgaaaaaacaattttcatatccaaatcatcaagacgaatttctccgatcactcaaataaaaaaggagaagatcgaagaacaaaaaaaaaacagaatcatcatcatctactctgtagatacatcttcaccagataacgatgcaatgagctccgatgtatcatcagcgatgccagatcggagagactctacaacctgctcgaacacgaatacgttacaaggaatatgaagaactcctttctgagtgtatccgtattcttgagctgatcgattcagcaatccaacgaaaacaggatgattcagcagctctgcactcaccacgaacctctccttatcttcgcctacgttgacgggaacgtgaccggaaggaacactcgacgcgacggttgctcgcttgaccaagaaaactgaagaggagtacgttgacgtcgggtgatggatatcgccgctgcgatttcggttgcaggaggatgagtctgcgattcgtgacagacgtcgaatcagaggcttcatctttgatcctagacagccaaaaatgctagagacagagagacataaatatgggagagaggtgtggactcacattaagcttatcagaaatgtgtatattaagtattattatattttgagatgacacaaaaatggtatttaatttatttcatacatatatgtgttaacataatgagtcatggtcaatttaacaattgaaagaactacctaattttgattatgcaatatgagaaattctctaaatttggtttattttcaaaactttcctcacttacattagtcaaattacaaataagaatagtaagggtaattgttaacaaatgtggattgctaaaatcaaattttgattattgtacaaattaattttagacttttttatgtatgatgaaatgtacagaataaaccaagagactatgtagataaaaatccgttgtatttattaatctatttcttaccatgaatacgtaattttcccgtttgatggtaaattaacatataaatacacagagacgagtggataagaaaaagacgtagtatttattaatttactttttatttgctttccatgtatatatattttcatatatatataaaagaaaaagagtataatttagcaaaataacaaaaatataaatattgatagatggtttttgtatcataatttatttaattgtatttctggaattaatattcttctttgactagatttcataagaaagtaaacgaacacaaaattaatgttcatctttgactttttttggagggaaaagagtgtttaaacgtgggagaacaagaaacaaagcttgtagccaaattaaatagaagacaaataatcattagtgagaaaaattcttagattcctaatcttctttgtgtcttttccatcaaaccctaaaaagattcacgtaagagatgtcgagatttttggaatagtcaaagaaggtcgatcggattttgagctccctattgagattctatcgataattccgacggattctttcgagcaactggatctcgcgaagaggcgattatctgtaaagtgtcgaatttggaggaagaggtggtcgaattgaggaagaaactccatgagatggaaatgagtattcacgagcttgaaagggatgtctaggcgtggttagttttcgacgttttcaaaattaacacttaaacttatttttaaaaagtaaactgtaaaattaacatggttttagttaaaatttatcagttattttaaaattgttctaattttttttagtgaaaattattattattttttaaaaatgagtttaagtgttaaatctatattacgtgaaaacc

SEQ ID NO: 8263 - DNA, 3000 bp, Unknown; identical to SEQ ID NO: 8248
  misc_feature (1)..( 3000): cDNA_ID_2127789_gDNA_ID_1621202_Annot_ID_174964 3000 nt of promoter + ATG

SEQ ID NO: 8264 - DNA, 3000 bp, Unknown; identical to SEQ ID NO: 8247
  misc_feature (1)..( 3000): cDNA_ID_3048018_gDNA_ID_1621202_Annot_ID_174960 3000 nt of promoter + ATG

SEQ ID NO: 8265 - DNA, 3000 bp, Unknown; identical to SEQ ID NO: 8246
  misc_feature (1)..( 3000): cDNA_ID_2990119_gDNA_ID_1621202_Annot_ID_174959 3000 nt of promoter + ATG

SEQ ID NO: 8266 - DNA, 3000 bp, Unknown
  misc_feature (1)..( 3000): cDNA_ID_3048022_gDNA_ID_1621202_Annot_ID_174956 3000 nt of promoter + ATG
attgatccttgtcacgcggtttcttaggatcttttgtcccttctattccaaatttttaattcctatgccgtttttttcttctatataagcggtaaatatcatctctattggttgcagatcgtcgaggcaccggaattgctccgataaatctctcattcttctctgtcatcgatttaggtttcgtctgatttctcttgttacatctgttttatctaaccacaattacctctgttctatttcgtctctgctaattgaaggatgtggttgatctgtcgtcgctcccttttactttctggcggtttcttctttccctttgcttcctttttggagttcttagattacctgatttcttttcttttctgaatttctggagaaatttctacgtgttagattgtgtagatgttgaaggcattgttggagggaggatggtttacgtatgagttggtgtttttggtttcttctcttctatacaacttttggtctaattattgttttatttaatattggctaatgttggtgaggtatgatttcgttctctgtgtcttgttgtgttttccagattctcttcatcaatcaattcagtctgtttctcttctgtgtacacattcagatgaaagatgaacatatattccttgcagacgagttttttcctatctcttgtcctttttataagtagttattctattgaagtcttcaagtttctcagtaatgctatgtcttagctcctctcatgtggtttattcaggttttgttcctctttgcctccgggatctgttgcaatctatttgttctaacatacgccctggttaactggtctattcctctttctctctatttatagtgtttgatcctactctcttatgcttgtgacggtgtttttttttatgttaagtgtcccattcttttaggttttttgaagatgcaaagaaggctagttctgtctcagtgtattctgaaagatatctttgatctgtcgtggttcctgttacctttctggcggtgtcttatctccctttgttttctttttaaggtttttaatttccctattacctgatgtttttgtcgttttaaatcgtagaggtcaaggcattgttggagggaaggatggtatgagtttaattttgtgtttctggttacttctcatctacacacttttttccccctaattgttttatctaatattggctattattgtcagtgaggtatgatttgtcctctgtgtcttatgtttcccagaattttcttcaccaatcacttcactacgtttctctgctgtgtacacacttgaaagatgatcatatattccttccaaacgagtttgttcttataccttgtccttttaagtagtttttgtactgagcattttcaaatatcttaggatatctatctctgagctcctctgatggagaaggcttggcctgaggtctggactgtaccatcagggagttctcaacatgacttgatttttgatttttcaggttaaaggtagattttcgtagcgatgttggcatttctgttttaagcctaaggccctgtcttttgttatagatattcaagcttataaaagggaaaaggttcaggtttactaaatggattctttcccctttatctctgttggtgttatctctcatgctacatctatattagtgatggcttgtttttatgtatgtcaagtgctccgctcccctatataggtatgttgaggatgcaaaggtggcaagttctactttgatctatttttctcgaaattttcatctacagtcctcttttcattggagatgtctctatttctggttctatgctctgcattttcctatggtttaaatgctaatcacttcggctcgagatctactctttctacatgaattcattatcttcatataggaatttggatgatgctaggacgattctgtttcgacctgttcgcctagatttattggcaacgagggatggatgtaatcagcttttcttcccttatctgttttccctttctggttatgtaatctgcatcttctctatggtaatctcttctgcttcagatgaaatcattatcttcacataggagtttgtcttcacataggagtttggatgttgcagtggaagttctgtttcggcctgcttgcctacatcgccctatatctgttacatcatgagtttatgaggtggcttatttctattgatatctatagtgttgattgccgaggaaggaaaaacaagtttcaaccgtggaccgtggttgtctcaacagggatgaacttggaggttccatctctggttggattcaggtgttttgagctaatcttcttctgggtttacttctctaccatactttctaccgatttgaagatttgtcttctgtacctttgatgatgattctcagttttgcagcaatgactcagtttttcgccttctagtcattaaactactttcccacaatgagatacttagtgtttttgtaggttctttcacacttgttagcaagggtatatgtatgttgccgttctcagaatttggtaggtatgaatcacagatgtcattgtttattattgataacataagtgattcttgctggtagtgtgacctcttgagggcaggctcatagaagatgaagagcctcttggttttgatgataatgctccctacttctgagttctgaggtttctttattcctgggttgtagctggtttaatggttctgtagacatttgataatgaagtctctcacttcattttgtttgggtgatgtaaaatgttgtcagtggattttaggtgaggcttaatctcatggattattcttttgaaatcccctcaggtgaatcagtgaaaattgagaaagtgatgttcaacttcttatctcttaatccttcatttgctctgtcacacattgaagcctattttcggttgcagtttgttaagttttcatgggaagcgttgtctttggagtgttctgaagttgactttaatcctgaaagaagaaggatatgcttttactgaagttatc

SEQ ID NO: 8267 - DNA, 3000 bp, Unknown
  misc_feature (1)..( 3000): cDNA_ID_3048031_gDNA_ID_1621202_Annot_ID_174949 3000 nt of promoter + ATG
aatgacaaaacgtggcaccttgtaattctcttaagctccataattttggcttattgtattaaatagttccatatggtgtttcttatttttttttggcctatttggctttttatgtggtgttgacaattataacttgatccctaagcaatatctactttggatataatacaaatggagcaaaaacacaacactttcatttttgaagaaaattatgtaaggtgattgtgtgtttattagtagtcccaatctaatagagagaaattaaattctaggagtgatcattttctaggatagttaaaacttatggatgactttcatatgagtttagatctggattttggtggggggacataagaaatatagatgcatatgtaagtgtacacaaatgaatgggccacttgacacctaatgatacaaattttcaaagaaaactcagattgcaataatggaagcatatcaatagtagtatgagatctcaatctacaatcttcaataacatttaaaaaataaaatccaacaacaactgtagcgtataggaattgttcatctcttttcatcaaagaatatttaaaattttgttagacaagaattaattaatgatttatatggttgagaaaactttttaaaaagttgtaaaactcatcgaataataaatcatttttaatggaaaatatagtttttatttttattgtgtggtattgctcggactcaaggatacatggagagagaggcagagtcaaatccaatttttcaactatcttatatgatattcttctgtgctttttatagtttgcccgaccataagaactggtcctaactttcattttttttgtttccatagaatatgtattcctatgatttttttttatagaattaattgtgttagttaatgccaaattaagattctcttttttaaaatcactttttgaagaagcacttacaagagagttgtgttaagaatagattccagatggaaaagttggcaagaaaagatgttttaagtttttgccttgtcgtctaatccaacggtcgatcttcgttcatatcaagaatccttatgacgtggaccattctcttccctccatctgtacctcttcccaacctctattttttaatttacatcgaaaataaataagaaggattgcaaaagaaaaaatagaaaaaaaactctctgttcttctttcttcttcttcttcgtcgtaagccattaccatttcttctccctctctctgtttttctttgttgcgtatctgtacttagttttcaaacataaaaataaaacatatctttagctgatgttgtcttcttcttgataaacagattttctacagctttttttctttctaatttaataattcttgagactttttaaaaccctctgcgaaacagatgattcgagttttggtttcttcatctgtgttttgattttttcgtcttttattcttagtcaaacacataaatttcttttactactcttcgtagatgacttctcatgttccaaaacatcctcgtaaatgtactctttctctctttctttcctacacacacgtgtttaatctgtgttgttcttacacgtctttttaacttttgcgtttgaccttttatctgaatcctgtgtttgtgtgtctgtaaatatatatatgtgtgtctatgtgtatagtgctctgtttcttgtgattagactcatatgtcttattttcaatattaactataaatatataagtcacgcctagttattagtttttatcggtacgactaaatattcagacatcagttcacgtttcaaacctgtctcttcacatagttaagaaaataaaggcatcaaaaagattactagtaatgtttgtgtctactttatacatacatatgtcttgtttctttgtgtttttcagaatctgatctcttcgggaacgtttgtttaatttgtttcagcctttgaagatatggtgaagaatcttaaagtggatcctcttgctaaggtcactgcctccaccacttccatggtaataaagattctctcttctctgtttattacagatgattcatatgttttggttcttaggatgatttatcagttatgtgtttttgtgttccttttgttttgcaacattaaaggtttctgcaaaagagaataagaatcagtcagaggcagagccatcatattatgaaactcttgagacatatcaaggcctgccttgtccttatggtggctactatggatactactatccaggttttgcttctttttacacactgatactatataatatgtactcaattctgcttttagatgatcataatctgaattagcgtgtttttacaggtcttgatggttcagttggagaagcaaaggataatggatactatggttatggaacagaagttcagtacccggtaatcaaaacttccttgtcatgaagagaatgaattactcactcgggtgactcgatctttttaactgaccattttcttgatcttgattttaaggtaatgcaaggggaaaatgggtctgtgatctacttgatgccagggtttcagtcttatgatgcaagccaaacttatatgcctataaacccggttggtgtatcgagtcaagcacttcattcgccgatgtatgctgctcagggttattatcagaaccaatttggttatgcagatgtttcatcgcccacatatttatgggaccctgttggagacaggtatgtgtatggtgttgcttcatataccccacccttgaaacagaacatatcttcttcaagtcataaccacaacaattattattcaaagagcaagaactccttcacgggtcacggcatgggagatcgtcctaaaacaccgcgaaaagtaacatttacactctttaattcttctctctttcacattacctgaagaggtttgactcatctttttttctttgtattgatgctataggcatcacagaacagctatgccccacccccactgcttaaccaagaaaaaggtcgcattgcttacccgatg

SEQ ID NO: 8268 - DNA, 3000 bp, Unknown
  misc_feature (1)..( 3000): cDNA_ID_3048035_gDNA_ID_1621202_Annot_ID_174948 3000 nt of promoter + ATG
tctttctactgacatacctttggtccagacgggttgacaattctgggaccagcaacatgatagaggaaagccaagcagttatttctaaggttcctgctggtgtgtcaggaactgcactagcagcttcactcttacgtgatggatggagtgtgagttttagtcttagtatacacttccagtttacagtgtttcaactctgtttgtggtgtatatatcactctttttatcttgcagctggccaaaatttatgagaagtatcaggaggctgttgatgccatgaggcatgagcaattaggtagaaaggaagctgagatgatacttcaacgggtatgatctatttaacttgttattaccaggtctttgtttaaaatttagatttccaatcttttccacttttgttttgtctatattctctatgtttcactagtgatttttcaactgcagttcactaatgacttgagaataatatttttcttctcctgttaacttactcttggtatcctgctttgtaggtgttatccgaattagaagagaaagccggatttatccaagaagaaagaggtatgatctacttctgtgcttctggagccatatgttttacgctcccaaagatttctttcactagtaatatatttgtatcttgttggagacacgcttaaatctgtttttgttcccaggggagtatgagagggtggttgaagcttattgtctagttaatcaaaaactccaggattctgtatctgaacaatcaaatatggagaagttcattatggagctaaaggtacctgatattgttatagtggttgttcaagatgcgttcttgtgctgttcttatacatttatcttattgataggctgacttgaggagacgggaacgtgaaaacacactattgcagaaagatatatctgacctacagaaacaggtaatttgatgatctattcttcgctgttcagtgttcaccatgtttgttgtggtcttcagtttcttgattaccttaacttgcaatgttaattgttgagactttgtctcactaatgtatgcctggttgttgcccaatcgattgatactgtgtttgtttctactatttaggttacgatactactgaaggaatgtcgtgacgtccaacttcgatgtggagctgccagggatgatgatgaagatgattatcctctgctctctgatgtggagatggaaatggaatctgaagctgataaaatcatttctgagcatcttgtaagtttgtttctttatctcgacgtcatgttttgtgttagattttattttgtaaaataaattgtggatgactaatgcttgtcctcatgttgggatgaatttcagctaaagttcaaagatataaatggactagttgagcagaatgttaagctgagaaaccttgttcgtagtctttcagagcagattgaaagtagggaaacagagctgaaggtatgaaggattttgcatgcatagtttctttggtagggtgtgaagttttaaaagaatttgtgtaacgtcaggaaacgtttgaggtagacctgaagaataagactgatgaagcttctgccaaggtagctaccgtgctaaaaagagctgaagagcagggacaaatgattgaatccctgcacacatctgtaagtatttccaccctccaaatcttttctctatcgcagcacttggtaaattgatgttgggtttcttttcaacggtttatttattttgtacatttttcgtccttttcaggttgcaatgtataagcggttatatgaagaggaacagaaacttcattcatctgattctcgttcttcagatttgtctccaggttctacttctatgcattattacgagtttactgcactatgtgttcttagataccctctattattgacctcatggctaagtttaattgaattaaatgatgtttcagttttatcttagaaccagttcttttcaaaattttaccccaaatgtcatcaaggtttagtgctgttctcaaattcaaacgaaatctatatttggaacagctaccaaagtttggtcttattttcgtatatctcaattgtcagtaatgaaaattaatgctgtacgcacaaattttgaagtgtattctggcttttcaagcataatccactttcctggaaatctcatcttgtttccttaaagtaaagaggtttgcaggctgttacatgctttgctcataaaattgaatcatagtctcagtggcactctagcttttcgaatgggtgacagagatgtattcttgtagctgtagtgccaggaaggaagaacttcttacatctgcttgaggattcagaggtatgacagattgctaaatcattctattctcttctttgttgtccacttttctagggtatcaaatttgttgtttggaactcaccttattggctgaattgcttgttccaggaagctactaaaagagcccaagaaaaagcttttgaacgcatccggattctcgaagaagattttgcgaaggctaggtatatttatcatcctcttgtcttttgtctttcatttcttactgggcaagtgattatttttgtgcaaaaagttttgtttgataaactagggtacctctgggtatgtaacacattttctagttggatagtcaagttgagagctaggacccagactatactagcgaaggaaataaagtgtggaaagcgtagtatctagtgtgaaacgtgtttgcagatgcaggtggattgctgaaaatactaatctgagcttatgtgtttgcaatcccagtgtcgatgtcctatagaagttataatcgtacgtcttgatacatagagaaacaacatgaaaaactggattgtatcttatgcagcatatccatgaaacgtaaactgtagttattgatttttgtcattgtttcctgtaaatttattttactgaacattataaactgcgttgttttcatctttcccctttggatttttaggagtgaagtaattgcaataaggtctgaacgggataagttggcg

SEQ ID NO: 8269 - DNA, 3000 bp, Unknown
  misc_feature (1)..( 3000): cDNA_ID_3048039_gDNA_ID_1621202_Annot_ID_174947 3000 nt of promoter + ATG
acaaaaataaattatcttcattgctttaaaaagcttaaacattattctatttaaaaagttaagaacatttgaacacaacttgctgatgttcacactataacgagcataaaataaaataaaaatacattcttcgatttaatagtagactttacttgatccattcaggtcttatcaatgaaaacaaagactacagagagcttgttggtacataataattagcgtagatgaagggtaatattccaaataaacatgatcttcaagaatttatttcaataaatcaatttcataagagattacataccatttttttttaccatgttcactagaagtctagaatccaaaaaatagacttgcgcgaaagaagagtctctaatcagtaaccacaccatatagttacttagcatataaacggagcattcacaaagcggtcattgcaatacaatcctggtctctgaataaacatctgtttcttcagaatctctcttgccctcaataccatttccttgtttgtaatcttatctttatgatcagtctctgacaaaaccatttggatggcattactaaacgctccaaacgcttctcctttcttcttaacatctgctgatgtctcatctgtttgacatccactcaacagaatccctcggtcaggaaacaatccgttgcttgatcttcctccataaatctcacgatcgctcttcacttgtgcctgcattgcgggtttcatgtagtgttcatcgttcagcgtctcttctatataccctcgagcactttcttcgatcttaccaagtagcgtactttggtcatttgttttccttagcttggtaagaatcactttcatgaacttctttatcttcgggctcgaatcttcaccaaagacatcaaaaagggtgggtctgattttcccaatctcgatattgtcttgcccagtttgttgtttgagaagttcaataaacctctccaacggcagataccttgatctgacaacttcatctccctcgcctacttctacgatctcgcgcgtctctacatgagaacttccgattccacaaaaagcaagcagtttcacaaaaatgctatgcaaacagtttttaaactcgaattcaaaagaagaaactttggattctcgatttggcttcgtcgtggtactctctccgatctgttccttagcttcatcaatgagcccgccgctgtgacaagagtctgatacgatagttatctgacatccctctggaacttgttccactaaatccctgaaatcatcatctggcaatgcaacacacaaaacagcgtagatatataaaaaaaaaaacctcaatcatttctattagtgtccatgtcaacataattcaaaactagccttgagacttaacagagtcaaagagaggggtaaacagattctaaacagagcactctgttttaaacagagcactctgtttttcttcattaaactaaggaaccattccataataaactcttaccaggaattggattcaagtcggaaggaacaatacactcatcaaaacctgtatcatcctcttcccctgtttccggtgggactctcgtgccgtgtccgctgtaatgcacgaataaaacgtcaccggattttgctggctttatgagctccgacaaagcctgacggatgttctttcctgtgggttgagtgtaagattcgtcggtgtcaatcagcacagtgatatcttcctccgcgaatccgaaccggtcaacgagacacttatgcattctatggacgtcattgacgcagccttgtagctcctccgtggttcctggatagttgattcctatcaacaacgctctctttgccattcttgcaaccttcaagagttctttgtcggagaaaaaacttccgctggatctaacgattcttcaatgagatttgtgatgaagattaacattaaaatactaaacattattggcttagtgggaactaactttatgtttctctatttaaatgatggcacgtgaaaattgtggactaattatcaaaaaacataaaacaaatcgccgtctgtggggatcgaacccacggccacgtggttaaaagccacgcgctctaccactgagctaagacggcgagctgatacaacatttcgtaattaattattaaacttaattttaatccgcatgtgtttaaggttcttctataattagtctaagttagcaaaaattacatagtgatgatgatttgtaaggccaagtgaaactatatcatcaggatcgtgatcctataatggatgtttttcttaagtgattttatagcaaagccaaatgaaatcttaagttattctttttttacaaggttcagtgttttaggtcttatcttttgtgtaacacctactttcatataatgatatttatactcttagcgaaaaaaaaatgaaatcttgaacactaatcagtaaaaattgtcaaaaaaaaaaaagaacactaatcagtaataacctattgcgatgagtatcaagtcgacagcaggttcactttaccatttttctcacaatgttggggaataagaaatgaagaattaaaaagaatttttaagttttgcctattttttgacagaaagaaagaatatttttcctatatattttaaaaacaaatcaaaacgccgtctgtggggatcgaacccacggccacgtggttaaaagccacgcgctctaccactgagctaagacggctgaacaataattaaatcataataacattcaaagcataacctaatcagatatgttgaagcccaacaagaggcctaatatctctattcggcccaactaacataacaacgacgtttaattgacgcctggggttttctgtctccggcatagcataatttttcgtcctcccgaagcgctttttcatcttcctttgttctgggtttctctccaaaaatcgccggagaaattcaaatcgtcatctctaattcgtcggagaatccaccgttaggtatataaacacggtttgtttctgaaattagggtacgaaaaa

SEQ ID NO: 8270 - DNA, 3000 bp, Unknown; identical to SEQ ID NO: 8241
  misc_feature (1)..( 3000): cDNA_ID_1841710_gDNA_ID_1621202_Annot_ID_174941 3000 nt of promoter + ATG

SEQ ID NO: 8271 - DNA, 3000 bp, Unknown
  misc_feature (1)..( 3000): cDNA_ID_3047984_gDNA_ID_1621202_Annot_ID_174990 3000 nt of promoter + ATG
gcccattaaattttagggcccaaaaattaaaaagtttcattacgaattcgttcattggttggtttttttttttttctgaataggttgaataatttggttatcccaaagccataatatttttgtttatctgatttatctcctgttcaaatgacttacctaacgcgatctggctgagtgaaaatcaatactaaaagattggataaatttgtgattgtaaatttgtaattggattaaaatcaacaatatagccaatatagcaatctatttagattttaaggcatttttgtatataacaaataaattaacctcgctcgtgaattaaaaactcacttgcattcgccacaagagatcactgcaacctttaacacggggacggttgtctaaatagttccggcgagcatcttcgacggcggctcgttcctcaggtgtgccggctttgggatcaaactcccatgtttgacgtccgacgaagttgttgctgctgaacaagtaaggatcttctccatttccctctcctatcttcaacttccacataacgatggtcctagctatgtatagttacgtgtacatatatatactcaacgagtttagaatttcatagaaataatcaaatgatagtatattagagagtccagtttgtaaacaggcgtacggtatatatagataaaaaaaccatgtattaaaagatcccttatgttatgaatatgagatggagagagggtaagagagataagagagtgaccgagagaatacttgtgctgggtcgatgtttgttttgcgattgatgattatactttggggagtttcatgtacgtatgtttatatatatagaggtaggcctccatacagtatgacaattgaataagaataatttggggatattatatgtacagtatgtaagagcatcattatccatgagttcttaagaatatgaaaaaatttcttaaaatattatataaaataaaataagaatttaaaatataagaaatgactcttaaaagaggaaaatggttcttagataagagatatttgctacattctctcttcttgttaagagccccttaatatttaattattattttgtatatcaaaatgttaagaattttgtgtaaaaactcaccattaaggatggtctaagtatgtatagtttacgaacattaaagacaaagcttaaagttgttgacatgaaaattacactcttcaactctacgcagcttaattgtagttacaaagttttctctccttctcttgtttttaggtttttattttatttctcaataatgtcttattgcgataacatcgtattatttgcttttaggagtatatataaatgaactcagaagacttctcgaatttttgctcattatgataaacagatattagttcttattatctaatactagctagtttgtagttaggttccatataattaaataatcagtcccatatcacaatatcaaagtcatatatataatcaaactcatttaacaaatgaaatggtggtccacctgtttagttcatgcaacttaatagagaatatgtgtacttttaaaaacactttaatttgattttacttggggagagtgtagagaccactcaaataaacgccgtataaaaaagttagaaacgatacggtcgcacttaattaccacaccgcaagaagaaacgatacggtcgcacttaagagatcaaagctttttctgtggtacgcatcccatgttacacgtggccgtatgtataagcgtaaattgcgattgacaaattgagttagctctctttcactctcactacatatgtttttgtcaaattactatatttagatcataacgatcatgtgcgtcctacatttttatacgaacatttgtccactctgcatcaaatacggtgcacgattcgtttattgttaggtcgaccaccggtcatgattaaatgctgattgatacattttaattttggttcctttttataatggtataatgtgcagtaacagttgggattgaattacatacggttaaaaaacaagtggcgattatgaatgatttgttagtcgttcacaaaaacaacgacgattcattttttttgtcattatgtatagggatcccttgtgtgaattatcgccacttgttttttgatgaacatatattgatgaacacgtgaattatcgtgaaaagaaggctctgctattttgtcatctaatcccctagctactttcctcctataataaaatgatttcataaatattttacggttttagtttaacataaatttagtgagcttaacatgtttatatttaatatttatggccactcgatagaaacattagaaaagaaaagggaaattggtttaatacatcccaactagatcgtaaatttaaacttcataaattctaagtgtgtccaacgctcatattcacaaccggacatttgaaatccaccgtctacaaccaaacttatcctagggctttaaatacaccctttgtttcggatgacaatctaaacccctggtttttagctactacgctactctctagataaatgagataactcttcattgatactcacgtcacgtacaaatcactcccaattacaaatcaatttatcttcttttctcaactttaatataattgacgagttttttcctcgagtctgacaaaaaaaccaaaaaaaaaaggtttagtatttagggctggactcaaattatacaaacacttgcggaatatcgtatgggctttgggtgctaagtgaggcgacatgaagatattactggcaaatattcagtcacgaaccattttataaggttgactaacaaaagtatgcatgcaaactaccgttgaaatgtgacttcaaaacgaattatgtatgtatgtgtgtgcgtgtaaatgaattcaatttcacacacttctcttctttaattttctccacatatattacgtgcatctcaatgcacgatgcataaaatatgccatatctttagattattaaattaattaaggtctaaaga

SEQ ID NO: 8272 - DNA, 3000 bp, Unknown
  misc_feature (1)..( 3000): cDNA_ID_2104927_gDNA_ID_1621202_Annot_ID_174989 3000 nt of promoter + ATG
taacagtctatatatatatatatatatatatatttaacaaataggatcgcacaaattggacttgacactaacaaattgtttatgaagcttaaaaattgtttcagaatacccaaaatatagtataaaggtgctcaagaataaaattgtttcttgaattactgttttttcaagcttcatatttttttttttgttgaattctggataaagacagggtaacaattattaattagctagcacgagagagacatcacttcacttcatactctgtacgtttaattcataaactatgttgacacgcacaaaaagtaaagaaaaatagataaatacctgcatacgccatatgagatcgctgctagctttaacacgaaaacgatcatcataaaatttccgacgagcttcttcgacggcagctagttcctccactgtgccggcgtccggatcaaactcccatgtctgtcttccgaggaagttgttggtactgaacaagtagggctcttctttgtttccatttgctatcttcaacttccacattctttagaccttaattaatttaataatctaaagatatggcatattttatgcatcgtgcattgagatgcacgtaatatatgtggagaaaattaaagaagagaagtgtgtgaaattgaattcatttacacgcacacacatacatacataattcgttttgaagtcacatttcaacggtagtttgcatgcatacttttgttagtcaaccttataaaatggttcgtgactgaatatttgccagtaatatcttcatgtcgcctcacttagcacccaaagcccatacgatattccgcaagtgtttgtataatttgagtccagccctaaatactaaaccttttttttttggtttttttgtcagactcgaggaaaaaactcgtcaattatattaaagttgagaaaagaagataaattgatttgtaattgggagtgatttgtacgtgacgtgagtatcaatgaagagttatctcatttatctagagagtagcgtagtagctaaaaaccaggggtttagattgtcatccgaaacaaagggtgtatttaaagccctaggataagtttggttgtagacggtggatttcaaatgtccggttgtgaatatgagcgttggacacacttagaatttatgaagtttaaatttacgatctagttgggatgtattaaaccaatttcccttttcttttctaatgtttctatcgagtggccataaatattaaatataaacatgttaagctcactaaatttatgttaaactaaaaccgtaaaatatttatgaaatcattttattataggaggaaagtagctaggggattagatgacaaaatagcagagccttcttttcacgataattcacgtgttcatcaatatatgttcatcaaaaaacaagtggcgataattcacacaagggatccctatacataatgacaaaaaaaatgaatcgtcgttgtttttgtgaacgactaacaaatcattcataatcgccacttgttttttaaccgtatgtaattcaatcccaactgttactgcacattataccattataaaaaggaaccaaaattaaaatgtatcaatcagcatttaatcatgaccggtggtcgacctaacaataaacgaatcgtgcaccgtatttgatgcagagtggacaaatgttcgtataaaaatgtaggacgcacatgatcgttatgatctaaatatagtaatttgacaaaaacatatgtagtgagagtgaaagagagctaactcaatttgtcaatcgcaatttacgcttatacatacggccacgtgtaacatgggatgcgtaccacagaaaaagctttgatctcttaagtgcgaccgtatcgtttcttcttgcggtgtggtaattaagtgcgaccgtatcgtttctaacttttttatacggcgtttatttgagtggtctctacactctccccaagtaaaatcaaattaaagtgtttttaaaagtacacatattctctattaagttgcatgaactaaacaggtggaccaccatttcatttgttaaatgagtttgattatatatatgactttgatattgtgatatgggactgattatttaattatatggaacctaactacaaactagctagtattagataataagaactaatatctgtttatcataatgagcaaaaattcgagaagtcttctgagttcatttatatatactcctaaaagcaaataatacgatgttatcgcaataagacattattgagaaataaaataaaaacctaaaaacaagagaaggagagaaaactttgtaactacaattaagctgcgtagagttgaagagtgtaattttcatgtcaacaactttaagctttgtctttaatgttcgtaaactatacatacttagaccatccttaatggtgagtttttacacaaaattcttaacattttgatatacaaaataataattaaatattaaggggctcttaacaagaagagagaatgtagcaaatatctcttatctaagaaccattttcctcttttaagagtcatttcttatattttaaattcttattttattttatataatattttaagaaattttttcatattcttaagaactcatggataatgatgctcttacatactgtacatataatatccccaaattattcttattcaattgtcatactgtatggaggcctacctctatatatataaacatacgtacatgaaactccccaaagtataatcatcaatcgcaaaacaaacatcgacccagcacaagtattctctcggtcactctcttatctctcttaccctctctccatctcatattcataacataagggatcttttaatacatggtttttttatctatatataccgtacgcctgtttacaaactggactctctaatatactatcatttgattatttctatgaaattctaaactcgttgagtatatatatgtacacgtaactatacatagctaggaccatcgttatg

SEQ ID NO: 8273 - DNA, 3000 bp, Unknown; identical to SEQ ID NO: 8240
  misc_feature (1)..( 3000): cDNA_ID_3048044_gDNA_ID_1621202_Annot_ID_174940 3000 nt of promoter + ATG

SEQ ID NO: 8274 - DNA, 3000 bp, Unknown
  misc_feature (1)..( 3000): cDNA_ID_1810916_gDNA_ID_1621202_Annot_ID_57719 3000 nt of promoter + ATG
ttgtcatccagaaattcagaagacgccaaaatctgataaactacgagagtggtcagttcatttacctttttgggatgaacttcgtaaactttcatatgaaaaagtcatttacatcatccaactgcccacgttgttattcgcaggtacttagcaatgttgagaaaagcttcaaaggagggcattgttgcagaaactatcaatctatatgaccattttttcatgcaaactggtgaatgtagagctaaggttacagcagctaggctcccgtattttgacggtgactactggccaggtgcagcagaggatcttatataccaaatgagtcaagaagaagatggaagaaagggaaataagaaaggaatgctcaagaaaaccattactaaaagggctctaaaagcttctggtcagactgatctatctgggaatgcttccaaggatctgcttctaatgcatagagtaatattttctttctatgaatattgcttcctttttgtatatatttttttctcatttgttttgtttttcttgttaatcatattcacctgttttaccgattcccagctcggtgagaccattcacccgatgaaggaggactttatcatggtccacttgcagccttcttgcactcattgctgcatactgatggtatctggtaatcgttgggtctgcagccagtgcaaacacttccagatttgtgacaagtaagaattctttcgaggtctttttgctctttgattttataatcccttctttgttgtattgcacataagattatgtagaagtcccgagagatacatttattggatgggctatgtgtccttgttactgattaagttcctctgaatctaaaatgtcattcttctttttaggtgttacgaggctgagcagagacgtgaagacagggaaaggcatcctgttaattttaaggataagcatgcgttgtatccagtgagttgcattttcttgttgaggatagtgttctttagctttgtctatgatcagttttgtgaatattggtggtattgatatcgcaggttgagattatggatattcctgcagatacaagagacaaagatgaaatactcgaaagcgagtttttcgacactagacaagcatttctgagtctttgtcaagggaaccattatcagtatgatacattgaggcgggcaaaacattcgtccatgatggtcctttatcatctacataacccaaccgctcctgcctttgtcacgacctgcaatgcgtgtcatcttgacattgaaactggtcaaggctggcgctgtgaagtatgtccagactacgatgtgtgcaatgcctgtttcagtagagatggtggagttaatcatcctcacaagttgacgaatcatccatctttagctgatcaaaatgctcaaaacaaagaagcgaggcaattgcgagtcttgcaggtatacactatactgttcctttctaaaactgatggtgcttctctcttggtcctgaaatttgtatgcaaatagtaacattttttttttgttctcttcttttggttttgcagcttaggaaaatgctcgatcttctggtacatgcatcacaatgtcgttcggcacattgtcaatatccgaattgccggaaagtgaaagggctattccgacatggtatcaactgcaaagtacgtgcttcgggaggttgtgttctatgcaaaaaaatgtggtatctcctgcaactccatgctcgggcctgcaaggaatcagagtgccatgtacctcgttgcaggtaaacaaacctcatgaaattacatcaaccttacatttaagacgtgaaacatatttggtccatttgattttgtgttgatgatcattgtgaacatctctgtctctctgttcagggacctaaaggagcatctgagaagattacagcagcaatcagattcacggcgcagagcagctgtaatggaaatgatgagacaaagagctgcagaagtcgctgggggctcaggttaaaaaaaacttgtatatttagaaagatcaattcaaagttgcaaaaactttcatccttctctcgaaggtaacaccttttggaagaagaagaagaagagccagttagagagagacagattgtgaaattagcttagattggtatttaacagtcacgggtcagggattaacatgcgagctttaaaccaaggatgccactttccagaagaagaagaaagagagcaatgccagccttcttcacagatgacaagagtgttgagagattcaggtttgatggggtttggttggctgatcttctgattctatctatacatacacacacgcgcacacacacacttgcccacttctatttttggtaatttattgtatttttgtaaaattgacatttctgattcgggaatggcaagagtgtaacatatacagtacgttaacgtgtttttttttttttttgttttttttttgtgtaagcaaagtaagataagagagaatagagagtctttagattctctaccactctttttttttggtaatttgtattgatgaaatttgtattcacactttgaatcaataataatttagttctttgattagatttgtaaacgtgcatgttttatttgcagttagtgtgttactgtgattgagaagaaggtttagagagacgaatcttaatgccacgtaagcaggagattctgataagtatctaactgggcgtttggtggagtttgagaagtatctaaattccaagccaccagaaacggacacgtgtctaaacaaggatagagtgtagaacgagaaccacttagcttaagcaagacagagagtctgatgagaaaactgcacaagaaaatcagcaagagtaatgataatacactgtccttcgtcatctctctatcgcgcgaaattgttatacaacagaggtagtagtaaatctcatcagtgtcagtgtcagagtcgcttggtgactcgatctgcggctgttcgtatatccacggcgacgatcggggctatagccgcggcggttatg

SEQ ID NO: 8275 - DNA, 3000 bp, Unknown; identical to SEQ ID NO: 8255
  misc_feature (1)..( 3000): cDNA_ID_1810909_gDNA_ID_1621202_Annot_ID_57721 3000 nt of promoter + ATG

SEQ ID NO: 8276 - DNA, 3000 bp, Unknown; identical to SEQ ID NO: 8272
  misc_feature (1)..( 3000): cDNA_ID_1810905_gDNA_ID_1621202_Annot_ID_57722 3000 nt of promoter + ATG

SEQ ID NO: 8277 - DNA, 3000 bp, Unknown; identical to SEQ ID NO: 8271
  misc_feature (1)..( 3000): cDNA_ID_1810901_gDNA_ID_1621202_Annot_ID_57723 3000 nt of promoter + ATG

SEQ ID NO: 8278 - DNA, 3000 bp, Unknown
  misc_feature (1)..( 3000): cDNA_ID_1810897_gDNA_ID_1621202_Annot_ID_57724 3000 nt of promoter + ATG
acgggaagcggtttgttggcccaataacgtctctgattttgcaactacgcaaagaactgtacttacagccttatgaagaaatcaattggatgaaagtccgccatctttgtgcaaaggtaagaatgttaggatgtatcgacatttctctttatgattttctttcatggaaaagaacacggatacattcctctactttaccttaggaagatacatattatccccgtccactggttcaagagttggtatgggacagtctttacatctttgcggagcctttccttgcacgttggccatttaacaagcttcttagggaaaaggctcttcaattggcaatgaaacacatacactatgaagatgaaaatagtcgttatatcaccattgggtgtgttgaaaaggtaaaaacaccttaccttaagacacaaagtattgagcatctggagttaacttcagtctctttctgcaggtactatgcatgctagcttgttgggttgaagacccgaatggggattatttcaagaagcacctctctagaatctccgattacttgtggatggctgaagatgggatgaaaatgcaggtatgtccatggagattggaaatccaatttgttacgtttactaaccttgagttggtaagaaatcgaattttttttgattatgcagagctttggaagtcaactatgggatacagggtttgcgatgcaagctttacttgcaagcaatctctccagtgaaatctctgatgtactcaggagaggacatgagttcataaagaattcacaggttcgatatctctgcagcatatactgtagcacaaggaactatttcttttgaaaaatggaacattagcttaaaattgataaacaattgaaggttggagagaacccttcaggtgattacaaaagcatgtaccgtcatatttcaaaaggagcatggactttttctgaccgagatcacggatggcaagtttcagactgcacagctcatggcttaaaggtaaccagccgttaaaactaaacacattgacatgttcttcagtggcatgagtactacatccttgctgttttctggtctcatagtgctgcctgctgttctcgatgttggcgccggatattgttggcccaaaacaagaccccgagagactacatgattctgttaatatcttgctctctttacaggtgagcattatcagacatagaatagaaccaacatcatcaaagaaacacccattttcaggtcgtgacagtttcacttgtttgcagagcaaaaacggaggtatgactgcctgggagcctgctggtgctcccaagtggttggaagtaagaaccaaaccccataattattttcaaacaaccaaaagatactttttaaaacatttgcggtcatgtaaccttcttcatgtatttgtctcagttgctcaatcccacagaaatgttttccgacattgtgattgagcatgagtacagtgaatgtacatcgtctgcaatccaagcattgagtcttttcaagcaactctaccctgatcacaggacaacagagatcaccgctttcatcaagaaagctgcggaatacctagaaaacatgcaaacacgtgatggttcatggtacactagcgattacgatttatctgaaattgttcacggaaatccaaactaacaagaaatgaaccattgttctttgaatctacaggtatgggaactggggcatttgcttcacgtacggtacatggtttgctcttgcaggcttagcagctgcgggtaagacttttaacgactgtgaggcaatacgcaaaggcgttcagtttcttcttgcagctcagaaagacaacggaggctggggagaaagctacctctcttgctccaaaaaggtacacacttgcacattttgatgaaatcaacttgatgtaggatcattcagtcactacaatcctcttgatctatgcagatatacatagcacaagtaggggagatatcaaacgtggtgcaaactgcttgggctttaatgggtctcattcactctggacaggttttaatcattcaatattgatcgacgaaaatacaattaattaatgaatcagtactatatatgaccagtgctttacacaacaggcagagagagatccgattcctcttcaccgtgctgcgaaacttatcatcaattcacaactggagagtggagattttcctcaacaggtacgtttcctacaccaaaatggctactatcatcttaaaacttccaaattctgtaatagctttactgatagaagtggaaaaaacaaagctaaaagctaattgtagtttgtttaattactttttcagcaagcaaccggagtgtttttgaagaattgcacattacactacgctgcatatagaaacattcatccgttgtgggcactcgcagaatatcgcgcgcgagtttcgttgccatgacgacacttttcataaacttttctttatatcagagaacatgtgaatttattaacctatcatcagtctattacaagaattcgtgtatgcgatatgtcaatgtttttagtcaatgttttctttttgtgtaccgtccattggaaggcatgtttcacatggtgaagatacagagatgcgtgatcgtctaaatttagactaggccatttgttacacttttttttttatgtttcttccaatttttcaacatgttgaacaaaagagtcaaaaccacacaaatgtgttattgtttctttatcttttttttgtgttatagaatctgaaattagattatcagccaaaaataaaacccttaaacaacaaccattagaaaaagaggaaattctccaacccattaatcttgcatctctacttcatttgcttcctccataaagaatctttgatcaatcaaactctattttttttttgtcaaatcaaagtgaagttttctcttttgcatcataaagactcaagagagggaagagatacttttcttccttttgttcaataataataatatatatatagagaagaagaga

SEQ ID NO: 8279 - DNA, 3000 bp, Unknown
  misc_feature (1)..( 3000): cDNA_ID_1810893_gDNA_ID_1621202_Annot_ID_57725 3000 nt of promoter + ATG
tccttccactgctattgttcccgtaaagaggtattctctgaatcaaaaacccttaaaggtccttactttgaacaaccctaatcgattctgtttgagcagataaattgtcgagacattttgctggaagacgcagacaaagttcgagccattaccgaatatgtttcatcttctgcaattgagaacttagtcgttggatctgcatcacgtaatggcttcatgaggtaattaaagttaccttctttcagattctgtaacaaaaagtttggatttttgttcaaaggattctgtttttgatgactctgagcagaagattcaagacggatttgccaacaacagtgtcaaaatcagctccagatttctgcaatgtttatgtcatttcaaaaggcaaaattgcttcagtacgaaatgcatcacgtcctgctccttaccaaaattcgatgcagcaatgtgaaattgacaatcatcacccacatactcctgacaaagcaccaaagtaccatgaccatcccaattctgcaggtttagttcattcctctttgaaaagaataaaataagttctttgcttttccaaaagctgatccaattttgtgtgtttccattgattttgcaaacaggtagtacaccatctagaccgcgcaaatcagttgaagcagataggtataggaattggaagcttgttgtgatgtctttaaggttaatgtcttacataaagtcttaaaagattcaacatttatgttttcttgtagatcgccgttggtgaaaaggaagccatatggggacttctatgattcagatagtgacctttcgtttatcagtccgtcttctcatcgtgactctgacatttccttcatcagctcaggaagaccaagcgttgagcggtcttcctttagccttgattttcctgaatctgcaaggacttcaagaatgtcaacgagctcagagcaaagcattggctcaaatcgtttgggaattaagttcagtgatcctgatttccttaacgaatcctctacattctctgaagagagtggtagaacatcctcctattcatctcagagcttggttagtactattattactcaagctccttctctttttcttcttataaagattgaatacttgctaagatgggattgtcttgttgcaggatgatgttgaagctgaaatgaagaggctgcgtctagagctgaaacaaaccatggatatgtatagcacagcttgtaaagaagctttaagcgctagacaacaggtagtacttaatactaacatctaagtcaatgagattagtacatttgaatcaaatatcgatttttgaacttttaggcaacggagctgcaaaagctgagaaccgaagaggagagacggttggaagaagcaaaaagttcagaggaagcagcaatgtcaatagtggaaaaggagagagctaaagccaaagcagcgttggaagctgctgaagctgcaaagagattagcagaagtggaatctaaaagaaggttgactgcagagatgaagacaatgaaggaatcagattcattctctcgcggatttgttcggtataggaaatacacggttgacgaaatcgaagaagctacttcaaattttgcagagtctcaaaaggtaggagaaggaggctatggtcctgtctttagaggctttcttgatcacacaagtgttgctgttaaagttctacgcccagacgcagctcaagggagatcacagtttcagaaagaggtaaaaaaaaaatctttcttcgtttctgattttatacaagaaagttttcatctttgagtaacatatgtttatgttttctcaggttgaagtgttaagctgcataaggcatccaaacatggtgcttcttcttggagcttgtccagaatttgggattcttgtttatgaatacatggccaaaggaagtttagaagaccggcttttcatgcgaggaaacacaccgccgattacctggcagctacgtttcagaatcgctgctgagatcgccacgggactcctcttcctccaccagaccaaacctgaaccaattgtccacagagaccttaaaccaggaaatgttctgctcgattacaactatgtgagcaagatcagtgatgtcgggctagcgagattagtccctgcagtagcggaaaacgttacacagtacagagtcacttcagctgcaggaactttctgttacattgatcctgagtaccaacaaacaggaatgttgggtgtgaagtcagatgtttattctcttggaatcatgcttttgcagatcttaaccgcaaaacagccaatgggtttggcttattacgttgaacaagcgatcgaagaagggactcttaaggatatgcttgatccagcagtaccggactggcctatagaagaagctctatctttagcaaagctttcgcttcaatgcgcggaactaagaagaaaagatagacctgacctcgggaaagagatattgcctgagctcaatcggttaagagagataggtgaagagagtttagagagtgtgttttatgcaggaaatcaaggaaagtctccaaacactagccaagtctcgattccggaatctccagctgcagaatctcaatcctagttttgatatgagggaagcaaatgtgctctaacactcaatttgcaggagttataaacaaaagcagagcaagtttctttgctgattagtgtatagcattagaggaatttggtattctgttaaataatcagttatgtaaccgcctttttgttaggcccataacggttttgaacaatcaatactgtatttattaaagaatcgataatgtaagagcccatataaataggcccaatggctcagaccggtttgacccaaccgggattttggttttattaattaatttggttttgaaaatcaaaatggttaaacccatagctacagataaaccctgcaacagcttcttcttcttcctcttgatgtgggcagaagcaaagtagcgacctttgtcttcttctccatcgtgtttgttt

SEQ ID NO: 8280 - DNA, 3000 bp, Unknown
  misc_feature (1)..( 3000): cDNA_ID_3046155_gDNA_ID_1971666_Annot_ID_175019 3000 nt of promoter + ATG
tcgaatgaaagcttctttacaggacctcttctatttccctccattcttcttcctagtgacctaggagttgggttcgtgacattttttctttctgcttattcaagtagcccggtctggtaagtaaggactttgctctcagtagaagtcaaaaagccttcaacaagaccacatccgctattgaatcagctgctatagacttagctaaagaatgtcttgcacgagattcaatgttatgtgcttgattgcgatcacatttttctcgtagttgatgagctgccaacctccggaattgagggttgtaggtagagtttcctgcgttcaacttggagttggaagagttggatttggagtttataaaagctgttattagttccgactccccggtctaggcctggtacttgttagttctaaggtatcagtgtcgctactttctgtaaaaaatttcctgcgaagggaagcgggaaagacaaggtttcgaatcttggtctaagaacttacactacactacggaggcacgggccaagagatcataacagtcaaatcctcaacctcacaagcagacaagctggtggatcatctgatcttgaaataggtcatcccagctatcccgatcttttctctctttatttcgtcaggtatctgaatcatacgattcctcggatgtagcttttcacattggaccaaaacaaggcccggaaaccccgctagctttgttgatagaaagttagcttcccgtgcttgactagtagggctaatgaacgacccttaactatggaatgttacgcctttcctcggttactcacaacgtaatcaactccattggttattttccccgggggaacacctatagccccaatagactgatttagtaggtatgatgtattactaggagtctctaagttcctgctttggttgtccctgtccgggctaagcggagtttagctttggccgttaataagagcttccctccattccttcagtccagtcacgcttttcttttcggcttttgcttcagtctcttcttttcgtcctttcaggtggcatttcgcttagtcttgtcattccttccgtcatgctactgtcatgtgctataaattgatcctcccgtctagtgtttcctctctcatgttatacagaccgctcctttaatccaatgaataggcggcgagggtgacaaaggcttagaagcaggggcgggcagaagcagcattaattctttcgcccgcgcgtacatattctattgagcgtatacgatcattgagctgatcaccggtggcttcctcacttgtgatgtgaagctgctttccatttctcatttttgaggatatcgatattctcttaagagaaagggtagccttttgtcacgagctggactcgaaccagcgcgtctggcaaaaagaccatccagatttcaaccttagactgatcgtgactttggttactcggttccccacgcgaaccccacacgccatgggtacgtccgaggtagattaactacgaacttttttcaaaaaaagtgtgatatattttcctcacttactagcaaagaactggaccaggattcgtccttggctgcctacgtacccctttgggaatcaagtaaatcgtagttctcttaacttattgtcttctttctaagtcttgctttcttctctctttactattgcttctttttcttttctttctataaaatgttcctcaatagcactgattcttcatatatttttgtcaaagcaattgggttcacaaagcattattttctcggtccattttccacctctttcttttgtcgaaccatgctaagcaaagatgcacggttccagtcttctttccctccccgtgtccactagcgctcctatcctctccttttcagtcgagtcactagggttcctctccttttagtcgagtcattagggttcctctccttttagtcgagtcattagggttcctctccttttagtcgagtcattagggttcctctcctttttttagttgagagttacgtcagtaccttttagtcgagtggcttctcgctcctgcccagaacgaagagaaggcgaaaaagcgccgccgaagcagcatgagcgggcttctattgctacgtaacaatagagcaggatagcattttgcgcccacatgtttgaattttagggtaaaaagctcgcttgttatacgggatccgacgcatccagcagagcgaagcagcgttccattcttttcggcggcatccttccgcattggcggcgagtggagtgccacaatcccattcatcatttttgatctacataagccaaagccctccgcactggcgacgtccccggcataaatgcaaggaggatgtatagctgatataggatcttgtggaacaggatttgattctgcaagcggttcggtacaaacaaagaaatttcgaacaaaaggatcggaactcgctgataggaaaggagagaaaaacaaagcaatgccaagagctccgtcaattcgctgttcatcgatagacgaagctctctctttatcatctcgtgccagatgcaacaaaggatgagtcctttttccttctcgcgaaccacgggagcgccaagcgtccagaggatttttaattttcctttcaggataaagcggcgcataaaaaagggctggtccgtcaaaagtccggttccttcgcgaacgaagttcagaatcaacaagggttcgtagaacgaagggagtgtacaactggtttttcaaaccactttcttgttcgtaacgagggagagataaaattgagttcttcacgaagttcgagacaaaaaaaaaaaaaagactttccctatggcctccttgttttaagacattatggctctggggtcgaccccggtaacaaagaaaaaatccataaaaatttgggatccgacaccataataaaatactaccctcatgattagaccatgttcctgagatttgataaaagaaaggtgcattagcggttaatacgttgtaattggataagttattaggaat

SEQ ID NO: 8281 - DNA, 3000 bp, Unknown
  misc_feature (1)..( 3000): cDNA_ID_3046102_gDNA_ID_1971666_Annot_ID_175057 3000 nt of promoter + ATG
cccaggatgcgaagggaatgagctcggctgcttctcctccacactgatttttctccgtgcctgctccgcatgcgcttccccattgggctttgctctcctcttattcttcattggacggttcggttcggatggacttcgccgttctttcccaactaaaaaagaaaaggctgtatcacatcgagatgtcgattcgttttccgcccccaatgagatggggaatttgtaaccccctatttctactttggggcccttcatctttctgaatccaggcccgtcccggctcgtgtcgttccaacaaccggcggggagcatctcagtatacgatcgcgcgcagtaactgggagtcctattacacctaaggcgaacttcaattcaccaaaccaaggttcatctcgtgtagtgattgtggactctactaaggatattgagtagacggttgatgtatcagactcgaccctatctttcgtagcatgcattcccatcggtgtcgcaactgattcggtaagctacgtgtccggtgcacggagaactgccttcggtcctccaaacttacttattcgtggcaaccttccggccgcccaacgacctataacgctagtcactactcccactggggctagaaagtaagccccacaacccaaagcggcgaagaacaaatagaatttgctacaaaagccggctaacgggggtattcctgcgtatgagaacatagtaatggagaaggtaatagccgaaataggattcgttttggctagagcgcccaaatccgctatatatttgacacgggtttgccgtaatgctgaaactatggcgaatgcatccatcgtcattaatgcataaataaagataccaattagtagtgattgaattccttctatggttccacatgagaaaccagtacgaatataacctacatgtccaattgaactatgagctagaggtcttttgactttcgtttgggccatggcggccagtgctcctaagatcatagaagcaatgctgcagaaaaagaagatttgttgcaatgtagctccataggaaccataaatagaaacacgtaaaatattagcagaaatagagattttaggcgcaatagaaaggaatgctgtaaccggggtgggtgaaccctcatagatatctggtgcccacatatatagagtcaaagggaatatggagtccgagggggagggggttttcttcggggctcgagagattgaatagacccacaagtttgaaattcgccactggggaattcacacgaaagggaacgaggaattctcaacgaaaaaagtgctctctgaaccgaacgtgaaagtttttttccatcagacggctgttcctgtaactccactctcgacttggattatatatccaaaaaggtccgctctcggccattccacacgctgcctagccgaggtgtggtttctgaagtggattctctcttttctagtagatgccgaacctgctgccccattgactaagaagaggggcgggcgcagcagctacatggaccccttcctttctgttgttgccagcgctttcccgggccgagccggaatttttgattattattctaatgggcaggcaaagccgcaggctgctatcccaataggccagcgggcggttcgaggagaggctccggcaatcatagcaccgcggtcgaaaaagcgtgctcccttcagataacacgcaccgtagctatcctcggccttcttcgttttcgatgcaaaagaaaggaaatctctcgatctccgaaagccttttccttaccccgccgcatctccctcccttcgtcgagcctttccggggttgttccttccttatcagaacttggcgggcattctttccagccgggggatgggttttgtttgaacataggctcaaacataattttaaggtcctagctacgccatgcgttcaataccaaatctggaaagctgcagaaatgacaaaaagagggccgctttcctatgttgcactgaaaaaagaaggacctaagagcgtcttctcttaggttttttcctcccgcgcccgccgccgcctggcccccgttagagggaaggggaagattagcaaagcgaaaaaagacagaggaagggggagcagcatcttattctcttcgcgagaacttccggattgaagaagcattcggaacgggctccagcgttcatttcattggcgggaaacgatccaatccattcggggcttcggccaaaaacgaattcgacttgattcatagatagaatcaatgataaataaacaaaagatagatgttcgagatatcttttctttctataaaaaaagaggaatagaatagacatccctttctttagatgtctatctatccttccgattttatatcgttatatctgctctctcaatttttttttagagagagcagatagatcctatcccctatatcgaacactaattcctatctattgataggaagatcttcgtctaatagcggactttgcctttttttaggaatttctcatatccaaggcagcttaccacaagaaccccaccccatacaactagttgggggggctgttcgccttttgaatcaaacaaagattgaagtaggtaggggcttcatagctactttcattctaaaggaaagcgaagaaccaatctttagtcaataggagccctacttccctcgacctcatcacttcaattgttgcgcaaacctctttcttagtcaccgggggagcgcacctttgtcacagtatttcgagctgtttgatagtgacttcttgcgtttggtagggcgacgaaagggctacttccttcaatctaggaaacagccggaaactcgagaaggtcgcctttggaacggttcgccagtaaccaaagcctcactccttccttttgattatgtcgtgacgctgactgaatccaatctataaaaaaacccggaaactcaacaaagtgcgttcccttcgtcaagtaggtaaagtaggcatacgaaccacttttgctttgcggaataaaaca

SEQ ID NO: 8282 - DNA, 3000 bp, Unknown
  misc_feature (1)..( 3000): cDNA_ID_2123815_gDNA_ID_1971666_Annot_ID_175065 3000 nt of promoter + ATG
gctctgcctgagctggagttgtccctccagcgagagttgctttcttccttgcttgatcggtaggagttgccgagatagcaggtattagctgttagccgtcggactcatttaaaggagtcctatcgggctacactagtctaagggcagttgagtaaccgattcctacgcttcctccgcttacctccgtcgcttaactattaatacgtcgcttacccgcctccgcttacccgcctccgtcgcttgttatctgcttcccttagctaaaacgttaggcgatagtgaaagccttcactctcttatatttacgtacacgtgggaagaagacctagtaattgagtgacagcattcctggaccaattctataaacagccaatcaggcatatcatggtacaggtgaaagaaacttatccaatacagatcttatcacctgcccatcaacgctcaaccgtctgctcctctcgtgcgtgtaggaataatcaaaagaggagacagcatgcctattattaagaacccaattctactaaaaacgataacaacgattcgaggttctcaatcaaggcagaaagcaagaaacccatccagctaggaggaaagcaaatcaaggagaccaatcagacatctagattctatagtacgcgtatgtgtacgtacccaggctaaaacagcaaatcaaacttggctatcgtttgagagcaacctatcgctaaacacaaaccaatccttttacacagtccattgaaaggaagaaaacaagggtggaaattcatgttcctttttacacagacctccaaaactcgaataggccaatcttacttttcctcattctagaggttgcaagggaagaaaacaagattggttctttatgaaacctggttcaaagcaacgaactccgctctctcccgtgggcacattcctattatagtaaacggggacttctctctttattcctatgcgtgctttacttgactcctctgaattcagaacaatgacttttaggctatttttccccaccggcaagaatgaacttctatgtgttaagcaaagaagaacagaagatctattccagtagttaggtacaatcttggacggccggggacctacttcgcgggaccgcctaaaaggacttggtccacacgcggcgaagtttctttgggcggcgttttatcgattgatatctaaagtgactggaattcgaatcttcttatataaggaattatcgattataaacttcttatataaggaattatcgattataaacgaggatgaaagaagttaggaataaaaacccgatgttgtgttctcatgcccggtcgaagtccaaggccaacccggtctgttgccaatgagttgtgaggaagtccaccgtcaagtgcgggatgtgaggccacgtcaactgtgtatgttgctgcgaaggtcaaccaagtcgaggaatgcgctgcggaaaaaataaaagtcactgaggatttgccttcgcggataccaattgcttggatggatgcgtttgaaagcctcgagatgacttgcagaaaaaatgctttctaggtttgtcttgtgtctccgtaacaaatggtccatttattgattaatgggcgaacgacgggaattgaacccgcgcatggtggattcacaatccactgccttgatccacttggctacatccgcccctaccctccccgcccttaattttgtttcactgtcataaaacctattaaacaactcatttacatttgtatcttagcaccaaactaaaatgaaattattctctgcctaatcattaataatcattaatgaaggggcccgcctcaccactccacttcccctttttatggaagcaaccaaactcaccatgacaagggccagcgctcttacagcgaaaggctccttttctctagccaaaaacattatgccatcaagccaagccagctcccgaatgtctttaatcgagagaggtacagaatagtcgaagaaagtaagcaactgcgacaagaaaggacttataagataacatggaaaatgagatttcacttctagttatccgccaaggaaatgccggaggaattctatatatagctgagcgatgaccgtttcgttgtgcatcttggatacagtaccgaaggtctgctctactaaaactttgtcataatgagagcggggatcatgaagattgaaactattcatgttgttttctataaactccaaggcttctggtcttatggcccagggtgattgagatcaaattttgattaggcgcgcatccggttcgtttaccaataaagtaaaaagtttattttgtaaatgtgctttccgctccattattataatgtcgaatagctcgttgtttagggcactttgatagtgatgaatgttgactgcgtggtccaaataatctctgaaaaaggtttcgtatttaccgaagtggaggcaatccatgaactaatttttgaggtttcgtatgcgcgaaaagagtttcgctctcaacttcgacgttctctgccctatattgtccagccagggatgtaaatcaagttggctggttaaaaacattggtccagcttaagcttgacgttgaatgggaatttagagttccaatccagctagaagaagcgttgttagaagcggcaaaagctatgagattcgaatcataggcaaggagttgtgtcaagaaaaaacaaaagacaatcgaaatggacaatcgacggatggcaaaaagatccaataactgagaaagacaaaacaaagattcttttcgataaaatacaaataagacaagatatatgagcaagaaatctgccaaaggtcttcgagattttgtatttatatgtcgctctattaacagagccgtgtataccggaaaaaaaaataaaagcgttatcgggtttgaacaactgagttgttataatgttctttttcattttaataaagtgactccgtcgcgatgttttttttcctcttcttatgaaatatgaaattttcattttatttcttcaccgggcttggacc

SEQ ID NO: 8283 - DNA, 3000 bp, Unknown
  misc_feature (1)..( 3000): cDNA_ID_3046100_gDNA_ID_1971666_Annot_ID_175059 3000 nt of promoter + ATG
catatgtactatcttctattctttctattctattggattattggatttctatcttctatttcatttcaacattccttctaattattgttattggatttcagcaatctaagcagaaaagcatgaagttaaggaaagcacggaagaagaaaaggccaatgcgaagtagtttgccaacctttgactagtcccattctatcggttaaggaggccaggaaagatcctcaggtagaactcagtttgggaacaaaaacttttccgagcccagcaaaataatcgcaaggagcccagcttcaaactaatagcccagctccataacaggcgagcagccaacaaactatgacccgaggcaaggaacattccccatccagctcagcccggcaagtgaaacataaaacacaatttgcactcttccagccgacttctcagcatagcaggaccaaccaatcagcacatttggcacttacgccagcaaagcatatatgcaagtcaggctcaagattcacacccaaactaggctcagcagcataaagatgcccgtggtatagactactcgacttagactaagaaggaaccgagaaagtaagccaagcggcgtagaccaataatcaatgtagactttgacacctaacaattgcactagattcaaggaaacctaccaaggaacaatcacatcgggattagcaagtcaggctccgcattcgtactaccaagctaagcagaaagattaccggtaaatggattcctttacttagaagtccactcacccgagcaaggaagaaaagcaatgcaaggaccaatccaactaaggacaatcaaacaataccagcatgggagaaaaaggagactcatcacattccatcagtcactcgagtcaaagcataaagcagagcaatcgtactccactcaagaataatcccatcaaacaaaaatgggcgattcacatttcccttccctcgacctggctctcttcaacttgtttcgaccggcttctatattctgaatgtttcaaccaatttaactttcacccttatcgttctaaatgatctttctctttgacttcgagtttcagtattcgtgtgacttatgctccacttgattagcgtagctgccttagcttgccccgacttgactgattggctgggttcgcttcacctcgctcggcttagttggaggactacagaaagagaagcatgacaagcatgacgttccttaattatatctatatatagttaactatccgtatatcatagtaaggaaccgaaaagtagttacccattcacgtacatcggttgtgtcgaatatttgtaatcaatcggtcaaccagacatcacgtaactattcagatccaacttctagaaataggtttcagtcagctcgatgaaatagactaatattgaccatttatgtcagatccaatagcttgcctcgaatgccagcatgaaacctaattacgatagcggtggcgaagacttgaagtaatcactttttcctggacaatcggccagctaaaggtcagacccaataatagcataatttcacccatcagtggttggtaccagtccgtaaaagtccagcacttaggtagcagccccatcaactgtacaataccgacctaacaggaccagtatccaccataaaaaccgtagcataacaagctaggttcccatagcatataaaggtagggcctagtctaatagactgaagcactaatcacaaggaatcacaaatagcatcccatggacaagtatttcaccaacatacagaggagcggaccaatttcaacgagtagacaaatccatttgaaaagacaactaaagatttattaaatttccggttaacttatgatcccggcctagctcgtcttttcttctataatagcttttggtcaccgctaatcatcaggtgacgctggtcaagatcagtactcttattaactttctgattggcattagtatagaatgggcgactaatataatagaagcatcaatctaaaatcaacaatcacaagtatctacatgtttactcaatgcctggaccaccttaactactatgtctagtcttcaaaatgcctggctacgctataataaaggcttgcaatgattgtgatctcttattgtatttgatcctattaaagtatcatgagaaagctacgaatgttactatgcacgcataaaaagaagtgagtcgaatatcttgagtgagaaatatggtagctttacgtgctagaatggaccaatacattataaaaaaggatctctctttgaaacctttatagaccccaggcttcaaaccggaccttagaaccctccaagctcaagagtacttatctagacatcgcaagtcaggctcaacagtcgtactacaagctcagcagcaatatgaccatggaatggagtcattgagaagaaagggagatcctacctccaatacgagagggaatcgtacgaaaggaacaaactcaacttcaagctcttagcccagcagcaacaaactatgggattggtccgagacaaagaagacagaaacagcccggcccagtaccaatatcatctaacgaattgtacgagaaagctaccaatccagcccggctcagcaaggcgtggaaaatgaagcacatcgggtccacatgggacagcgcaagttagactcaagattcgtaccatccacgactgagtgaagtaggacgaaagcaaccaatctaactaaactagatagaataatgtttcaactaattaaactataaaccttgttcgttctgaactatctcctttcttcgacgttcactgggttggcgtgactggcttaaactctctgaaacctgctattatatcaaccgatgaactaactatctcttacatatctctatatagaatagattatctataatgtttgattcttagtctactgcccgtttaattcccttgacttggccttacttcttttcctttcttcgcttgggcgttcctatcaaaagaatctgtcatgccaaagacccaatcc

SEQ ID NO: 8284 - DNA, 3000 bp, Unknown
  misc_feature (1)..( 3000): cDNA_ID_2123774_gDNA_ID_1971666_Annot_ID_175034 3000 nt of promoter + ATG
ttagtaaggtaagccaggtaagccatgtcagttggtaagaaagtaatcccttccagagttgtaaggttagtaagcttttcccgtttataggaatgggtttctaagcctaggaagtcaaggaagttgtgttggtctttcccctggttccttgttcccctgttgcctttctcttcatttcattgacgggttggagaaatgttcacgacgtaagtcagtggaagcaaacgggcaatcggctgcctaaaggaccccatttgtggttgaaggctaagttcattcttcgatatatatcactccgctatgctagaagactgagcagcttcagtttattaccaacctcgagttcaacaactattgggtaaagcctaaaccttactcctttccttctatcggaactggcaacagatctctagatccgatgcaactagaagtcagtcgattccgtctgaaaatggtttcagtccaaaccttttttgtcgagtgaaactccgcttcttaagagcttctttggacagactcactcccttactcgctgggttggcgtatccaaggtagcgccagcagcaagcgtaggggttactacgtaagtgcgttcgttagcgcgttacgttttctcgcttgctagacacgacaactaaggatagacgcgctgggatagcaagcaagtttgttgaaagaggggcagtagattctagatctgctgaaaaccaggttatagggctatatctttattccatggtagggctaggggcagggtggtttaaaataactccttttactttccctcctacaattacaatgggaagggacgagacaaagccttcttttaaactaaataaagtaggattccgctttcactgttctcaaggtatctcctgactcgaagattagggcttcttcccagccggaggcatccgaaactggagaatcatcaaccctcgcataaagaaacaactaaactatacgcggcaggttggtcaaaaagggaaagaaaaaggtgacatacattctattcggggacataatagtgattcctatcgagcacactctgttatatcgatcccaatcaatagtttttgggggaagtcgatggtcccccccatgctttatgacatcttttctcttctccgtagtgatcagtgtatgcacgtagcatcacagtcaatcttttatgcttggttccggtcgcgctcttcttctaactgcaggagcccgacagggctgtcttactctttttgttgctaatgaataacctttttcttggtgattcatttccaagggaataaaagaaagacctgtgactcattgtctcaatcataacttcaaacagaacctcactgtagagagggagacccccgaaagcgtaagaacgacgatttttgagcctgagggtgaggttctccatcgacgagtgagaaaagggcctggtctcggaagagatgcagctaacgtgagtaatagctgaacagttgcctaatgcatgtggtcagcatcagacaaggttataaaatacatctttacatcccggtcaaagtaacgaaaaaagacgagttttagcaactttttcatacagttttgccctcttttatataaaaaactaacttacgcaaatagtaaatgagaggaccttagcacttttcgttatggagtgattcatctaaaattcccggggttttgtgaatgaattcaactagaaaatctcaattgcacgggattcgcgattcggtgtaagttcaaaatttatcgtgctggacgaccacggttgagttttgttgtggatccaactccaagcgtttgcgggattttggatagatggaatactcttgcaacggagcttgtctgtcaaatctggtctggtatggtagcggttcacaatggcagctcattttcctggaatccgggtgaaagatcttttctttccaaggtctttgctttctattcgacttagcgatggagtcgggtcggaaataaatactaagtaaaggcagacttacaataatacgcaaacaagggtcccgcgatgtcttgtacattctaagtactttgcctgctaagacgtgacaaacaatcgctgattctttactaacgagcccagtagccactaaggcgatccgaatgaggaaacgccggagtgaccgagtgtcttcaaaaacactgcgccaagagaccaagcggagcctctcggtgaatgtggtaaacaaattgaaagccatatcaatcggtataaaatgacaaaccttttggtatgtaccacaaaacactaagaaagaccccgccggttctactctccttgacccgtggacaaacgccacgtgatggacggcgcccggctctgacgaagaaccagtaagattaggtattgcctaatccgtaaggttgtcatacccttatcagctttctgaccaaacctctgtgttgccactttggtaaggaaagtccaccaaccgggcatagtacctcgttagcaggaccactattgctccttttaaagctttgtgctcaagtgatctgggagggtgtcaaacctcccccagccccttattcaggggatggtgccagggagtttgaactgttaacaaaagattttctcgatacaaagaagagccccactcctagaatagttagccactcagtccacagattcggcttagtgaaaatagccctagaaagatcaaggtgcggaaggataatttcctccgttaatgatagctataccatagagttttccatcaaggaaagacaatgccttctcttctccatcctccaggtaccagggaagaactctatattccgggtccaaggatgatggttgcaacgccccgcgcttccaccaataagaggtgcgggggatggtgatatcccttgaaagacataactaacttacaagacttaaaatgaaaagtaaactaacggaacaaggcgccggaggaacccccttctaaaagtctaagagctagaaggcggggtacagcggttgcttcctgtaagatttgaatagtc

SEQ ID NO: 8285 - DNA, 3000 bp, Unknown
  misc_feature (1)..( 3000): cDNA_ID_3046124_gDNA_ID_1971666_Annot_ID_175037 3000 nt of promoter + ATG
ttgttatcaaaaaggaagttgttgggtaaagcaaactccctccttggacgagcacggggcttagtcaagtagaaccgggttgcgctgcttgatgctccgatcgaaaacaaatcagtggggccatgccggtacgactgaatatgcgttagaaaggtcaatccctcccctacgacaccaaaaaaaccgggccgaacttctaacagcccgcccgcttccatagaaaaatatcgcggcaacgtagacctaagtggtcatattggatccttgggaaccatcacaagtacggccggcctatatttgaacgagaatgccgtgtcgttcagcggagcctaaaagaaggtgactcgcgcagacagctgactccttttcaatagaaaggaatagccaaaccaacccagctggctgatcaatctcagagatcttatcggccggcaaaccggagacggacgaccacggttccgaccttaccagcaccagaggtgtactaatcaatgaacccccgaaaccaactttattttctgacaaaatccaccaagtctaagcggtcacgacatcttgttgatattgattgaggactttcgctgactgactccatccataaacctagaccccggtaaccttcgtaaccaaagcgtcacgacaacatccaaagtttacctttggattctgaagtagggggcaaggaggagcgcgtaggaatgtcgaccaccacataagccactagtggctgagagaaagcgagcagcaccttgtataggttgggcagagcttgaagaagcaagcccctatcagagcagagaaagccattgcgcgctagcctaactagctagcatttttcagctggctgttatttagttgtagcgcgccttccctccttctataactttggaaagatttagcagtattttcttatgatgacctggtcgagagagtacgatacatcggtgtaaaaggttgagtgggatctgtaaggttggttatagtcaggcctggccggaaagtgttcttgcctctatcattagctcgggtagcccctgtttctggtcttttagtcaccttccaatggctcttttcccaatcacatccctgggtaaggggtctctaactctgctttctaaatctctgtttccacacttctttagtgttgccatttcaaactaaaataacaaatgataggatcaaacccgccttcccctactttatggtcttgtgaacggagtcgagatagggtatggacagtctcccataacaagaataggaatacgcgagccttcccgatgtctttgatttcctactagagaaagacggcttctatcacgagtttaggtccttttcccggggatggggttttaaaatcttccattttttggttagaaaacgagcttctggcaagacaccggggggagcatctataatttcataacctgcattggtgcggtagagtggcacctcatatgctcgatccatagagaaagagggagtaccaagtcgttcaggagtggaaaattaccacgtatccatcaatcagtcatcccatttcattcctctttgacacccatttagtagtgctttgggcagttatccggtcattccaatctttcgtatgcgaatctgtaatatctatatctgaataagacgcttcaggagaggttgaaataactcgactgaaaggagagaggtaatcaacaggcgaagcaagcaagtcctgcttgaacggttctatcttggtagttctccgatctcttggaaaactaggaaacaaccaacagtgtcaaggtcttccgccgaagccgagtatagatctatggcgtttgctttgtgcgagcttaaatggttcaaggagttacttctctcgtttggtatcaaacatgacgaaccaatgaagtgattttgtgatagcaagtctgctatgaatattgctgccaatcctgtgtttcatggagcgcacgaagcacattgaatctgattgtcatcaggtgcgtgatgcggttcaagacaaactcattacaaccgaacacatctctactaaagaacaacctgccgatttgctcaccaaggcgttaccagctccgacttttttttatttgcttttaaaatttggaagattgtgaccctgtcctgcttttcactggctcagctgctcgataggaataggaaaccgttccaaccacttccacaactaggaggattggcatttggccaagtccaactggaattaaaatctctgccacgaacgggctactccgaatcaggtggccttgggagctcttgatggaagcttgatggaagcaagtgtagctaagaaaacaaactgtactagcatggcctgaatgccgagtctttctcccgccgttccctgttcgcttatttttcaatgacggtaacgccgtttccactttaaagaaaggataggacgagtatcggacgagatattgactctgacctctcctacttggcgcttcggcccctgagaattttccgtacctgtctctggcccaaaaaggagttttttccaatcaattcggaaatcagaaagttgactctcccagcgggcctggttcgtgccgagaatacgctgtttgaaaggtctcggaatttattgtccgattgaaatggtagaaacgacttctccgactgatccgcggctgctgtttctaactaactactgttgctaagctcccttcgggagagtgagctacacttgcttgtattctttttaaggtctctacgagcggggttccatactgttgacatggttagctcagcaacacatgcttaacacagcaaaggaccgtagcgcgcagctgccttcctggcttgcttgggataccaactagaatccctacccatcaccgccaattgatcaaagtgcgggatgatcgggcagatcagttggtccgattgtatctttcttggttctcagtgtgtcggattattaaattggcgaagcctataaaggctagcacattccgtaccattgtgactcccattaaagatatg

SEQ ID NO: 8286 - DNA, 1973 bp, Unknown; identical to SEQ ID NO: 4634
  misc_feature (1)..( 1973): cDNA_ID_1397552_gDNA_ID_1971690_Annot_ID_175069 3000 nt of promoter + ATG

SEQ ID NO: 8287 - DNA, 3000 bp, Unknown; identical to SEQ ID NO: 4641
  misc_feature (1)..( 3000): cDNA_ID_3073833_gDNA_ID_1971690_Annot_ID_175076 3000 nt of promoter + ATG

SEQ ID NO: 8288 - DNA, 3000 bp, Unknown; identical to SEQ ID NO: 4640
  misc_feature (1)..( 3000): cDNA_ID_2170372_gDNA_ID_1971690_Annot_ID_175079 3000 nt of promoter + ATG

SEQ ID NO: 8289 - DNA, 3000 bp, Unknown; identical to SEQ ID NO: 4639
  misc_feature (1)..( 3000): cDNA_ID_1824949_gDNA_ID_1971690_Annot_ID_175080 3000 nt of promoter + ATG

SEQ ID NO: 8290 - DNA, 3000 bp, Unknown; identical to SEQ ID NO: 4638
  misc_feature (1)..( 3000): cDNA_ID_1824945_gDNA_ID_1971690_Annot_ID_175081 3000 nt of promoter + ATG

SEQ ID NO: 8291 - DNA, 3000 bp, Unknown; identical to SEQ ID NO: 4642
  misc_feature (1)..( 3000): cDNA_ID_3092020_gDNA_ID_1971690_Annot_ID_175073 3000 nt of promoter + ATG

SEQ ID NO: 8292 - DNA, 3000 bp, Unknown; identical to SEQ ID NO: 4635
  misc_feature (1)..( 3000): cDNA_ID_1824977_gDNA_ID_1971690_Annot_ID_175070 3000 nt of promoter + ATG

SEQ ID NO: 8293 - DNA, 3000 bp, Unknown
  misc_feature (1)..( 3000): cDNA_ID_3092108_gDNA_ID_1971693_Annot_ID_175089 3000 nt of promoter + ATG
ctgattctgtctcctccctaaatcatcattcatcgcagcgacatgttagattgttgaatatatgcttgtgtttatgaaaatggcagcataatgatcattacctaagagtattgataacagaatgagaggtgaaaatctggattgcagagaggtaaggaacatagtattggaccaatgtttcgcccgtttccgatacaatggggacacctgcaccgtaagcactccactcgtcgaaacaatcccaaaaatctcccaacctgaaatactcgacgctctggctctccaacggataccatagaggattaaggttcttgatctgtgtctgccaaaaaacacacagtttcagatcctaaattcagagaattgttttaagaaaaagaaaaaggcgtaaacctttgggagggaataggcaggcacaatcggtgtagtgcagcgtaagaatcggtctaggttagattcactgtcaaaaaccatcattatccaacaaagaaccaaacttcgacccagaaaaaaaaaaaaaagagagaggagagagtattgcgggattctctttccctgacgtttcaaagagcttagttttcggacaaaagtgttagctttattagacgagcatttgagactttcacggcaatgtcagaaacagggaaagattgaacgaaaagggacaaactttttaaagaaaactccaacggaactctgttttgagcaatgagaaaaaaaacaagtaaaattgtatctactttgagataaaagaaagtaaggaaataggtttatataatcaaccaaactccatgagacccattcttctaaggcaggagattattggtagattcacctgtctttctcacaactctccaccttctccatttattttcattttcatttaataaaatatagtttcgtttctctaactttgtcggatgagattgagttttgtttgtttgggtttagtataaaacgttatggcttcttaatatcttcattttgcatagttcgtgaacaacacaacaaaacagagctattattcctaagtcttagatgatgacatctcccaatacaaagtctccttcttttggatacatcttgaaagaagagaaactaggtcgatcacatataacaagatttcaagagaaactgggtcaatgacttttttgtttacatattataattcatatggtttaaaagaatcattaacataaaaggacatgtgtgacaggatcagtcggcaatgttgtaatccaagttaaactaaatatctactatagaagtttgacacattcaaatagtacgacgacatggggataataaaagtacggaaacactctttgacttttatggatttcttacaaatttctatcagacaactgtagaatatgccgctagtcacgtaaatgtaattattaaaacattatcaaaagattgatcggagaagaaaactcaagaaatggtcaaatatgttttaccaacttcgtaaagaataaagagaaagtaaaagaaatcaaactctttcaaagtggaagccgtcgtctctcgctgacttcttcttcatcggtttttctgttacttgtatgtgaagccaaataaacctgcagaattcacggtttgaatatgagaagaaagtaggattttaaataataaaagaaaagtgagagagaagacaaagacctcgttgcacaaaagcccatcacaaccaaaattactaattagacatgtgtggcaaatgttatgactgatcatcatgcaataattcaccgccaataccatagatgctaccagactttgtaggctctctctctttagtaaataaagcactttgtttatgttcgtttaatgtacccataattagctttaactatttcactctactctatatattacacacactatctcttccatcttccctccacaaaccacacattcaagctcttaccttttatcctcaactaacacaacaatggcttatactctgcaaaatctgacagccacaattgttctggtaagcctgattcttggatgtacagaggaagtaaccggaatgcgttacattcccatttcccccactcccagtgagagcaaacattcagactttcctgtaaacatggtgcctcaaccatctagtctcattcctggttttggaaggttcttgctacctcccacacctaagctgccattccttccttacaaagatccccttgctgttgccccagccacttcaaatggaactcctagtaataaagcccgcagtccgagttcaggagaagatgaagttccaccagtgccacaaccatgacctgtcaacaaataagcttttgctagatgcagaagggtattcaattctggttcacataacaagtatactagtcatttcatcatagtcatatatcttcatgatctctctctatatatacttaagaggatattgaataaattccagagcttttgcttacatactatctaaaaataatatttccaaataaaatgtaatgactcacattgctgcaaatgtattgagtcacaaaagagtagaaatatgtagaaactcttcaattgaatcattattgccatgattgagtcaaaagagaaactctctttacaaagtctgaaattttgtcaagatatgtaaaatctcaaagtttcaaagtaatctcagcattagcatttagcattaacaaaaccaacgacaactacgatgtattaacaaatcaaatttggaaacttctaaaacaatgcgatgataatggacaaagagatgtcttggaaaagtctattggaattgaagtttctgtctatccatagcgaattggaaaaaacgatcaccatgaccaaaaaccaaatcgatgaaggttcgttcaaacacccaataccttgaagatgatataacaaagaaagcagaaaaatataaagaggaaaagataatcaacgaacacgaagaagttcgtggatccatggtttcggtttttcatcttcgtcttcttcttgtcctctgactcgtcctcatca

SEQ ID NO: 8294 - DNA, 3000 bp, Unknown
  misc_feature (1)..( 3000): cDNA_ID_3092098_gDNA_ID_1971693_Annot_ID_175093 3000 nt of
tcaaaaaagtgttttagagtataactagactcataaagtagtacatcgactcctgttctgttacaaccaaaattcatatcttaaggatcacataactgaaacctgcatccacaaatacgaggcaaacatagtgtttccttcatcatacatactagactacctataaatcagagatcaaactatgaaatccgcggattcattcagagtctttctcgcacgccaatacactccattggctgtctctgatgttcccagctgcaataaacatcagaaagattgtcagttagcatacttgacactaagtcatagtattggttttggtcagggtattaagaatccactttacctttgtctccaatgagtagtaattcttccacagctccacgtcttgaccgtaacttgcaacagcagaatcatacagcttccgggcattactgagaccatctttatcacctactgatatgaggttggtctctatttcaatgcaacctttgtatagaacaagactgggaccaggaagagccaagaacctgcagttttacggtaacagtggtgagaataaagtccatgtgtgactcaagggactggaggagtagtgactcacctcttgtatatcttcctcgcactgtgggccccttttgtttcaagaacaaatttcaccactgtggaagcaagagaaaacacatggtcgctcccatggcttttggttgctgataggatggacatctctacaagtttgtccaaataagttcgctgatgagcaaagaaattaaaagcctgcaatacaataagcattttattagtgtagtcttaacaaactagtgtattgtctagaaaatatattagtcacataccattagccacaagctctcagattctgagatcggtactttcctcaaagcatttgaaaggagctcaaagactgtctgaaaatctgctttactaggagatgagttctctgaaagtgatcttatttcaatggaaactcttgaaagccacaacttagctgatccagcaaatttttcagagcagagcttttctgctagcttctgagcttcatgagtcttttccagtttcaagtacagagaaacatattcatcagcaagctcttcagtcaaacagccagtttcatcagccttttggtacacgtttatgatatgtgaaatgatcggattagacaaagaggagatttcattctcgtcgccgtttgactgtacaatagcctccatcagaaaatttatataaatctcaaacatagaacttgacgtaacagtttgcaagccttcttcaaaaacctgcattcaggggacaagatttaagacctatcagatattgtactttctagtttctactactaagccgaaacagattgtggtaaagcaagttagtatagtcctaaagaaaagcccccccataaccaatgttccacctgtcctctccgacattattaaactaggcaatttgacttcaggttcaaaccaaaaagagtgagcgtaaaatcaagactaaagatttgatctatgttaaggaaatgcagcacaactatggccgccacattctttaacagatttcagcatttaataaatttctaacccctagtcataagttaagatttgtttacctgaatagccttttgcatttgaggatttgcaaactctaggcctgcctcattgctaatacaaccactcatttcatgtcttgcaagccaattccagtattcaggttcattgcaaaaatcacgcttcaggtcacttagaatggtattgcgcatttcatctgaatgcgctaagtctgttgcctctagaatctccaaaaaacgcttcctcaagtcaaaactagatggaatagcctcaacggctccactatagatggtctgaagaacattggaccctttctcttttaagaaatcaactttctcagtcacatcctcaacatcttcgacaatagagtcctcgtcattctcttctttttcatttccttctttctcatctagcgacataaataactctttgttctcatctttccattgctcatcctcaacggttttcgtgtcacgcaccaaacttcctttatcttcaccaagggcaactttacgagctttcagcttatttagaaaagtaagttccattcgcagatactcaacccacaggtcttcagagtttgaacacactctcagcccattcagcataagagcacgagctgctgtaacattcaagtttctatcaaattcccaagatgcagcatatatccacactccagccacttttggatgaaaccttattgcttgagccaatgcctacacatgtttcagataatataaacgcaattaaacatcgacatatacccaccaaagacaaatcattaacaaagcaaccagcaaatttcaaatcttttacctttttcattcttccatgcctcttctgtttacaaaactcgagatacctaaaccacaaattgatatcacctttatacctcatcgtcgccaatctataaatctcaacaatcctagccacaccggcgaaatcagatactgatttcttctttctcttcttagtcacacgcgccaccgatttcctccgtagctgacggagctcatcgagcttaacctcatagtcaatataggctatgaaatcttctttgagtgggcttggacgcttgagccggtactcaaacttacgccgctgcttcacgatctcagctatctcagcacgagtgaagatttctcttcgttctagatcatcaagctcgtcaaccatccgctcgaggcggtattgaactacgtcggccatggctgctgcttctcgattctcggcggggactgataacggtagggcaaacgcttaatgcttcttcttctttcttcagttattatataatgggccgtaagagtaagaagctattgggcctacgtctaattttatcacggcccaatgttaaaactcttgctatgagctatttgttgttgttctgggggaaaagctttagaagttgaagacgacg

SEQ ID NO: 8295 - DNA, 3000 bp, Unknown
  misc_feature (1)..( 3000): cDNA_ID_3046196_gDNA_ID_1971693_Annot_ID_175100 3000 nt of promoter + ATG
cacacccatcaccggatcaggcattctatacatgtaacgttgactctccccttctcctaaacgttgaccaactcctcttaagtcataaaccggaccagttggtctgctcggtacatttgaaccggactggggagctttctgtcctcgtccgtagatcgggacaagcgtagcctcggagacatcagatttgcataccggacattttggtggttccctcttatgatcgtattgatcgactcgttgtcttgaattgttggacgcataagtccacttgtgaatgcagggccaacaaaacaggtggccacataaagtcacgaccgggtctcgaacctgatccaaacatatgttgcagtcgaagtctcctccagaatcaaccaatgttgtgtcgtcctcatccttctcaatctccattttactaaaacatacaagacaaacaaccattcacttgaccagtcgttgtttatttaatgagatttcacctaaataagtaaatagtaaatactaaagtctaattccaattagagatttataaaatcaatgatacttcatagaaacaagaaatatcatcaaaatatgaagatcaatatagattataacagaattgttgtgtatatacttagcatgatcgatcttgaatttaaaacttacactaaccaaaaaaaaaaaagaagaagattagacgcaaaaaagtaaggatcatattctttaacaagttgaagttacgaagacttgacctaatcactttctgtttccgacgctttgctctgttttcacttaatcccaaagcacgttattgtttaagaaaaaaagctaaataattaaagacaaaggagtggttgattaaacaaacaagtgatattatgatcctttaaaaaatgacatggtatatcgaaaacaatcatcttcttgcgtagcaactcaaaaacggtgcagatctactactaattcgatgcctttagatagacacacgcaacaatatataataagagtgatgattccagaaaaaagaaacgtactctttggaaagattgtaagtaccgatggatctcttctgtctttaagcctttggaaacttgagagagcttgtacaggttcatgcgacaatggcagaagaacagagaaaatgatttatttgggttaagagaatggggtaagaatgtttagatcgagggtggtgcagaagcaggagaccttattatacacacatacacaattatttttattcttattttcttaaggtgtgcaaaattaaaatccggacaagttatgattttaaagaggaagaaacgtctacctaattaaaaataagtagataaagtaacgaaacgccattcatcttttttttcttacatgtctgtctttatttcatgaaaaggtcagcaacggatagcatcgttttaaaaaaaagtaaacaagataatataattatttatacacaactaaatatatatttatagaaaaatatttattttagtttgaataaaattgtatgttgaaaaaaaagtatgaattggaaatatgccctaatgagtccatgagaccatgacttttgtaggggaaatatacacagaaattgcaaaattcccccataactttatcccaatatcatattcataagataagaatttggctctgaaaaaaacaaaagataagaatttggcagtttctgtttctggcaacacaatagtagatactgaaccaagctcgatgacgtggcactccatggctgcaccgttactccatcaaattcacttgaaaaaaaaaacaaaaaaaaaatgctagtaattttgaaaattctgcttattttggtactttacttttttttttatggaaattgtaactattaggtgttgagtgaataacaatggcaatttggtaagttgtttattcaaagttggaactggagaatactaagtttgcgactaaagccttaatcaaaggccttatcaaccaatagttgaattagtttatagaccacaaagataattaggttacacgtcacggaagcaaggagctattggtgtcaccagaccatagtatttaatttcaagtctattaattgtagaaggcaacccaaaatccactccttgaaataataaaacactgtcttaaattcgtatttgttgagtccttcaccaccattatgtctgattctgcttatatacaaatttaagtaaggttgttagacggttcatgtctccgaatctttgatcaattgtaaagtgtaatgtaaaatagttttttttttttttaattttaaatttgcgactactatatctaaaagtctactatcaactacaacttcacttgtaaattgtaatactctcgaatagatcatttttgatgaaacaagttagacaatcatccaaaattaatcaccaatttgagtgcctccgaatttattcacaatattcattattgaaaagcatttttggatatggccaaccaataaaatgaaaattgaactttaaaaaaaaaaaactactataccaacaatgtaaaaacaatgtgtgtgttcaccatcattagaacaagatctactcaatgttttaaatgtatatataatatgttttgcgcaaaaaaacgtatatgtaatattatatatatcacgttcatgataatgttttcaaattctcatatgaaattattggagcaagttgcatttacgatccggagaactgagccaagaaatgggcggttctcaatttattatgggtattattaaccagtggtggttgaaccaaaattaatctattcattttctctatcaaactttttgttactttgatggtttgtctcaatcgattaaaatagtaactagttattttgttttggcatgtcactgaattgatgttgtttcttctaatttatgatccgctatatccgcagcatttttctctcctcctataactctaatggaaacaggaaaaagaaaaaacaagaaacgattagaaactcaaatgtgacaaaaagtcaaaaaatagaggaggaaacaaaaac

SEQ ID NO: 8296 - DNA, 3000 bp, Unknown
  misc_feature (1)..( 3000): cDNA_ID_3092101_gDNA_ID_1971693_Annot_ID_175092 3000 nt of promoter + ATG
caaatgtgtaagaatacacaaacacactctcaatgagcaattcccaaatgtgatttttttgttcacccacaacaagaacttagctaaagatacagaacaagctaatcagaaatactacagttaaagttaggaaaatattgagattaaaggcggcaaaagtcaaagattcgagatacatcggatttgagaaaaggaaaacatctaagaaaggtcccgacttttggaaagcgatgacaaagtgaacattgaaaggcaatgaaacctgagagtgccgaggaggaggagcttagaggcaagtggagcagatcgagaggctcttccgagagaggaaagtaatgtcattttggtgaaaagtcttcagaggtttgattctgagaagacaaagttgaagagatccaagagaaacctctgaccgagttcaagtactgagctttagtagcgacttttcactaattaaaaacgcttagtgtctccataatccagatgtcgtggatacaaagtctcctttttttatctggtcgattgattattcaagttacatacaattgattagcttaagttagttacaattgattagcttgtgccattcggaaatcgtgcaaccaattatgtgtgattaaataagaactattatattgatgttgcacatggatatgtcgtcagattcaagtttatgtcgcaacacaaaatttggtagaagggtcagtttataaatcagcacacatccaaggtccaaagcccacaagaatggcaacactctattaatcccacaaattcaagctgtcctcgtttttgtttgtttagcaatcgatccaattcacatcgaattcaaccgggtcaagaacaagcgactattttgattcacagattccaaatgattttgctcataattagccagtttcagacaaatgccaaatctggaaaacaaaaaacaaaggcaaaaacgaataaatgaaaatgaagtggtttagcggataattttagaggctaaactatgatgaacaagtatgcctccacgttaacaccgcagttcaatatatgcctcgaagactagctttgtttccgtggttttatatcgaaaacaagctaaaggtgatgtgaggcaatctaaaaacaaatcctttctcccccaaaacagtaaaaccatgtacacaggtgaaaaataactatagaaatcgaacaatacaaagaaaatgcggactaaatgagatgttaggaggaggaagaagaaggtggtgacgctccgttatatagggtcattgtgaagccctaattacagctgaaatctacttagatggcttctagctaagaaatagcccaccaccagttctcgaaatgggccgtattaactaacattatccaaacagagaaacaaaacctttttcttgtatcatcaaaaatttctcttcaaacattggggaaaggtacaacaagttacaacacaaactagttttgttcgtctctaaagttctttgtttcagcagagaatcaaacaatcatccaagtcaagtgtctgtatccagcccattttgcagcaagtcggacgccaatggctaatgctgcagccaacaacggcattggtggtgccctccttaagatctgactctcttcttctgaggaggtcttcgttgaattgtgatacatggctagagccagataccctgtgatagccaccactctcacccatggctcccctactcctgccagaacagctgcagaaggaagagccgaggtcacatcgtctctcttctttatcaaccgcgagtacccatacaaacctaacaagacagtccagaagaacggctctgagatataactctgcaccgctgcataccccaccagacccgcaatagttaccacatacggctgcttgctgattgactctggtgcaactgcttctcctatagcaagcactgaggatgcaagaagaattaccgtggttaactctctcacaggcgtgtaagccacaatcccggagtagaacgccctaacactgtacattgcagtctctacaaggctgatgagagaagtgatgggatcgcctataaagtggaagacaagagccaatgcaaacttcgaaaggtctcccacaaacgcaaggatagcgaaagccgcttttctccagttggatagctcaaacaaaacagctctccacgcataaacgagaaaccccagcgctacaacagaagatcaagatgttacttcatttatccaaagcttattcgaactatgcaacaaggtatacaaaactcgaattcactagactactattcaaatgctaaaccagagtatagtccctaaattccaatctcagggtcttgagtcagaaatgcttcagcgattgagaacaagaacaaaaatttgattttgctacaagacttatgattcacggtaactaaaacgaagccaaaagtaagcagaaacgtaccaacaaaccatggccatataattggactatctggagcttctttggtcaaatatctgaatctatcaggcatcgtgctctctcgtctcgcaaatcgctccgcgtcatcttcaatcccacctttgggtgcattttctttctcgcacctcgtcaaaaccctaagtctcacacttggaaacttccccggagccacaaaacgacggagactcgcgccggcatttaaaaactgtggcggagaatttgtaagcttattatcaccattaagagaagaaatacgcgacacaggagagaaacgaatacgagaattgcggcagaagaaggaaggagaagacagagaagaagagagagctaaaagcgtcatcgtcgtcttcaacttctaaagcttttcccccagaacaacaacaaatagctcatagcaagagttttaacattgggccgtgataaaattagacgtaggcccaatagcttcttactcttacggcccattatataataactgaagaaagaagaagaagcattaagcgtttgccctaccgttatcagtccccgccgagaatcgagaagcagcagccatg

SEQ ID NO: 8297 - DNA, 229 bp, Unknown
  misc_feature (1)..( 229): cDNA_ID_2999495_gDNA_ID_1971712_Annot_ID_175114 3000 nt of promoter + ATG
gatagtgagtgactatgttttcgaagattgttgtccatattttgggataatagcaattatgaatagaaagttggaatcttagtctgacatggcagttggaattcattgtatttaatgccaacagagacatgcatctatgcctgtatatagcaatagaaatacataaagtggttttcttaagtatgtctcgtaggcgtggcatagccatgcaacgaaagagagatcaatg

SEQ ID NO: 8298 - DNA, 3000 bp, Unknown
  misc_feature (1)..( 3000): cDNA_ID_1534390_gDNA_ID_1971712_Annot_ID_175123 3000 nt of promoter + ATG
actaccgataacacatttctgtagtgactatcctatccaagacatgatgcatacacaaatattttaccaaaccaggctcatatctatcactaacagatatcgaaacagtaacacaaaagatcaatcaaggccttacatattcgacttcgtactgaagctggaagatggcttgattagccggtgttctgaggtcgagcaccctatagttcaaacgtgtatcctgattgacacgagcagctggagatggagtctgcaacagtcatgaaaacaacaactcctatgaacagattgaccaccataatagtatcagaagaacacaagttatcagaattcacagcacaattgtaccaggtccaacaaaatctccaaatcttgaaacagcaaactatacctgaagagatgcttcgatatctgcttcactccgagcagcatcctccacactaagtggtaatttggccaaggatttgttgatgcagtacacttttctcacttgaatttcaacctacaattaaaattatcgatacacacacaaacatgagttaaagcaaacgagaaatctggaggagaagaagaagacaaggaaactaaacctgctgcgtagttcccgtcagcggctccttggggagagtgacgacaccgataacatcgacaaaggattcgcgactcagctgcttgaggtatttaaccatgttggcacctactttggtcttctctgattggctaaccacgcactgaacagttgatccgctctccctcaagaccacaaaccccaatttgttagacgttggacgattcgtgtgcactcggcctctgatcagaacctctgattccaacatctcttccaccaaatcgctcacatcggtccactcctttccctcaacagcctctatccacttcccggctttcggatccgccgacgattgcaactcggtaagagtcacgtcgccgtagttattggaaaactcgtcattctcttccagagagatcgaagctgttcgacgcgttgcttcctcttgttcttgacgacgtcttaacttctctagcttggcagcttccttcttagccgctttcttgctggtcttctctccagattcctccgctgcggcggttgatgacgacaacggcgggatttcagattccgacgacatgatgagaatgaatgaatagtcagtccactgaaacgaaacactaggttttatgtaagtaggttataaaaactagataaattcaaaaaggcccctttaatatttatttaattcgttttgaccccaatacttaagaattggaggttatttagagaaacgaaaagaaaaatagaaagcgtgaaccagaagctacaacgcgccgcctcatacaatcaggaacataaacaaagtcacaaacagtttatgttagcaaaagaatcataacactaagacacaacaaaagagatacttaaacaaattacaaaaccaaaataaataatcgattatttaaagtttataagtaaaccctaactctataatgctcaaaatagatacacagacataacacaagaacagtaaacaaagtacaaaaccaagataaacaatcgatattctctaattttaaagtttagattaaaccataatcctataatgctcaaaatcaatacacatacacaacagagtaaccgtaagcaaagcacaaaatcatagataaaacaacagaggtagatcttagcgagcaaacaacaaaacaaactattaaacaaaaaaaacgattaagaaaggagaaagaagaagaccttacccctatgagaaggagcaacagatgatgactcggatcccgatgatgatgatgagacggaagatgaagatgaagatgaagatgatgaagacgaagatgacctggatcgaattctgggactagctggagacaatagcgatagtggggatgatgaccttagcagcgacggccatgaaagtattgctctgaagctgtcccaattaataaaaaaattagggttaaaatgtgtattgctcggaatggtagagcgcgtgtgagacactttctatcggagagagtattgctcggaagctgtcccaattaataaaaaaacgaatttgccagcaaaggacggaccaaaattaaataaaaatcccaaaaaaaacaaattaataataaaaaaaaaaaagagagaaaatcggagtctggaaaaaaagagtaaatgggaagcgacgactgactcttcttcctcctcctcctccacctcttgtttaggttcttagcactgaaatttgatcagaagtaagcttgtgggttatgatcttattactttgtgggtattgattttgtcgatcggattcagagtttttctcttttcgatcgttttacttatccagtacaccaaggcaaggtttgcgtgtttcttttcatgtcatatcaagtgtttttgtgttttgtgaagctctaggtaatctatgagttcttgctttagcttatctcattatggaattatcggatctgtgtctacttttttgggttttgtgggaaatgatgattttatttttttcatccacgagttttctcatatgacctctcatttttctttgttttctttgaaataaaattatggaattcaatgatgaagttactatttttacctagttgaagctgagctgagttattaaagcatctgatttcagcttaattcacgaaaattttcattcttatactaacatgtatatatatgtttctattttagggtgttgacggtgtagagcttcacgaaacataaactttcatttcttctagcttcttgatttgctcttaaaggtaagttctttgtatttgcagttacttcaatgaaagaaaataccattttgataatagtgatttctcatatcctttcttttgtttcctttactatggtctatatttgctttaggtgcatgttgaagtgattgaaagcgatttacatgtgacttgcagctcggtcagacattatacattacactcaacacgagattggaaaggatg

SEQ ID NO: 8299 - DNA, 3000 bp, Unknown
  misc_feature (1)..( 3000): cDNA_ID_3092672_gDNA_ID_1971712_Annot_ID_175120 3000 nt of promoter + ATG
gaacagagtcggaaaaatcgaactgtaaaagaaaaacactcaccgagacgacgaatgaatctggagatttgtggcttcagagagataagagaaatcggaagatatggttagttaggttgcttagttttgattttggtttaattcgatccacttgcactgataattcggggatgagccctaaaaagtctccgagtgttgttgttgttttgggctcttcaagattctgttgaccaaaaaataaaagattccatatttatcttcttccacatgtattcatcatcttatttttctttataaaaaaatctacgtaatagagattttcaactgatttacttcctcatattattttttattctgaatatagatattactataatttacaaaataaaaatatatcttgatcgtataattatttggtataaaatattatcttcccacgtaggtatataatttaccaaaaataagtttaagatggatttaccaagaatccaatattattacttgcgatactttatatgggaagtagaataattggatatgatattggaatttctttttggaaagtacatattgaaaatgttcattatcgtatgaagcagaacttaaagactggctgggatagttagtacttttgagaaatgggattatcgaatctttgaagataatctgatgttgtatgttccaaagagtctgtcgagttttgtatgcggaagctttcactgttgtaacactttgcaacacttgttctttataaaatggtaacacttatggggatatttaaaaaaacaaagatagcaacatgtttagcttttataaaaatgtattatttgaacgataccagggaatcaggatgctagatgcattatccggtcggtgaacgatcgtgacacccaagcaacaaatatacaagaccaaaattggccacgctctctcctctacccctccagctttacttgtccttatcacttccctttatcatctgaattaatttcatctcattgatgcttctctatgtataatgatccaacacaaataaatcaatcaaatcaaaccaaccgatcactttctctttttcactcataatcattccaagcatgattttaaaatgggcttttgttgtctctcataaaaggtgatagctattcgcctcttccactttcttcttagattgttgtagtataagtttaaacctacgactacgagtggataaaatggttttggtttgacttattaggtttaatcgagtacgacaagtggacttgtgacacttgtccaaccgatacttcttatcttgtgtttttgtgttttctcgtcttctagatcacgttttggcatattgaatttattatataagaataagattcgattgttgaatttttaataagtatggctttgttatattacacgtaagaattgaaaacattacttgatcaaagaaataaaagattttatgtgtggtgactgataatgttgttgaggaagatcagagtcattaatgcagactcagtgaccagtggacaatcttgtataaagaaagacattacagagttatattcaaaaacgtggaaaagtatgcattaccttcttgagatggaaatcttaacaaaaacaagcttttaaaattgagtgcatgtccaagtcatttttagatttggtgtttagtgcttcaatatttcacaatatccaaaaaactcataaaaagatttcagagatagaccaagaaaagttatttgagtctctaagaagggattgaccattattcttaattatactatttgatgtttcaactcacttccaatatgaaagtcttaaacataatcatattatagatattaacctgtgaataaaatgccaatcatccaactctcaaaaatataaatgggccgagaatgggctcacacagtaagggagagtaacgagagaggcttgaaggagaataaatgttacttcaccaaccggacctgccgacctctttcattctctgtttgactcactattccttcacacaaaaaagggaacatttaagtttttttacattttcattcaactttaattctgagagcatcaggtaacactgctccacaatctttcaaagattcctcctttttttgttgttctctctttttatttggcttacacgtccgcttgacctcacccacatgcccctgcctcacatcaaaccatctttatttcgtaatagctaaatcttagacaggcaaaatctatcaaattttagaaagtactattcaaaattaatactctctcatgttactaccatacttgctgattataataactgtaaactataacaaagatggtaaacccaaatctatatttatgattgattaattattttaaagtatatattgatgattttttctttataaattatcatgattgccgtatcgtataattaatagatttgagtggtattgtgaagagctactacagctaaggaagtagacaacacctaacgtagtaaattaaaacattaacgtttctcttttagtccctttttttttgttaatcgttttcataatattctgctaattaaatttcgattgggggtaccaatcaaaaagcaaacaccgcctttcaggtcactgggacagacaataaaaaaacctttttcgtttatgttccatgtctgaaattaaaacattttcaagtctcgtgtatttcagattctccatcttagttcttgtaacctctccctcttcttctccaaattccacctgagagaagagaacttattccacccaaaaagcaataatatatagtaccgtactttgattttttcgataatctgttgattgaagttaagccaaaactcagctctgttcttattcttcttcaaacccaagtttcccacttcactgattctttcatcttagctcgttttaaccacaaagttcagttcttttttggtgtgtttctttttcgttattggcttttgccttttttgggtatagggtgtttacgatttatctctcggttccg

SEQ ID NO: 8300 - DNA, 3000 bp, Unknown
  misc_feature (1)..( 3000): cDNA_ID_3055700_gDNA_ID_1971712_Annot_ID_175116 3000 nt of promoter + ATG
cataaacaaccttgtgggagttggttgcagcagcaaggtgtcgttggagcatataaagcaaaacatggtgggatgtgagttgaactgcagtacgactaacgcgtcggatagcaacagcatccctttcttcgacaaaacggggtgctctttttcttatactttcgcccaggtttgtacaggaaacaaaccggaagatatgggatgcgatggtaggggatgttgtcaagcgagtctacctagagagcctcaacaagttattggtatcagaatagagagcaatgatggaaagtcaacaacaagtggagactgtagagtcgccttcttaactgatgaattcttcagtttgtcgaagctgaccaaaccagaacagttacatgctaagagatatgctacattaagtctaggatggataatgcagacgaggaatacttccttcgtcaactccttggcctgcaaaatcagaaaagacacggacactgcttactctaatgaccagagtataaagtgtatatgcgactacaccatgagcatcatttctgatattaggtatgccaattgtgaatgcaacctaggttacaaaggtaacccatatgattcggacggatgtagaggtcagtattatgttctttccttatgccctcctctttttttgtgtgtggaagcaagcatcctttctagagaagtttctttcatcgtttgactatcgtattttcatctttcaattatagatattgatgaatgtaaagagaatcccaaatattgtaaagaaacagacacttgtgtgaatttcgagggaggctatcgctgtgtgggcgataagactaaagcaataatgataggtaggtcactgatttttgttccacaaatttagagcttttaaaaagcaagtgatgatcaacctataatattcttgtgcggtttggcaggggcgggtactggttttggggtcttagtcctagttggtggagtatggtggttgagaaagtttctagtgaagagaaggatggcaaagaggaagaagaagttcttcaaacgtaatggaggactactgttgcaacaagaattgaatacaagacaaggcgttgtcgaaaaagcaagaatcttcacctcgaaagagctagagaaagccactgaaaacttcagcgaaaacagagttcttggacatggtggtcaaggtactgtgtacaaaggtatgcttgtagatggtagaaccgttgcagtcaagaaatcaaaagttatagatgaagacaaacttcaagagttcatcaatgaggtcgtgattctctcccagataaaccatagacatgtagtcaaactcttgggatgttgtcttgagacagaagttcctattctggtttacgagtttatcatcaacggaaacctctttaagcatatccacgaagaagaagctgatgattacactatgatatggggaatgcgtctacgcattgctgtggatattgcaggagctctttcttatcttcattctgctgcatcttctccaatttatcatagagacatcaagtcaacaaatatattactagacgaaaagtaccgagccaaggtggctgattttggaacatcaaggtcagtaaccatagatcaaactcattggacaacggttatttcaggtacggttgggtatgtggatccagagtattaccggtccagccaatatactgaaaagagtgatgtttatagctttggagtcattctagcggaacttatcactggagataagcctgtcataatggtacaaaacactcaagaaataatagccttggcagagcatttcagagttgccatgaaagagagaagactttctgacatcatggatgctagaataagagatgatagcaaaccggaacaagtgatggcagtagcaaatctggcaatgaagtgtttgagttctagaggaaggaatcgtccgaatatgagagaagtttttacagagttggaaaggatttgtacgtctccggaagattcacaggtgcagaaccggattgacgaagaagaagaagaagatggagtagaagaagaagaagaagttgtgacaatagtacacagaggagattcttggagcattggtgttactgctccagcctcaagtattgtggcttcacctccatcttcagatgttgaaccattgaatcctcttctcacatggtgacactcaatcagatcttaaagtaatgatgatgaatgaatttgatgtatctcgttagaaatgttttctgtaataaatttgagtagttgttagtctgtgtttcccgcttaagaacgtttgttgtgtgtttattattcctaacgttcacctttgtgcctcaccgatcacagactctctgccattgattgaaaccagcatagtggttaatagcagctgtcgagtagtgaacgtggaaatagccccactctagaaataaacagaggaagctgcgactgctgcgaccggtactcgttcagataatctgtttttgctaacgtagtcactcttgaatttggatcattttcgattttaattctaggagcctaaagtttcctcgtgtttttctcgtgttagtttattttattcagaaatgaataaagttagttatggacggtgtttttatacccaactctgcttttcaagtttttattttttatttttttgtattatacgatttcatgatgatatgaatatgacttttgcaagaaactgcatttttgccagagtagtttttttatctttcttctgtaatcaattaccaacaatgtctttccaaaaagaattgatgatctccactttacagactttcaacaatatttaaaccagtaaaagagaagctttccgccatataattgatctgatcaagaaacacaaagagaggtatcaataaaatatccaaagatgaagaccattagcacaaggaatcttatcctctgtctccacttacaaaggccatctgctttatagttaatacaattaactcaggaagatcaactttgctctagtagagaaac

SEQ ID NO: 8301 - DNA, 3000 bp, Unknown
  misc_feature (1)..( 3000): cDNA_ID_3092676_gDNA_ID_1971712_Annot_ID_175118 3000 nt of promoter + ATG
attcagatgataaagggaagtgataaggacaagtaaagctggaggggtagaggagagagcgtggccaattttggtcttgtatatttgttgcttgggtgtcacgatcgttcaccgaccggataatgcatctagcatcctgattccctggtatcgttcaaataatacatttttataaaagctaaacatgttgctatctttgtttttttaaatatccccataagtgttaccattttataaagaacaagtgttgcaaagtgttacaacagtgaaagcttccgcatacaaaactcgacagactctttggaacatacaacatcagattatcttcaaagattcgataatcccatttctcaaaagtactaactatcccagccagtctttaagttctgcttcatacgataatgaacattttcaatatgtactttccaaaaagaaattccaatatcatatccaattattctacttcccatataaagtatcgcaagtaataatattggattcttggtaaatccatcttaaacttatttttggtaaattatatacctacgtgggaagataatattttataccaaataattatacgatcaagatatatttttattttgtaaattatagtaatatctatattcagaataaaaaataatatgaggaagtaaatcagttgaaaatctctattacgtagatttttttataaagaaaaataagatgatgaatacatgtggaagaagataaatatggaatcttttattttttggtcaacagaatcttgaagagcccaaaacaacaacaacactcggagactttttagggctcatccccgaattatcagtgcaagtggatcgaattaaaccaaaatcaaaactaagcaacctaactaaccatatcttccgatttctcttatctctctgaagccacaaatctccagattcattcgtcgtctcggtgagtgtttttcttttacagttcgatttttccgactctgttcgttgattcgattttcaaatctgatttatgttttgggggaaatcgaatttgatatctgtgtgctctcggatatattatataggttaaggttagacggagaagaagatacaacaaatatggcggttagtatgaaacaaatgtcgttggtcgtctctgctttgggcgtcttatcctttgttttgggagttatcgccgagaacaagaaggtacaaaaaaaagtcgtctccttttgattatttcgtgagaaaactttaaatttcctgtttgttttcgatgatgatttttgttcttcttctttgtgtttatctactactaccacataaacaattcctgttgctttttggcgcaagttagttttttttttgcacaggaaataatcactctggaattgtatgtatcaaacagtgatctaactatggatgaatcaattgttttgatttcctgtttctttaggatgctttggttgttatttgtgctattctctgtgaatggaggatgtcaaatttgttttagtcacaggactatgactctgatattgtgatattgttggattgtatgaaaaaatgtgatcttctcacagcttcataattgtatctaatgatgggaaaccaatgtgatcttaactgacccgtagctaaatcttactctttctacacaattgtttgacctcatcattgtcactgatctctctaggataccgtatgtcaagagcttttcataagtgggtaaaccacttcggctttcttattcttatgtgttactgattgtgtgatttgtttctgttctttgtgttttcatcttagcctgcgtctgggactccaataagtggaaaaggagtagttatctgcaaatacccatctgatccaactgttgccttgggatacctttctgctgcttttctccttgcctgcactgtagcaggatacaaatccttgttcatctcttacaagggaaagtctgttcctaactctgtcttgttcaaaagcaccagcttctctgtgttcttcaacattgccttgtaagcatttcctcttcttttcaagaacacagtagctagaccattacaaatattcttggattccggtattataaagcctaaaaataggagtctttttgtgacctatggttattgtcgtgtaggataacatctggactggccttgtctctgttgctctggccaaccattacagaacaacttcacttgacccgtaatgttcaccgaaacttagaaaccagttgccccacggctaagaccggtctgcttggtggaggtgcctttgtgtctttggactcgtgccttttctggttggttgctctgatgctcgctgataacgcccgtgaagaccattttgatgaagttgaaagcagaagcatcgatgggaactcttcctccagggatgtgaatctcaagattgatgcttgagagaatgatatgcttttattggtattgggtataagaagggtttttcatttgttttctacttgtttgattaggaaaataataatttgtttcttctgttgttttttttttttttaatgattggctagaatgttatgaaacccatctctgcaccttgatgcattgtgattcataagctgtatctgtgaaaaataatcttttggttatatctcttacatttgacataattgatatgagaaagcacttcaaatcacacactatatcaacatttttctttctaagaatatgtaaatattcacttgaattcgggtggctactagtagtctagtactactatcacaaaccataagactcttttatgtcaaaaccaattaacatgtttagagccaatggttggagcttgggatggcataaatgggctaggtatagcatatcataaagcccattagaaaagcccgatataaactacagatcagtaaaattaaaccctgtcaaaaaccctttcgttttcgtcgtccgctcgagaaaagaagattcacttccatctgcaaattccttcactccctgtgagctcaatagagagagaagaagagatg

SEQ ID NO: 8302 - DNA, 3000 bp, Unknown
  misc_feature (1)..( 3000): cDNA_ID_3092222_gDNA_ID_1971713_Annot_ID_175134 3000 nt of promoter + ATG
ttcaactttaagaactcaccccccctcaagaaaaagtgaatccgcgagaaagtcgagaactttggggattctaactaagtacagtaaccaaaaaggctcgaaatttcagaatcgaaattgacaaattaaacaattcaaaaccctaaaatcagatcgaatcacaaacccaattgaagtaataaggaagatcaagaaacagagagggataaagaagagacctttgagaatcagagaaagaagaagagaaaaagagaaagccgacagccatggccgcctcgaaattcttcagacttattccaattcgaagcaatcaagcaaaggaaaaggaaacaatccacccaaaattaaaagaaaaatctgatctttcttcttcttcttctttagttttttttttcacccttttactttctctcctctgccttttgcctttgtcgctttctgcatcgttgtgagtgagttttcttcttttttattgcctctttgtttggttgatgttttcttcttcactaatacccaaaaaaaatccgattaaaaaaaaatgtgtaatttgagactgcaggacaagaagagtgcaggcgaataaaaacagcagatggaattatttcgaagctttaggaacacgagaagagactggtctttagttaaaaaccaaacatatgtactcgaaagccatttattacctttttatttttcttatttccgcgtgttgaaaatgtcaggtcccttgatctttggtttttcattaattacttctttttgtatttctcaattatttattccataatctttgatactagtggtcagcaaaacattaaatattaataaagtggtatataaaatgatggagcatgtgaaattaacaacatatcatgattcatttaaatttgttagtttttaattgtagatgttttagatattttaccatttatatttctaatagttgttactattaacatgaaaaaagtgaattttaaaatacattatgtatcttgaaggttgaattatttttgtcattttttaatctattaatatgtgtggagacatctaatcgagggagtactgactcttgttagttgttaggtagatgtttaggttataaagttggacattataaggatgtatagaaagtagatattgaataaataaaactagctgtcaattggtaaaatgtagaaaatcaacttccaaatttgaagtttaatatatggttaattacatcatttagatatatttatcaaaaacatctcatccatacttagtaagttaatattcatatcaatctttaatatatattatgaatatatgtcataataacatggcagacgtgagacgaccaataataaaaataacttaatgccaaaacaaatttatatgatgagatttatgagtagactcgttaaaatattcctcagtgaaaaagtattgcatacctcaatgaaattggtgtgaggtccataaaagagagttcaagaaagaaagtacacatatttacattttgagtcatcgaagttccattttacaaatattaatacgtcactgaaaaatgaaaatacctacaagaagatatatgtgtactgtgtaactgtaacagattgggtgtaagaaatcgagaattcttttacttcttattaataaagaagataaaaacacatgcttttatgcaaactatataaaagaaacacaaaacaaaattacattcacacatggaaccaactatacaataaaacattgcagttttcaatgggccacgagtcttaatgcatgtgaaaccagtgatcagtgaccacgtgttaggctttaatttgtgaattccatatgatccaacaatttaacaatatcatctattctaacttgtataaatttatttcgtctaaactgagccttcttaaccccaaagatttggcaatcgagtttatgaactccgattttatcttactcacacattctaaactataggaagaatttctttatatcttccacccattgacaaagatcgtactatgtaataaattagaccgcaaacaattaactttataagaatataccttggataaaaataaaaacaataagagaacaatgtcaaaaacaatcactaaaaacttttcttttatttcacaaaacaaaaacttttcttgaaggtaagtgaaaaatatttaattgattgtagaaaagacgttgttctttttgtttacgggtttcgggctacaccgtcgtcacctgaggcggtctatatgtttgtgtcttcgaggctgtcatgatactaaaagattagaaatagaatcgaaaaattcactttgtagaaaagttatatattagctcgaaacaaaacagttagacaatagacgtacctcgaattaatacgtcatccttattagattctttttcttgtgtgtgcgaaaccttattaggttcttcacaccgtttttcacaaaggtaacgtaagagacgacaaatcaacacggcacagaacaccaacaaaaacacaatgcatcccaaaataatcttctccatatcgtgtctgcttcttcttcttgcatacaaattatatttaaacactagtatgtgtactgttaacgagtttacattttgaggtcagaaaatattccattttaggatcttatgactatgtaaagtttacatattttatcaatgtttctaatttgtgatcacattatggatattgtgatcacataacgaaatgggaaaatgccaaaaaaagaacatatccaactttaaaatttgccaaaaatatttcaaatttttcattaacggaggcgaggagctaggtatatgaaattatgaatatttcaaacgacgctgtttcgattatataaactaaaccaagtatcgggaaagataaccgatccaaatcaaggacagtaacacaaaccgaaataatccaaaccgggattatacagacaaagtggattataagagcaaaaactcagttaccaaaaatttctgcgaatttcgttttgaatttaggaaacgagagaaatg

SEQ ID NO: 8303 - DNA, 3000 bp, Unknown
  misc_feature (1)..( 3000): cDNA_ID_3092203_gDNA_ID_1971713_Annot_ID_175141 3000 nt of promoter + ATG
aaatcagagaaatcatgagctcgcaaagaaacacgatttataccgattcgtttccgataaatctcgttacagtttcggattcagcattataccgaaaattacgggaaattttccttattcaagctacatgcaacacgaagatttcaactaccaattcgacgaatcaaaagtgcgaaattagggttttttcgcgtacctgagcgaggaacatttcgttgagaatggttgacagaagttaaagaaccaatcgaccgaacacaagccatatctgtgatgtctgagtgcacgaggagttagagacacagagagtaagaaggagatgaagcaaaaagctgtggtgtggtggcgggagaatcgtgacgtgtcactaccaaagccgttccttcatttggataccgtcatcgtctcaacttatgggcttttacctttaggcccgagatgtttataataagcccattttggtcaaattgtcatataataaacccattttggctttagacagagtcagagagtctcttgctgtctcagaggtttttaagatgcatgaaacacacgtggcacatgcgtgtagatcgtaaggaaaagctggactctcaagtctgtgatgccatagcgaatcccatggcctgatccctgatggccatgtgacgaatcgtcagcatacatacttacttgttaatatattaattagtatggtattaataatataacccaacaaaacaccatttgcaaagagtttaggtacttatttgtgggattaggtttctctctctgataatacagaaattaatactaaattaagtcactataggtgctgatccacatgcatcccattaagccttcaaacctcttgtaagtgtttatttctttatgatctatagtctataaaatctcctataaaccatccattgttcttttgggtaataattgattattataatatttatggtgtagatcaaatttatttattttcctaagatattgtatatatcagtgatcagtcgaaagattcaaaactgaaaagtgtattctatcaattatataaaaaaaaattacttactgagtaatcgtagaatttaaggtattttatccaacgatcgaaaggataattaagcaaatgaagaacttaactacggatcggaatgttttctaaaaacaacaaataataagaaagaaaaaacaattgtataaaagacaggtccacatgagtgcatgtgaagcaacagtttgtgtttagtactgtaataagaaggatggaaacatgaaatcagtaagaggagtgggtaattgttggagtattacaataattgttttgatgaatattatgcgtgtgcatttctctgccattttcccacaaatcatttagcatttagcttatcttatcctttatcaaattgatcagttagtttacctcgacccgttcttgatacatacatatctgtttgagtttttaaacatcttggtgttgaatttgtcacggttattatttatcaagtttggattctttttagtgatatcaaattactatgctatgctaattgggcagtctgaaaaaaaaataaaaattatattctctcgtttgacgtacgttttttttattccgtctccattttactttaccttaaaggcattggcactgactttgggtgtatacgtctacacatgcttttagtcttttagacatcaggtagaaagtttacgaaattagaattttatatctgaagaacgtttaagaaagtagcattttaattagggacaatttgctgatacattcaagaagtgatacaattaaccactttatttaatttttatttgttatattatcaacaatattatactatacctatattacactgccataaatctgtaacatgggaagattcttatctaatcaatcatgcaaacgaaagaacagtaacaagcctgcactctctgcagtggcatacattatagtattcacacttttgttacgcatcaaggtaagtatgattgaactaaagaaatatgttttcacgtataatggccatgagtgggctcgatcttaattttttttaaccaaccaaatagaaagaagcttttcgaaattcaaaaggggtaagaagaaacgtgaagatcgatcgtgggaatatcttcattattgctgattttaattaataatgaaatttatttggacctatctgatatttaaatatgctgcagagcatagggtaataggatcatctgttcttcttcatcacatgtgcaggtcacccattcttatatgcttcgaacgttcacctcggtggctatatcctaaatacgagatttacaatataatcactgattcatcattaatatgtaatgtaatcgaatattgctaagagctaatggtatattttttgtttttcttccttagaaggcaagcgttaaaagacacaaaaggaaaaaggtgggaaaatagataaagacattctacaaaagctgaattagaatgaagttaagcataagctacctctatgccacacaccaagtgtatgtataaaaaatagtaattatattagtattagtttaagcttaagctatctatggcacattcacaaatcactatacagcaaatcaatagttgacttaattaattttaaaacaccgaacacatttttggattagttgtaattgtgaagaaaacacattctctcttcacatgttcaatgtcttaagaaatttctcaaatacttccaagatcttgtttatttctttttttcttagaacatgtaaccctacatactctttgatcactacatccatataaaaccaagattcatttttatatatctctgtgtttatatgtcacatatatataacataataaacacagaacaagcatatacttacagagtttcttcttattctactctcttcctccaccacctccttgcatgttcactagtctcgttcttggtaatgaactaaggagtcaagtttcagttgaagctgttgagacagaggaagaagttgaagatg

SEQ ID NO: 8304 - DNA, 3000 bp, Unknown
  misc_feature (1)..( 3000): cDNA_ID_1024037_gDNA_ID_1971713_Annot_ID_175142 3000 nt of promoter + ATG
gaatctgagattttgcctgtgagattcatccccgccaggtcgagcttctcaacattgccatttgagttgcaccgaacaccggtccaattacagtgatcgctggtgtctgaaagcttccagtctttgagaaagttgagaggatccacaagagttgatttcaccgacagcaaaacagagagctcgttgacattgtcgatggaagctaaaacagaggaagtagaaccaatgtaacagtagtaaaggaagagaactattatcttcatcttcatcttcaacttcttcctctgtctcaacagcttcaactgaaacttgactccttagttcattaccaagaacgagactagtgaacatgcaaggaggtggtggaggaagagagtagaataagaagaaactctgtaagtatatgcttgttctgtgtttattatgttatatatatgtgacatataaacacagagatatataaaaatgaatcttggttttatatggatgtagtgatcaaagagtatgtagggttacatgttctaagaaaaaaagaaataaacaagatcttggaagtatttgagaaatttcttaagacattgaacatgtgaagagagaatgtgttttcttcacaattacaactaatccaaaaatgtgttcggtgttttaaaattaattaagtcaactattgatttgctgtatagtgatttgtgaatgtgccatagatagcttaagcttaaactaatactaatataattactattttttatacatacacttggtgtgtggcatagaggtagcttatgcttaacttcattctaattcagcttttgtagaatgtctttatctattttcccacctttttccttttgtgtcttttaacgcttgccttctaaggaagaaaaacaaaaaatataccattagctcttagcaatattcgattacattacatattaatgatgaatcagtgattatattgtaaatctcgtatttaggatatagccaccgaggtgaacgttcgaagcatataagaatgggtgacctgcacatgtgatgaagaagaacagatgatcctattaccctatgctctgcagcatatttaaatatcagataggtccaaataaatttcattattaattaaaatcagcaataatgaagatattcccacgatcgatcttcacgtttcttcttaccccttttgaatttcgaaaagcttctttctatttggttggttaaaaaaaattaagatcgagcccactcatggccattatacgtgaaaacatatttctttagttcaatcatacttaccttgatgcgtaacaaaagtgtgaatactataatgtatgccactgcagagagtgcaggcttgttactgttctttcgtttgcatgattgattagataagaatcttcccatgttacagatttatggcagtgtaatataggtatagtataatattgttgataatataacaaataaaaattaaataaagtggttaattgtatcacttcttgaatgtatcagcaaattgtccctaattaaaatgctactttcttaaacgttcttcagatataaaattctaatttcgtaaactttctacctgatgtctaaaagactaaaagcatgtgtagacgtatacacccaaagtcagtgccaatgcctttaaggtaaagtaaaatggagacggaataaaaaaaacgtacgtcaaacgagagaatataatttttatttttttttcagactgcccaattagcatagcatagtaatttgatatcactaaaaagaatccaaacttgataaataataaccgtgacaaattcaacaccaagatgtttaaaaactcaaacagatatgtatgtatcaagaacgggtcgaggtaaactaactgatcaatttgataaaggataagataagctaaatgctaaatgatttgtgggaaaatggcagagaaatgcacacgcataatattcatcaaaacaattattgtaatactccaacaattacccactcctcttactgatttcatgtttccatccttcttattacagtactaaacacaaactgttgcttcacatgcactcatgtggacctgtcttttatacaattgttttttctttcttattatttgttgtttttagaaaacattccgatccgtagttaagttcttcatttgcttaattatcctttcgatcgttggataaaataccttaaattctacgattactcagtaagtaatttttttttatataattgatagaatacacttttcagttttgaatctttcgactgatcactgatatatacaatatcttaggaaaataaataaatttgatctacaccataaatattataataatcaattattacccaaaagaacaatggatggtttataggagattttatagactatagatcataaagaaataaacacttacaagaggtttgaaggcttaatgggatgcatgtggatcagcacctatagtgacttaatttagtattaatttctgtattatcagagagagaaacctaatcccacaaataagtacctaaactctttgcaaatggtgttttgttgggttatattattaataccatactaattaatatattaacaagtaagtatgtatgctgacgattcgtcacatggccatcagggatcaggccatgggattcgctatggcatcacagacttgagagtccagcttttccttacgatctacacgcatgtgccacgtgtgtttcatgcatcttaaaaacctctgagacagcaagagactctctgactctgtctaaagccaaaatgggtttattatatgacaatttgaccaaaatgggcttattataaacatctcgggcctaaaggtaaaagcccataagttgagacgatgacggtatccaaatgaaggaacggctttggtagtgacacgtcacgattctcccgccaccacaccacagctttttgcttcatctccttcttactctctgtgtctctaactcctcgtgcactcagacatcacagat

SEQ ID NO: 8305 - DNA, 3000 bp, Unknown
  misc_feature (1)..( 3000): cDNA_ID_3046243_gDNA_ID_1971713_Annot_ID_175140 3000 nt of promoter + ATG
ataacaacaaaatgtaagagaacaattctagtcaaaatggcaacttacagtatcttgagggacaactccaatgcagcttcgaagactctctagtgtcacttcctttatatcttgaccatcaatcctaacattaccagaatctgtgtcaaagaacctgaaaatcattctaagaatcgtcgatttgccgcttccgctactaccaacaatcgctacacttttccctgccggtacctcaaatgaaatcccatccaaaatctttctctctggcagataactaaaatgtacattctcaaaactgatgcttccacctctcagaacaagaggaggtagctttgtctctgtatctttatctccaatatcggatctctcctctagcaactggaacaatgatttcatatcaacaagaccctgaacggtttcacggtaaacaccaccgagaaagtaaagaggaagagacaattgaaagagaagaccattcaccatcaccaaatcaccaactgtcatctctccattcataatcccttgagaacacaacaccattgatgttgacaaagctgtactaaatataaaactctgtccaaaatctaaaaacgcaagactcttctgagtttgcaatgcagcatcttcatatcttccgagtaaatcatcgtactttctcgcttcgtaatcttcgttgttaaaatacttaacagtctcgtagtttacaagagaatcaatagctcttgtgcttgcatcattatcagcttggttcatagcttttctaaacttagttctatactgtgtcacaaccaatgtgaaagctatgtatgatccaacggaaagagaagtgatcaaagcaaaaacaggtccaaaattgtatgctaatatacctgtgaccattgatatctccaagatcgttggaacaacattgaaaaccatagcagagaggatcgtgttaatcgcgcgacttccacggtcaatgattctattcaaagctcctgtttctcgattcaaatggtaacgaagatcaagatcatgtaaatgcgagagcactttacgagaaacagatcgtattgtgcggagagatactttggagaaaacagcagtacgaagctcgttaaaagctgaagatccagatcgagcaatgccatagccaatgagaacggaagaaggagtagcgaaagcagcaagtagataaggatttgaatcagtgattgttgaagatgaatatgaagagagtaaatcgatagataatttgaagaggaaaggaacttgaacattcaagaacttagctcctatgagacacgctaaagcagcgatgactctgaatcggagttctgggttgtctttcatccatagatagcttgaaatcgtgcggaggatcttcttagatgatgctgttttggtttgatcttgatttggagttgaagttgaagttgagaagaagaagactcgtgcgttgactggagatggagatggagatggatcggtgaagaatgcattgatagctggtgatctctgaattgagctacgtttgataaaactggagaaactgtgatggtgatgatcagagcgaagacggtgatacagagaagcgcgagagaggagaaaccgagatcccctcatcatcgcttcttgtccgaacgaatcacatacaatttggtctaaatcgattctttaattctctgttttgttctctctgtactacagagtagcttaacaagaagacgaggaagaagatatcaactcggaaataaccggttttggttttctgtttttattaagataatgaaattagctatctcggagataaccggtactggtttgattgcaactgggcttgagagaatcagatacggtggtacacaccgcagcgaatctcagagtattcattctctcacatggactctttcgaaaattcaactcttctactatatgcaattaattaaaaaattgaacggtttatttggaaagtgaaaagaagcaacggtcggttatgtcttccctccagacgacagggtttttattcggacaccactaaaaatggacagctaaactcctttattgccttaaaaattcaattttaattacgtgattaaagattagattgccacttgattttaaaatactaattaaacctatatagtgatggtatctaactatcaatagctttaaaccggaactaatcagcaccgtccgatttggaaagatggatggaccaaaggacgtgtgggcacgagtcccccctctctgtacacgtgggtcccactaagccttctaagtaatctttttctagccgtccgattgaatcccatgaagctgacatgtgagcccccacttcttgaaaatatatatttgtatgaattttgtttttattttattttccagccttttaaaaatgtttttattaataccacggatactaccgttttgatatcaaattttctttgaaatctatccgatcttatatcagattttggagtcaaataccaactacaaaaatctgaacattaatacaataatatacattttgaaaaatcatgttgtccattatattttttggcatctaatcctatcgttaattgattataagtttataaatatattacaacggaatttcgcataattgtaaaacttccctatataaacttacgaaaaattgaaataattataccaaaagtccacatattttattttaaaaacttacataagtggatattgttaaaagaaggaaaaaaaaagagtttctagtaaatatagtcacggaataatgtgagaaatttattattggatcaaaaaaatgataaaattgggcgagaaataagactaaaagttagggaagtgaaaaagagacaaatcccacccgtcgtgtcttcttgttcatcctttgtttccctttttctttctcactgtttctgccttacttaaagtctcaatctttgcttcaaattcaacccatctctttttcctcccttccctcacaatcaaaatcttaattctcagcttctggttttgtcgaaa

SEQ ID NO: 8306 - DNA, 3000 bp, Unknown
  misc_feature (1)..( 3000): cDNA_ID_3092211_gDNA_ID_1971713_Annot_ID_175138 3000 nt of promoter + ATG
gaattaaagaatcgatttagaccaaattgtatgtgattcgttcggacaagaagcgatgatgaggggatctcggtttctcctctctcgcgcttctctgtatcaccgtcttcgctctgatcatcaccatcacagtttctccagttttatcaaacgtagctcaattcagagatcaccagctatcaatgcattcttcaccgatccatctccatctccatctccagtcaacgcacgagtcttcttcttctcaacttcaacttcaactccaaatcaagatcaaaccaaaacagcatcatctaagaagatcctccgcacgatttcaagctatctatggatgaaagacaacccagaactccgattcagagtcatcgctgctttagcgtgtctcataggagctaagttcttgaatgttcaagttcctttcctcttcaaattatctatcgatttactctcttcatattcatcttcaacaatcactgattcaaatccttatctacttgctgctttcgctactccttcttccgttctcattggctatggcattgctcgatctggatcttcagcttttaacgagcttcgtactgctgttttctccaaagtatctctccgcacaatacgatctgtttctcgtaaagtgctctcgcatttacatgatcttgatcttcgttaccatttgaatcgagaaacaggagctttgaatagaatcattgaccgtggaagtcgcgcgattaacacgatcctctctgctatggttttcaatgttgttccaacgatcttggagatatcaatggtcacaggtatattagcatacaattttggacctgtttttgctttgatcacttctctttccgttggatcatacatagctttcacattggttgtgacacagtatagaactaagtttagaaaagctatgaaccaagctgataatgatgcaagcacaagagctattgattctcttgtaaactacgagactgttaagtattttaacaacgaagattacgaagcgagaaagtacgatgatttactcggaagatatgaagatgctgcattgcaaactcagaagagtcttgcgtttttagattttggacagagttttatatttagtacagctttgtcaacatcaatggtgttgtgttctcaagggattatgaatggagagatgacagttggtgatttggtgatggtgaatggtcttctctttcaattgtctcttcctctttactttctcggtggtgtttaccgtgaaaccgttcagggtcttgttgatatgaaatcattgttccagttgctagaggagagatccgatattggagataaagatacagagacaaagctacctcctcttgttctgagaggtggaagcatcagttttgagaatgtacattttagttatctgccagagagaaagattttggatgggatttcatttgaggtaccggcagggaaaagtgtagcgattgttggtagtagcggaagcggcaaatcgacgattcttagaatgattttcaggttctttgacacagattctggtaatgttaggattgatggtcaagatataaaggaagtgacactagagagtcttcgaagctgcattggagttgtccctcaagatactgtaagttgccattttgactagaattgttctcttacattttgttgttattagtctaaaccgtgacaaattaggtaaaatgttagttatctacttagggcttattggaaaaatctatttagggtattttaaacttttttgttattcagtcacaatttctacataaatcacatgcagatgacattttacactccaaaagtgattctgattaaacctgatgatcttaattttcattttaatatcaaatcgatttaatggttataacttgcatacttaaagataaactagactaatcatagcctcaattgactcctggaattatggcaggtgctcttcaatgacacaatatttcacaacattcactatggaaacctttcagcaacagaagaagaggtgtacgatgcagctaggcgagcagtgattcacgatacgatcatgaaatttccggataaatattcgaccgcggtgggagaaagagggctgatgctgagtggtggagaaaaacaaagagtggcacttgctcgtgcctttctgaaatcaccagcgattctcttgtgtgacgaagcaacgaatgcgcttgatagtaaaaccgaggcagagataatgaaaacgttcaggtcgctagcgagtaacagaacatgcattttcattgcacataggctgaccactgcgatgcaatgtgatgagataatagtaatggagaaagggaaagtggtggaaaaagggacacaccaagtgttgttggagaaatctggcagatacgctaaattatggacacaacaaaacagtacactggaggtgtgaatctcaagagctagacagctagtgtttgggttctgttttcgcctcactaattctttttttttgctgacttcccttatttttggaatcatatatttgcaaatatcattgatggtactttgtagccttgttacaaaaaataaaacatatttgtaaccttgggaaaatcatttatagtcgtagaggtaccaaaccgattttttcaattaccttttgacaaatcaaaaagtttcgttattcggttttaaagtaagctatttgtattacctttggaatcattgaattggataaaaaccaatagtccttgaagtatccggttctcatgcctaaaacacgtggcaatcgaaccaggaccggttatctccgagatatctaattcataatcttattgtaaacaaagactggggaggttattaacaagttgagatctccaagcaagaggtaattttttaatcttattcttcttcaggtgctatggtacgaaactggattcagaaagaggtcgagcaaaaagtcaaacagacgactctacagaaatataagaaacgaaccagacgaaactgtatatgttaggacaagaagcaatg

SEQ ID NO: 8307 - DNA, 3000 bp, Unknown
  misc_feature (1)..( 3000): cDNA_ID_3092900_gDNA_ID_1971714_Annot_ID_175150 3000 nt of promoter + ATG
atacatattttttgtgccaaattagtaagtcgaatacctattggtacttgtatatatctttcgctgacatctgcgaactgaaattgaaaatctgaatatatatattttttgtgcacaaaaaatctgtttattcatttttaaaaaaaatgctagacactagttgactatatcactacaaataatgaaaaataaacagtaaaaccgcttaaggtgctgagttgacatatcatatatgaacatgttttcacttagaaataaaaaaaaaagaaatggaattcaccggcattttaatgaagaagggaaataaccaataatgattgaaggaagtgattattcttaagactagagacacatatcagatgagacaaacaaatgtggcaaacatatggacccaaatcgcagttttatattacaaggaatctcttgttaattagctagttgtccacggagttttgtactatataattcataattcgaatatggaaaactaatatgatatgaagatttagatacttttcattttcccttttgaacttctttccattttcccaattgggtatatggactaggaagaagaataatagaaggccatgtactcaaaccaataacatatatgtatatacaaaagggtagaattacatagcgaccaagataaataaacgttattctcttcttttctttttgaggtaaaaaaaaaatgtatatacattaataatagagaaatattccgacatacttatgaacaatcatgaaaataccttggataatatatataaaccatttcttgttgtaatattcatattaaaaatctaaatagtactattagagatattccacattttttgcaaggatatgcgtacttgataagtatatgaattttaattagaaaagtacaatttcattaaataaacaatatggtaaaattttagttttgaaaaggttaatagtattttagatatttagtaaataattgaaatgtattagtcaaaacatttgagttttctaaatggacgatgatttgaataattgtctaatactaatgtaaagatagagaaagtatcttatgcaaaaatttataaacattaaaaaaatatttgtatgagaaacttcttgtcgaggaccattatgaaaaaaaaatgtagtaactagttattatataaaagaataataggcttaatcgcatattatttaaaataaaatttcagttgacgcaaaaaaataatagaaaaatatattaaaattaataaaaaaagttctctctatattctttaaaacatatagaataatttaaaagaaaattagttgtaaataaattctctaaaaaaactaattgagaaaataaatatatgtcagtatttctatatattgacggttatcaaaatgtaagacattttactgtcatacaaatagacagacatatatgcatgacatgtttcatacaaacattctatgattgtatttatgtttttatatgtaaacgttacgtgtagaacaacgtttaagataatggtcatatcaatcaacctttaaatagatgaatcaaaggtgcttcctttgtttgaacttctaaatccacacaaaaatacaagaaaagtcaaataatgtggtctttatcatatttgtttgctccgaaaatatagtgtcacttgaacaaaactcttgacaaactggcctatactggttttttttcttaaccaatttatccgttaattttcaatgccgtattgggttcacttcgaagcatttcctgtcagtcattataatccaccaataatgtcagtttctctctctcgcccaaaaacgaacgatcgaggtgaatataaatgaaacatgtacattaattaatatatttatatcaaagttttttccggctttgaagcttgaaaatactccatatattatatacttctttgtgctaatttgtcgacgctttggccattttcatctatcatcgaggattcacaatttttggtgcgtatcgtttacatgatcgaagaaatagatatctgtaggatattatgacaatgtaaattaaatatagtttttctttagtctgttgattatctttatgcttagtttaagaaatagtgtaaacgcttaatatactcactttgcatgacccatataaacagtgtaaacgctaaaatataactcttcatcacccatattgatttaccttaaaatcacattcaccattgcgtctgatggaagtaatatttaagtatagaatacacccatatatatgtatatttattcataatattatatcaatatatattcatatatacgcgttgacaaaacagaaattcattctaacacgtacgtttatttaactttgataatgctagagtattattgacaggtataccgtgtacatggaattaatgtttttactcgctgctaataaaatgtatcttaccaccaatttaagcgaacgtatatcgtattattttaacaatagtttcagcagctgcaggtttccaacgactaatcttttaaattttggaatagcgatcatattcatcatatatcgttaataatcatgaaccaaatatgatttggtcgccaaaatctataatatcatcgttagaacttgtcgctatttttaaacctatcattaacttaacataagacaaacaagacttggttcttggttacaaccactagtgattgtaaaacgaattatcttaactatgaaagaggtatcctacaaattaaaaccgcatcaaaacttaccgtcaaacttcttttaaataattatcgtcatttacgcgtatctaaaaaatgaatatattatatcaacttgaataagaatccatcatttgtaacaagatcccttaagcgagaccctataaatacatcacatgcgtagcaccaaacattcactaaaacttcatttactttcttgaacttgtcttgtgccctctttccaatacactgaaatccacttcaaaatatttatttaataaaaagaaaagaaaagaaaaaaactctgccagg

SEQ ID NO: 8308 - DNA, 3000 bp, Unknown
  misc_feature (1)..( 3000): cDNA_ID_3092894_gDNA_ID_1971714_Annot_ID_175152 3000 nt of promoter + ATG
gtttccgatctcggccccaatgtcttgtaagcttttctaactccaaaattttcaaggcagtctcacgactcaatacatgttcacatttattagcaatatattctagaagcaagtgacccatatgatacgcaccataattttctaaattttccttcacaaaattagaaacgacggcgtgttcagaaattggatcagattcttcattgcagaaagaaccagcagactctctgtcaaaaccccttttaaggacaaatttctcaagatattgaaggatgtcactgctaggatccttactgttatcaaattctaacccttccttctcaggtttctggttccgaagccgttcaagacgagtactccgcctctcttgggggtgttcttcagaaaacacaggctctttttcttttacagaaccaccactttctctctcgatgttgcaatccttaacagacacattacttgaatctgaatccacacaatgatccttctttttcataccttgcataacagcctctgtactaagggataattcaatggttatcggtatatcagctgatatgcccacagtttcacgcgaaggatgcactatcccaattagaatatttagcagtgccacccatgaagcttcaggaagtttaaattgcactctttttcttaacttcttggaggtagcatccatgtcctgattcatgtcagacacctttcttttgccaagaaatttgagccgaacgtgctgaggttcaagtttatctatacccttgggagcaaaaggagctgaatctgtgtcttcaatacaatgtttaacatgcaaagcacgagaatgtgatggccaatgccttaaaatcagatttgcaactgaaagacaggaaacttcatcacctacggcaatgagaacttctagaagtttctccatgcagttccctgcacattagccaattcaattttcaagagggagggaagggtaaatgcaatagtccataccacatatgagtaatgtgaacccaaaaacagagagagaaagaggagaacagtgcgtacagttattggggctgcagagaagtccctgttcaaatgcccatcgtgaaatactcagtaatcccatagaacatgatagggttccaagatggttccagagcacagaatcttttgcatctaagtctatagcttgaagataacagtttagagcattctcgtagtgacttgaaccaagctcaagaaagacagtggcaagattcttcagagccaaaaatctgcaaacagaaattatttataggcgagaccacagcactaatgaactaaaaatatatgaactagacaaaatcaattagtagacatgtaaccaataactagatgaattaaaacgatggagcttgacctgagatgatggagatgattgtcgtttgcaatagtctccacctggacataatgtcaataagaaggtcattcatcatccaaagaaatcatcagagtaagtgaagaagatgattttactttggagttggttataataggatctttaaggatagattctagcagctcccgagccttgtcatagtctttagcttgcagcttgagaagaccatcatgatatgtttgtgacagatgaaactcctgaagagggcaatttaaaaaaaaaaacagttcaatatatttttcaacaatgagctaatctaacttctttataccaaattgagaagaaagaagccctgaatcagaagaaaacctgagcttctttgctaggagctaaaggttcccacttctctgtggactccgtatcattgatcgctgcaatcgaaaactgaaaaaaaaaaaagcgaaacaaatgcaaaaaaaatcaaaaactaaccgattaaaagggggatcaaaattaaatctttgcccgaaattatcattaccatcttgatactcgaagctggtaatggttggggttttcgagttcttggcgcgaaattggtcaatcttcttcttcttctaactagggttgatgatgcacgttaaacacattactagagttttagatttcacagaattcttttctttgtttggtctgttcgtcctctactgtgtttttcttttgttttggctattttgccgtctgttaaaaaattggggttttccgataatgtattgtatatgcctgaattatggaaatatcactaaaaacacttttttgcacttttgtatatattgcaattaagatttaatttttctattttgaagactttttgttaaaagagagatttgctaactcaaaattaccggagttaataagttcgttctcatcagattagcaaaacattcatctttaaagaaatctgtttatctcacgtaaaattctactaattggcagcagcacactactttaatgggcctattactatttcaatatgcactgaaaacttcattggactgtccaataacattataacattattaaaactaaactacatttgtatttgggttacaattttataaagagtaagactcaagatactaattgggctgcagacaactttaaaagccttactacaaaaatcaaaaccattcttaattaactaacaaccaggtaaaaatctcagtacaatatttacactaaaaataggtgccacccactatgcaaaagtttagggccacgaacaaaaaaacctgtaaattgttatgtcttcacaatatgtgttttaatacacatgaattttagctacggttaatgtaaattttgtagttaaattaaggctaaacaatctcaaatataaattggtcaggtccacagacaacagcctggcaagtggcaagcactaaaaattcgaccgttattttttgcccctttttttaatatttcgaaattgtatcttttagttttattttaaagctttttagcccgctcctcctccgctccacctttaattttttcaccaattggatttggatctgtcaaaaatattggcctctttctctctttctctcttgctctctttctttgttgggttgatctcttcttcc

SEQ ID NO: 8309 - DNA, 3000 bp, Unknown
  misc_feature (1)..( 3000): cDNA_ID_3092887_gDNA_ID_1971714_Annot_ID_175154 3000 nt of promoter + ATG
cacacacgatctccctgataactgtattaagcccggggcataggccaccacaagtgacaatacaggcacgcacatcagatggcttgaagtacacctaaacacaatatataatcatatatcagcagtttttacatcatcaaatacagaagctgcagagcaaaggaaactcatggagtagatgaagtaccttttggcgcgggcctgcacgtctaaaatgtgtccctctaggagaatccttgtgaacaacaatctatacatcacacgaaagggaaaatgagcaatgtgctaaacatatcacatgatcacttacgaagagaacaaatgtaagaaaggaaagcgtcagtgagtttcaccttttcctggactgtatcatcctcatcaacaaaatactgcctgaaaatcacacagaatatgaaccctattaactaaccgtcatctttcaatcaatcaagttcataagtacaacatcaacttaccttactactgaataagcagcatttgattgcaacgggtttggataagtctgttagagaaggtatcagcaaaagtgaataaagtataaaatgaaacgaagctatagcatgatttgaaatatgaaccaaaaagcttttttttttctccatggcaagactaatttacaatccaattcttccattactctacatgtataagaacctcattacattagcatcaaatttagaaaatagtaagtgattaatagatctaatcaaacattcggtgacgagtaagcatatgtgcaccaatcaatttccacgttgacattgatttaacatttcacatttgtatgcactaatacgaatataaatatttatgtaattctctccctgatagagaccaggatctcatcaacagtccgaatcaacatataggctaaaaataggcgaaaccaattatacaaacacaacttttgcatttgctatacacgaaccaccaaatcggcaacaatatcaaattcgtaaatcgtataaccaccgatccatgaaaatgtcgatttcaaagaataatcgatggaatcgtatagagatagagagaggaagtagtacggggagatcgagaatgtaatcgctcaaatgaggaacatcttcgagtacataaccagcaggtccttccaccaacttaatctgctcgtccacgccattagaagccatcgaagaaaaccttattcttctgagtgtttttctctccggtgacgtaaagcgactgtgaatttgaagcgtatgtatgtatgtgagttttaattctcagagctcagagtggtatagaagtaaggaacgagaaagcgacgtcgttttggctcaccgttactttatgatatacggacattaccgaaataccagcgtaaacggcggctggtttttccttttgtcaatttccggttttcagataattgattcgtggataaatgcagaagtatggataaaatctcattaattatctttattatacctttaaagaaaatgacaaaaattaaacgataagaatatcttaatatttacgaaatatattcttagtaatttctctatttggtgtcaaaaatatataggcaatttttctattctttaatttcttaagattttttttttttaaaatcattttttcttagtatatggtattgttcatgacaaagagagaaatatcatatcctgttgagaaatagcatttataaaaactgatttgttttgtaaaaataataatgtcaagctaatgtatagatcgaatagttattttagcttaaaaatcaaatttctgagaggagaaaatttatcttacaaatctttataacgcttaagtataaaaaaaagatcttaatacacaattgtccgaaaaaatcatttttaaactatcaaattatcggtttaaactttttatttgattaacaaatcaatctaaactttacaaatcttcatgaatcaatttaggatttaaatatcaaacaagtggattctaaaataataaagtttcctctccaattaggagtataatgaattacatatttggaaagaaaagattcgagtattaataaattttagatgaatttgataagttttagacagttaggaaagttgttactatttgttattaaaaatatttgcaatctccctcactaaaaaaaaataatatttgcaatctcacaaaaccatgagaattgggtctttgtaatttttaatcaaggaaatccattattacatcactaattgaaattcatgtttgtatatacagcctaaacttttgtatatacagcctaaacttttgtatcttttatttaaaaacactttaatatgttaaaatccaatatagtatcaaaattatatcaaaatctaataaacaacacaccagttttcaactttatcaattaaaattaacagatggtgattttaaatcagttggtttccatcgacacatgatttctagttaccaataatcccactaaccccattaaaatctttaaattaaaaatctgaacaaaattatctaatttagatttgttttcaaaatgattacaatgttttcttgttttgaacggagacttatcggctccctccgtaaaataatcatacacattaatccactaatcaaaatttaattataaaatcgaatcgccgtgtacctaatatcttccccaacctttgctctctctctctctccatctccctcatacctccttcttcttcttgatccatcatctctctctctttctctcttctctctgttcctagtccatcgatttaacctctttcagattctccttcttctttgactttttttgacaccgtagtctctttccccttccatcgatttagggtttccgattttcaaaatctcctttttatttgtttcctctccttgtgcaattcccgtctcgaatccatcttgacctgggggtctgatccgatctccctctaatcatatcgtgaagcgagattatgtttttgtgctgcgcttctgctttgatcgcttaggattatcaatcgtgttatg

SEQ ID NO: 8310 - DNA, 1270 bp, Unknown
  misc_feature (1)..( 1270): cDNA_ID_3092878_gDNA_ID_1971714_Annot_ID_175157 3000 nt of promoter + ATG
atagcacagagatgacaactccggtggcaacaacaatggccaccacattggattagaagggcaaaagaagttctaataaggagcaaactaatagccatgaaaattatgaatttaccatactgaaaacaaaggaattaaggttttgaattcaatacttgttttgttatatatgatgttgatgtgacgtatttgtgcgtttctcatagtgactttgaaaggaaggctaaacgaatttgcagtaaaagtaacagaagaaacacttcaaaattgaattaaaatgaagaaaaaaaagaatgagaaaaagtgagaagtggtggttgtctggtattaagggtactcacttctctccttttcaacacagcccgacacacatgtctctttttttttttttcatacacacatttctatttattagtttcctaaaataaaaattataaaacaaaaagcacacccacccataaactaaagcttttctctctcatcccactacaaatcttatatacaagtttcgcaaatcttgactcttcacgttgtggatctatctagagagataagtaagagagaggaagagtaaggaagaaagtggttgaactgtagcagagtctgaggtttgaatcttgtagttcccattgaagcatgcttcaccgttttttccgaaggaagttactcatccactgagagagaaagagggatttggagatagagaaagaaatttctcagatgggtttgtgagaattcacagcaagagcaagaaactcctatatcttcctttgcttccagagaccagcgtgatcaaaaacaaatatttttacggtatctataagaatcctcccctctttttctttttccttaaagagaatttttttgcatctttcttaggttccaataaatatgcagaagaaagttaaaatttttgtaccgtcgttgaaccttttaaagacctaattaagagacaagatcatactaagctcataaatcactttctatttacacatatataggttattaatcttaaacaagatctatattttatctttgagatttttcaagatttcatcaagtgtcacgttcattcattgattacatttcaaatttcactaagaaagttaaaacacggatctttttgagaatatcaagaaagttctttgaaatataccaaaagaaatcagtactttcaagaatacataactttttaggttgtgttaaataatatttgcttttgtaataaaggaacaaaattaaatagagagatcggagaggatcaaagatg

SEQ ID NO: 8311 - DNA, 3000 bp, Unknown
  misc_feature (1)..( 3000): cDNA_ID_3046255_gDNA_ID_1971714_Annot_ID_175151 3000 nt of promoter + ATG
atgaattagcgaaaaataatagtaagaaagaatacagttttgggtttctagataacagttttggtcgagattggcgagaacagtaagcgttttgtttttaaactctgtagattccagaaggatcagcgttttgcacgatccacggatgctccagaagcttgtgcaatggcagacgttgcgaagactccttgacaagcatctatacatacaattgagaaaatatgtgagacttcagattcaataactagcacttgcatcaaagtgtatctgttagattgaaggtatagaatataacctggctaataagatcctttgcagatgcagagattattggtttgggagggaacttgagatccacttgcacaatcctgatatagatcattggtggtaacaaatatcatcaaacaaaccccacaagaaacagactataattgtagatttcaaatgctgtttaccttctgtatgtgtctgagtgctccatggcttcaaaaggaggtacaccataaagaaactcgtaacagagaatcccaaggctccagatatctacactagcatcatgttctacgctttcgactgtaaaacaatccaaaaggtcactgttaaaaagaatttagatcccaccagaactaactttttagcaagccttcaactttacccatctcaggaggaaggtaatctagtgtgccacacatggtccttcttcggttaaatgtgtgtaccgaccaaccaaagtctgcaatcttgagctcaccctgaatagttaaggatccatgaataataatattagctagtttcataatcaaatggatagatgtaaaggaaaaggtaaagcttatatcatcacctgagcaccaattagcagattctctggtttaatatctctgtgtatcacatgcttgccatggcaatagatgagagccctcgccaatgaggcaacatactggcacaatgaacatagaaaggatatcagttttcatacaagaaatcagtttgagaggtcaaaatgtggaaggaatgactaacagtagcagctcgtctttcgctgaagtatttgcatttctgaagatccttgtaaagttcgcctctagcagcatactcaagtatcaaataaactcttttctgcaacaaatgaagaacttaatcatgctcaagagtagattggataacaattatctgtgaataaaaaaggagaaaaatgaaaagttacttgatcatagaaatagccataaagccggagtatgttggggtgacgaagatgagactgaatctcaacttctcttctgagctgatgttcaacttgggattgttgaagctggctcttgaaaagaacctttagagcgacaacgtgattgctctgtttcacattttgcatgtatgtgtgagattggtggaaggaaaaacaatcaaggatctaaaacaaatgcttcttaagtttggattttaacaacaaaaatttgaaagatggtggaagatgatagattgttatatactgacccgtttttctctggcgagatagacgtgaccgaatttgcctctgccaagaggcttaccgatgtcgaaatcgcttaaagtccatctcttttgtgcagctgctgcagaagcatctgaagcctcctgataaaaaccaattttcagatcatcgctagaaacgaatctgctttgaaattgagcaatttttgaacatctgccctaattgattctctttctattccaaacataaatcgattgttcaaattcacaaaagtttcaaaccctaaaatcgtgcaaaagaaaaggaagaacaaagaaaaatcgaaagaaacggaaaaaagatttggctaaaaacgacacgaaggaatcatggaatggtgaaagagtaccttctcctggtgttgtgtctccgtagggatcgccatggaagaagagatcaacccaacaaagaaagagagcaagagagaaagagagaaagaggccaatatttttgacagatccaaatccaattggtgaaaaaattaaaggtggagcggaggaggagcgggctaaaaagctttaaaataaaactaaaagatacaatttcgaaatattaaaaaaaggggcaaaaaataacggtcgaatttttagtgcttgccacttgccaggctgttgtctgtggacctgaccaatttatatttgagattgtttagccttaatttaactacaaaatttacattaaccgtagctaaaattcatgtgtattaaaacacatattgtgaagacataacaatttacaggtttttttgttcgtggccctaaacttttgcatagtgggtggcacctatttttagtgtaaatattgtactgagatttttacctggttgttagttaattaagaatggttttgatttttgtagtaaggcttttaaagttgtctgcagcccaattagtatcttgagtcttactctttataaaattgtaacccaaatacaaatgtagtttagttttaataatgttataatgttattggacagtccaatgaagttttcagtgcatattgaaatagtaataggcccattaaagtagtgtgctgctgccaattagtagaattttacgtgagataaacagatttctttaaagatgaatgttttgctaatctgatgagaacgaacttattaactccggtaattttgagttagcaaatctctcttttaacaaaaagtcttcaaaatagaaaaattaaatcttaattgcaatatatacaaaagtgcaaaaaagtgtttttagtgatatttccataattcaggcatatacaatacattatcggaaaaccccaattttttaacagacggcaaaatagccaaaacaaaagaaaaacacagtagaggacgaacagaccaaacaaagaaaagaattctgtgaaatctaaaactctagtaatgtgtttaacgtgcatcatcaaccctagttagaagaagaagaagattgaccaatttcgcgccaagaactcgaaaaccccaaccattaccagcttcgagtatcaagatg

SEQ ID NO: 8312 - DNA, 3000 bp, Unknown
  misc_feature (1)..( 3000): cDNA_ID_1823758_gDNA_ID_1971715_Annot_ID_175164 3000 nt of promoter + ATG
taaaattagggttaaaaatcagaatcacaaacctagctaaaccttcgagttttggttgtaaaaagctcttaatcttctttgatgtaagagcgtaacctacaataatggatttcttcaccggaaaagcttcgattactaacgaacacggcgacgatgtctcttgctctgtcgtctccatttctcgagttccgttcatggtgatctcttcgttgtccgttagcttcatcttgtggaaaaatcaacgaaacaattttggggattatggaagtggagaatgcgagatcggaggaagaaattttctgggtttgatgcgttcacaacggagtaaaatttgggattggttttaccgggtcgggtttagatccgaattgttttagtcggtgcttgtgatattttgggtgggttatgagagagtagggagaggtctgaaatatttatagcggcgtgagggacatgtgtacacatgtatgtgtctaacggttgttttttttttttttttggtaaagaaacatgttttaattatgagaaatgtatattgcaatttgaacatattcttggaactgcactgttttatttttgtctgagccaagccgatatatagctagttgtgatttgttgttgtttaagaacgtgaatgatctaggttggaattttttaaaatgttagatagatcgatctggtttgagtttggagagtttattgttggtcgggatttgaaatcaatgtattgacaagtttgagagacgattaaattttttagatataattcgcaaaatgaatgttttaggagaaaatcatgtagctaattttctttcaaataatatagttagcaaaaaaacaaattaatatttttgtataattttattaggtaaaataattttttatcaatttatcaaaactcaacaactatttatatgaccaaaacggttgtataaatgatattagtgaatgtttgtgaataaaacttaggtagaatttcattaaaaagaatatatattctatgtataaaaagacttaataaattattttatttcaaaaaagcagatctcacatacttttaaattttaaaattggtaactttcttcaaaattcctcttaaaatagtacgtctttccctttataaacggctaagttactacatcactttaactttgagctttttggtcctccgaatacgtcctcacattcttagtgacttaactagaactcatcttcccaactcatcttcccatgctttcgagaaaactttgttttggctttttgagaattgatgatcttaccatttcttcaaagagtcctataagattctcaacaaaaagccatactacttcaaccattggttctttgatttggagagatgcatgttgtagatgtgtttcttaataccatgatatcttggattcacatagaagtcatcccctcccaactctagatggaagagatcttttgcaactttggaaactcttgtcacaaactactttcgagtattcgagcagttaatgctccggtttcaagaatctaaattacaatttgagtagatgcattatcccttaaggtttaggaagaatacacaaatctcaactagtgagactgtgtggatctctttaacgtattagaaactctacttatgatgttctaaatggcataatatttttcatgaagatgattcttgctccttcaagtgagagtctcatagtgaaggtcgcattactagaaagtccctattgtgcaccgcaaggatttgttcacgaagttatagattagctggactattactctttcccgatttacaatgatacccatatacgtacacattcctcgtgttagagaccatatcttgccccatcaccacccgagccaatcatcccttctagagattatcgatcttaaaacgcagatggtaaactgcctctaaatattggggaagcgtagagacgaatgaattttaaacctcatacttttttgtcttcattctcgaacgaaataacattagatccctaatagtgcttgagatggtgttagggattattcggatgaagattaggagagaaaatcatcatgatgaaacatagctctctcattgggagacttctccacaccctcaaaagagtaaaagtttgataccattaaagcttgtgaaacgaacattaacaaccataatgaaaaaagcagataaaatattttaattttcattgaaaattttgaaaaatatgaaaataattcaatcgagtactatgcatatttttaataatcaagagaatcagctaagatataaagcattaatcaaatgtaatctcatctaataaattatcgaatcaatggtttaattaaagattttcgaaaataaatcaaatctaaatgattacaatctctccttaagatcacatttgaatagtgtttcatattaaatcaatcaacaaacgatgtatagaaaactagttattgttcttaaaattaattacattccttaaagtgacgtgcaaaatttccttattctaaaactgaaattaatgatttgcttaatttaacgagaatattattattaaatacttttaatatatttcattacaaaaaaaaaaaaaaaacttagtgcccatattcgattctcgccacgtcagcaaacaacacctcaacaacggcaccgatttttctgtcctcttcgttcaagtcattccaatattaataaaaaaacgaaattagtaaattaaaatttttaaacgaaaaaaaaaaaaactttggcctctccggtgactcttccttcttctgctaccgaacttttcgcttccttctctgaccaatttttttcaacaacctctcttcttcaacaaattctcttctcaaatcctccaaatcctctctgccatgaacgctactttcttcctcctctccaccaccgtctccaccgtcacaatcaccggattcaacggtctcgatttctcatcttagaaccacatgcatcccttctgttgcgttacaactgtctccgatcactctccttcg

SEQ ID NO: 8313 - DNA, 3000 bp, Unknown
  misc_feature (1)..( 3000): cDNA_ID_3046272_gDNA_ID_1971715_Annot_ID_175174 3000 nt of promoter + ATG
ttaagaaatgggttatagctgaaccagagacaaagatctcgagagttgagcatgaccatgagttcttaatcttggcatcacatggtttatgggataaggtaagtaaccaagaagcagtagacattgctcgtcccttctgcttacgaaccgagaagccattgttgttagcagcttgtaagaagcttgttgatctctcggcttcacgaggctcgtttgatgatatcagtgtgatgttgatcccattgcgccagttcgtatagaaaagagaggcatcttagaagattttagatatatgacattagaatttctatgatttagtccttttgttttacttaattcactcattccaaggttttttcgagtcattttcaaggtttcatcctcaaaggcgaattcaatagaaagggacattgctataagtgtgacaagggatggtcgtttcagatcttatttagctagaggaggccctggatggttactttccagaattgaagaagacaagcgaagatgactttgtggaattttcttttctttacctttggaattttcttttctttacctttggttattgtttggagttttcatgctctgtttttttatggatgtatgctctatactttgttttgacttttcaattaatattataccagacggcaaaaaaaaaattgagtgaacaaagctaaactcaatgtggcttaagttgatcttgtcttgtataaacattgagctttatgatggtgctaagaatttgatcgagttggactccaatgttaatgttgaatgagcaaacaaaaaagtgttaattttatcgagctataaacacattcgcagcaaatcaaagacatacttgtccattaatgaatgtccaagaagtccagtccatatggttatctagtgactcacatggtagtttcatactaatacataagtttatacatgaacaagaaactatccaagcagtctagtccatatggtcatctaatgactcacatgatcgtttcatactaatacataagtttatacgaggaacaataaacgtcaatccaaagtacattatccattatgaccatttatccatatgtgtatagacagttaagtaacaatgatatgtaaccaagtttcttgatgtgcatctcaggtctcaaagtatactctaacactttacaagtagccatccacaagcgaccatttcgtgttgaccatatatagttatacttgtacggatcaattacaaattgaagaatagttatgatttataaggataagcaaaacccaaaattattaaatttaaatggacaccatcaattgaaaaaaagagattgaaaaaatagttatttgagttaatagtcgatggaaactattttgggtacaaaagaggaaaccaacatacaaaaatggtcaccaaacctgcaaaagtacattgttcatatggacaatacaaaatggataccacaaaattggaaatagaagcatataatgaattttttggtgttcaattaatctatattggatcatacacttgaaatggttcatttgatatgaatactttggcattgacgagacgttaaatactcaaaaagccatataatttgacagcaaacttagagacaagttcaagtaaagtacgagaggaaggtaaagagaaacgtgtccaaatatcgttgtccacaaagctctgttcatttaacactgctagatcttctcgattggattttaagttttaaatacaagtcaaagtttgattttaaataccaaacatctcaagatataacataaatgatcacaagttcaagggactaatctcttcaccggtgcgaaggtttaataaatacacaattatcaatagtcaatctcgtttcattatctttaatcatgttacgagaatggtgagtccataacacaatccgttacacaaccgtcaattacaatttcaaatactaatttgtctataacatatccatgataacaagtccacataaatttgttcacataaacgtctcccatgattctttcaaacaaaccatattcagatatgatagaagtcttaaatataatcctgaagtcacaaagctggtcctagatacctggaaagctgaccatcgtattacacataaatttcaaatactttttctctctctcccatgattcttacgcacactaaaaaatctctctctctctctctttcgagagagagagagagagagagagagagagagagagagagagagagagagagagagagagagagagagagagagagagagagagagagagagagagagagagagagtattttagttaagaggatattttagtaaaaaaacatagagaaagtgtctactcctttggaagtgcctaaacacggaaataatttttaaaaagtgtctaagagtgtaatattctttatttttaatatgatttgtctacaaaaaaaaaaaaaaaaacagtaaatatgtttatttcgaatataaatcaaaatattttgtatttttcaatttgttagagataaaacaaaaaattcaccataaatcgaatgccattaattgaaaaatacaaaatactttaacaataaaatataaatgaaaatattaatgttataaatatattccgatattttctcatttaccaaatataataaattaagtatatatccaaaaaaatattcgacatacattccatccaaatattttgtttttgtcatatcttaatatgtaaacaattaatagtataaatgtaaacgttaaattattagcaattatactaaaaccatctatttttgtttaataaatcaaatatatagtactgctctttcttcttcttctcccaccaaaacgagatatttgacataatagagaaataattgttcgagtattagggaaaaatttctctcccaagcacggtatccaaagaggatattatcagtatgtctcccgcttttaaccagatctattttacttttacatcccaaaagtagaaatttttaacggttattacccaaac

SEQ ID NO: 8314 - DNA, 1085 bp, Unknown
  misc_feature (1)..( 1085): cDNA_ID_2177299_gDNA_ID_1971715_Annot_ID_175182 3000 nt of promoter + ATG
tcaacttttttcttaaaccagaaaatctggtttcattgttgtccaatgaagtaaacaaattaacaagtgaaataggtttaaagctatcatcatcatcatctcttgaagaatctgaattaagtttaaaagcttctcttaaacattctctagcaacctcaagaccttcttcgtcaacacctggagcaacctcaactacaataacaacaacaaaatacatagaagaagatttaaaaaccctaaatatctctaaatcaaaacagaaatgaaaatcgagaaacgtgattggtggtgattaccggaatcaagaaaatttaagaaagaacggacgattttccggcagagaggagagtctgttgttagtttcgccattggaggaagagagaaagagagaaggagaagaatctggtttcttcttctctgcgatgaaagtgttcgttgaaggaggcaattgaaaagtctgtctggatacaaggttattatagttctggttgggtatagagttatattaagctgattaacaaacaaataaactatataattttacgtccttgtcctcatctggttccgctaattttagcctgttggacgtcctcgcgtcccagactgaagaagtgatgagtagggctgggaaaaaaacccgaaaccaacaacccgaatcgaaattggcccgaaaagttggatctaaaaccgaatctgaattcgaagatttattctattaggtcttaaattcttctatccgaaaaatcaaacccgaacccaaaactaaaaatacccgaatattttaattgaaaatctaaattttacctaaaacctgaaattttactcaaaaatccggatatttacccgaagttccaaaatagggcccaaaaatctatacccaaactaatccgaacccgattagatgcgaaccgaaatcgaaccgatattttagatttatccacctgggttctaaacttttctacccgaaaaatctgtaaccgatcgggttttaaccgaacccgacccgcttacccgaatgcccatcccactgacgagtgtatatcacagagattaccactggacttgcccttcttctgagagaaatg

SEQ ID NO: 8315 - DNA, 3000 bp, Unknown
  misc_feature (1)..( 3000): cDNA_ID_3088959_gDNA_ID_1971715_Annot_ID_175169 3000 nt of promoter + ATG
tcatccaaaaaacatccaaaaatttggatgagtttaaatggtgtagtcagatagagatgattcttccaaaaattgcaaatattcaaatttccctcaattacaattgggaaaaatgtcatttaaatcatcagtttaccattttcgttggtttaaaggatgaactctagacatagtgatttaaattcctaattttatgttgactttcaatttaatcacgaactctcgttaactaagtcaattaacgcacatcgttagaaattccttaatcaaaaaccccaaatcaccaaaatcagttttcaattttttctctctttttttcttcggattctctcatcttcttctttgaattcaaagtaattatcgtctctagatcgactaatggcgtaaaaacgagaggatttgtgcctcaattggcttagtcaacaagaattcatgattaaattcaaagtcaacataaaattgaggatttaaatcacccggtccagagttcatgctttaaaccaacaaaaatggtaaactaataatttaaatgacatttttcccaattataattatatatcaaatattgttaatttctcattttatatttaaaaattctatatctgcactaattttcttccaaaatatcgtaaatcacaaattataattttccgttaaaattgcaaaattgcgttttacgaaaatcttaaaaagcttgtttccgaacaatttttttgggtcaaaattgtgttttttgcgaaaaaattgcataataacatttcaacgaaaacaaaaaaatcacgattttggcggaaaaataacggaattgtttttcactatgaccagaaaaattggagaataaagtttttgtcaaaacctttcaagtcgtaaatttcgctaaaaccgtaattctgccaaaactataaaatcatgattttcacggaaaattatggaattatcttttctcatcaaaatcaaaaaatcgaattatgtttttgtcaaaaccgtaaaatcacatttttttcaccaaaattgcggaatcatatttccttaccaaaactgtaaaatcatgttttcccgccaaaaccacaatatcatattttccaccaataccgtaaaattatattttctgccaaatcatattttccgtaagaaacacaaaatcttatatttttcggcaaaaccacaaaattatatttttttgtcaaaacccaaaaaaataatttatatgttcaaaataataatttgaaaaatatttagttgtaaatatatttaaagcagtaattcaattaatatagctaagactaaaattaaaattaaaagttgattaaagtatagatattttagtcattttctggttaaaattatttaaatagagatgaaaatttataaaaattacccaaacaaacaaaaatttattgaatatccaaaaatggaaacgaacaatatttattaaaacatttggattgaattttttgatagacaaaccctttaacaaaaaaaaaaaaagaatattttgtagaccagaccatttagattataaaacgaatcaaatcatcttcctgccaatttattcacgtaatgaaacagaaatttaaagaatgggaaaacagaaggatcacagtttccaatgagagtatgccacgtgacaaatccacgtagacgtcgcgaaacttctaacacaaacacgtcaaagagtcaaaagagacgatataaaatctaccttaatcgctatttggaggataattaattgatctctggagatttgctgttgacgaataagaagaagaacccagaattctactttaatggcgtacgtcgaaggaggtatgagattctcttctctctctctgtttcttttcgatttctggatttcttttttggcatcaatttggttaaattcgatctgattgttcgtttttcaatcaaacctgtaattgttctttccttgaacatagattcataactattaagctttgattgttacagaatttgtgaatttgatgtatatgtaaaagttaggttttatattcctgaatttggattgatcatgaatctttaaattaggtcaattagattcataactatagtaatgctatattcattgtctctacagaatttttgctttagtatatctatgaagttaggttttatgtgtcagaattcggattgagcatgaatgtttagagggttttgaggttttatacgggatgatgtgtcaccattatgggaaactttataggtttatggaagatggaaattagataaggtcaataatcattccattattatatgattctcagaaaactgatatgaatacaaagctcgatgagcattccatagcaggagacatttctagactttgaatatctaaatggctaagcttaaacgaagttaaaacttttgagatttatagtgggaaaagttagtgaaagagtgttgattatggctgagtaattgtaaggtgacattgtttctataaagttagcgtaaagcgagatcatgttcaatagtttgtgatcatagaagctcaattcgatattaatgtatgactgtggacaagcaacagcgttttggacaaatgcaataagcgcattaaccgagttcgtgttctatattcacgtctcacgttcttctagcattgtagagatttgtcgtcggagtttaggagggatttttgggtcttatagggaatgtagaagcttcttcaaatctgtgtatcttgtttttttggggttttaattgatagctggagatatattctgaaaacagagatagatggtgcatatattaactgtatttgacattgaaaaacactggaacatgtaccaggtgtggttaaagcgaagaggccaatatggagactaaggacgatcaaagatttcttcttgtccatcattaatctaatacaagtcttctttgtaaccatgttttcggtatgattctgctttcgtttcttggatttaggttccataagctgtctcaagctttgactgacctaagagtgttattggacagatg

SEQ ID NO: 8316 - DNA, 3000 bp, Unknown
  misc_feature (1)..( 3000): cDNA_ID_1823730_gDNA_ID_1971715_Annot_ID_175172 3000 nt of promoter + ATG
accaaggttttctatatcgttttatggacttgctacatcagttctcagccatattcgactctctagaggcaggcctttcaatcgctaacccggcccgtggctttgttgagcgtgtttttatcggtccttgggttgctaattggttgacgcgtatcaccgctaatgatgcagaagtcgagagctttgcttcgtggccacagtggttagagactaatgggttcaaacccttggaagtgagctttaccaaccgttgtcaagcaaaactccttttgagtttgtttaatgatggatttagagtggaagaattgggccaaaacgggctcgttttgggatggaaatctcggcgtcttgtgtcggcctccttttgggcctcgtgccagacgaatcagtaaattctcgtttttgcattctcgagtacattacataagatagtccctttttttccttttttgatataatggtttatgaagacatcaaattatgtgaatatcgaacgtgtaatttctcaaaaatgacagtttagtttaatatgacaagtaattgagccacgacattgcattgtatgttgaatctttaatcttctatataaattaaaatgagaaactcgacaatcgttttacacaagactatgtttgaatatacgtgttaatatgttgtagtaattttggtagcggaccaagccatacttgggtacaagcggaccaaggccatacttgtagccgcaaacaacataaataatatttttggtcaaagtttcatcattggaattggtaactctcttaattgaagtggtggaactagggttccaaccttcctcttttcataaagcttgtttaatttatttattttatctgcttgcagcctataatagtttaagctgcatagaagcggaaacggaaacgctcggaattgctcgaaatcgtctcagaatcgcgattcctaaaatgatgtgtttggaaacgtggaggaaacggacaattcagcttttgaagcgtcggtggttgagatcgacaatgtctctaccgtaaatcaaagatgaaacaagtcaaaaacatctttttgggcttataattgataaaaatacatcaagttatgtttgggccaaatagctcattttgtaaacaaagtaaaagttaaaacctaatctatatatacattattggagattttgtggccaaaagatcatttgcttatgcatttattacaattccctttgcattaaataatttgtgtctgcattaaatatacaaaatgggctaattatcaatattattatctacatatacatttttgcagtcattttagcaaataaatcctcaagttggaacttatttacaaagaatgccattagcattaatcattatcaattaattaatattcctaattattagtatttctttatctaatatttctccatcaattctaattacttttaaaaatgagaaatcttaggactttattaatatgatactttattaaagataaatattatggttatttaaagtttataaaatatttagagtatttaatgaaaaacgtttagaatatatataataaatacaatctataaaatcaaataaccatttcaaaagatttattttaaaattgatttgaattataaatcttttaataaaaatattattagaacaaaaaataataatgtttaattttaccgaactagattagatggtgggacgagtttagaatactatagtatatggatttttataacaattaaataaccatttgaaagaaaaaaataaattactttgaattatatatttttaaattaaagtattattaaaacaaaaataacaaaaaaaaaaatgtttaatttcactgaacattatagatatgtttaattgtaggacgggtttggtcgatagtaatacgagacggtataccacaggtgaaatctattagatatgtttaattttactgaacgagattagatggtatgacgggtttggattgatagtaatacgaaacgatatagtacggatgaaatcctaaatataacaattaaaatacaattatattatattaaacactaaacaaaacaaacaatattaataaaataaatataatttaaatttaaattatatagttataatctagattttaacttaataaactgtatgttattgtttccatattttttaaacagcaaaaatcaaacatattaattgtatactaaaaaaatagatataagagttgtacatttagaaaatacaaagcattaaatcatatatatctttaatctactaaacaaattaaatttttagtttcttaaaaaatcaccgaatggattaaaaccatatgtatttatttcataacggctaaatacatatactactcttacgacattccagagttcttgtatttttcacaaactatatagtctaaaatcaagtaaaataaattgaattttacataatatagtttatcgtgcttttattagatgcactatacattttaaccgtaatcccaactaacatactaagaaaacacatattataaatatatttgattcggatccttcattaatcttttgctaaaagccaaaaacaaataacgacattaaataatccaatatattccgagatttgcttcgtcaatatttttaagggaatgtgacacgtttacgcacttttagactatcttattcctttgggaatgttacactattaggcacttttagaaaatctttttacgtttgaggcactttccaaggttcaggcacttttccttgtttctggaagataaaaagacaattatatcctttccaaattaaaccataaattgtttaaccagttcgattggttttgttttctgtgttatctaataaaacacacgtgtaatacatgttccttctatttcgtgtcggttgagatcttgagatgagaaagagagttatctcacaattacagcaaataaatggatatttttaaaaaataaataatatatagtgtcgctcttcatctctaaaaccaaattctt

SEQ ID NO: 8317 - DNA, 3000 bp, Unknown
  misc_feature (1)..( 3000): cDNA_ID_3089546_gDNA_ID_1971724_Annot_ID_175190 3000 nt of promoter + ATG
tttgattaaaaggctcgttttgtttttcaagcttatcgatttcaattttaaaagaaacaaatcggagttgtggatgatggttttttctagtgcctttggattgagttcaacataattgtggttatttcttcccaccgatctatgaagatgattgctttcttttatgtttttagttgttggttggaagctttattggcttaatctctaagcggatgttactcggttaaaacagttcatggtttgaatgtgctttaggttcctaattaaaagctttagttgttgtgtagatcttgaattaccttttcgtcgttgttgtcaaggaatcagagattcaattggttaagaatcagtcgtgagcaaatcagtatggtgatctgcgattgtcattacggtgagaaacagaagatttgattgctcgaacttagttttccggtgacgatctaaaattcatcggaagttggatctcttgcggtggaggttgtgaaatcaacatgtgtcgtaatctcatctttaccgtctgacgcgtcttgtgatatgaagatagtttgctttgctgtctcttttctttctttggagggtttaatcttgggtctatctttgtggactatatattcgttttgttagctcttaaaatattgtcttgtaagaataccttgtgccgtagactttcgatcaataaaaaaacatttacgagaaaaaaatatgggtgaattgcaaaactaactgtttttgataatttatttaagaaactaacactataatatacaaaatgtagaaactaacactagagggtagtaaacttactaaattagtctttttgattggagatggtagtggtggtgatggttgtggccggcggtggtggatggagttgatggtggtcggaagtgttggtgatcggtgtggtggttgccggcggtggtggtggtggccggtggtggtggtggccggtggtggtggtggtgaccggcggggtgatggtcggcggtggtggtggtggtggtggtggtggtggtggtgaccggcggtggtggtggtggccggcggtggtggtggtgaccggcggggtgatggtcggcggtggtggtggtggtggtggtggtggtggtggtgaccggcggtggtggtggtggccggtggtggtgatggccgacagtggtggtggcggtggtggtggtggccgaagttggtggtggccggagttggtggtggccggatttgatggtggccgacagtgacggtgaccggtgttggtggtgaccggaatagatggtggccgaagttggcggtgatggccggcggtggtggcaggcagtggtggccggcggtggtggcaggcagtgatggccggcggtggtgaccggtggtggtgaccggtggtggccggcggtggtgaccggcggtggtggccggcggtggtggccagcggtggtggttgctactgaaggtattgaggcaacaagggcaaattgagtaatattacatataatacagagaatattataattacatagttaggatggttagttagtgaattatagtttttttgttagttatttctgcaaatttcccaaaaaaatatatcaatttccactaattttttttatgtacatgttggattctagaaaatcaatgaatttaacaaaacaaattcatgatcatcgcacaaattggctaaaatattgttgattttggaattggatggaaggttaattgtagattataacggaatttaaattgtttgaatcttggagtaactcaaaaatatagatcaaaatgattacatatggctatgttctattgcaaatcgtgagcgacagttccgacaaaaaaaatacgtcgatagtaaaataattcaaaaataatctgttatattaattttccatcacatatttccaatgccttgcttaaatatatattttgaactgtataatgttcttatactcttgttacttacctagtataattaagaaaaaaacagttaaaagtaagctaacaatccctatttgtaatagaaaaaatcatattcaaattttcaatttttttatataaatgcaataatcataattaattttttttatatgaatttataattgcccaattataaatattaaagcgggttaacacaattatactttaaaaaaaatttaattgaataacatcagattctatattacactttaagtcattaaaactcttttgaaatcataaaccaataacacccttttacagttgaattttttacctttcatgattttatgtaaatcaattgtttttttgaaatgaatttttgtagtggcattttatgtaatatttaatatgttgttggctatttacttaaatgtatgtttagttaataatatagaaatatcaaagttaattgctaaaaatattattaaacaaaatatagagagtatattgtaaatgataattcgaaaatgaaatccataaattttgttgatctcaattgaatcacatcccagtattagacaaattgggttttataaacactaagaagataaaacggggtcatttcgaaaccgtaagaaaataggatgatttctgcaaatatgggtaatatatatgtagaacgataatattaataccagaaaccctagagttgcttccgcttcgcttctcgtctctcttatcagtcttctcttttcacggctacaaggttagtcctaagtttcggctctgttcttgcatcagtgattggatctctactgccttttaatcaaatctcattgaattgatctgggttagggtttgggtcaggttatcgaatctttctgtgttattttgattctatgaaatgaatttagggtttgggcaagttttttctggtctatgtagcttccatccttttctgagatatctgattgggtttttcggattctggtgatctctgtaacaaaatcgcttctctgtgtttttcaggctaattgagagtgtcccttgcgttagagtttgttactagcttttttcgtctgaaacatg

SEQ ID NO: 8318 - DNA, 3000 bp, Unknown
  misc_feature (1)..( 3000): cDNA_ID_3089622_gDNA_ID_1971724_Annot_ID_175199 3000 nt of promoter + ATG
tagacatggccagattgttgtatggtacgttattccaacatttctttctctggattttgtttggaaggacaagaaaaaataaacgtttacgagttaatttgtacctaacaaaagccttgactatttcctctttggtatgttatgagcttagatacttttaagttccaagatgtccttattgttgctaatgagtcatatacttgcaaatgtacagaccctgcaaaacaaggtgaactagattggacaagacggtacaatatcattggggggattgctcgaggaattctatatcttcatcaagatttacggcttacaatcatacaccgtgatctcaaagcgagtaatattctcttagatgtcgacatgaaacccaaaattgcagattttggcatggctaggatttacagaattgatcaaagtcatgccaattacacaattagaatcgttggaacatagtgattttttttttctcttaacttataaccttacaaatacaaactatatttggtggttacttctaggctaaaaagtctaatccttatttgcagtggttatatgtctccagaatatgcaatgcgtagtcatttctccatgaaatctgatgtctatagctttggtgtaatgattctagagattataagtggtaaaacgaatcgcagcttctactacattgatggttctcctagcaatttggtcactcatgtgagtatatgatcgttcaagttatatgagtgtatatgattaagccaaaggatattaatttatttgatcacttttgttaggcttggaagctttggagaacagggtcaccttttgaacttgtggatccgacaatgggagagagttctcggagtaacgaggctattattagatgcatccatatcgcacttttatgcgttcaagaagatcctgtagatcgaccaatgttgcctgcagcaatagtcgtgatgctcactagtaacatagacaattaccgtttgcctctcaaacatgaatgaccaatccacaagcaggtctattccttgttctaattaacaatgatgtatcaacacagttctagatcctcgttgaagaatggtttttttcttgatattggaactgtattgaatatatggaagtatctacatcatctcttgttcttctcattactctactttatgagacatttaaacaagtatatcagatagtaacattgtacaacaagattcacgttttaaacatattttcagtaaccagaattggttcagacataattaggcattggtgtttcatgtttgtgaagccaataactgaattcatagtttgtataatttaggaaatagacataagaaaatagtttgaactaaacgaacgcaaaacattagttttttttatccatggggcttggttacattgttataattgaaactgttttttagtttttgttgtattatatcatctttcgaggaagagctggtggatctggaccacgacatctctttgatttttcacatcctcgatggtacggattcgccggttgatcgggtggacagttgccatgatcacatcctggttggcgatcgccgcgtcccattcctggatagccaatctcatttgcaactgctacgttcatgttgttgcttatgaacacacatgctatgaacattgccacgaccataaacctttttgtttctttcaaaatgctcatgatgattgatgcctttttcttatgtcaaatatgagtttagatagttcaagagtgttttatgagtgtaatagaaggtttcactttgtgatatttatagagaatgaaaattctgaaagacaatgatccatacatatcaaaacagtgatatttgttgtataatatggaaggaatctcggggagtttgatttgtcttaatctttagaagcattgtgtcatgaaactatttgttggtaatactaaaaatattatgatgatatcttttcgttttagttttacttaaacagagatttgaataggataactgaaattggcagtagaaataaactactaaatatatagatgccataatagttaatagtaaaatttttacttttatattatataaagcttgatttggttttcaaagttgttaattcacgtgatcgtgacacgtctcacatctgtcagttagattatgacacatgttgaaagattttaacattttttaactaaatagaaaaattaaaaagaaaaaagtacatatctacaaatactatttctaaaccaactgagctctattatcttaatccaaaaagtatactagaagaaattaacatatactaatttacatgtgtgttatagagaactcttaaaattgtgttccttaacccaaaaaacaaaaacgaacaaaaattaacatacatactaatttatgtgtgtatagaaaactcttaaaactgttttttcttaacccaacaaaacaaaaactgaaaaaaatgtttttactaatgtttctaatttttattatcggtttacacgtggaaggagttatatgactagaaaccgtgtgtaaaccgataatagataaagagtcatattttcccaaagatattagagaaggagtcatattttgcagttcttttttgtgctagttttactcatttcataatcaaattcaagatgttcaggtatcaatatttgatcaaattaccagtcatgattctataacttgtgtactgaatgcaaatggcaaattctgactagtataaatgggtttgattaaaatgtgttatccggttgggttttgttggttttgtgtggtctaagtttgtttgttgacttccattagagctattgactcagtcaactttaatttttcaaaggcatttgcataattttccttagaccatctctttcaattaagaatgtatgacaaattcagtgaaccagtcaaatctgccaagagaacctacatagtttgagttattgatgcccaaacaaaacttcttgattctaatatctaaacacaatcttttttttctgatcttgagaga

SEQ ID NO: 8319 - DNA, 3000 bp, Unknown
  misc_feature (1)..( 3000): cDNA_ID_2992718_gDNA_ID_1971724_Annot_ID_175202 3000 nt of promoter + ATG
ctcagcttggtgatctcaacctccgtttgagccgcatgaacccgaagaatttgttctttcacttcaattcctatgtacaaacagaggatctcatgtttgctgctgagaggtaactttcatcttttatttaatgaatcatagttaaagtcgtatacaagaggaggatctcatttgtttgttttgtttctcaggatgccaaacatagagaagcttgttttaccggtctggtgctataaaactgaggactcatttcagtttgcgtttagtcaatggaagaatcttaaaacactaatcatcgctcaagactatcagcttcgcaaactcagaagcttgaaaaattaatcaaatgtactaaaatattgaaaagctttgtttgttgtttcgaacgaatgatcagctaaaatgttcaaatcaaatgatatataacgtacacaacattaaaactaggagtatacattttatatttatccctcgtttaacttgttccaattatacacagaaactataacattttgtgaattacacgaggaagaatccaaatccataaaactgtacaacattacagaagatcacttccatcagaaatcatcaactgctacagccgatgaaggcagctcacgctcatcttccttttccatctccaattccggttcgaactctgtcaaatcggtatcagcaagtttcttcaaatcgataatcgataactcgtctagtcttcttaccaccagctcagctgcaccaagctcataaatcgggtgtttactcgccacagccacacatttcatcctcccatcgtgagctgcctctatggtctggtttgagtttccaaatacaatgcaacgttccggtatgaaatcaagaagctgtgctgcgtaaatgaacatctcaggatctggtttacctctgtaaacatcttccgatgcaactatcacactgaagaactttctgatacctatcgatccaactgcattctccaatgtttcccgaggacgagtcgataccaaagccatagggatcttattattcatcaagacattgacaaattcctgcgacccatctcttagtctatacactcctccatgtagagctttaaagatctcttctttacgcttagccatccttctcacttgaacaggatctctcgaccaacacagaacctcagatatggcctgctcgttcttcatcccttcgacacgtctgagcataaaagccggaggaggagatttcccttcttcttgagctaaagtaagccatgattggttatccaagtcaggattgtcttcaatcaatactccttcccactcaaatatagcacctaaccaaccacaacccatccgctcttgcctaagtaaaggattatgcaatgaaggcttatcagctttgttctcaggaggccataaactaggcttatcatcagcaccagaatcaagataattccaagttttcggtaaccgatcgtctttcttcttctctttcgtcaattccatagcaagagccctgatcggaaacaccgacattcgattctttttcacactctgcgtcatcaaatgagagagaacacctttcgcactataatctaccttcaccggaaagcgaacaatgctctgtgatttctgcgttttcaattcattcttcactgtaatcctcacaattgaaggtcgatgacccaccaaagatacagcaccaatagcctccgccatgattacacaatcaagaaactcccaaatcactaccaatctatgattatcaatcaaaacctagtacaattccaaaacctgtgagaaagctgcaagtgacgttaatcaagatagaattctagaaccaaacagctttccccaccgctaaaatcttaaaccctaatcgatcaattacccagagaatccattagaaaagagagaaacttcacaagtaaaacaaccctaaaagtctaaaactttacaagacccagatgacgaaacttgaagatcgagctatgtacaatgaaacccagatcaaatcgaaaagaaagagagggaattttcgactgaaacctgagaatggaaacaaccgatagatgaatgaaaaactcaaagatgaaatctttttcctgaattgggtttaattgtgattctcttaaattcgagcttttttcttcaattatactatttcttttccttgattttaatattcttttttgtggatcgtaattattcacaggaaattgttaatccagatatttctcgtttttttaatcttcacggttaataaatcatccacgtgtccaaaatctgtgatgtctacgaaaaagattattctacgctgaaatagcggtacaagagaggagattactgttttgccacgtctcttgaatcttttaaagtcacgtgtcttttaagacaacacgtatcagttatcaaaaagcagaatatcggcccatttaggttcaggcccattaattgtagtttatggccattttcctttgtgctgggtacaaagatgatgtctgttacacttttttttccggcccaatatgttttataaagcccatctgattttaggagtcttattcagtcataagttttagtagaatatcatctataaaaataattagaaaatatatttgtataaaattaattttaatcatcaatttcaagttagtggataattttggtgtgtaaatacatttaatatatttgatgaaaatacaaaaaaaaaaaatcaattaaccacataagtttacccatttatttaattaattataaaaaatttcatattcattgtataagaaaaataatttaagctaacaatgaaaattttctagtaaaccctttaaaaaagggactaatttacgaaatagtcatagatgtaaacaattttttttctcactaaattggtaaaagaaaagagatagggtgaaaagtgaaaagtgaaaacattataaataggcagagagaaaccacttctcatattaaacaaataaaaagatccaattttttgataattctggaagaggaagcaatg

SEQ ID NO: 8320 - DNA, 3000 bp, Unknown
  misc_feature (1)..( 3000): cDNA_ID_3089615_gDNA_ID_1971724_Annot_ID_175201 3000 nt of promoter + ATG
ctcagctctttacatctgctctttaaactgcgtagatggtttttggtatccgaagatcgtttctggtatcaaaaaacgtcaaccagcaaagtgaagattgctcgttaaaatccaaaagttatgtttgtgatgttgtatgtacttccagtaattctgttcattaaaaccccaaaagtgtattaattttcattcaatgtattaagatgattttcttgttacttgtcttcttaacagtcatcgtcgcgttcttttatttctcttttctttcttcttaaaacttgagtaataatattattgttcttgggaaggatcttgatgctcgagaagtgaatatttttattttgtaacaggaaactatattagactgtgaccatactagaatgtttgtgcctgtatgctccgtttttatgacagtttatatatgagtttcatgagacatggttaaattagaataccttaggaatggtttattactgtacttcacatccaaacaataatatgcttgtctatatttgtgagcttgtgtggaggttgtcgtaaacatcattttagcgtttctcctaagtgttgaattgtaatttcatttttgttgtgtctgcagaacactgcactgctggctagacgactgctcaatggcgagttagagcctgcaaagattttgaacaatatcctccttctctgtgcaaataaatctagggatcctaataatcacattttgattctgttcttgcatctagctggagtgtgttgactgtggctattcctggtatgcttcaagggatgaggcatcctaataatcacattttgattctgttcttgcatctagctggagtctgttgactgtggctattcctggtatgcttcaagggatgaggcatcaactctgacaataagcacagaaaacctgcccaaggcacagagaaggaggatattgagaagaatttgaccagatctggtgaaaccgagaaacctcaagacgaagccttgaagaccaatgactcaaatgcctccaagaatgggcgaagacatggggagtctcctaactcgggtactcatctggttcaacggatcgataaacaagtaaggaacagaatctcagtaatcaacgcaagtggagactgccggtatgacaaggccctccaatattggtttcaatctagaatgggaactaactagcaaatagataaaatctctttttaaactctttcggcaaaagtcgcacttgatgtacaaacgctatttttcttttgagtttaatttaacattacattcaaaaaaaaaaaacaaatgcctccaagaaactagagtaaagggtttccaacttttaacttttatgtttagagtttcgagtctgaattcaaactgggtttcacttttaacagttgattaaccgtatagtttaagtcgggtaaagcttatcatgacaacaaaacgaagaccttggttatcatttccctgttatttccgtgtactatctttatcaataatcgtctctttatgtttatcgaccataaaagatctaaggcagccacaacatggccaagtagagaagtacgtggatagagagagaagcacaagttagtggcacaagacacaaagcccataatctattattgtctttctcttgtgctcaaaaccttacttaaatcatgactgtctcagtagtcaatacgattgtcacttgcaccatatacttcaccgtcatcataactcttttaaccttttacctctcccacttcctcagaatatacccatttccaaaatttctaccttttgacagattctgattttgaaagaacggaatggacgaaggcacggggagacaccaacaccggctcccacgttctcaaagcaaattaataagaatgtgaggaaccggcttagtctttcgttaaggctggggtcatcattcgaaatagggctgcaatattggtttagtacccatactcgcggttgaatttttcatgttgtgactatccatctcaaatgtgtttcagatttttgatactctgatgcattcttttggtgaataaatttgacattcatacaaaaaaaaatttgtttttcttctagtcaatttatgtactttgcttagttatttaactaataaaccataaatgtttttaatagaattgttattggatgagcactacgagcatctttcagattaaacaaagacatttaagtagagagagaacgaccatggactttctcagattgagcatagttttgacttttgagatctcagatttcttagcaaaaaaaaaagatctcagattccattttctcttcttctttcttcttctttttttcacttcttcttcttatcaaatcttgtagtatacgaccatggagttagagggagtgtcactaccgttgatccacaagcatcttatgatgccttggaatgatctaaagagaggtgattgctgtggacgctctggatttaccactggtggctattactgcaaaagatgtgacttttatgtccacaagaaatgtgttgatgagtgcttagaatatattgaacacccatctcacacagttcacgcttgttggtcgataattgagttctgtctatattaaagtttcatgtattaagtggttacttgtcaagggacacaagtacgaagagacacaactcattgtgtgttgtgtctatttgttttctatataaaccccttgtatcgtcatgtaaataccaacaagtttcagtttcaataaaacaaagttttgttcttgtcttcttcacaagagaagagatatgtctctcttactctgtttttcttctctctctcaataatccaacatggtatcagagccgatggttgtccttggttgtctctacaaaaataagatgtcttctgctgcgaaaagaaaaagagagatggagacaacaaatctatggtgagatgaagaggaagaagaagagggaagaagaagaaataagaggtggtaacaagagaaagtaccatcagttttcacaaacacattcacatg

SEQ ID NO: 8321 - DNA, 3000 bp, Unknown
  misc_feature (1)..( 3000): cDNA_ID_3000008_gDNA_ID_1971724_Annot_ID_175193 3000 nt of promoter + ATG
caggacaatcaatagctttttggagtatcatgaataacattttctaaatcaacgcgactctctgagtacttgaagaagcaattgattgaaatggatgatcactgtgataaatctgaggactacattttcttgagttattttgtaaattatagaaaacaaacaaaatgcaaacttcattgcactttgcaaagtttctttttaccaaaaggtttttggtccaaaacatgctcgcttgaaccagaaagaaacgcattaactatagcacaatataccgactcaacacggataactagagaggttctagtaaacatgaacagaagtacagaaccgtagcatccaagtaatctaataacataatgtttcatcatcaaaggccaaaacagaagaacatttgtgtttttgtttggtatatcggccttaccgagcaaagtagtgatttgagaagcggagaacagctgttagatacattgactgctttaaaatgtctctgcaacttcaagtcttcccggaagtttcagcatacacttccaccgaattgacagaaagcgagtggttgcttgcttcagattaaacagtgcagctgaccaaaagaattccaaaaatcagaaagaaacaacacaaaacacaaaagacatcaatcttaacctgaagagaaaagaaaaagagccacctactcaaagtgattaataacagtttactttgaagcagaagatgattcggaaactgaaacactctttatataagtcatgtctcatgtcttctatatacgattcaattcttaatttggccaacaatggctcctttagtctctatcacaaacatttctaaaaccagatactccgaatcaatatcagatccaaagaaacctcaccctcattagctatgtcgcaagaagcatcttcacaagaagcagtctttctcaaacacttccatgagcaaaaccctttggcttaatcccaccaatctgaaaacccttttgttcttctttatgacaagttatatcatttgctctgacttctttcctcactagaaacttcatctgtgagattcccagacatggccatacccgaaaagttcaagagacatgggtatcgcgcaacgtcggaaacaccatcgccttcaacaatgttttcgagtaatgcaaatccaaacgccaatctatctaaacactgtcgtttcgtaatattattcaccatcatcgcctgaaactacttcggaaacaccatattcatcgtcgccgtcgttcccttaaccaaaactctgccgtttataatttaaaaacgccggctttaaacgttgtcgtctcaacttaccaatacgcagtcatttatcgacctaaacgctgtcgttttatttatgcaaaacgacagtgtttcaaataaaaaaactgaagctataaatctcgccgttcgatattttagcacggcgtcgttcaattaaacacaccaatttttttaatgcagcctatgcaggcaataatctagattaatcttgtacatactgtcaaaattagtctagatttcaccgttcataatcaaagggcaaacatacacaaacacaaacacaaacacaaactttaaactttcttctccaaaatactaaatggagtcaccaaattaatttatacgagtgacgagtcattcaatcccaaatccctataaactaatttttgtcttttaccaatttggaccaaaatgttttaaagttgaaagtttggtcaaaagtgggtcttcccaattacgatgcggcccattatggatagaaaactagctatcagagtatattgtttaatagtaatcttaaaaaaattaagtataccacttccaataaatcacacaagtattaatttcataaactcttttcgaaataaaattaaaattaacatagagtcgaaagattttaattggggataggaatcccacatgaacttcccgagaaacaagtaaataatattttttgtggttcacgaaccgatccaaaattttaattaatctctctcagtgtctcaccagatttgtttacttaaatgacgaaactacccttctatatattttagcgacaatttctgacaaagggtaagattgtcttaggtcacacacaacacttcattgaagtgaaaaaaacctttgtttgatagaacaagtgaaaaagaaacagacaacaaaaaagctaaagcaaaagtacagtgtgtgagagatagtgactgcgagagagagagagagagagagatagatttttgcacactcgaagagggaaataaagaaacaaaatgatgccttgatggagaaaactaattgattgcttttttttcttctctatctttttgtttacattacaaagaacatgatcggtttctcttattaccaccttcagtgttttgtaatctctattgcttcttcttcttctccatgtcgatgaagaaatgtttgagatttacacactctgtttctcactgtaactcgggtatgttttgtttttttctcttatgtctctatctgtgtctcttattagatctctttttttctctaaatctttaaaaaataaaaattgattctttgcttaatgctatctgattcttttggtttgttgttcttctttgactgctattttgggttctttctgattttctagggttgttttgatacactctttactactaattgggttttttgtttgctctatcaaccttatatgagatctacattgtgtatgaatcaaaagatcattacttttgcatgtgtagtttgtgttttggaagcttaatttgaatccttttgaagcttttatgacattctattcattagatctactaatcactgattaaaactctaatctgttactatcattacaagaagttgtttagtaaattttcagagatttcattttagcatgtttcatctactaatcattgaaagtgtctttatttaggaggactaaactgttttcttgtattgtgtaatgttttacagatgttttgaagtggtgattggagtggaaatg

SEQ ID NO: 8322 - DNA, 3000 bp, Unknown
  misc_feature (1)..( 3000): cDNA_ID_3445840_gDNA_ID_1971730_Annot_ID_175213 3000 nt of promoter + ATG
cctctccccgaaacgcatcgatttcatcatgggaggatctcagctctgcatagactcaatcaattcgatcaaaactcatcagaggaaggccaattcatacacaaaaggcaaaagcccgatgatggcacctgatcaccagatcacattttgggaaagtgaaaccactgacctcgataaacctcacgatgatgctctcgttatccgaatcgacgtagccaactacgaactctcccgtataatgatcgacacgggaagctcagttgacgtactcttctatgactcacctccccacgtcaacggctcctcccccaccagggaagtcccgttaccggacctggatggaaccaactctaataaaaaatagctcctccacgtcaacggctcctccaatccacaaggatccggattcggaatacaactcacctcccccaccggggaagtcatcgaacaatcgttccgacttggattcaacgcatcaaacaataagtctgagtacgaagccctcaattctggcattaagctagctcaagaaatggggatccgcgaaatacacgcccatagcgactcccaactcgtcaccagccagttcgaatcgtttgaactaaccaggatccccagaggagaaaacacctcggcagacgccttggcagctcttgcttctaaaacctcttttaggagaaaatgggtataagtgttgtctaaatactcctaattcatctctaactcttataattagtcaaaggctttggattgtgacacattttaaccatagaaacaataacaaagctatttactgtttctaagcaattttttgttcgttttagcctcttttgggagaaaatgggtataagtgttgtctaaacactcctaatccatctttaactcttacaattagtcaaatgcattggattgggacatattttgatcatagaaacactaacatatatattgactgcttctatgcaattttttgttggttttagccccttttgggagaaaattggtataagtgttgtctaataactcctaatccatctttaactcttataattagtcaaatgcattggattgtgacacattttgaccataaaacttacaaaacttacatctcatgaatctcattagactcaggaatatcaggatccggaaagacggttgatatcgggccttcggtgctaacacgtacgttctttggaccatcaaaataacggtcaatcttccaccacccaagaacaccgacaataactccaccatcatatcgacgataattatgatcaaagtcaagagcttccttcttagtagctagacattccaaaacacgatttctaaacagataatcaaaaatagtattagaacagtttaatttaggtaattcaaattaaactctcaaagaaggaaacttactcattgtcacttattttgaaagttagcgtcaaatcaacgacgtggttttgcttaggtattgtgtttatcaattctccaacatcatagatcgctcccaccaagtctccaaaaattacaaaaattaattaaaataaatcagagtcaaatatatacaattgatattgaaaatgacaaaactaatgaacactaagatgcatgatataaaataatgaacacaacaaattcataaaaatctcaccgactaaaacagatttatcgatttcatcatcgataatcgaaaagaaggatggtagaagatagtgaggaatagtgggtaccagacttgttaatctgacgacagtgtcaacagaaaattcaattttgaaggtatgagttgttggcctgacaggacccgagttctcatcaactccaaaccttgttatcgttgcccattctcttttattaataaaatctttttagtgatctgacatcttgtatccaacagtagcttcaatagtcataccctacggatcaaacatactaatcaaaactctaaaacatgcaaacctaaaattatcattacaaaacagtcaatacttacatgttcgtcgacgagaagcaaacccataacctttgaagatggaaccagcggaactaagaatgtcctcacaactctcacacgaatacaccatcctgtaatagacggtttcaacagtgtaagaggatgaaacgattccatcttttcgctgaaatttcttagttattttttgtattcgttttatgagatgctaatgataccgatatatatatataagagagagaaatacatcgtagaggcatgttagatgcaacttttaaaaaagtaataatagtcatgatgtttcaagtcatttcgtaatcttgaatattctgtaatatattttgaataactcaattattaataaaattaaaaatttggcgagtcttacattttagagaaataatagaaatattttttcgttattattaattagagttgttatataaataccaattgtcttaactgcgtggataaattagtaacaatcacatgatcctataatgtttgagacatttaataacaaaatttccataaaatttaataattatggagagaaataagtaataaatatttttcatattttttataatggaagtgattacaaattaggaaacaatatatatgcaaatatattgctaacaaaagaatctataatttaattctattatggcacaacatacagaatggatattctaatttagttttctactctattattggggaaattggaacacaaattaagggatgcttgattaagagataagagttgaaataatttattttttcaacttagaaggttcctctatgaaggtgattttacgacatatttctttggacaaatcttttaataaactcctaggggttgggttttggtgttcttttgtttaataaggttagatatctaactctttatttgcgtgtccgatgggatacaatatttgccgccccatacctctttgtttaaccccgcgcgattttcaccctaattgttagactcacaaaaggcagcagttgactcagaggtttacaagggcttg

SEQ ID NO: 8323 - DNA, 3000 bp, Unknown
  misc_feature (1)..( 3000): cDNA_ID_3046312_gDNA_ID_1971730_Annot_ID_175215 3000 nt of promoter + ATG
ggtttctactcagattgaaatttcagttgttggactcgaccattcggctggatctcgctttcaaactaagtccaccttggacgagaaagcagccatcattgagaggatggttaaacgattcaagccagcaccgttaccttcacgtgctctcccatggaaattcaggaaagcgtggatagaaagatacaagtctcttgtagagaagcagcttgataagatggaagcggtgatgcctctgatagaagttctcaacctaatcccggacccgcacaaagatgtgagaaattcaattctggaaaggattcatatgacgaatgtgatgctaatccttctagagctactgtcaagaggattattcaagaaaagctggaagatcgtgatctttcactctaccatgttccattgggcaattggctttcagcagttgtttgtgtgacttaggagcttcagtaagcttaatgccactttttgtggcaaggaagctggaattcactcagtacaggccttgcgaccttactttgatctttgctgataggttttcaagaaaacctttcggcctgctaaaagatctaccagtaatgattaatggagtggaagtgcctacgtatttcgttgtgcttgatatggaagcagaacctaaggatcctctaatcctaggatcaaagtcaggtcgaattgtaaaagcctaagtagtgtttccttgttagaagatgcaaagccaaagactcatacggagtcctgctacaccatcaaagctttgagaagcaggaagaaacttggtaaatgttttcgagtcaaatatgacaaaatgtcatgtggatgattgaatataagacttagaaccgcaaccggatcttaaaagcctagtgtttccttgttagaagatacaaagccaaagattcatacgaattttggatacaccatcaaagcttggagaagcaagaagaaacttgattgtgttttggagtcaaatatgacatgatggcatgtgtataattgagtataagaactataaccgaaaccggatcttataagcctaagtagtgtatccttgttagcagatacaaattcaaagactcatacagatttttgctacaccatcaaagctttgagaagcaagaagatgctttgttatattgttggaatcgaatatgactagatgtcatgtgtatgattgagtataagaactagaatcgcaaccggatcttaaaagccgaactaatgtttccttcttagaagatagaaagccaaagactcatatggacttcaactacaccatcaaagcgttgagaaccaagaagaagcttggttagtgttttggagtcaaatatgactaaatgtcatgtgtatgattgagtataagaactagaagcgcaaccgaatcgtaaaagcctaatagttttttcttgttagaagatgcaaagccaatgactcatacggacttctgctacaccatcaaagctttgagaagcacgaagaagcttggttagtgttttcgagtcaaatatgactagatgtcatgtgtatgattgagtataagaactagaaccgcaactgaatcgtaaaagcataagtagtgtttccttgttagaagatgcaaagccaaagcctcatacggacttcggctacaccatcaaagttttgagaagcaggaagaagcttggttagttttctagtcaaatatgacaagatgtcttgtgtatgattgagtataagacttagaatcgcaacatgatcttaaaagcctagtgtttccttgttagaagatacaaagccaaatattcatacagatttcggctacgccatcaaagcttggagaagcaagaagaaacttgttagtgtattggagtcaaatatgactagatagtatgtgtataattgcgtataagaactagaaccgaaaccggatcttaaatacctatgtaatgtttccatgttagaagatacaaatcgaacgacaaataagaactatggcaacacgagcaaagcttcaagaaccaagaagaagcctttttagtgttttggagtaaaatatgactagatatcatgtttatgatttagaataagaactagaaccgcaactggatcttaaaagcctaagtagtgttgacttgttagaagataccaattcaaagactcatactgacttcagctacaccatcaaagcttcgagaagcaagaagaagcttggttagtgttttataatcaaatatgactagattgcaactggaccttaaaagccttagtagtgtttgcttgttacaagatacaaagtcaaagactcgtacggtctttgactacaccattaaagcttttagaagcaagaagaagcttggtttgtggtttggagtcaaaaatgacttgatgtcatgtgtatgattaagtataagacttagaaccgcaaccgaaagccaaagtagtgtttccttgttagaagatagaaagcccaagactcatacggacttcggctacaccttcaaagctatgagaagcaaaaagaagctttgttagattgttggagtcaaatatgactagatgtcatgtgtatgaatgagtatatgatgcagcgcatcttaagagttcatgggcttctcgtctacgtatcatgggcttcacgtatatgagaatcctttagaatgttcaattacgttttctcctttttcttaggttattaggataatactaaatcttcgatatgattagctttagagtattcgttgttatctctttattccctaaaagtagccttcattcatcatcgttgtaatcacgctttagataataaaattcagtttacattaaagagcttcttaaccctgaggagaggatcctcatccctttgttgctttctcgatcattatcatcgagataagtaagatccaagctcgagtttgttgtttcctggagatctcaaacccctgcttgttactttgcttccgcctctctatcagttggtatcagattctagtttttcttggcttgaaatttgaatcaacaatg

SEQ ID NO: 8324 - DNA, 3000 bp, Unknown
  misc_feature (1)..( 3000): cDNA_ID_3046303_gDNA_ID_1971730_Annot_ID_175218 3000 nt of promoter + ATG
gctcttcctcaacttattagcttgttttagattctgtataagcttgtgttaggttgcaacaatgattagcttgtgttaggttgagatcctctagcttgttgtcttgagttgcttgtcttaggttgcagcaataattagcttgtgttaggttgtgtcttgattagcttgttgtcttgatctgcttgtgttagattgtggtggattgtgtcttgattagcttgttgtcttgatgagcttgtgttagattttgatcgattgctattgtgtgaacataaagctcatgtcttgatgagcttgtgttctgttgtggtggcttactctcttgtgttctgttgtggtggcttgctatcctgtgttagattgtggtggattgctcttgtgtccgctttgttaatttgttgtgaacatatattgtgtcttgatctgcttgtattagattgtttcattggattgtgtcttgattagcttctgtaatactactgtcttgatgagcttgtgttagattgtggtcgcttgctatcttgtgtgaacattgtggtcatgtcttgatgagcttgtgttctgttgtggtggcttactctcttgtgttctgttgtggcggtttgttctgttgtggtggcttgctatcttgtgttctgttgtggtggcttgctatcttgtgttctgttgtggtggcttactctcttgtgttctgttgtggcggtttgttctgttgtggtggcttgcttacttgtgttctgttgtggtcgcttgctatatcttctgtgaacatagtggtcatgtctagcatacttgtgttctgttgtggtggcttgctctcttgtgttctgttgtggtgacttgctattctttatgttgagtagtttcactaatgtaacatgtttttatctttcattgtttcatgtgtttggaggtttactcgcgacaggggatcaaagttggttagaaagatcactcggatttttacacaaatgctccctactataactggtcatgtgtaccagtgaataaaagagagaggttatttcttgagtttgcggtaagctgtcatgcatttctcttactttcttaactttccagcttaatcttttaaatttcactaactcaagctacaattttttgtagaaaactcacagttgggatcccttaataacagagactgtgcagtattacttcaatgaggtttgtaaacggcgcttgaaagacatggttagcaccgcaaggagaactagggtgcagctgttatgtgcgcttactgggacaccgaaccagcacaaaaacggagtcggacctattccaaagcttgtctctctgaccgtaacggtctcggtcctcacatccacttctctgggccaaagtcttttcaggaaatccaagacgaattagtaagtttttctgttacctctttcagttacctcacatgtaagtttttgagtatttgagctgtgttggtttcagtgcaggaggagaaattgggaagaacagtcactcttggtgaggtgtttgtagagactcatactaagtcggatggtacgtatgttgatcggaaggcggagatgattgctcaaacttatgagcagaatgtgagagatagattgtcacagctagaggcggaagcttctgctgacaaatgaggagttgacaaccatctttctccaggtaaaatgttgcaatctaaacctcttgactttgagtttttggttattcattcactaatctcttctttatttcttttcagtccaccgaaagggattccagaggcaatccttatggacttggcagtctcaaagacacattaggctgtgccaactgcaatctccctggacaatcatcatcttccttcctagatttagaagaatggctgaagaaatcgcaacgcaagattgaggagcaggcagcctacaatgagaagcgtgattctgagattgttgcgcgtgaagcttagactgcccgaatctttggaattccttgacttgtcgttagtggagaagtatctccgacaaacagatccgcaattccttgacttcatggcctctcaatcttcgacaaccacagagcctctaccagctactccacataatgatcaataggtttagatttcagtcccttttcacttgaactttgaacaataatgtttgtgtgtgtgtttagtactttgaaccttaagtgtaagttgtgttttatgtatttgataggattttcaataaaaatgtgtttttgttatactttatagcatttagaacaacaaacaaaccgaattctcagaatcgatgaccaaccaacaaagaaatcaagatatgaccaaattcttatttggacacaaaatgtcgtcgtcaaattgtcgtccaatagtcgtcgtatagtcgtatcatagtcgtaaaatagtcaccaatattaacgactatcgtctgacaatataagagagtcgttaggtagtcgtaaaggcgtcgtacattagtcgtatattatttagcgactaagatacgacaaccagaatagtgcccagagtttaatacaattgatcgtaaactagtcgcaaagtagtcgtcaatggaagtacgactagtttacgactacacgaataatcccccataaacaggttaattaatcgtatcgtagtcgccaaatgttacgaccaatcgacgactatttcatgccgattgttacgtagtcgtaagttagtcgtaactttacgactaacatacgactatgttgcttagcgactatatatatacgactactctgattagtcgtctattagtcgtattatttctgtttacgactatgaaacgactagtgttgtagtcggtaaacgcctgttttcttgtagtggaggcatatgtattctaagaaggatactaaaccaagactattgagatggatacttctgttgtagaagtttgacatggaaacagaagacaagaaagcattgaaaatggtgcagctgaccatctgtcaaggatgagaattgaagaacctattcagatagacgactcaatg

SEQ ID NO: 8325 - DNA, 3000 bp, Unknown
  misc_feature (1)..( 3000): cDNA_ID_2038917_gDNA_ID_1971748_Annot_ID_175228 3000 nt of promoter + ATG
ttcacttcaagtggtacagagtctttttttttttttttttttttttgttaaaccttgctttcattcaatggaacatagaacaattacaagaaatagagtttaagaactcaaagattaaagcattacaacaaacggtattccccaataccataaaaagaaagataaagtgcatcgatttgaattccatgagagctttgaggcataagcaaagaagcacagtgcaacatgtgaggtcacagtaaatcgaaggatcatcctcgaaatagtcgaaggacaacaggttggtcacggtcaagggacgtagtgacgttgacaaagacatcgaagctatagatctcaccggggctagctgcaatacccacggaaaaaggatagcaaggattcgaaggactatggttctatagtcggttaaggttagctttaggatccaacacaaaaggcaaacaaatctccgatcaatagcggcatacactatgagacaatgaaacatgatgatggacatagtgatgagcttgaaggcgatagatgagctacttggtgaccattgagcgatgaaaacccataattcaaagccacatttgacacaaaggcaagtacaattcagaaaaattagagagaaggtcttcaagactttggaatgaggccacacattcctagatatagctaaaaccaggattcgcaaatgataaatgaagaaccaaaacctccatggtgatatctctatcaaatggtgtccatggccattgataagaggagatcgacacaaaaagattaatgggcctaacatagaattaaagaaatcagatctgagaataaaagccttacaagttctaaaacaacagatgggcttgggcctgaaaggaagaaatgggccagcgaaagaaactaggtccactggggaaaaccctagtttcatgtcgaggtgccaaaacgctgaggtagagcggcggctgtccaagaaaggcgagatgatttgcagcgcaggagtcatctccgatgagtgaaagatcgttggaagcagactatgaccatggctcaagtaggtggcaaagatccagggggtcgcatccttttctacatgggatagctccgagcacgaatctgtccaaagagctgcagcagaggaatgggagaaggagagagcatgttgcttcaaccttccttccttgatttgtgttgaagagcgtcctggtagagatgcaaggtgaggtagattggttaacaagttatgggctggaataacaaggggaataacaagaggggaaaggatgggaaaaagcttcaaaaggggaaaaataaagaaggaaactaaggtaacgaaatagcgacgaaaagaagagaagttggggtcccgatgccggtgaacagaggcttcaccggcgccggaaagagtagtcgatgagagagcttcgataatcggacctgaaagagaaatagtttttactttagttagttttgtggtacagagtctctgaattggaattgacgttttagatatacaatggtatccatatatatatataccaaattaccaatggtataataccatcataaattcattatcacatcacttttattttagtgaatgaagatgtaaatatgctattatgaaaaaaatttgatggaaaacaaaatcattgatataattgttttcactcgtacttaggaagactccctaatagtaaagcaaagttagacgatattgttttcgtctttggacacgaaatattttgaaaaccttccgacataaattaacggtgaaggccttttaaaagttttgtcgttaaaaatatgatttgacaaatcgacttagttagtgggtttctggagatgtgtactatcatggaaaagaacgagaaagatttttttttttaaaagttgatgtgattgggcccaattagaaaagttttcggtccatacaaaagcctagtaaggttgtgttaactagatcattattaaaaatatttttggttgattagtattattattaattggccgattgactgaaaaataatctgatatggttttgccatcttttttgaaataatcgttaaatcattttataaaactatccacatgtaaaacaatgcatgaatatatacagttgttaatcgtctaatattgttagtttattttgataattgaattgtactattcttgcagctgtttgaatggttagatgttgaatcttacctggtacacaaatcattactggttagagcacagaaatcatatatggaccggcacaacattgaaataagaaccatcttctctaatcaggtaactaaaaaggaggtcacgaaacctcaacgaagatgtgaacgcaaactaactctctcgtcacaactcttaaactcagtctctcgtcagtcgtcacaactctcaaggttttgttttagatttatatgtatgtaatacatgaatcttttgtttttgaacttatgtatacatgaatctaaaacgtgcatttttctaatctaatcaatatcttacctcctttttccaaatatttaatcgacatagtccaaaaactgtatgttcatccataattaataacaacaataggtcttgtaaaacccctttagtatgttgtaaaacctagcaaatctactagatcgcatctaacatatctgtttatcaaatttaacatgtgtaattatctagatttaaaagaatctctctcattttctaaaaaacaaattttatttttctttaacagacttttattttctaaacatcagatttaaattgtatttttaattatcttgatgctatatattgggaaccacgatactaacagactttcgttgtcgcatgtaaaatgttttttttttgtaatcagacttccaaccaccaacttagaaaagtatctataaaacagagaccaatcaagaatacacttatctcttttcttaaaagaatcttttttttttttttacttcattgactctttttctctatctctctagatcgaaagggaaaaggagatagagattgaag

SEQ ID NO: 8326 - DNA, 3000 bp, Unknown
  misc_feature (1)..( 3000): cDNA_ID_3045028_gDNA_ID_1971748_Annot_ID_175256 3000 nt of promoter + ATG
ccacggagatctgctgcctttatctctgtctacggtttgttaccgctacggaaccagtctcacgctggtttactctcagtaggagaagtggaagtgttttggttccttctgatcattctctcccatattcaaattcaaccgtaacgatgggttcgaaaatatatggtgaacatatgggtgacgcttttggtccgtcttcagctatatggatatatgactgttttactcgctcgtggggcgatgtccccaacatgaagatgaagagggaaaacgcctccgcatgtgttttggatgacaagatttatgtaatgggaggatgtgactctgggggcatcaattggttcgaaatgttcgatgtaaagactcagtgttggagacctctaccggcgaatcctgacgttaaggtgatgacggaagataatgttcgaaaaatcgatgtggtgggaggaaagatttacgtaaagactggggctgagtttatggattggatttatgatgtgaagcgaggtaagtggagtgctgcagatgagtatatgagtttactatggtcgaactcttggtgcgtgatagagaatgtgatgtattgttactcttgctctagatataggtggtatgatttagaggctagaatgtggagagaagtgaaaggtttgaaatatttgaaaagatacagtagtgctagtaatgataatcgtaatcgtatggttgaattagttaactttggtgggaaacttgctattctttgggataggttcgagcggcctggtcgtagtgagaacaagaatatttggtgtgcgatggttgcgctcaacagagactttgaaggtgaaatttgggggacggttgagtggcttaatgttgttcttacagtccccaagtcatataatttcttgcgtcctatagccgtttcggtttgatgatctcttagtcaccttgtagagtcatccttttgcttttaccaaacttaaatgctttgtcttgtgtttgttgtgagtctttttttcttttttctttctacaatttgttgtgagtctgtaaaatcctaaatgaattcatctgatttctagactttgtattgtttcaatttgcattctgcattatgaccatctcctatcgttttgttggtttaattctggttacagtaaacactaagtccttgtgaggcaaatctctttgttctttctaggtcttcatctaaataatgccagtagaagaatttgagtaccttttgatttcactttaaagtgaagtgagattctcctaaacttaatatattattttatatatgccttggtgagatttacattcaagattagatggtttaacatttcagtgttccactttaatatgcttttcctctcttcctctgtttctaagaagaaagagtcatctcgtattcggtcaagttcaaaaccctttagtggctacaaacatttgctatattgtacgtatggttaagacttaagataaaatggataatggtttgtgttgtttcgatatgtagagaatagttgttacttgtcaccggctcataaaatatttagttttccggccgactaatcccggactttccagtagactcttgatttaggtttagctaatcatattttttcatctttttgtggagagtggaaatgtgcagagcaaattcgtcagttatacacttttgtcattatgaaattcgccaaaatggtataacacaagtgagacaaattgagtaatttcgtaagcttttacgttttatgtgttctgtttaatagatcatatacgattattatatatatcactagttcgttagatatctttttttttttttttaatcaaatttttgaaagtagtttgggattcaccgttcaagaataattgaaactttggaaaattaaagatttactagattttcacccgcggtataccgcgaggacaaattatattttaaagttagtatatataaaagtttgtaatttgtaacaatctatgtaactatctataaatatttttattttatagtttagaattgttattaagtaacgtcctgtcaaacccgtcccgccaacccgtcccgtaaaaaaaactcatttattttattaatgttgatcttatttatcatatgtttatgaatcattatctaaatattttgtaattttgtagtaattaaatgctatcaaatatttctgcggtttgatgattataattgaattgtaatagtcatgtagaaaaacaataataatgataattttgtagtaattaaatgatattaaatattttgaaagttttattttaataaccaatcgtgtagttaatgtagagagattttaggaagattgttaaatgtcaaatatttaattcgaagattttttttctaattatcaaaaacaaatattaaaatccagtgacaaccattgtaaataagtcccaactacaagatttatttcacaaaatggctgcaaaaatgtatatatagacatttgtaaagaatgtgcataattacagttataaccttaaacgatgcacatcctttataaaatttacttaactttgttttattatatagttctaaattactaaataagatttcatttggaaataacttacaattttctagtaaagttcccaatttaaaaaaaataaatagaaaaagtgaaaaagaagattttttttgtttgtggaaaaaaagttcagattttttttgaaataaatacaaaagtcgtaaatctaacaaattaatatttttatacatgttaggaataataatttttgtaatgtaatgttaaactaaactaattaagaaatttgtttagaaacgtgtcgaattggggttaaactcatccaaactataaaacaattccgaggaagtccaaaacacgtatctttttcctccgtcgccggagacgattctctttatcaccggaataatcagattccatgttcgaattcagctgagtattataagttataaccccaatcgaaggacaaagaattttaatttttaaaaagtcttcg

SEQ ID NO: 8327 - DNA, 3000 bp, Unknown
  misc_feature (1)..( 3000): cDNA_ID_1010357_gDNA_ID_1971748_Annot_ID_175254 3000 nt of promoter + ATG
aacaacattaagccactcaaccgtcccccaaatttcaccttcaaagtctctgttgagcgcaaccatcgcacaccaaatattcttgttctcactacgaccaggccgctcgaacctatcccaaagaatagcaagtttcccaccaaagttaactaattcaaccatacgattacgattatcattactagcactactgtatcttttcaaatatttcaaacctttcacttctctccacattctagcctctaaatcataccacctatatctagagcaagagtaacaatacatcacattctctatcacgcaccaagagttcgaccatagtaaactcatatactcatctgcagcactccacttacctcgcttcacatcataaatccaatccataaactcagccccagtctttacgtaaatctttcctcccaccacatcgatttttcgaacattatcttccgtcatcaccttaacgtcaggattcgccggtagaggtctccaacactgagtctttacatcgaacatttcgaaccaattgatgcccccagagtcacatcctcccattacataaatcttgtcatccaaaacacatgcggaggcgttttccctcttcatcttcatgttggggacatcgccccacgagcgagtaaaacagtcatatatccatatagctgaagacggaccaaaagcgtcacccatatgttcaccatatattttcgaacccatcgttacggttgaatttgaatatgggagagaatgatcagaaggaaccaaaacacttccacttctcctactgagagtaaaccagcgtgagactggttccgtagcggtaacaaaccgtagacagagataaaggcagcagatctccgtggttccgagttgatatcgcgcggagtagaggggttgagagtggaggagagaacgaaaggttttgcagacgagggagagtgaacggtaagacgatttagagagacgtgccaagcagttcaccaggatctcgtcgggaagttgcaagaacaacgacgtctcacatggtaacgacggaagcttcgtttttttctgcggccgctcaacttcttctttggggatcatctttggtggtgatggagacaaaaatcatgaaatggggttcaaatatatagaaatccttctccctgatgtaaagaaagatagtaatgtagtcaaaagaaaaatcaaagggaaaatttatcaagtttccattggaaaagagatatcttactataatctaaattttatttctcaagatatgtacaatagataggcaaactaatagctatattccacgcgctagagtcgcgcgtggatctaacttgcggacggttttctctttcaaatcttctttcttttgatcacaagaggtttactaatagctcaattctagctgcctttatttttaatattaaatttgattaatacaaaagcaagactatatatatcaaaaccttacaataaaactgtgaccagtggagattgaaccaaagataaaaaagctacacaaacctttgaatttcattgaaacaatgctttccagataaaagcatggtcaaaatttacttctagtgttttatcgttctaattaactattgttgataatttaactcaatcatatttttgtatgatatcttcgtaaaatttctatttcaaaatattaaaaaaaaaaaagggacattcaatctccaagagactaaataagagagagtcatcaaaccgaaagacttatacaatgctggaattgatatgactcgtattgtgtaaccatagcatcagaccaccactcagccttaccctaaacctcacttccattgcatcttgtttctaaggaaatctcggcataaaaaattgttgttcccgctctggctttggggttccacataaccattggggagattggtgctcaggcaattctaagcagaaatattcttagaattttgagatcgtgtagtgtagatttggggagaaatattctttttgaataaaaaaaagtaaaatagaaatattctttctaaatttttgaagtcaaaatgttaagagaatcgagaagaaattcaccgttgtttttcaaaaaaagattcactgtagttaatgggttaatgcccaaagaaaaataggagaagaaacccaattggcccacgcccactcaaatcaagaaattaacttggtacgacattatcatctttaataaaattttgtatacagtaccttcattgccatgatcaaatccatattagatacatcgtttgaattatacccttattaggctcaaactcttattatcattgttccaagcaatagatcatcttgattttaagtaagcctttataatgttccacatgttctcatcaactacttatgacactgcttaaaatctgataaaactagtagccagacccaaaaacaacttatgcttgtgcactctaaaattccaaaacaacatactggatttacattttcaaatggtaaaaaatcaaatgtaagaaattgcaattactttggtaaatacaaaaattgcattgagtggagattggaccgttaaaaaaaaaaaaaaaaaaaaaaagcagaccactgtggtctgtctgtactgtagtactctttgcactcgaacccatttatctttttaatattattttttattattataaatctaaaaaagtttttttttttttttttttttgttctcgaagcagtaaaatctactacaacagtcaaagagagagagcaaacatgctcgcttaattcacggaatcgagacgtttctacaaactcaattttatattttcagctggaatccgaactctgatatagaaagcacacaacgttcacctccagtgacttctctctatctctaaatctctcttgcgtcacttaaaaagtcggtgcttcctacttaagtgttcttgagagtgagacgtttcatttctgggttcaagggtgtagaataaacacttgagtgaagtttaaagcttgagaaagacagaggaaagaaaaatg

SEQ ID NO: 8328 - DNA, 3000 bp, Unknown
  misc_feature (1)..( 3000): cDNA_ID_2990205_gDNA_ID_1971748_Annot_ID_175267 3000 nt of promoter + ATG
ttaataaaccagtgcttatttagttacctatcccactgaagaaaatgccataattcattcctctgtacacggttggtatcactgttgaataagggcattccttggaaaatccaaccttttggttgttagattcttggattgattgtttaagctcgtttacgcaacgctggaactgcttgtggcagtcaacataagtcatacctgtaaaaaagcaccaaatgcagcattctcagatccaagatgcagagtgcaattagatttgtagtggacaaagtagttaaaagatgttaacttcactttgtgtttctctgtttatagaatagttttacgtagatattcttgattggtttaccttttaaatcaacacaattatcatgagtcatacaacaatcatcaagatcatcacaaggtggctctccaggacatccaaagtaacctatcccacaatacttcccatagcgaataccgagaactgaaacagagataggttttgcttcagaaatgttctccatgttcaaaggaatgcataagaaaaatgaaaatctcaccattgcatttctgtgcaatgcaggttttgctgcacttttcctgacattttgatccaacccatcagaaagaactagcaataaccatcatttggaataaaccacaacgcacaaacatgaacaaagaacagtaagtgatatgtatcaacctggctgtgaacgacggcaaggaggaggaagacggttaagcctaaagcaacatgtgtcaaagcaccaccgcggatcatgtttctatcttaccttctccagtagaagtttgttgttttgttctttcaaattctgaccccaagaattataattgtgtctctttggaatggaaggtcccattcttggtcctcctgctttctcgtccctcctctttctcatatgtaaaaaaagaagacgtttcatgattaccaatcaaccaccaaattttatggccgttctttatcaaaaaataaaaattatggatgttaagaacagagtatcatgaagatctacataatcttttagaaacgatatttattagattgcaaatgataatatggtttcaaattttgtatcattgctgatattgatattaaacaaggacaaaaacattatagtgaaagcaatttcctgggaaattttgttcttattgagagcaacctttatcaaagagttatagcaaaatggatttttctcagcttcaaagcctccgtttcagggataaactggaaaaaaaattgattcaagagagaatcatgaaaactaaaaacggaggggattacacaatcttcaagttattgttactctccttcatgggtaatagcctgtgaaggtgaatcctctgccggcgatttcacctgcgcaataccatgcaaagcattcgagaccaaacaatgcagcgattcctgcatcttctaccttcagaccggatctgttcttccataggttctttgcgtagtctacttccttccagaaggtttcatagcgtccgggaatgctgtaataaggagtggaagagtgttagatacttaacactatgggcaaaatcaagattgcaaaatgtgaatcaccaaaactcttcaattcatggcaaaacaaaaggtggtgatagaactcgcatatgtataaacttttcaagattaaggaacaggacatgctctaaagccgtcatcaagaaaaaggcaatatactgagacctcttttgtacccgaaaatatggaccgtaaaagattaagagtcaggttattgtataatctaagacttagtagactggaatgatcgttgcaaatgggcttattagagattaataatcgaacaaacttaagattgactactttaatacacaatcctgcaacttatgaaaacagattaaacaagacaaacagctcaacaaaaagatagcatcacgaggtcatagaaataagaggatagaataaaggattcatagtatgccattttcagttccatgaacagccaagttttgtatgagctcagcattccctggctatcttatacctcaaagaagatgctttattgacaaaagtctctttctaaccagaatctagataaggtaactatgaccagggaaatgttcatatagaaggaaaagagagatatcgacctagcaagacgggtgtagagcaactgcttagacaactcttggcacttctcaacagtggcaggttcctggatatactgcttgttcttctccaacagctgtctgtagtaggaagttccatgcttagccacaaactttgaagcctcacatgcctttgattgaacttgtatcaacttcgatgccatcttcacaaccaaatccttcaaatacaaaaagagattctttgaatcataaaatttaaattaatcaaattttgacattgaaaattttgtaaatttccctactacagcaaacaagagacgtttcagtgaattcacacaaatcaagcttaaagacttaaaaagcctaaaaccccaaatcctatattccataacgatagatcgaacaaactacagtgtgaatcaatcaagcaaatcaaaattacaaatcagtcactcctagaacgaacaaatcgttatcgaagcaagaagagatcacagatatagatctaaaagtcaaaccacaaagcatagcatatacaagagaagcaggagcaaaagcctcgacccaattgagaaacatcggtcagagaccagaaactcgccgtaccttcctgcagttttgataatgcagcaccggtgagctgagagatgagtcgattcgagatttcgggccactggttcaacaacaactgcgtaatacttctcttctttatgttagaacgacggcgtaatatgcgtttcgattggaacgatgtcgtttctttcacactcttagaacgacgtcgtatatattcgttttcctcgagttctataaaaacgacagcgttttggatatttggctttattattaggccttgccggaaaaacaaaaaactagctcatcgtcgtc

SEQ ID NO: 8329 - DNA, 3000 bp, Unknown
  misc_feature (1)..( 3000): cDNA_ID_2038813_gDNA_ID_1971748_Annot_ID_175265 3000 nt of promoter + ATG
caaatctccagagaaagtgaagaagaaaggatgaaatgtcaaaacctcaaagctggcaggttttgagaagttactgctgtcagtattaagaccatgcaagagatacaacaggggctttccagatcccttaaattgttcattaaagacttgaataatctcatccacatagaaaaccatgtcaaccatatatgtttcctgcaacaagaagcacaaactgcaatcactataaactcactgaacaaattaacaagacttaaaaaagttcaaatatttaccttaaaatgcgacaatggcttaatctctcccaaccaaacagcataatcatcaggcaaccttggaataaaaaggatagatttcccacttccaatgtccttccaatatcgaaagtgactcaatgtcattggttaagcaacaatcaacatatatagaatgaaaatggtgaacgggtcatatgttcttaagaaatggagatatagctagcaaaactcacaatagctccatagaaatctggctctctgactccaaacaagtaagcaaaataactctcttgcctacaagtcagttcaatatcatcttatttccactcaatacattgaacagattgaaagagaagaaacctcgagataaaatttcaaatcaatacctgaagagctcggtgtgatcagtacagtatcgatttttctcctcgccaccctatcgtccagaatcaagaaaattacaaactaaacacaatgaaagcgagctcggaatcggatcatcgatacgtgttggaaattatgtatataagagctaatcaagggtacctgtagaagaacaaatccatcgagagaacgattggaactagataactgacggcgtattgattctagtaactttttccggttaccggcgtggagttccattggaatcggtggaggagacagagacgacatgacgacgatgagctagttttttgtttttccggcaaggcctaataataaagccaaatatccaaaacgctgtcgtttttatagaactcgaggaaaacgaatatatacgacgtcgttctaagagtgtgaaagaaacgacatcgttccaatcgaaacgcatattacgccgtcgttctaacataaagaagagaagtattacgcagttgttgttgaaccagtggcccgaaatctcgaatcgactcatctctcagctcaccggtgctgcattatcaaaactgcaggaaggtacggcgagtttctggtctctgaccgatgtttctcaattgggtcgaggcttttgctcctgcttctcttgtatatgctatgctttgtggtttgacttttagatctatatctgtgatctcttcttgcttcgataacgatttgttcgttctaggagtgactgatttgtaattttgatttgcttgattgattcacactgtagtttgttcgatctatcgttatggaatataggatttggggttttaggctttttaagtctttaagcttgatttgtgtgaattcactgaaacgtctcttgtttgctgtagtagggaaatttacaaaattttcaatgtcaaaatttgattaatttaaattttatgattcaaagaatctctttttgtatttgaaggatttggttgtgaagatggcatcgaagttgatacaagttcaatcaaaggcatgtgaggcttcaaagtttgtggctaagcatggaacttcctactacagacagctgttggagaagaacaagcagtatatccaggaacctgccactgttgagaagtgccaagagttgtctaagcagttgctctacacccgtcttgctaggtcgatatctctcttttccttctatatgaacatttccctggtcatagttaccttatctagattctggttagaaagagacttttgtcaataaagcatcttctttgaggtataagatagccagggaatgctgagctcatacaaaacttggctgttcatggaactgaaaatggcatactatgaatcctttattctatcctcttatttctatgacctcgtgatgctatctttttgttgagctgtttgtcttgtttaatctgttttcataagttgcaggattgtgtattaaagtagtcaatcttaagtttgttcgattattaatctctaataagcccatttgcaacgatcattccagtctactaagtcttagattatacaataacctgactcttaatcttttacggtccatattttcgggtacaaaagaggtctcagtatattgcctttttcttgatgacggctttagagcatgtcctgttccttaatcttgaaaagtttatacatatgcgagttctatcaccaccttttgttttgccatgaattgaagagttttggtgattcacattttgcaatcttgattttgcccatagtgttaagtatctaacactcttccactccttattacagcattcccggacgctatgaaaccttctggaaggaagtagactacgcaaagaacctatggaagaacagatccggtctgaaggtagaagatgcaggaatcgctgcattgtttggtctcgaatgctttgcatggtattgcgcaggtgaaatcgccggcagaggattcaccttcacaggctattacccatgaaggagagtaacaataacttgaagattgtgtaatcccctccgtttttagttttcatgattctctcttgaatcaattttttttccagtttatccctgaaacggaggctttgaagctgagaaaaatccattttgctataactctttgataaaggttgctctcaataagaacaaaatttcccaggaaattgctttcactataatgtttttgtccttgtttaatatcaatatcagcaatgatacaaaatttgaaaccatattatcatttgcaatctaataaatatcgtttctaaaagattatgtagatcttcatgatactctgttcttaacatccataatttttattttttgataaagaacggccataaaatttggtggttgattggtaatcatg

SEQ ID NO: 8330 - DNA, 3000 bp, Unknown
  misc_feature (1)..( 3000): cDNA_ID_2038824_gDNA_ID_1971748_Annot_ID_175263 3000 nt of promoter + ATG
acttactgttctttgttcatgtttgtgcgttgtggtttattccaaatgatggttattgctagttctttctgatgggttggatcaaaatgtcaggaaaagtgcagcaaaacctgcattgcacagaaatgcaatggtgagattttcatttttcttatgcattcctttgaacatggagaacatttctgaagcaaaacctatctctgtttcagttctcggtattcgctatgggaagtattgtgggataggttactttggatgtcctggagagccaccttgtgatgatcttgatgattgttgtatgactcatgataattgtgttgatttaaaaggtaaaccaatcaagaatatctacgtaaaactattctataaacagagaaacacaaagtgaagttaacatcttttaactactttgtccactacaaatctaattgcactctgcatcttggatctgagaatgctgcatttggtgcttttttacaggtatgacttatgttgactgccacaagcagttccagcgttgcgtaaacgagcttaaacaatcaatccaagaatctaacaaccaaaaggttggattttccaaggaatgcccttattcaacagtgataccaaccgtgtacagaggaatgaattatggcattttcttcagtgggataggtaactaaataagcactggtttattaataacactatgagaatcacttatagacttcggaaaccataagctagtgatgaaaccgaattacttatgttacattgttttgtgacattttgtattatagcacttactatactgtcttctaatgttacactgcaaatagcttagtttagctagtgttaaaatctgataagatgcgaataatctcgcgcaggtaatatcattatacctaagaagccagcaagtgccgggcctgtcgtggaggtggatctggcacggagtaaagcggacacaaaagatggccttggaacaaatcaaggccctcaaacaaaagatggctccaaagtctctgttccgatgaacccttctccttcttgatcattaggtgactcataactctcaagttttgtagattatttaactttgttgtcttatgaaaaatgatcaagatcttgaattctctcaggttcatgattcccatgtattttatacattacattagtttctcttttactctagatatgagaggattcaaaacgaattcatacttatataagaaatcaaatgtagaaaagaagaaaaagtgtatatggattttttttttctaataaatcaaacataaattctgttgtttcttgatgtaaaaatcagcaatgatacgaaaatcgaaacatattaatctgcaatctatttgtaacagattgcattaagaaaatcattagccgttgcgaatacatagcttaaacgtgttctgttccaagaggtaacaaaaatgatactctgtttttaccgtccatgataatgcttcttcgagaaggaacgtccataaaatatgatgatttgattggtagtcatgcaacttcttcattttttaaattcttgtgtacgtaaaagagagagagaggggaaggacaagaaagcaggaggaccaaccaaaaatgggatattccattccagagagagccaaaaatagtttgggacagaatttgaaagaacacaaaacccaaaaacttcaaccagagagcgagatttagaaagatgatcaccgggcttgctttgtcacgtgttgctttcggtttaaccgccttcctcctcctcgccgtcgttagcagccaggagaagtgcagcaacacctgcattgcacagaactgcaacagtaagattgtttttttcttatcatcttagttcttatgccttcctttgattttggagaaaaaaacttgtgcatgcattatatgttttgatccaatctttgttttcaggtcttggtattcgctatgggaagtattgtgggataggttactttggatgtcctggagagccaccttgtgatgatcttgatgcttgttgtatgactcatgacaattgtgttgatttaaaaggtaaaccaatcaacaacataatctatgcatgaaaaccattcttgagttaatatttggtttttattaggtatgacttacgttaactgccacaagcagttcaaacgttgcgtaaacaagctaagcaaatctattaaacactctaacggagaaaagattggattctccacacaatgcccttattcgatagtgataccaaccgtgttcaatggaatggattacggcattttcttcagtgggataggtaattattgagctctgattttgtgacattcaatataagctagtactagtgatgaaaccacatgactctttttctgttacattgtgacatttcttatgataagatatatgtgaataatctctgcgcaggtaatatatttaatcccccggtgctgggaagcgtgcccgtcgtggaggtggatctcgctcggagtaaagtggacacaaaggatggccttggaacaaaactaggccttcaaacaaaagaaggctccaaagtctctgcttctttaaatatatgagcccttctagtactatttcttgatcatcttctaaagtgactactctctgtaacttcgttgttatagaaaattcataaaacaaaaaaagactttgaattctgtcccagatcaaaatcaactggcaatcaatgactcagtctatgtattttatctattattttggatgttaatcacatctttaataacttcactaaagtcaaaacgtgacattgtcactaattccatcttataaaatccaggttgtcttcctgtccttagtgggaaatatatatagttactgagccaatgatgaaagaaaagtctacaaacacctggctaataccataaagagtagactttgcactttttggcttttaattaagcttatcttactcgcacgtagtctgtttttttcctgaagatggtaagctgaagaacttctgaaaaaagagagaagaaaatg

SEQ ID NO: 8331 - DNA, 3000 bp, Unknown
  misc_feature (1)..( 3000): cDNA_ID_2038828_gDNA_ID_1971748_Annot_ID_175262 3000 nt of promoter + ATG
gaaagtcctgtaagtaagcacaaatatacacagtgttggtctatttaaataatgaatttgcctcttgacacatttacttgtgttgtaaggaatttgaaaggaaacaattttactgggtttatcccaaaatcccttatgaaaaagttaaaggccggtttacttacgctcaggtaacagtttctagcattattcagaaagttattcaacacaagcactctctctgaatcttgtgatttcctctgttttgcagtgcggatgagcaaaacctttgtaactcatgtcaagaaaagaagaagaagaagagcatggtcgtgccaatagctgtagcagcatcagtgatcgttctcgttgtcgtcttggttatcatatggatcatactaaggcaaagaaaaaaaggttagatggctggaatatttacttcaggattaatgaattgaagttgttttatgctgagaaaaacgagtgttttgatttcaggagcctattcaggaccactcctgccttcagggaagagaaggttcacatataatgaggtctctagcataacaaacaacttcaataaagtgattggtaaaggagggtttggtattgtgtaccttggttcccttgaagatgggactaaaattgctgtaaagatgataaacgattcttcattggcaaaacctaaaggaacttcatcatcatcattatcccgggcttctaaccaattccaagtcgaggtgatctaaagaacaccaaaaacatgatcaaatattttagaaattaaaatgcttaagtactgtaaaatgtttgcaggcagagcttcttttgacagtgcatcaccgtaacttagcttcatttgttggatactgcgatgatgatcgtagcatggctctcatctacgagtacatggccaacggcaacttgcaggcttatctttcaagtcatcttattatctctctatatatctctgttaccaattgttgctttgcttcctatgagctcacgggtgttatgtttatggacatgcaggtgagaatgcagaggatcttagttgggaaaagagactccatatagccatagattctgcacaaggttggtcccggttttggcaaccttgattcctcagggcttaaccaagaaaccaaacctggtttagcctagttctgtattgtgaaacctggttttatttcccccttggcaggtttggagtatttgcacgatggatgcagaccagcaatagtacatagagacgttaaaacagcaaacattctaataaacgataacttggaagccaagattgctgatttcggcctttctaaggtcttccctgaagacgatctcagccacgtcgtgactaccgtcatgggcactcccggctacgttgatcctgagtaagttccttttcacaatcaatacagatcacatgttctggctggtagcttcacaaaccagagcggtttagtgagactagggttagggttggccaattcagttcggaccctttttaagtttatcaggaatacatggtaaccaatttgcgacgtgtggtgacagatactacagaacatttgtgctgaacgagaagagcgacgtgtacagttttggggtcgttcttcttgaactcatcactggccagcgagccatcatcaaaacagaagaaggagacaatatcagcgttattcactacgtttggccgttctttgaggctagagaactagacggcgtcgtggacccgctgcttcggggagacttctcgcaggactcagcttggaagtttgtggatgtggcaatgtcttgcgtcagagataaaggatcgaatagaccaacgatgaaccagatcgtagcggagctgaaacagtgcctagctgctgagctggaccgtgagccacagagccagtgaaagtcaaagagattacggagaagtaggacgaagccaaatggattaaaagaggtttggataatttctatataggttatttgtgttgtatggtcagattcatattatgattgactacaatttctaaaaggtttctactcaaattcttttgtataaaattcgatcgttgtcgattccgttaaaatcctacttgtaatagttttgtgatgaaatgaatgattcatatttctcataattgctgatctaggaaattaacgtactatagatcaaattgataagctttgaattgagtgatgaatcatatatttctattaaattgtatagagttttatcatgttatttttgttgaaaataaatcaattaatttcttcttaaacaattgttttttttgtctaatacaaaaaatgctaattttgaaatttagttttatggtatttcagttatctgttgtcggtgtctctacatttaaagacatttcaaaacatgtgacccactaactctagacatatacaaaaaatcggttataattatttaatacatatctagttattttgtaacgctttaaattttattagcttaattattattttttcaagattgttttgatattaatgaagatctgataaaaatcattgtttatatattaaatgattcggggattaattggagtaacgaaagatattcaaagttggaaaatctaatatttgaataaccttacaaaatcaataatgttaatatacaagatttttgtttaaattactgtcgacatgacacatgtctttttcattaactcgtttttctgagtttttgttttcttacatgattgtcattttgacgcgttaatcaaaatcttctaacactatttaacccgtttttgccaaaagtcaatttttcttttttatcgtctctatttcacctcttcttctgcgtcttctccaaaattgatacttttcttcgtgtcacgtgaaggtccatttcctcagatcacaaaatttccatctgatttcctcaacaaaaacccttaaagcccagatttttcgtttcaattgtgtgtactcggagactccacaagacctcaaaaggcttgacctttcgtttctctaatcaagtttcgctcaatg

SEQ ID NO: 8332 - DNA, 3000 bp, Unknown
  misc_feature (1)..( 3000): cDNA_ID_1027990_gDNA_ID_1971748_Annot_ID_175261 3000 nt of promoter + ATG
catcctcgagaactccttcttgaggatagacttgttaacagagagcttaggcttgttttgtctcttagtcttggtggttccgagtacaacaccttggtccttgccagccgcctgaatggtcactgtctttttgttggccaaacctataatcatataaaaaagactcaaacttcaatcacattatcagatactaatacaaatccaatcacccaatagcatgtaaccaacaaaaagatagtcatcaattcaacaagttgttaattttcccaattacatttagctagacatataaaggtaatgacttgtgttcatatcaacagattcaacaaaagaacaaacttgagataaatctagagtaagcaacagttgtgtattaccagagtgcttgtacgagttgatgttgacgaggttgttgctctctttgctgaactgaaccttggcattacctctaccgaattgcttcaccaagaaacagttgtttctcttcacgatctcccagatcaactgtcctggaactgtggccatttcgagctccttcactgattattgaagaagaaagcatttagtaacacaacatatatgaagcggtaaaacaagggctacacagattgaagaacaaagaacggcaaattggtttgtaaagagatgattcaagctcaccttgatattagcagacctagatgacggcggtaaagagaagagaacgagactcgtgccggagttaagttatgatttatgtcgatgcgttaatatatatacattctctgcaaaaccctagtttggttctcggaggcaatgtttataagtcaaatataagtaaaccagacttttatcaaaagggcgtttggtctagtggtatgattctcgctttgggtgcgagaggtcccgagttcgattctcggaacgccccttctaaaatcatttttttttctgccaactaaactttgtttttcttcacccttgctaaattttccaaacaactctgcatccattagactcaaattgaccacttaactggataaatgaaaatcatcatcagacataattttcacttcaatggagcaaatccaaatcttgttttatatggtgaagctatagatcttacatggtgaataactatctatatttgaatacaaactcttcatgaagcattataactccctgaaaagcatcagcacaacacaacaacatatgaaaacactcttgacacattctttgttaccatcatcatcatcatcacagaagattccaagtttcagacttgaatgttcggacttagacccacatatcttcacctccttcagcccacattccccatttccatctcactctcgggttactcatcatacatgtcgatatcagattgcttcttactctaggatctttgtcctggtgaatcatcagtctcatgtctgtcaaacctctgtacttattaacaatagacctgatgaaagaaactgtttgatgaacattggtatgatctgacatctgtacacgtgctgttatttgcttcaggctgtctgttcccttcatatcacctaggccgccttggctttggaaatgtgtttcgatatctgaccaagtcctgggactcaaactaagagaagtaatgccagggaatgctttgaggattgttgccagtccaagttctaacctctcagattgttctatagactttactgaatccactgcaagctttttgatcttgttgccaaaactgatgttgctgattaatctgtacatatcaggagatacgagctctaaagtcttcagatcttgaaactccccaaaactaacaccttcagcgtcctccacagaaagatggcattgcaccaacttgggcgtttcaactagaagagatttaggcttgttgcattttagcttcagttcaagcaggtttggcgccacgatagccaaggaaagtggagcattcgacacagtccaatgacaactctttaggtgaagaaaatggattcttggttccttaagtcctccaacaccaatcaaattcagctcttgaagaaaagggaaacaatcattgaccttctctagattctcatcatcaagtctgatgaattcaagtgtcaagtatctgagattaggcatctcagtcaggccaactacagagagccaagcattcttcacctctagtttcactaacttactacctgcaagatacaaatagacttaatctagttactatcatatatcatcatcatcatcatcatcatcatcatcgtcttccaataaaaaacttctatttcaaacgaatccgaaacgaaactagaggaaatgatgatggagaaaaaaaacttacagtttgaagaaatgagcgccaaaatatccgattttctccagcaagattgaatccagaaatccgaaattgacaaattctccaggtcttcacgaaccctaggcaaccactccttcacaaattcgacatcggtcaggtacaaatccttggaatcttcttcattgaagtcgtcaaacgacattcccttaagcgccttatcgactccgactgagattgagcgaattttgctagagttctcgattaggcttctgaagatcgtcttgaacggtgtgacaacgacgatggaccgcgattttaagtaccgagaccaggtacagatgagattcacggcgcgaacctctcgagaaagcgagttcaatgtcttggaagcgactctacatcgtgctagggattcggaatcgttgattcgactcagaattttgatccagagctctggtggtaactcgtccatggtgtttcttgatttgggaaattgaaggaaaggaagaagacgaaggagagaaggagttatagaaatttggaggtacgtgtggttaaaatcccgcacgtgttaaaattgtaaacgactaaactacccttatgaattctggaaaataacaaacgtgtcatagagtgaagaaaaacccttattgttttctagatttctccgatttgtgtagtatcgtcgggattttttgaccggagaa

SEQ ID NO: 8333 - DNA, 3000 bp, Unknown
  misc_feature (1)..( 3000): cDNA_ID_1010681_gDNA_ID_1971748_Annot_ID_175259 3000 nt of promoter + ATG
cttacaactataataaccatttgaaatcgctatctagcaacattacccaaaaaaaaatccatttagcagaagaattatctaaccatccttaatatgaatcaacaggtatatatatacataagtagaacaaagcaactcagaccactgatagcatcataaaagcaaaaacataaacttggaagcaaaaaacattaaactttgtttcaagtttcaaactttcaaatgttgtagcttcacaagtaagtaagcccaacaatctcacgaactaattgcagcttctaaaatactactaaatctagtgtccatgagaattgatgagcttccgatcccaaaaatgataaatgggtaagcatcaagaaccaattagaaaacaaaagggagaaaaatttcacctttctccttcatgattctcaagaacgaagacataacggtggagattggtttgagctccaccgaagcttttcctcgtctctcagcattcacaatcgtcctcaacgcatcgttcaaaatcctcctccccatttctccggtcaaaaaatcccgacgatactacacaaatcggagaaatctagaaaacaataagggtttttcttcactctatgacacgtttgttattttccagaattcataagggtagtttagtcgtttacaattttaacacgtgcgggattttaaccacacgtacctccaaatttctataactccttctctccttcgtcttcttcctttccttcaatttcccaaatcaagaaacaccatggacgagttaccaccagagctctggatcaaaattctgagtcgaatcaacgattccgaatccctagcacgatgtagagtcgcttccaagacattgaactcgctttctcgagaggttcgcgccgtgaatctcatctgtacctggtctcggtacttaaaatcgcggtccatcgtcgttgtcacaccgttcaagacgatcttcagaagcctaatcgagaactctagcaaaattcgctcaatctcagtcggagtcgataaggcgcttaagggaatgtcgtttgacgacttcaatgaagaagattccaaggatttgtacctgaccgatgtcgaatttgtgaaggagtggttgcctagggttcgtgaagacctggagaatttgtcaatttcggatttctggattcaatcttgctggagaaaatcggatattttggcgctcatttcttcaaactgtaagttttttttctccatcatcatttcctctagtttcgtttcggattcgtttgaaatagaagttttttattggaagacgatgatgatgatgatgatgatgatgatgatatatgatagtaactagattaagtctatttgtatcttgcaggtagtaagttagtgaaactagaggtgaagaatgcttggctctctgtagttggcctgactgagatgcctaatctcagatacttgacacttgaattcatcagacttgatgatgagaatctagagaaggtcaatgattgtttcccttttcttcaagagctgaatttgattggtgttggaggacttaaggaaccaagaatccattttcttcacctaaagagttgtcattggactgtgtcgaatgctccactttccttggctatcgtggcgccaaacctgcttgaactgaagctaaaatgcaacaagcctaaatctcttctagttgaaacgcccaagttggtgcaatgccatctttctgtggaggacgctgaaggtgttagttttggggagtttcaagatctgaagactttagagctcgtatctcctgatatgtacagattaatcagcaacatcagttttggcaacaagatcaaaaagcttgcagtggattcagtaaagtctatagaacaatctgagaggttagaacttggactggcaacaatcctcaaagcattccctggcattacttctcttagtttgagtcccaggacttggtcagatatcgaaacacatttccaaagccaaggcggcctaggtgatatgaagggaacagacagcctgaagcaaataacagcacgtgtacagatgtcagatcataccaatgttcatcaaacagtttctttcatcaggtctattgttaataagtacagaggtttgacagacatgagactgatgattcaccaggacaaagatcctagagtaagaagcaatctgatatcgacatgtatgatgagtaacccgagagtgagatggaaatggggaatgtgggctgaaggaggtgaagatatgtgggtctaagtccgaacattcaagtctgaaacttggaatcttctgtgatgatgatgatgatggtaacaaagaatgtgtcaagagtgttttcatatgttgttgtgttgtgctgatgcttttcagggagttataatgcttcatgaagagtttgtattcaaatatagatagttattcaccatgtaagatctatagcttcaccatataaaacaagatttggatttgctccattgaagtgaaaattatgtctgatgatgattttcatttatccagttaagtggtcaatttgagtctaatggatgcagagttgtttggaaaatttagcaagggtgaagaaaaacaaagtttagttggcagaaaaaaaaatgattttagaaggggcgttccgagaatcgaactcgggacctctcgcacccaaagcgagaatcataccactagaccaaacgcccttttgataaaagtctggtttacttatatttgacttataaacattgcctccgagaaccaaactagggttttgcagagaatgtatatatattaacgcatcgacataaatcataacttaactccggcacgagtctcgttctcttctctttaccgccgtcatctaggtctgctaatatcaaggtgagcttgaatcatctctttacaaaccaatttgccgttctttgttcttcaatctgtgtagcccttgttttaccgcttcatatatgttgtgttactaaatgctttcttcttcaataatcagtgaaggagctcgaaatg

SEQ ID NO: 8334 - DNA, 3000 bp, Unknown
  misc_feature (1)..( 3000): cDNA_ID_2038840_gDNA_ID_1971748_Annot_ID_175257 3000 nt of promoter + ATG
atgagaaagctaacacgtaagaagaagtactcctttgtggtgtatttcttcaatgaaatacatttgttacgcttggcttctgagttaatagtaatatgaattattgtagcatacctagaatttgagattacttttatttagtctgcaattcgtacctatcagtgatgagaaagctaacacgtaagaagaggtactcctttgtggtgtatttcttctatgaaatatatttgttacgcttggcttctgagataaatctttcttctgtgcaccatttcatattgcatctgttttgttttctatcagtaaaagtactaaccgattgattgtcttcaacttttcaggtagtggacaactactacaggcctgatttgaagaaagcagcacttgctaggcttagcgctatcagcaaaggtcttagagtagccaagtcgggtcccaagaggagaaacagacaggcttgaagaatccactactgaatatcttgtttactttttctaaaaagcttgttgtgagccattaagagtttctgacagcagcttgtaggttaagatttttcctgaacagctcaaggattgtaccaccatccttttttcactaaatgatattaaaactaccatcattggcttttatcaaaaaagatctattcttggctgcctgctctcacttctcaatacttgtcattgcgcaagtgctacaaagattaactgaacgagaaaatatgattctaatttcccataatatcactctgctctgatttctcaatacttgtaattgcgctagtgctacaaagatgtaattgaacatgaagatgtgattctaattttccataatatatcacagtgcaaatctaaataaacacatatgtgaactcttgtggcctctgaaacagctgtaatctaatgggtgtgtgtataagatgttaaatcttgtggactctgaaaccagattcctcggatgtcatattctccttccagctctcgaactcagatccaccaaacacaactttctttatcccgacataactagaaacaaccaaaacaaataccacgttagagcttacacacatttcaaacatgtccatctcaaaagcttaattcagttaataaacatacagagagaaggagagaattgaactcactctgagctgatttgtgtcaatgcgtttatcagaacatcgagaatcaacggctccgaggtcccaatatcgagcctgtcaaaaccatcatttatgtgatgagtaacaacaagacttgcaaaaaatgtttttagggtgtagtgagagttatcaccatattcgagcgacattgtcttgaacctcaagatccccgatgttataaaacgtggtgggctcgacattagctccaagtatggcatcatagtttggcctcttatccagtggtgcttgtgataactgcaccatacgagcaaaagataaaaaaacagcttaatgcttataatgcgagaaaacaaaaggaaaccgaatagataaatgctttcactttctcaatcatagacatacttgcatattcatggagttgtatccaccaagtcgtccaaggatatgccaggaccggattgtctgcaagattttagccatcaaaacaaaacagtgagtgatttgttaagattttccctatctcctcagattagtataggaatgcaaagattcagtttgaggactcacatcagagatcaaggctatgtctttgtccagcggtgtgttgtaaaactccaaccacatgtatgaattcgaatactcaaatcttacagaacaacaaaaccaagagtttaataaacaatgagaagaacaaggcactgaacatcaacaactactgaacaagcagatcaaatgagcaagcaaaatcaaccaagagaatcacatataacttcaaaagcaacataggatcactcacttgttaaacgtcactggcatcgaagttgcagaaccagtcttagtatgaagaattttgttcctcttcttcctcaatctctcttccatctaaaaagagttcattgataaacaacccatttcaaaataacaatcaaaatcaaaagctactcaaaaatttcagctcaataaacgttactttgtcaatacatcagctcaacaacagcttctcgatcgaaatggtaagatccaaagatcaaagtttaaaacttcaccttcttttgagctttatctgggttatctaaacaatctccaagaatatccgcaaactcagggtctttatcgtaatcaatcttctctttcttcgctctgtaaacgcctctcttcttcgccgagaactcatcttctacctcatcatcatctccatcatctacttcttcgaattcttccacaccttcttccatttctctacctattccatttactcgcaactttccactctccctcgaccgattcgcacgtaactcctggatcttctgtacaggaatcgtgtcggtgacccgaaacggcgccaaattgtgtaaacaaatattcgagtggttgctgttgttcttcgccatagaaggctgaagaaggtgaagaaaacattgaaaccttagcattattttttcttcttcttacttaacctctgactctgttgcttgcaagtattttagagaagactgaagaagctaatgggtttttgtaagagatgatagtgaaggggtttatcatagctaacggtgagcttgcgcgtacacgaatattaagctgacgtggctaacaaaaataactagtgagatttgatctaaaccatctgttactgtcacaatcggaccgatatcaacccaactaactaggaatctaaatttcgttgcacaggcttccaaatgataacaatataggcccattaagaaaccactaatgggccgtatcagtacagatcgtcttcatcacttaaatatcagtcatagaaaaccctaatctctgagaagagttaaaagcgttgccgtacactataaccggagagagcgccgattccgtcgtcagaagaatcctcgtaaacaatcatg

SEQ ID NO: 8335 - DNA, 3000 bp, Unknown
  misc_feature (1)..( 3000): cDNA_ID_3045046_gDNA_ID_1971748_Annot_ID_175232 3000 nt of promoter + ATG
actttgtgataggaaatgggataaaacggagctcaaattctattaagttctaaagacttctaaaacaagaattatggcaaagatatgataatacccagacaaagaggcaatcataggcatctatatgttttattcaagacatgtctttggcccctccatgatttcattctttgactctataaattattttgaattttcttcttttatttaagaaataatataattatgatgggtattctataaatacacaagattatatatatgtatgtattatatatgaatttctttgcctctctttttggtttggtggcgttctaacgttgggattgagattgtcatttttttttgttaaaggaatgagattgtcttttgtatatccttaacttgagttgtccaaaaaaaaaaaaaaaaaaaagtatatccttcacttgaaactcttgacgttaaagttacaatccttgagaaatcgaaatgaattttaatttataaatctagctagctatttagattcttttttgctgtggttatgttttcaatctaaacaaaccatttattatctcaaattatttttaacatttcggtcccgcttaattattatttttagcaatatatttttttttttactgatttagtgattttcaaatcataatgaatagtttaatttatgttacaagaaaagctgaagtataattttggcagtttatcttagatttcagaaccataagaatataaaatgttcaaagagagttccaagacctaaacacttcaatccaatcgaaagatctcaaattcaaggatggacccagagtttgtgggggctacgttaatcttatttcatactacatcatataagagccgtataagcatattacacctgacactttctagactaaaccgcttctaatcaaaaaatttaaaatgcagcgtgaccggaaatcaagaaaagcaaaatactatttttgttgttacaattaggattaaggcttatgtaaaaatgaatctatttttcttacacttcattcgagaattttaagtgtacgatacagttttcttctattctttttttttcctttggtagttttgaccatctattgatttttctttctcaaataagttgacgtaaaccacattacatagattatacgatagaactcataatcattacagtcaagatactcaagattgttatgaattattatatgatagatatgtttaaagaacgaacacaaattcagttaataggcgtaataatttcaggattccttcattaaacatttttatggcaaaaggaaacgattgtctgatttgaaacatatgtaaaaaagtatagttgccatgatttcataattcatgctgatgtaaacaaatctccaaagagaccatataataataataaaaaacaaaatcataattaaaaatattcgcttttctatacaatacgagagacatgattttatttatttcaaaagaaaataaaaaatacgaaagatatattataaattagaaaataagagatggtgtggtccatatgatgggtcgctgctcaaattgccttacttctcaagcaacctcttaattcctttttttttatctgcagaaattaaaataaaataacaaaacgaaaaaaagaagaaaaatgaataacaaaagaataatgatcacttcctccagctcgatgcccatgtgatctctcttccttcttctcgtctttttttctctcttcatcttttttactttttttgttttgtttattctcttctgttcttattaactttctacaaaaacttacgtttatcctagaaaaattagatgtttatagtatagtgtgaactaagaagtgaagtatattattttaatatatcatagatatagaccaagaatacaaaatccatgtagtaaataagttataaattttttttgtccaaatttacttatatatatatatatatatgtatttatttatacacatcatctaaaggatagtagaatacacaatgttaaagttaatagcgatgaaaatttccaatctattccagcatgaaacttacattatattataaagatacatagatggtaaaaaaaaaacttctgatattattttattttcaaaaattcatatctccactctattataaatactaaatttgtaatgaattttcgatgttttaaggatagctaaaatgagaagttaaagaaaaagagtagcaaaaaggaaaaggaataagttagaatgtagaaacctatactatacatacaaataaataaataaatatttttattataaaaaagtatagaatttgtagataaatgtaaacaaaccgcttgaaagactcatagcggcttcttaaaccagcaaaggcaaaataaaaggtgggtcagtgaatgggtttcagagccacctttcccttttttctcgcttacttcttcagttaaagtttgagatagacacatattatacatcatatagtatacatatttatgttatatactatcttaattccctcaacaaaaaatctctcgaatgtttttttttaattaatttatatacctttcacatcccaaactctcacactttctcttcttcttcgtcttctcctcctccttcgtcttcgtcgtttattaactctctctctctctccttgttctctctctctctctttttcctgatttgcagtactgtctaagatcttattccgctcgaccaagtttgttctttttagcataatttgggggagtttttccccattaattctcactttgtcttcttcttgtgtcggttaggttttcaagaaaaaccctcttttgtcttgtctcctcaaaatcagttgcttcttctctataataatagagggtttattcatatcttcactatctagcttcttcttctatcatatgtactccaactctcggatatgatcgaaagagctttgttattattatctttacaacttcacgcagacgcataagagagagagttgatcaaagatattcgagattgag

SEQ ID NO: 8336 - DNA, 3000 bp, Unknown
  misc_feature (1)..( 3000): cDNA_ID_2038856_gDNA_ID_1971748_Annot_ID_175250 3000 nt of promoter + ATG
aataactctggatgcaaatggccgaacattgtttttcaaaaccaaattggaatcagtgggttgaacgaatccgaccaatatccatatcaaaactgattctgaataaatcggacctagtgcctagtatagtagcttggccctagcgcatagctagtaaattgattgttcgaggttttgttttcatttgcgagaagagtattattacttacatgcattggttattttgtttccttcattttttatctctttttttgtcaaagccatagatgcattgaatattcatcaggaaaaaaagaaaaaattagcaacttgggcaaatgtcttcttaaaacattaatgtattaccaaatgcgaaatagaagagaaacttgttacgtcctttcatagacattaaaaaatagagagacatatctatttcaagatctttgcacgtgatcgagatgtttttattgtttttggctaacatatatccaagttagagcagaagatatcaaaagaatattatggatggcaatgaatcattttcagtgaagcaaatagtacgttccttaaatcaattagggtactaaagttttgcaataatccattcaataatagtatctctctctcttttctttaccaaaaggcttttattgtcctataacttatgaacatcaagagaggtaagtgcattttatcacctacaatattagtatggaacgtaacatatagaccttctaaattggtacataagtcctaattactctaaccaaacagcggaataaaatgtaaaattctatatgaaatgcgaattaccataaatttactcgagcttatatgtctatttttctttataatttttgtcgtcaattaatgtataaaggatttcgtagcatattacatgcatgtggccgtaatacggaaagaaccaaatcactaatttttaataaccaagtctcctctttaatgggaggacccattatcgaacaacataatatattaactatcgaaataccataagtttattgaaattacctagagtaatcataaactctagggtcgtcaaatgaattacgcaatgtcaaatatgagatatatagtgttcatgtttggtaacaattcatttcgaccatgaccaacatcgtagacaagacatataattacagttaaacacaaatatcgacttgttctctctttttttggttgataagtattaagtagtaatgatttttttttcctccgctaataaattccttcacctcattaaaagaagcttcatatacaagttcgtttatccttaaaccaaaagaaagtgaaaaggtttctattataaaaataaaagtcaactatgtggatatgtacgtgaacttgctgttttagcactgatttcagttaaaacgttttctcttttggttttccagtgagctattgtattgtacaagaatcaatcatatggtatgaatgagtcttgcatgcctatatataattgcaattattattgtgatactatatacttacatcatattgttttaacaattacacgggattggagtttattcttggttagtctgtatatttaaccatctaaacacaaattttcattaattagtttcaatctaaagtttttcttttgctttgggagtaagccaacacatttcatggtcggtctctctaacatcatgttcatgctgaacgtgtgctcctttgtgttattttagttttccaaaaagttttgcgcctagtactatagttttggacctatgtctataattctttcggaccagagagactcaaagattgaaaactagtctgactatctattgttgaacatgaagaaagtttctaaatatgattagtgttgtcttgtgaatcattaaaataaattagcgaaagagttaattgattcgagtaattatttaattcacaattatacactaattcaccatttataaatataacagtcaaacgccactaccaactaccagtctacgagcgccgtcaacaaacagaagatctagagcgccgaacaaatcggacggaaaacgacaaaaaaacagccagcgaaatgccacgtcgctcctccttctctcccgccgacgatcctgacggcgttacggtgacggactaatatatgataattagtggcccaatacttagcccaaaattaccgtaacgccaccaacgaacaactcaacacagctggaatttgggtccatgcaaacttatctctttctctgtttcgtttcttccatcaatttcatttaatctatttcccatcaatttcatttttcccaaataaaccaaatccatttttgtatggttttgttaatattttcaattaataaggtgtgaaaaggtggagttttttcttgcggttacatatcatttagtatataatctttcgtaattaatatcatttaattattataaaaaaagacttttagtatcctaacattttttttttaatacaaatttaacacgtaatatctggattgtctcaataacaatgattaactaaaattttaagaaaggtttttcttattaaattcaaaagaaaggtctaaaaataatataatataatacattaaaaaaaaagttttgtttataatcaaagtatgcaagattcatgaatcatgatacatttgtgcttcacctagaaaaattaaacaaaacctttaattaaaaaaaagaccaaataatgaaaaatgatgaattgttttattgtgccgccgaatttcccgcgattaaaaataaaataaaacaataccaccaatcaaaaattataatctcaaaataaaaacaaacttaattgtcatagaacccctgggccccactgactctcatgttgctacaaaaacgagaaccatcaagaagacgacgaacaacgacctctgcctctcatgacaaatattcaactgattccttcttcatcttcaaattctctctaattcgaatctctcaaagttcaaatttcaaattccgaagaagaagaagaagaaacactcgaaggtttttgtgatg

SEQ ID NO: 8337 - DNA, 3000 bp, Unknown
  misc_feature (1)..( 3000): cDNA_ID_3045036_gDNA_ID_1971748_Annot_ID_175252 3000 nt of promoter + ATG
gcacttacctctcttgatgttcataagttataggacaataaaagccttttggtaaagaaaagagagagagatactattattgaatggattattgcaaaactttagtaccctaattgatttaaggaacgtactatttgcttcactgaaaatgattcattgccatccataatattcttttgatatcttctgctctaacttggatatatgttagccaaaaacaataaaaacatctcgatcacgtgcaaagatcttgaaatagatatgtctctctattttttaatgtctatgaaaggacgtaacaagtttctcttctatttcgcatttggtaatacattaatgttttaagaagacatttgcccaagttgctaattttttctttttttcctgatgaatattcaatgcatctatggctttgacaaaaaaagagataaaaaatgaaggaaacaaaataaccaatgcatgtaagtaataatactcttctcgcaaatgaaaacaaaacctcgaacaatcaatttactagctatgcgctagggccaagctactatactaggcactaggtccgatttattcagaatcagttttgatatggatattggtcggattcgttcaacccactgattccaatttggttttgaaaaacaatgttcggccatttgcatccagagttatttaaatcacgaaaaatatagtttgctatttatcatatacatacggaatttgcatgttaacactattgatcaactagatttttctaatgttatattttttttggtggggaagtattgaacttaccttaccactctttttcgattcaaatactaagaatcacatttatcagttgtgagtttagctaaatatgtgggtggttttaaatttgtgagtattaaatttgtcatttctatcacaaaacaatgggagaaaaaaacgaaaaactagtttcccgacattaaacatgcgaattactgaaacatggataggtccaccatttttgccatttgacaagctcggtctcttgttttccttgttcataaatgattttagtttgtttgcttttttaaacgcatctttctatcacttttttcttttggttgcaaatatgtcgttttctctcctccctccttttccgggatttaacttatcacaatgtaatgaaatttgcatgttcctctctcgccattggcaagttccattgcgatgtctctatcgataggtcaaacaatccaaaagaaccaaaaccttttttcttttcttttccactcacatttaatctagggaccctttaatcttattcattttctcaacgataatgtaaaaaagtatagttagtaaactgttaactgtgtagattatacatgttttttaatcaatcatataattagaaggggtatttagccgtccaaaagctgttttcgcgtgactatgcatgaaacccacttacgtagcctccaacgtaacgaccaataaaaagctctaacttaggaacattacaacgaactaatatttaataagttatataaggtcatgaaatgaaatcttataacgtatctaacaactcacatgatctataccatgtcacattttttatcaaacatatgttaaccacctaagcactaacactactctttgatcaaacttatatttcgcatatactccaaaagaaaccaagtggcatattggcatatctcgtaatgtggtgccaaaaatgcttatcaacttaattatagttcagatattgtctccgtatcgtatcttaatatttgtattcaacaataggtattatgttgtattagctaggtgtgatttgtaacgagaagagatatctcgttctattgtgaggtaaaaataaaataaagcagtacaagaacataacggtataaacggtttttactgttaaaaaacttgtaattgtttatgtaccaaccctattgattgtgtttaagaaattatttttaaatcttgagattcttattcaaatataaacattgaagatcgatattgctcaatatcacaataatctttctaagttatgaaaagaacgtctactactatttgtttaaaactacataggacaacatcaaatcagttttgaaattcattgtaaaattcttttaatactaaaattgtttacagttaatgagaaattacaatattatttttagcagattataattagaaaatacattattattattgatcaatttaccttgcagttccacgcaaaaccaacaaaataacaaataacaaagcattgtgtggaatgacgtaaggatgagtcagcagacaaggagtgagatcgaatcgggtcaagattatctggttgggacccgtcacatgcacatggaccctctcccgtacctaatccaggttaaataatcttgattttctgtttaattaccttaaaaacacattattattgaaactaataataaatctcggatctttggttccgaccatacttgcgaaagatcattgctttaatgctaatgtttctctaattttgatattccttgagattagattccctttgcattgtcttttcttgttaatttgttagggttcatattcttacattattttttttggcaaagaaaaaaacatttataaacatatctaattcgagcctgatctattaatgggtcaaataaaagcctctttggcccaattcaataaactggccaactggggatcatcatagagacagactactagagagtagagacgcatcagaaagaagagaaattgatcccacaagtttaaacacgattacaaattaaaacgtgccacgtattcaagacggtgaattaacacgacgtggcaaggtatgattggataacttacgcagctgcctaacaaaaacaagtgatttgagttttcagatgattagaaggaaaaaaaattctggaactttcgagcttctgttttgcggtgctctcaaagcttatatcggatctcgaatcttgaatcggactcagaacctcggatcttcgaaaatcgacgaac

SEQ ID NO: 8338 - DNA, 3000 bp, Unknown
  misc_feature (1)..( 3000): cDNA_ID_3045032_gDNA_ID_1971748_Annot_ID_175253 3000 nt of promoter + ATG
cacgtattcaagacggtgaattaacacgacgtggcaaggtatgattggataacttacgcagctgcctaacaaaaacaagtgatttgagttttcagatgattagaaggaaaaaaaattctggaactttcgagcttctgttttgcggtgctctcaaagcttatatcggatctcgaatcttgaatcggactcagaacctcggatcttcgaaaatcgacgaacatgtcttctcctggcgagtgagttccgttcccctctattgaaactttgcttcgattcgattttgatcgagagattcttagcttggtcttcgtacccaggattttgagtccttaggttaataattttcatgattcgtttagcttgtataggggtttttgaagcattcaactgttgattcttctcaattcgagcgtaattttgcaacaccaagcgagttctgtgaacttgagctaacgctatttttagtatatagttatcaatttgcattgtcatcatttgatattttggtgatttgagatgtaaagaaacatcttttatgccatggaagttagtacaagtcaactggtagttagttcttgaaatatggaatctcatagtgtcttgaagcaaaactgttctcgtttgctgtatcatagttacaaggctactttgattctcctagctacgatagtctaaaatatctctgcgtaggcttgtctcttgtggtaaagttttatgctttagctgatcttgatgacatttcctgattagaaatttatagatggatggaatatgtatgattttgattgtttatctgtcaaattgtttcttagatcgcttgttattgattgcagattctataactcacttccacctataaccaaggcttatggtacgttgtgctttttcactacagtagccacgcagcttggcttagttgctcccgttcacattgctttaattcctgaacttgtacttaagcagttccaggtatatgatttattcttttttatgattttcctttctttctcacaaatctctgtcatcctaagttcctaattcattctgcaatttttgatctatttggtgtttgtagatctggaggctgataacaaacttgtttttcctcggtggtttctctatcaattttggaatacgtcttttgatgatgtgagcatactattttcacatatatagatgaacaaagctaatttcgatttttattatcttaacatactcttttaaatgattgtgcagagcaagatatggagttcaactcgagaaagggccatttgaaaggcggacagcagactttttgtggatgatgatctttggatccttcactctattggtatgtaaagcctcccctgtattctattcttactgatcattgttattggttctttgagaaccccagtactagtatgtggtatgccacaaagtagataatcgctggtacataatatcccaaagctgagaagatcagaagctctcaaagaattgaatcagggttgcattttattaaagcgagacaaaattttggaaggtattcatactagtaaatccgtgtgttaaaacagttaccttgttcaaatttcaggtattatcagtcataccatttttctggacaccgtttcttggtgtttcacttgtgttcatgcttctttatctctggagccgagaatttccaaatgccaacatcagcctatacggtcttgtcactcttaaggtattgaaagtgtttcttttgtaatcaaatccactccttggtatatataatgttaatggtgaaagttggaattactccacaggctttctacctcccatgggcaatgctagcacttgatgttatcttcggttctccgatcatgccagatcttcttggcatcatagctggacatctatactacttcctaacagtccttcatcctcttgctaccggaaaaaactacctgaaaaccccaaaatgggtgtatcctttattcaaattctcgattatttccagatgattgtttctctcgcttctcagtttttgttttgctgttgtaccttgacattctcaacagtaataaaatcgtagcaagatggcgaattggagctccagttgcaagtgttcgacaagcaggtggtgtaggagcagcaggacccggagctggaggaggagtaggaggaggaggagcttattcaagcgctcgtgccccacccgagagttcaaacacagcattcagaggtcgatcatatcgtctcaccgactgaaatagaaatcttctcgagtttctttgttttcatcatatcaaatctttttcaaacaatgccactaactaatcccaggtagctttgtgttttcgaacagtacagtttttgaatatatgactctgtaggaagaatctttgaggttttaatacaatgttcttttcaaaatgtggttcatgtttctatgtttttgtttttgtctagcaatcatctccttactaaattgaattcgataaactatagccactatgaatataatcaaatgaaatttgtgacataagaatttggacgtaacgagtttgaatatctatctagataagttattaaattcgtgaccaaagagtttggtcgtaacaagtttgaattttttaggacataatattattattggctaacaagattacgactaacgagtaaataatcattccttcggtccttcctctaaaatgccgttggtgatcgtttataaataggggaaataggaaaagggaagaaagtagacgtggcaaatagcgaaacaatgattgagctataacaaaggcgaaacttgagcggcactaattgaaaatcactccttgtttttttgaagaaaaagtaagatgtagggctgagaattcgtctatgtgatccaacggttttaaaatgatccttgttccttcctctcctatttatctgaaggacgaagtccccacgctgcacataaccggggcacttaacgtatagatcataaacaaagaagaagaaaaaaaataagaaaagaagaagaag

SEQ ID NO: 8339 - DNA, 3000 bp, Unknown
  misc_feature (1)..( 3000): cDNA_ID_3045044_gDNA_ID_1971748_Annot_ID_175238 3000 nt of promoter + ATG
tctttaaaaatacccatagaattcaaattaaccttttcatgataaatatatataatttgaaattttcctaaaagctaaggacatacatactaacaaaattagggggtagtgttaattaatctataaatatggtgatgaataggatagaaaacagtcaaacacaatagttttgctagctacagtgtgataagagaatcatgggataatattaattaatctagtattatttgtttgaactttgaatacattttttaagtatggaaatggatagagatacacatgaaaaaaaaaaaaaatctatgtattaagttaactgctatagttttaagttttaacactttgagaaggtgcatatagtaatcaatgtagtcaagtcaacactacatttttcaacatttatttacttactttttacttttatttctgcttagatgtttttattatgtgaataataaagaaaagtcatgtatacctcgatatatattaacacaagcattacataacaataaagcaaagaaaatagcttttcatttttcatctctaatttacaaaacattagtattctgttgttgtgaattgtgatatatttgatcatggccaacatatcatggtctcattttcttatactcatgcttgtgttctcaggtaatttcatgtttcccacttccaaacatcaaaaagtagttttcatctttacattacattacacatctaagcgtgtacacatatacactatattgtttcacatcataacatatggtattttactttttaatattttcagtggttaagaagggtaagggagatcagactgataagtattgtactataatcattgatccaagaactccatgtgaccttgttgattgtcgcctaagctgctatacggggtacaatggagttgggaaatgtattgcatccaaagctagtagaactcctaattgtgtgtgtacttataattgttaaagtggcaaattctaaataataatgttttataattaagaaaatattttccataataatctatatgaataaataaaattggaagttcttcagcccttcttgtaattgaatatttaatggaaacattgaggtgatgatttcagccaccttattgttaattttcaaaattataaaattaatcaaacatatatagtaatgattggaaactttatagagataattttttaccaactctcaaaactatataaagatgcaaaaagagggagcttataacctaaccactaatgaatacattgctttgccatgttcaaaaacgctgccaaagtgaccgcatctgattagcgtcgtcatagcgcgtgtaatgacaatttgaacaataattcattaaaatatggttatagtataatttttggaaatgttttgatttacctctattattaccaaatcaaattcagccagtgaagacgttgtagttctcaacaaaaatcacgtgggagtgtaaatacgacaataatgttccatctttctatattttaaattcgcgacctatcttcttctttcatccaatagttgaaaaacagaaaaagcctctccaatgactttttctcgtagcagctcgattacgttcttcatcgttgctttattcaccgtcttaattaatccggcgatctcttctcgcgccgcgtccttcatcaagctgcctcggtcttccatcgcttcatactgcgagagttggagattagccgctgagaccaacaatgttggaccctggaaggtgattccgtcccaatgcgaaaactatattaaaaactacatcaacggaggccagttcgacaaagactacgatgtagtcgctagttacgccattgactacgctaaaacggtcaaggttggcggagacggcaaggacgcgtgggtctttgacatcgatgagacgcttctctccaatattgagtactacaaggctaatggttacgggtaaatgctctctcatgttattattaccgttagattctgttttatcaacgaataatatgattgtattgtttgactaacttcgttgaccatgcattaaaccgggagatttgtggattcagatctggttcttggtttgagatttcttttgtgttatttttcgatattgtaccgagtgatttgttgatggtggatttaggtctgaaccgtacgatagtattaaatacaatgaggtggtggaaaaaggaaaagacccaggttatgatgcgagcttgaggctctacaaagctctcaagaaacttggtttcactatcattttactaactggccgagacgaaggtcatagaagtgtcaccgagaaaaatcttcgggatgccggttatttcggttggaaccgactcctcttgaggtaaaaagctataccaaaccacttctcttgttttgtttaccaatctactaactaatttactaaacttatgaaccggtaaatgcaggggtcaaaatgatcaagggaaaacagcaacacaatacaaatcagagcagcgatcacaagttgtaaaagaaggctacacaatccatggtaatactggagatcaatggagtgacttgctaggttttgccgtggcttctcgttctttcaaagtcccaaatcccatgtactatgttgcttgatcaccatctgccattgatatattgcatgataatttatcatttatgtatgaataaggatttatgaatgtatcccataattcaccgaatgtagccattcttaatgtaccacgtcctatatttttagtaggattcatacgtcactggtatgtaagaaaaggggactgattaaccaaataattttgatcataattgtgaaacaaaatccagataatgcttagatagtagttatactctaatccaattgatttgatcaacatttttctatatataaaattcttgattctgctaactaattaactaattaaagtttttggtttggtaagagttgcgaaacgataaccaataataaatgggagacatcattatctctttttctaaatctctccaatg

SEQ ID NO: 8340 - DNA, 3000 bp, Unknown
  misc_feature (1)..( 3000): cDNA_ID_3593350_gDNA_ID_1971748_Annot_ID_175229 3000 nt of promoter + ATG
aaaaagatgaagagagaaaaaaagacgagaagaaggaagagagatcacatgggcatcgagctggaggaagtgatcattattcttttgttattcatttttcttctttttttcgttttgttattttattttaatttctgcagataaaaaaaaaggaattaagaggttgcttgagaagtaaggcaatttgagcagcgacccatcatatggaccacaccatctcttattttctaatttataatatatctttcgtattttttattttcttttgaaataaataaaatcatgtctctcgtattgtatagaaaagcgaatatttttaattatgattttgttttttattattattatatggtctctttggagatttgtttacatcagcatgaattatgaaatcatggcaactatacttttttacatatgtttcaaatcagacaatcgtttccttttgccataaaaatgtttaatgaaggaatcctgaaattattacgcctattaactgaatttgtgttcgttctttaaacatatctatcatataataattcataacaatcttgagtatcttgactgtaatgattatgagttctatcgtataatctatgtaatgtggtttacgtcaacttatttgagaaagaaaaatcaatagatggtcaaaactaccaaaggaaaaaaaaagaatagaagaaaactgtatcgtacacttaaaattctcgaatgaagtgtaagaaaaatagattcatttttacataagccttaatcctaattgtaacaacaaaaatagtattttgcttttcttgatttccggtcacgctgcattttaaattttttgattagaagcggtttagtctagaaagtgtcaggtgtaatatgcttatacggctcttatatgatgtagtatgaaataagattaacgtagcccccacaaactctgggtccatccttgaatttgagatctttcgattggattgaagtgtttaggtcttggaactctctttgaacattttatattcttatggttctgaaatctaagataaactgccaaaattatacttcagcttttcttgtaacataaattaaactattcattatgatttgaaaatcactaaatcagtaaaaaaaaaaatatattgctaaaaataataattaagcgggaccgaaatgttaaaaataatttgagataataaatggtttgtttagattgaaaacataaccacagcaaaaaagaatctaaatagctagctagatttataaattaaaattcatttcgatttctcaaggattgtaactttaacgtcaagagtttcaagtgaaggatatacttttttttttttttttttttggacaactcaagttaaggatatacaaaagacaatctcattcctttaacaaaaaaaaatgacaatctcaatcccaacgttagaacgccaccaaaccaaaaagagaggcaaagaaattcatatataatacatacatatatataatcttgtgtatttatagaatacccatcataattatattatttcttaaataaaagaagaaaattcaaaataatttatagagtcaaagaatgaaatcatggaggggccaaagacatgtcttgaataaaacatatagatgcctatgattgcctctttgtctgggtattatcatatctttgccataattcttgttttagaagtctttagaacttaatagaatttgagctccgttttatcccatttcctatcacaaagttctactagatcaaattcagttttaattttttggatgctaaatgaagagagatataagaaacaaaaacaaattaggttatttatcttagctgattgtcaaaggttacaaatgcatattagatatattattaaccaatttgtaaccatagacatgtaataaacttttgcatgatggaagatattcttacagaaaacacaactttgatcgaatagatttgtattctaacggtaaagtctcttgcattggtaaacacatgaaagaaatcttagaacatgggcaaattgtggttggtcaattggttcagaaatcagaatattagtgggcttatgagctttacccattttaaattagatgttctgtcatgtgggccggacatacttagttctttcccttacacatttttgtgtcaatttcccttaagcctagtcttacgcaatatgaaaataaatgtaattagggaaatcaagcccaattagggaaatatgttttgacttacaatttatgtcaaatgagaaacatgccggtgtaggctagagcatagttcatgccgtatcctaaaatttctataactagaaacctactccaataaccaaaacacccactccaaaaaaattaatatcaaaatcattctctttttaaaataaaaaaaaaacatcaaaaatcagtcctttattaataattattacacacagcccaaatctttcaacgaattttaaatataactcttcaattattgaaatggtcaattttgcaccaaagtaattaaaaccttctcttctgaaatgtctcgtatcttctcatcattaaaagcaaaaaccacaaacatatcgccacttgttcattatcttcttcatccatacattcaccaccagcccgtgatggcctgatctgcttcctcctcctccttacttcttgtttccatcttggtttcaaatttcttcaaaggtgaattattttctaaagtttccatttttgttaacaatataaaaaaaaaaattgaagtcaaagaagactgttccattttttgggtttcatataaaaaaaaaatgggtgatgacattttctgtaatctttcattgtatggatttgtttagattccgatcatcttcacgtcggagtacacaatctgaaaccgatcatcatcatcatcaattggggtttttaatccctagaatcagtagaaaatatcgatcattgagcttcgattctggtctccgtttgattgtttcggacaatcagagctttgagtctccgaaaaggttggttatg

SEQ ID NO: 8341 - DNA, 3000 bp, Unknown
  misc_feature (1)..( 3000): cDNA_ID_1397961_gDNA_ID_1971751_Annot_ID_175291 3000 nt of promoter + ATG
tttttggattacctggttgatgaagaagggatgacttttgcatattttagtgtgttttgtgagagtattctcgtttgcagtattcgttgttaataagtcttgatgaacctcctgaactaggctatggagattttggctcatactttggagagtgagtcaaatttaaagaggagggtggacttatttttccttgtggattctatcgctcagtgctccaaaggtctgaaaggtatgtcgtatgtgcaatgagttttgataagccgcatcagcaaagttctaaatgcggaattgaccttgaatactaccctatttttcaggtgatactggttgtgtttatctttcagccattcaagtaattttacctcgtctattggcggctgctgtacctgctggagctaccacacaagaaaatcggaaacagtgcttaaaggtatgcaataatatttgctagctctttcggatcgttattgtttctcaacctctctgctatttataggttttgaagctttggcttgaaagacggatcctgcctgaatctattgttcgtcaccatataagagaacttgattcacatagtatagttcctgcttgcctctattctcggcgctcagctcgaacagaaaggtcgttggatgatcctgtgagagatatggaggatatgctggtggatgaatatggaaggttagatttttcgttttttatttaatctatatatgtacccctgtctctagattcgttaaaactaattcatctttacttatcagtaactcaactctccagctccctggattttgcatgcccgcattgcttaaggatgaggagggagggagtgactcggagggagggtgtgactcggagggaggcagtgactcggatggaggggatttcgagtctgtcacccctgaacatgagtccagaatccttgaagaaaatgtctcgtcatccacggctgaaaggcatacgcttatattggaagatgttgatggtgagcttgaaatggaagatgtggctccgccttggggaactgaaaactgcacacacactgatcaagctgataatacaaaggtttccaattgtcagcttggacagcagcatcggcccgtctttggcacttcacatcagcatatgtccttgtcatctccaccactgccatcttcctcgccaccaccgccaccagctcccccttcacagcagggggagtgtgccatgcctgattcctacttgaatgggtttgaaaatggaggatatcgcaacgtgcatgtacgtttgtttgttgtaaaatcgttttacaagaaagatgatgatatatcttgatatggtcacttatcctattgttattggtaaatatgcagggagatcaacaggctggtcctcttaggatgaacccgccactgtctggaagcacaatgcattatcaaggtccggagtcgtcttatatttctggtgtacaacttacgaatagtattccacaggcagatggttctaatttccagcataggccttatccctctcatcctcatccacatcctcctccccctccaccgccaccacagcatcaattctcatttagagagccgggccacgttttgaagtcgcatagggacgctccatcgtactcccacagatctcattatgtgccgaattgtgatgaaagaaattttcatgataaccatgagagaatgaggcatgcaccattcgagaatagagataattggagatatccaccatcttcttcttatggtgaggccttttacagtcatgcgtgtgttaattatatatatatatatatatatgctttctaatgtaatgatgcgggaatgggaagtctgatatgatcgtctcctcgcaggttcgagatatcaagatgaacacaaagctccttatccatccagttcatacaatggtgtccggtgggataatcctcctcgccaatataataacagaccctcttttcatccgaagccgcattctgaaggtcctgctccagttggaatgagaggtaaggaggttggagacgtttataatccttggccttgtaagtatttaagtagtttccttgctatcgaggaacccactcgtgctcagaatgaacaaccgtagggacatgaaaggctaattattttactcatcttctagtgagccatgcgcaacattcatatggtaggatataaattttagtggaatcatattataggtcgttttctgacatttgaggtttatttggcatttaatgatgaagtaatatagggaataaccccgagtatcatttgtttatttgcagatccgggaatgtggcatcagagaagtgactagagaaacttgagagagttataaactggtaaacgaagagggtggtgtgaagcaaaaaagccaaaacaccgaggtgatgtggctctaatttaaaaagagaacggttatgttgttgaggtgaaatagtgatatgataaagaagtgagagtgtacatacatgatttcggaatcagaatcacatgcaatgcagattgtgaggagatggttaaaaaaaagaaagccatttgtagagatcgagttagtatttatatgcactcctttgcttattcattgttttttttttttgtgtcaacattattttgttatgtgggttttgaccttgaagtgtatgatgtatatcagtatattcatctcttataataatattcctactaaaaagttggttttttcttttttgaaatggaatgatagggacttttctcttgaatatagtacagactagagagagagagagagagagattgttgagaatactttcaatttttttttctataataaggcaataatgcaatttcacatttatgtaagaatgaagtaaaaaggagagaagactagaaaaacaaggaggaagtctttccctttaaaaagggtcaaagagggttccttaaataaaaggttggttcctcgtgagagaaagtctttccctctaatttctctagagagacagagagagagagatagctagagatg

SEQ ID NO: 8342 - DNA, 3000 bp, Unknown
  misc_feature (1)..( 3000): cDNA_ID_3045094_gDNA_ID_1971751_Annot_ID_175317 3000 nt of promoter + ATG
tttaattcttttaatcaaagcatgatttaatgtaaaattatactactgtatgactacttttcttaaaaatataacctaggcaacttgttcatgtgggtctactcgttaggtgcttcattttgaatgatcatgtttaattgcgtaacgagataagtaaactggttaattgcttgtgtgacaaaagatacatatcaaatttaattaatcattaactttgattaaagaagtaggcggcatccccaaagtcaacaaataaaatcaaaggtttctggtttaatccacgcgttgccccatccatattccctttatttctaaacgaaagcgaccgccatttccgtattttgtctccctagcaccaaaattacatgaccatttatttacttacgtggttctttttttctttgcagcagaattatataaatatgcaacactggttagtctaacgctatagatatggatgatattttagatatctatatatacatttttgcagccattttgtaaaataaatcctagagttagaatttatttacagtggctgccactgacatttaataattgtttttgataattaaaaagaaaatctttgaattaaatatttgacaatcttcccaaaatctctccacattaattacacgattagttactaaaataaaacttcccaaaatatttaatcttatttaattactacaaaattatcatttttgatattgtttttctacatgactataataattcgattataatcatcaaaccgcagagatatttgatagcatttaattattacaaaattaaaaaatatttagacaatgattcataaacatatcataaataaaatcagtgagttttttttacaggacggattgacgggacgagtttgacaggacgttacttaataacaatcgtaaactataaaataaaaatattttatagataaatataatttgcaaacttttatatatagtaactttaaaaaataaattgtcttcgcggtataccgcgggttaaaatctagtaagacctaatagagtaccaaggctagaacaattaatacgagtatcgcgtatgaaaaagaatatacatgtattctgataactatataaagtagtagatgaaatgattttgattcatgaatctctatgttgagtgagaaaatgaatagcctgagacaacacaagtgtaatagctttcacgcttggacttgtgtctgaattttggaactgatgatgtttgctgctctttctagaagacctgttgaaaaaagcataaatacgctctgttttcaaatttggcaattgatatttgtttttgtacgtgtctatttaatttttggtaaagaacgcacgttgtttatacttacacaccgcccttctagaagaacaggctctcacgtcatttgcatacaacttccatcttctggaaccaatggatccctgttacaaaagttgctcttaaaacataaacaaaaacaaaagaaaagaaaacatttttatatttgtcgtcaataataatggccactttctgcttacatgtatatgaatgtatatattactataatacgtagctgctcgtgtttcttgtctaagttctctgttatagttaggagacaaataaagagaattagagaacagaagaccagaaaaataaagatgaacacaaccaacaacgtgtttgatgtgtcaccgttcttgcttttagaagcatctgcagattccgaagctggccacgacagcgttgacgatgataaatgcgttaaggattacgatcttggtcatgagtcttctagtgccagttcttgcgagacgtcttgcgtgagtcagagaacgagtttgttaggttttgacctgcaggacgatacggtgaatcatgaagaaagagacgccggagatgaagaagacgaagacggagaaggagaagtgaatagctacataagatgtgggagaagccaacgtgaaaatctggctgtggattctgctgcggyggtgagtgagatggatcaaaatcgaatgttctgggaagcttgtctcgcatcttgatctgtctttattaattaatgtcatctcatcatcaacagagaaaacaaaatagtatatatctagcttagcgtagtgttcttgtctgtgtttcccctttggcttttaatgcacaactaatcgatatgatatctacccattaaccttaattagtcccctttagcgtagtgtaaatttgttttgattcgtcaagagaaaaaaagtggtctaagggactgactagttggagaagaatccgtataaaatctgttaaaaggagaaacaatatactatactagtcttttctcgtagaggaggatgttatactaacattactaatttatgctcacccagtttaaataaaataaaatcaatacttttttggtttgtactaattaacatatatatatatatatattcccaaaattaaagattccatggctaacagacctaaagaagaagaagaacaaacacaataagagattggtgtagttttacttttactatattcatctttgtctttattgaccaataaagtaatttctcccctttatctatttgatagtggtatactttaagttgctttttaattgctggtgtacaattatattggactcaccaacaagaatctgtgtgcagtcagtgtgcttgttactattgttttatctcattaattgatgatcactttttcaccttcatacatgagagctgaattcatcactttgttagttatataagttgggctattctattattaacagtttgatttttgacagtaaatttgtctgccagaataacttatacacattaccacccaaaaaaaaaaaaaagaagaaccatttttggacattacgtggttttgggtttgtctagcgaccttttatgggccaatgatatgaggcccagtaaggaaacaaagaacggcccattataatgtaaacatatttagtacaaggaaaaggggtaaaaaaggaacaaggggaaagaa

SEQ ID NO: 8343 - DNA, 3000 bp, Unknown
  misc_feature (1)..( 3000): cDNA_ID_2994335_gDNA_ID_1971751_Annot_ID_175321 3000 nt of promoter + ATG
atctttcttgttaacattaaaagacgtgactgttgatacagcgatcttgcttatgtaactcgatcgttccttcttctttcagaaagattttgtttataaaaatttgagtaaaaagaaaagaaaagaatgtaagataacccacccaccaaaatgtcattgcaaagttgattaatgacgttagcagagaaatcaccggagcggatcaatcaaagtgttgcacactcacacatggatatcttcatggacctccgcatctttcgtgtctttttccaacaaaagcttttgtcgtggtctgacatttgataccaatgtgaaatgtgtgtatatatatatttctaagcctgtataatattgcatccaaagctgttacaacaagatgagtttattggaaaaagcaactgtacttacataagtgacagaagaagcatcaaagaatgaaatgaatgcacactaaattaatatctacaacatacatatctcatctaagtggtattcgtgttccctgaggggccatcacctccgaatgagaaggcctgatatcccgtggggctagtgagcttccctgagccactgctgctactaacagagcggtcaatctcttccctacaagccaccagagggattggccgttgaggtatggctataacagtgaactcattgctctccagcattttcaccacttgatccattgttggccttgcgtggagctgagggtgagagcacagcactgctatcagcacatacttctccagaacctctgggggtcccttctctggcatcccgtcttccaccacatccaatgtctggccttctcttaccagcgaccacgcccagtctgccaccgacacaggctgcccctcctcgtctgtcacaatcgcctttctcctgctcagaagctctagaagcaccaccccaaagctgtacacgtcgcttttctcagtcagttgcccgtacagtgcgtactctggagcaacgtatcccatagtgcctgcgacccgcgtgctcatatgagtcattccttcggggttgaacttggccagcccgaaatccgcaaccttggcctcaaacctctcgtccaagagaatgttgctggccttgatatccctgtggatgatggagggttgtgcgccgtagtgtagataagccagtcctctggccatgccaagggcgatcctctgcctaagaggccaggcaagctgagcctccaagtcgccaaagagatggtcatgaaggctaccgttactgacaagatcacagacaatgatcctctggtgaccttcatagggcgtggttgcagtacagtagcctctgagggcaaggagattgacgtggcggatgctggcgatgacctcgacctcatgagcgaagttggcgtcccctccagcagaacagttcttgaacctcttgaaggcaacctgggtgccgtcgggcagggcgcccttgaagacgttcccgtaacctccccggccaatgatgttgtggcgtgagaaattgttggtggctttcttgatctcgtcgaagctgaatttgacaagagtggtgctctcgctcatggaatcaagtctagactgcgtgccagcttctaaactagtatcccgaggcttgagaagcttgcttttcttcctccggcagtaccagaaccaagcggtgataaccagaacagaggcgacgagcaaaacagagaaagaagaaactagaactttgactttgttagcaccggagctagtgggagaagccaaatcgagctgaaacaagcatttggcggtgcctttgtcggtggggcccaaggaattggcgaaagcagcggcgtagatagagggaaaagaagcacagtcggagacattaccgagggatggaccggagagatagggctgaaacgcggagaggctctgagtgcaggaggcgcaaggggtattgctctcgagagaggtgttacagcgcatggcggtggtggcgagggaggagttagggataagggattcgaattgagacctggtggtgatgtccatgcacccctgcgaaatccacggcgtctggaaaccgcaggtggatcggacgtcaaagcgagggaggaaaccggcgacggaagactggagagcagcccagcaagaagcagcagactcaggtggcgggagaaaggaacccgtctgacggagatggtgagagtagaggaggcgtagcccttggaggaggtactggcaggtggtggcgccatcgggtttcggacgccggaacggttcaaggacggaaaagtccagaggacacgtggagttctgagcggcggagaaagaggtgaagacaaagaagacgacggcgattcgacggagaaacaacatctaattcgaagaaaattactaattgacaataaagacataacataacactctctctctctctctctttgtttcttacactcattgacccactagtaatattttggtcattagttaaatatatatatactcttaagtgtattattgattgtgttatttacttgatttacttgaaacggtcaaaacatgtcatgaacctaattgagtctcatccacgaagttgcacgagaactttcctttcactttttgtttcattttcatactattcaatcaatagtggtaatctggtgagagatgataatatttaaaattcttgattggatcctgaagaggtcttacctactcatgtttctgtttcgtatttaataacaagcctaattgcattatctaataaatccaaacgtgtcttagtcttatcatagctctgctgctcacaattactaatctacacgtgatggccgccggaacatgcgaagaaaagaatctgtgttaagtgtgtattctaagaaattctatattccaccgtttgacttcaaaccaacaaaaataaatggacatttcaaatgggccgagaaatgacgaaaaggcccaaatagaaccgaaagggccgaatcatcacccttgactttgagagagagcatctcaattgctcctcctagtctccatg

SEQ ID NO: 8344 - DNA, 3000 bp, Unknown
  misc_feature (1)..( 3000): cDNA_ID_3045090_gDNA_ID_1971751_Annot_ID_175319 3000 nt of promoter + ATG
tgtatggaccaaaactttgcaatggctagtcgaagctgattcatcactaaaccgtttttattatacaaggaactgacaccatcgaaactcttgcagatgttacccaggattgaagcatttggctccaatgatttccaattggtatgacaaactgaccacctcctaagagctctcatccttcttagaatgtaaaatctgatatatatctatttgcagaatcttattgcctccaagctgggagtccagaaaatcgctgggatcacggccttggacacaagagagaaaaaaacctacgaacttgttccagatatggaggtcagtgtactaaccttttttgtatatcttctgggttctaggtccctctctttagtgaaaacaggaaattggttcaccataatcgatattgttgttggcattatactgcagatatttgtagagacagactaagttataagacagcctccccgagtggtgttcttcctcgacaggttttgttattgcacctcctctgtgttgttaattgtttttgtttcttagtagaaaataatttggctcctttgtagaagaagaaaaaaactaaacggctttaacatatggactacgccgtttgtatcttgttgttacaaaccattaaacgttactgtttgatcaatatgttaattcagaactgtttggtttaaagcataagtattgaagtcgtcaaatgaacaacttgcaatcttttgctttgtatgagatacaaataaaatcgtggtccgtttataaaatagctttctccaaacaatttcaattcccttttaactaacacaacaaacgacccggcccgtcaaaagaagaccaacagacgatgaaataaaaggaaaaactcaattttctaaactatttttgggggtcgtaaataagtgaaaagcctgccgacgaaaaaagaagaagtgaaaaaagaagtgaaaagcccttgtcttatttgtcttttactatttttctgatttaaaataaagaaacaaacatttacagtatttgtttataacgggggctaagtagagaatcatgagaagattaaaatccctaaaagttttgggggaaagaagaaagaaggaagacgatgatgatgctcagaatccgaagcagagatggactggagagagtcacagcggagggagctcatatcactgtttcccagctcaaaaccttgatcgcggatcagcttcagatccctctccataagcagaccttatccaccaatcgtgatctcctcctcgccaaaactcccgctgatctactcgccttcaccgacctcacggacccaaacctccccctctcctctctcaacctcggccatggctctatgctctacctcgcctacgatggcgagcgctccattcctggagctcctcccgttactcctgccggatccttcgggaggaagatgaccgtcgatgacttgatcgcccgccagatgcgcgtcactcgtcaggagacgtctcactgcgactccgtctccttcgatcgcgatgccgccaacgctttccagcactacgtcaatgagtctctagcttttgccgtcaagcgcggcggctttatgtacggcaccgtcaccgaggaaggacaggtggaagttgatttcatttacgagccgccccagcaaggcacggaggctaatcttattctgatgagagatgctgatgaagagaagcgcgtggacgcaatcgccatgggcttggggatgaggagggtcggtttcatttttaaccagaccgtggtgcaggacaagactgaatacactctgtccaacgccgaggtgctacaggcggcggagcttcacgccgagagcgagctgaaggagtgggtcacggcggtggtgaagcttgaggtgaatgaggatggtggcgccgatgtccatttcgaggcgtttcaaatgagtgatatgtgcatcaggctgttcaaggaagagtggttcgagacggagattatgccggacgatgatccaaagctctctaagatgaagaaggaggtggttgttggtgtgaaggatcttaaggaggtagataacgatttcttcctcgttctcgtcaggatcttggatcaccaggttcgtgtttttctctctacccttcctttgcatcaatcatcattgttctttgtactaatgctctgcttgggcaaataaagtaattgaatctggagcttttaagtcttaggttaatgaagcttgtcagtgtttgctttccatgagataattgaaaattagcatttcgtcaatggtccctgtgttttaacattaggctgctgtgatcaggggcctctgtcatcaacattcccaatagagaaccggagcagtcgagcaacgatgcgggctctaaaaacacatctggaccgggcaaagagcttgccgttggtgaagaagatgtcagattttcatctgcttctctttgtggctcagtttctggacgtgtcatcggacgtccctgctttagccgagtgtgtgcgtctgcagtcgcctgtcccagagggctatgcgttgctcatcgaatcaatggccaacacttgttaatttttgtgtcattgttttttggttcttgatacagtatatcatgttcgttttatggtccagaaaatcttttttactagttgacaaatgaaaaatctctagtgtactcgtgatgtatttgattcaagtttgggggttaatttaagttatcaacaacttgtagaaacaaagttaattcacagagtaataaatcattctaataggtatgctcaggggcaaattggcaaaacataaaaataaaaagagagctactaaagttttcgagcgaaagcgaaaatgaaaattttataattcgagcgaaatgttaaaaagctgaaaattgggggaagaagagagaagagtttcatcgtcactggaatcaatagagtcaattggcgggagaggttagtctcgaaaagaagtggaagccctagggggaaactttctcgctcactcgctcgtctgcaaacacc

SEQ ID NO: 8345 - DNA, 3000 bp, Unknown
  misc_feature (1)..( 3000): cDNA_ID_1376179_gDNA_ID_1971751_Annot_ID_175312 3000 nt of promoter + ATG
tatctgtaagcaaggagataaatcacctggaacccaagacgttaagctcatatgagatatgtgctacaggatagttgccagatggaattctcgggctcacttgtttcaaactgagaagtctgcttgaacgggttctggtaacctgagttccaggattcgtcggctgagcgtcatagacagtgaacttggtccccagaaagttagatctgaaagaaagttaagataagagaaaggttatggcaaatatatgaaaaaaccatggggtcaatctgtagctaagtacctaagctttccgatataggtattgcttcctcgagagacatcatcgcagtttaaggagatgatgtagtcagtgcaagttggcctccgaaacctcttggcagcaagaaggaactttccatcatcatttgaagctgctgctggaccagaaaaagtaaacctttgagtgttattcagaaagagattaggtatgcaaagagaaaagaagaagcatctgttagtttcaccttggtttaacccgaggtatagatagtaggtttgattgctgcggtttctcataatatagcattgaacaagtgatcctctaggacccggctaaaaggaagtagggaaaaacgattagcctggataagcacacaagtcatttataaagtaaagagagaatgtgatgggatactcaacctgtttgagggagataggaaaagtgagtttgctagaaagctcaggaactctgacgatctctttgacgatttctcgccagttcctgcagacaccagcgcaagaaacaacatttttcctagacggccaagtgtcttcggattgctcaatcctcataagaacatctctcaggagctccggaggcatactagcccagcagctctgcttgaaagcatcaacaggaacagaagtatcctgaacaacacgttgagacctggatctaccatacccgaatctgacatcgaatccctttctggatatactcccaagctctcctctcatgtcctgaatgagactcttgaaggacatggctctgaattctaactaataacgaactagaagcagtctctatatatttcttggtaatgcacctaattcaaagttgcagactttttcaagaaccctaataaacccacattcggaacgaacgagatctcaacgaactaaaacacaagctcctccaaattattaaaaaaaaaaaacacgcttcttattacattcagatcaagagtactaacccaataggtacaagatccgattatagatagagatccggatacagagaataaatacctaagaaatcccaagcgaaattaaaaaggccgcatcgattcacaagttatacgagcttcacatcaataagaatccaggtggagcttgggaacagtacccaggtcccagattggggcatcgaaatcgacaaccaacactcgaaagcgaatgccttttacaacccacagaagaagaagcggtcagaggaaatagattttagggtttgacgggggagtgaatatgtatgtctgtctctgtgttatccaatcgcttccttccttgtctcatttttaattgttgtcagtcagtcattttattattttatcattattttcttcaaactaaatttggtaacaaagttttacatttcattctaattgaccgtattcttaccgatttatcttctgcctttttaattaagggatatatataaagaaagcttttcaattatagaaataaattaagctgccacatgataacgaaattaaagtgtgctttctatgtatttctctttctcgttgttatcttttgttttggtaatgtttctagaaatgttggaacttcaccgaaataaacatggtaactgactagattctaaaaaatcttgttcaaaattcatcatataaaatagacatctgaagataagaagacttacaaatagaatactttggtttaatggaaactttctttccgtttttcctctttttacgcaattgtatttgacaaaacaaaactaagcagagtaagctttttgttgccgtgatcacagcactttcgccgctttaatgggccaaaaggtgttttaacgttttactttatataattaagatgaaatcttccttctttggatataaataatgatttggacaactactgatttggtcaaaacgtaaacaaaaacaaacaaacaaaggaaaacgtcaaaaaaaaaaaaaggtgttatgagttataaaaaataacattattgggccgtaagaatcctttttttcgtctatatgggccgaattgaagtctaaatgggtctcgatcttaactatgcctacacagcataaagaagttaatcactacaacaaaatcatcatttggccttataatagatattcattctcaggcactctaagacactgtgaagtggatcttttgacgcttatgttcatcttactagattgcataggtgagctttttctctcaaatcatattatctttgccactgctatggtagagaccttggggacttatctttgccaaggaatgttccattgcatagctatttaaactttaaagtgagcagaattctcagtctttgagctacttacttacaaagcctctattgtgcaactcctttgacccggtacgaccttggaagacaaagaaggcctcactgcttgcaaggggcaatggcgaagaagaagatcagagacggtcaagcttgcagatgctcctgaaacacctcaccaacagtgaaggagattcgacaatgcctacatctacatgagaccgaggaggctgacttgagttgaaaacattccacattaaagaagagagctcttcatttttctgaacgattgaagaaatgcattctgcttaacatttgaaacctttacgacagacagcaaaatatatgtatttgtgcggtgaaggaaaaaaggataaaatggaaagaaatgaagaaaaggccaaaagaagaggataaaaagaagactaagacacaaagagagatagcgtctgtga

SEQ ID NO: 8346 - DNA, 3000 bp, Unknown
  misc_feature (1)..( 3000): cDNA_ID_2038801_gDNA_ID_1971751_Annot_ID_175295 3000 nt of promoter + ATG
ttacaagtagatataatctccccctcctgagaggagtgacagctgatgcatgattctcaaatcctgacaggaacgtaacaatccgaaacaaaaacaacgaagaagaaagaaagaaagaaaacatagtggaatcagaatccgatccctttctaacatcactcttccttttttgaaaaacttgtaaaagtttccaactttcctcttttcaacaagttgtaatttcttcgcttgttgcatgttgaaacacgttattctgcaattaacaaagataaatcacatagattttgcattataaaaagctcgttaatgtcactatcttctctgcacagatcacctttagtacttcccaaggtgacatccatggcaaagaactcatcatcacagagtagtagcaagaagaagcaagaaaacagagtgtgcgagaagatcttcagagcagtgactagtcctgtccgaaccgttcgtcgcatctccaccaaatcttcaccagcagaggctgttcgcgtcaaatttgcagagacatcggctaggcctagggcagccaaacccattacaaaggtggaaccggtgatcgctcgagtggatactacgatcaaaacggacgagaggttcaccgagtatataaagaaagcgaagctgaagataagggcgatgacgaatgtcggtgatatgatgaaggaggatgcgtgggagacaagtgatgaaacagatcagacacgtcatgatcatcttcaccaccatgtgcctatctctcacgtaggtagtagtggccggagatcatcagatcagttctctgagtacataaagaaggcaaagatgaagctcagttcctcttccaccattgctcgtgctaacccgactttcaagtgatggatttcgacaaattaatgatttgaataatcctctggcctgagagattgatatatatgtatatgttttgtggtgtgtgttgacaagtacggacatggatttgtcgttttaatgaaaactataatactagtgatcattttaataattttgttgttacatcggtagcgagtggtttcttttcttaagaatcattatatgggctgtgaatgggccgccaaagaagagtctgtttaagttgataaagatgataataaaatgataatgatgagaaagcttggaattataacgaaatgacatgcacgatcgttaaatccgttattaaacaataccccgatcggctctgattctgaaaatgggcggttttagtcgtacgtaacatgacgtcgtgacctgtactgaatattcattcattcattatgaagcgataactcttttttaatctgaagcccccttaaccaaaaaagggcagattcagttgagatttccttttcttaattaaatacgattgatttcctttgacaatttcttttctttctcggtttttctcctttcccagttaatatactgtctgtcgcagtatattttttcatatatgtttctactagctactgatttaatttttccaatggataacttattcgtttattcacaatataccataaatgagaggtgtttctgaagttgtgtcgataactcacaatttttgtttacgtccattataatacataaatggagaagtccctttccgacgatcaagagtcaagtttgactccagcagatgcataatatgcacaatagacaaaatcgatcgtatatttaaattaaaaacaaaaatgaatacgacgaatctcatgattggcccttatgcaatttaaattcaaattaagtaataaaactacattcatatgtcaactaaatctgacgttaccaaactggtttgaaaaggaagaaaaaaactcgaggacgcctagtgtttagactattttacaatttagcaaacgcagacaaattaatgttttgtttcctacattttattatgagcaatcgggaataatttggtttgataaatcaagtagtcgacatggtgtaagcgaggcactggacggtggcacgataggtgagtcatgatgactcaagaaggcctcacgttactcacagtggctggatcattttattatataattactctctgagttgtataaatcctaatctataattaacaaatgtatagtctatatataatttgtctgttcgttcactcagtatctatcgtcaatgcccttacaaaaggcaggcacaaaaattacgaacaaatcaatgacccctcagtgacagagagaccaatcaaaatcgctttatttatttatctggtgaactcattgtgctcttcatacataaaaaaaagagttttatatattgagaaaagaaaagtttactacctacacgtggaaaacgtagagggaagtcgactttatggatgattagaaaaaggtgtagaaaaattgcaacaggtcttgaatctttctttaattgagtaaaaaaaacgtaggaaaatgttttggaaccgtgaaaattacgaaagagagagaggcagtcatattatagcagattaggagacaataataaagatatatagagagaggcaaggccagttatggtagataattagttccaaaccatgcatctctgtaaccatggatggatggatggatgatacgaacgaaaacggcctagtagagaaaagaaagagatttttgtcttttccggcaagcgagaggactcttctcctgaggggcaatgtgggaagaagaaagctaaatgatatggccacaacagactcgatcgaaggacttgttctcctcactttcctccaacttaattttatttttttaagttatggtttagtcaataattacgatggagtcgagtcgagttgagtttgtccctcccccccccctacctatatttaaacatcatccatgcctagagctttttacttgtattattaattttgtggctaaaccaaaaccaaagaaacatttattattacaaattttagtatccaacaaagcattcaagcccttaaaccccccaaaacctcctccgatcccattctttcgttaactgatg

SEQ ID NO: 8347 - DNA, 3000 bp, Unknown
  misc_feature (1)..( 3000): cDNA_ID_2038951_gDNA_ID_1971751_Annot_ID_175298 3000 nt of promoter + ATG
tttcgcaggccctaattaagacattcaagaaaacaagaagaagcataagaagaggcctaaatgcccagagaattaaacaaatgggcctttaacaatattttaaacaacactgaacaatagatgagatctcaacttcgaaaagctaaagccttaatataaaaccaaacatcaatctctcgccgttaaggttacatctgtcgccgccgctgagaccgccacttaaggccgtctcctccgctctatccatatccaaaacagctataaagataaacttccagagcttggtgaaggagcagcaaccctagttttcaatccctaaaggtgaagtttttgttcttctttttctttgattctactcttttttcgtcacaatagcgcagtagcgatctgggttggcgtttttattgacggattttggtgggtttgggttcgtgttagattttactttcacagattcaggtatgtatttgatcttatttagctttggtaatactcaaaccaactagtatttgatcttaattaggtgacgttgatattttgtgtgttgtgggtcaatcatccactctaggttgatctgcgtctatgtttagtcctaattttgaagaatcattctaattgctgatgtttatttatgacaattttatgtcttacttcgaatttagctaagataataaatctagacgagtgcctttataaacagtttatgtatgaacaatgcttcgcttgtgggattgttgatttcactacatttgattaagaatgtacatactattacaaatgttatcgattaaaaacgtcattttcagatattagttctccagcgagttgacacaaaacccgattacgtttcatccggcgactcgctttgatattccatggattctcagttgaatccttccaagagacgcaagataaggttcgcgtctctcatcttttccccagttttttttcttattcgaatcacttaaggcttgagaaattagtggttagggtgtgtaaattgcgtttgatatagtgtcaggcacagatgcgttgcgtgctataagatgttcaatagacgagaacacctcgttgagcacatgaagatttcctaccactcacttcaccagcctcgctgtggggtttgcctcaagcactgtaaatccttcgaatccgtgagggaacaccttaacggtatgtttgtatttgtattcgttttccaccacacatcgtatgaatatggtggttgttgatgtttgtttgattccgtctttccaactatttcagttccagaccatctttccaaaggaaactgcaaagccattttcactaaacgaggctgtactctctgtcttcaaatctttgaggaggcctttgctctcgccgagcataaaaacaagtgtcacctctccccacctcgtcctcttgtaagttttgttgggaattatttagataatgtggactatatatgctctgccgcctccaatattcccgagtctattctttctgattattgaaatatcagcagttttccccttaaatgatctgattagtgctttattcatatcagggaacatctacccaaaggaatccttctagttcacttgctggttcacgtctcaaggctatggcacttgactgtgaaatggttggtggtggtgctgatgggactattgatcagtgcgcatcggtttgcctggttgacgatgacgagaatgtgatcttctccactcacgttcaaccactgctccctgtcaccgattacaggttctgcttgtggaccatttgtgcttgttttgttttataattcttccttttaaatctcaccccgcctcatgttcaggcacgagataactggattgactaaggaagatttgaaggatggtatgccacttgagcatgtacgagagagagttttttcgttcttgtgcggtggacagaatgatggggctggaaggcttcttcttgttggtcatgaccttaggcatgatatgagttgcttgaagcttgaataccctagccatttgttgaggtaactaactgacccgtttttgttgactctttgcttgaaatctaatgtaattgctatgcttcacctcagagacacagcaaaatacgtgccgttgatgaagacaaatcttgtaagccaatcgctcaagtacctcacaaagtcatatctcgggtaagttatgcttgggctttgatttgttgacattggattatgaaaacttggaacatgagatagaaactggttttgtttgtatgtgtagatacaagatccagtgcgggaagcacgaggtttacgaggactgtgtatctgcgatgagactgtacaagagaatgcgggatcaagagcatgtttgtagtggaaaggcagaagggaatggtctgaactcgcggaaacagagcgatctagagaagatgaatgcggaagagctgtaccaaaaatcaacgtcagagtaccggtgctggtgccttgaccgactcagcaatccatgaaatgaaatcccaatttctcttttaaaagaaagctccttctcttcctcccttaagtctctttttgttcgatgggaggattaagaagacttgttaagagcttttccggctagtttttggataatcaaatatgatatggcttcattcaacaacaactctccctttgggaactcgtataaaaagttactacttaagcttcaaatctgtgtaactaaaatggataaagtctgatgcatctgaggtcttggaatctgttgctcatagttgtggataccagcaacatcaaacattattacttgtttaccaaacccactctcagcttccatttcatcagtttgaagtcaagtggataaaaagactgtctacataactcaaatactgtagtattatattcacatataaatgagaaattgacatttcctctagaaaaagaaaagcaatcgtgtgagaagaaacaagtaaaaggctgaggaagaagacgactattagtccccgtcgaacttgtttctcccggtcgtccaacaa

SEQ ID NO: 8348 - DNA, 3000 bp, Unknown
  misc_feature (1)..( 3000): cDNA_ID_3024907_gDNA_ID_1971751_Annot_ID_175308 3000 nt of promoter + ATG
acgagatcgacaacgacccggactgccgtgagatcgagaaggctcttctccggctcggctgttccacggcggttccagctgtctttgtcggaggcaagcttgttggctccaccaatgaagtcatgtcccttcaccttagtggctctcttgtcccattgatcaaaccctatcagtccatcctttactagcaaaattaaaccaactcaatatataatatctaattattagctagtgagaataaacacagttacagctagagtgtgagctagctagatattcagtgaggacttcgtctgaattaatgtttatcgtttgtatgttctattgtttagcttctctcgtgtttcagtttagttaatcaactggtgtatgttgatgtatgactctctgtttatgctaatgaaaatagtattgaaacttttacattttttcccacacaattagtaacgatctcttgtgtatgttgagtaatttagggctttccatataataaggcaagaaaccgtttatacttgtctgtttttaacatggtatcagaaggaggctacacacaaaccattttcttatttagaaatattcacatacactgacagtagctagaataaaaatgtgaatggccaacacatgcatgaactcgtcttctaattatcaagatgtaatgtataagttggcttcatcattattagttagacctattgatagttaacattatatcgggcgatatacagatttagcctttgtgatgttgtgtttagagcgtacttttgaatcaaggataaatcagtgcccattagagtatatataaatcgaatgtgaaaaatattagatcagaatagacttaattagtctccaccatacaaatttggtaagaagaaaaacaatgataagataccagtggcctaatgcaactaaagcagtttgaggaagaggatggaagatctttcgcggtccaagtatatcatggctacacaaaatcactgctctttttgcgttcctttattcttgagtatcttcacgtttaatttactattattttctaatgaaaaattgtacacctttttatatatatgaactctttgttttttcgttagttgctcgtgtagtaaattaaacatatatgctcataatcaataaaaacatacaatgttagaagaaaaaaatacaattttttttactaacgaatcatatgaatagttgttttatatacggtacattaacgatcctctcatcagctttatagataacgaagcatattattctccttagttccgctttttatcacttgagattaaactctactcacaggtttaagcacgtaaattagttactaaataatggatttgacatttacgctttgcatgcttatatatgttacccataattatttccctttagttacttaaagttaccaaaatcaactacttcaagattctccaatcaaaagaagcgtgtaaaagcctctatagttatatagtagtatatagaccttgaagatttctttttgaagaaaatatgattatactgagttcaaaaggtcgaaaagaaataataaaggtagaatccctttacatgatgtgtggaacaacttttcttgacctccaacttcttgggatcgtgggaaatatataggagaatctaatcggaagttgtacagaacgtgtaagaactaagaaccatattcactttgttgtcattgttataagattcaagattctttgaccggcgcgtgaaaaaagcatccacctataggctcaagattcgtgtccaagaaaatatcgagaaccgatgattacttggaaagtggaccattttttaaaaaatcaaaaattaaaaaaggaacgtagctcatgcgaatagtttagtccaccaaagtgaaatggtagaacatttggtttcagtttagttgtgtgtatttttattaaaggcttcagaatcaatttcgatttttgaaaaatgagtttttatagccatgttagtatgttacgaggatggaaaagcaacctagctagattatcttgtgatatgtgttattgttcaagagaagtaggggcagtagttgtcgagatcatgttattagtgtcgctggaatgttagatattgcccatcctgtctctttttccccatcgtgccctaaaagtcaaactatgcatggtattagctaatcttgaataggtttaattcagtacggaaactctaattgaaaactaccttcatggagtaatagttatcgaggaacgatgatgaggtattagtggagataagcagatttggactcaatatcaaaaattaatggtgggatccatttccgtttcacctaatatacatagtggcaaacaaaaaacaaatataagaagaaaagattcagtatcgagcattctagctatgtcggtaacgtgacaaagtcctttttttcgtttgtctgtttctttaaagttaatcaaatcggccaacgctgcctcaacaacgagcttcctttttctaacgtccctaatttgccacgtccattttctggactagtcccggtttaaaaaatcttcagagatgtattcgtggtcaacttcattaactctttctcttgagcccttcattagttatgatcttatttactttttaaaaatctaaccaagtactgtatattatatatgtggtagccaaaatattatgttaaattctaggctaatccgatatatcaagaaaaatcaatatataaaaatggagagctatttttcacgagttaagtgagagagatgagtaaagaaaggcacgggaaggtgaagagagtgtaggtttccagcttcttccccaagaaataaaatgtatttgactttgtctaagcaaatatgtcgtcactttaacgtcattcattacctagaatgcaattaagatatggcttttacataagccaccaaatttggttttgttgccccaaaatatcccaagaaaagatcaacttcttcttcttaccaaaactgtcggcgtcgtctcctctaagctcctccc

SEQ ID NO: 8349 - DNA, 3000 bp, Unknown
  misc_feature (1)..( 3000): cDNA_ID_1836253_gDNA_ID_1971751_Annot_ID_175303 3000 nt of promoter + ATG
ggggcaatgcaaatttggtataacctgtaaatttcatcatcctcagcctgctggtactactgtcccaccaccaccagcatctgcacctcagttttatccatcggtgcagtcacttatgcctgaccagtatggaggtccatcttctagcttgagagttgcaagaactcttcttcctggttcttatatgcaaggcgcctatggtccaatgctattaacccccggggtcgttcctattccaggctggagtccttactcggtgacctttttttttattgatgtatcatcaatacatttgttattcaccacagtctcttactgtctcacttttgcttttgcttcaggcacctgtgagccctgctctatctcctggtgcgcagcacgctgttggggcaacttctttatatggagttacacagctcacttccaccactccttcgcttcccggggtttatccatctctgtcctctcctacaggtgttatacagaaagaacaggcctttccagagagacctggtgaaccagagtgccaatactatttgaaaacaggagattgtaagtttggaacatcttgtaagtttcatcatcctcgagatcgggttccaccaagagcgaattgcgtcctcagccccattggtcttcctctacgcccggtatgctctgtgttaatatgtcataaaggttgttgatcatagttataacatttctgtctctaaatccgttgtttatcttgggttgaaaacagggtgtgcaacggtgcactttctacgtacaaaacggcttctgtaagtttggatcaacatgtaagtttgatcatccaatgggaacgatcagatacaatccttctgcgtcctctctagctgatgcaccggtggctccttacccagtgagctctctcttgggtgctctggcagctgccccttcttcttcatcgacagagctcatagcaggcggtgcaaaagatgcttacatgaccggtgtgcctacatcaagaagcacatcaaacatctcggcaggtttgattttctcccagagcggtgggtcaattccattctcagagctgcaactctcgagccagagctctcttcctctaacaggtagcagaatcacaagacaagggcgtgaaattcgtcgatccttttgaatagatcacctcagaaaagggtacgcatacgcaggtcctctggatcaccttttagcaattcttaatctatatgactattattatatagaagcatgtgatgtgaatttatatatataatcttcgtaccttgagaagaagaaaaagcctatttgagtagaagacctgagtgagaatcacatatatctgagaggaaatctatatgtgcatataccaaaaaagataacaagaaaaggcttcttctttttttttttggaatttgtgtataatgtttgtatagagacagacaaggtttctttgtcttgtccgtacttctacttcagacccattccggctgagacacaaaaacaaaaaaaaaaaaactgagacaaagaactcaattctcctcttcttttagtctgccaattggtgtacttctcgtgtgttaaggtttgttcttattgtagatgaatgatgtgtgttgttaattttgttatgttactgcttcacacattacatgtgttatggtgatgaaacaacctacatttcaagactagttttgaaggttggcaccattatcttgaatatatttatttccttaaaaaaaatggttttgaaatgaagttgagcggaagcacactaatcctagaatcgatcaatagcatcgggaaagtggtacaaaaaaagagacgagagaaatgatggcctagaaacaagttttaaaacaatatggagaaggaagtaatctttagagaaaaccctacctgagaaaagaaactatcatgctcaatttaatatgcttcgccatcatttgctcttatttgccttccccacttgtctctctctctctacactcttacttttctttttgtcaaaagcccaaggaagaagatgaaatcaactaaacttggacatccggctttggatttggattttgtagagtgggaaattgtagtttgttgtgaaatctaacaacaaaatatttaccaaaatatagatttgcttaagtgagatatgtagtattttaatgaattgcgtattaataggttaggagtagtaaactttttgtttttcttgttaactcgtttgagctacttccggaattgaaaagaaaaagaagagagacatagaggtatgattacaacccccaaaagtaatgcaaccattcacatttcctgcagtatagttttcttttaaaaaaaatataaataacctggtgtaaaataaacaaagagaagacacgataagagacctttttaacttttcaccgaaaagcataagtaataaacagcacacttaattgactttttacgcatatatgcatacatatattgcttttcaattacaaaaatagaaaagtacagaacatttagcaaactacctctgtatatatattgatatcctgtaagaaaaatctaaatattattaatatcacctttgaaacaaaccaaaaaaagaaagaaagaaagaaagacatttgtatcacctgacgtgtgtgtggactgtgggctgagatcatgtactcatacaagcattctcagactacctatagcaagcgagattagtgtcctaattcccggagaataaagttatatatatatattcacctaattttttattagtatatgatatgcacataaagaactgtttatttttatgaagaaagtcataattccactttaatcctgcatgaattcatgtgtgtttttaactctcactccatggcacaatctttcatatttgaaaagcagacagagagagagagcatttgcagccgacagtaaggaacatttttgggagaaacacaaaaacatatttgcagtaacacaaaaagaggtttacaactttatttggggagaagagatagataataataagatcca

SEQ ID NO: 8350 - DNA, 3000 bp, Unknown
  misc_feature (1)..( 3000): cDNA_ID_3045117_gDNA_ID_1971751_Annot_ID_175292 3000 nt of promoter + ATG
cctctggtgatgctagctccggcgcccaagaggctagacgctggcactggagttttcttgccgtggacaccgccagtgtcaagaaaaccagccaagcatctcccgccgcgtgtccagaggctgcgtctcttgtcatcatcaaagtcagtggcagatagtgagtcatcgtcgccagagataggagtgagttgagttggaaagtgtcacacacggaagctctttctttttcctttactttttttttttaaagcagagtcttttggttgtacacttgagagtttagtgggtttttcttgtttcttcctaacattttgctttccttttatttggtcaattttatagaacgaagattagggtattatgctacatcatctactgttgttacatgattcactatttgtattaaaaatctttaggatatgccccaccacttgccattaatttcaaatatcttcagcttcaatcaagaaaagaggaaacttgattgatacaaatattcctgaaactgcttctcagttaaagtaaaagaggatgaagaaggaagcagagagattctggttttcttcttcttttattggataaaacgacacatagcttccactggctcaatttccccatctaacaaaagcgtagaatcaaagcaaacccgatataccactactcatttcttcatatacaccaaaaccactcctcaagcacaataatcctggagagaaaagaaaaatacctttctgtttctgcagtcttctttttgacagagaatgcacataagagaggatgatgacagcatcagctctctgcggcctcggggcatttgccgtcggctgtttcgatttgtggtggctaaactatggatattaggagacaaagagatgaatgaagataagcctgagaggaacaaactgatcaagaagggatcaatgtctgacatcactattcatttcaagcaattagaagactcggaggataacaattcccctgcctcgtcaagtccagaatcagagagagagacaatgattacactagttaatggtagtaacggcccaaagaagaggttacaggagaacggggaaaagagcatgctgggtgagcccagccctaagcaacaaatcactcagcctgaagcagggaaaccaccacagcctcatagacgcctggggcccctactaaatgatataaataagaaatcagatgcttttatcgaaagtacactcgagaagatgaggaaaggcttagcctagaactaaacacatgagcctccttcttctctcgctttctctgtcgaatagaagaaccaacagacactgggatgcaagaattatctatatactcaattcttttactttgtttaaatttaccagctgcattcttgataacaaaacgtatatgtactcccacttgtattttgaacaataattcatctcagaactttaagatttacaagaaatattccttaaggggctagttcatatatcattctagagcaatgttcacattcatttgccttaaacccacgtacctaacacgataagctgaatgaagtaccattctaaggaagaaaagacaaagaatcttcatgctctaatcccatcatgattcacgagtagtccctactctgttctttccagccatccaagctgaagtaagaggcaaaaagtgaaaaaaataatctgagcaagcacatataactatataagcgcccctcaataattaccattcgacataccttccaggcatacatagcaaagaaggcaaccgtgtcagcagaccagacaagagcaaatgatttccaaaagaagggaatagcaacattgagcaaggggacgatgagaaagaggtagttaagagcctctttctctttacttggacagtctcgtgcccgaagagaaggaatagctggaaagaaagtaaaggattaggggcaaaaatgcagccttggaataaataaagttagaagaaagtagagaaggagacatactgaacatccaaatggaccacatgcccatcaacctccataaatcaggttcgctggagggaaagaggaggttgaaagaaaggacacctccgaggaacatcgatgcatagccttgaacctcaaaaactttgtaaagagtagttccagggagagcagggtttttactggcggtggaagctctaggggcaaaggttgcagcagtcttgttaacaacctgcttgaattgaaaagtcataagcttgagcaactctttcaacaggttcaagcactagagaccaatctaacatggtgcattttcattttcatgtcttcctatggtttcaacagaaaaatcgtaaatgatatagaaaaaaggcggacctttttcaagtctttaccgagagcagaggatgaggaagggagaggagattccggcgggtcgtccttgggttctaatccgtcagaggtggcgaaaatacggaaggtggatcttcttctatggcgaaagccataagtgagagctatggaagaggagaccccatgggtgctgcagagagaccaactcattctctcctccaataatcgcgataaggaagaagaaacttgttggctttattgaaccggtccaattctcaaccgaactccggtattccaaattaaaagccagcaatcaataattgaatctcgagcccacgacggtttgattggtttagccatttctcggcgctaaatataatttattaaaatgatgattattgcgagaagaaaagatctttctttgatttttgcttgtggatttggatttccagtttccaattctctcaaatttgcaatccaccttcaaattcacacacatcttcaacagctaccttttcgggaacttgctagaattcgtgagaattggaaatttttatcctccgttttagtctccggcgggctgatttcgttggccttttggaagaaattgaggtcggagctagagaggggatctattgaattcgatgagaattgggatatggtgatcgttaagacaaaagtttccaatg

SEQ ID NO: 8351 - DNA, 3000 bp, Unknown
  misc_feature (1)..( 3000): cDNA_ID_3045295_gDNA_ID_1971772_Annot_ID_175380 3000 nt of promoter + ATG
ccagaaacccaagtttccggtttgtaaatcgtacatgtgaacaagcccatcctggaatacaagacaaagaggaatgagaaaatggttacatgatctaaccataagagtgttaacagaggaaaaaagattgcttgcagttttatagttaatgaaaaacaaaagctcaggcattagaaaggataggaagatcaaaagtacctgaccaccggtacctaaatgtcgaccacatggctcaatatcaaagaatacacgctgtttgtgttctcagttgctctgtacaatctgatcacacatataaatgatccatttcaaacacatgtcaacattataagagcttcaacatctaccatttctcaagctaagacttctattaacttgaacattgatgtaacgttaatcttaagctgctcatggctcattaagcattaatcttgtttacagcacttgttcttgcttctagattatattgtaaaacaagtatgagcttagaaaccaaagactacccaaaccaaaataaagaagtaaatactcacttatagactatttcaacagatttccgaatatcccagcaaagaatgtaaggatcctgaaaaagagcaaacaaaaaaagaaacatttttttggtgaggttaggacaattcatcatcctattacatatcatactctaatattggacaccaacgagaatatctctggacagacgatactttcctccaaaaagggttatccttaaaatggaagtcaagttgcgatataatatgctcaacattcagagggtaaaatgtttataacagtatgttactcttgcgacctcctgtatataaatagttcccatcctttgaaaactggacctaaaagcaccaaaaattcgatcaataattgatcatatcccaatggacaaaaattaaggcacatttagtggtcaatgcttacatgtgtaacaccgccttcttgaccatgtaaaacaatacaatagctccatgttgtcttctctataaatcccagtagtttgcccgtaagaccccacagccaacattccagaattagttggggagaaagcaagagtagataatatacctggaaattatgaaccagttaaggttgttcttgtttctgtataatctgtaataatattgttatgcagcgtctgagtggaaaagaaagaaaaaaacctgcttggccctctttgtttttctgtagagttgaatactgctctaaaatctcttctcaggacgatgaagatcaaacactctgatggagctgttgtaaccagcaaagatcctaaagacataacacaggcaaatgaacatagaccacttttaatcaattctttaccgtgtgggaagatggatacaacttagatgaagtttttgcttacttggttccatcaggattgaatccaactgaaaatgcagcagttatttcatccatagcatcatagagccggtatgtgcatcgaagctgacattgtgttattcacatgtaaataaacaaaaaaggatggtagaaaaaatctccagtaaacatgttaagtttcatggaaaaaatcagcacctcaccagaagtactatcccaaagatgtatcggatggtctctagtggaggtagcgaagacgcatgttaaagggtctgatatcaatcagtgaacagccaaaatcagtaattcaactgatgaaatcattaagccaaaaaattgaaccccttatgatgagcttatctattacctgaaactgacatgtatggataccaacagaaatcatagacagattcaccctcattcactagaagactcgcaccatacgaatctacaattccaataaacacaccatgaatcacaaaattacttcacacatattttacagcatttgccacaacatacaaatgctagatggaaaagctaaccttcttcagggactggcactccatagccattagaatcccctccatcttgtggcctgatggggcaaatttgcaaaactaaagattcaacagagaactaaaactacacaaacatacaaaattattgatacttaagctacaaaaatatttcaattgaaattattcaacttacagatgaaacagactaagtgtattatcttcagagcttgcaaaacatgaaccatcaggtgacctatataagaaacagtaacaaaatcagtacctcaaaagttaggcaaaaagaaaaaaccaaactttgagaaagaacaaaactctactcaagagattgatttgaaacaagaagaaaagggtaccacttaagacccttgaggaaattattagggtttcgagctgtcctgaactgcttagagaaatggtgcgttctataaggagagacatcaaatctcatagtaggccaggatgattttttgttctcctgattctaccttaagtccaccattttcttctgctactgcttcttcttcacccatcttcttcgtcagagcttctggaaaaaagcagcagagagaggtttactttcgttctaaaccccagtcaaaatctccaaaacctgaaccaggttttcaatctcagaccgacaaattgaaccgaacttaaaccaaaaaccgattagggattttgattggaatttggaagaaaagcccgccaggtttgtcattagtgcgtctctctcttctcccggcggatcggcgaatcccggcgaccaccgtcttctttcctttatccactctctacagctttcttctcaagtgtttctctctagttacttccttcctacagctttgctagatattgaaaattagaatattaacccctaatcccaaaaacctcggaatgtcggaaatgagcgagtgacgaggaagaaaatatcattcctttccagctccagttcgacaagcccataccttttcaggttttggttctactcctgctcaaagttcgtgtcttttttatgcttttaaggatttagatgtttatatatgttcaatttcattagattaagatagctgagtggaacccggagaaggatttactggcaatg

SEQ ID NO: 8352 - DNA, 3000 bp, Unknown
  misc_feature (1)..( 3000): cDNA_ID_3045275_gDNA_ID_1971772_Annot_ID_175386 3000 nt of promoter + ATG
tgtaaacttgggtttgatgataatgaattgttcatgttaaggactaataaaaacagagaagaaagtgtactaaaatcgaaatttgagctctccaattactaaatcggtgctaaatgaaccggtcggtcgtttctatatttgattcgttcggtttatcctttaaccggtcgaaccgaagcttcttttgttcgtatgaagaaaactaaaatccaaatctctctctggtacaccatgagaggagctctgttcagaaatgcatctctctgcgctcgcagaatcattctttcttctaggatctcccccaatgttccctttctcactccaatcgccgctccggctcctcccaaattcagatttttcagttccgaatccggtgagaactcgactactgccactgagtcttcgccgactgattcatccgataagaaggatctcgttgtagaggatgtcagcaacaaaggtaacagactctatcctctcttcaagcttgtttggttacctcacacttgaaatggccttgtattagttgaaatgtgtgagtctaattctcatctcgccatttctgaatgcctcacagttttcaattgatccttcgatataagattcgtagcttcttatctcctgaactactaggtaatcgtttgaaattgactttataatgttggattttgtggtctcagagcttaaaagccgtatagacaagtctttcaatgagggtaatgaagatgctttacctggagttattgaagcacttctacagagaagacttgtagacaaacacgcagagactgatgatgaattgatggaaaaaatcgagagtctacctttcaaagatgatgtcaaggatgaagattttgaatccgatttcgaagaagcgcattctactgacgaagaacttgaggattttgtacaactctcccgagtatgtagctgaaaagatgaggaagaaagaatttttcaacatggacgataacaagtgggatcacaatgattagagaaggtatccaacatggctgatcttaccgatactaaacaatgcgaggagattctcgaggatatgctcaaatgggaccagcttcttcctggtaatgctcttttatttttcaatcttcccgttcatcgactcacatccttagacatagattaggttgattaatagactattgtagcctcgttatagctaaacacactctcttagtggaacttatcttttgtagttaacctttctatttggattttaatgaatcatggtagtagaaccattcttcttttcttaactctttcaaggtaatgtactatgtcggatttgttgcttctcggatcagtagggctgtttagagaatatattggtttgttcctgttatgcgtatgtatgaacatcctctaactgtgtatcttcattcagatgacttgaagaaaaaagttgaagcaaagtttaatgagctcggggatatgtgtgaaagaggtgaaattgaggccgaagcagcttatgagcttttcaaaggaatttgaagatgagatggtaattcagtatggggatcagatggaagctgaagggtcctccccaatttggtgaaacagatacttctgacaggaatactgacttggatgatccctccggtaaaggcccaatcctcaggtggcaatcaaggatagtttttgctcctggaggtgatgcgtggcatccaaagaacaggaaagttaaaatgtctgttacagtgaaagagcttgggctctcaaatcatcaggctaaaaggctaagggaacttgtgggaaaaaagaataccattcagggaaagatgagcttacaatcacctgcgagaggtatataaactataaatcttaagcttttcgcgagacaagaatgttgaatcatgtaatgtttttgtcctgtcacaggtttgaacacgagaagaaaacaggaaagactgcttgagaactctttacgggttgatagaggaagctgggaaagccaacaagatcgctgaagacaataagaacttcatatgtaaaacagagactccgagccagtccagcttttatgcagaaactacaagccaagatcataaggtctaaagaatcaaatgccatcaacgcttgaaaaaaacttttcccggttcgcagcctttcttcttgtctcaccaaataatctgtggatcgtcttcttttggcaatcatttgatccggtacgggttttcagatcgatgaagaatctttgatggtaactcctattttagtttggtttgcttcttgtatctcatgaagacatgaaccttggctgtgctgttggtaactccatttgtcttcgtcgggaaactataaacagaacagtccgaccactttttcatgctaacttctagattcataatgcaatgttggtaaaaatagacaatgaatgaaactttttcatgtataaaaaatatggaaacttggggttgataatgaattgttcatgttaagactaaaataaaaaacagaagagggtgcttgtgtggttagtctcaattgttaaaatcaacaattaagttctccgattaggcgttgaattaaccggtcgcccgtttttaattttcatcgttcgattttcaacttaacctgtccaccagaaggtcccttttgtgcctaattttgatgaaatgtcgtcatttcgtcgttgaagctacaacacaaaatacaaaacgttgtagttagattgctgaatctctttgtaccggtcaaactcggtcataccgagtatcaatccgaatgatccggtaggaccgggattttaattaggaatccgaatctctaaattccagatgctaccttatacgtgtacgtcttctccgcccttcttattcatttctactctgctgcgttatttctccgtcgtcctcaactcatcgccggcgtttaccatccgctagatccgtcgcctctccggtcgactatttatatggaatcgtaaatttacagacactaataagaatagttttgacaaaatctgtagctggaataatg

SEQ ID NO: 8353 - DNA, 3000 bp, Unknown
  misc_feature (1)..( 3000): cDNA_ID_3045253_gDNA_ID_1971772_Annot_ID_175394 3000 nt of promoter + ATG
atatccaggtgaaaaaatggcgattcataaaatcagcgagctgtaaaggaaattcgggaactcacatcttcggattcaactggtgcattgagattatataactagagctagaggtaccaatcttgattcttgaccattggtaattaccctattcttctgggaaagattcagctgttgagtttcaaggagtcgtagaatgtaaaaatatatagaaataaagagacaatagctaagagaaagaaaaaaaaaagaattcatttaccattccgatgttgttggatgatataaagaagcattgatatcaaatttgatagtggataaatatcttgattatacaaaaagtctaattacatatgttggtttgttattgttgacaacctaatgatcatatatacacaacttagtacaaatattgacttgcttgggctcattttgttctaagaacaatcttaccttttgcatcgtcatgcataattggtagaactatctccggaggctgaaccctccagactttaggatcctgaaactgatgtcctaacttagccaatttatcagcgactcgatttccttctctgtaaacatggctcaacacgcagttgttcagctcaggcataaccactttgatgtaattcacatgcttatttgtcttttcacatctcaatctccccctcctcgagatgatatccattatgatcttggcatctccttcaagccatagatccgtcaacccgttctctagagccagctcgagccctcttttgagggctgcgaattctgccatggtgcttgtggcttcccctatggattctgagtacccaagaaggaactcggctttgtggtttctgaatacccctccaatgctggcttgtccttctcttcctctggatccgtcaaagtttagctttatccgtccattttcaggtttcttccacacaactttgacaggctgtttgtggtagtctcggattaacaaataaagtagcccgggtttgcagcaacccttggaatctagcaatctttgtgaaagctaacaatagggtttaatttttttggtaacagattttcttgtcgtaaaaaatggtcgactcaagatatttcttttggctctatagtcgtggtgttataccaagagtaggcaatattgtggaaggggtttgttagggaaatgatccttgcaaggaaagcaaagaatgatccttaattgaattgaaagggaaggcacatttgcagaatttagtaagcagtgttatatgaggaatgttttgaagaatgattctgttcaatggagattttaagtagaagaagttttaacgaagaaaatttaaataaacatgactacttttgtcttatccctaaaatactgaaggtctctcctcaacctcaggaggatctctctttctctctccctctctagaaacttgcaagcaaaagaaggaatgagaaacagagttacccacatttcccggaaacataataagttcttatacatgaagttattatttatgttggttctgtttacgaagcaagattcacaacatatcaaacaactaagaaatgattcaatatagagaacacttgtcatactgggccacttgtcataaaaagaaaaactgatgagtctttagtgtccaagaaacagatcgatcgatccccactaagacattgtctgatacttttttcccatacatcgtggatccattccctcttcgaccaaacttccacaggttcaaaccaaaccggaaatcacagagttcggtttacaactcaagaacctaaatttaaaaggatcctaaaaccagagacaaatagataagcaaaccgaaccgttgaccctgtcaaaaatacgtaagttcagcattaccgatccggttattatattattcgacccggtccgagattatttttgttcataaagtggaaccgtcctcactctatccctcagcttaatccgccgtcgttggttcaaacgacggtcgtattgatcttcgctgattggatctttataatccgtacaaactcccggagctcttggcctatcaatgtccgggattgatggagctatccaaaccagctgctctgttacgcacctctggaaccacggcgataagcaaaggcgtcgaattgactcatcacgggaacttcattactttgctgttatttccaagcaaagattgtgaaaaagtatgaatttcttcattatagtacatgcaggagttatgttttctgtgctgaaaaaaataacattttttcttggtttctggtttgcaaattgcaggtttctcgatttgaagaggtagctagtaaagttccaattgcatttctttgatgcattaacaaaagcattcagatttgaggtctcattcagcgagtaagatccaagacataaagatcttccacaatccgcacctcataagtataaattcaaatacagcaggagggatgtgaaaaaaaaaaggagtctctaggatgtccttaagtagtttatttcccattaatggaagattagttttagtttctagttggttaaagtttcagactttgagttcttatttggtcctggagagaaaaagaagtgagaaatataaacttattttaaatgttttcttgtaacttataacttcttatttcacacatccgttgatcctgattcgttgcaccaactcctaaatttttatattgaaatttttatatatcatcatgcaggacccaacaagcttacaatggctgtccacttgtgtctgtctgttactgaaatttataattgtttttgatcagcaacttgtgttctttcggctgtgagctagtttaaagaacacacggcttttttttaaggtcaaattaggtcgacatttaccatataaagactcatcacactggtgggtttctcatagattagagaaaaaaagcttcaagctttcatggaacatgtcagagttatcttcttctttgcttgtttcctaacgcttgctccatttcatgcctttgctcaggtagattcct

SEQ ID NO: 8354 - DNA, 3000 bp, Unknown
  misc_feature (1)..( 3000): cDNA_ID_3045245_gDNA_ID_1971772_Annot_ID_175396 3000 nt of promoter + ATG
gagattcaagagaaagaaaggtactaactacgttctttcttgatttcttagtttggttactgcatcataagatcttgttgatttacttctctttattatatgcagatgtttcaggagcatattgtggtaagaacaccgatacatcggttgttgttgctgatctgaccaagagcaaagaaactacttcagcgttttcaggatcagtagacataatgattgaagggaaagctgttaacacatccgagttacctgtcttttctctgaatgctatagccatagctactaatgatttctgcaaagaaaatgagcttggaagaggtggattcggaccagtctacaaggttggttgattactttggttatagacaagagtctttgtgtttaatttttgtgatttttttgttgatgattgtgatatttatcagggtgttctcgaagatggacgtgagatagctgtgaagagattgtctggtaaatcaggacaaggagttgatgaattcaagaatgagattattctcatagcgaagcttcaacatcggaatcttgtgagattacttggatgttgcttcgagggagaagagaaaatgcttgtttaatgagtatatgcctaacaagagcttggatttcttcctctttggtatgtttccttttttaaagatccaagaaagaataagcacttcctttcattcttcttagttttgctctttttgaatgtacagatgaaacgaaacaagcgttgatagactggaaactgcggttttcgataattgaagggattgcgagaggattgctttatcttcatagagattcaagattgagaatcattcatagagacttgaaggttagcaatgtgttgttagatgcagagatgaatccaaagatctcagattttggtatggcaaggatctttggtggtaaccaaaatgaagctaacacggttcgcgttgttggaacttagtaagaaaactgaatccaaaaaacagagcaaatgttttatttcaatgaatcatgttcttaagcaacttactttacatttgatatttgtatattgtagcggatacatgtcatcctgaatacgcgatggaaggacttttctcgagtgaaatccgatgtttacagcttcggtgtcttgttgctagagattgtaagtgggaagaggaacaaagtcttcgatcttctgaacatggaagtctcattggttatgtaagtttcccaaaaactaagagtaaaaactgttgttctctcttaatgagcatttgaaattttggtttggtttggtttataaatggtctaattagtggtggaaactgaatgcttgcaggcttggtatttgtatactcatgggagatcagaggagcttgtggatcctaagatcagggtcacatgcagtaagcgagaggccttgagatgcatacacgtagcgatgctatgtgttcaagattcggctgcggagagacccaacatggcttcagttttgcttatgttagagagtgacacagcgacgctcgctgctgcctagacaaccaacgtttacttccaccagaagaaactccattgatgtcaactttgctcttgattcgagccaacaatacatcgtttcttctaatgagatcacttcaacggttgttcttgagacgataagattcttttgtttgttcttttgtaaagtttttttttatataattgttgtgaaaacgtataatattttttggtataataatggagtaatggttgttgaaacttgaaattttgttcataaagtgaaacattacaaatgggttttattacagtatgatgttgatattttgaaaaaatcaccacactattctttttcaaaaatatcacaatggatcaatttacaagtataaacaaatgaaaacagataaaatatcaaaaagcatttatctgaaataaatcttcaaataaatcgtttatactataacaaaggtgtagtcttaaaatatttaggttagttttgaaatgaggatcataataattgttttcattctattaaatataggtgagttgtttcaaatattgtaggattattgtgtttaatttaattaaaatgtgattgatttttatgtatagagttattatatataaatcaaacgaggaacgaagaattatgaggatgttcaaaaataagacttttggagcgttgactatggtaattagtactgttttgatggtgaaaagagtattcggtcttcgtatttcatacttatataatatacctaaaaccgtgttaacataaattttcctctcctccaagctccaaagccaaaaatcgtcaaacaaaatagcataggacaacattatatttggtgatgaataattcaaatgtagactcattattaaattgaatggaatgatgaattatttagagttagagaaaaaaagaaaaagtcaggaaaacgtgaaacgacccctttcttttttgtcttcggagaatgcggaaataaattaaagtagggtttgtttgatgaatactaacattgaagttcttattgggaaggataaaaaaaaattgagttatttattacgaaaaagaacactgaaatttatataactctcgaagcaatgcatacaaaaggttgactgataataaaatacgaaaaaagcaatatattaagtaatttattaaaaaaaatggtcatcaataatatcatattttgaagaaaaattctgaatttatgaagtaaaaatgactattgaaaaggaaagaaagcctgacaaaaaaaaagaagaagaagactttttatttgctaggtcaactatgaattggactgtacacatagtacataactagatattttttccaaatgcgaacaagaagaccaagaaaagaaaaaaagcaaggtaatatattattgacagaaataaaatcggttacgtaaggttcacacattacacaaaaacatgtccgatatctccaatggaaataaactctcatacttttctcaagaaaggtgaaaacaaaaaacttggtttagagaa

SEQ ID NO: 8355 - DNA, 3000 bp, Unknown
  misc_feature (1)..( 3000): cDNA_ID_3045269_gDNA_ID_1971772_Annot_ID_175388 3000 nt of promoter + ATG
acaacatactagtaactagtacttgagtttccttagaacatacaccattcttacaatagttttgttattagatgttcccgttttgtgtataatttgattcttcttctatatggtcttgtattgtggaaaacgattattggggagcaaagaaacatacaccaaaaaaaatatgatcaaaatttttagtgtgtggaacctttcgaaaaccctacgatgttcaagtaagaaattgcaattatatgagatattatatatatatgcaattgttcttagtatttaggtgtttagaatatatactttagaccgttttaagatgtttgttaaaagttagtcttcttctaattagaaacatcttcttttgtttttatgaagtaagtgataagatatacatataatttacctcgaccaagtttgaatacttgctaggttaccatgtcatgtttaatcgtccacatgagatatctgtgtgactgtgtcttcggttcgatgtggctaattttctagaacatgttatcaaaagcaaacgtcgtcgtaattggctgatactgaggaaaatgcagtttggcaatgacaagaaccacacatatatacaatattgatatctattgaataattatacaatattaaattcctttgcattattcatttgtttcgtataaactaaaacctttgaactctaaatagttgaaaggagcagagtcagcagacaaggaccaaagatcccttcgaccacacatataaaacgatataatttgatacgaaatcgtaatggttgtgcagttgatgttgccacttaagatcacttacgtaagacttcatgcaaatataatttaatatacgtacctctttgaatttacgatgttagtttgattatatatatattggtcatttttttggtatttgctcgataatagagttgatgggaaaccttgataatattaaaaattatcatatgaattttggaggaaagacagcaacacactcgagaactctctggaaaattgcgttttcactttttttgttttccaggattagttgatctaaaatctataatatatattaataaatacaacctaataaacaaaaattatttatgtttcagttaatgtaacccattaatatagaagtaatctcgtaaatatggagttgattaaaaatatgtacttaatcaaattcatctatatatatatatatgtgtatatatatatatatatatatatatgaattatattacgtcaattatctagcttttaaaataaatttttttatcttagctcttattcaaaagtctttattccatcacaaggttatgttatcttttgtatttttattttattttatacaaggattccaagttccaacatttcaatttctaagtacatgcatatcttattaaatagtgatttaaatacacaaaaatatgaaataaattctaaacaaggtccactctataaaagaagaaaacccacaaattccaaagcccaaattaaaacaccaaaagagcccaaaatacaaactcattcttcaccactaaaatattccaaagcaaagcaacgaacataacggataagtgttatcctcatctagtcatcttcaccctctaactcaccgagaaagaaaagtaaagagagtttggtgtcactatgaacattgccattcataattaccgtcactcaaaattcatcgtaaatcctcacatagacaagacttttgcaaggactcgacaggcaagatcaaataatattacattcatgacaagtactcatggaagaagaagaacgatgggactttgtttggtaagagcaagtgccgagaccggagaagaagaatccgacgatcaaaacaagcctgagagaagaagtttcttgagcttagcagaagctggtctagtcgaaatctcaggccttggtgcacacgagaagtttctctgtcgactaacggtaaattaaatcataaatttatccctacatattataaaccctccaataccaaattttaattgcaatctattaataaatctcttacattgttttgaatattggtatggttaagataggaaatgaaacattaattttacataggaaattgaaaccatatgtagttgtgaaacaaaagaaaatcttataacacgtcctcaagaaatgaagtgtgattaacagtctaatagtaaacatatgtacattaagtaaataactggaatatcatttttcttagaagcatgtacattgatttatagatgtttcgtatgaacttcttcttatattttggaactggatttggcagatatcatcattgaatttgctaagagtgatatcagagcaagaaggatgttcaatagaagagttgaatgctggcaaaatatgtgattggttccttaaggacaagctgaagagagagcataacattgaatctgctgttcttcaatgggatgattcccgattttcctttttaaatatccttattttttacattcaagccacacaaaagtatgatcattaacaaggtgaatatgtatcgtaagtcttaattagtctattgtggtctgactaggaaaatataaaccttttgttaagtcctacaataaaacgtattcaacaattccaaatattatccatgactgaaatacataaagaaaaggtttaaattttatctagaaaccaggaaaaaagacaacagtaaacaaacaattaaaaaagaaaagactttgaaagaaaatccaaaagttgtagaagaaaagacttaaataaacacaaagagaatccaatacgctgtcgtttttgagcaaagtctctatcgacttttttccttccgttaatcaagccatcggatattaaataattacaaaattattttcagacaaaacacggacgcgaaatcaaccaattaaatccacttctctctcaccatctcacgtccgatctctcctctctgagctctcatcacgagtcaacccctttctccgtcgaaattcgcatgcttaaactctgagagaagaagatg

SEQ ID NO: 8356 - DNA, 3000 bp, Unknown
  misc_feature (1)..( 3000): cDNA_ID_3045279_gDNA_ID_1971772_Annot_ID_175385 3000 nt of promoter + ATG
cggttggcttgcaggaggttgaagatgcacagagaattcgtagtactgtcattgattcatttgagaaggcaagtttacctggactaaacgaacaagagagaaagagaatgctacattttgtagttgttggtggtggaccaacaggtgttgagtttgcttctgagcttcatgattttgttaacgaggatctagtcaaactatatcctaaagccaaaaacttagtgcagatcactcttctagaggctgcagaccacatcttgaccatgtgagattttcttactcttaaacttttgatctatatcgaagattagctcatgtcctatggtttgacaggtttgacaagagaatcacagagtttgctgaagaaaaatttactagagatggtattgatgtgaaattaggttctatggtggtcaaagtgaatgataaggaaatttctgcaaaaaccaaagcaggagaggtctcaactattccttatggaatgattgtttggtcaactggtattgggactcgtcctgtgatcaaagattttatgaaacaaattggtcaggtgagtagccaaaggtctaatgataatgctcatattttttcatagtgaacgagctttatcaactcggtctataagatgatttcttgtaaattccagggcaatagacgtgctttagcaaccgatgaatggcttcgtgttgaaggatgtgataatatatatgcacttggtgattgtgcaacaatcaaccagagaaaagtcatggtaaccaaattcagaacctagataaaaatgagctcgcttgtgtatagggtttctctgtttcttatactttggattgttatggcttttgtacaggaagacatagctgctatattcaagaaagcagataaggaaaaggaacactgacaatgaaagaatttcatgaagtaatgagtgacatatgtgatagataccctcaagtggagctctacttgaagagtaaaggtatgcatggcattaccgatcttctaaaacaagcacaagctgagaatggttccaacaagtctgtcgaactcgatatagaagaacttaaatcagctcttttgtcaagttgactcacaagtgaagctttctaccagcgacaggacaggtttgttctgtttttacttacttgaaagttttatcttcggtcacaaggtcacacactcacactcacacactttgtttgctttctcatcctttgtctggtggctttataaaggtcgctgctcaacaagggacttaccttgcaaaatgctttgatcgtatggaagtatgcgagaagaatcctgaaggtcccattaggattagaggagaaggtcgtcaccgcttccgtcccttcaggttggttcctagtatctgcatcttaggaggctttagtcacttttgagattgcatgttttgtgaatttctcaatactgattatatactttatagtaaggagacatgagacaatgaatatatatgttatacaggtatagacatttgggacaatttgctccattaggaggcgaacaaaccgcggcgcaacttccaggagactgggtttcgataggacacagcagtcaatggctgtggtactccgtttacgctaggtaacgttaaatgactaatgaaatacgaaatgtattcatatgatttttgtatttttttgtaactttttggttacaagtttttgtttttaataatacagtaagcaagtgagctggcgaacgagagtcctggtggtctcagactggatgagacgattcatcttcgggagggattcaagtcgcatttgaaaatctcatgtctctcttactctctcgtttgaattatcatggatagtcttattgctttttgttttttactttcaaataaaagcataacaacgggaagatgttaaacttcatttggttacttctgtttttggaattggtacgtgaaattgatatatttatattgctggagattggagtataatttcacaaagaatataatctactgcttttcttatagaataacgtttaacattacaagatatgtcgcctagctagtcagaaaaaaataaaaataatacaatgttagaacttttgttgtccttagattttgacaattaattccctttacatgatacagtatcaattatgggagaaagaaataggagaatcttctggcaacacgtaatacttaaattgttcatctttctattagtaaaactaaaaacaaaacctaacctaccaaaccactactctccttgacctcgactaaaatcgcaaacttacctataacttcttttctaggtaaaaggcaaccaaaaatattaattcaaatcaaccaccatacactcccgattcatatcgttaaattttttacacgttagcctgctagctaggatactaaaaataataagattactttatactaaggataaaaatgatctactattttttagagtgaatctaccaattaaaaagttttcaaaaataatgtatattgacttatgtgcctggattatttacccatttttgggtgggaatctaaagattttatttccaatttttctcaaatctctatgtattattttttaccacaaaaatgaattatcattttaagagaaaaaaagaagagaaacaacaattgacttcaaacattgttgtatataacatattccttcggttacatttcaagtgttgtttaagtgtcttacacatatataaagaaacaaacatagattgcgtaattttttttgtctttttttccattaaaacattcattcattatttagaaaaatatattcaaccaataacaaaacagtctgtctaatactaacagtcaacaaaaatatataaagtaataaaaattttaataggatagtttccctaaaacaacattaaaaaaatttaacaaaatggagtaacaacagttcatcaacttctcctctttttgtttatataaacacacattaacgattcataagccattgtctactaacaaaacagaaaaagactaaa

SEQ ID NO: 8357 - DNA, 3000 bp, Unknown
  misc_feature (1)..( 3000): cDNA_ID_1989457_gDNA_ID_1971781_Annot_ID_175405 3000 nt of promoter + ATG
ctatctggcagcttagttgcataaacccaccatggacatgtatggctgacgcacacagccgccacaacatttggcccggactttacgtaaatgaaatggaacttcctccggatcgcatgaatagcgagcttagttgaacaatcctctttattcttaaaaatgcggctgatgtaaatgtcacccccctcgtaatcagcatccttcagggctcgctgaagggcatctgcaagtcaatcaacgaatcaggcgttaacgatatgttaatgcattcgataatattattactagagagatatagaaagttgaagataaagttttcttttattaatgttgttatctgtcgctaacgataaacacatactcttctatatgtatgataatatatagatatacttttaacttcttgctttcctgacgataacaacagttgtagctatctaacaatatatttagcaagttgatttttttttttaccttccttcccttgatcgtcaaaatatggcggagcatctcggtcatacaagaccgtcgcaaccgctatatcctttacggtcattgcatttctctacatctccaatactcttgaggtattggagaccaatccaacaacttcactcggtaaggcattctctatcatgatatcttttcctttatccctcatggtgatgggttgaggattttcaatgagtgggccatcggcgtcagaataaaagtgggacagagtctcatcacctacattacgaaacacgttagtcgataaatgcgagtaacagtttaaaaacttatcagttaccaaacatgttatttgttaacaaacctatcaccgatacgctaaggctgtcggaagagtcagtatcatccattaggtcttcgctgcagaaagaaacgctcgttgatatcgaagttggcgtcccgaaggttgaatcacttgaagacaatgcgactatttgtggtccaacagcttgcgattctgcccctacaagggtcaaatgcaaattttcaatttcattgtcgtttgcatgatatgtacttccgaagtctagtgctctcgctgtcttctctttatcgcatccgtttgtttcactcggttgactcccttttagcgacatttctcttgaacacatttcacgcaacattgcttcttgttgatttgttctccacacctcgaataaacgatctttttctctctcatcgtcatctataaccttctctttgcctttcaaacttgtaattgcccctggttgtggtactttcgatggcgtctcgctagtctccgctgcaatctccgtgttttcccttatgatgacacctccatacgggttgtgttattcaatctctttacgtatgccgacgtcgttggtgtcccccatggttgctatatcttgtccgtctcctgaaatctaaatattattaacagatatccaacttatttgataacttaaatattatcattaacgtggttttgaggtttacccgagaggttacgcaacagcattctggttaacgcggtaccccatacagctcttgtttccgcacaattttagtatttatccgatatttctttcgaactcaaaccgcttagatccatgttactgcggtaactattaacgtttcgaacatttccacctcgtataatcttcactagcagatgcacttcatccagatatgccctaatagccacgaacagtgtcgtatcttcgtcatccaatatgtcaattgggttcgctcgtttccaatcaggaccgagcatccactgtggccactggtacgttaactcgatatcgtcatctggccctaacgctaatctatcttttcccgccataacaatcttcgcaaaactatctctctcacgcagtcggactccgaattcaaacccatctacatgcgagatgtgttcgaaaattccgttttcatctcttttccactccccaggtatcaatctcaccacgaacgccatttgtacctgaaatagtttcagaaataacaagttagttatcggtttctattataatcttgcaaaccctaaggtaaaaaaagtagcttccaaacatttaactatcagttacaaaatacttggatcttttacttttacgtctctgctttgaattttctgggttcctagcttttgcttgcattaaaattatcggaaatttaagttgttagtctgctagttttttgttggttgaagttagtacaacggtaataaataggataacccaatgtatatggctgatattcccgcaactcgaaatatatttgtaatgatcacaatattttcccccaatatattttatgtttccaaaatcggcgagtgaatcttcgtaaatctctacggcgttaaatgcttaaacagctacgctacaattagttatcgtttactccgggttatagggatatttttggtacaaaaatatgtcacacaagagagaagctaatttctaacttatcatgcttacttcttttattttcggttcgactgagcatagaaattaaaatagctttaaagtaatcatgataacttacatcattcatcattacttttttttaattctcttttataatatacatatatatatttttttttttttgaaaattctcctccactatacctaatattaaaaaaatcttaccaacaattaatatttttatacattttattgtttacgggaaaactgttgaaatgttttattcttaaaaaatccacgtcagcagtcaaaggtcaaaaactaaaatacatttaggtcataaatgcatttgaatctaacccaaaaaaaaaaaaagagatctcctcttactgcttcgaattcgatcgttactagaaactgcgaccacgacattggtcgtggcctcgttggggaagaagtagtcaaagtcacccgcatcgattgggacacgttcttcttcatcaacctaatcgaatcttttatcctctcttcgatcccaacatcgataaattattattaccatttgcggcgttgttgagtgatctccgcgactatg

SEQ ID NO: 8358 - DNA, 34 bp, Unknown
  misc_feature (1)..( 34): cDNA_ID_3089068_gDNA_ID_1971781_Annot_ID_175423 3000 nt of promoter + ATG
cttgctggatattcggaatatgttggaaaaaatg

SEQ ID NO: 8359 - DNA, 3000 bp, Unknown
  misc_feature (1)..( 3000): cDNA_ID_3089091_gDNA_ID_1971781_Annot_ID_175410 3000 nt of promoter + ATG
aaaactattttagttgcgtaaacaaagttaatatatgagaaccatatttaaccaaattcatgttagcttcttatgcatgtaattgttattaattaattgatgaagcaaacaatgaattagtgatatgattatggagaattatataattttcgtgaatgacgatgtaagaattaaagataatgatctatgcatatacatggttatatataaaatttgagttatattgttttttttagtaggataagatgagaacaatttgaattataatggtgaggcagaggttcaatatttatttgattataaagaagctaacatttgcaaatacaataaacaaataacaaaatctaactctttgactatttaattgattagaaagaacactaaaaattaaaatcatataatttaaatgtaggattatatatcggtaaatatatagtcacaatattttataaacataaattatcatgcagtgtattcagggctggtccgacatgtttaaatgccttacgcaaataaaaacaaattatgccatataatattttttttacaaaataacaaatgatatatagtaatatatgaaggtcctactaaaattgtagagagatttgcaaaagttcaatttttctactaccttttgcaataataccctttctttttgaccatttttaaaaatatccttttatttgaacaaaatgaccaaattacctatcatctaatgagaacatgtaatttgaaactgaaattttcccgcaaaaaaaagaatgagaattttttttcgaatttattttggcggaaaaattatatttggaatattttaggtgggaaaaatcaatagttcactttgtaaacctaaaacattttcaaaatagggataacatgttcattaaaagttaaaagagggtataaatgaaaatggtcaagaggaagaggcataattaaaacaggacagtcttgaaagagcattcttattaatttctcaaaattctatacaacatattttaatttcataaaaagtctatgagtaaaaacattagtttttaaatatagctctattttagatttttgcctgcaaaatcattgatcagactcatgtaatcgagcttttcaactataatttttttaatggatagcaaagccaacacatttacttgattaattattttttattttaaatcaaaatctaggcaccataccttacaatgtcttctatttgcaagcaatttaatgtttaacttttagaaaacacaatatatcactaaactatatccattaacaatatatttaattaacttttttattaatttaaaggcttaaattccacaaaatatggtgaaaagaaagctcaacaaaaaataaatttattgtaaagacctataatatttttattaaaatataaaagacttaaaagaaattctaaaatatacttttttttttgatgtcctaaaccatgacttcactaaatgaagttgatttgctgacggtgcaaaaaaggaaccatggctctttaacaactggtttgttgctactcatagatgggaggctgctcctattttgacttttgtcactactattgatctttgggtgcagattcgtggagttcctcttctatatgtgtgtgaagagactactttggagatagctcaagaattgggagagatcatcatgatggattatcatgatgctacctcaactcaaatagtctatattagagtaagggttcgttttggtatcactcacaaactcagatttttccagaggatcatctttgaatatggtgaaactgcaatcataagattccagtatgaacgtctcaagcgaatatgtagcatgtgtttctggtttactcagagactattgtccctatcgtcagtgtcctcacaacatagcaagagaaagggctctcttccgagatagtgttttcagatcaagtttgaattctcagtctcatatgacttagactttgtttccagctcccttgacaccgcctccaagagtagctcctcctccgctgaatcatgaagaattggcggctgcaattccatattttgccacaacaagagatgctcataacatatatggtgggagtctagtactacaagacaacaagggtcatcaaactctaacaacactccaccacgagaagcggcaaacttatctggtagtagcagagtctatgaagttggtcaatcatcaagaaggaatgaagctggagaagtacgaagagctgtaggggatccacgacttcagactcatcaacaaggtgctccaaggatgggaggaattctgaaacctccgaagaaaagataatcactctaaaaagaattatgtcataactttttgtttaaagactgcagtggaacaagtatcgtagcttcaaggcttgaataacaacacatagtttcagtatggtttttgtttaggacatacccttggcttggttatgtttgatgtttggtgtttcagtttaaatttctactaaacaatgttttttgttctgtttaccttaatcttgtaagtggaaagtccactgttacactttttgtaagatcacagtggtatgaaaaacaacttttcaggaaaaaagaccatgactttacttaaattttaattgttttataatttaaaaattaaatatattgctaattaccatttacccactcccgttcaagttctctttctttttgacacttattttttctacaccaaccagttagccacccaggttcataggcgaagcatcatgaaatttgatttaaaccattaaaccggtaattgcaaaactttccggtttagttctttcttacagaccaaaaacaaatcaattaaccgtaattgcaaaccaatccggttaaaatccaaaaacaacaccaccctcttcgaaaatcgttgagagtcctttttcacttcttcagatttctagggttcgctcaaacaaacgaagagaaactcaaattctgtaatctatagattttggaaatttccagatcggaaccctaaacg

SEQ ID NO: 8360 - DNA, 3000 bp, Unknown
  misc_feature (1)..( 3000): cDNA_ID_3089088_gDNA_ID_1971781_Annot_ID_175412 3000 nt of promoter + ATG
cccctcaagcgaattggagatagttcgtccaaggaagagtgatcatgtgaaaatccttgggggttcataccttgggcttacatgtaagctgatcggaatcgacgggttggatgctattgttaagatagatggtaatcttgacgtcaagattctggacctggccttattagccaagtttgtgcaaccatgatagttttaatgaaagtttagtttcatcttgtgagaccgtctattataatttcaaatttctctacatttgtatttgttttctacatttttagtttagcatgttggtcccctcccttgcaagatccccttactttttttccaacctattatgaataactattgatgctagatttatcaagtgaattaaagattcactatatgaccaaaacaagaacggctttcgctagtttatttgaagccattgaacaagacatatggtgtaaaaagaaaagatcgcgttggctacattgttcaatgacttcttctctttgacactcatgtatattctcattcactccatcgttcatcaaaagtttcagggtttttgaaatatgtgaataagcattctcttgaaatatgtgattctattgattttctcttccatctccccttgtttctctttaatatgatgtagtgagtttgcatcaatgtaagattgtttgttctgttatacaaacacaacaattaggggtgtcaaaatgagttgttagctcatgagctggctcagctcgacttgattatttatgagctcgagttttatttttaaaagatcatttaataaatgagtttaatgattgagttttatttagctcgagagttatacgagctagctcatgagtttggttttttttctgaagtaatatatacaaaaagttaacaataaaaaaaaatatatattttttctattaaaaagagaaatatattttagaaaatatataatttacagaataatattagaaaatatataatttatttatttgcattagctaacgagctagctcatttagcttgcgatcaagatgatctgagtctaaatttgtattttaaaacttatataataaatgagctgagcatagctccctttttctccgcgctcatcatgaattgagctaaggtgagcgaacaggctcattttgacacccctaaccacaatatgattattgtttcaatatttttagatattttcaacagatgtatgagcagggccggccttgacattttgtgggccaaagcccaaaacaaaattaaagttaatttagaagttttaaaaatttggggccaattattggaaaaatgaataaaataagggttgttttgtaaataagttttgctgaataaaaatggaggccacagcagatgtttcattttgttgtgtccacggccagccctgtgtatgagaatggtaaatcttgaataactaggaagattagagaggccattgatatgggtgtcatccggaatgtttcgcttagtcttttgccttttcacaacctccagaattttttactctaaaagataaacaaaaccagaaagttcaatattaaattgtttaattagctatattagtatcagattttgtctaaagaaaaagcagaaaagaatatgtctttgctaaactacccttgaaatttggacttccatttttttagaacatgtacaaaatgaagaatacaaactctaatattcgtaaaactctaagaaatgtattcttaatattttaaacgaggttttatcttttaaaaatttactttttcaaattaaattacaaattgtttccttcaaatcacccacattcttttaaatcacaaattgttttcttctatttcctcctttttaaatttgcttagagaagagtcaaaaattatgtaggggtatttacggcaaaaatgacaattcataataaaaatgtatatgagcaaacttttttttttttttccagttttcccatttaaatttggatacacatgtcctatattgtattgtgtatctttttttcttttcttattgaataaatttgccaaatggaaataagagtaaaattgaataaaaaattaggtcattacaaagatgtgacattgttttaaaatattgtccaaatcttgtttttaattacaaatttactcttactttaactactgtatattgggaaatatttgttttgagtgacgtgatattccgttatatgtaaaacctaaggttaagaaaaacaaaaaaaactttcgagcaccatttacgaggtctcaaatatgaaagtagatttcactctttggtccttgtttctctttttgcaagcattttgtaacctcacataacattctcaactaggtgaccactatcgctttctctctgcgattctttttctggtggtcagagatccttttaacacttatccgcaagttttatcgctccgtcggtccttcattccggtgagatttttattcttcctccgccgtttgactttgtcgtcagtgagatccatctccggaacttggcagtacagagatttgctgatgacctctcccctgtctcactttgcggtgaagacatttgtgaagagtccacttaatcgtcttgctatgtcgacaatcccaaacaaacagatccttgctaaatcagatcattattcgctgcctaaccatcttcgcggatgagaaactagggtttcctggttgggtcaagatttgagcatgtagcaagatgggcctggtgaatttaaagaccaaacaatcaatttattttgtaacccactcgccaacgttgttaaggcctgtttttcttaaaagtgataacccatgtcatttcttcctttcacgcttctagttcatcaatggatgttgaggctgtgatatcgtatttgatgaagcttcaaagaagttctgaaatgtgatggtgctaatcaagatgtacttccactctatttcgaccagcactcatgtgataagcacataaccagagtaaaccggtgtcatagaaaagagatgtggtctcgtg

SEQ ID NO: 8361 - DNA, 3000 bp, Unknown
  misc_feature (1)..( 3000): cDNA_ID_3089084_gDNA_ID_1971781_Annot_ID_175414 3000 nt of promoter + ATG
tccatatgtctacaagtctccgccttatgtctatagttcaccaccaccatatgcctatagtccaccaccgtctccatacgtctacaagtctccaccttacgtctatagttcaccaccaccatacgcctacagtccaccaccgtctccatacgtctacaagtctccaccttacgtctatagttcaccaccaccatatgcctacagtccaccaccgtctccatacgtctacaagtctccaccttacgtctatagttcaccaccaccatacgcctacagtccaccaccgtctccatacgtctacaagtctccaccttacgtctatagttctccaccaccatacacctacagcccaccaccatacgcctatagtcccccacctccatgtccagatgtttacaagcctccaccttatgtctacagttctccaccaccatacgtctacaatcccccaccatcatctcctccgccatctccaagctatagttatagctctccccctcctccaatatactaacaaatatataaatgatgaacaattatagtttcatatatcagccatcatattcatgaaataaaacttcttatctaaattatcatatgtgtaagaattgaaatgtatatctttggttacaaaccaggtgcatttttttgttgtttgattgcttcgtttgatgttgtttaactctttaattaagagatcgatgtgcttgtcctccatttttattgtctaataaactcaataaattttattgaaatatatagtatgaaaatatattaaaattatgtaatcataaagaagcaatttgtttttttcaattatagttaaatgaagaagttcttcatttagttaaatgaagaagaacagaagaacagtgaacgaaacatttttggaaatttgttataaaattaaaaaaaaaaatacctgaacatccatatttaaaattacaagatgtaatataatggagtatcaaaatttaaattgacaatttcaaagtttcatactcaaatgtaagacatattcataaactacatgtcgtataatggatgctatttaaacagcttctattctatcacaatccattcaaacataaatctgttgaaaagtaataacaacacacaaaagctgaaactatagttttattcgacgtggcaaatcctattaatttcatacaagagctgatctacttgtgaattggtcttggctgttacaagtgcccagaaaagatataaacgttgcaagaaaaagcacaacattgaaaactatagagatatacttctacgttctcacaagagataaacgttcaaaggattttaactggaaataagattcaaagtttctttataaactatagagaattttaagattataagacaaaatttatacggtctcacaagatatacttttcgttcattcgaacagtatcatggttgaacaaacttggctaataggtctaggtcatgaatcttaacgtcaagattgttgagctttccgagcccaatccaactctttctatatagttgtttttagccttcttgccaaaaggttttctactaatcggagttagatttgacttatatatcaaaagcaattattttctaatcttcccatgttagacgttgctctgtctcccaagaatcctccacttaacccaaggaccatgaatctttagcctcccctctagcgaaaccttggcacccgggaaccagcactccttattcgcgaggtctccttgagacacccttccgatcgtgtcacattgagggctcctcccacaacaaacatgcagcccaagctcaccttcataggtccacctttttgacctaggctttgatatgtaaaaattaaaatggaaatgaggtcaaagcatgcatggattcgtttgtatttcgaaagttaatggtgtgttggctgcgatgacatctaccaagatttatcccaagaatttgtttgatctccttgtttttaacttttttttgccaaggaatcatatttataggtttaacatatgttgtaaaaccaaactttttatatttctgatatttacatgcgtaacaaaaaaataaaatattaacagaccaattaattctcgtactcacattttgtagttagcattacaatatcataaataagatagatgagactcaaaattgttatgtttggtttataagcgattatcagaacttgcatgtgacgtcaaaaaaataaaagaagtgatataaaaaatacagagatcaatcaggtaatcttaattatgtatcattaagtggatggtcaaatattgaatcaacttgctgattctcttgtgtcgtggaaatcaaagaaacttgatggtctcaacgtgtctctgtccaagctatggttgctgcgttgaaaaagttgcagtgggttgagagtgtgttgggcacactgaatattatatatcacatatgcaatttatggacttatatttctagggtctgcctaaactatttctatgcctcaagcaaaacaataatatttttagcctattaacaaacaaaactctatgaaacaaatccaaaaaaagataacataaattgtaaaggagaagcttcagtcaacgacaacagagattgggtcaaaccctctgctcagctcagagtctcccaaacaaaatgctatgggccaagacaccaagcccaacaccattcaacataacgaaaagcccaacaacagaagattgcctctgcaactcacaaacgacaaagagaacagagttgcaggcgtgaaggagagagccgttgcaaaagcaacaatgctgagctgtgaaaccgtaccgaaggtagagacaaagaacagatatgacgctcttaacctcctgtgctcaaacgacatgtgttaaggcacctagggtttatgagaggttttgagttgtataaataagagagacaatcgcttgtaatcaactaagagagaagagcttaataaagttataatatttctccttcattctaagtttcttacatggtatcagagccatg

SEQ ID NO: 8362 - DNA, 3000 bp, Unknown
  misc_feature (1)..( 3000): cDNA_ID_2176755_gDNA_ID_1971781_Annot_ID_175406 3000 nt of promoter + ATG
taagtcgagagacgaaaggaactaatgttttgtggtgttgtgaacagcagaacacgagcacgttttacactcaagagccagaaatgggaggaggccagggaataccatctcagttctcaatgcctgtaaaccctgatttgatgagcatgttcatgaacatggcgggaaacacattcccgggaaatcattctcgcaataacgagggaggagcaggtggagatggtaccagaaatggtgcagatgagcctgagatacatgtaggcggaaatatcaacatagatctcggaggcacagagcaaatgccggaagatttatcgggtgcattacgatcaatgatgcagatgtttggaggatcaatgggaggcactggtaacaataatcctcaagattctaatggtgcacaaggaagaccatctgggaattaaccttggaatcattgttttattggtttttgagtttgtgccacaaaaactttgttaggttttgaattttaacgtgtagtgaaagtaacatgttattataaaatgatgatggaagactaatggcttcttgttgataaaatgttttacattacacttgaaatacagtatttgaattgttgtacacagcttttcgacaataaaattggtaaacaccaattatgaatttgagcaagaaacataaggcaaattgttgttactactatacaactgaaaagccaaaccaaccttatcaaaacagtaccaagccgataacaaacacttcatcgaagatctaaatccgaaactccgaagaagatttagaatatcggcgggtatatacagtagtagaagaagcactcacagcaaagcgaccgcagaagaaggttgaagcgagcggattctgatatcgtacttcgtaacactaccaatcctaggcgatgtcggatccgagttttgtgtaacaagtgcatactcaggagccttctcctgagaagcattgccgatataattattacatttgcgacatagaagcttcgttctgtgtcgaaacaaaccccaagagtatctagagaagtgaggcatgcattggaactcatcgacctgactgaatcttccctcgtcgatgttgaagaaagatatgatcccactcttcatggatttaccgtactttgatccgattgtcgatgtgattcgattcgtggagctcaggtttagttcatacccacaagatccacaactacaagaaagttcaaaagatatttgttcagtctaagttattatctaaaaagaacacaacaccaacaaactaaagatcaatcaacataacaatcctttatctaagtaacaaaactaatctaagtaacaaaacgagctctatgacaagacaagactacaaattagtcatcgaattatagacaagacaagacaacaactaagtataatcatcacctaccaattcacataacaataatcatcatcatcatcaacaaattaacaaattcatgattcacatgtgccttattaaaatgatgaaccaagctaaatacacaattactccaaaatcaactatcaaaaccctaaataaaaaaaacctagactacctttgagattcaatacaacaatcaaatcaaattgattactaattccttattcacatgattactctgcttccaaattagtcaccgaatgatgaaccaaactaaataaagaacaaagatttatcttttcacagttacacagaaacaagggttctgtctcaatacagatttttactaaattcagaaaaaaaaacaagaaccattagcttcattttcttactacaattactaaaataagaaccctaagccacaagattcagtaaattgacgtgtaagcaaaagatacctgtaattaacatgtctcatggaagaagaagaagaagaagaagagaaagatggcgaatagaattggttgccaccaaaacggccgtcgttaacacccaccgacgctgatctctccatagtcgcggagatcactcaacaacgccgcaaatggtaataataatttatcgatgttgggatcgaagagaggataaaagattcgattaggttgatgaagaagaacgtgtcccaatcgatgcgggtgactttgactacttcttccccaacgaggccacgaccaatgtcgtggtcgcagtttctagtaacgatcgaattcgaagcagtaagaggagatctctttttttttttttgggttagattcaaatgcatttatgacctaaatgtattttagtttttgacctttgactgctgacgtggattttttaagaataaaacatttcaacagttttcccgtaaacaataaaatgtataaaaatattaattgttggtaagatttttttaatattaggtatagtggaggagaattttcaaaaaaaaaaaaatatatatatgtatattataaaagagaattaaaaaaaagtaatgatgaatgatgtaagttatcatgattactttaaagctattttaatttctatgctcagtcgaaccgaaaataaaagaagtaagcatgataagttagaaattagcttctctcttgtgtgacatatttttgtaccaaaaatatccctataacccggagtaaacgataactaattgtagcgtagctgtttaagcatttaacgccgtagagatttacgaagattcactcgccgattttggaaacataaaatatattgggggaaaatattgtgatcattacaaatatatttcgagttgcgggaatatcagccatatacattgggttatcctatttattaccgttgtactaacttcaaccaacaaaaaactagcagactaacaacttaaatttccgataattttaatgcaagcaaaagctaggaacccagaaaattcaaagcagagacgtaaaagtaaaagatccaagtattttgtaactgatagttaaatgtttggaagctactttttttaccttagggtttgcaagattataatagaaaccgataactaacttgttatttctgaaactatttcaggtacaa

SEQ ID NO: 8363 - DNA, 1123 bp, Unknown
  misc_feature (1)..( 1123): cDNA_ID_1989414_gDNA_ID_1971785_Annot_ID_57977 3000 nt of promoter + ATG
gaattcgaggtggccaccgggaagagcgaaagtggagttgccgattgaggaacggcggcgacctaataagattgagtttccgttgagaatgaaaacgacgacggcgactcttggtatcgcttctcctgtcgacattattatcgaacacagtgaaaccctttcttgtcgtgttttagttttgttgacttaatttgagtttaaaacgatgtcgtatcggttatgcgtttatatacgtgttggcaaatgtgtcgccgtgtcggtgtgattggctgtacacaattatcgctgtttctttttccattgcacttgttttcattttatttattaaaaaatttagatgatattatataatatatgttctttatgatgttgccataacgagaacgattatgtaaaaaataacatatacatatacttttctgtttataaatgattatttttttagaaaaaatttatttctaaaatattgatttttttaagttttttatgcaatatttattggttagtattgatgaattgtaattaaaaaaaaaaaattaattatcattgttttttgagttatagaaaactgtaaaacataaaaaataatgtatttataatcaacatttattatgttttcttaaaaaatagaaggagtagtcatttgttagatagtaagacttagccaaattatatgtcatttactgtactttagtttttttttccgatcataagaatgtatgttaaaataacaatcaccaaagaggcacaaaataaattgtaggtccaaagataaaacagagttagttaaaaccagttactcctttcgtagaatttttacccaaaaaaagaaaaaaaaaaatcgtagaatttccttctcttttcttcttaattataatatatcaactgtttgttttgttgtttagtttggaaaggaagaaaattagcttaagaaataagaatatatttttttggggaaagatgactagcaccacaaatttaactacgccataatttactgcgttgaccaccataattagtaattaagcaccatagctaacaaaccatatataatcactcttcaaaatatttaactttgatcactgcaattattcattccttcaccttgttcattgatacaatg

SEQ ID NO: 8364 - DNA, 3000 bp, Unknown
  misc_feature (1)..( 3000): cDNA_ID_1989413_gDNA_ID_1971785_Annot_ID_57978 3000 nt of promoter + ATG
agataattagataatttaatctagcatgtattagtacatatagcgtagacatgcatgcatgttggtaaaattaaagttaaataaaaacaaataaagactgtgcataaccttagatgtgcgacatacacgtactttcctgaaggtgctagctaaataagtatatattctttagacttcaatagtattgtgcaaagggcatctgcttaagtctttttggtgaaaatacatattctactagacttccaataactcacatgatttagtggtagctgatacaaaacgttattaaaaactggtccaatatcaaagaaatgtatgggactcggcttataacctcctgataaaaacatatatatactttatatcaaaatattagcttatttatttccaaatataatcttacataatacattttttttgcaacggatacaacaaccattttgttaaaaaaaatcgtatagttggtacggttgcccatatttagattttagacgtataagcagtgcagttacacatattactagtttaaaagttattttcaaaaaaagttaattttgctcctaatgtgcgttaatgaaaaaacacataatgaagatggaggagcatatttcttatatctagagagactcaacgtacagatattctccatatattctaaaattgggccctatatttttctcacgacatcaaagatagtatagtattgaaggttggtatcttattcttacaaaattgattttatcaggttttgttaaagtttcccaaatgatttagagttttctgatttgattaacctactgttctacataagtgtacatcatagattcactaagttacatgtcaccggtacatatacctcatattcactaaattacatgtcaccactacatatacctcataactgtttaaggacaaaaaatgtggaactgatgtctcctaggtggtggaatatgtgaagctagaaaacaaataaatgcggtccgactcagaccatcattttcctcttgtctcattggttttaaaattaaatattatattataaaatctgttgcagtattttttttaatctcaattagagttatttatttaggtctcaacccatggtggggaaaaaaacagctattttaggtaaatttagattacaaaattgtatagtcaatatcaataataggttaaagttttaataaactgggtgaatcagtttttgtttggtcttcttggatctttgtttggtctcaatattttggattacatataaattccatcccgactattatttgggttttgccgctggactctataacacactgattttagttttatatgaattttacgttgttttacgtttgatcatgaactaaaaattcagcaatccataagaaaatattttttggactagttcgaaactcggccagacaatactaaacctattcacatatttaactttttttttttttggacaaacataattaactttagtaagtgttatatttttgtcaatattaaactagatgtggtgtttttaattgtgggaaataaaattaaagaagcaaagttccatgaaatatggactttccgtaattggaaggccgccatatgttgccttcatttgtattttccttttattgacccttttgttttcttataagataaatatatatataactaattaggcagaagctgagtggcattagttagtgaaatatatttatcattatcccaaattcctctagctgacattactttgaatttagaaatttcttatccgcaaaatttgtactaatattatgaagtagtacatcgaatagaatatatattggtgcacattatgatccactttcaatgccatccattcgaatggttgctcagaacgtacttgtagaaaccgcgtgcataaagtttcatatgagcatcgtgtgctttgttatttaattttttcttccctaaataatcagacagaaaaattcataaacttctttaataaaaccatccaaaaggggattatactacgaaaattatggcatctaaacgcaaagtttaatatatttttagtaccaatgcattgtaaaagaatggaaattaaataaaaacaatatgaaactgtttgttcccttggacaaaaaaaaaacttggtatgactatgatttttatatgcgcttttgtaattgcattgtaattttgtcgatatggaagtggattttaaagaacattaatccatgatctgataggtgaaaactcacactacttgactgctatataacatggtttggtagtatctgcatttgtaatgtgaaactatgaaatcagaatttgattggtaattcttcttctgcttcttttttcttgattctttaagatttagtatgtgtttcaaatttttcattgtcctccgaaaaaatgtagtggaaatcgagctggtccaatctaagttcactcaccttttgtgtctcttggcacctaatttctttttggtccatttcagctatcttcttccttttccacacaaaacattacaaaatacttactatttctagttctccgatttacaatacccaaattacccttacccttgcccctcatatagttcgtataacaactttcactctaagatgaaacattttgagtgttgagaaaggtatatgaagctcggtagccggaggaagcacggtggatatacactggcgagaatcaggacggtcccacacgagacaagatttacctctcccaaaagcacaagtggaaggagcataggataaaaattagtacatgaaattaggtttcaagaaggatatttgagaatgtgctttgtgaggcatcgtcagtaggagtaagcaatccagtcaaatatattcttctttttttctctgcctttgcttttgtccactataaaacaaatctcatcctcctctcttgccctacactcacaaaacaaacacactctcttcttgatcattttctcttttgagtttttgagtttaaggacttaaaagagaaaacgct

SEQ ID NO: 8365 - DNA, 3000 bp, Unknown
  misc_feature (1)..( 3000): cDNA_ID_1989412_gDNA_ID_1971785_Annot_ID_57979 3000 nt of promoter + ATG
cctttcgacaagttcaagtgatccctggccttctactactggtaattatttaccaaacaatagtcactcttcatcaagtgtttttttattctttagtaaaatttgtatacttaatctgtttgctttttttttacagggtttcttgctgatactgatttgtcccttgaacatattttacaaatcgagccgttacaggcttatatcagtcattagaaacatagttttttcacctctttacaaagttgtgatgctcgatttcttcatggctgatcaactttgtagtcaggtaataccataaattacatttccatagactaaaacagagtaaacaaaaaaaaattgattcattccatagaccctgaatcaaaatcttatctttgacaatgggctaactctactttcgcaggtaccgatgctaaggaacctagaatacatcgcctgctactatataaccggtagctatgcaacacaggactatgaatattgtatgagagtcaaatactacagagatctcgcatatgctgtttccttcctcccatactactggagagcaatgcaggtaaattaaaaaacactaaacatcattctttcttccccaagttactgtttcttctcttgcaagttagggagaaaatactgaaatatgattttgaaacagtgtgcaaggaggtggtttgatgaaggtgaaacgagccacctagtgaacctagggaagtacgtttcagctatgttagccgctggaacaaaagtggcttacgaaaaggagaggagccttggttggctctgtcttgtggtggctatgtcaagtgtagctacaatttaccaattgtattgggactttgtaaaagattggggtttacttcaacataactccaacaacccttggcttaggaaccaactcatgcttcgccaaaaatctatttactacttctctatggtacaaacccaaatcttatatccaaaaatctcaacaagaaaatgaacaaagaaaacaaaactagtgagaacaatttgattctcctcttcaatttttctcatacttatgctccgcgattcattctgatttcttttgtaggttctaaatcttgttctgaggttggcatggctacaaacagttttgcactcaagttttgagcatgtggattacagagtcacaggattgttcttggctgctcttgaagtcatcagaagaggacaatggaacttttaccggtaaaattaatctccctttaagaatcttatttggaatcagattcaggatatatactgatacttgtgtggacaaaatacaaaacatatgcagattggagaatgagcatctaaataatgcagggaaatttcgcgctgtaaagacagtgccgcttcctttcagagaagtggatgaagaagactaatctgatctggtcgatcatcatatattgtttgcttcgtcagatttgaaagaacaagagaagaaaaagaagggggaaggatttgttctttcttgatcaaccatattttgtgatcagtgatcaagaatcttcaaaattaatattattcttgttcagaaattgatgtaactaaagaattctcccatttgttttcccatcgttcatcaccaaaacattgaaggaaaaaaacaaactaaaagagttatatctttacatcaacaatcgccatgttttgagctaatatagtcccaacctactcgatcgtaagccttactcatctcgcaaccaatcaatcgagattcgacatatgaattagaaatactactaatttatagtttctgtcgaataattgaaatcataattcacatgcacataaattctagaaaatattattcttcattagaattgagaatagtttataaagaggaacataaaaattaaactgtgcaactaaaagtgcagaagcattgatgtaccgctggcccgcaaacgccttttccagtcttgtacttcgaactacacatatcaatacatggttgcttttcacatggtgctgttaattgaaaatattcatgacacagttcttgtccttgtgacataaatttatcaccagccctaatataaatatttttgttaaggcaacgagttaaagaaaattatcaaataaaagagaagatatttgaatatacgtaatgtggattcttagtttaaaatattaatgatataatatgtgaaagtgtgaatcaaacctagaacgaggacgcatgaagatagcaagaacgggagttttagagatctttgatgatataatcgaaatgaaaacttcaattaaaagtgatgggtgtgttggttcgttatgtatatacacatgaatacggtatatataagaaattagatgcatgtactaactataaaagtagaaaagaaaattagattctgaaactggctaaagatcagaatgagtgacacatgtagaaaagatctctcaaaattaattaaagtgaaagttgactacaagtggtcaaaacatatacgaagatcataaatgcaaatgaaaaaaaaaaacataatagaaaatgtagcaagataaacaataagtcaaacaaaaaacaaaaatttttaactaaagattaaaacaaacaaatcaagtggtttaattaactatagatttcacgactttttctaaaaaacaatttttaagttacgatttttctgattattgtcttctttcatcaactacaaatcacagtattaatatcctattatataaagttggattttttaaaagttgttatcttatataatcacgatacatgttaaataaaacattgaattttgccaagtatcaagttaaattttttattaaatttataagcaaaaaaatagaaaaattatgaaccctattggaaaaagaaatatatccataaataaaaagaatatgtgtttatatattcaatatatatatatattttacctttatctcttaatttttacccgaaacatagtatctaccatttacttagtttggctccaacaatccagtcaatacagagagacaaggacggaaaac

SEQ ID NO: 8366 - DNA, 3000 bp, Unknown
  misc_feature (1)..( 3000): cDNA_ID_1989410_gDNA_ID_1971785_Annot_ID_57981 3000 nt of promoter + ATG
aaaatgtgatttgagaaactaattaacgttttagatttagacttctctgtctttgacattttctttgcagcgttgatattttcttcttactaaaataagaatagtttattagttttagtagatttacctaagattataggttgtaatcgttaactaatattttcatataaagctataacaaaagaataattcattgcttattactgaagttctttagtttatagaccaataattgtactacttttgtaacctttaaattgtcaaatcctattttaccatacaaattttagtggaagattgtcttcataaatatgaaatatcatatcaatgatctttactcttttacacatcccattccaatactcttaaggacaccgttttggttaggacaacatctttgctctttttctttttcgttcttcttccttttttatgcaattatatatatttactcctgtttcattttctttttgctattctcttcccgtttttttttgttggtgtacattttgacttgattttcaatgaatccaaatgatcaaatgcttattttgttatcgtaaatttcaacgtaataccaaggatatctttaaacctaatttgtataactagaattatctttctataataagtggaaacactaacccaaaacccaaattttgtggtcggaccaaattaagaaattaccttataatatagtatagtttattcttcagcccctagctatatcttccaatcttattttttctcgcatacccaataatacatctatgtaagacatgaaataatacaaaaaacgatttactgtactacactcaattaatccattttatgatttaacattttctttctaaaactgttagtcgatctgagaaaaaaaagttgctatcttatgttacacaccattgaagagctttaattcttttagaatatatatagaaagatttgaacagagcgtctgttcaataaattgcaaatctcgaattgatgatgttcacatatcacatgtggcacagttataaaaaaaaacgaatcaaatgtctttggagaaaagagaacatgttagcaacttaggataataagtcacggacatctccacaagtaaatccatttttctccttggaataaatagaatccttatcgttaatgcactatggttttgtcctagatacaacaaagtataaaagactggtcctgattgttcataatttcatttgcttttgtgttaaatgtgttatgcgtatcttttcaaatttaaaccataaccataaaaatttcagaaaaaccctattgcctattgtaaattgcacaccagggaaaacggaagaagaatatttcatttgcataaatcaatgttgtttttatatatatatatatatattttaaaaaaatgttgtttatattttttagaaaatagttattaaaattaaagatgttcagcatttaaaaattaattttagaatatatattttccacatataaacgcaaacacataattttaaataattgagaccctgccatctacaaccaaatcccatttttgataatatctacaagactacaactttaagatcctccacaaccaaatttgaaacaatttgataaaatcccattttttatcatgagaaatttgtagcatgttctaatgagtgttacctatatgttaggttaaactaccaaatattgatggtggtctaaatttgttcaacactagaatgaagatccatgttatctcgcctatatagaaatatgtatatgtagtcgtctgaaatatttaaaaatttcacattattatattttggtttctatttttgatttcttaaaaacttaattttttgtgtgttaattccatccaatatacaaaagaaaaactaagttgcagatgaaagaaaatgaatcaacacaagcgtagacaatggaccacacatacacacgcacaaaggcaaataaagacaaggtaaaagaagaaagaaaaagagagcaagtaagaccaaaaatggaaaaagaaaacaaaaaagaaagagataagaaaaactttgccctttggcatagaaatggagagggcaaagagaggagcccaataggctagtgtccaacacatgccattacctacaaaaccttacctgtcccttataattagctatcttctacctctaaccaactttttaagtactattatccatacatacgtacattagtacatgcacataagtcacgtaacaacactattaatatacataaacgacgtcactatgttattatattatgtcttaatggaattatcaaacatcattagtttagtcacaatattataacagctattggctcaataaactgcgttaatggatacaaatacaatcaatcattcaagatattttacgtaccagttatcgtttactttttttgatattttttttaatcatttttttttctttttaaaatagtaaattcatatcgtttaattaatatcgttttttaaccgttttaaaatagtaatttagtgagaaatgagattataggtttggaacagagaaaattcatattttattttaaagatctacaaaaattttattcgattttacggtttttgtaggtcttcgattttggaaaacagaaaatttgtttcttgtaaatttggttatagaattattcaaaggaaaaaaaaattgtataaccaaatttacaagaaacaaattttctgttttccaaacatagctaaacgagtttatctgaagaagcccaacatcttatacaggcccaatcttaatctcgaactcggtcaaatcaattttaccaactcaatcaaaccggaccggtttattttacgactcgctcttgtcttgtcttcttcctctgcaaatccaacacacaatttcatattcatctccaatgttaaatctcatcgaagatcacaataatggttcccttcgtttcaaaatgaaatttcaatagattcttctatgtttgaaacaaggtacctcttctaattcaacaaaaatg

SEQ ID NO: 8367 - DNA, 3000 bp, Unknown
  misc_feature (1)..( 3000): cDNA_ID_2687430_gDNA_ID_1971785_Annot_ID_57982 3000 nt of promoter + ATG
ttatcttaggattttttagaagcttctctctcttttttttttcttttacgccggataccgacgaggcgacgaccaccaaagatatatgaagatattaaaatgttggagaaggtttatggaattaacgaattttaaaaacattttaatcaacaaatccacaaagagtttaaaaggcgaagaattatatggtataattagtgaaggtactttggctttgcatgggaatatatggggattattctaaggcatgtgatgtgtaattcgattgacattctaacaactaagttttgaattcttcgccaaagtgttgtttccctaattacctttttttccatgtcttgacatttattgagagtgtgacatctcgatgatgccactgcacacataaattcgtaccatataacaaattttattatatagattaacatttttgtagattgaatttgtcaaggattaccacaatcaacgtggctaataactcgaacaaatataaaatatacgatatttgatcttagagtatgtatacctgattatatatatataagaaaagaaaacagaatagtgttttttgataagcaaaactgatattgttatgtatggataaagtgacatgtgcaatgtgttatgttgtcatggtagttataataaaagaataagaaattattgtttaaaaaaaattccaagtgtagatactatgagaaaaccccaaaatttttattaggtacatgaattagatataggtttaaaatctaatcactaaaactttttataacgactcccaaaattttggataagccatgcaattaaatttatcgaatagaattatctcatattggaaaaaaaatacgagtctgacgatcaaagatttagataagtcatgttataaaactttttttggttcttagacatcaagtattcacctctactcgtttttcttcttgtttaggcataaagagttcatcaaagttcactcaaattcacaacattcatgacaaaatacattgaataattttattctgatctttagcagctgttaagtatactaacacgttttacgaacttgtcattgttgtaccggactaagaaccaaaaaaaggagaaaccctacaaagaatgttcaatttatatgtgatgcccataagcagaagttgattaatagttagattctaaaacatctagcgacttaatagttaataattaacttaatgtagaacctatatgatgtttttaatttcctactagtttttatagatcgtacatatgaaatgggaccggtaatatgttaaccactcggtacttgtgaacggggaattatatttagttgaaacttgaaagcaaaattcatgcattaaatgatgttcaccaaactatacaaagccggtgccatgttttatgcattaaaagtaaaagttcctctaataaccataccaaaatcctagaggttataaagtaattcaccaaactccattaccactgagaacaataaaatgaactaaccaagtgagtcattaaccaacccaaactcaattttgtggttagcattagacaaaactataattaaaaaaatatataacaaaaaatatgtatatatttaaacatatttgaaattatgatttaattattttaagtgaaagtattttcgttttctttttttaaaacttacatttatattataaattttatcttattatttgaaaacttgtagatatattagaagttaaaagttttttttaattaaatacattaattagaagttagtttttttatagcctaaactcatttctgaaacctaattttaggggagtgtacattgttcatagccaagatttggcgtacggatactagacgtatacaaatcacgtttttaaaaacagagattatttcacctaatttctctaatccaaaatgtgaataataatgacactcttaaatctctaaaaatatatgtacactcaacgtataaacatataagtagtaaatcaatgtcaaataataagaaaatgaaaaaggtagagaaatcatgcataatttgattgattgatgcatcatctaatttatatgtggtttgacccgcatttggtgtcttggtcaccttctccgccatgacggcgcatctaatgttcctccaatcgattcttcttcctcctctgattctctcctctccaaaccaaaactctcacttttctttctgagattatctgacagtaaaaaatcatcctagattagaaactgtcagatcaatctcagtctttgtctctctctttttccacagtcctgtttttgtttctttcttcacacacagcttataattgatgatcatcaaaattcccaaaaacaaaaacttttttttttctttgtttgtttgggaaaagagtttcagcattttgatttgatgttataatatttcccagtgaaactatgacttgtccaaatcttggcactttctctctgtttttttcttcttcgtcttcgtcttcccaatttgtttggatgagatgagaatttttcgctataaaaaaaaacagagcatatcgaaaaatttatgagatctctctctctcactcaaaactctaaaaatctcaactttcttaaagatcataactttttatagatacccttcacctctcactcactcactccgatctctgatcttttcccgagaaaattcctcattttcccgagaaaactaaaaaaatttagataaccggaaaattgcaaacaacgaggtcggaaccgaccagtcacggtcttctctctgcttttctctgttcggttggtttcacggtactgtctttttttttttttttctcttttctttttctttttttccactttataaaaaacaatttttttttctttcttggtttcttcgttttaaattgttctcgcgggtatttaaaaaaagatttgtttttatataatttcaaggtttcttgaatatctgaagaatctgaaattgttttttttttgtttcagtaaaaaataaaactttgaggttca

SEQ ID NO: 8368 - DNA, 3000 bp, Unknown
  misc_feature (1)..( 3000): cDNA_ID_1989407_gDNA_ID_1971785_Annot_ID_57984 3000 nt of promoter + ATG
actataaaccatctatgtataccaaactgaggagttgaagaaagtttgcttgtagttgttgattcaggtagtttagatttctataaaagtcatgtgcggtgtagagatttactcatgatggttttgcagtaaattgtaatagtttggtagcttagagaacctcaagattactgttggtagtgagagcaaatattcaacatttcagcgattgttgttaagaatagtttgagctgatgatgtttcctaatgttgttaagcttcgatttgacataagtagagtctactactatgtggatttggagagtaggaacattcatttgctactctgtggaatattttgataatctctatggaatgtgttattttgttttgattgttccttatagataaatcacagaacggatatatatgatgcagagagcaaatgaaaaactgggagttgcagtcagtcaacaagatctcaatattttctcagattgtctttcagataaataatttttgccttttgggtttaaacctatttgacacatgaactatggatttttccttatgaacccatttagtcatcttgtaatgtatcatcttttttacatttttcaatctcgttcttgatttttccatgtcttgaatgtgaaaactagagtggagagcaaaattagtttgcgtaatatgcatcgacatgaacacatgtttatgatatgggcaaggatcatatatttattatactgctaatatataataaaatagagtcaatatagcaacagattctggtaacatctaagtggagacagcattagaggtggcaggttgtttgcgagttacacctcttgtgcaatgatgatggatcgaacaagtgcgttctttcattataaattatatttgtttttaacgtcaagatccttacttagctctcacaccacatgtccaagtaaaaagaacatttaaatattttccctcttctttaattttttgacttgttcacaagtaatgatggagtaatggcacgtggtgagataagagtgtgagtgtgtaaataaaaaaccaaaaaaaaagtggcatagacaagaagtagttggaatgtcttgggatcacggattagtgaatgttcttttgggggtttaaggtattgacggcgacacgtatttcatgttactctcctcaagtgtctctccctttcaccgtaggccgtagcattttccttttctttgtgaaactttttgcatttatgatggatatttgggaccgaaatccataggaatactagtttttaaacaagacacaaaagagaaagaaaacaaaaaactcaaaatactagccaaaacaaaggataaacaagacttggaagagagttaaagaaaaacgatattctttagtgaacaccattactacgactcaaccatcgggtgaatctccgaaattcccacttgaattatgtggcaaatccttctattcaaatttttattatttgttggttaaccacgtgttttctattatctaacacactatccaacctgaaatattattcctcatttttctaaccaaaatatttgaccgtttcaacactaacttggctaatctcatttctgttttccaaattgatttgtagtgttcgttttcgtaaagattagcgtaaagacatccgatgatgacatatgtgctctcatcacaatatttaatgtactccctttttattatatagttttgtccttcggattgtcatgtgctacaaaatgaaagagctactaatattttggatttatcaaaattggggaaaaattatatacaacaacgaagaatttaaaactaatttttctagaggtcaagtcaaaccacatcttgagaaatatagaaaaagtcaacttgatatatttcgcagaaaatattaaaatatgtataaaattaaccgccattactattgaacaaactacttgccaataaaataaatacagaatttattgacatgctagaaaaaaattaatgtagccgatttcatcaacatcttataactccatctttgaaatcatgtacagtaaattattttcatatacgactactacatgaactacatagtagtaaaaaaaaaaaaaaatgaactacatagtaaaaccatttgagctttctttataaaccaaacctaaatttaattctcaatattcaaatcatcaaacgacgttttgtgcattaaatttttcgacataattaaagcaacacggtgttttaataaactcaatgcaaaatccagctaattttcattaaacaacaaatactcctttgcttatgacaaaagcgcgtaaaggcttacggtgaaatttggaaagtagctaatttgacttaattcggttatggaaacaaattaattttatttccttaaaaacaaacaattaaaagtttcaatttctttgaccgttgatttaacgtagcattgaagcattttctcagagagtagagaagacgctgcgaaactcagaaaattaaattttcaagctcggaaggaaactctgattcattattacagattcgaagtttcagagaagaagggacaagacaaagtttaactgcttacttgttgtgtttttgctctctggtcttcaattgctgaagttttataacggagatgtttcagttatgatcttacagatctgaggttattgcatatccactcaaattgggtaatctcagtgatctggaattttggtggaagcaaagcaaaatttgtgttttttttgctcggccgatctgggtttgatctattacatcgtcttctctgctttgtcttgaaattagctgtgttgtgatttcgaaagtttgctacttcttcacgtttagtgttcttagttggtaaagtttggtactttcaggatactgtcatactcaaagtctgggacttttaggtgtttttgattgttcatttggtgattgatcatcgtctctgatcgttacttggaggaaagattccaaatttttgaatgagaagttgatttgttgatcggaattgagatg

SEQ ID NO: 8369 - DNA, 3000 bp, Unknown
  misc_feature (1)..( 3000): cDNA_ID_3045332_gDNA_ID_1971785_Annot_ID_57985 3000 nt of promoter + ATG
gtggacctaccgttttagggttgtttaacacttgaaccgtccgtaagtcttgttaagctataatttgttagtcttggttagaaccggttcaatgtgtgtatgtatgatctacggtttatacttttttttttatttttagttggttttgtcatttctatatataaaaatgtaaatgttctttacttctttctattgtaatttgtaaatgttcgttgtctcggtatcctgcacaatctagcttcagtgacgatgttttagagaggctaaggttaggttggtaactggaatagaaaccggagcctattttcttaaaccattttcaacggaagtttcttaaatccagccactttgtgaaataaatcttggagttgagatttatttacatttgctgccactgatatttaataattgtttttgataattagaaagaaaatcttctaattaaatatttgacatttaataatcttcccaaaatctttctaccttaactacacaattaattactaaaataaaacttccaaaatatttaatatcatttaattactacaaaattatcatttttgatatttttgcttttcggcatgactataacaattcaattataatcatcaaaccgcagagatatttgatagcatttaattaccacaaaattacaaaatatttagacaataattcataaacatatcataaataagatcaacattaataaaataaatagtttttttacgggacgggttgacgggacgggtttggcaggatgttatttaataacaattgtaaactataaaataaaaatattttatagatagatacaatttgcaaacttttatgtatactaactttaaaaaataaattatttctgcggtgtaccgcgggttaaaatctagtgagtttttaaaatagaatcaagtgtaaatatagataaataatatattttaatgatgaggttcttacatttgaagaaacttagttcaattgactcttagttaagaaacaattggactaagtttcttcaaatttaagaaaccaaactaatatttaaacaatataatatttttattatatatcaagaattttgtttagaaactcccattgaaaaaactcttaacttccatgttcttggtagtttcccttggactcagagtcatatgttttatttttgtgcattgccaattgacaattattgcattaactgattaaccgtctctttttagctctaattgacactcttaactttgttgtttaattgtggctatgcaatagctattatgaagagaactccaatacatgtgttggagtcttggagatcttacttgcatcttcaaacattcataatactacaacttagacattgtttgttttcttttcccatggaaacaaattttatcatgtgctaataataaaggtaagaattgatggagccaatctcgtttaaatctatatgtcccacacctcccacataaagaccaaacatgtattagctccatcagattgagacaacaaagttctatgtgtagatttagatgttttttcttaaaacagatttgattaagaacatgtggaatgaatctgatatttgcctattatgatgatgattaaagcaataagcatgttgtaactttccatctacaagaaaacagttgatcatttcaatcgaccttcaaatagtttcatcaatcatacataagtagacccataaaataaaattttgatgatcctaatggtgattattgtgaatgaaattagtccaaaatcttgctgtatctaaaaaacacaaaaatactattatcatattcatatgcattaactcatcctatcaaggaatcgaaccaccaaagaaccgtttgtttttcttaaaaagataacgacgaaaccaataagataaatgaatatgacaaaagcagagaatctggttgcatcaattgaatatttggtcacgtgggtacgcgctctatgcgcgtgaacatttagcaaattggctcttgaggaatatgaaaggtcggatatgtaaataattaatacgcggcgtgggcaaatgtgattctcacacttccttccaaaagattcttctttctatttttttttttttttttcctcccctagaatattccttcaccaaattagctcatttccaattcaaattttaatattcgttctaaatatctgtaaaaacgtagtcgagtggtaggttacataaattgtgaatgattaacgtttggagttggaattaagatatcactaatgatatgatttattgtcattgaaagttttaaacataatttttccttatgagatagtagtagtattttaatttatttaatgaaacgcatatttgttaggtgaacgtcaatttttatgatttttggaaaagacgcataataaaaaccaaatctttaaatttgaaattctaaatcataaaatctccatttaatgaatagatttgcccatatagaaacacagaaaatcatttctattagatgatagttaagttaaatgaaggataaaacaatcgttggaaaacaaaactctggaatcttaattaggggagaagaaaaatggttgagttttcgttcttatctgaaaaaaaaaagctaaagagattggaatagtgacgtcagttccagcccatacaaagagatgcgaacctataatcgaatctgatcctccgaatattcacccatcatcttcacgatattactattttacccttctcttccaaaagagaaaaaaacattttaactctcaaagattcgttttaggtacgcgacggcccgacctcgattctcttccacttctttcttgttccaaaaacctaaaccctctctctctctctctctctctctatctcttgaaaaatcaacaaaacattggaatcaatttctctatgttttgattctattttaaagatccaatattctttctccattgagattaagcttctttctcgctgtcgtctctctatagatcttggttcttagtcccttttgaataataatgatg

SEQ ID NO: 8370 - DNA, 3000 bp, Unknown
  misc_feature (1)..( 3000): cDNA_ID_1989406_gDNA_ID_1971785_Annot_ID_57988 3000 nt of promoter + ATG
gtacctcaaagttacatgaaacagtttatatcgagctttcttctagactcatagttaaacagttattaaccagtgagaactacatgatcttgtttatttcatatagtaaactttcgtacaagtatatctaattatctgacagagttataaaaagtaagatctacagaaatgttgttgggaatagtcccggtaagaccttttgcacctactgaatccaaagctctaagaccaagtaaattttgtgttggcttataagtaatggctaatagtctctatgctcgcacagctaaatgattaaaactgtgtaacaacaacaacaacattgctttctttattcctccacatgtcaaatcatcatcaataggaagttgtagaagatttgttttggtcaaatgtaacaatctaatgtactgtatctaattatcttcggaaaagagaaacactcaagactctaaacctttttatttatgaaagaaaaaaaatggtacatatgatgcagagaaatgttctaaagattatttacttctcccaaatgtttcaaaaagaaatgagaagagaagaaagagacaagatcggattctgacgagtaaaaaacaagaaaatacccacaagactaaacagagcctagacgtcattgactctgccaaatgtactactactctcttgtccaaaaccaatttcattattggtacgtttccggtttggtgtaaaataggtatccaattctcggttatgtgtaaatatttggtaaaagaaaagtcaatgaagcctccgggagaaacgagagtttactggttttagaataggagacagtaataaattttcatttaaaaaaagttactaaaaaaactaatgctcataatagtttctacatttataatgaggaagatgtttctttcaagcaaagcttttctttttaatgctcttcttcatcggtccactgaatatcaagttaataatactgcaaaaattatttggtttttatcattaaatagggatactattagaattcatttatttgtgtatgattttataaatcaaaattaaaaatattggcagattttttaattagctttccatcaacatcacatcagcttcagagcagaaaccagccagccagactattgcctgctttatggtaactagatttcattaatatctgtttttttttttaaacttcaaattagttatatagttaaatacataaaaataatcattgagaaaataacatcttaggctaggcttttgacatttttacaggagagatgagagatgagacattgaagaaactttcaacaatacatcatgattcatgagcatatccagttatcaactaaatcgtgcattaattacgtttttataatatttgaaaattgattagagaaattcattagctttgttatttatattaaataattatatatttttttatatcttttgtgcatgggaaaaaataaaaactcagagtggcagtggtcgagaggccattttcaactttggcagacacagtaaaacaagatggaaatgacactctctgtatctgaattatccaggctctgcattacatatacatacaaattttacacatttattccatgcgtgaaggtttataattatatgaaaacaaaatagttaaagaataacaatttcaaaaacagttaaaagcaaatcataagcctaatatcttggcaaattaaaattttatttttcttcaaaccctaaattttgacttgcacaagaaaaaagaaggcttattatagaaactttaaaattaaattaaataataaatcaaatattagagaaagaaagatatgaacatactcccaagtttcaagagacacattgtcagcaaacatccaaattatcgtcattctcgattctatcttcatatcttggttaaagaccatataataattccaaatactaatgtgtcgtataacaccattatgtctcaatttaaaaactaaaccacatcttattataattcggtaacacacatgacacatatggttgatttaaaattagcatgaactcattcatattcaattttgttttgctatcttcgtattgaacgtatattgaggagtgatattttagctgctaatctagctataatacatgaaccattgtgttagaatagtttacaaaaaatgtcacaaaatatttgacatctcatataattcataagccatatgtcctaacatacaatatatacaatgtgacatgggaaagaaattgcgagatcaaacttagaaactagctttattaggcttttgataatacgtaagataattaaaagactcaataatcactaatcctaaccttttattaaaaaaaatttgtcaactaaaactaaacttacacatttttcctatacttagacactttgttgattttttcaccaaggtaagatccaaccttacatacatttaatattttgatcgtttaagatttttaaagttcttgaaaatggagtattacaatagattcattagcaaaacattattagttttattttttcctcattcattagcaaaacaaagttaactgatcattataatcccacaaaattaactacactagatgtagtaaaaatctggaaaaattagtaaatagagtaacatatttttaaaataggaaaacaaagggtacgtgggtgtgtgtgttggttattgggaaactaaaatcccaccctctcagacgcaatacatttacactttttttttattaaacataaatctcaaaatctcttctctgatttctttctctctctcacacacaatatagtaatttcgtatttattaatgatgaatcctccagccgtactgattcgccatcttttcacctctttaatgaattctctcctcactccctccttcccttttaacttcactttcttcttctgataacccaactccttaagaaagctcacttctttttcccctgattccctttgtgtcatcatctttcatcatcttcttcttctaagaatcaacaaca

SEQ ID NO: 8371 - DNA, 3000 bp, Unknown
  misc_feature (1)..( 3000): cDNA_ID_4262594_gDNA_ID_1971785_Annot_ID_57992 3000 nt of promoter + ATG
agcaagctttcaagaacaagtgaaaccagtctcgcttctgtcgcatcgttatccatgccacttgttcgttactctcttaacacttttgtcttagaatgattcaactctgtggattcttttaattgatcttgtgtgttatcagattcaggagattgttctatcagcagacatcagatgtagtgactgccaagagaaagtcgccgacataatggcgaggatgatcggtgagtatatagcttacttacttccgagatgagacacttttttgttctttcctctcacgcttgtttcctctgttttcttggagcagaaacatattcaatattggtgagtgtgttggagaagaaagtgacactaacgtgtacatattccggtgaccggagagtctctaaatcctatggtgaagctcttctctgcaaaatctcaaccatcaagcgtttgatatgtccttcaaggaaacaataactcagagttgcttgatgtttgcttttattatcattttctctttccaataaaatgaatcttttatgtcgaatgtgattggatattgtttagataaacaaaaaactctcaatagcaataataatcatagacaaagtgaattcttgaaatgcagaaatcaaaaaagagattattgagaagttaaattgccgccactttgttgccagagattgatgatatcagtggcttggtttagaagaatgatcatcttcttctgagagatccatggtttagcttcaagagtagacttaagctcttcccaagcatctttcctaggccagaagaagtaaggactaagtgggattgtgccatgtccaggtacatgttggtccaatcctaatcctatgttcttctccatccacacaaacttgagtaccactcttgatttctcatctggcttcaccacctaacacaaacaacaaagatttgtgggttttgtaacacaagagacaagaagatgaagaagaatatgttgtttttacctttattgtttgttgtggagtgttgtcggaagtatcaattccggtgactgtttcagcggtgagtgtctctggagctgctagagttatgattttccgttttacagagatgggtttggttgtttgggtatggaacaatggaggagaagcagtgatggagagttttggatgttgagagatgaaagaagagcagagggaagtagaagagagtgccattgatgacatcatttttgtgttttctcagagaacaatggagattttgtgagaatatggataaggaagatatggtcacatttttgggtggagtttcaaagtagtttgactatcaaatttatgggctttgttgacttggcccatcattaaatgggtcaagaatacagagtttattataagcccatgaatacaaacctgaagctttgagaagtagacttttaaaaatacagactctgtttcaagtattttcgagggactaattcaaagatctcaacatataagtattaatcatatcatatttaattcgaatgacatttgacagccacaagtatttatacaaaaattaaaaacctcatctttgtttagtgttcatgatttgatcaaagtcaataaatttttttgtgtgaaataaatttttgtattaatcaaaacacaatttttaacaaaatataattatcgatattgtacgctgcaagatgtcctcaatttgttttatttatttatcaaaaacaaataattgttgagaaagtggcctttacattatatatgtcacatgattctttttacattatgtcacatgattcatcttaaaaaatcgtcttctttattttcacaggtttgctgaggccaaagaagagtctttctttggacttgaagtagcactggatagatgagatgagaaagcctttaaggagaaagacaccatgatggtcattcatgaacatcattcgatgagtatatatagtaaaagtttgaaatacttcttacatcgtagttattatataatgtgcacacgatattttttattttcagcatacaataattggataaaacaatcaaactcacccaaaatacataaataattgttgtttctcaaaaaaaagtaggaaaaatctcatgtgagggtgggtacactgtgtagggtagggcttggcttttgagcatagttaggaagtagtaagatgcgatgcggtagtaagtaggagtttcaaaatgtcacattcacacaagtcacgaccatgaaacttgtcgtctctttgatacttgcaacttctccaaaactgtgggtctgtaattcaattattagagtcttgaacttgaagagactttaagatatgtgtgtaaatttgttcaccgtcacattattggtccatttacattacacacgtccactatagttaattctcaggttgtttatccatagatatctgttgttatttctgcgacacttttactggtcacaatgaattatgttgatgtttagattcaacaaaaaaacttactaaatcgggtaactatgaaaaaatattatgtagctgagccaaaaaggtaaagtctacagtttaagaaacattaacacattgaacagaaattaagaaataatataattctatttttaatttttttactgaataactaatagtcacaaaaaatcatattacggccttaccggtccatttatgcattactggtccacaaatgtaaattctcacgttttaaattccatctgtttcaaaaaatttggacacttttggtggttaatatgttaatgattagatttcaaccaaaaacatcaaagttataaatcggacaattattaaaatttgtaatgtagatgcaccaaattgtaaattttttaaaaaaacttgattatttagagatgatgaatcgaaggcatgcattaattgcgtagtacaaaacaaatcttgataaatagataaataaacatctttctattcgtaaggacgacaagaatctctcaggttctgtagaattgtcagaatcatttctaatgggaggtaaaatg

SEQ ID NO: 8372 - DNA, 3000 bp, Unknown
  misc_feature (1)..( 3000): cDNA_ID_1989401_gDNA_ID_1971785_Annot_ID_175459 3000 nt of promoter + ATG
tattagtttctgttaatgttatcaatgtttttataatttcacttactagaggttttgatgcttaatttataaaagtgtgcaaattaaaattttagtggaatcctttaaacaaatcgaaaatattaataattcattatatccaattgttgtatgttatttacttttgtcattctttgatagtataagaatttatgacttttctggtattttagaagaaaaaataatcacatgattttttttaatcacatgtttggtgctacgtataatttatatgaattatttaccgtcacataaattatagtaaagttttgttttgtaatctattttagaaagacaaaaacttcataattattaagatctctcttatgtatttttaggtctacaaatctttgtaatgtaaaacaacatttaataattaaaaaaaaaaaacatttaagtaggaattagtaatgaaataaattattatgtaacagtcgtgatgattctatcccaaaaaagaattaaaaaaaaatggtagtgatcaatatctggaatagagatttgtcttattttaatggagaaagaggcgaggcagagactggtgaggccattcctcgagaactacacttatgctttcccccataaatccatttcttgtctatctctctacttttcttcttttcatttatttaatagttaatacggctttgctttttagttgaaaacagtaaaaaccgaaataaaatgtgtttcgtcggccgatggagattgagaaagttagttaaaccaatgatgccgacacaaaacaaaaagttaatccgatgatactattttcactactgtatcaatcgattcgtcggctacgtggtatgttacgaatcttaagagttattttaatcccacaatgttgaatgatatgcaaactattgttaaaatgtcacttaattgttatattaacctgaccgaatagctataaccaagtcttcgtcaaggctgcgtggccggttttgggaacgtatgaaaattctttaattcttatattattaaattaaagaatttatttcttgttgctatttatttatttagtgttgtaaatagtgttgcatcaactatgtaaatgatgctatatcatcacattaaacttgtgtcatctttagtgtttcataagagagttttgagtgtaaactcacatcaaaattgtgttttagtgtcccatctgcttttgagcctaaaaatagaggttttgattggctaagtcctattccatttttatcctaattaaacataaaaacaataccaaagcaatataagaaaaaatcattttcacttttttatactgtcatcttgcactgctacagtttaacgttttaattatttatgtattgtttactgtaccgttaaagacttataccgctttgagttaccaatatgatttgcattttggttgaatactagaaaatgatattttctatgtatgaaaatgatattttctgtgtacgaaaatgatattttagtttgttcttatcattaacatttatttgtctgttataatatttatatttagagttcaatgttcagacttcagagtataatgccaaaaagaagccaggtgaggaatgcatctgaaatacaaatttggatctcgtgaatcattcacatcaatacagcgattaatttgtgatataatttacgattatattatttgtatagtgaaacaaaataatgtgatggtagtacttgtagacaatgtgcaactccggaatcgagatgttacatgcatgtatgaatatcgatcttggaaccttcttcatttttaataatttttcatgccctaccttaattacgcttgtcgggagtccaaaatccaaactccaaactaagattttgcatctcgttgtatcttgttaaattcagttttattgtcacggacacggagtatatattttatgcatggacaaacattttcttgaatacttcaaaagatgttacttgttagtaaaaatatggtaagggctaaataaacgtagaaattgagcatagagaggaaattagtttgggaagcgagaatcacgcttcaatttagagaccgaaatgtatggagccacgttttggaacatatcacctcctttgattttctttgtttttattaattcaatcttttttatttttgacattaacaataaacaatctattggtcatcgcattaattctcaaacaacgtaatataaagatatctggtccatgtgagcataatttttcaagatattgttataaagactagttttcaatatttattttgatgccccaaaaaaactacttgtatccaagaacaatacttaattagttaatagtttaatgatgatggcaaaatatatacacaatacacttgcctattagtgtttgcaaatattgatgataaaagaaattagtgtttgtcatgtttcatataagatagatgatagatcactacaatactcatacacacataattcttaatcacacatatacctgttgtttatgtaattattaaaaagaagagaatttactctattccactacttttcttcaaaggtttttcatttctatcacttttgtttattatttttgaatctatcatatttgtatgatagaaataagacgatttcattattctcattttcataatataatattatatattgaatgtatagttgttaaaaaaaagattatctattgagaaagagaaaaaaaagatgttacaacagtattaataaaaatgatatatgtaaacaaaaagaggataatgtgatagatccaaaagatttagggaacaaaatagtaaaaacaaaaagaaatttgtaatttgtagtagttttgttaattttccttaaaccgcaaaatcatattctactatttatatcctcgtttagtgttcacaaaacttatcaagaaccataagctaaagagggttcggttctttaaacccctccatctctctctccttcattacactgtagagtgttaaagtaccactctatagcc

SEQ ID NO: 8373 - DNA, 3000 bp, Unknown
  misc_feature (1)..( 3000): cDNA_ID_2039691_gDNA_ID_1971785_Annot_ID_175452 3000 nt of promoter + ATG
ggaaataaaaatacattcacaagcaaacaaatggttgcaccaagaccaataagcaaaatcctgtaataagcagtgcttaagaagtctcttgagttgttcccggaaacaagaacgatacaatatgtcaacttgaacactctgaatgcgtattcgtatggtttcatggacgcgtatagtttcaaataactagcaccaaaacctgacatagacaaagaaaaattaaatgttagtatcctcattgtgtgtaatgaaattgtggcgatataaatgttgcaaacctgcaaggaatatgcagattacgatgatgacttcttcaaactctcctgctaaaacagagagctgcgcgacgccgagagcaagtcctccagctaacattgtgcctaatgctctattgaatcctttaaccaaagttgctcctgaaaattgaacataagagtgactcaataagtatgagaataattgatctgaaaatgtaaataaaacagtaaaatgcaaagtcaataagtaaatctgaacagagaaaatagaaaaaatctttgaatccacttatacaaaaagatggattatacaatcaaccaattgatgtctttagttccatcaaatggattccataaacagaaaactcgaaaacagtgaaaaatattcaatccaagtaacaaacaagcaaagaaagtataagagttggtctgaaaatgtgaataatacagtaaaatgtaactcaataagtaaatccgaacccatcaaaatgaaagatggaatccaaaaaaaggaacagtcttaggattaaaagaatctttactagatttgcttcacatgcgcaagtgtcttgagttcaagattccaacaaaacataaaaacaaaactcaaagatccaatcaaaggatcataaactaggctatgagttaagaatcaataccgacgtaatactcgaaaatgagaacgacggtgagaatcgcccaaactgcgaatttactagcatcttgaagcggctctttgagaaagatgacgaaagaacagagtgccaaagcaattcccatcttgatggagaagtaaagtttcctacgatcagaatgtcccagcgcgtacaacttcgccggagcctcgtagagagccctccacgagcaacaccggaacttggagtcacggctatcagcgacgtcgcttgactgccagagaagcttctctgtgttttgctccggtactgatcccattttacctcccattagaaatgattctgacaattctacagaacctgagagattcttgtcgtccttacgaatagaaagatgtttatttatctatttatcaagatttgttttgtactacgcaattaatgcatgccttcgattcatcatctctaaataatcaagtttttttaaaaaatttacaatttggtgcatctacattacaaattttaataattgtccgatttataactttgatgtttttggttgaaatctaatcattaacatattaaccaccaaaagtgtccaaattttttgaaacagatggaatttaaaacgtgagaatttacatttgtggaccagtaatgcataaatggaccggtaaggccgtaatatgattttttgtgactattagttattcagtaaaaaaattaaaaatagaattatattatttcttaatttctgttcaatgtgttaatgtttcttaaactgtagactttacctttttggctcagctacataatattttttcatagttacccgatttagtaagtttttttgttgaatctaaacatcaacataattcattgtgaccagtaaaagtgtcgcagaaataacaacagatatctatggataaacaacctgagaattaactatagtggacgtgtgtaatgtaaatggaccaataatgtgacggtgaacaaatttacacacatatcttaaagtctcttcaagttcaagactctaataattgaattacagacccacagttttggagaagttgcaagtatcaaagagacgacaagtttcatggtcgtgacttgtgtgaatgtgacattttgaaactcctacttactaccgcatcgcatcttactacttcctaactatgctcaaaagccaagccctaccctacacagtgtacccaccctcacatgagatttttcctacttttttttgagaaacaacaattatttatgtattttgggtgagtttgattgttttatccaattattgtatgctgaaaataaaaaatatcgtgtgcacattatataataactacgatgtaagaagtatttcaaacttttactatatatactcatcgaatgatgttcatgaatgaccatcatggtgtctttctccttaaaggctttctcatctcatctatccagtgctacttcaagtccaaagaaagactcttctttggcctcagcaaacctgtgaaaataaagaagacgattttttaagatgaatcatgtgacataatgtaaaaagaatcatgtgacatatataatgtaaaggccactttctcaacaattatttgtttttgataaataaataaaacaaattgaggacatcttgcagcgtacaatatcgataattatattttgttaaaaattgtgttttgattaatacaaaaatttatttcacacaaaaaaatttattgactttgatcaaatcatgaacactaaacaaagatgaggtttttaatttttgtataaatacttgtggctgtcaaatgtcattcgaattaaatatgatatgattaatacttatatgttgagatctttgaattagtccctcgaaaatacttgaaacagagtctgtatttttaaaagtctacttctcaaagcttcaggtttgtattcatgggcttataataaactctgtattcttgacccatttaatgatgggccaagtcaacaaagcccataaatttgatagtcaaactactttgaaactccacccaaaaatgtgaccatatcttccttatccatattctcacaaaatctccattgttctctgagaaaacacaaaa

SEQ ID NO: 8374 - DNA, 3000 bp, Unknown; identical to SEQ ID NO: 8371
  misc_feature (1)..( 3000): cDNA_ID_4283694_gDNA_ID_1971785_Annot_ID_175451 3000 nt of promoter + ATG

SEQ ID NO: 8375 - DNA, 3000 bp, Unknown; identical to SEQ ID NO: 8370
  misc_feature (1)..( 3000): cDNA_ID_1989406_gDNA_ID_1971785_Annot_ID_175446 3000 nt of promoter + ATG

SEQ ID NO: 8376 - DNA, 3000 bp, Unknown
  misc_feature (1)..( 3000): cDNA_ID_3045332_gDNA_ID_1971785_Annot_ID_175442 3000 nt of promoter + ATG
aaggtggacctaccgttttagggttgtttaacacttgaaccgtccgtaagtcttgttaagctataatttgttagtcttggttagaaccggttcaatgtgtgtatgtatgatctacggtttatacttttttttttatttttagttggttttgtcatttctatatataaaaatgtaaatgttctttacttctttctattgtaatttgtaaatgttcgttgtctcggtatcctgcacaatctagcttcagtgacgatgttttagagaggctaaggttaggttggtaactggaatagaaaccggagcctattttcttaaaccattttcaacggaagtttcttaaatccagccactttgtgaaataaatcttggagttgagatttatttacatttgctgccactgatatttaataattgtttttgataattagaaagaaaatcttctaattaaatatttgacatttaataatcttcccaaaatctttctaccttaactacacaattaattactaaaataaaacttccaaaatatttaatatcatttaattactacaaaattatcatttttgatatttttgcttttcggcatgactataacaattcaattataatcatcaaaccgcagagatatttgatagcatttaattaccacaaaattacaaaatatttagacaataattcataaacatatcataaataagatcaacattaataaaataaatagtttttttacgggacgggttgacgggacgggtttggcaggatgttatttaataacaattgtaaactataaaataaaaatattttatagatagatacaatttgcaaacttttatgtatactaactttaaaaaataaattatttctgcggtgtaccgcgggttaaaatctagtgagtttttaaaatagaatcaagtgtaaatatagataaataatatattttaatgatgaggttcttacatttgaagaaacttagttcaattgactcttagttaagaaacaattggactaagtttcttcaaatttaagaaaccaaactaatatttaaacaatataatatttttattatatatcaagaattttgtttagaaactcccattgaaaaaactcttaacttccatgttcttggtagtttcccttggactcagagtcatatgttttatttttgtgcattgccaattgacaattattgcattaactgattaaccgtctctttttagctctaattgacactcttaactttgttgtttaattgtggctatgcaatagctattatgaagagaactccaatacatgtgttggagtcttggagatcttacttgcatcttcaaacattcataatactacaacttagacattgtttgttttcttttcccatggaaacaaattttatcatgtgctaataataaaggtaagaattgatggagccaatctcgtttaaatctatatgtcccacacctcccacataaagaccaaacatgtattagctccatcagattgagacaacaaagttctatgtgtagatttagatgttttttcttaaaacagatttgattaagaacatgtggaatgaatctgatatttgcctattatgatgatgattaaagcaataagcatgttgtaactttccatctacaagaaaacagttgatcatttcaatcgaccttcaaatagtttcatcaatcatacataagtagacccataaaataaaattttgatgatcctaatggtgattattgtgaatgaaattagtccaaaatcttgctgtatctaaaaaacacaaaaatactattatcatattcatatgcattaactcatcctatcaaggaatcgaaccaccaaagaaccgtttgtttttcttaaaaagataacgacgaaaccaataagataaatgaatatgacaaaagcagagaatctggttgcatcaattgaatatttggtcacgtgggtacgcgctctatgcgcgtgaacatttagcaaattggctcttgaggaatatgaaaggtcggatatgtaaataattaatacgcggcgtgggcaaatgtgattctcacacttccttccaaaagattcttctttctatttttttttttttttttcctcccctagaatattccttcaccaaattagctcatttccaattcaaattttaatattcgttctaaatatctgtaaaaacgtagtcgagtggtaggttacataaattgtgaatgattaacgtttggagttggaattaagatatcactaatgatatgatttattgtcattgaaagttttaaacataatttttccttatgagatagtagtagtattttaatttatttaatgaaacgcatatttgttaggtgaacgtcaatttttatgatttttggaaaagacgcataataaaaaccaaatctttaaatttgaaattctaaatcataaaatctccatttaatgaatagatttgcccatatagaaacacagaaaatcatttctattagatgatagttaagttaaatgaaggataaaacaatcgttggaaaacaaaactctggaatcttaattaggggagaagaaaaatggttgagttttcgttcttatctgaaaaaaaaaagctaaagagattggaatagtgacgtcagttccagcccatacaaagagatgcgaacctataatcgaatctgatcctccgaatattcacccatcatcttcacgatattactattttacccttctcttccaaaagagaaaaaaacattttaactctcaaagattcgttttaggtacgcgacggcccgacctcgattctcttccacttctttcttgttccaaaaacctaaaccctctctctctctctctctctctctatctcttgaaaaatcaacaaaacattggaatcaatttctctatgttttgattctattttaaagatccaatattctttctccattgagattaagcttctttctcgctgtcgtctctctatagatcttggttcttagtcccttttgaataataatg

SEQ ID NO: 8377 - DNA, 3000 bp, Unknown; identical to SEQ ID NO: 8366
  misc_feature (1)..( 3000): cDNA_ID_1989410_gDNA_ID_1971785_Annot_ID_175433 3000 nt of promoter + ATG

SEQ ID NO: 8378 - DNA, 3000 bp, Unknown; identical to SEQ ID NO: 8373
  misc_feature (1)..( 3000): cDNA_ID_2039691_gDNA_ID_1971785_Annot_ID_57993 3000 nt of promoter + ATG

SEQ ID NO: 8379 - DNA, 3000 bp, Unknown
  misc_feature (1)..( 3000): cDNA_ID_1989403_gDNA_ID_1971785_Annot_ID_57994 3000 nt of promoter + ATG
ataaattcagtgctaaaccggatgggagcaattggttaccggataacaatttgaaccgagggaggcttgagtatttttactggttgattactgtgttacaagctgttaatcttgtgtattatctatggtgcgccaagatttatacgtataaaccggttcaggttcatcatagcaaggaagatagtagtccggttaaggaggaattgcagttgtcaaataggagtttagttgatgaatgagtcttggcgttggatgtgtaatgtaaaattactaaattagtatagttgtaatatgtacttatcaatccaataaattagaaagaatgactttgtccattgttgtgggtgttcaatattgataaacccacctcacaatttttttatttttttgataaacctatataatccgatcggaattaaattaaaacaacattcgtaaattccaaaccaaatttactttgggttaatactaatatatttgtaaattgtaatgttgaaagaagtctgaatcgaaaaataaaaagaatcgatcatgaatgttatttatatgttaaaagtgaaaccaaaactgtattttaaactgatttcatattatatttggttgtcttttttttggggggcaaatatttggttgtctttactaggactattttttcaaaaaagaattgaagatctatgttgattaagccatattaggccgaaaataatataaatgggccaaaaggcgaatacattgatggtgaaacaatcaatcattgatttgtctaagtgttgcagaaaatttatattacaaggcttcggtggccttaaggcccattaactattaccatgttgaatattgaaaagttgaaaacatatatatatataacttttttaacatcatcaattctttattaatttaaaatcgataatacaaatgtatcaatgagtatacaaattgaagctctacaaatcatattgccgatatttaagctgaacgaaataaacgaaaaagtgaaaaacacgttgctttctgttgtagataagccttacacgctaacagattaatcaatctcttatttttctttacctccttcgtcaccggtctattttgatctccttgttgggctatcttcttttttacatagcaccaaaactttttctgaaaatcaaagggttgcgatccatcagttacatcgctaaccacacaaacatttccattacccgcgttaggcgatggttcgatattggttgtaaatatcacccgtgatagatccataatctcgattcctttgttggtatatttcaatggccagaattgaaaagattttgtaatttcttcatatgacttcgataaaaagcgattttattggtgtagtcgatgatttttttattccctcagagtaagattaactgcctccaaagccaccataacgtaccggaaaatctgtttaacaagggatttttggatccataaaatcaatctttatatccaaaaagaacagttggtagcgtaaagattttcgagcacaagaatgaaaagacgtcatcatcgaactttatccttgcttccatgagtgagagaaagaggccaatactcgctgaacatagatggagatgatgtttaacgataagatctgtctgaatcttaatcctgccatcatctaatccaacatttgagtctccaagatcctagattcgggattgtaaatcatctctcaaaaagaaattcatgtcgaaaacgaatcgacgatgtagatgagagtccattacaatcaaagaacaaagagactcacttaaatagatattcagcggaaaggcatcgacacaccaccgaaaaactcgccggattgtggtcggattgatactcatcccaaaggagaggaagattatgaagatttgaacaaagagagccaaagaatttgtggaaaacattggccaaattattaatggtttataactagaacaggggaattgaaactagaaagcagaagagaaacaaccggccgacgtcaaggaaacgatgtcggccggaaacagtagaaaacagaaacggttggtcggaaaagaaagattttgggaacgtcgtcttattcaggtcttatttttttttgaaaattttaaatgtaagcagaaccagtttattcacaactataatgatactatttgattgataaccaactttttgttatagttgaaaacatatttatctaccatgttttgtcaagaaatttaaaatgcatggattttataacaatgaaggtaaatagctgtagtgacgtagtaaaaagaaacattccatttatatagatatgatccatatccattatccaaactaaaaagtatacataagatatgtccgaaaataatttgtttctatttttgtgcaatcttttcataaacaaatcgttccatttaccaaatctgaaacctttcccaaaaattcgatcaaagtcaaaagataagaacatatatcatttccgtatttgattttctaccaagatccaaaatttaaaataaaatacaaacagatacggaaatatctaaaaaaaagaaaaattccaaaaagacgtgaaagcacagctggcatttaaatagaacaagtcttctaaaataaataaaaaactccgtaaatcacgcgtttcaatttttattacacaacttgtcttttgtctttttttccgttataaaaattccaaaatcgtgacggaagcaacccctcttaaagggtattatagtaatatgcctaacaccggaggataagaatcgtaattaacaaaatcatgctcctttcgaatcaatatacgtggatccaatcaccacccttaatcttatccccaaattcgaaaccctaattagctccctcctctgtttttttttatattattcaaattccgcctccaaaatcctctctttctgcgatttctatcacttcacgcgcattgagagcgagagagagagagacccaagcaagagctcaaattagggttatttttccgatttgagagatccattaacaatg

SEQ ID NO: 8380 - DNA, 3000 bp, Unknown; identical to SEQ ID NO: 8372
  misc_feature (1)..( 3000): cDNA_ID_1989401_gDNA_ID_1971785_Annot_ID_57996 3000 nt of promoter + ATG

SEQ ID NO: 8381 - DNA, 3000 bp, Unknown
  misc_feature (1)..( 3000): cDNA_ID_1989439_gDNA_ID_1971789_Annot_ID_58021 3000 nt of promoter + ATG
atagaaataggtgaaacgcctcatgtctttacctcaggtgatcagtcacatccacaggtaaaggaaatctatgagaagctggagaagcttgaagggaagatgagggaagctgggtaccaacccgagactgagttggccctgcatgatgtggaggaggaagaaagggagctgatggtgaaggttcacagcgagaggctagccattgcctttggactcatagctactgagccaggaactgaaatccggatcataaagaatcttcgagtctgtttagactgtcacaccgtaaccaaactcatctcaaagatcacagagagagtgattgttgtaagagatgccaaccgcttccatcacttcaaagacggtgtctgttcatgtggagattattggtagtgactcgtttttggcctcaacacaagtcatagtgtactcatcctgtaacattacctcactcataattgatttcttttttgacaataattcttgattacttgttacaatctacatgactacgcttaaaagttgaaaacctatagtatacaaaaaagttgacgaagatcttcattcaaataatctatttctatggttacaattacatggaaatgcaagaagcatattaaaaaagaaactatacagaaatttatcaaagtcacagaacattttacatcagacaattccgcatcatatatcttgtgttgcagttatatttgctgctgaaactttatcatccgctggctttttcttcttttttgggggtggttcttgcactttccgaataacttccttgtttggcaccaagacaataaacaaatttctgtcccgaaagtttttgctctcctcagtaccaagctgcatatgttgatgagtttcagtgactcaacaaaaacgatccattaaggtgcaaatccaataccaaacttgtattaggaaagagcatagagaaacaatacagacctctcctatttcagtctgaaaacgtctgaggagctcaatagcaatatttctgaactcgttttctcggcctttcatgttcacaatcactttaacctgagtgtattacaagtcacacattaacaaaatgtgacagaactcgcctataacacaaaacaaagtaagtggggacaaccttgtcaccgtcttgcaagaacttccgggctgctctcatgcgtacagaataatcatgctgatcgatgttataactaccggagaaacaaaatacaaaaaccttttgagaagaagcttttctaaacaaaagcatcacaacgacacagataaaagagatagtgaaaatggctcaaatcaccccattttaagctccttcaagtccattcgagtagctgacataagaagaaagcttcagttacacaatccattcatgtaaaatacgacacagtatacacacttatagtttcaacattatctccagttaagcagagaagaatgatcaatacttttcttctgctgttcctttttcctcttttgctgctcatatctgtatttactgataatgaagcaaaaaggaaaaagaatcattctccttgaaacttcctctacacaatgtatatgatacaaattatcatccttgagataatttacctgtaatccatcattctaacaaccggaggatctgcatccggcgaaagaatcacctgaaaaccatatgagatcaagctcagcttacaagaaaggtacttacaagttgtaaattatccaaagaaacacaaaccagatcaagctcagcatcttcagctcttcgaacagcttcttctttggaaactaaaccaatctaaacaacaaagaaactggaaaattttcaatttttgctgaaatcaaaaagtttaaacatttaaaaggcacttcattttaccatgttctgctgatcatcaataagcctaacagtggctgacctactcaatttgagatacatcaaaatcaatcataacttcagctacagaaatttcaatttctatcaattaatagtttccacaattacctaatagctgagatatcaagcgaatcatcatcctcggattctttctgcctacctctcctatcgccgggaaatctagagcctccgccaccaccgcctccgtaacggcaagtgatggcgggacaacggcgatgatgataaggggaaagagaaacaattgagaattcgggtacacagagtcgaagaccaaagagcttagatttaacaggatgcgacaccgttttggtggctccggcgagaatggcgttgaatccaacggtgctggtgatcccagccatttgcttcttcagagtccagagtctgtctctccaccaattagaatgatccgatttaaatacaaaagaacaaaaaaaaatctatcttatccataatatattgggatacatcagattaaaaaatctatactttaaagatttttaaatgaagaaatgaatttgtgaatttagcttagcttattgatagtgacataatgtacttgtaactacagtttcactaatcactgagtaatgattttttgatcatttttttatgttttacaaatttgatataaaatgtctcagtattaaaagataatcaagtttaatgttttttaataatattttccaaaatggttaagctttttgggccaaaccctaaaaatgctttggacagaagctaagagctaaaacagacaataaaacagctgcaacgctctgcgccgcgttctctctttctctcaatctctcaggtaaaagcttcttcaatttcgccacttattagatttgtttctagacggcattgttcttctttttcctaggctttgtcttaaattgtgataaacctaattatctgcgtctttatagaagaactttaccatctaaattagttgtgattcaatcggttatatctacttgctgcgttaagttgattactgtgacgttgagactctaatttagtttgtcttgtgcattttcagaaccgaacactgcttctgtctttcctgttaacgcgaacgaaagattcgagtgatg

SEQ ID NO: 8382 - DNA, 3000 bp, Unknown
  misc_feature (1)..( 3000): cDNA_ID_1989438_gDNA_ID_1971789_Annot_ID_58022 3000 nt of promoter + ATG
tggtcgtggtgatgaccggatgacccttccttgttctcttcatgttcaactagttcccgacccaaaggagtgatcgtatggcgtccgcatgaaattatgagggattgagaaagtaacaagagggagatgatcaaaaaccaaccaagaagagaagaagttctcatctttttcttattctttaaacaaaattgaatagaaaatatatttatcttgtgttttttgaacttatgagtgtgtctgtgtatttatagatttgtgtgaaagtagttgtaccatactctcttcttcgtgcacgcaaccaaacagatgagctcttccttaattaacaactaggcagtgatataatcatcaagacagctcataactgttttttcttttggaaaacttcttacttacacaagagacattttgacacgatccaggatcatatgactctgtcaacgtattaaaatctcaaattttatatgattgactacgtatgaaaaatgggaaatatccttaaatgtcatttttcaatgtataaattagtgtgatattttttaaatatctattttgaaatgctcatctgttcccattaaagtaaaccaccaacatgataaaatacaataataataataatgattatttgacaactacttgattatttaaattaaacttttcattccaagactatctataaagagtacaattcaacatattcttttctttttcctcatcttgaactcttccaaatgaataatgaactaaggcaccaaaagaaaaagcacaaaccaagaaaaagaaaacagagtaataaaactgaatctaatttcgattacaagtatgatattaactcttaacatttttcaataaatgattacaagaaagatctcacctgttttttccggcgagcgtggggtcttaaactgatcaaaacatgtattgagaagaaagaaaccacacaaactacaccaaaccacggcaagcctcaacctctactgcttccgtagtgagtagagactcactaacactcctcatcacagcttccaagactgctttcttgaaccattcgtctcccattttcattagaatctctttcaccaactcagaatccgatgctttggccataaccaaactcccaaggatctccccaaagttgtttggcgcttttggcagatcgatcccaatgtcatcgagcatagacccatagagcagacaaccattccttaagtctttaggagttagaacattcttagagaccagatgttccaagagcttcgccactggttcaacacaaggagggttcttctccaagccgagggagatagcttccttgacaagctcaggatggtaagacggggttttcagttcttctatgcattgtaatgcctcatccaatagacggacattgaaatattcctccaaaagcgagttggtctttctactgagctctactgtgttcaagctagtagtcgtaggaggagccacctcctgtggctgtggttgtggttttggcttctccacagtttgtctggtcggggaaggaacaggtttaggctgttgggaaccattaccttgcacaagggcacttggtctatcgttcagaaggcctccactgccctgaggtagcagccttgaattacctctctgagctgaagcagctgttctcgagtgaaccgcaaaagctcatgaccctcaaatcgcgagtctcctttctacaaaacacatacaagtcattagacttgaacctcagaattcgaagcaacagatgaaaaacatggttggatttactacgtataagctcaaaccaataaaatgtatataagttatatatgtaggtcctttatgagcatcaaaaactgatagagtgcccacctaaaagcctacaaatattaatctttgtccatatttacagcaaggtcacattgcttaagcgccccaccaagaattaggacattgcatactaatgttcaacaaagaaaatctaaactcttaacacataagaatcagcaaaagatccaaactttatcaataatccaagtcaaaaccacaagaagcaatccgacactcaaaatttacagctcatagaacttataagaaggttacaaacataaacaaatcaacacacaaaaaaaaaacagaggatttggataccttaacggcaaaagaaggagcgtctccgccattggtaagatcagaggaagaagataaggtaaagcgtggggcaaagcgtctgcttcctccacgaccacctccaggcctcaagctcagcattgagtcaccttgctgcatcactcgaatctttcgttcgcgttaacaggaaagacagaagcagtgttcggttctgaaaatgcacaagacaaactaaattagagtctcaacgtcacagtaatcaacttaacgcagcaagtagatataaccgattgaatcacaactaatttagatggtaaagttcttctataaagacgcagataattaggtttatcacaatttaagacaaagcctaggaaaaagaagaacaatgccgtctagaaacaaatctaataagtggcgaaattgaagaagcttttacctgagagattgagagaaagagagaacgcggcgcagagcgttgcagctgttttattgtctgttttagctcttagcttctgtccaaagcatttttagggtttggcccaaaaagcttaaccattttggaaaatattattaaaaaacattaaacttgattatcttttaatactgagacattttatatcaaatttgtaaaacataaaaaaatgatcaaaaaatcattactcagtgattagtgaaactgtagttacaagtacattatgtcactatcaataagctaagctaaattcacaaattcatttcttcatttaaaaatctttaaagtatagattttttaatctgatgtatcccaatatattatggataagatagatttttttttgttcttttgtatttaaatcggatcattctaattggtggagagacagactctggactctgaagaagcaa

SEQ ID NO: 8383 - DNA, 3000 bp, Unknown
  misc_feature (1)..( 3000): cDNA_ID_1989436_gDNA_ID_1971789_Annot_ID_58024 3000 nt of promoter + ATG
tacaaatgcgttggaaaaagatccaataacatatgatatgatcatatacagtaattcaataaaagaaataaacgttaatcttaagatttttagccaaaatgaatcattgaacggaccacgggagactagacgagtagatttatcacatatacgcataaatgtatgctaggttcaatgattctaaataaattggcagtacgtacatgtgtagccaatataaaagaacataaaacaaaatatctctaacaatacaaaagtgagaaggttgatattaataaattcataagaattccaagtggaagtaaagtttggagtacgactccacaaggtaagggacacacaaaagaatgagagacaaaggtctactatagaaagcttacgatcatatgatatgtccaaatcatctcatgtgggagcaaacctttctcataataaaaaaatgggtttattcattgtttctatttttaaattggattactttatcgtgtgtttatgtactataaacctcatactaattacggtgtttaattagtctttagagtcctcgtcgatgactagactgtatatatttattgttttttttggatacaattagccactaatcttaatatactataaacataaaatgaataagattcaagagattgaataatagaataaattaacaagaaaattatgagtaaacaaaacttagttgggccggggattagccatcgtaagtgtttggtaaatattattttcaaagtagaagaaaagaccaaataaaaaaaatagaaagaaagagaaatgaccaaacacatatcatcatgggtaaccatcataattccattttctcctaaaatttatattattttttcgatattttattcattgtcttagagcttgtttcctcgtaactcttatgaatttaggtaaggttgggtaggaaaagtaacagaatgtgtaaattagaagctttcggcgtaaaatgccaattttcaaataaaaaaagtgttataaagaaaagaaaaacaactagaagcaatgatcagtaccataatcttgtcacgtttagtctcgatccattgcaagtattatattttcttttataagtaccaccatcttaacattaaaccaaacaacaatcaatatagtaccaaagaaaactacaatctcatgatcattgataccgaagatggaaggattccggttcaaatttcatcacggtttattccggttaaaccggttttgcttactcaatttatatgtttttttttctttgttgtagagcaaaaaaggcctagagagagatttttggggtttttttattattcggattagagagaaaaataaaaagacccttttaatatcaaaattaggtggcgcgaaaataacgccctctctctctcactctttcctttttttctctctctttgatctcctcgaacccatcatcttaaatcgcccgatcaattctatctccggcggtctagcatttttcatcgccggcgaaacattttttaccaattctccagcttggctaatcaactccgatcacgttccgtattcccaaattcgatctcgaagggggacatagagaagtctttcgcgaaggagaatcacgagactttgattacttttggcactcttatgttttcttactggtatgattctctatctcccaacctcagattcattggatctctgattttaagcttctacatttggtttcatcaatcccaattttgattctaattcaaaatcagaagaaccctagattttttttctgggtaataataaatgcgatctgacgttcatgagttagatcattgatagaaactatgaatgaatctcatttcgtttataatttgtgaggattttgcaatttcatggaaaaattactaaatttgattggataaaaagagtctgtgtcattgagagacacaagtcgtggtgtcagtaactgacaaaatttccgttttggattcttcgtcagaaccatctcattcactttgaagaaacataataagtttgtgtttttttcattaccagattttcttctttcatcatccttcactttctcgagattatttctcaaatgatcaaaatttaatcaatcatcaaccggtgattttctctcggagagtgggcaccggttcttgattcttcaatccacgtggtcccatttttggagaaaacaccaaatatctgtcaaaatgtccatttttgctaagtgttaaactagttctatatattactactactacaaaagtacaaatctaacattgtgacactaattattaactttgtaagtttactgtttgcaaagtgataaaggaagtttcttttgttatcttttgaggtgttgtgatgttgatgtaaagaagaagaagaagattggtatatagattgaatcgaaaatcttcatttaattttccagcacatctgaccatggcacttccgtgacactgtaaaagattctttctctgaaaatcttgtttttaaaaaaaaatattcctgatattctgaaactgtagcagctaactagttagaactcaacccacctttctctccttttttgtctgtctctcttgtttgaccactgttttcctagttctacaccattttcttatctctttcactgttaagctctttcttgattattatagtttggatttgcttctttttttttgttttcttcattgtaatgatgatgaaattgtcattagtttgttccccttagataatacatgtgggagtggtttttgttgttgtaaaggtagaatcttatttacttttctttatctgggctgtctaatattctttgctctttttccgcatggcctatctgtgaggtatcttactttgtctcctgggttttgggtttcttgcagaataaagggacttcatttacagcaactggagctgtttttattgtttacctccaagcgcataattaaacgagaggcatgaagaactgctgaattcaatcaatgcaagtttgtttcgttagcttgaatg

SEQ ID NO: 8384 - DNA, 3000 bp, Unknown
  misc_feature (1)..( 3000): cDNA_ID_1989435_gDNA_ID_1971789_Annot_ID_58025 3000 nt of promoter + ATG
tcacacaacaaaatgacatatgtcattcgatattttttaaattaataaaactaataaaattaaataagcaaattaaatgtataatcaatcctactcttaactgatttctccaaagtaaaaaaaaaaaaaaaaaaattatgtaaacaaattaagtactactttcattatattctttttattttcttattttttattatcaatgactaatttttttttgtgttgtagttgtttgctacctaacctcttattagtttagtaatttaattttgagtctttgataactttgacattcaagttttttcaaataataaaccttcaaaatattagacctaccaaataatgtgatacacgatcatttctcttatattgatatatgcaatgacagaagatctaaaagtattgactttaatgatactttaatttttgctttctttttattcttttcatatgaatactcttgaaatcttatttattttatatcaattctatatatttaatcatgagcctataacaatgttgttggagtattatatctggagaataaataaaaccataaatagtttatttataatcaagttgaacaatttttaaatcatcaaggacacaatcatttctctaatattgatatatgcaatggcaaaagatctaaaagtgttgatttcaatgacgatcaatttttgctatctttttatttttttgtacgaatactcttcagacatttgtcagttgatgttaatgcaaactttaattatgagtgtatcacaatgttgttgaagtacataaaataaggaattgatttatttataatcgagttaggaaaattttaaaccacaaaagtaacataattacacagaattgtatcaaaatatcattattgttgttatatgtattcatgaaatgaaaaaatattaaaatcttataaataataagctttatacacaaaatatataaattgatatttcgagtcacaaataaatctaaccataaaaattgtaactattatgaatctaattttattaacaatacaaaaattaacaaatagaaaatataaattagcataaagaacaatcaatgtaatttttttaacaattttcaaaacaaacctacgcgtagcgtgggtattcatctagttctttaaacagaagcttggatcttggtgacaaggcttcaaggggtataccaacttcagggcctggaatggggccgtctcttaggagaatgtccttttacaaaatgccttgcttgattaaataatgccttgattaactaactaaggttcttttggatatatatgctgtgttggatcaaactctccagaaccaagatatagagaccattttacctgcttggataacaaagatatagagaccattttacctgcttgaataacgggttttgtagtgatacacagaaactagattgaagaacgagagacaagggaaaatccattttgcttctctatagcaatctgaagaaaaccacagcaaaaaaagtaccatatatagagaggctcgaacacaatttccagctcatttcaaacaaaagtatctctctaaccgaagataacaaagttacttctaaacaaaaaggatctaaggatctaagtctctctcaagtgatccaagtctcttcagtttcttagagtaggtttctcaggagtgcctgccaacgaagatgcacattatttgaaaatcttggacctcctctttctgtgtacatcctatcccatctccatacatgcatcacctcatacgctaaatcatttctgtgatattcaaaataactgaacaggtaatattcaattacttttgtttctattgctaatcaatactcaatagttactttgtccggaagtttaatccttatattagcacgtttataacatatacatcatttatagattgatcttcttttatcctttcgaagaaggtaacaacctcggtggatatagcgcaaatatagataactttttggtttgataacaatataaacacatgtgtactaactacaaatgcgttggaaaaagatccaataacatatgatatgatcatatacagtaattcaataaaagaaataaacgttaatcttaagattttaatttagccaaattgaggactactcaatccctgaaagtgccgatccttttttgatatacgagaaaatcaaaacagctattgtcaagcattctcttttaaggagtagcaaagtgaccatcctgatttacggtggtgctgagacgaaatggttgactgaatcgcaagacagactttgggattctggatttcaagtctttctctgcaaaggtgatcaattccttctctaactcaatatttaaaccctcgaatttatcttgtataactaagtaatctattgtatcttgtgtaactaagtaattttttttttcttgcaggggataaacgtgccttattcaacatgattataacccaacttgttttctggtcatggaactggaaggctccaacaaatttggcggtactcacagaaaacaaggaggagatggaacaagaccccaaatttttcagatttcgtcaagctttagaaaataaaggtttctttgttgccgtagaacaccctgagacactcatcaaccaagaaactgccgttgaagagccgccagatgactccccaataccttactatcaatatgcaagtgacaacactcttaagttggcttactggagcaaagaagatgatgaagctttcagatctaaacatgaagaagtttgaggttaagaacgcccctgacaacaatcgaacctctttttccttggcgcagacaaatcttaagttgtataatctttttttttggcttttacagtattgcgtttgtgctattttaagactgtcgctttgaaatacaattcttaagtcatccatcacacttcttgattgtggatttgacatgagcactcttagagtgtgtaggtacgttctgaaagacttctcttttacattgatcaactaagatttcagaaaatg

SEQ ID NO: 8385 - DNA, 3000 bp, Unknown
  misc_feature (1)..( 3000): cDNA_ID_2134074_gDNA_ID_1971789_Annot_ID_175535 3000 nt of promoter + ATG
ctgatagaatggagtatgcaggagtgctttgtctgcaagcaaagaacacaatggcggtgtgttaagtgtccaatggctgctcatgataaacattctccatggtcaaaagaaatacttcacttaaaagaccaaccaggaagagcagtttgttggaggcatccaactgattggcggctagacacaaaggttgattttttagtttaccgctttcataagatacttcttgaagcttcttacgatttgtactttcatagagttttactcacaggactgacaaaatctctgttgattgagcagcatgcagttgcacagagtgagattgaggtcagtgtttctttgccacgtgccaaatgtgactgtagtaaaggaaactaattcttacatagacttgccgctcgaaaatcaaaaagagggaagagatttgaaagctggatattttgtttttatcttacacaatttcaagagctaggcactgaatgtttatctactttcttattcaggaagtcttttgccagttgcctttgccatatgtggaagaggagtttaagattgacttagcatggaaagattctgttgtgaaggaagatccgccttcttatgtgcacattagacgcagtatcctttatagtttccacattcaatatttctgccttaaaagtacataattctcattttttcacaacattagtgtgtcttttccttgactgagttaagatatttacctcgttaagaaaaagcgtgataatgctaatgatggtgttgggtgcacaaattgtggccctaattgcgatagaagctgtgtttgcaggtatatttgttaattaaccaaacaaattttctctgttaacattcatttcgttttgaatagtttccgttttgaaaaatttctctcagggttcaatgcataagctgttcaaagggatgcagctgtcctgaaagttgtggaaacagaccattccgcaaagagaaaaagatcaaaattgttaaggtaaaactagtctctagtttatgattcttgcattacactcttcttgtgtttttttatcttgacatgtcatgttattggttttacagactgaacattgcggttggggagttgaggcagcagaatcaatcaacaaagaggacttcattgtcgaatacattggtgaaggtaaactatcttgatttggtctttgagccttatgtttgtggtggaaagcgacagagtttttagtgatttgttttcactctatccacagtgattagtgatgctcaatgtgagcaaaggctttgggatatgaaacacaaaggcatgaaagacttttacatgtgtgagattcaaaaagacttcacgattgatgctaccttcaaagggaacgcctctcggtttctgaaccacagttgcaacccaaactgtgtattggaaaagtggtaaagcatatattatttcatataaatatgtcgatgatgctcgagtaagagagcatgagtcagtttgattattttgttctaacaggcaagttgaaggtgagacccgtgtgggtgtctttgcagctcgtcaaatagaagcaggagagccacttacatatgactacaggtcaagttcttgaccatttgtttcttttatgtgcttataattagcctaagtaatctgagattctgatatattagcttctctctttgtgtaatggcagatttgtgcagtttggtcctgaagtaaagtgcaattgtggttctgaaaactgtcaaggttatcttgggacaaagaggaaagaaccaaactgtttggttgtatcttggggagcaaaacgcagaagattgtttcaccgacctatagcccgtaaaccgcagcaagattagctgcaaaatatctataaacaatgtgctttgatagtttgtctgttgtcgttatctagtaatctctgtggagatatagaaccaatcgtgcttgtaaccgaagcttaggcccacaattgtataactgctagctgaagccacgggatagaccggtcggttataccatacattctttcagttccattacaacacaattattatttaacccttgtcaaatttgaatctgatttaagaaaatacattcccttaaaaaaaactatctaaagatctcgcactatcatggcagaaaattcgacagaacaaattttttgatataaccaaacagaagaaaacaaattatataaagactacaatcatattacaaaatcgctatagcaatctaagtatcaagtttcatcatgtgactggtttcgctctgccttgagctcatcaggtgatcgagtttcagatcacgaccagttgattaagggtcggcctagtcccctttttttgtttttattacagaaaatacaaaagttacagagaatacaaggtcgggttgcagatcacgacgttacggatcatcgtggaatgtgggtagaaagactcataagactccatgaattcgatatgtacctcaatggtgcgaggatcaggtttcgggatacgtctttgttgttgttgaagtttctcgactttgttgtttgatgaaaatatgaaattaatgtattattgatagataagtaaacaacaaaatagtaaaacccaaagatgaaccaagtgacaaattgtgacaactacatggtagctatcctaattatcgaacataaatttttcatcaaaagtctttaacgaaccaagtgaatgacatgtttcaaagtcgaatactaattattgtactggtttaaaagatttgttccaaattgatatgatttaaaccagaagtctccgtatgaaacggagacttactcttcggcaagagaaggttttagtcaaaatccccattttttaaaaattctcaacaaaacgcctaaaaactgaaagtgcttattcctcttctccggcgaaccaaagatcaaacctttgcgagagaatttccctctttttcggcaacgagtatatccaatcagcaaggaattttatgatcgcttgataaattgaaactatttggagtgggtagtg

SEQ ID NO: 8386 - DNA, 3000 bp, Unknown
  misc_feature (1)..( 3000): cDNA_ID_2106236_gDNA_ID_1971789_Annot_ID_175534 3000 nt of promoter + ATG
gttaccatttagcactactgctaattgcaatcagcacacaacaaaaatgggatttgttatttgaaagcacttatgttgcatgtctactacttaaattagaataaacaatgtcacagaataaaaaaggaagaatctttacgtgatgcagagtttgatcgctggagaagtaaacatcttttgacattgccattgacggccatggccagcgaattgttgctctgtcattaggacccacaaatcccccaaaaagattgaaatttgtttaattttcctcaaaacaaaaaatgacgattttgacctcgagatttttcttacccggagagaaggctaacaaagccggcgaggccaagctccgtcgtctccattgaactcacaaccatcatccaagtaaatatcgcaaatccacacaaatgcctgccaaatttcaaaaccccgtttacaaattttcaaccaagggaaaaaaaaatcagaagaaaacgaaaacatacgtccagatgttgagagtctcattgtgccatgagaaagcgctgaggaaagtttctttgattgaccactcacatcgataatgattgtgtatgaactcgttatctttcaaatacctaggtaactcctcgaacttcatcaatctcttctcagatctcttcttttcgccggaatccatacctttaccatttcttatcttcgtagattccttcaccgttctccgtttctgcatgattcccctccctctctcgcacagctcgtcggggggaaaaggaggagaaatctagctacgaaattgaactccggcgaatcacccaccaccgtagatttctctcttcttctttttattttcagtatttgagaatctgatttgttttttttcgatcttcgtggtatgcttcgtcgcctacttatacggagatgaaacctctttgaattttaaaaacgagcaagcttcgtgacttttatctacgtagcgtctttgaccggtcttttttacacgtgtctcttccttattagtatgttagtttcgccttagtgtgagggaggatacacctgattatttttacccgccgtgtcaatttgaaacaaatattaaagttacagttggaaggtgagaaatgcagaatttgtgggtctctgtttaaacctatagtctataattattaaatcgagaactttgtttttacccctcaagatttttttgttgcctgacccttaataacattgttgagtaactaaaacatatattttcgtttcatttatacgtttcctaaatgatttgataatatggggagtgttgatcaaaacagattaaacgaacgaggtaaattgaaagagtaggtaactttttattggctttatggcataagattctccaaggagggttgattcataagacaagacaacacgtacatacatatctatatttaattggtatgaacatggattatgttattgatttatttaaaacgcgtcaaacaattggatataataattaaaaactgaatgaatggttcgcttaccaaagcaaaatatagttggcccagaattcgatgttggcatgttacgactacattgctacattgttatcatcaatgtttcagattatttttaatttgtactttcatagtaattcaccgcaatgaacgatgaggaaccatcgaatcggactaaacgagggtaacaaattttgagtagtaaagtgtagtaacaacaaatgagtgaacaaaaatcgaatggaaccgtacgaatatagtaataatttttgttgttcgcctgctgaatctcaaatgataacctttaggatctttttagcaaatgataatcagtttgtaatctagatttatttggagttcttcattttaaaatcaagataacgtggatccggtttgatccggtctaattcaaatttcataatataaatacaagaatatttcaacattagcctaaaaatacattaaagaaaagagtgtagtattttcaaaagatttgttgtatatcatacaaaatgaatgtatattgttttgtgtataattatatacaaagttgtcgtgaagtgaacatatattctagtttgcttagttggtccgtttttcatctaaatcgattcttagacgccataatttcttgctaagaggattaagtataaactatgtgtacatggatgagtaaattctttggattatttaacgattactcattatctttgtaaagtgtataaagaaaggtgagtattgcgtggtgaactgtggaaacctagactcaaagatcaatactttattagattttgttgctaaatatggtctaacaaagcaatttacgctaggtattttgtttgagtatagtaatcaaatgaaaactgaattatcgaaatttagacaatagacactaacgaaatgaaaaaaaaaaacgaaattaagatgttatacaaactgattaatccatttatctttcactagatgaaatcatagatcatttttcgtgagtctgtaaagatgtatgataaaaaaaagagagtaattaattaaaacatacctagaaagcatataatttgatttaagttgtgacataacgaacctaaaatgacatgtaaacatatccaaaaacgaaaacgaaatatcttgtttataactaacaaaccgaacactgatcaatacgatatactttcaaatcatgatttgattaattttagctatttgttcagttccgttttgggaaccggcattaatcattgcgtgtagcactgttattggtagatatgaatgtgggggattttagttggtaaagaaatttaactagcagaaaaaatgtttgggggcaattaaaacaatatttaaaatacaaggacctttttgtataatattttaggacaaatctcccgccttaaattccctccatattttttcatgtctcttcgcttttcgcctacccaacaaagacaaaacgtaactgtcttcttcttcttactcttccatcttttgtactttcgagtttaggatgttagatctgggaaac

SEQ ID NO: 8387 - DNA, 3000 bp, Unknown
  misc_feature (1)..( 3000): cDNA_ID_2134078_gDNA_ID_1971789_Annot_ID_175533 3000 nt of promoter + ATG
gccgcgaacagaacacgataagtcttcccccgggtacaccggcttatggcaaacaagacaatcaacctgacaccaaatcccatatagtcattatgtcaataaatctaataacttagtcactaattgacttgaagattcgaatgactttaaaagtaaactagtagtcaaacaatatctaaatgaatatgagatcttacacggacatcactaaagccaaaaaaaggtgatgaattcaattcacagatgcaatatacttcaaacaaacttcataactcaagatattatgtatatcctaaaatccaaatcccatgtagtctatatgtcaataaatctaaaaacttcacaagtcattaatttgacataacaaacaacataccattttcttggcaccaacaagaaaaggaaggaaacatgtcgactctgaaacaccagaagccactcttctcttgacccaatccttcacatgatcatccaagacaaaccctttcttgactctgtcagacggattctgtttccgggtaaaagcagtgactccattagcaattttaatgtccttgacctcttcctccggtggaatcattggtaaatgtttcccattgcattctccggctagattttccggggaattgatagatttggctaattcagggcctgaagccgccggaagaaaagaagggcaacaagtgagagcaacagatgcagacatagacatgtttcccagatctaacatcctaaactcgaaagtacaaaagatggaagagtaagaagaagaagacagttacgttttgtctttgttgggtaggcgaaaagcgaagagacatgaaaaaatatggagggaatttaaggcgggagatttgtcctaaaatattatacaaaaaggtccttgtattttaaatattgttttaattgcccccaaacattttttctgctagttaaatttctttaccaactaaaatcccccacattcatatctaccaataacagtgctacacgcaatgattaatgccggttcccaaaacggaactgaacaaatagctaaaattaatcaaatcatgatttgaaagtatatcgtattgatcagtgttcggtttgttagttataaacaagatatttcgttttcgtttttggatatgtttacatgtcattttaggttcgttatgtcacaacttaaatcaaattatatgctttctaggtatgttttaattaattactctcttttttttatcatacatctttacagactcacgaaaaatgatctatgatttcatctagtgaaagataaatggattaatcagtttgtataacatcttaatttcgtttttttttttcatttcgttagtgtctattgtctaaatttcgataattcagttttcatttgattactatactcaaacaaaatacctagcgtaaattgctttgttagaccatatttagcaacaaaatctaataaagtattgatctttgagtctaggtttccacagttcaccacgcaatactcacctttctttatacactttacaaagataatgagtaatcgttaaataatccaaagaatttactcatccatgtacacatagtttatacttaatcctcttagcaagaaattatggcgtctaagaatcgatttagatgaaaaacggaccaactaagcaaactagaatatatgttcacttcacgacaactttgtatataattatacacaaaacaatatacattcattttgtatgatatacaacaaatcttttgaaaatactacactcttttctttaatgtatttttaggctaatgttgaaatattcttgtatttatattatgaaatttgaattagaccggatcaaaccggatccacgttatcttgattttaaaatgaagaactccaaataaatctagattacaaactgattatcatttgctaaaaagatcctaaaggttatcatttgagattcagcaggcgaacaacaaaaattattactatattcgtacggttccattcgatttttgttcactcatttgttgttactacactttactactcaaaatttgttaccctcgtttagtccgattcgatggttcctcatcgttcattgcggtgaattactatgaaagtacaaattaaaaataatctgaaacattgatgataacaatgtagcaatgtagtcgtaacatgccaacatcgaattctgggccaactatattttgctttggtaagcgaaccattcattcagtttttaattattatatccaattgtttgacgcgttttaaataaatcaataacataatccatgttcataccaattaaatatagatatgtatgtacgtgttgtcttgtcttatgaatcaaccctccttggagaatcttatgccataaagccaataaaaagttacctactctttcaatttacctcgttcgtttaatctgttttgatcaacactccccatattatcaaatcatttaggaaacgtataaatgaaacgaaaatatatgttttagttactcaacaatgttattaagggtcaggcaacaaaaaaatcttgaggggtaaaaacaaagttctcgatttaataattatagactataggtttaaacagagacccacaaattctgcatttctcaccttccaactgtaactttaatatttgtttcaaattgacacggcgggtaaaaataatcaggtgtatcctccctcacactaaggcgaaactaacatactaataaggaagagacacgtgtaaaaaagaccggtcaaagacgctacgtagataaaagtcacgaagcttgctcgtttttaaaattcaaagaggtttcatctccgtataagtaggcgacgaagcataccacgaagatcgaaaaaaaacaaatcagattctcaaatactgaaaataaaaagaagaagagagaaatctacggtggtgggtgattcgccggagttcaatttcgtagctagatttctcctccttttccccccgacgagctgtgcgagagagggaggggaatcatg

SEQ ID NO: 8388 - DNA, 3000 bp, Unknown
  misc_feature (1)..( 3000): cDNA_ID_3045401_gDNA_ID_1971789_Annot_ID_175527 3000 nt of promoter + ATG
tgtttgtgacaaccgaaatagtgtcaagaacttcatatcactcggtggattactttatttgattgaatcttagttgataacgaaatcctttctttttctatgtatttcgattattaatgtaatcagaaaattttaagtattttttcacgttatccaactttgagagtactgtccttgtgttggccaataagtggttgaatatatggtaaaagtataaaagctcccatcatgttggacctactagctttgctatatataaaatgtcctgtcattgcataacgtaccactttctgaatctgttttacgtgcctatcaatgatttgtctttaacacttaccgtaatattctacaattaagttcaagtgcctagattttctaaatgtgtataaagacattatatatggcaaatgatcctttagataaccatttcatttaaatcaagcattcgattcgcattcatagataaaatactattcaccggtccagttctaactagccatccagtctggttagaaagcaaaattgtttattttattttaggttcagttttcagatcggttttctaacactgttttggtttggttctcgtatcggttcaaccggattggatagtcataaagaatttgaagtccttaattaagcccaaaacaagtagagcccatatatatactaacaaagccgtgattagggtttttggttttcgtcagaagatttcaaggtttagggtttctgcaattcaaccatggcagagcaggtttggatctacattacattgtctttatgttataattggggattgctagttgttggattctcgttttctgggttctttgattttggcttttaatgatggattggtgtgtttgcagacggagaaggcgtttcttaagcaaccaaaagttttcttaaggtaattgtcacacctcaaaaattcaactgctttgtattttggctatggtctctttatgcttatgattcaaatgttctatcagctcgaagaaatctggtaagggaaagaggcctggtaaaggaggtaatcgtttctggaagaacattggccttggtttcaaaactccaagagaggctattgaaggtactgtttttatgtctcagctctcaattttgctttaccatgtctagaagaagcttcatttgttaaaaaagttggattctttagagaacttagaggattttggtttagtgtctctaatttggttgttgagacattttctgagtaatctgattttagagtaatgccgctttgttagtattctcattgatctaagacttgggtagtagattggtggtatttgcccaattttaggagctttggggaaattgtttgacatagctatgttttttcttgattttatttgcaggaacatacattgaccagaaatgtccctttactggtacggtttcaatcaggggtcgcatcttgtctggaacttgtcacagtgcaaagatgcagaggacgatcattgttcgtagggactatcttcattttgtgaagaagtatcgaaggtaaaaggatcggttttgttattgtgttcaaattctctcagcttatttgaaaccctccagctaaatgcttaatcctaccagatatgagaaaagacactcaaacattcctgctcatgtttccccgtgcttccgtgtcaaagaaggagatcgtgttaccattgggcaatgcaggttaggagcactaatatctatatacttggtttttcgttcaaaggaattcatgctattgtataatactgcctgaactttgataccatctttatttatcacgcaagtttctaaacttatcaagttaacgattcaggccattgtcaaagacggtgaggttcaatgtcctgaaggtcattccggctggaagctcttctatcgggaaaaaagcattcactggaatgtaaaagagattcagatttgttgaaaaggtgcgaactagtattctaagagtttagaatttttctagcagagttattggattcgtttcttaagatctatgatcaaaggaaaccagattttctgtttcatttagtgattcaagtatcaagatatgtctatggttatagttttactccaatatatctagtcatgagttgctatctactagtcatgatttcgatgaaaagtggaattatgcttttgctatcttgatatttatctttgtctaatcgatatttcttgcttccattacattaatttctgaaaatgatatttaagagaaaacaatacagaagttgcataactccagggaatgctatgaacgtgcagcctcattctatgccatacatttatataaaagctccgattgcaccccttaagcttattaagtcatcttcaaaattagaaaaagaggtgcctaagtcatggcgaaaattagtcgaatgaaaacgacacaaaagattcttcatgtataatatacaaaaatatgaccccgtatttcacatggtatagttttttattacatcacttttccaaacgtaaagttaattaaacgttgagaaatgtgatgttgcttggtaacagctcaattctcgaaaacacgtgaaacctggcgcacttgcttctgtttcacatttgcatacaatttcaaccactaacacgcaaccatctccaaacgcagggccacgtttatctgcgtttgcgttaccaaagtcaatgattgacaaacaaacaaactaacactccaaccaatgacgagttttagataaggtattcgtgattttatacaatgcatcaaacagaaatcgaaccaaacacctccttaagttgtttcacggttcgaccaaccgcatcgaacgccaaattaacgagaagaggttgttgttagttgaggaccacgcacgatgggtgaaataaaaaagtccgaatcttttgggttcgttgagtagcttctgacgtcatttcgcacattctaattctaatattcagtctttaaagtcttaaaggatcttcattgtactttgaagtatagtttctgtaacaaca

SEQ ID NO: 8389 - DNA, 3000 bp, Unknown
  misc_feature (1)..( 3000): cDNA_ID_1808149_gDNA_ID_1971789_Annot_ID_175526 3000 nt of promoter + ATG
ttctttcgccttcgttgcacccagaagaatttatcctcttttttgctttttttgtttctatttaaaaaggaaaaaaaaaattaagctaaccctagaagacgcaaaagcagacgtgatacgacaaaggaacgcgattgcgtgaagagacgagtgtcaaagtcgaagaatttatccgaagccgcaacaacaaaggatcaaacttctcttcacgaaaacctctttcaccactatacttaaacaattaatatcctcaattttcttcttcttcttcttcctcttccacttcgcttcttccttttttctaataaatttttgacattttcaataatggaaagttgcgcagaagcttctaatgtaagtttactctctcacgcaaacaccagagtcgaagaaccctttcgctcttcttcatctgttgtccaagacaagacaagataaagcctgttttgttataaaaagtaattattttaatttaatatttttatgggggaacggtaattctgtaagtatttcagtttcaccccaatagttttgtaaatggtttaatttacccctaacagatttaaaatttacacaaccggttacatttggttcggtttatttactttggtttttcacaaaaaaaaacacataacgcaaccataaattgtactgtatatggttttgagtaacggtatcaacatgaatttcgaacatgtaaaatcacattggatatacacaaaaataacaacacaaaagaataacaaaattatctttttggttcctaaaaaaatctgaatcttggcgatacggacaaacaaaaaaaagttcaatacaataaaattgtggagccaataaattactttcatttcttttgataccaaaacttataaccaaccttcaaaaccagcataactctactcgttaatcttgttatattcctagatttgaaccatcgtggccatataactgaaagctgaattcattgtgtaagtaacgtatgatatgataatactatatgtgtataaataggtggacacatatatgtatataaactaaatttggcatttcctatcatatgatatgataagcttgattggcatgtgatgtggattggaccacacaaacacacacacacagaagatgtccataggccataggcggtccattattattggtaagaaatgattaaattaagtatgcaaacaacttgacattgaaaatgatcttctgaaagtgatatttcaatgttttcacacaatcttgcccgtaaatggttgcatttaattgttactagatagaaaacggaaaaaaagaacaatttttttttttgtgtttttgtttttaatctctttctaattatgtttttgtgaataactgtgtgtttgattaatatattgttttcgagattcatcatataatatttgttacactctatagatgtgatagagttatctactacaccaataagatataagaaggccacattttgattgtaattgtatatatgaatatctgtggacaaaaaggtaacacttcacataattccaaaggctacgtaacatcagattggttgagcttccacatgggaattcggcaaatctgtaatcttctgtatatgccaaatatgtaattcttagacttaggaaaaaatggtcatctcttcaataataatacttctaattaaatggtcctcactaaaacaatgtttacttaataaaacgtataaacaaatagattttgttacatataaaagtataacctaaaatgcatgcagcaaatttctggattgttagcatatagctcagaacaatcggaaacaagatgtgctgccacctgaaacaaacatactaatatatgattattaagttgacatgacctaaggggaatctcgtgagattcgttttttgacaacttagctttggatccagaatcaaacatagcccacacaaatgaaaataggataacatggattccacaaactcttcacactttttatattatatatagtacttgtgattttataatataaaataaactatatcaatgatattagctagatatttaattcgcgttgaatgtggatactacaagagtttgatagattaaattgattcaagcaaatattttagtgggaatttgtaaaacactacatcttcgttatcgacttgggtatgagactaagagacaatatatatatattctattaaaaaaactcactgttacatgcgataaatggatgaataattcttgcttaattaagtttgagtatattactttgtttgtgacaaccgaaatagtgtcaagaacttcatatcactcggtggattactttatttgattgaatcttagttgataacgaaatcctttctttttctatgtatttcgattattaatgtaatcagaaaattttaagtattttttcacgttatccaactttgagagtactgtccttgtgttggccaataagtggttgaatatatggtaaaagtataaaagctcccatcatgttggacctactagctttgctatatataaaatgtcctgtcattgcataacgtaccactttctgaatctgttttacgtgcctatcaatgatttgtctttaacacttaccgtaatattctacaattaagttcaagtgcctagattttctaaatgtgtataaagacattatatatggcaaatgatcctttagataaccatttcatttaaatcaagcattcgattcgcattcatagataaaatactattcaccggtccagttctaactagccatccagtctggttagaaagcaaaattgtttattttattttaggttcagttttcagatcggttttctaacactgttttggtttggttctcgtatcggttcaaccggattggatagtcataaagaatttgaagtccttaattaagcccaaaacaagtagagcccatatatatactaacaaagccgtgattagggtttttggttttcgtcagaagatttcaaggtttagggtttctgcaattcaacc

SEQ ID NO: 8390 - DNA, 3000 bp, Unknown
  misc_feature (1)..( 3000): cDNA_ID_3045409_gDNA_ID_1971789_Annot_ID_175523 3000 nt of promoter + ATG
ccaaaagtggcaaaagaaaacattagttgactagtgtgacacacaacacacacaaaaaagtaataatatatataatagcagagttttctctcctctaaaagtgtccacgtcactacatctttttaatgtggagcccacatgtttttactcgccttcacattttttctatgcgtgaaatagatttagtgatgtttatggggccacgatttggtcaaaaagcccatgagccaaagaaccaaatagacttagtgatgtgtatcgggccaagatttagtcaaaaaacctatgaaccgaaaggacctaagaaaacccagttaaaattgcaaacccttgatttcattttctcctattcgatcgacgcaattcagaggacgacgaaagagaaaaagagtgtttcagtcactgccctgttgatgcacgaatttcaacaaagtatatttgtaagttctttgataagggaaaaacattctcatcgcgttgaaggtcgggagttaggtcgttcttgcgataaacatagagtttattagttttatagctgcaccttgtaaaaggctgcctacgtacccttagaaaagggatcaagccatacgtagttcatattataataagtgagctaggtcatcgttggaggtaggtcgtatattgagataggcagtttagagatgaggtggcaggttggtgacgagctggcaggtaggcgaagagctggacgaacttagttacgaggcgaactggttgatagacaacgagttagacgaactgagtatttgagtgacgagctggtagccaggggccaagctcgacgaaatgtagtagagagacgagtcggacaaatcgagttgtctggtgaaaatctagacgagctgggagacgagataggcggactgtgtagtcaatggacgaactgacagctaggcgaggagatagatgagttaacttgagggacgagctgctgactaggtgaggaattggacgaactgactagctgacagctaggcgaggagatggtcgttgagtcatgtggagcttgaagacgatctgaagaacttaaagacgagctgtagagcttaaagacgagctgaggagcttgaggaccagctgaggagcttgatgacgagctgtggagcttgaagacgagctgaggaacttgaggacgagctgagtagcttgaggacgagcagaggagcttgagaacgagctaaggagattgaggacgagctgaggagcttgatggcgatctgagtaccttgaggacgagctgaggagctagagaacgagctgaggagcttgaagacgttttaatatggatttcttcctccttttttccatgcctctctatttatagaaaaactaagctcactacataaaaggtataatatggtactttaaccttgatcattgtgacgttggtctccaccatattggcatagcagctaacggaggccagcaatctacatgtatgtcatgctattattatgtagaggaaggactgaagagggaaaaacctatatgagccaacttgaatgggctaaagacaccaccatggctgaaacgtgttggaaacaaatcaaaacttcactaaatgggattagagtggcgagaaaaagattgtacatgatatcacttcgcaacatgaaaccccccgacgtgtgccatccaagagatttggacaacacatgtgagaaatgttttttctacaaacaaatgtttaagtttatttttatggtataacttaaacaaaacatttagagagttggaaactgtttttaaaaaattccctataatgtttgagcagtgaactatcacaaagactcaaaacaaagttattactcttatttcttttgctttaatgtgtgtctttccttgctgttgtaaggaaatttatatttacaataaaatcaaacttttaattaattatctaagcatatcgtactttcaatgttaatattgttataatccaactctttttggctaattcgcgaagagacgttgaaaagtgaaatcttcccaaaaccaaagagtagtttctaagattttaacagagacacaaagagaaaaaacaaatgggcgggttcatattgggccaaaattaacaatggcaacgatgtgtaaaataacttcgtcgttagtctctgttcttcgctatcctctgcagcaaccgcttaatacgagagagagagagagatttccattgtatttttaatttaaaataaaatatataaaaacaagaccaatgtaacaaatgcattgcttagatatatataactctaaaaaatattcttacaagatagtaagtttggtctattgtcctataaattctagcatataactggtaacaatatgaaaaaaaaatgtaaaactatacatagattacaaaaatgtagaaatcaaaaaataagattagcaaataacaaagatattcaccttttaatcaaagatcagtaaaaaaaatcgaagttataattacatactaacaaaaccaaaaacaaaccaccaacgcgcgtgtctcctccctagttaattaaaggcaaaaggaagacgagtaacacgtggcaaatactctatctgtagccgtcataaaaaaaattgtgggaccctacaccctataaatcaagaactactggttgttcgccagcgaattaactaaaatatttaataaacataagaaatgacaagtttagccctctttccataggcataacatggtggctaatttgggaatttcagcagcattcggagtcaaaataacgatagcgcgtgtcggtgaaatcgcggtatacgcgcgtcgatagccgccaggagaatcctttttttacacaatcaaagagagagatcccgtaaatgttttatactctgatttctagggtttgcttttgattctctttcgcgttccagataaataaatccttttgtggaataatttcgtgatttcgtttgtgggttatccgaattttgtctgaatttgagtttttgagaaggaaaggtttgttttttcggggg

SEQ ID NO: 8391 - DNA, 3000 bp, Unknown
  misc_feature (1)..( 3000): cDNA_ID_3056917_gDNA_ID_1971789_Annot_ID_175516 3000 nt of promoter + ATG
ctcttcagacatttgtcagttgatgttaatgcaaactttaattatgagtgtatcacaatgttgttgaagtacataaaataaggaattgatttatttataatcgagttaggaaaattttaaaccacaaaagtaacataattacacagaattgtatcaaaatatcattattgttgttatatgtattcatgaaatgaaaaaatattaaaatcttataaataataagctttatacacaaaatatataaattgatatttcgagtcacaaataaatctaaccataaaaattgtaactattatgaatctaattttattaacaatacaaaaattaacaaatagaaaatataaattagcataaagaacaatcaatgtaatttttttaacaattttcaaaacaaacctacgcgtagcgtgggtattcatctagttctttaaacagaagcttggatcttggtgacaaggcttcaaggggtataccaacttcagggcctggaatggggccgtctcttaggagaatgtccttttacaaaatgccttgcttgattaaataatgccttgattaactaactaaggttcttttggatatatatgctgtgttggatcaaactctccagaaccaagatatagagaccattttacctgcttggataacaaagatatagagaccattttacctgcttgaataacgggttttgtagtgatacacagaaactagattgaagaacgagagacaagggaaaatccattttgcttctctatagcaatctgaagaaaaccacagcaaaaaaagtaccatatatagagaggctcgaacacaatttccagctcatttcaaacaaaagtatctctctaaccgaagataacaaagttacttctaaacaaaaaggatctaaggatctaagtctctctcaagtgatccaagtctcttcagtttcttagagtaggtttctcaggagtgcctgccaacgaagatgcacattatttgaaaatcttggacctcctctttctgtgtacatcctatcccatctccatacatgcatcacctcatacgctaaatcatttctgtgatattcaaaataactgaacaggtaatattcaattacttttgtttctattgctaatcaatactcaatagttactttgtccggaagtttaatccttatattagcacgtttataacatatacatcatttatagattgatcttcttttatcctttcgaagaaggtaacaacctcggtggatatagcgcaaatatagataactttttggtttgataacaatataaacacatgtgtactaactacaaatgcgttggaaaaagatccaataacatatgatatgatcatatacagtaattcaataaaagaaataaacgttaatcttaagattttaatttagccaaattgaggactactcaatccctgaaagtgccgatccttttttgatatacgagaaaatcaaaacagctattgtcaagcattctcttttaaggagtagcaaagtgaccatcctgatttacggtggtgctgagacgaaatggttgactgaatcgcaagacagactttgggattctggatttcaagtctttctctgcaaaggtgatcaattccttctctaactcaatatttaaaccctcgaatttatcttgtataactaagtaatctattgtatcttgtgtaactaagtaattttttttttcttgcaggggataaacgtgccttattcaacatgattataacccaacttgttttctggtcatggaactggaaggctccaacaaatttggcggtactcacagaaaacaaggaggagatggaacaagaccccaaatttttcagatttcgtcaagctttagaaaataaaggtttctttgttgccgtagaacaccctgagacactcatcaaccaagaaactgccgttgaagagccgccagatgactccccaataccttactatcaatatgcaagtgacaacactcttaagttggcttactggagcaaagaagatgatgaagctttcagatctaaacatgaagaagtttgaggttaagaacgcccctgacaacaatcgaacctctttttccttggcgcagacaaatcttaagttgtataatctttttttttggcttttacagtattgcgtttgtgctattttaagactgtcgctttgaaatacaattcttaagtcatccatcacacttcttgattgtggatttgacatgagcactcttagagtgtgtaggtacgttctgaaagacttctcttttacattgatcaactaagatttcagaaaatggctgcttttgtctcaagtgttttgtatgtttggattctgtctccataaccaaaagctgttgtaagaggactgtttcgttatcagttgtttgaaatgagtgatgtttaaggcaccatagttgtgcttctctctgagtttaattgtttatcagttgctacataattgtcatctttatggtagattgtatatcataagcctcatgctctattcttccttgcatatatttgcatgatgtactctacgtcacctgctttctgcagattggatctatcatctctggaaagttttggtacgcgtatttagtgggatgatacattgatacccatctctattttcattattggcctactttaggcaaacaacagatttgctctgtaggaatgatgcaatcatttacgtttgctttttatttatttatagattcctgcatttggagcatacaaagcttctggtcttagtaagggattattgtcacacggttcagaggtgatcaaaattgtaagttgcatgcacttggatagtaccatcagaataaaatgaaaacttcggttctcattatacatgagaaattcaaaaacgtatcaaccgaaccggattaaaatcaacgattaatgtataaccggactcgagtcgattcaatttgaaatgaaaggataactcattagacacagagacgagctttttagtttgagctctctctcactatg

SEQ ID NO: 8392 - DNA, 3000 bp, Unknown; identical to SEQ ID NO: 8383
  misc_feature (1)..( 3000): cDNA_ID_1989436_gDNA_ID_1971789_Annot_ID_175514 3000 nt of promoter + ATG

SEQ ID NO: 8393 - DNA, 3000 bp, Unknown; identical to SEQ ID NO: 8381
  misc_feature (1)..( 3000): cDNA_ID_1989439_gDNA_ID_1971789_Annot_ID_175511 3000 nt of promoter + ATG

SEQ ID NO: 8394 - DNA, 3000 bp, Unknown; identical to SEQ ID NO: 8390
  misc_feature (1)..( 3000): cDNA_ID_1989432_gDNA_ID_1971789_Annot_ID_58031 3000 nt of promoter + ATG

SEQ ID NO: 8395 - DNA, 3000 bp, Unknown
  misc_feature (1)..( 3000): cDNA_ID_1989431_gDNA_ID_1971789_Annot_ID_58032 3000 nt of promoter + ATG
gcacgtaaaacagattcagaaagtggtacgttatgcaatgacaggacattttatatatagcaaagctagtaggtccaacatgatgggagcttttatacttttaccatatattcaaccacttattggccaacacaaggacagtactctcaaagttggataacgtgaaaaaatacttaaaattttctgattacattaataatcgaaatacatagaaaaagaaaggatttcgttatcaactaagattcaatcaaataaagtaatccaccgagtgatatgaagttcttgacactatttcggttgtcacaaacaaagtaatatactcaaacttaattaagcaagaattattcatccatttatcgcatgtaacagtgagtttttttaatagaatatatatatattgtctcttagtctcatacccaagtcgataacgaagatgtagtgttttacaaattcccactaaaatatttgcttgaatcaatttaatctatcaaactcttgtagtatccacattcaacgcgaattaaatatctagctaatatcattgatatagtttattttatattataaaatcacaagtactatatataatataaaaagtgtgaagagtttgtggaatccatgttatcctattttcatttgtgtgggctatgtttgattctggatccaaagctaagttgtcaaaaaacgaatctcacgagattccccttaggtcatgtcaacttaataatcatatattagtatgtttgtttcaggtggcagcacatcttgtttccgattgttctgagctatatgctaacaatccagaaatttgctgcatgcattttaggttatacttttatatgtaacaaaatctatttgtttatacgttttattaagtaaacattgttttagtgaggaccatttaattagaagtattattattgaagagatgaccattttttcctaagtctaagaattacatatttggcatatacagaagattacagatttgccgaattcccatgtggaagctcaaccaatctgatgttacgtagcctttggaattatgtgaagtgttacctttttgtccacagatattcatatatacaattacaatcaaaatgtggccttcttatatcttattggtgtagtagataactctatcacatctatagagtgtaacaaatattatatgatgaatctcgaaaacaatatattaatcaaacacacagttattcacaaaaacataattagaaagagattaaaaacaaaaacacaaaaaaaaaaattgttctttttttccgttttctatctagtaacaattaaatgcaaccatttacgggcaagattgtgtgaaaacattgaaatatcactttcagaagatcattttcaatgtcaagttgtttgcatacttaatttaatcatttcttaccaataataatggaccgcctatggcctatggacatcttctgtgtgtgtgtgtttgtgtggtccaatccacatcacatgccaatcaagcttatcatatcatatgataggaaatgccaaatttagtttatatacatatatgtgtccacctatttatacacatatagtattatcatatcatacgttacttacacaatgaattcagctttcagttatatggccacgatggttcaaatctaggaatataacaagattaacgagtagagttatgctggttttgaaggttggttataagttttggtatcaaaagaaatgaaagtaatttattggctccacaattttattgtattgaacttttttttgtttgtccgtatcgccaagattcagatttttttaggaaccaaaaagataattttgttattcttttgtgttgttatttttgtgtatatccaatgtgattttacatgttcgaaattcatgttgataccgttactcaaaaccatatacagtacaatttatggttgcgttatgtgtttttttttgtgaaaaaccaaagtaaataaaccgaaccaaatgtaaccggttgtgtaaattttaaatctgttaggggtaaattaaaccatttacaaaactattggggtgaaactgaaatacttacagaattaccgttcccccataaaaatattaaattaaaataattactttttataacaaaacaggctttatcttgtcttgtcttggacaacagatgaagaagagcgaaagggttcttcgactctggtgtttgcgtgagagagtaaacttacattagaagcttctgcgcaactttccattattgaaaatgtcaaaaatttattagaaaaaaggaagaagcgaagtggaagaggaagaagaagaagaagaaaattgaggatattaattgtttaagtatagtggtgaaagaggttttcgtgaagagaagtttgatcctttgttgttgcggcttcggataaattcttcgactttgacactcgtctcttcacgcaatcgcgttcctttgtcgtatcacgtctgcttttgcgtcttctagggttagcttaattttttttttcctttttaaatagaaacaaaaaaagcaaaaaagaggataaattcttctgggtgcaacgaaggcgaaagaagggggatattgattcggttgaatatttgatttggtgaatttcgcttaaatttcgagaattgagaaaatttcgtggtgggtactttgggataacattagctaacgctggattctgaatttgtgtgtatcctggtcgtgatcaggtctggatacttggggtttaaaggtcttctgtgaaacatatcaaaagctccgagattcgacgagggtttttggtgaatctggattttggtcaaggatcgaggatatagaaaagctctgtgcttttacagattcgtggttgggattttgtgttggagggcttttgattttggcagccttgcctattttggttcctaatttgattaggtgagtcacctttcttaatttggctgtgaactttggggtattgattctgtggttgaggatttttgggtcctttggtggttacgatg

SEQ ID NO: 8396 - DNA, 3000 bp, Unknown
  misc_feature (1)..( 3000): cDNA_ID_1989449_gDNA_ID_1971791_Annot_ID_58033 3000 nt of promoter + ATG
aactaacaccacaattattgagcacattcaaatgctgtcatttttattactcgtacgtacacatgaataaggtggaaatgtcatatttgggaaaacaccataaaacaatatgtatgtcgttcactttggtctcatataaacgctagccaaatcatacagaggtaatggtaatgtttttttatcgacggcaacgaaagtttatgctaatatgtttataaattacttttattgattaatatgattatctctgtatagttgtggacgtgtgtatataactgaccgtctaattaaagaaaaatttatcacatcacgtacctaaaagacgttcttcattaatccataattgctttagtgtataactaatcatctatttagaagttttttgttttacttttcctattgttaatgtttgaaagattagaatatatttataagaagaaatttataactttttagcaaaaaaaaaaaaaaaaaacttataacttatgaagtctttggtatgtatattaaatttgacctgatcacaagtaatgcacgtatattcacgatttgaggtacgaagcagatgaaaattgtactatttaacaaaattactaaactataccaattaccagacacataaaatctagataaagtggtcctaatttctgagaaagaatattcctgtgttcgttctttctatctctttccttttctgttgttacatttcccacacacaaaaaaaaaaaaaatctatttactgatctatgttaaataaaaatcaaaaggaaattgttttatgatttttattactttatattaatttaattgatgtaataaattattaaattaattcttggaaaattaatcaaattaacttaaatcaaacaaaatttagttaaactaataaacactttaaaataaaaagtttaatttgattaatttagtcagttatttattaaactaataaacactttaaaacaaatttagttaaactaataaacacttcagttaattattaaatatttatgagaattctaaaagattaatccttatgaaacagaggaaatatattttaagatagaaaagagatattaagaaatctcaaattaaaatacaactcatatttgacacccataagcaaaagatattataatactaaactacttatcaaagatatttcagtttattgatatgatcagaatttggtcaatttttctgtcaacaaagattggtctaaattaatgacctaaggaagcgaattaattcattaagaagactttttttctttctcaaaacttatgaaaattaacccacttctaattaatcatcaaaaagcttgaaattatttgtaaacgaagactagaaagagagaggggaaaaaggtatgacaaacagccttaaagttaaaggtaatagtaccttttgtttgttcttctttttttgcaaacaattttttcccttatttaattacgtttataaaccttaattcagattccttaaatacattgttaggactccataattagtaacggcattaggagcataaacaaaaattatgataaaagttttgatattatggaaataaccaaatatcttacctgtaaataaaataaagagatgtgaccaaatttaattgtggatttaattacattatctaacccttgaagaaactcaatgttttttgtgggattgttgtcctaaacctgaggttacatgtaatcaaaacattaatgggatttgaagtaaataaattagatttgcgccaaaaaaacaaaatctccattgattacagtgttttaatatggtcagataaaaccacagaagtggtaacgacataaaaaatcaccaccaaacataaaaccgtaagaaaagtttcgatttttattttctgcgatccaaaggtctagtgatgaattgaatttggtttttgtttttataattgaagaatgaagaaataaacagttgatgggttcttcgcttcttctcttgttgggttagtgataagcacgcctggcttctcatcattccctccaacctttctctctctaaaagacttcaattgttttatcagcttctctctctaaataaagctctcaattcaattctctctctttcacttttttttcctctgcttgcttcttctgttcatctttttgcttcgtcaaaattttgaccaaagttttgtacttttttgttgctgcaatttttgtgattagattggatctgggcttggagctgaatagcggatttgtataaggtaattgcttgaaacgtaccgaattgattcgtttttttgtttctctgagatttttcaatatctgggtcttagagtttggctgatctgattggttctctgagattttcatgtagataagtttgttttaaaagccaaagccttagtttttaattagtgagatagatttatgtagagagcatcaatgatcaatccttgagctttatcttgggttttgttatgttgtttattgaaaaatggtttgttcggtgagtatgatgattatgttcaatggaaatgttcttccttttctctcgaatttctgagttttgctttggtttcatataactttgtttgtttgtctggggaattgtgaaatttacataaccactacttccgatgtaatataaatatcagagcttttctttattgacagagattttttgacttgagatgaatgatgttgacccttgtggattctgagttgatttttgattctttctaattggtttctggtttctatttctattgatcagctgaatccaatcatggtcttttcagtagtgtatgctattggtgaaaatcaatattggtttcttcgccttgcttgtgatgccttgtctgctatcaaaatgtgtcatttgattggtttttgatagaattgatttgcatttgttgattcttgagattttaatcttagttgatgttgtctcataggttattattagtcttctctatcgttgcggcgttcataagttggagaaagtggtaaagactgcttaagt

SEQ ID NO: 8397 - DNA, 3000 bp, Unknown
  misc_feature (1)..( 3000): cDNA_ID_3409398_gDNA_ID_1971791_Annot_ID_58034 3000 nt of promoter + ATG
cttgagtctttgatttatttattcttggggttattttgatatcaaattgaggaaatttggtttcaaaagtcaaatttttatttagtgagatttcataaaaacaaatagactctgtaattttgttttgcagaagttgaggattgagtttttttttttttttttgtgtacagcaaagtgtacaaactaaattgtgcttcctaaacttcagatttctttattttactacattttctcataaatatagaaataccatttgttggccaaaaaagaacgaagaacgaattaccacttaaagtgtataaataaatatttttcaataactcatcaatctctttttctttgacattgtatatggtagctcatgcatgagacagacagtaacactcgaaaaggtaatactggaaaatcttgaaagtaacaacactcaaaaaggttacaaagtaagtaccgtgtaccgagaggtctaaagactaatacatagaagatgatagaaacggcgtcgttttcgataatcatggttagatgccatgtgactgattagagccgtcatgacttaaaaagttaaaactcttttattgattttgtgtattatattagtttataaaactttgatcaaataattcatgtgccaactagcgattgacctagtttttttaatcaaccgaaacatgagtcaataaaatgtgcaatgtaactctctctccctctcttttttccagagcaaattaactagttaaaatgattcataagactcatcacatattgccacatctctctatagttggacgtcttaacgaaccctaatgatttttaggctttttagcttgtcgtactctaaatgacaattatatataatgtacgaaactttctagtttagacttaatttgatcatcaagacagaactattcatctagctgaatttaatattcaacccaagcgataacacaactataatagcaattattgacatattgtcatcatgcaaattgtaaagtcactagtcattgatgtaagatctcttaacaaactcttttttcaatatatttctaatgtgaaatcggataattataatatgtagaaaagttgatacaatcatttactttcaaattaattatcgtctaattcatataaaatcatgcgtagttgtggaactttatttactactattagtaacttattttactgttataatgaaattttgcgtgaaaagcttcttacttgtgaattaattcgcatttggcattacagtgacatgccttgtcgcttttttccagtttagtgtttttttaatcgtatattcgtatgagagaatatcattaattaaaaacgttaaaacaaaacattatcaactcaattattgacaatattacagcatcaaggaacatgttcgtgaccgcgacgcccatttttttattaggataattttcttacattttgttttattgtggatcccttaataatttcatagaaaactaaaaaaactgtccctaatacggcaatcagggatttaatcattttcttaacgacgattaaaattaggtctaatacattacaatatatgtatgaaaacgttgcatcgtctcgcatgacttaattgtctcccaaacatgtagtatttgatgatctttgacgtaatttttttttgttagagtatctttgatgtatatatttatcatccaatttataattagtagtgtaatgatatcacaatacagttcttacattttgaatgacattggtttccagatttaacttcatatgtcttgccaagtaaaatttgtacgcattgatatagtatcatggtcctgactttaagcattggcgatgggtaatgatattaatgaaatatcggcgaaatttcttggataaaaagaaaagattcgtacgcatgaaaccaatatgtgatgttggttccatattcacatagcatttgtaaaatttagaataaaatcgagtttacgtcagagccatccaaccattaccattaaaaattggatgaactgatgaacaggttgaaccagaaattgtcactcaaagttagagcttggttgataggttcttaagactaaacagttcctcatcagtatgtaatataatgaaataatttaatctctttgtgtgtaaggtgttaactggactaccactagactgaatttttaattaagtcttatcctatagtcttttcaataagttcacaattgcaagtacttaataaacaaaataattaatcagttaattatgacaaattagtcaacatccgatcacattccacgttgtaaagttaaattttaaggtagatactaatcatacttgtaaaatgaataagatgagttcttcttcttgtcacctctcgatcttgttttaagtagttggtgagatgtgataaacttgtaacatgccactgagttgtcaaagacaagcatctatacagttattaaaaaaaaaggttaagcatgtaaaaatacacacacatgtcgtagtaaatatacacctttttataattaattatattgtaacgaatttgttgttttgttataatatatagattaatgcatgatgttttgcgattaaagccagacgagttgtaatatccacagccttgataagctctacatgcagtgaacaattttatacatttagaaaaaataatcactatctcgaccatatagaccaggccactacattacagctaatctctggatttacttgataattaagacaaatatagaacattaaaatactaactcgatgcctcaccttagcctcctctcaaattgtcaatatctagatggagtgttacatccacattcctaacagtttttactctttattttaatatatccttcaacagatcatcatcagaataatcatcaaatcattattatatatttaactagcccaaattgtaccatacctatcaatttaaatttctctttctatctactataaaaagtgactctctaagaactccaaagattagaacattgaattgaattagcc

SEQ ID NO: 8398 - DNA, 3000 bp, Unknown
  misc_feature (1)..( 3000): cDNA_ID_1989447_gDNA_ID_1971791_Annot_ID_58036 3000 nt of promoter + ATG
atattcgattcattttcaaattagttgaattgcaaaactacattaaattcaaatactgattggatcattgccagtttacgatatatcagatcgatgtcaagtcaatgatgtaaccgatatacatgtgtgttcttatttatgaccgtacgtactaataagattcttaagtcgaattaatacgttaaaacttgtgtgctatatatttcctttttatagaagactaattttatgaaatagcaacgcatatattacatcacgctataaaacagttttaacatcgccttcacgataatgatatccctaggattttacgagttttatattttagttaatgaaaatgtcaaatgcagattccatagatgtattgctaataatctgtatttctaattaataatactagaaatcccgtggataatataaaataaatggtataatagaatgtatgaatgtaattcatagatttataaatcacgaaacggcaacatttaccatacaaatttacagtgatgaagttctaaaatacattggttatgttcgaggactaactaataagagcaatgatctctaatcgacaagcgtgattgcaagctcatagtccacgctatcttctagtaatcatttaaatcaaataatttcacagtaattacattagttttctcttttctgaaattatcaccaccctagaatatgggttccatgattatatatgtgacgttaatcataaagattatctagcgaagttctggagttagacaaataatcggctatacacgttgttacataatagagtttcatatttaatattatattatatatatatatatatgtatatatatataaaatatctaatctataatgaagtcaagctctagcatatatatacaaaataattaaattgattttagtttcaatgcaggttgtaaatagtcgaagacaaaatgaatagaagaatataccaagtcaaaatgaagacttctaacataaatgaaagggcaacttttgaaaaagatgaatggttgcaaatttgtactaatgaggtcaacaaaatggtttttcatttttcagtcatatatgtacctatgcgactgtaaactccttgattattttaggactatgctagtagttatatgatatatggctattcagatgttcttttctatatgtatagtgtgcattaaggacaaattttgcctctttccttcatatatatgacatgataagtttttaaatgtgtttgtaagagtcatttaagtcaactagatgataatatattatatcttatattttaaataatttagttaaggttcatttgagctgcaaaattaaatacatagtgaacttattttactagattaccaaaattatattggtaaagaaatattgtggcaaactgtaaataagtgatgtctttttgtattttattcaaataaatagtatgatatatatgtaaagtatgttactgtatacaataatctaaaacttgttaccccatgataaaaaaatgtgataaataaaatcattttgtttacaatttttctatccatcatttgtgaaaagaaaagaaaagacaagaaatgattttcgtatcttgtacatattctctttacctaatttacgagacgtttgtttagacttgaacacttattaattaggacatgaatcctaagaagttaaaacgtagaggagttggaaatgacgaactttgtattattgggggacccatcacaatcaaaagtcaatttctcagtatatcttcagagggaacaaatttaattaacactatggtttttattcaattattaacatgtgacatcgttcccattgctgaccttgccatgaggcacaccttggaagggccaatattttcattatcaacgttagggccacaaataactatatatattaaaattactattctacaaattactactatataaattagtccgtcgtaactaattacgatccacaccaactgatataatgtaaaaatagtaagaaaaagtagttttcttacctgcttaatcaaggtatgtagtttttgttataagcatctctgtcaaaatttcagagatttaaagtgttttggcttggagaagtatttgtatggttgagaaagaaaaaatggaaacaaaaccgaagtaacccattattgcttatcgaaaaaacaaatttagaaaaaacgaacctaaaccagttggaaaacgattttgttaagaaaatatagtattagttgaaattttcagaaagaaatatctttctttaaacaaaacctaataggtgtccaaaaaaaaaaaaagaaaaatgaagaagaggacaggctaagcagcaagtagtatgttgcttagtcaaatataaattaaaaaatccaagcaatgtatacctccaccaaatatttctttcttgatataatgattcatgacaaaagaaagaaaaaaaacaccaaagtctatgatctagtaattaaaaaaagagatattacaaattagtttctcttataagctacttcctccttagagtcccttttcaaactactataaaacatcaaaatatctcaaaataaaaagaaaataagaattattaacggtagaaaattttgttgtttaaaatgaacaattattccataattaaagtgtaattaggacccacaaaatatatacaaatttgattcgggttcataagccaaaaatattacattaatcaacggtcaaagggtgattaagaacttaaagaggcagcaaaataaataaaaagggtaataaatatagagagactacttggtaatgggacccacatagccaaaacggcggagaaaatcgtcgtttttagtggcttataaaaagaggactcgtatcgactctgcaacagaaccacctaatctctcctcctctccttctctctattttgccggaatacatatgatcgagtgaaacggcggacaaagctgtcgtgttgagtactaattcgccgtcgtttttctcagtgaaggagtggtgagagatg

SEQ ID NO: 8399 - DNA, 3000 bp, Unknown
  misc_feature (1)..( 3000): cDNA_ID_1989446_gDNA_ID_1971791_Annot_ID_58037 3000 nt of promoter + ATG
tttcaagtttctgccgacgtaaaataaattgtttagcgtgttatgccaaaactcaggccacttttatgaaatatatgacagaaaacatatataataattaagtcaggtgtgcgtatccactagaaacaatttcacacctcccgacttcgatatgacgaaaccactagactatattcactactttttgcaaccttgtttaatctgcaactaaccacgaaatacaaaataaaataaaatgacatgttttgacgagtctaaaaagggctatggcatgaccaaatttgatcttgatatttgtttttacaaacttaattagcattctgagtttttgatctcatcatccatagtccctcgaaaagtaaaataaatactattcacgaccaatgctttatttcttgaaactaatgttatatagtttgctcaaagacaaaatattatgaaatatatgtgaatgagatttttttatcacacttttcgtacttaccccatgcaatgattcatgatttgtttttctttttttgttggtaatgccatcacaattcacaacccctttagggaccacatgagatgataacattaaaattgttatagtttaatattcttttatatatatggtatgttgccacttgccagtccacattattcaatacttccaccattaagtctaacagttttttttgcatacatatataggattctttgtcaaatacagctcgtaacaatgtaccatgcacgacttccgcataaaaaatattcattcaatcatcccaccaatacagatgatggtgttacatatattcatttatgtaaaatttattatcatcaaagtaagacctatttcgatcgtatatttcgcactactacataatgctttggatgtaaagtagccaaaaatggttgttacgacttacgactgtgcacaccgaacataaaaaaattgatctaaaattcttggacgctttgattttggctacaccgattaaacatgtcaatgaaaagtcaacgggatttttggcttacacgtacgtaggatcaaacaattttttagacataacatatttgtcattattttgaatcttaagagctgttaatttgaaaaattataaacctcactttttcaatataaacatgtatgttatccgtactaatattagctagcttttactatggcatagctatagatgattgctaactaggttaggtggagattcaataacaacaaattaaacgatacgaaagaagcatgaccatgtactttacttatcttcatatgctagctgttgctaattatatgtgtttcatttatcgtctttactaatcgctaagtctaacgtaccatatattacatatttagatcgtaagtttcatgtccagtaccttgattcatgtgaccatatctgtatactagaaacagttcgtctgacgtaacatattttggcataataaaaattatgggtacacgattgttaaccgatgtaaatacaaattaattaagagatgtagaacttttagacaataaacaaaacataaacgagaaataaactacagatacagtacttgaaactcttgaactcttcgtgatagctagaaatagaaatctgcgtcttcacagttgacaagaaacctagaaaaacagattaggtgtgctattaacggtcagattattcttatataagttcgatatgcgttctcgaatattattaatttaagctaaactagacccaaaactccaaaagaatccaacatgtttatccatatctacctaagactacttgtgatccaaataattttcgaaaaacaatatttctgtattgataaataaaggtcaaattatcaattaccactaatatatgtttttaaaaaaaaatttgctacaatgtttttgcaggtgtactgtgttaggcacatgtcgttttatacccttcaaatccaagtttttcccgtttgtgatgatagccaatgctcccgtaacacacacgtatacaaatttgccaatgtctatctaacacgtgttattacgcaacatgcttattccaaaataaacaaattaagatgagataagtgtcacataattatacaatatgaaataatatcaattgcatacctattttatatacgtgagtgactcgtaggaagtagaaatcctctttgttttattaggagcatatatcttctcaatttactttcttttcttaactctcacgaatcctcttttaatattttcttaactctcacgaaaacaattccttttaaactttgaaatttccttaaaattgaaaagttcctatatatgaaactgaaacatgatataattgaccatcttatatttcactttctactataaaacaattcaaactgtaaaaagaagaagaatttactaatcaatctcaaaaaagtaaaataaaatttaaacacacagaaaattacgaacgttacgaaaccaaaatcacagaaataacgtgaacataaaaaaagggtaaaaaattaaaataaactcttttttaccctttttgggggcccaccagaaaactgcatctcttataggcctctctctcttccatagacccatcttctttctctttctctcttcctatctcacagcgacaatctctatctctctctatctcttctccgctcacagcgaatctctctctctctctctctctctctctcttctccggtgtattccgttctccgggaatttctccgaagagggagagaggaaaaaaaaaacgtccgattcaatctcttcgttgctcgacgaatttttcttaagctttccttattgggtaactttctttccttttatacttttttcccgatctctctctctctcctctgttttattatttcactcccaaataaaagtttttatttttttccattgttttacctaatttttatgttttcttcacatcgcagagatttgaagattctgagtggttgttatgataatgtgggtttgattagttcttcacacacagcttctctacgctcatg

SEQ ID NO: 8400 - DNA, 3000 bp, Unknown
  misc_feature (1)..( 3000): cDNA_ID_1989445_gDNA_ID_1971791_Annot_ID_58038 3000 nt of promoter + ATG
tagactgtaattggttgtatattatgtctatactaatatactgttttttgctcacatatgtatacagtttttcatttctacagtagaaatgctttaattttgtttttattacttaaaccagtcgacatatggtaatttttggtgtcaactctgatagttgtcaaaatgaaaaaaggcaaaaaaacaaaacaaaaaactgatcttcgcaaacctatgaaggagttttggcatttttaattttttctgcattaagaaaaaaatattgatacttgagacttttttttcttcaaatttccaagtatttgcctcaactcaaaggacctcaaaggtctaaaaagaaacggtagggtcaagttcaatacacaaattcacaatcgaattcaaatatattgaaaataaaatgagaccaaaaaggccggtcattttcaaacaattgcagagtacaaatattttatgttaataagatgttttttcttgggcattacaaactttattttgttgataaaataacaacaaacaaaacaacaccaattgattaatacataaagtttgatgggaaatggatgaaccaagtgattaagatctgtccacgcgggaagtgttggattcatatgattcacagtttccctatcaaccactgaaaaccatattgcttcatcaatctcactacgtgggttttttattgcctttctctcatttgcattttgagcccaaccaagtctatttattaatcactttttttgtcgatatttattaatcacttttctctcatctataaaccactttgtagttatatttttttttgtcgtaaaaaaaaaaaatagcaaacaatgattgatgaaaattgtcccaaacaaaaaaaaagaggattgacgataataaagatgcaaaaacagctttctatttctgtcagcatataaggattttatagaattcaaacttatatttctacactaagaaattaaagacttataggtgtaatctattacttcacagttcacacttttgatttcttatgggaatgtgttttcgtaaagggcaatatggttttaggcattcatgtgttttggatgagacgctactaccaaaagaatatgtcgttactaaaaaactatatttttgacacatgctgttaattttggatacatagaaggtctaagagattaataggaatcgtttttatctagtttctaatttagttcaaacgttgactactccaaattttcgttgtagagttatttattgaaatagtcatcgattttaaattgggtaatactatatccgatcgaactttaatatgaaatatgaattatgctacttatgagatgcgataacaaatttctatagtttagcgatcttttgttcatgttatttagagtttggatttaaaaaagttatgaaacaaagacacgtgtgttgacgggttgtggtgtttgatttgccttgctttctttcttctttgtgatgaagaatctctttggagatccaatatattgtttttggaagtatcacgacggtgacatgtataggtcgatcgaggaaacgccaatgataaccaaattgaggctgtcgcaactaaatgatcagtcgatagtcattattaatagtatagttcgattaaaaaaaaactttccaagattattgttaccttgtattttttttgaacattttctaaaaatgatatcttctaaacttagataattcaacctatttgtggtatcattaatttgaacaactttgacatgcaagtggttggccatactccatactacaagtctacaacatgtctgcgctaggaactttcttactatacttcatttttagaccattaatgttattgcttggtcttttaaaatgatagtaaattattattttatagtatctatcgtatattattatttacatcgatcataaagtgctggtttacaaaaaatatttttaaaaagaaagagtcaaagttccttccatatttgaccaaccaagcttgaccgactcgattcaatgggtccaaagtcatagtggtcgaggtaattggtcaatcaaaacaccacgggctatatgaatctcgcttaattgctaacacgacgtattgacaaattttccattcgtaatggtgcaactattcaaaaacaacaaatacttgattttattttgaattttattagtgtttgccaaatgattttagtccaccaactaaaaaatatagaaggagcaatagcatgccgctaacaagaaaaaaatagacatcttacaaaaaaatgttttttggtttgaccttagaataaatgtatttagttagcaattctaatttaattaaaaaaaacaacgaaattatcaatatacaaaatacaaataatgctacataattcgcttaagaagaattcaactattttattttacccaaacaagttaattcttacttttttctattttgctcttaatttcccattctgattaagaaacaaatctcatatacttttctatttttgttagacatgaatttcaaatatatatcttacatttataaaattaattttcaatcaaaaatcttgtagtattatacaaccgtgatgttcctaaaaaatacctgtcatacagctgttatgcttcttaaaataagataaaattatatttactgtattaagctagattgtcaaaaattaaacagcaagataataacgtaattaaccatcgttaatatcaaacgcgttaggtcggtttgaccggtctggtttggtgagcgctggtaataatttcaccatcccaatcaatcacagacaaaattgaaaaccccaattaataatacataaaatgaaaaacatgatgaattataaattaaaactctgttctgtctcaaaaaactcaaaaggagtctctctctcacctacaccacacctaaccaaaccccctacgattcacacagagagagatcttcttcttccttcttcttccttcttctttcttcttctttcttcttctagctacaacatctacaacgcc

SEQ ID NO: 8401 - DNA, 3000 bp, Unknown
  misc_feature (1)..( 3000): cDNA_ID_1015869_gDNA_ID_1971791_Annot_ID_58039 3000 nt of promoter + ATG
aatatcgatatttcttatactaaatgacgatcctatccttcttaatcaacggcagagcaagtaaccgcgcacaatgttcgtaggaataatatagtaatttatggatgaggaacccaaaacggcgccgtagcagccacgcttgtgggcttcttgcaacttaaagcgttgagaaacctccaagaaggtgacggtgatggcgaccgagatccacgagctctcctgttagcaggagatggaaacataaccggtggaatattccggcgaatctgacggctctttatatccttgagttcgatctccggcggaaacttaaccattccaaacatgatcacataccatcttggccttacactttttacacttcccgaagacgttgtttcaggcttccccgtgtttttagtcgatgaactattttccggtggagaatgtacggtggttagaccacgtgaaagcttacgataatctaaagagcggcttgccctcataggtcccgcattgtcacgacgtgccacggtacaactaccgggacggttaagcttatggccttgtatcgcggataaggactcagaccgtgaacggattcgacggctaatgtgctcaggaggtgaaaagaaagcattttggtagtttaaagggatgagtttcccgccaaagattatattttctgccggagctacgtcgtaggaggatgaggttagaaactcaaaaagttccgttgacggttctttgtggtcttcggtggtggtgggattaggattcttggctttgaggggaagatctcggagagatagtgcgtcttctttttcttcttctaggtgatgttgaaatggttttgggagtttagtagggttttggagattagtgttttttgtagtttccatgttttttagggagagagagagagaagacaatgaagatattgaaagtattaatttttgtcaccatatatatacatggtctctagaggggtcaaatacttttacagaacttaaagtggaaactattttgttttacgggttagaattctttaggtgtatttatatacatgcatatatttgtagattgttgaccatccgaagtttccgtttgccaaatttctcatgatttaattatttcaggtcgatatatgacatattatgttggtaataacaataatacaattttaatgacaagaaagatagcaaatcttacttattatttattatttaaccacacaaagtgtctattaatattaactaactctagttttcatatatagttttaacgacaagaaagataagacaagtaactctagtcttcatatatagcattgatcatttattcatgaatctttccgatttttcagcttagaaaatttagttattcaaaagcatggtcaagaatgatagagatagaattattcaaacacaaattaataatgtttgaaaatttgagatttacatttcttcatgatgtaaaactttgattgaaatgcctatattttttaaattctttgtcaaagactatatgtttatacatatgtacataaatgtaccacgatcacacaaatttgcatagatttgtacacccaaccggtaaaataaaaagactgtgcaaaaagctaactgatggtattgtataaaatatagattcgacatgtcaccacttctatataaatatatataagaattagcgaaacacaatctaaaaatgtttagacaattttctttaggtatattttcgaaggagcaagtttacacacaaacaaactgtatgaagcatattgattgtgaaaaaagatagtcgagactaattcagaagaagactaagacattgtgacaaaagtataaaaaataagtgctgaggtatgaattgttgcgcgtaactgaggtcagctgagaaaatgactttcgcctggctgctaacatttcgtttcggacctttcggttattacaaacattaaaacgatgattataattatattctagactatagtttttgatattttcaactatccaattatagtttaggtatattaaatcgaggaagtggaagtgtagtgattaaagaaactcaattgttagagaaaaaaaaactaaaggaattagagccacaattacaaactatccactttgttttttcgttttcaacgtacatcaacttacgctgcaaggcacaagtcataagtaggttattcatatacattgcttgactacaaagtttgatttgttttccctttttataacaatttcatatggtgcgatgttactattttgcctttaaacgcaaaaaagtaagatgattcacatctatagcagttcacttcaaatgtttttttgttcaaaaaataaaaatcatgatgtagataaccttttctattagcatgctgattttataagcgttttctttatcatagtaaacatataatgacgtgaaaaaaaaagtaaacatataatgacttgtaaaaaaaataaaaatgaaaagacctcaaaaatgaaaaatactttgcactagatgatggatgacctcaacagatgagtggttcacgttcacctaattctttggtcatatatgtgatgccaatcgttttagttttgatgtaataattatagaattctaatggaattatatataatctaaactaataattggatggtcaaagagtagaaagccggctaattgttttaaaggcaagctgacaaaatttgatcattgtgtaaagatgaatgcaatataatggacttttgttctcgagaaaccattcttcttgccggttttatgtcattaggttggaatgcatgtcgtttttgtcatgtattatttgttttcacttttatggagatttcacaaagcaagccagttgaaccaataatgggccttatgagatattttcgcaggcccattatcttctgtacagcaacgaataaacccagccaaaaaccctaaatcgagagaaaccacaagcgtatcgatatttgttctcccagatcttcgtttcgtctcttcgttctcaaactcatg

SEQ ID NO: 8402 - DNA, 557 bp, Unknown
  misc_feature (1)..( 557): cDNA_ID_1444514_gDNA_ID_1971791_Annot_ID_175574 3000 nt of promoter + ATG
aaattattaaagtatatcctagcatttactaatagaagagtctaattttaattttgttattgctcaaacacagtatataattttagagatttctttggtttacgtcaaaaaagtctgtctcaattttaatattttagtcggtcatcagtatcgtccaaacaatcattttacttttgttatgataaaatacggaattcctcccctaatgacaatcaaattcgaattcaaaagagctaaacaacatatttctaacaaataatatgctcatgcatgctaatatttactgtaacatttaaaaaaattaaggatggtaaacataatctgcttaccaaatgatggagatactcaagagtccagctgtaatacatcttgcatgcaatatcttgatattagcctccttttgttcacccactctcttctcttcttcttctcatttatttatatgttaaactctctcccactatatatatctctcccccttcttctctcttcctcacattcctcaccaaaccctctccaaaacacacccacacgtacgcacacacacaaagacaatg

SEQ ID NO: 8403 - DNA, 2283 bp, Unknown
  misc_feature (1)..( 2283): cDNA_ID_1989441_gDNA_ID_1971791_Annot_ID_175573 3000 nt of promoter + ATG
aaattattaaagtatatcctagcatttactaatagaagagtctaattttaattttgttattgctcaaacacagtatataattttagagatttctttggtttacgtcaaaaaagtctgtctcaattttaatattttagtcggtcatcagtatcgtccaaacaatcattttacttttgttatgataaaatacggaattcctcccctaatgacaatcaaattcgaattcaaaagagctaaacaacatatttctaacaaataatatgctcatgcatgctaatatttactgtaacatttaaaaaaattaaggatggtaaacataatctgcttaccaaatgatggagatactcaagagtccagctgtaatacatcttgcatgcaatatcttgatattagcctccttttgttcacccactctcttctcttcttcttctcatttatttatatgttaaactctctcccactatatatatctctcccccttcttctctcttcctcacattcctcaccaaaccctctccaaaacacacccacacgtacgcacacacacaaagacaatgtctcctttcaaaatattcttcttcacgactcttctcgtggcggcgttttcagtgtcggctgctgatttcaacactgacgtcaacgtagcttggggaaatggccgtgggaagatactcaacaacggccagcttcttactctctccttagacaaatcctctggttccggttttcaatccaaaacagagtatttgtttggaaagattgatatgcagattaagcttgttcctggtaactctgcaggaacagtcacaactttttacgtgagtttatatattttctttaggagttttaagtgattttggatttggtttttatattgagacttcatcttgacatttttgtgtatttgcagctaaaatccgaaggatccacttgggatgagattgattttgagttcttgggtaatatgagtggagatccttatactttacacactaatgtttacactcaaggtaaaggtgacaaagagcaacaattccatctctggttcgacccaaccgccaatttccacacttactcaatcctctggaaccctcaaagaatcatgtaaagacaacaatctcacctttcttgctacacacgttaataaaccctaactaggttttcgatttttcttacccatctcttatctgttctgttttctatcagattgaccgtcgatgacacacccattagagagtttaaaaactatgagtctctcggtgtcttgtttccaaagaacaagccgatgaggatgtacgcgagtttatggaacgcagacgattgggcaacaagaggcggtcttgttaaaactgattggtctaaagctccattcatggcttcttacagaaacattaagattgactcgaaaccaaactccaattggtacactcaagaaatggattcaacaagccaagctagactcaaatgggttcagaagaattacatgatctacaattattgtactgaccataggaggtttccacagggagctcctaaggaatgcacaacaagctcatagaatctcaaattatattctatttatttatctacacttcctctctttcttttatgtgaaaattgtgaatgctctgtttatagcttgtctattatgtccgagaatttctttttctgtttttgattcttttcgttgtatatctttgtccaataaaggaaatgatgtgtctttactcttatagatatgtataaaaagatgtccctgttttatttgttaaaaaaaattgtttatgataatgatagttctttcttcttcttcttctttttttctcataaaaaaaaaatgatagtttcatttgctttatatatatacataattaatttacttacattgtaagaaatatgataaacgtgttgaatgcttctttttcaaatccaattattgaaaaaggtcaaaatatcaaattttatttattatagaatgtatcaaaaacttacaataaaaaactctctacctgagttttatctcaattttattaaccaatcgcatgctttcatagaatgagatattatgaaacgacgtcgtttagggtaagaacattacgtcacacgtttattttaatattattttatcatcgccctctttgtaatttcgacttctcttcttcgtcagatctgaatcttaatttcccccaaatcaaagcttttgacctaaatccgtttcccgggaaaaataaatcaacaaaccatcaccggaatcttcaatatctctccggtgaagaaaaaatg

SEQ ID NO: 8404 - DNA, 3000 bp, Unknown; identical to SEQ ID NO: 8401
  misc_feature (1)..( 3000): cDNA_ID_1015869_gDNA_ID_1971791_Annot_ID_175569 3000 nt of promoter + ATG

SEQ ID NO: 8405 - DNA, 3000 bp, Unknown; identical to SEQ ID NO: 8400
  misc_feature (1)..( 3000): cDNA_ID_1989445_gDNA_ID_1971791_Annot_ID_175568 3000 nt of promoter + ATG

SEQ ID NO: 8406 - DNA, 3000 bp, Unknown; identical to SEQ ID NO: 8399
  misc_feature (1)..( 3000): cDNA_ID_1989446_gDNA_ID_1971791_Annot_ID_175566 3000 nt of promoter + ATG

SEQ ID NO: 8407 - DNA, 3000 bp, Unknown; identical to SEQ ID NO: 8398
  misc_feature (1)..( 3000): cDNA_ID_1989447_gDNA_ID_1971791_Annot_ID_175562 3000 nt of promoter + ATG

SEQ ID NO: 8408 - DNA, 3000 bp, Unknown; identical to SEQ ID NO: 8397
  misc_feature (1)..( 3000): cDNA_ID_3409398_gDNA_ID_1971791_Annot_ID_175559 3000 nt of promoter + ATG

SEQ ID NO: 8409 - DNA, 3000 bp, Unknown
  misc_feature (1)..( 3000): cDNA_ID_3092444_gDNA_ID_1971791_Annot_ID_175556 3000 nt of promoter + ATG
gaatttaaataattatattttattttaaaaaaaagaaattcccaatgattgtcaaagctttgataggccacagtatcttgcctattcacggcggctccgaccatcagtttccacggtgccggcggctatatacgatagtcgttgtgaagaaaaaggtccttttcgtcaaatcattttacattggagccgaaagtgtgtactttactttggtcggtttttgatattttatcattactttattctgaaaataaaattaagtttgatgtattcatttcttgagactttaaagacaatagtagaatatatattctccttgttataaatatgattgggtgacatggtacgaccgcgatataaattctatatatatcatcaactctgatattaagaaaaattacgataaaacgaaaggatataaaaaaatagtcaaactttagcgatataacaaaaattattgattgtacaaagttttgtattgctgtcatattagaccgtaaaattttatgacgatcccaattcccaaccctaaactaacaccacaattattgagcacattcaaatgctgtcatttttattactcgtacgtacacatgaataaggtggaaatgtcatatttgggaaaacaccataaaacaatatgtatgtcgttcactttggtctcatataaacgctagccaaatcatacagaggtaatggtaatgtttttttatcgacggcaacgaaagtttatgctaatatgtttataaattacttttattgattaatatgattatctctgtatagttgtggacgtgtgtatataactgaccgtctaattaaagaaaaatttatcacatcacgtacctaaaagacgttcttcattaatccataattgctttagtgtataactaatcatctatttagaagttttttgttttacttttcctattgttaatgtttgaaagattagaatatatttataagaagaaatttataactttttagcaaaaaaaaaaaaaaaaaacttataacttatgaagtctttggtatgtatattaaatttgacctgatcacaagtaatgcacgtatattcacgatttgaggtacgaagcagatgaaaattgtactatttaacaaaattactaaactataccaattaccagacacataaaatctagataaagtggtcctaatttctgagaaagaatattcctgtgttcgttctttctatctctttccttttctgttgttacatttcccacacacaaaaaaaaaaaaaatctatttactgatctatgttaaataaaaatcaaaaggaaattgttttatgatttttattactttatattaatttaattgatgtaataaattattaaattaattcttggaaaattaatcaaattaacttaaatcaaacaaaatttagttaaactaataaacactttaaaataaaaagtttaatttgattaatttagtcagttatttattaaactaataaacactttaaaacaaatttagttaaactaataaacacttcagttaattattaaatatttatgagaattctaaaagattaatccttatgaaacagaggaaatatattttaagatagaaaagagatattaagaaatctcaaattaaaatacaactcatatttgacacccataagcaaaagatattataatactaaactacttatcaaagatatttcagtttattgatatgatcagaatttggtcaatttttctgtcaacaaagattggtctaaattaatgacctaaggaagcgaattaattcattaagaagactttttttctttctcaaaacttatgaaaattaacccacttctaattaatcatcaaaaagcttgaaattatttgtaaacgaagactagaaagagagaggggaaaaaggtatgacaaacagccttaaagttaaaggtaatagtaccttttgtttgttcttctttttttgcaaacaattttttcccttatttaattacgtttataaaccttaattcagattccttaaatacattgttaggactccataattagtaacggcattaggagcataaacaaaaattatgataaaagttttgatattatggaaataaccaaatatcttacctgtaaataaaataaagagatgtgaccaaatttaattgtggatttaattacattatctaacccttgaagaaactcaatgttttttgtgggattgttgtcctaaacctgaggttacatgtaatcaaaacattaatgggatttgaagtaaataaattagatttgcgccaaaaaaacaaaatctccattgattacagtgttttaatatggtcagataaaaccacagaagtggtaacgacataaaaaatcaccaccaaacataaaaccgtaagaaaagtttcgatttttattttctgcgatccaaaggtctagtgatgaattgaatttggtttttgtttttataattgaagaatgaagaaataaacagttgatgggttcttcgcttcttctcttgttgggttagtgataagcacgcctggcttctcatcattccctccaacctttctctctctaaaagacttcaattgttttatcagcttctctctctaaataaagctctcaattcaattctctctctttcacttttttttcctctgcttgcttcttctgttcatctttttgcttcgtcaaaattttgaccaaagttttgtacttttttgttgctgcaatttttgtgattagattggatctgggcttggagctgaatagcggatttgtataaggtaattgcttgaaacgtaccgaattgattcgtttttttgtttctctgagatttttcaatatctgggtcttagagtttggctgatctgattggttctctgagattttcatgtagataagtttgttttaaaagccaaagccttagtttttaattagtgagatagatttatgtagagagcatcaatgatcaatccttgagctttatcttgggttttgttatgttgtttattgaaaa

SEQ ID NO: 8410 - DNA, 2033 bp, Unknown
  misc_feature (1)..( 2033): cDNA_ID_1822689_gDNA_ID_1971791_Annot_ID_175552 3000 nt of promoter + ATG
gaattctttaacgccgtccacttgacggagaacgttacctacgatagaaacctccgatgaacagcagattccaacgacgtcgaagtaacttgtctgtaaattcatcttctttgactcttcaccttccgccatcgttgagcttgagatctcggactaaatttcgaggagatacttttacgggatgatgtcggagggaaattaattatttggtttaggcttacattattatttataacatttgaaattttcagtctctataaggaatgttatattaattgctccacgattttttactatttccaaatgtcaatgctgagattggatacgcatttaaattttattttattaaccatgtaatttttgaaagatttacatttatttaatagaaataaatattaataaacaacaattaattagtcaattatagtagattcgattttattattgaaaaaaaacacttcaaaacctatatagttttccagatgttaaagaaaaaacctatatagttgatatattaaaatcttttttagcaaataatatttgagcagatagaatctaacaaattcttctaaatcaaattcagattttgttattaaagaaagagaaaagagcctattgggccataacatgggttcatacaattctcaatcagataacttccgaggccttataatgacttgtaatataaatggcaatttcgtgattaagtgagtatgaaagggtagacatgacaaaacctaactacagtaccgaggtagccaataatttatcttggctggggccatactctgaccgcagtttccattaatttacagaaatacccacgcttgggatatatatgtatatgtaaccataagtgtaacattttattagttttcagtcgttttccaaatttatgaatccatttacatgagacaaaccaaatccttgttggtaggtccatcctttacactattagaactgaatcatttttatttttctttcacaagaatagaatatttgtcgtaagcaaagaaacaaaagtaaggttaaaaattagtaaaacaacaaagggttgcatgtaacacaaggtttagaaggaataaaataaacaaaagttatgttagtaacgtctttagttaaaaaaaaagtttcatagatgaataaaacaaacaaaattgcatgtcccacgcagctataaaataagaaaaaaaaaaattgcatgtcctaacgccacctaataataaataaagtgaaataataagacaaaccaaaacaccattgactcattgagactgatgtcaaaaaatgagaaaaaaccaatcacattgagagttgagattttaaccaatgcaaggacaatggcaaaaccgaaaataaacgtaaaaatcgaggttgataataacataactcataaaatccgtattttcatggtgtcttcttcttcttcttcaccttcttcactcatcactactcacaaatatatttttgaccgttgttcactctcaccttcttcacacgctccacatcttcttctgattgacctttaacacctgaaaggttttgtcttctctctctatcgtccaaaaatctaaacttttctggttttattttatagatttgggtccctcagtttgtttattttacctttatttatgaacaaatgtgcaaagggtttagattttagctccttgaaggctcataacgcataaagttcttggcttcatcgttttctctcttgattaatttggcattgtatatcttatgtctgattgtgtgaaaaaaccacaaatgaaaggagtttagacacaaatcacagtttaagacaaaattatagtcttgtttctttcaaattatgcaaaaaaatcaagaatctgagacataagagaaacgtttatgtctctctcttttaatcaatgctatgttgcttttctcaactgtttcaagcgttattacattactagctaaaaatcttgatgtcttgttcttatttttgcagtttctcctcttgagctttggaattgaagctaagataagaaatttagagagaaatg

SEQ ID NO: 8411 - DNA, 2058 bp, Unknown
  misc_feature (1)..( 2058): cDNA_ID_1989441_gDNA_ID_1971791_Annot_ID_58043 3000 nt of promoter + ATG
aaattattaaagtatatcctagcatttactaatagaagagtctaattttaattttgttattgctcaaacacagtatataattttagagatttctttggtttacgtcaaaaaagtctgtctcaattttaatattttagtcggtcatcagtatcgtccaaacaatcattttacttttgttatgataaaatacggaattcctcccctaatgacaatcaaattcgaattcaaaagagctaaacaacatatttctaacaaataatatgctcatgcatgctaatatttactgtaacatttaaaaaaattaaggatggtaaacataatctgcttaccaaatgatggagatactcaagagtccagctgtaatacatcttgcatgcaatatcttgatattagcctccttttgttcacccactctcttctcttcttcttctcatttatttatatgttaaactctctcccactatatatatctctcccccttcttctctcttcctcacattcctcaccaaaccctctccaaaacacacccacacgtacgcacacacacaaagacaatgtctcctttcaaaatattcttcttcacgactcttctcgtggcggcgttttcagtgtcggctgctgatttcaacactgacgtcaacgtagcttggggaaatggccgtgggaagatactcaacaacggccagcttcttactctctccttagacaaatcctctggttccggttttcaatccaaaacagagtatttgtttggaaagattgatatgcagattaagcttgttcctggtaactctgcaggaacagtcacaactttttacgtgagtttatatattttctttaggagttttaagtgattttggatttggtttttatattgagacttcatcttgacatttttgtgtatttgcagctaaaatccgaaggatccacttgggatgagattgattttgagttcttgggtaatatgagtggagatccttatactttacacactaatgtttacactcaaggtaaaggtgacaaagagcaacaattccatctctggttcgacccaaccgccaatttccacacttactcaatcctctggaaccctcaaagaatcatgtaaagacaacaatctcacctttcttgctacacacgttaataaaccctaactaggttttcgatttttcttacccatctcttatctgttctgttttctatcagattgaccgtcgatgacacacccattagagagtttaaaaactatgagtctctcggtgtcttgtttccaaagaacaagccgatgaggatgtacgcgagtttatggaacgcagacgattgggcaacaagaggcggtcttgttaaaactgattggtctaaagctccattcatggcttcttacagaaacattaagattgactcgaaaccaaactccaattggtacactcaagaaatggattcaacaagccaagctagactcaaatgggttcagaagaattacatgatctacaattattgtactgaccataggaggtttccacagggagctcctaaggaatgcacaacaagctcatagaatctcaaattatattctatttatttatctacacttcctctctttcttttatgtgaaaattgtgaatgctctgtttatagcttgtctattatgtccgagaatttctttttctgtttttgattcttttcgttgtatatctttgtccaataaaggaaatgatgtgtctttactcttatagatatgtataaaaagatgtccctgttttatttgttaaaaaaaattgtttatgataatgatagttctttcttcttcttcttctttttttctcataaaaaaaaaatgatagtttcatttgctttatatatatacataattaatttacttacattgtaagaaatatgataaacgtgttgaatgcttctttttcaaatccaattattgaaaaaggtcaaaatatcaaattttatttattatagaatgtatcaaaaacttacaataaaaaactctctacctgagttttatctcaattttattaaccaatcgcatgctttcatagaatg

SEQ ID NO: 8412 - DNA, 557 bp, Unknown; identical to SEQ ID NO: 8402
  misc_feature (1)..( 557): cDNA_ID_1444514_gDNA_ID_1971791_Annot_ID_58044 3000 nt of promoter + ATG

SEQ ID NO: 8413 - DNA, 3000 bp, Unknown; identical to SEQ ID NO: 8357
  misc_feature (1)..( 3000): cDNA_ID_1989457_gDNA_ID_1971793_Annot_ID_58046 3000 nt of promoter + ATG

SEQ ID NO: 8414 - DNA, 3000 bp, Unknown; identical to SEQ ID NO: 8362
  misc_feature (1)..( 3000): cDNA_ID_2176755_gDNA_ID_1971793_Annot_ID_175588 3000 nt of promoter + ATG

SEQ ID NO: 8415 - DNA, 3000 bp, Unknown; identical to SEQ ID NO: 8360
  misc_feature (1)..( 3000): cDNA_ID_3089088_gDNA_ID_1971793_Annot_ID_175595 3000 nt of promoter + ATG

SEQ ID NO: 8416 - DNA, 34 bp, Unknown; identical to SEQ ID NO: 8358
  misc_feature (1)..( 34): cDNA_ID_3089068_gDNA_ID_1971793_Annot_ID_175607 3000 nt of promoter + ATG

SEQ ID NO: 8417 - DNA, 3000 bp, Unknown; identical to SEQ ID NO: 8361
  misc_feature (1)..( 3000): cDNA_ID_3089084_gDNA_ID_1971793_Annot_ID_175597 3000 nt of promoter + ATG

SEQ ID NO: 8418 - DNA, 3000 bp, Unknown; identical to SEQ ID NO: 8359
  misc_feature (1)..( 3000): cDNA_ID_3089091_gDNA_ID_1971793_Annot_ID_175593 3000 nt of promoter + ATG

SEQ ID NO: 8419 - DNA, 3000 bp, Unknown; identical to SEQ ID NO: 8357
  misc_feature (1)..( 3000): cDNA_ID_1989457_gDNA_ID_1971793_Annot_ID_175586 3000 nt of promoter + ATG

SEQ ID NO: 8420 - DNA, 3000 bp, Unknown
  misc_feature (1)..( 3000): cDNA_ID_1989456_gDNA_ID_1971793_Annot_ID_58047 3000 nt of promoter + ATG
aatcaatgagtgaataacatatgatttttgtttggattttcaattccttataaatctataaaccaatgacccctcctaaatttgtaaggactaatattgaaaatagtaaatcggtgagggatttttggccaaaaaccctaccaaaaatgtatatgtagatcattcatcatcatatagataataattcttgtattctcctctacaatatctacttttcatgtatggataatgatttaacatcttaaaaatatgcaaccaaccaagctaagcaaactcttcacctaatattaaaagaacttaccaaaagtaatattttcaaattttcatacattttagcttatgtataataaaataacaaaaacaaattatacgaaatggcaaaactgttgagaaacaaatcattacaaaaatccacgtcagcagtcaaaagtaaaaaaaaacgaaaatacaattaggtcataaatgcatttgaaactaacaaaaaaagaaagagatctcttatttcttcgaatttaatcattactagaaactgtgaccacgacattggtcgtggcctaatgaggaagaagtagtcaaagtcacgtgaatcgattaagacactttcttcttcatcaacctaaagacattggtctttgcggccaattgaatatgaaaaacaagattgattcatgattcttttaataagatttgattcttaaatactactattttttatacattttaaaattgtgtatttcaaaaaaaaaatgtaatattttagtgaccaacatattttttgcccaaaatacaaaaaaagtgaccaacacattatgattatataagataatatctaataaagatcatcattcatagataatatttaataaatttagttactttttaaagctttagattgaagctcatataatttttaggaaaacaaatttagtttatcacttgtaaaatactttaaattttaaatattaaatattgtataagtttataagaacaaacaaaaataaatattttaataacaaagtaataaatatatgggagtccaaggttttatccaacaatgcaaaagaataaataattgttcatttatcaataaattttattcttcttctcaattattttaatattactataatatgctatttatccataattatcatatattttaaattcttacttagctcatactaaacttaaatttataatcaaagttaacaactcatactatataataagatgaacatcactcaagccaactgaaacaacccgacccatttttttttttttttaaatataattaaatattcccataaatatctaattaaaccaaccaataacataataattaaaccgcaagtcaaaaatattattttatgaataaataaattattcgaccaacaaaaccaagaataactgacaatcctaaccgggttccaataaccaaaaacaccaaaaataaaataaacgagtttctatatcatcctctcttccttgtcatgattccacgatcacactttatctttacctgcatcaacaacacaatgagatgcgcaagtattatcataaatacttattgaggcgatcctcccatccacgagctatacacacaagcaaataaaaaggtataatcacgaatacaatacaaacaaaccagtcattgaacaattcacccaaaacacattcaccaccctacatatcatcacacaaaacaaatcacacaacccaatcgctcagataagctcatggtcacgcactcaccttaacaaattgattctaataacaattaaactcaggagagactctccttgcgtctgaaacaatccagaaacgtcctacaacaagtcacaaccaaaagcaaccttgaaacaaactggacatgaaaaacagaaacagacaacctcaaatacgaaaccctaaaatacaaactaaccgttaactattaaatcgctccggtgaaacgctagccctagacgtcacgaagcgtcccacacaatattgtcccgatcggaaaacagacgataccacgatctcagtttcaaaccctgctggtcctaattcgcgtctgagaaaacgtgtctcacgaaactgcgaataactcaaccaagtttaatccaaatccaattctgtaaactggataataacgataaaggaattgggaataactctactaaatttcgttaccttttaccacgatttgatatgacgaaactgatttctcccaaaccctaacgattttgctccttctccttttctctctttttctcctttataaaacgaaaagtggctaactaaagccctaatttcgagtttccttcttttataggcacactctagggtttccaattaacccaaccaattaaaccggatgatttaaaaacaaaccctaaccgattttccggttcacgggcgttacaccaactaaaatacatttgcaacttgaataaaatcatggataatatcattgcgtatgcccagaggattcattatttaggtcgcatttttcttaacagttccccagctactgttaactcaaagattacgcatgtacccctatgatttcgatatcgagaggagtagagcgtagacgatattattgctagagtgtaggagttgattctctctagatttttttggggaggtgtgatgtttttttttaattagcttgttatcgaacggtcgctacttttcaagtttatatatcatgaatgacggtttggaggcggaagaaatcatcagagcaactttcccaaaaattagctttttcggcagtttttattttcgatcatcaactcgtctctcagatctgggatttttcctgacaaacgttatagtaagttcattttttcccctctttttgtcatcagtccttcatttgttgactaatggctttgtttgtttcttttgtaggaagatggcgcctctccctctccctccccgactgattgcgtttcgtgaagaaccacacgacgagagggtcaacgtgtatcagaaaatgaaaaccttatg

SEQ ID NO: 8421 - DNA, 3000 bp, Unknown; identical to SEQ ID NO: 8359
  misc_feature (1)..( 3000): cDNA_ID_1989455_gDNA_ID_1971793_Annot_ID_58048 3000 nt of promoter + ATG

SEQ ID NO: 8422 - DNA, 3000 bp, Unknown
  misc_feature (1)..( 3000): cDNA_ID_1989454_gDNA_ID_1971793_Annot_ID_58049 3000 nt of promoter + ATG
tgtactgtgaacacaatgaataatacgttaattctacgcagttatatctagagatgttgtggtgggtaaaaaagcccaacccgacctgaacccaaaataaacccgcccaccaaaaactcaactttagaaaactcagatgggtttttgattaagtgcgtaaagcccgaaaaaactgattattccgagactacccgtgggtacccaacttggtttttatcatttttttagagtttatttttaactgttaatatactattatatgtatgttgtatctatattttgcttattaatatattttaaattatatttattttctgtattacatatatatttgatgggaaaaaggttgaattgcgtttttggcgggaaaatgttaaattgcgttttttggagaaaaaatgttaaattgcgtttttggcgggaaaatgttgaatatcttttttggcgggaaaatgttaaattgcgtttttgaccggaaaatgtgaaatctttttggcgggaaaatgttgaatgtcgtttttggcgggaaaatgttaaattgcgtttttggcgggaaaatgttgaattgcgttttggcgggaaaatgttgaatatcgtttttggcgcgaaaatgttgaattgcgttttggcgggaaaatgttgaatgtcgtttttggcgggaaaatgttaaattgcgtttttggcaaaaaaaatgttgattatcattttttggcgggaaaatgttaaattgcgtttttgaccggaaaatgtgaaatctttttggcggaaaaatgttgaatgtcgtttttggcgggaaaatgttaaattgagtttttggcgggaaaatgtgaaattatttttggcggaaaatgttgaatagcgttgttggcggaaaaatgttgaattgcgttttggcgggaaaatgttgaatgtcgtttttggcgcgaaaatgttgaattgcgttttggcgggaaaatgttgattgtcgtttttgacgagaaaatgttgaatgtcttttttggcgggaaaatgttgaatgtcttttttggcggtaaactgttaaatcgcggtttaggggaaaaaatgtgaaatcttttttgacaagaaaatgttgattcacctgaaaaatgacttaaaaaaaaccgtgggtacccataacccaataaggtaaacccatatgggttttatttatttgggtacccagcccattttaaacctgtattttttttctagaaaaagtagatttatgggcttaaaattttatgtgggttttgggtacccagtgggttttaacccatcattaacatctctagttatatcaaagtgatcacataatttttaaataactatatatataatggtcaaacgcaataaagaatacgttgattctactcatttatatcaaagtgatcacattacttattgactaactatataatggtcctaagtcctaacacaatgaataatacgttgattctacacattgattctaacaaatatctaaatatcatatatcgaatatgagtatatgaaaaaacagaatggatcatgatatgctaaagaacatgatagtgagtttaagcactgtatctctgtatcatgaagaaaaaaatcacgtaaatatatatatagatctattatgaatgaattatcacgatggtatcatcacccaatcaatgtgacctttgttctcgatgatttggaattatacgataaattaaagtttaataggtctagacattcagatacacatacccaatcgttttttttttgggtttcgggtctctttgggtaggggttgacaatcttgatattctaaaatttttgtttgggttcgggttcgattattttagtaaaaaaataaataaaaaagtccaaaaataaccaaaaattccaaaatagttttgggttcggatcagattttttattcatatatactaaaatctgaccaaaatacccgattacgagaaaatacattggttactctttaccaaatgtaaacaaaaatacttaaattacttaaaagaaaaaataacattgattacttttatctcaaatatatccaaatatatatgtattactacaaaatatatagtatatccaaatttataattgtaattttgagtatttaaggtattataaatataaatataactaatatttttaaatgtatatttgtattcgggtatccacgggtattagatttggtttaggttgagttcggttttttttttttgattgtagacctattcgggtaattttaaaaattagactcggggttggctagtttttttttttgggtcaagtagtacgacatatgtaagaaaaataaagctaactattctaacattaccgttccatttttgacagctcactgtaacattataaacagacattacaaaccaaataaattctttttacaagcctaaaagtcatatttgcaagcccaacactaatctgcccagtaaacaataattagggtttcaattaaaatttggaaaaatcacggtgtcaagagtcaagacataaccaaagccgagatttggagatgaaagaaaactagatcgagtgatagaggagaggagagaaagaggagaaaaagagagaatagaaattggattaggaagtgggtttgcttttagcccacgtaagttagtttgaaagtcaacgtgttgtaatttgtaaacctaattggattagaaagtggggtttggtttatcccataacttagcacctctatttatataaaaactctagtcctaatcctattaggaaagcacttatttagataactcctaaagagatttgagcttatcacttcctaaaccataactcggttaggatctaaaccataactcggtttaagattacttttattcttatgctttctttgaagcttaatccatgttgtaatttgtaaacctaattggacttgggtttcataatcctagatagatagtcacatcaaatcattcgatttaagagagatcagttcgaggaaccaaaacctgagagacaaac

SEQ ID NO: 8423 - DNA, 3000 bp, Unknown
  misc_feature (1)..( 3000): cDNA_ID_1989460_gDNA_ID_1971796_Annot_ID_58062 3000 nt of promoter + ATG
ttgttcgtcaggaacgttgataccgatttcaatcagacgaggccaatcagactcataagctcctactctaagaaatcactcctctacgctgctgccgccgcaaaagtgaaattcgacaaattctaagatgataaaagaggcttttgaggtaaatgattaggcttttggaagttttcgataatggaaaagggtgaaaattgaagctttggcagaattgatcgtcttatgcccgtgattgcgctaaaggaagacgaaaccggtttaattgaagaaatcatcggttgggaatttggtgtaagcgattgatctcgaagtggttttgattgaagatttgataagaaaagaaaaagagccttttgtttcttggaaaaatggaagagacaaaggaacaaagaaaaggagagaaggaggtgaggacacataggagagaaagtatgggaaaaggttttcagattatgtttaattacgtaaatacccttggattgtgtctattcgtgagctctatgagatgggtcttttaagtatttacggcttgttggccgtagagactgtccatgagctaagctaagcatccgtgtttttgataagagagattgaaactaaaatacgagttaatgattggttaagcaaaagcaagcaagttcgaacttgtctatactatactacaaaaaccattgatctacgtaggaaaggaaatctaattcgatcacagaatgatggatatataaatcttcataaaaataaaattttgtttgtattataagatgccattttaaggtccatcacataaatgaaataggaatccatttctgatatcatatctctatacgaatacaataaattgcagagcgcagtcctaaatccaaaagtgatgcgatgattcatctattgcaactattaattccaaatcctaagaaaaaacaagatgagaatttataacaaacagccaccaatctgcatagaagaaatggattctcttatcctttgacagttttctctagtttttttcatcatcatataaaaattctataggcaattagcaaaacatctcacgagtcaactcaaagtcagaaagtcgattaaaacgatttagaatttaaaaaattctttctaatgcccttttcatgatgccccttttcaactctacctttttgttttatccattttcatttctaccctctttaaatttttaatgaccattttacccttatttggaaattgttttaggttaacaaaatgaaatattaatatttttcgcctaaaatattccaaaataaattttccgccaaaaaaatcccgccaaaaaatttcgaaaaaaaacattcccgccaaaattttgttttcaaaaatatttttcctgccaacttttttttttgggcgggaaatagatttacaagggattttaaagggtttttataagatttacaagggattttaaaagggtgatttacaagggattttaaaaggtttttaaaagatttacaagggattttaaaagggttttaaaagatttacagggaattttaaagggatttaaaagatttacaaaggtcttttaaagatttttaaagggtttaaaatttgtttaaaatgattttaaaatatttacaagagattttaaaagggatttacaatatttacaagggattttaaaaggctttaaaagatttaaaaagaatttttaaagatttttaaagggtttaaaagtgttttgaaaaatttataagggattttaaaaccttttaaaattactttgaaattttttttaaacccttttaaaattccttgtaaatcttttaaaacctttttaaaatctcttataaatttggaaaatttactagagtaacccatattttatacataatgacccaaaaggaatgctaaaaatatgagttatttgagtaataattatacctaaattatccttgttttcctttgcagagaaaaaaaatattacagaaatgccattactatttaattccagcaaggcaataaaaccacatttatttacgaaaatgccatcgtcgtttttggtaaatctgtggctcttgttgcgacggatttgttatcgatcaaagttttgttggtcaaccacagattttttacaacagacttgttttgtaccacagactttcctgtgttatgttacgccagattttttttttttcgcagattttttaaccgtgactaatttgtttcatatagtctccacagattttatttaaatttcaaaagtaagaatgttgaaaccaaatctgtcactgatttgtttttcggaccacagatttttctttatggtggcaacagattttctatttgcacccaaaaatctgttgtgttataacagatttgttaacctcgaaaaatgttatataggcatgacagagttgttttgtgtaatcacagatttaattaacttgttaacaaatctggtgttttacaacagatttttgttaaaaaataaaattactacacagtcacatagtgataacagatttgtttttagtgatgacagttttttttttcagtgtcaaagcataacagatttactcatgtcaatgttatggccgatttgtttatgactagaataacctttttagtaataacagactttttttggcagatttatttttaaaatttcgaaattttttgttatatgagatttattagctagccctcaattaaattatttccggtttgattgtatgttaaatccggtttgactggattttttttttttttttttggaaaacgttacgacagacttttattagccgacagatttttccgaaatattaccatatttgagtcaaggaatattctcgtaacgcctagggtttccaatgaaaaaaactgccattgtcgttttcttttttcttctgtaacgcctaccaaatctaatttcaatacaatccattattcttctacctattcgagatcttagttgcttcatctttgatacaaattcgattcccttgtttattcgattctctctttggt

SEQ ID NO: 8424 - DNA, 3000 bp, Unknown
  misc_feature (1)..( 3000): cDNA_ID_1989477_gDNA_ID_1971801_Annot_ID_58064 3000 nt of promoter + ATG
aaaaatgggaaacaatgcgctattctcttctgacgccgccatctttggagcctttaaactgagagattctattctgctgaaaggaaaagctctgttataatctcacaacatccaaaaagcttcaaggatacaaaattatcaataacatgaaaagctggatctgaggccactgaaattaattagggattctacatgacggagatcaacactaatagatctcggctaatctagtctaaaggtatatgaatccctggactcactttgagatcgacacaaaaccttagaaaacaaacaaacgaaactacgggaaggaagcaaaaccaataattggtgaaagaagatgaaatcgaacttgaaaggatattgtagaagaggaaatcgaagaagaagctcacctaggatgatagctctctataatcagagagatcgcgctgctgcagatcggcaacaaacggcgttgcagtttttttttctttatgcttctcttctcttctaatttctgatttctgattggtgagttctttcttctttacttgcttattcacttttctttaccttctcaattaaaatatttcgcaattcatttctctctttacatttttacgagttatttattttccattaaattagagtaattattaatagcaaagtttttatggtgaacgaaaacgaatttcccaaaaaaaatcacattttttataaattagaaaggaaaaagagaaaaggatatggatcaaagagggattatatgctctagagatttaatgtgatccagatattgtaatagggattgcaacaaatctcttatatgttctagagatttaatgtgatctagagattgtaaatagttacaacaaaatagagatttaaacaaaacaaatatttaatgattttaagaaaactgttttgttgtaactatttatatttcgaccagaaataaattgttctacttgcaaaatacatcaatcttcgttattattatcgatttaatcataaactgtctaattcaattaaatttataagagcatggttaccaatacttttttatctactgtaacgaaagctaataatgattttgaatgagtttggtatgatttggttattcgattcactaaaatagtcgttttaaatctagccaaatatcgtataattttacttgttttgattatattaaataatcagttatttgaaaactttgttgacatgttaatattatatataactaaaacaaaatatagatattaaaaacaaagaaaatgttattatatagctattatcgtttttcataccatttaaattttattactggctttcatattatgatattgttgtacatagacaccactgctaaaatgcttattaacttgagattttgcttgtgagatttggaggctaatttttttctcggttaagcatttctcgcatcatatgccttccacatagtttgagcttttgttcaccaaatgttcttaccactctcaagaaactggcagcacacgaatatgctttccacatggtttgagcttttctcttggacaaaaactcgttcaccaaatgttcctaccactctcaagaaactggcagcacacgcatatgccttccacatagtttgagcttctctcttggacaaaaactcgttcaccaaatgttccttccactctcaaaaaaatggcagcacacggtggagtttaccacatttgaaaacaagtaaataatgtcttacataattcacagtcactgctttcttcgatcattttcaagaattttgaccgtgaaatttgcaataccatatcttcaagaagacatctaaaaggttttcgcaatctggtgattaggttaatgctcttttgtaatacatttctttcattttatatatgatattaacatttataacaaaagaaaacaatcatagcatattgcatgtcattgcaagtttgctatatacagtagttttaaaccgagtaaacttaagatcaggtaggaaagatgcaaataaagaagcaagtgataccaaaaatatatgtaaacatttaatatagttcttcaatctaattgacgattagaaagtactgtactagatgattacgatccaagatttttgtccacactaagaatatttcacaaaataaggtttgcaacagtaggattgaaatgccagtaaacagtgacattatctcgaaaaaatccaactcagaaatcatttactagctaataatatttttcaaatagtttagaattattattgttgtttatcattaacgcatacaaagttagttgtataatctttcaacttataaataatttggttttggacggaagagctttacgcaaatgtattaatttggttttgataatttttatttgtagactcgatttgtttacgtaaattatgaaagagaggcaaaaataaatatcataagatatagtattagaagaaaaggacataaaagtagtaattaaaaaaaaaaaggaaaagaaagtgtgaaaagaaaaaaggaaaagtagagaggaacgcaaccctgggggcttcttaataaacccctctcgctctcttgtctcttccttacgacaacctctcctgctcttcgttttctctctacgacgataaaacccagatttgggttcaagcttccataactttaaacccctctcgcgatccaggtatgtttcccaatctttattcccagatcttccagatctgaagctcctcttctattttttcgtagatttgatttttaggtttgatctatttgtatgaatggctcgcgtgttctcccgtattggtgattgtaatctaaaatgttgatttgatttaggttcagtaataagactagttatctgacctgtgttaacaccaattagtcttctcctagtctgctttcattgatattccatccttgttcatctgatacttattttttttgcttttattgatctgagaaggttgctatcaaatacttgggagcccccagtattattgaataacacagcctgacaatg

SEQ ID NO: 8425 - DNA, 3000 bp, Unknown
  misc_feature (1)..( 3000): cDNA_ID_1989476_gDNA_ID_1971801_Annot_ID_58065 3000 nt of promoter + ATG
aacaaggcaattctcgtttccaaaatcaaacccgactacactcattgtcaggctgtgttattcaataatactgggggctcccaagtatttgatagcaaccttctcagatcaataaaagcaaaaaaaataagtatcagatgaacaaggatggaatatcaatgaaagcagactaggagaagactaattggtgttaacacaggtcagataactagtcttattactgaacctaaatcaaatcaacattttagattacaatcaccaatacgggagaacacgcgagccattcatacaaatagatcaaacctaaaaatcaaatctacgaaaaaatagaagaggagcttcagatctggaagatctgggaataaagattgggaaacatacctggatcgcgagaggggtttaaagttatggaagcttgaacccaaatctgggttttatcgtcgtagagagaaaacgaagagcaggagaggttgtcgtaaggaagagacaagagagcgagaggggtttattaagaagcccccagggttgcgttcctctctacttttccttttttcttttcacactttcttttcctttttttttttaattactacttttatgtccttttcttctaatactatatcttatgatatttatttttgcctctctttcataatttacgtaaacaaatcgagtctacaaataaaaattatcaaaaccaaattaatacatttgcgtaaagctcttccgtccaaaaccaaattatttataagttgaaagattatacaactaactttgtatgcgttaatgataaacaacaataataattctaaactatttgaaaaatattattagctagtaaatgatttctgagttggattttttcgagataatgtcactgtttactggcatttcaatcctactgttgcaaaccttattttgtgaaatattcttagtgtggacaaaaatcttggatcgtaatcatctagtacagtactttctaatcgtcaattagattgaagaactatattaaatgtttacatatatttttggtatcacttgcttctttatttgcatctttcctacctgatcttaagtttactcggtttaaaactactgtatatagcaaacttgcaatgacatgcaatatgctatgattgttttcttttgttataaatgttaatatcatatataaaatgaaagaaatgtattacaaaagagcattaacctaatcaccagattgcgaaaaccttttagatgtcttcttgaagatatggtattgcaaatttcacggtcaaaattcttgaaaatgatcgaagaaagcagtgactgtgaattatgtaagacattatttacttgttttcaaatgtggtaaactccaccgtgtgctgccatttttttgagagtggaaggaacatttggtgaacgagtttttgtccaagagagaagctcaaactatgtggaaggcatatgcgtgtgctgccagtttcttgagagtggtaggaacatttggtgaacgagtttttgtccaagagaaaagctcaaaccatgtggaaagcatattcgtgtgctgccagtttcttgagagtggtaagaacatttggtgaacaaaagctcaaactatgtggaaggcatatgatgcgagaaatgcttaaccgagaaaaaaattagcctccaaatctcacaagcaaaatctcaagttaataagcattttagcagtggtgtctatgtacaacaatatcataatatgaaagccagtaataaaatttaaatggtatgaaaaacgataatagctatataataacattttctttgtttttaatatctatattttgttttagttatatataatattaacatgtcaacaaagttttcaaataactgattatttaatataatcaaaacaagtaaaattatacgatatttggctagatttaaaacgactattttagtgaatcgaataaccaaatcataccaaactcattcaaaatcattattagctttcgttacagtagataaaaaagtattggtaaccatgctcttataaatttaattgaattagacagtttatgattaaatcgataataataacgaagattgatgtattttgcaagtagaacaatttatttctggtcgaaatataaatagttacaacaaaacagttttcttaaaatcattaaatatttgttttgtttaaatctctattttgttgtaactatttacaatctctagatcacattaaatctctagaacatataagagatttgttgcaatccctattacaatatctggatcacattaaatctctagagcatataatccctctttgatccatatccttttctctttttcctttctaatttataaaaaatgtgattttttttgggaaattcgttttcgttcaccataaaaactttgctattaataattactctaatttaatggaaaataaataactcgtaaaaatgtaaagagagaaatgaattgcgaaatattttaattgagaaggtaaagaaaagtgaataagcaagtaaagaagaaagaactcaccaatcagaaatcagaaattagaagagaagagaagcataaagaaaaaaaaactgcaacgccgtttgttgccgatctgcagcagcgcgatctctctgattatagagagctatcatcctaggtgagcttcttcttcgatttcctcttctacaatatcctttcaagttcgatttcatcttctttcaccaattattggttttgcttccttcccgtagtttcgtttgtttgttttctaaggttttgtgtcgatctcaaagtgagtccagggattcatatacctttagactagattagccgagatctattagtgttgatctccgtcatgtagaatccctaattaatttcagtggcctcagatccagcttttcatgttattgataattttgtatccttgaagctttttggatgttgtgagattataacagagcttttcctttcagcagaatagaatctctcagtttaaaggctccaaag

SEQ ID NO: 8426 - DNA, 3000 bp, Unknown
  misc_feature (1)..( 3000): cDNA_ID_1009376_gDNA_ID_1971801_Annot_ID_58069 3000 nt of promoter + ATG
actttacatttcagcgataagggaccaaatcaattggttggttggaaaggtaagaaagatccctaaacccataaatcctatttccaaatcaatatgtagacataatgtaatcagcactgtgttgactgtttaattcttgtttttttcgttttatctggtcattgcaaaagtgttaattaatatattcattacagatttttagtggatttagtatatattcttttgataattattttcttacgcctataatcacatacaatgtctcatataatttgtatttattatttttaaaaagttctgataaattggagaataaaaaacaagagttaaagcaaagctttgttgttgttttttctgtagtcaacaaatattgttctctttttttaagaaaaaaaatgaaaatgaaaagacttgataagtgataatgggagacacgatcactcgtaggcgttgcttccggtttttatttctaacatttttctactctcttttttttttttttttctcttatggaaaataattttgtttttataagaggaaaatacagaggcaaggcaaacaatacgagtcttgtacgtattctctctttgcttcctaaaaatcaatcaatcaatcaatcacagagtacgcaccaccagccaaattataagtgagagagaagataacgacgacaagaagaagaaggagaagctccaaaattgttcatttgcatttctccaacttgtaaaatcgagcacctgcatttgggggctttcctcttatctggaaacaaagagagccgccactgatggtaaatttgcttttcatccttaacctctctacttcttcttcttcttcttcttctactaccactactttttgagattctatctatctatagtcatccattttgactaggagactttatattattttcttcatttgaaagattctctatacatagatagtcatcgattgtgtttctgtgtgtgtctgcaatatctgtagttttgatttgaaacttgcctgaatcaaatccaaccatgaattcggtagttttgtagatcagagattattggtagagagtatcaatgttggattgattgattgaatgaagcatacattattatataacacaagatttttataaattgctactgaaaccagaaaaaggtaaaatattaatttgtgtatttttgtaggaatgagtttccgtgaatcatccacccaggtgaaaggaatcataatttggttggtcaactaataataaaaatgggtgaggcaagtgattcagattcgtctgatgagtctttgaaacacaatagcaccccaccactctttagcatctctggcttcttttgtgttgccaaaggaggagactctgatcccggtaggagccctacttctccccttgattttggagtctttggtggcctctttagccccaggtcttcttcttcttcacccctccaccgaaacaaatggctttctcacaaagtcgggctttctcttctgagctccagcttcgaactaggcgatgatccattcagaagggactacattgtgcttgcccctcaggtcaaggtcaacaatgttaatacagcaactcccaagctttccagtgatccttgtgtcattgtggaggaaccaaggagatcaagctcatcatcccctatggatatcatctccacgtactctcgctccctctctgggcgtgagatggctctctctgaggactatacctgtataatttctcatggaccaaacccaaaaacaacttatatatttggcgattgcatcctggattgtgaccccaaggacttgggaaaagaagatattgagatacacgaagaaggggatgattcttttagcacagaaaaacctcaaaatcacaggttcttctggctccaacttacaaagcagcattgagtggtctttttaaccttgaactaattacatctctgacattttatttccgtgaatgaacaatagggaagtatcagcagaaaaggaaagtgagaacgctggtgctgaagaatcatgttacgaagaggaggatctgtttcctatggcaatgcctcttaacccgtaatgagatggccagagtgaagggggtttattgtgtgggcctctccctctttgagtgtgacatttagtgttgtaaggttaggtgtggggatttttgtgtgctcaataaaaagctttgattcgggtgagttttgctgtggcctgatgccccggctcatcccttttcttcgtcttgttttttttttcttcttactttgtatgattgcgttgttactactgatcctcatttgatggacacacttgtgttttctctctatatcaattgttttagtggctcacgttgctgaataaaaatggatattatcgatagggcatcttttattctattttgggatacaagaatgattgaaacacaatattggaaagaaaagctaagttgcaaaaaaaaaagaaaaaggaaaaaaagtcgaccacagtgggagtcgaacccacgaccttttgatccgaagtcaaacgcgctaatccactgcgctatgcggtcattcttgttacttatatcatgaacaacatggtaagccaaaacttcttctttcctctttcttctttctgttttctggtcgctcgttaccaccaagacctcgtcgaggtttctctctctctgaaaaagtgcttttgctgcgtttccatgctctcggaaggaacttggctgaatcgttggagaattatcgatctggcgtcgttggtgcatctctagctgcgccaattcatcggatccggtttgatttctccctttcgcgaatctagccttccgtgatcttaggtgggttttccgaattgatctgtaattgaggatgtaaatcgaaactagggatttcctagatctcgttagctgtgtatttgattattgcagcagagtttttgtttaggtagagatatagggaattttgatatagggacacttaaattttggtgtatcaatttgctgcagcagcc

SEQ ID NO: 8427 - DNA, 3000 bp, Unknown
  misc_feature (1)..( 3000): cDNA_ID_1989473_gDNA_ID_1971801_Annot_ID_58070 3000 nt of promoter + ATG
ccttgattttggagtctttggtggcctctttagccccaggtcttcttcttcttcacccctccaccgaaacaaatggctttctcacaaagtcgggctttctcttctgagctccagcttcgaactaggcgatgatccattcagaagggactacattgtgcttgcccctcaggtcaaggtcaacaatgttaatacagcaactcccaagctttccagtgatccttgtgtcattgtggaggaaccaaggagatcaagctcatcatcccctatggatatcatctccacgtactctcgctccctctctgggcgtgagatggctctctctgaggactatacctgtataatttctcatggaccaaacccaaaaacaacttatatatttggcgattgcatcctggattgtgaccccaaggacttgggaaaagaagatattgagatacacgaagaaggggatgattcttttagcacagaaaaacctcaaaatcacaggttcttctggctccaacttacaaagcagcattgagtggtctttttaaccttgaactaattacatctctgacattttatttccgtgaatgaacaatagggaagtatcagcagaaaaggaaagtgagaacgctggtgctgaagaatcatgttacgaagaggaggatctgtttcctatggcaatgcctcttaacccgtaatgagatggccagagtgaagggggtttattgtgtgggcctctccctctttgagtgtgacatttagtgttgtaaggttaggtgtggggatttttgtgtgctcaataaaaagctttgattcgggtgagttttgctgtggcctgatgccccggctcatcccttttcttcgtcttgttttttttttcttcttactttgtatgattgcgttgttactactgatcctcatttgatggacacacttgtgttttctctctatatcaattgttttagtggctcacgttgctgaataaaaatggatattatcgatagggcatcttttattctattttgggatacaagaatgattgaaacacaatattggaaagaaaagctaagttgcaaaaaaaaaagaaaaaggaaaaaaagtcgaccacagtgggagtcgaacccacgaccttttgatccgaagtcaaacgcgctaatccactgcgctatgcggtcattcttgttacttatatcatgaacaacatggtaagccaaaacttcttctttcctctttcttctttctgttttctggtcgctcgttaccaccaagacctcgtcgaggtttctctctctctgaaaaagtgcttttgctgcgtttccatgctctcggaaggaacttggctgaatcgttggagaattatcgatctggcgtcgttggtgcatctctagctgcgccaattcatcggatccggtttgatttctccctttcgcgaatctagccttccgtgatcttaggtgggttttccgaattgatctgtaattgaggatgtaaatcgaaactagggatttcctagatctcgttagctgtgtatttgattattgcagcagagtttttgtttaggtagagatatagggaattttgatatagggacacttaaattttggtgtatcaatttgctgcagcagccatgttctatggcacagctgtatgggacccttggcttatcgttggccagattatttgcctccaatgctcttactatctcactcttggactcttcaccatggtctttcttggccttcgtgttcctcgccttagtcttgtctacttcttcgattacgctactctcactacttccaccttcaccggttggtctgttattgcctcattcctcttctcttcactcgctgggtattttgctttgccccctagtaatagtatccatccatttatttccctctttattactagtcttttcagattccttgtattcattttaattggcagggctgtgtacatgatatttttggtggagcgagcacggaaatgcttagatttctctgcaactctctacatcatacatctcttcttttgcatcatgtatggaggatggccttcctctatggcgtggtgggttgttaatggaaccggactcgctgttatggctttgctagctgagtacttgtgcattaaacgcgaacagcgagagatccctatggatcgcttccactcaagtaagatgatcattctttcttgaaatctctctgtgtgaacaagcatatctttaccttttactttctcaagactgacttaacatgaaattaaatttggctgcctatgctgctgctgcaggggtttgaagattggtgaaagaacaagtgatgaagattcttgtgggttagcagcgcgactcgtagagcctagtagagcctagtactcttaacaattgtgatgtacagagatgaaatcagaggagtagaatgggcgaaaggaagttcagctagccaagcaacaatgttggacactggtgcaccaactctgactgcaatttttagtgacttcaaatactaagactttggaatacgtttcaatttgttcttttgtatgaaaaaaacattagactcgaataggttattgatttcatgttgcttcttttttttgtttatactggattttctcttctatcctctacttggtgcagctttgtgtgttttaaaaccagtgtctcattcatcatactcttttaccaccaattgaatccttccaatttactgttttttgggggggaaaattactgtgtactaacaagtaaaaagggccgtccgtcaaaatgtaacatctcctatatacggtgcggtcaagttaaaaaaaagagcaaaaacgcgtgataaaacgacgtcgaattagagatcctactagacccagattcagatccaaatcgccaacgcgcactggaagtgggatcaccaccactgcgcttcttcttcttcgtcatctctgatcccccctgcgatcaggggccatttccgtcgataatccgatctccggttcagacattcgtttggacttgcaaag

SEQ ID NO: 8428 - DNA, 3000 bp, Unknown
  misc_feature (1)..( 3000): cDNA_ID_1989472_gDNA_ID_1971801_Annot_ID_58071 3000 nt of promoter + ATG
gtttttactcgattcttattttttgacaggacattgctgtagaggcacaaaatgaatctaaatggaagcaacttggagaattagctatgtcaagtgggaaggtgaccattttttagctgcaatcagtgttctaggattcttacaaaggttaaagctaacatgtatttttcttttcattttccttcccatgcttggactacttagctggatatggctgaggaatgcatgaggcatgctatggatttgagtggtctgctgctgctttattcttcattgggagatgcagatggaatgatgaagctggcagcacttgcaaaagagcaaggaaagaacaatgtcgcttttctttgcttgttcatgttgggtcaagtagaagactgcctgcatctgttggtggaaaggtacattgtttactatttcttacatgtggaacatatattcccgcaactaattacgtctatgctgatattaatatggttacagtaatcgaatacctgaagccgctctgatggcgagatcgtaccttccaagcaaggtctccgaaatagtggcattgtggagaaacgatttgaccaaggttagtggtagacacatccgatgcaccttgtgattgaatttcaaaccttgcctgttgagatatccacaatttttcttcatcctctgtcaatctggatatagataagtccaaaggctgctgaatctctggctgatcccgaagagtatcccaatctctttgaggagtggcaagtcgccctgtcccttgaaaatagagctgcagagacgaggtatcttttcgtcgttgccgtcattagcttattcttaaaaacagtgcttatgaggaaacctttttaattgaattgtgggacttaagccatttagagtcatgtgtctgtattacatagcaaggtagccgtcatgtatttgcttataatttgaatttatacccgtataaacataagccgaatgtcgatttcattttttcaggatcctcataaacaaagtatttttgttgacttatcttgcaggggcgtccatcctcctgctggggattattgtagtcatgcagacagagatcatacaactttagtggatgcttttagaattatgcaaatagaggaagagggtcgacttgagcaaggggatgttctcgacgaggtatgcatgtttacattacatgcattgaagaggattgtcttttacccatgatatccaatccaatggtcttggccatggtggacaatggtaggatcattaattctactgtcgctgcttcatttgttgtgaacaggttggggaagagggggaagatggagaggaagaggaggaggaggatcgtcaggaagagagtagtgatgggagacagcagaatgtggaagaagaggctgttgtggtggacgctgactctacggatggtgctgtgctagttaatggtaacgagtctgaagaacagtggggtaagattagtgaaggaaccgcatcagccttatagcatttgtggttatcaattgattataagatgtcgctgcaccaaaatatccttttgccatctgcacatatatcataggatttgcgtttgcatctgtccatcaatgtttcctcatctgtctgcctcccatcttcgtcttactgatcatcttacttttgatgttgactgtcttttaaatagtgcttctctatgccattaacttttttatcaatccgtggactgattaaatatttgtttgttgtacagttctaacaccgccacaagagtagggttggtgaagagtgaagacatacacagatagatattttcttggctttgaaacttgatacattcagcagagaaatgaggcagcacagagagagattagtttccattgttaaaaaactgatctattgatagcttccgctttgtgcttttaatacagatacatattaaaaaaaaagggggttttgggactcttatgtagctttaacttatgagagatttcacctgtagaatatctgttttgaactgagatttcacccatataatatgttttgactttcgattcaataggttatgtagttgatatcttttttttttttgcaaaactcaatagcagtagcaaaaaacttaattggaaataatcaaagtgaagggataagttgggaaagagccagaggataacgcatggtgcattattattagtattgtggaggagacgcatctcgaaacatctctcaaagcaaacaaggacccaaaacaaagttccttgcattcttccactgtccgtaatcaccatcaccatatcattattcttctacccattttgtcttggaaatgattttaaattttcttgttgcttcttactgcaaactgtgtataggttcaactactccattgagttacacacttgcatgcacctatggaagttaattttccggttttgattgatattcaagttgttgaccaatggagttatatacccttgatttatatagaaaccacatgttttatttatattaacatggtcacttttgtcaggattaatagacaacaatagttgagagaaaaagtgataaggtagagctaatttgtattaaacttatcaattagtattgttggttaaaaaaaagttaataaagtagtcaagttggataattcccaaaaactgggaaaaaagaactcaagcgtcaaatgttgtaggtgcatcatcatcagtctacaagtagtaaaaaacccattcgatttgataagaagacccaacggaaagagtcttcccgtctacaaagtaaacccaatcaatcttaataatctttaagaggttttttcttattataattatctatctctctatctatctatctgcggatctctcatgaagaaacactgaggagattctctcgctctgatctcctggtatcgtcgtctctctccgtagagatatactagtttgtcccatatccgattgattgctctattcaatttattcctcttctaggttttcggtttggccctccgatttagagggattg

SEQ ID NO: 8429 - DNA, 3000 bp, Unknown
  misc_feature (1)..( 3000): cDNA_ID_1989469_gDNA_ID_1971801_Annot_ID_58074 3000 nt of promoter + ATG
tcgcgtcaataatattttgggctttaatgggcgctataggcccatacatttgaagataataaaataactcattgtctacgatatgtaggggcagtgtaagctgaagggaaagcctttgtacgttctggtggaaccaaaccagtttgatgaattaaccttataaaagccttttctattcaacgattatgacaaataatgtaatcggtttaatcgattttgtaactaaggatttgtttgttttctattggctccatgtggaatgattcatgctagttactatgaaattcggaatacgaaggtatgcagtattatgcaccactgttcttcagatgaatgaattcaagtcgattttctagtgatttacatggcagaatttataaataatatacatcatattgtttgttagataactttactaagggggcaaaaaaggaattatcagataaacaaaatatttgaaaaaagaaaaaaacgttggcagggagtttcacgcgcaacgcaacgcgcccatgtgattaacaaaagtacgagaaagcccctgccgcttaaagatctgtatataaaaagggtaaaataaggtctcctggcctggcctttaagataaagaaaaggaaacccaatcgaaaacctaaaacccgattagattttcttagatacgaaacctctcttacgacgctccttcctcaatctctctcgatcgtcggagattctttcttcaagagtcatcttcttcttcttctccttctccctaaaccctaatttatcgcgtttggatcgaatcagctgtcaattcttgttttggttttcacggccagggccatgtctgccgtatattgcggaaccaagagatcttacttcgacgataattcttctccgccctcttctaagaggttccgatgtttttcgccttccaattctccaatctggtcctctcctccttcctcatcgctcgatcagcttcactctgcgtttcctcatattgaactcacggtaggtcttccttctattcaatccacacagatctagctttaccttgttcgcatcttgtactagaaatctcactgactaggcatttgttgacctcaaattacgcatctgtctccgatatctctcttcttcttcttcttcaccgcctgtaaattgagcatcgaaaattcacgtctcggttgcacaggttctttatgcgattggttgtaagtaaattttgtacagtatctagggtttaactagatttgcaagtctttctcaggttctcgtcaaggcactagaagataatggaagtgattttaatgctgctatgaagagcttatactctttcgcatcttctgaggagaagaaagctgaagaattggccgcaggaggtgctgctactcaggaaactgatgccgtttgtggtggaaaccccccgaccagtggtgatgactgggttgaattgttagtcagggaagtgttacaatcgtctggtacagatgatgcaaaagtacgtgcagcaagagtccttgaggccttagagaagatgttaagtgcacgtgctcgtgaagaagctggaaacaaattccaagaggtaaataaagcattgcatctttcttaatgtgtttctttcaaaatatacccttacatatgcaccttgtgcatacatactggctatcagaccatgaatagtgataatcatatttgttctttgagctctgggcatggaagacagtttcagttgctgtaggacataggttgaaccattagttacttcttatgtaggtgcatacgctcgtcactgattacaagtttgttggatctaaacacaattatgtataatggcaatgaggaatcaactgtgaaaggacaatcatcgtccatttgttctgcattaactatgatatctgaagagggtttgtttttcaatgggggaaataaagttatcatagtaattttgttcttagtaacaatctcttcttagtatttttggcatatcttgtctcaaaataacaatctcatatgattttacaggagaaagtggcagtgcagcaacaggtggagaccttggtgaaggacaacacagtcctcaaacgtgctgttgctatccagcatgagcggcagaaggcattggaggatgcgaaccatcagctaggacttttgaagcaactggttcctcagtatcaggaaaagcttagaaatctggaggtaagccttaggcgatagagagcttctgcatatcccttgctattgctttgaatggtctggtgttggttgttttaaaattgaaccaaaaacagatgttgttagaatttgatgatgcctcataaaagaaagagtgaatgacaaaaggtagaaaaaatgcaggtgaacaattacgcgttgagaatgcagctgcagcaagtggaacatggcaactcaatgccagcaagattcaatccggacgtcttctaaagctctccaagaagacaaggacacttgcagaggaggagaaggcaataaacgaaagtagagggagagagagagagagagcgatatcaaactacaaaacaaaagtgcttttgcattgtaatactgtgtagtcaggacaaacaaacattctgtttcctttccttttttttttatatatttctttggtttgctgctgtttgtctcaggcgcatttattttggaaatcaaggatgtgttttggtacatagggctgtataatttgacattgttctgaaaattcgaatcggatcaaccattagtagtatatgatatgaatgaatgattttacctgtaagaaataagcaaacgagacttttgggttacggcaaaagaagtgatggaagagaaaaataaaaaggaaagaaaggaagaaaatccacgtgagcgaggttcgcaccacaaaatcccgaatttcactctctttagcctaaaacgcttttggaatcatcgtcatcatctctcaacaatgcccgttgccaagcttctccgcgtcctcttggtagcttgagaagctcgtttgattccattttgtctctaatg

SEQ ID NO: 8430 - DNA, 3000 bp, Unknown
  misc_feature (1)..( 3000): cDNA_ID_1989468_gDNA_ID_1971801_Annot_ID_58076 3000 nt of promoter + ATG
ttccaatgattattggtttatgaatttgttgtccaggattgtatcaaaagatccatagttttacaaatttcatatctatcttcatgcattgtgaaagctgaaggaaggtacatttttattcgcataaattcagcctagaacacagtagtaagatcatctgatttgtgataaaacaagaatggattgagtatttgtgttgattttgaataattttgaagtaatatggcaaggtaaaccttatataggctgaaaatggttaaacccataccaacctactgagcccaataattggcctcaccattttgctggtcaaacctatgttccacccgagaatctaagaatgacacgccccaccactagcatatgctcatcttcttgcctctgttttattaaaaagtaaaaactgtctatcgttgtcatatttgtctgtgtgtataaagttaacttgttgacaatctggattcatagggtgccatatggttcacatctaatttaatgttttcattcgattgaaaccttcctagtagtttcaagtttgtttcaccaatgaaccaggatctcattgaattaatgttagatgtaagctggtcaccactttctcaggttgttttgagcttgagaatattgtttccttgtacatcttgagaaagtgaagaatccgctctgagagatttgtctttagataaacaatcgaattttggctcttaatgatcggattagttcttggacgagtgtaagggttttgttcttgtcttcataataaactttttgtttttttgtttttttgttcttttgtatttgctttcttggctggtaaagtgaaaaaatgcagaaacggtggaagcaagtgcagaagtagacagtgagtgtcaatctatagccaggcttgaagactttcattctcgtctattctgcattctgtgatccacgaagagtataccactcaataaagtaaagtaatccccaaggcacagccactgaggttgttacaggtcaggattctactttctaaaaaaattggtatgactgatggatctcagcatgtgggtctaatctaatattggatgtgtgatagtctcattgtcctgcatgcactggacttgtaagttacaagttgtaacaccaaaaggtgagaggatagtggatacagtgacttacactatctgccaacagtaaaaaacgcaaataagtgggatctttgattggcattttgattagagttgatgttactgttagaggagagcacagagtcacatggtcaagtccctctctttcaatcctttttatgtctttaaaaaaaaaaaaattattggaagtaaatgaaagagaggcagaggagatcttgggtagtgattgtcctcctaagatttggtgtccttctctgtctcttttgaaattaactgcacgaaagatatttgtgaggtacgcattccttgtgtttcgttttcaaacttcatcatctcttctttcaaccatttttccttttctttacttaccgtttagaaatcttgaaataaactgaccaattagatatttcagtaaaaaaatcctaacatctaaggatatagataggtgcaactcggccgcttacgaatgtattcgttgtgttcttttctgttttgaagttggatttgaaagaccactacaataatcgagtttgagtgttgttgtcgttttattgtgaaatataaggagtgacgtgtctaatgatctagagtcatagtgtgtatgtagatgaaatcatgaaaagcataagttggttcagatccgactagtggacagaaaaggataatagtctcatctgattgattttgattttgcctcttcatctgttttcagctatatatctttgaatccaattataggcttcttttgtttataagatttatttcttgtatttctgtgatgcttcaaaatgaaagctttctaatacgtctccactttgcttttcttctctgttttacaacgtataatggaactggtgatgtaatcacttatctcaaattatatggtaagaagaagtagtactagtagtagtagtagtgcggagcttaaaatgttaaaccatatatctagacgaaatctaaagccaaccaaatctctacttgtgattgaaaaaacggcatacataataacataggtggggcacaaaatatagtaaagtaatgaaatgatttgaaaatcaaacaaaaagaagaagaagaagagcaggcgtgcgcttcaacagtcgaaataggcactcgtacgtttttattttatctatctccctactctcactcacatctggaccctccttgctcctcttttaccttctttaccggttttaccattgaatcaacgttttctccccttttaacattacaactttctttggaaattgatttgtttatggaaagacagagataaatgggtcataaccactattactataaatgctcgagtttacaatttcatatcttccagaaagatttgttgattttctggtaaagaaagattcgctgtatatttttacaagtatgcgtgcatgctgtgctggcacagaatatcgatttcgttagatcaataccacaacacatttatgatttttggtaaaaatccatcacacaaaagccttgatctagaagactagaacccacaaaattaatcatattaacatgaaatctatatatagtcaaccattattggatagaatctaagatatttgaactttggttctcaatttacatagtaaatctatccaaccactatgaagtggtcgttacaagtgagctttaatttgattattctttatatatttcaatttttaaaagatatattaaaaataacaaattcggatggagacgtacgatgagtggggtgaaggaaataaatgagagatagagatagaaaggaagaattatcaatataaatgctatcataaatacagcaaaccccattctctcttcttcttcgacaaacaccaagacaaacgtaagcacaagcacgagtgagtgagagatg

SEQ ID NO: 8431 - DNA, 3000 bp, Unknown
  misc_feature (1)..( 3000): cDNA_ID_1989467_gDNA_ID_1971801_Annot_ID_58077 3000 nt of promoter + ATG
gccaatcaaagatcccacttatttgcgttttttactgttggcagatagtgtaagtcactgtatccactatcctctcaccttttggtgttacaacttgtaacttacaagtccagtgcatgcaggacaatgagactatcacacatccaatattagattagacccacatgctgagatccatcagtcataccaatttttttagaaagtagaatcctgacctgtaacaacctcagtggctgtgccttggggattactttactttattgagtggtatactcttcgtggatcacagaatgcagaatagacgagaatgaaagtcttcaagcctggctatagattgacactcactgtctacttctgcacttgcttccaccgtttctgcattttttcactttaccagccaagaaagcaaatacaaaagaacaaaaaaacaaaaaaacaaaaagtttattatgaagacaagaacaaaacccttacactcgtccaagaactaatccgatcattaagagccaaaattcgattgtttatctaaagacaaatctctcagagcggattcttcactttctcaagatgtacaaggaaacaatattctcaagctcaaaacaacctgagaaagtggtgaccagcttacatctaacattaattcaatgagatcctggttcattggtgaaacaaacttgaaactactaggaaggtttcaatcgaatgaaaacattaaattagatgtgaaccatatggcaccctatgaatccagattgtcaacaagttaactttatacacacagacaaatatgacaacgatagacagtttttactttttaataaaacagaggcaagaagatgagcatatgctagtggtggggcgtgtcattcttagattctcgggtggaacataggtttgaccagcaaaatggtgaggccaattattgggctcagtaggttggtatgggtttaaccattttcagcctatataaggtttaccttgccatattacttcaaaattattcaaaatcaacacaaatactcaatccattcttgttttatcacaaatcagatgatcttactactgtgttctaggctgaatttatgcgaataaaaatgtaccttccttcagctttcacaatgcatgaagatagatatgaaatttgtaaaactatggatcttttgatacaatcctggacaacaaattcataaaccaataatcattggaagagattaaaaaggggacataggaagaggttgtgacttacggatttacatcttgggtctgccaccgaaatgcttcaaagaaaatctggagggaccactgcgacactcgggtccttttctggaaactccccaacgtccagcatatggcaaccatcctttaattaagttaactagtctggattctgctgccggtaactcgtcttgtgctcctggataacacttctcagctacatcatccacaccgttctggttttggttttgtatttggatttcgttgacaatggatgacacatccaacctaccatacaaggattctttagcagagcattgaaatgcagagacgatataggaagattgttacaaagtacttactcgaggtaccgcttgcaactcgggctcttggatcttttgttcataggagagtggtctatcgacaaatgccttacgaaatgtaactgaaatagagtgaaagggatgttaagactttcaaaggaatgagattgcgtgcatacgattcttatatagaagtgagaaggagtttaacgaacttggtctccatcattgagaccgagataacggatgctagtcttgtcattgactaatctctggtctcgataacacaagcaaaaatgaccccagacgtgagacctgtaggcaaagatcaaagtgaacgactgtaccagaaagcttaagctgtgagaattttcatatgaaatgatgatataccatgaaatcatgccgtgaccttccagaggagaaatggtgaatacttgttccacagctcttttgagctctgccactgagcaatcctttgcaacttccacatctattgattcgttggaaaccatttaacttcttgagaggccaaatcagaaacagtaaccaaaaaactagttgatacttcatccaaaattatgtctattaaggctcttaaacaatgatttctaacagcaacaaaaaattccggattagagatcgattagggtatcaccaactgagggaaccgttgagcttgattgtaaactaaactcttaaaattgctatttcggaaactggataagcaaaatcgtaccgaaaagggagccgttgagcttaacgacggaaagcttgatacgaccctgaggaggaagtttcaggtaggaagatctccgtccagaaatcgaaccaccgtcgtttaaagcaaacgatgacaagaagcgtggatctatcaacgacctcagtcctccacttcgacgaccgtccctaaccggactatgctcttctcgcattgccgattctcccggattttcaccgacaagattctgctctctttgctcttcttcttcagccttcaggtgactgttgaggagctgagcgagcgagcgagagaatcgggagagtttgttttccggggaaaaaccgcaattactgctatatagctccccaataaatgccaaaacaaaaaatcaaattaaagtttgtcaatgggcatcacggcccaaatctaataatcaaaggcccaataacttgattcgacaatacttagcgggtttggataaccgcctaagcatctgttcgacaccgcctattttttttttttacttactcctcctgatctgctgatataaggccgaacgggaataaaaaaaaaaaaaaaggaagaagcgactcacccgaaaatgttttagggtttttctttactcgattaagctcactagttcttcgcaacgtagttagagatcgacactggcgcggtggatttagggtttttttcctccgcgactacgctcggcgtttcgatttggaaccctaagct

SEQ ID NO: 8432 - DNA, 3000 bp, Unknown
  misc_feature (1)..( 3000): cDNA_ID_3045528_gDNA_ID_1971801_Annot_ID_175722 3000 nt of promoter + ATG
cagcctaacatcatcgatcaccggaccacatagcgagccagagtgatcgcttttcatgtggtaaaacgtgctcaagaaagtgacacgtgtcctggccgacactgccttgaacacaagcctcccacgtctaaacccgccttttcctttagaagcgtagtccaccatgaccttgccctgtccagcgaacgcttccacaatcattggtccctcacaaccgtctctggcgtctcccacgttgaacgtgagggcgtagaatttgttcagtgacgtcctcactatctgagaaatggcgctctctttgcctccaacaagctcgatggctcggtgtccttcggggacagcgaagtgtgctttgtctacgtacttaacggctttgagagactcgatcatccaaccgggcaatgggctgttatcgtcctcgatgaacggtgggatcagtactccccattttgccgtgggaaacacgtaaggtccttcttcgaaattcccattctttatcagattatctgcaaacagaggtcaccacttaatcaccgaatccggtttactctaaaagattaaaagatatgaatatggtcggttccggtttacttacatccagagaatctgggagggaacaaagccttgatagccacggcgtcgatcaaaggtccgcaagccgggtgctcttcaacaccagggttatggaaccggatctcgatttcgggaccaccagctttaaaagcccatgagtatgagtcccaaccatcgctgccgtacatcgtctggatagggatcacacctgactcatgcgtcacggatatattgagcctctcgtcttgagcgcaggttcgagcggcgctgaacgttattgagtacagacggccaggtaggacggatattttctgggagattgaggcttcgttgcctagtctaacggcggaggaaccctgcggtacgaccaagaccatgtcatcttgtttctgaccggatttaatgaactccacaaagccgattatgttccagtttggtacggcggttcgttccttaaccacggatcctttcatttgggagggtttaggacccaactcgaagttgccgtttggtaataaacctgaaacaaaaaatattaagaaatgttaatttataatctcggatttgagttgaaatgagctttaactagagttactaccatcgcggactggggccgataagacgacattcgaagagatgaagaggagagctaagaggagtgctgcttcttggtacatcatgacttccttgggtgatagatgaagatcagatggtgagtactatccaaagggtgaagaaaggctgggtttttatgagtttgagaatagaagacgagcactggttttgaagaaaacaacgggaatgccactggaagcatcctgggttctattgtcaggtgccacgcagacacagacagctagctcaggaaacatttgacttcatgattagcatttccatttcttcaatgtattgtttaaggggctgccttaacaaccattatattaaactatatattcaaacgtaatttgcgtttgcctatctaaattattcacataaattttcaaagtattaaaatattttttggctttttcagaaaaacatttttgaagatcagtacatccatgcgtaaacgccaaaaaagttctttttgaaaaaaggtttacgggtaagtattccttaaaaagtgattaatctggaaaaaacatacacactaattaatataaatatatagggtacgtaacaactaatgcaaacaaacaacggaaaactaaaatatgtagagaaaaaaacatatatatcatcaccactcaactataatgccatggttttggaaaatgaaagaaatataatgtatatttgagatgtctctaagattagtcatttaacgccatgcaactcatcccaactctaatcaataaaaaataattatgattttcgtatagaatgcgacaaccaaaagttaatgacgggggaaaatatgtgctgttttggaataaatcaactcaacttaaaaatgaagtcaaaaatggtattgattgatgttagatattgatcacattgggatgaacacgtgcaggggtaggttgttttctggtgcagggcacgactgccgactttaccgcattagaagtttcgatcaatattcctaatgtccttattaacatgtcaaccattatcataatccaaactcttcccaacatctttgattaaattatgtatacattagttttaagtttcaatttgttaggcaaagtagagagggacattatggtgaaaaaaaagacaagggacattaagaaactttagttatacgtcaacatatatataaaagacaatggttgggagagagatcacgtgcgacaaggctggaaagattgatttgccgtaatttcaaagcgaaggatttaaaaaaagatgagtcagaaaaaaaagatgaggatatagttcgggggtttgaacccgacgtgaatcgaacacgcaaccttctgatctggagtcagacgcgctaccattgcgccacggatcctcaggtaattacatctatacgtttacttatttatactaacaattagtgaatgataaaaaattaaaaaccccttccgattctaatttcctggcggagcaaatttagggtttatcgtttgcatcggtctcgcgtctcgtttcccacagacacatctctcgaatcttttgaaggccttcattgcaatagattgctcgtaagggataggtaggcctttatgttctgccgcttaatttcttcgccggattctgtttgattcattttaaggtgagtgaccccatcgcttttagattacagacaagtatgtatttatggtttgaatgatgcttattgtcttgttgttagcttagattttacattcagccattaatttagtattaataagcttcggttctacttgttttaagcagttaaatgctttaatctctgaatctttgaaacttgctcctctcttaggaattagg

SEQ ID NO: 8433 - DNA, 3000 bp, Unknown
  misc_feature (1)..( 3000): cDNA_ID_1989479_gDNA_ID_1971801_Annot_ID_175720 3000 nt of promoter + ATG
gaatgcgtcgccgatcaattgcatttacccggaattacccttttgtaaaagtactttcttccttgactatttttgcactttaaggatttataatcagtactattcatgatatgaccccatgcttttagaatagtttatgatcaccctaagaaatttttaccatagttgcattttcaagtaccaccaatgtcagagatgacgaaggaagcggtatactcgtttggtcttcaaacaacgcaacttcaccaatcaaatgaagaaaccgtaactttaattaaatatgaaccatacaataatacaacttttcaaaattttgtccagagaccacaaagtaagctaattttgctatatactctacgtattaaggacaccatcctcaattacaaacatttgcaaccaaccaccgttcatcagaaagaatgaccaaacaccagagaatatgaggatcaagattcaagaccatgctctgcattctccgccaactccatcttcttgtgctcctgctgatgagcatcctgatttcttcctctcactgtccgtcgttaagcagccggacttccccaccgcaacaggtagcttctaccgcctccttcaaacacaaaaggaaagcataaatatctagcatcaaatactctaaggtccttccgctaactgtataccaaccttttccgtgctttcttttttgatttgttgtcgcagatttgagtcagaatctcctcaatgtctacagcatcatctacatgcgttttcaacaaattgcagttatccaaaagcctgagttgatgaacaacactcggagcaagagaagtatcattttgtacccttttcctcgcgtgctccattagcacaagccctgcagaataacatactggattcataaggtcaaagatggaaagcttcacaaagcaaccctgatgtctaatcatagaagaattttcatgattgtgcaacattttgaaaagtctaaggaagcaagaagagaaccgagagatcggagcaacttaagatcaaatttgtcagctagttcttggtgaccacttattttggcgcgttgaatggctagcttctttaagctgatgagcaaatcctgcaaaacaagttcagcggatatctcggtaattcatcgatcgattaatgtttgcttgactgacggaagaagcagaatttaccagttcagattcagagagagagcaaaaccaagtgagatcatctgtcctattgttcttcaagatttgggttaattcctccatcctaattcctaagagaggagcaagtttcaaagattcagagattaaagcatttaactgcttaaaacaagtagaaccgaagcttattaatactaaattaatggctgaatgtaaaatctaagctaacaacaagacaataagcatcattcaaaccataaatacatacttgtctgtaatctaaaagcgatggggtcactcaccttaaaatgaatcaaacagaatccggcgaagaaattaagcggcagaacataaaggcctacctatcccttacgagcaatctattgcaatgaaggccttcaaaagattcgagagatgtgtctgtgggaaacgagacgcgagaccgatgcaaacgataaaccctaaatttgctccgccaggaaattagaatcggaaggggtttttaattttttatcattcactaattgttagtataaataagtaaacgtatagatgtaattacctgaggatccgtggcgcaatggtagcgcgtctgactccagatcagaaggttgcgtgttcgattcacgtcgggttcaaacccccgaactatatcctcatcttttttttctgactcatctttttttaaatccttcgctttgaaattacggcaaatcaatctttccagccttgtcgcacgtgatctctctcccaaccattgtcttttatatatatgttgacgtataactaaagtttcttaatgtcccttgtcttttttttcaccataatgtccctctctactttgcctaacaaattgaaacttaaaactaatgtatacataatttaatcaaagatgttgggaagagtttggattatgataatggttgacatgttaataaggacattaggaatattgatcgaaacttctaatgcggtaaagtcggcagtcgtgccctgcaccagaaaacaacctacccctgcacgtgttcatcccaatgtgatcaatatctaacatcaatcaataccatttttgacttcatttttaagttgagttgatttattccaaaacagcacatattttcccccgtcattaacttttggttgtcgcattctatacgaaaatcataattattttttattgattagagttgggatgagttgcatggcgttaaatgactaatcttagagacatctcaaatatacattatatttctttcattttccaaaaccatggcattatagttgagtggtgatgatatatatgtttttttctctacatattttagttttccgttgtttgtttgcattagttgttacgtaccctatatatttatattaattagtgtgtatgttttttccagattaatcactttttaaggaatacttacccgtaaaccttttttcaaaaagaacttttttggcgtttacgcatggatgtactgatcttcaaaaatgtttttctgaaaaagccaaaaaatattttaatactttgaaaatttatgtgaataatttagataggcaaacgcaaattacgtttgaatatatagtttaatataatggttgttaaggcagccccttaaacaatacattgaagaaatggaaatgctaatcatgaagtcaaatgtttcctgagctagctgtctgtgtctgcgtggcacctgacaatagaacccaggatgcttccagtggcattcccgttgttttcttcaaaaccagtgctcgtcttctattctcaaactcataaaaacccagcctttcttcaccctttggatagtactcaccatctgatcttcatctatcacccaaggaagtcatg

SEQ ID NO: 8434 - DNA, 3000 bp, Unknown
  misc_feature (1)..( 3000): cDNA_ID_3000102_gDNA_ID_1971801_Annot_ID_175719 3000 nt of promoter + ATG
ctcatcttttttttctgactcatctttttttaaatccttcgctttgaaattacggcaaatcaatctttccagccttgtcgcacgtgatctctctcccaaccattgtcttttatatatatgttgacgtataactaaagtttcttaatgtcccttgtcttttttttcaccataatgtccctctctactttgcctaacaaattgaaacttaaaactaatgtatacataatttaatcaaagatgttgggaagagtttggattatgataatggttgacatgttaataaggacattaggaatattgatcgaaacttctaatgcggtaaagtcggcagtcgtgccctgcaccagaaaacaacctacccctgcacgtgttcatcccaatgtgatcaatatctaacatcaatcaataccatttttgacttcatttttaagttgagttgatttattccaaaacagcacatattttcccccgtcattaacttttggttgtcgcattctatacgaaaatcataattattttttattgattagagttgggatgagttgcatggcgttaaatgactaatcttagagacatctcaaatatacattatatttctttcattttccaaaaccatggcattatagttgagtggtgatgatatatatgtttttttctctacatattttagttttccgttgtttgtttgcattagttgttacgtaccctatatatttatattaattagtgtgtatgttttttccagattaatcactttttaaggaatacttacccgtaaaccttttttcaaaaagaacttttttggcgtttacgcatggatgtactgatcttcaaaaatgtttttctgaaaaagccaaaaaatattttaatactttgaaaatttatgtgaataatttagataggcaaacgcaaattacgtttgaatatatagtttaatataatggttgttaaggcagccccttaaacaatacattgaagaaatggaaatgctaatcatgaagtcaaatgtttcctgagctagctgtctgtgtctgcgtggcacctgacaatagaacccaggatgcttccagtggcattcccgttgttttcttcaaaaccagtgctcgtcttctattctcaaactcataaaaacccagcctttcttcaccctttggatagtactcaccatctgatcttcatctatcacccaaggaagtcatgatgtaccaagaagcagcactcctcttagctctcctcttcatctcttcgaatgtcgtcttatcggccccagtccgcgatggtagtaactctagttaaagctcatttcaactcaaatccgagattataaattaacatttcttaatattttttgtttcaggtttattaccaaacggcaacttcgagttgggtcctaaaccctcccaaatgaaaggatccgtggttaaggaacgaaccgccgtaccaaactggaacataatcggctttgtggagttcattaaatccggtcagaaacaagatgacatggtcttggtcgtaccgcagggttcctccgccgttagactaggcaacgaagcctcaatctcccagaaaatatccgtcctacctggccgtctgtactcaataacgttcagcgccgctcgaacctgcgctcaagacgagaggctcaatatatccgtgacgcatgagtcaggtgtgatccctatccagacgatgtacggcagcgatggttgggactcatactcatgggcttttaaagctggtggtcccgaaatcgagatccggttccataaccctggtgttgaagagcacccggcttgcggacctttgatcgacgccgtggctatcaaggctttgttccctcccagattctctggatgtaagtaaaccggaaccgaccatattcatatcttttaatcttttagagtaaaccggattcggtgattaagtggtgacctctgtttgcagataatctgataaagaatgggaatttcgaagaaggaccttacgtgtttcccacggcaaaatggggagtactgatcccaccgttcatcgaggacgataacagcccattgcccggttggatgatcgagtctctcaaagccgttaagtacgtagacaaagcacacttcgctgtccccgaaggacaccgagccatcgagcttgttggaggcaaagagagcgccatttctcagatagtgaggacgtcactgaacaaattctacgccctcacgttcaacgtgggagacgccagagacggttgtgagggaccaatgattgtggaagcgttcgctggacagggcaaggtcatggtggactacgcttctaaaggaaaaggcgggtttagacgtgggaggcttgtgttcaaggcagtgtcggccaggacacgtgtcactttcttgagcacgttttaccacatgaaaagcgatcactctggctcgctatgtggtccggtgatcgatgatgttaggctggtagcggttgggaaactccgaggatgaaagttggggtcgttgactcattcggttgaatatactacattaatggataattgtaattcatgttacataataaaaatgtaatttacgaactagtcccacaaaatttattaactagttaatcaccgtttcaacatatattatatataacggagtttcattttttcttctgagaagtcttaactcaactttacgagccaataaaatctaataagagatagtattagatcatatgcgttaattaatttttaagaaaatatatatcctacaaaaatttatttaatcatcgacagaagtttttactttaatcttgttacatattgattttgatttttgtttcaaattagataatgggtcaacaagtcgcatgatccaggcccaacaggccgtcgccaaaaagtcgaagtcttgttcaatcttcaatttattcaattcatttccgtttgaaggaggtagtcggagactgagaatcatctgagatcggaaacgacaaacctaattttcccgaagaatcgagaccattatg

SEQ ID NO: 8435 - DNA, 3000 bp, Unknown
  misc_feature (1)..( 3000): cDNA_ID_3045538_gDNA_ID_1971801_Annot_ID_175715 3000 nt of promoter + ATG
agaaagaggaatattttggttctgagaaaagacataaaaaaaacaatagagaaaccttgtaaaatcccgccaaaattttcacagaacccctaaaaaagtttgagtgttgccgccatccatagatttattccaccatcttcatctctggaaatccttcgccgccgcgagaattgacattgttttgattgcatataaatctccgcaacagtatggtacgttttgtttagatctacggttttgttatcatccgttaattcggcgacatcagcaacgatttgcttcatccacaaaccgaataggttcggtttaaacataagcctgggatttgagtcaattatttgcatttgcctacttttttcaattttctgggcacgccagatgtttgatgaattgctcgaatagatagatgtcaaagtgaagcgaggagacccgccgattcgacatgtacgggagaaaagggtatcagcttatcaaagattttgccaccggagagaagggtcagctcaaacctttcaacgtaagacttcaagctcccacctttatgacactaaatctctcaatttatacaggctattgaaatttttgagtatctgtaatctaacgtatatcaatcttgcaagtttggccagtaggttttgattataggtgacggaatgttagcaaatttccagtcctgggttgataatatccaattctgtaattagaaagtattatcttggttagctatgaggtagattagttctttaacctcttgtatttctaacagagcaaactctttgatgaaacaatcgaagagtgtgaccagaatcaccatcttatccagtccttgataaggtattgatccccttttttacactgttgcattttttcaatccatcacaaaagacttacttctgattcattgaggttgatgtttccatttacaggaaaatgcaacaagaaggtttggatgttcagaacaacagaaacgctgaccactatggagcactaattcaccaccttgctttgatccggaacaagcgctgcctcatggcttatgtgtgagaaccacgtttcctatcagtaacactatatctggacactcaatttcttaaaaatagctgcaattggtgtcgctatgcaggtacaaccgagcagaaattgtgcgtgatttggcatggagagtagggcttgaacttctcgaccttccctctgaaatccaagagaagctcactacactagagaaggaatacttcaaaaaccattcggttgctctaaaatcatacatgggaaaagtaggaatcgagttgaatgtcgtaagtcctctttccaccaccctggcttttattaattaattggatttttcttgtttggtggacttgtaactagtaatctcctcttgatccatttcttgaaggatatggtccctcctaaagatccttatatcaaggtcagaattttggatgatattgatgaaggaatcgtgctgagtgacaaaacaacaaattttgcccgtcattctatgcatttcctcaaacgtactgatgcggaaccatacattgctcgggtcagtctttttcgttattccttccctaaaactagaatgatctaaagcccataaacttccacgaactgagaaattcaaagaatgagccttgctcaaattcgcagagatgtagatagaaccttgattacagccttccctagcaggtttaataggaaaaaagaagactgcttaagatagattataactgaaaaaacgaaactatagaattcctgaaagatctgaatagtgatgcaaatagaagttttaggtttagaatatgcgtgaagtgtaatctgaagaattgacttttgtcacatttcttggtaccgtcaagattacataaggtcgaaacatttcataaactgtgagtgtattggattctttggttttccatgtgatgtttgtcatagtatgccaaaggagttgctaagcaaatgcagtctgattctactgcctagcttaaaaggggtctcgtgtcccatcatttggataaagagtttctaattgttgagatgtgaatgggataacagggccaaatggaggagctgacaggatgattgatctaatcagaagctgtggtgggctcagatgaatcacggtcgggtctgtgatcaaagaatgtaagcttacttagccttgtataattgtaagacaggaacatgaaaccagaaacctcatactcaaactcatgtaacaattatttatcttacaaagttacttctgtagtgcataacattcactagcaataatgcagttttgacaagctcaaaattaccttttttccaatggacaatctttcaaggcttcaatactcagtctttttgttacttgctggcttttcactatagaagtgaacctgcagctaaaaagataagaatctgccacaaatgctgcagaaaaatgagaatatgtcatctacaaaacatacctcaagattagcttgtaagatctgaatagtgatgaggcatttactcgaacgatgatcattgtcacatctctgattaatgtaaacgataaacggatttttgatgtttccatatagtttgatattgtctctttccttaggcgttttcaaaaccataaacataggtgaatgttatttacaatgtctctatagttatgattaatttgagttgctactcatcttgtttctgaaaggaggaattcttgcatcttttgaggattagttttttgacttgcatacagaaaatgtgttcttagtctcttgccttcttagttgttaccaccactgcttcgtcaatattttattattggattcacaacaaaaaaattcctctttattttttatgagaaaaggggaaaaaacacttaaaaccttttgtgttgaccagaaaaaaaaagagggataaaacgtgggggtattaatgggaatggggatgttccacatatttctgaaatttttttccctctgctacgaaacctttgaaatttgtgtcatcgaaatcgaaaccaaa

SEQ ID NO: 8436 - DNA, 3000 bp, Unknown
  misc_feature (1)..( 3000): cDNA_ID_2040042_gDNA_ID_1971801_Annot_ID_175709 3000 nt of promoter + ATG
gtattgattctgtctcctctctctgctcttttgctcacggctccgcacaaggcatcattcgacctttatcctgtttctaactattttagtaatttgtaaagttttggggtgtaaattgaattactatgtaaatgcaggggtcatattggaataaacaacaatgttttagttaaaaggcctgtataacaatgcaggcccaaacaaaaagatatgagcccaatagtcactgaaattgttttctcaaacccaaaaaacctaaaaccttaaacctccgtatgtgttccgtcgttagcctcctgctaatctccatctcagatcgcaatttctcccttttccggtcactgctccggcttacgactatagcgttccgagataaagttcggctgtgttaattaaattcgccgtcggagggattttacggatatggctgttgttgaatcgcatggggatttaggttattgtcgattgaggtaaatggatgtcgagggtttgctcaactcttcgctctccttatctttgaagctggttctatagattggttagtagatcttacaaattgcaaagattggagatttgggggatttgaataagctacatgttattcgggtatgtttaggctcgagggaggccctggatcatgctatctctgcgacacattcgcagattctgccattttccttcctctgcagccactggtattgcatatgtttcaacagagtccaatcagatccagggtttgaaaccgctcgaggaacctgcccttgtgaagcttaaatctgagcgagaccctgagaagctatacaatctctttaaagctaatgccactaaccgtttggtgattgaaaatcgatttgcttttgaagatacggtctctagattagctggggcaggtcggcttgatttcattgaggatctgcttgagcatcagaagacacttccacaaggtaggcgtgagggtttcattgttaggattataatgttgtatggcaaggctggaatgacgaagcaagcacttgatactttcttcaatatggatttatacggttgcaaaagatctgttaagtccttcaatgccgctcttcaagtcttatctttcaatcctgatctccacaccatctgggagttccttcacgacgccccatcgaagtatggcattgatattgatgcggtttcttttaacattgccattaaatctttctgtgagctgggtattcttgacggggcctatatggcaatgagggagatggagaaatcagggttaacaccagatgtagttacatatactacacttatatcggcgttatacaagcacgagaggtgtgtgattggaaatggattgtggaaccttatggtcctcaagggctgtaagccgaacctcaccacttttaatgttaggattcagtttttagtgaataggagacgagcttgggatgcaaatgatctgttgctgttgatgcctaaactccaggtggaaccggacagcataacatataacatggttatcaaagggtttttccttgcgaggttccctgacatggcggaaagagtttatacagcgatgcatggtaaggggtacaaacccaatttgaagatataccagacgatgattcactatttgtgcaaggcaggaaattttgatttggcttatacaatgtgcaaggattgtatgagaaagaagtggtacccaaacttggacacagttgagatgttgctcaaagggcttgtgaaaaaggggcagcttgatcaggctaagtcgatcatggagttagttcacagaagagtacctcctttcaggtcaaaacagttgctctcccttaagtccattttgtaatgtttacatgaaatggaacaaatttgctacatgtacacgacaatgcggccaaaagaattctttctttctttctcctgagtttattttgtatagctgtggtggaactggaaatgggatgtagcctcatattaggaggcacacttatcttccaatcagattcaactatttgttgttcaatgtgaataaagcttaggatgatttggaaacttcaatggagggatacccagtaagtcatggatgcctctacaatcttaagttgtgatagcacagaactagtttaccttttgtaatgctacttacaaaacatgttgttgatttcagctggagagcaaaatggcatacacaaagcagggaccatgtgctgaagaaaccaaaaggatcttcgtctgacgatgcaaaagctcttgagcacctggaaaaatgagttatgttgtaagcttcatctagccaaattaaaagcactaaacatataacaaaggatatcaacgttgatagctttttcttgatatagcacgaatgtaaacaacagagaatagaacagagacaacattaccagcaatgaatatttttattattatgtcgaataaatacattttcccacaagtgacagagcaaacaaaattcacatatttttgtctattacactttggtgtcagactgacttgttacgtagatttatggcggtggattataacattgtaactttaaatatcttttaacgtaagaaacaaaactccaaaattggtgtttatttttaaaaataaaaatttgagggggcatgtatgtttgtttagttgattcacgtgttctttgtgtctgaaaattctgaatttgatgattttgaaaaaggaaaaaaagatacgaggtatcctcaattccaaaaggatgaatgatacaactcatatatacaagattatagtaaaaagaagggatgcatataaagaaacatagacatcatcgccatccatcctcagatcagttccgtagtttactggatcacgacacacacacatatacacgtgtacatataagccattcttatcaaaatgaccaccttcctcctgaattctcattcattatataggcgtatatttcggaattctaagttttgttgctacgatcgagccagcgttctgtttctgtacgtctctctgggtaagaaagaaaaa

SEQ ID NO: 8437 - DNA, 3000 bp, Unknown
  misc_feature (1)..( 3000): cDNA_ID_1989485_gDNA_ID_1971801_Annot_ID_175703 3000 nt of promoter + ATG
ggccttgaatattgtttggggacatgagcaaagatactggcactggatctctctccctaacaccaggtctcctttttttctgtgttacaaactagacttcctcttctgcattgctttattataagatactaaatgtttttgtgtgcacaaacaaacaggttcggagaagtggctgagctcatcatggtctggtggcttgagatcactggcaagatcaacattacccttctctctgatgacaccctctacgccgcttacttcgtctttaagtggaaccatagtccttacggttttcgccagcctgtagaaacctcccttgtcttggctgacaccgagagcactgacaatgttgttcagccttccatgattagtctcatgcaagattcaggcggcgaagaaggtcagtcccctgtgctgagaagagacggttggtacgaggttgaattgggacagttctttaaaaggagaggagatttgggtgaaatagagatgagcctcaaggagacaaagggtccttatgagaagaagggccttattgtttatggcatcgagattagaccagtgccctaattgtatcctactcctaaatacctttgcggtttccagtgttctcttgattctcaaccctgtgttgttatcttctctttccctgccttcttcttcttttccttttctatattgatgcagaagaataatgtttttttgaaaaatgtttttatatgatcagctttttgattatgacattactatatatgcttgaatttttgtcttggtttgcaataatgtctgattgaaagagaaatacaggcaaataagacggtagtttagcagtttgtgtttatatcgttgttgtattaacgcctaagctaaaaaaatcttcatgatacatgcatgttaatatgttatgtgatttgaagaagaagaaaaatatgatattggcacggttctaattttgagaaaattgagagcacatgcattagatatgatcattctcatagatagtgctggaggttagagaccgactttaccaacgtgttcattacgttttctactcgctttccatttttctttactcaatcaggtcagatcgaaacgttggactcatagttccaaaattagctaaaattagatacttatttattaaaacaatcctgtacttttgacctaattagatatttcggcaaaatatctaacaaatatccccttctgatcttttggtattttctcaaaataaactaatccaaaccgaaactaaaattatttgatggaacgtacattcgttaaatgaatttcgcagacataaataactttactttattaaaagagagtaataaattggaattcaattatataaaacttctaactctttattattaaatgaaagttataagattttcacaatccatgatactgcttaaaaaatttcactgcactgttatcatacaaacaaagaagaaaatactatgcaatttctgtaagaattgatgactgatgggaacgttatgattatgttatcttcaactatggagtgaggatctttatttccatactatacaggccactcgatgggtctatttgaaataatgcaatagatagatagatgtatatatacacacacaacaaatatgtgtattgtttatacgctccgggataaacacacattttccacacttttaattcgttaccgtttcaggaccaattttaaaaagaaggttggtactatactattgactagctagctggtcagggaccttgatggtacatggaagtttcatattttatacagaaacaaaataatagagagtataagaatatcaacgacgagatctgagaagatttgttttctcttttttttgttatcaaatatgagaagattttgtaaatctgtaagttttaatttataaaagttgagatgcaatccagtgactccattcttttaaaatccactagtacttagttaccctaatgttaaacgttgaaaaatgagatttagattagttaacaagactttatagttaactaatcatataggggaatcaataatatatatgcaacttttgatgaccacactgttagatgctttgtttaaataaaactaaagatagaaagaaaagtacccttttgatctgtactgattgtataatcgttctataatatgtggaatattgtaaagaatcgaaaaaaggagtgaaggagaaacagtgatcggaaagaaataagtaatgtaaggttataatgttgcctaagaccgtcaaacaagaatcttcaaaagtatacacgaatatatatgtaacaactcaagtgattaatatcaaaacggaaaaacaactaaatgttgtaaatatttatgttgtttgtcaacatgcgagtttaaatatggatggtaccacatggatgataatgacaacacatactaatatatgtcttggccaaatgtatgtctcctaatagattgggagtaattgagcaattattacctatatttgataagatatgtcattatgtgtagtatcatttaacaagctataattaacatactttatatatactggttagagtaataaaccaaaagctcacttcacccaataagtgaaacagaactttaaatacgtataagccaattcaaagaagaagaatgaaaaatattgatagttaaaacacgaaatcatcatcccctacgtttgttaaactcttgaattgtatcgcacataagatatgtttaacgtgacgtagtaaaaaataacggtgaagaagtgaagcgcatctatatgtacttaaactttttgaacataagttgaagcgacgagtcagcggcacgtgtcaagttagcattagcttaaacagtaaaattcgcgagtcgtcgtcttataaatgctgtactcgttgtcttcctttccccaaccttcactttcctctcaaatctccaataagtaaactctctcatcgaaagcttaaaagcatcatcaccacaagaaagaaaagaaaagagtagaatcgaac

SEQ ID NO: 8438 - DNA, 3000 bp, Unknown
  misc_feature (1)..( 3000): cDNA_ID_1989486_gDNA_ID_1971801_Annot_ID_175702 3000 nt of promoter + ATG
atttacaataatatttagctattttcatatatcattctatactagctcacaataattacatatgagcacgcttttttgtgttcaaatattataaatcttcgttagttaccgctgctttttataattatgtatactttctggttccaggagactaattaaggaagattattagaggcttcttatacgtgccatatgattatttatttatgtactgtcatggttcatatatagcgatgtgataccaatataccaatcaccaaagttatgagaaaatcacgtaaccagaggtgttggtacatacattttctgttaaaaatagttaagaggacttgtaatcttttgtgtttaactattgataattttttactttattcggtgaaacaatttacgcatgtttctgtgttgtgcttgtgtttcttgtattcttcttgtgtatagctttccttataagaaagaaaaagaagaagattaattgattagatcgagaaagagaaaggccttttgagatagaaatggagaaaggatggattgaatttgaagcatagagaatagcgaacactcactgcaaagttagtgggaaagtcgcgcgtcatacgagggagcaacaaagtgtgggcttttcttttacagtctcagaaactaatgcatgctcacatttaaaaaaaaaaaaaaaaaaaacaattcttgtgttaaatcaagagtggattaattatgagataatctaatgtacattactgttatatgattataacttgacagaccaaataatcatcttaatcagacctgataaaagaaaagagattaatttcaacagtgagaaattaaagatagaaagtacatattattggtgtaaaagttgttgatttaatttaaggcagatgtattaagttaaatatgtaaatgtagaggctgcgggaagggtgaccagctggtctgacagggtacgccggttgtcgggaggaagaacgccgctattggcagagtcacgcggggtaaccggctggcggctgtagccggtcacagagtgtattaatatggtcgtacaatacttgtagagtgctttttcctgtgacggtcccgtttattccccacaccctcctcgattctttcacttaaaagtgggggaaaaaggtaacctgactcttagaaaatttgaatacaattgtgggtcacctcatctcatgtagtcatgtctatacaattataaatacctctcaacaaacccaaaatcgaattataagccttctctagctagaatttgaagcaagacctgttcacattagtaaaaacaaatatatagaaagaggaaagattgaagcggaaaacgggacaagacgggtgtgccgttgtggatgttggggttgggtgtggaccggcttcaagccgacatcaaccggctcctagcctctcttttccaccagggagtgctggacgagcagttcttgcagcttcagcagcttcaagatgagacttcaccaaactttgtgtatgatgtcattaatatctactttgatgaatccgagaagttactccgcaaccttagattattgttgtgagtttcttcctttgttaatgtgttccatagttgtatgttgtttggttccaaaatgtatacgtatatatatgttatgaatgatgacgaatgtaaataaataaatgaacaggatggatagagaattctcggactataagaaaataggattacacctgaatcagctggtgggaagcagttcaagcattggtgctcgtagggttcgtaacgtctgcgttgcctttcgttctgcttccgagcttagcaaccgcccagggtacaaattaaacgagctatatatatatatatatatatatatatatatatacttctttgtattaatatataggtcaatatttaagtcaatataatgcttcataaatgtgacgatgcttcaggtgcttgagaggactggaggtagtagagcatgagtatcattacctcaagaacatgatgcatgaactcttccaggtacttacttgttttgttaatatattactcacattcacacaaacagaaggcaaaaacgtgagctaaatatacacatatatattgatagtaatatatgttaacaattatgtgggatttaatattttgagtggttgcagctggagcagcagagaatattagctgcaggagtcagatatccaatgtaaaattagaattttgtcataaaaatcagagaaaacctaattagtgtgtgatgatagtgtgttataagctaccgaagcgaaaccctttagtttcttctaatgatgttttgttgttaatctctccataaattcgagatacattaccttttgtattttcaagtgagatttacccatgtcaaaagtatctttacatgaacataaaacatttagtacccaaaaaaacagaaaaaagaaactgggctataaaatgaccgacagaaacggaagaaagtaggcccaatgtacggcccgttcatctcaaataaatgatttagttttgtttttgtttttttcattttagcaaagataacgatttctgagcaaaaagaattggaaaatgatagaatataaagccgaaaaaatattctgtgtttattttcaaaatcttagaatcataaatgtgtctcgaatgtaaccattaactgattttctggattgtcccaaaaaaaaaaaaactgattttctggataaaattagtaaagagaaggggacaggtgggtgttgcttactctagtagtcagtcatgaggaaagtaatctgaaaaaaacgagtaaggaatagacacgtgtggcttcatccctaagtatccgtttttacttaactaatcaatgcacgacttccacgtctctcttttttttactagtataaaactcattaaatgtgagcgatactttgctcgatcgaacaagtcgtatctatataatcgagaaagaggaaaagatcttttaaaccccaaaataatcaatcaagcaaataagcaatcaatcggaggaagca

SEQ ID NO: 8439 - DNA, 3000 bp, Unknown; identical to SEQ ID NO: 8431
  misc_feature (1)..( 3000): cDNA_ID_2040066_gDNA_ID_1971801_Annot_ID_175698 3000 nt of promoter + ATG

SEQ ID NO: 8440 - DNA, 3000 bp, Unknown
  misc_feature (1)..( 3000): cDNA_ID_2040070_gDNA_ID_1971801_Annot_ID_175697 3000 nt of promoter + ATG
ggaaaaacaaccataccctccacattggagcccaaaatccacaccctggacccttacccaccggaccagtattgaaacggtaatatatcaagtgctttaaatccttgcacatccgaatctgcctcatcagtctgtatttataacgatacatacccgtcaactggccaacatgagagaaaatatactgcagaccatcagccaattggaaggcatcgacattaccaagtcggaattggacatttgcatcaactacaagttttgtcaggcggaggatctcacggcacagatggaaagcgttcccaaaacgtgacttctttcgctctttggtggtcaaagttttcacaggcttgaggttgaagttgtagtcaagatgcaggtagtttaaattcttcctatgaatcagcagattcagcatattatatccctgccgacagacttgcagacccacttcaacccaatccagttcggtactttggaaaaactttgtagctgcaagagatcgaaacaagtgcttcttcttctgagctttaggcggtctatggtgcaactcattcagcacatagcacttcaatagcttttggtaactaacccgaactttaaccggataggctggaggactgcagttaatgagttcacaatatgtattaggacggtcaccagtaaatttcaaaacggtaaagaggaccaaagtagaataaaaacaaatagcttaccagtgctctttgaaccactctgacaccaagggaatatcttctgcgcggcgcgtcctcccagacctcatattgaaaggtcgtggggcaaacaacaatgatatgccagcagctgtagtgtcagtgtagagttgggtatctcttagcaaaggttccacaccttctggtaaggcgaagtcatcctcatcatcataaaccttcctttcacgtttttccttgttggtgttgcttattgggtgaatcaacggatcataataaaatgcaggaagatcgggatcctcggtctttatatacatgatcataggactgtgatacacacagagttttactttcctgggccgattattgtagagatggggaaaagctattctgtactcagtacgcagaggggaacgaataatgagcttgttgatgtcattaaactcattccagtcctcatcccctttctccatatcacggtacaaaggttcaaacttgggtccacctggaaaagagtaggagaatgcattaaaagcaatggacccgcagcaaaaatataaaaactggagcatagaaggaaaatggcgtaccaggtatgcacatgttcagagcttttgctgtgaagaaagatggcatgtcaaataagtagaagtagttgcgatcaatcaaatcagacagcaactggcctgcaagcctgtgaagggttgccatgattggaagtgagaggttccacctccggtaactgggaccattaatcagttttgttttaacgagtggcttgtggtcgtaaaaccaagtgtggacagcagaatcttcttcctcatctagctccaattgaattggctccagaggatccacgtccagcaagttgtctgcatagtctagtggaggctcctcatcatcaaaaggtgggaaccgcattctcttgaaatgacgacgatccctcttctcccttcgcatcataatccacatagtaccccactgcaaaacaagaatggaataaccatcaaaagctattgaaaatccatcagcgcacagagacagtaaataagagataagactaatcaccaacctgagccatgtaaataggttccacaacccatggtatctcgttcacaaatgtaatagctccggtgatgtggtacaaaacttttacatctcggacctgaaagaaaatgaggatttagataaatgaacagacgatgaaaacagctgaagctaaaggaaaaaaaatgtacctgctcccagggcataggcatgttctccaagagcttgaaaactgcgtgagggacgaatttaagggctccaaggtatacacgtttgtcgtgacggaatttcttggatgacatatcaccatgatctctgaagtaagaaagaaatcgcagcttcagtctcaaaataagtaaatcctaaccaaatcttagaaacctagccagaaaataattatcaagtaaactgtatttcgaaatggtagagaaagaagagaagaaaactagcctgatgatcttcctgacgtgctcaggtggcatgtcctccttctgagtttcaacgaatccaaacttcctcttgtcgccgtaccgtttggaatttagctgcatccattttcgggccttctcctcaagcttagcctccgcttcctcaggagtaggctcgaccggaggagtcggattagaaggcggcggaagcgccgtgtaagaaggatgagcagcgggaggtggcggcatcatggacccgccagtaccaggaggagctaagggcataccatcgttgttgttccacatagcttagggttccaaatcgaaacgccgagcgtagtcgcggaggaaaaaaaccctaaatccaccgcgccagtgtcgatctctaactacgttgcgaagaactagtgagcttaatcgagtaaagaaaaaccctaaaacattttcgggtgagtcgcttcttcctttttttttttttttattcccgttcggccttatatcagcagatcaggaggagtaagtaaaaaaaaaaaataggcggtgtcgaacagatgcttaggcggttatccaaacccgctaagtattgtcgaatcaagttattgggcctttgattattagatttgggccgtgatgcccattgacaaactttaatttgattttttgttttggcatttattggggagctatatagcagtaattgcggtttttccccggaaaacaaactctcccgattctctcgctcgctcgctcagctcctcaacagtcacctgaaggctgaagaagaagagcaaagagagcagaatcttgtcggtgaaaatccgggagaatcggcaatg

SEQ ID NO: 8441 - DNA, 3000 bp, Unknown; identical to SEQ ID NO: 8430
  misc_feature (1)..( 3000): cDNA_ID_3045555_gDNA_ID_1971801_Annot_ID_175694 3000 nt of promoter + ATG

SEQ ID NO: 8442 - DNA, 3000 bp, Unknown; identical to SEQ ID NO: 8429
  misc_feature (1)..( 3000): cDNA_ID_3045559_gDNA_ID_1971801_Annot_ID_175692 3000 nt of promoter + ATG

SEQ ID NO: 8443 - DNA, 3000 bp, Unknown; identical to SEQ ID NO: 8428
  misc_feature (1)..( 3000): cDNA_ID_1989472_gDNA_ID_1971801_Annot_ID_175689 3000 nt of promoter + ATG

SEQ ID NO: 8444 - DNA, 3000 bp, Unknown; identical to SEQ ID NO: 8427
  misc_feature (1)..( 3000): cDNA_ID_3045563_gDNA_ID_1971801_Annot_ID_175688 3000 nt of promoter + ATG

SEQ ID NO: 8445 - DNA, 3000 bp, Unknown; identical to SEQ ID NO: 8424
  misc_feature (1)..( 3000): cDNA_ID_3045581_gDNA_ID_1971801_Annot_ID_175681 3000 nt of promoter + ATG

SEQ ID NO: 8446 - DNA, 3000 bp, Unknown; identical to SEQ ID NO: 8438
  misc_feature (1)..( 3000): cDNA_ID_1989486_gDNA_ID_1971801_Annot_ID_58081 3000 nt of promoter + ATG

SEQ ID NO: 8447 - DNA, 3000 bp, Unknown; identical to SEQ ID NO: 8437
  misc_feature (1)..( 3000): cDNA_ID_1989485_gDNA_ID_1971801_Annot_ID_58082 3000 nt of promoter + ATG

SEQ ID NO: 8448 - DNA, 3000 bp, Unknown
  misc_feature (1)..( 3000): cDNA_ID_1989483_gDNA_ID_1971801_Annot_ID_58085 3000 nt of promoter + ATG
ctgcgaatcctaaagtcatttttgctgtggttcttggattgagtcaagcaatgtaaaatgcggcgggtgctgattcttgaatcattgatcttcatgctaaacaagacacgttattttttgtgataagagataaaacagagcaacttaatatcatcatacttcttgattaatctttttattaatttgaaatattaacttcgatttaaaaacaaatgcctatttcctttattgctggaaaattcattgaactttcaagaatcagtacacagaatccttggatggcactccgatattagaggaaaattaagtctacaaatgaaatacattcagagaatatatccataaatagatacctaaaaatttaagaaaaccaaacagagtgcatgcatttatatccaatgctgttatgttactaatgtgatatttgaatcaatcccttatgttgtgtgtttatatataccttaagacaatctgaaagtaatccactattcaactctgcttagatcgatccatttctcgttaaaatggtaagactcgttgcctatatctactaacattgaacctgatttttaaaatattaatcctctttttgtacatatgtgtaggattggtttttgatcgtactcgttgcaattttaggatttcccgggttaagctatagtgaatcagtgatgaaatatggagcggtcggggatggaattgtcgatgatacatctgtaagttattggtgtatatatattatatatcagtacaagcagcataattgtttagtcatcatataaaaaaaattaaacttttgcatggtatatgtgggcaaaaaaaaacaaggcgttccaaaaggcgtgggaggatgcttgtaagggaagctccaaaatgggaagtgtaaacgtaccagcagggaaggtgttcctcctcaactcccttcacttcacgggtccttgcatacccaaacctctccttttcattgtaaatccctccaccactttacttgattgatattacatgaatactcgaatatgaacctactcctccaagttaattataaagttacttttgctgatatatgtatatatagatcgatggagagatgatagcgcagagtgatccacagaagtggggaaatggtgagaacggggtaataccatggctcatattcgatcaagtagatggacttgcaatcgtagggcgcggcttgttggacggccaaggcaaatcatggtgggatattcattgtagagaccatcccggacccgtaagtttccttttttttaactttttatttttcttgggttataatgtatcctaacaaaccatctctatgtgataatacattttgtaacctataacgtgtcacagaattgcatctgccttgcaccaacggtaagtttgctatttacaaaaggaagtacgtagtatgtatataataacttggacgtctctataactatagatatatttctcgcagatgatgacatttagcaactgcggaaatgtaacattaaagagtttgagatttagaaatagtgcacaaacacatgttcttgtgatgggaagccaaaatgtgtatatcgatgatatcaaaataacatcaccggaggctagccctaacaccgacggtattcacatcacatcttccaccgccgtttctatcaatcattctgacatcgccactggtatatttccttacctaaccatataaaagatcaaacaaaagtttaatttgtttatttattctcacaattaattaaacaggtgatgattgtgtgtcgatcggagatcaagtgaataatttgaatgttacttttatgaattgcggacctggtcacggtgtgaggtgattaccatctccttatcgacctcgtaatcttatatttttcataataaaaaaatgagaactaataagaaattagagacagcattgggagtttaggtagaggaggaacagaggtaacagtggaaaacatacgtgtgtcgcacgttaacttcactggaacaacaaacggagctcgaatcaagacttggcctggaggaactggttacgtccgaggaatcgagttcttcgatatccgtttctcgtctgtacaaaaccccatcatcattgatcagttctacggttgtgcccctacatgcgttgagactgtgagaacctttttctttctatctttcaagttaatattaaatgtaaatgagctaatgtttgaatgtaatgtatcagatgaagggagttcacatagagaaagtgagatacatgaagatgagtggaacatcggcgacaaaggtggctatgaaactcgagtgttcaggggagagtgttccatgttccaaccttttcatgagagacattgacttatctccggccgatggtattgattctgtctcctctctctgctcttttgctcacggctccgcacaaggcatcattcgacctttatcctgtttctaactattttagtaatttgtaaagttttggggtgtaaattgaattactatgtaaatgcaggggtcatattggaataaacaacaatgttttagttaaaaggcctgtataacaatgcaggcccaaacaaaaagatatgagcccaatagtcactgaaattgttttctcaaacccaaaaaacctaaaaccttaaacctccgtatgtgttccgtcgttagcctcctgctaatctccatctcagatcgcaatttctcccttttccggtcactgctccggcttacgactatagcgttccgagataaagttcggctgtgttaattaaattcgccgtcggagggattttacggatatggctgttgttgaatcgcatggggatttaggttattgtcgattgaggtaaatggatgtcgagggtttgctcaactcttcgctctccttatctttgaagctggttctatagattggttagtagatcttacaaattgcaaagattggagatttgggggatttgaataagctacatgttattcgggtatgtttaggctcgagggaggccctggatc

SEQ ID NO: 8449 - DNA, 3000 bp, Unknown
  misc_feature (1)..( 3000): cDNA_ID_2040042_gDNA_ID_1971801_Annot_ID_58086 3000 nt of promoter + ATG
tgagatacatgaagatgagtggaacatcggcgacaaaggtggctatgaaactcgagtgttcaggggagagtgttccatgttccaaccttttcatgagagacattgacttatctccggccgatggtattgattctgtctcctctctctgctcttttgctcacggctccgcacaaggcatcattcgacctttatcctgtttctaactattttagtaatttgtaaagttttggggtgtaaattgaattactatgtaaatgcaggggtcatattggaataaacaacaatgttttagttaaaaggcctgtataacaatgcaggcccaaacaaaaagatatgagcccaatagtcactgaaattgttttctcaaacccaaaaaacctaaaaccttaaacctccgtatgtgttccgtcgttagcctcctgctaatctccatctcagatcgcaatttctcccttttccggtcactgctccggcttacgactatagcgttccgagataaagttcggctgtgttaattaaattcgccgtcggagggattttacggatatggctgttgttgaatcgcatggggatttaggttattgtcgattgaggtaaatggatgtcgagggtttgctcaactcttcgctctccttatctttgaagctggttctatagattggttagtagatcttacaaattgcaaagattggagatttgggggatttgaataagctacatgttattcgggtatgtttaggctcgagggaggccctggatcatgctatctctgcgacacattcgcagattctgccattttccttcctctgcagccactggtattgcatatgtttcaacagagtccaatcagatccagggtttgaaaccgctcgaggaacctgcccttgtgaagcttaaatctgagcgagaccctgagaagctatacaatctctttaaagctaatgccactaaccgtttggtgattgaaaatcgatttgcttttgaagatacggtctctagattagctggggcaggtcggcttgatttcattgaggatctgcttgagcatcagaagacacttccacaaggtaggcgtgagggtttcattgttaggattataatgttgtatggcaaggctggaatgacgaagcaagcacttgatactttcttcaatatggatttatacggttgcaaaagatctgttaagtccttcaatgccgctcttcaagtcttatctttcaatcctgatctccacaccatctgggagttccttcacgacgccccatcgaagtatggcattgatattgatgcggtttcttttaacattgccattaaatctttctgtgagctgggtattcttgacggggcctatatggcaatgagggagatggagaaatcagggttaacaccagatgtagttacatatactacacttatatcggcgttatacaagcacgagaggtgtgtgattggaaatggattgtggaaccttatggtcctcaagggctgtaagccgaacctcaccacttttaatgttaggattcagtttttagtgaataggagacgagcttgggatgcaaatgatctgttgctgttgatgcctaaactccaggtggaaccggacagcataacatataacatggttatcaaagggtttttccttgcgaggttccctgacatggcggaaagagtttatacagcgatgcatggtaaggggtacaaacccaatttgaagatataccagacgatgattcactatttgtgcaaggcaggaaattttgatttggcttatacaatgtgcaaggattgtatgagaaagaagtggtacccaaacttggacacagttgagatgttgctcaaagggcttgtgaaaaaggggcagcttgatcaggctaagtcgatcatggagttagttcacagaagagtacctcctttcaggtcaaaacagttgctctcccttaagtccattttgtaatgtttacatgaaatggaacaaatttgctacatgtacacgacaatgcggccaaaagaattctttctttctttctcctgagtttattttgtatagctgtggtggaactggaaatgggatgtagcctcatattaggaggcacacttatcttccaatcagattcaactatttgttgttcaatgtgaataaagcttaggatgatttggaaacttcaatggagggatacccagtaagtcatggatgcctctacaatcttaagttgtgatagcacagaactagtttaccttttgtaatgctacttacaaaacatgttgttgatttcagctggagagcaaaatggcatacacaaagcagggaccatgtgctgaagaaaccaaaaggatcttcgtctgacgatgcaaaagctcttgagcacctggaaaaatgagttatgttgtaagcttcatctagccaaattaaaagcactaaacatataacaaaggatatcaacgttgatagctttttcttgatatagcacgaatgtaaacaacagagaatagaacagagacaacattaccagcaatgaatatttttattattatgtcgaataaatacattttcccacaagtgacagagcaaacaaaattcacatatttttgtctattacactttggtgtcagactgacttgttacgtagatttatggcggtggattataacattgtaactttaaatatcttttaacgtaagaaacaaaactccaaaattggtgtttatttttaaaaataaaaatttgagggggcatgtatgtttgtttagttgattcacgtgttctttgtgtctgaaaattctgaatttgatgattttgaaaaaggaaaaaaagatacgaggtatcctcaattccaaaaggatgaatgatacaactcatatatacaagattatagtaaaaagaagggatgcatataaagaaacatagacatcatcgccatccatcctcagatcagttccgtagtttactggatcacgacacacacacatatacacgtgtacatataagccattcttatcaaa

SEQ ID NO: 8450 - DNA, 3000 bp, Unknown
  misc_feature (1)..( 3000): cDNA_ID_1989482_gDNA_ID_1971801_Annot_ID_58087 3000 nt of promoter + ATG
ttcttattattttgttttgtttatatgcactatatctttagatggctaacaattaacaaaaaaaaaacccgttgatcatgttggttttgccaaaataaccatcaccaaaaaaaattgatagaaaatatttggtgttccatcaaatctacacttacggataagacgctcttatttttccaattatttgctttctctttctgacaatcatcaaatttttaaagctaaatgccgttttcttcgcatgcttacgttttagctgcttcaataatcaactcaaggacttccataattgtagcgagatttgaaatgcatgggtatattagatttgcgatgtagatttaattggggattaattacgatatgaacacgcaaattttgttgtccatatgaaaaaagtagcacatgaatggattgtctccacattacacaaatgggatggtccagcaagccatatagcaagatatcttacaaaataaaataatccacacctctcaaagttgagccattatatttcaggaaatattaggttcgagttttgcgtgattattattttaaaactcgatgaatcagtcatctactaatacttgtaagtttcaactttgaactaaccaaatcaagcatgaacaacgacgagtcaccaacgcttgatttccttaagaaatattaaaaaaaattaagccatgctggattatggttgataaaactatatgctatgcgatgatctttgcctgaaacgtgaaaagaaaaataatcatttttggcagataattaagtggctatagctaaatttaatgttaaaaaaaaagataattgaaatttcaacacataccacccaaaaacgttgtttgtactattctactcccataattacccgctgctttgacccagttttttctctcccgtttaaaatacgtaacaaataaaatacaatgattacgcatctaaacatgataatcgcgattatatttggttggataattcgagaaccagaagaaaaaaaacatataaaattgaaataataagacgacaaaagaaaattaattagaaaagacacaagtgccttctaataaagagataagaaagaggaggaagaaatgaactagtctgaaacacaatgatgaaccacttttagcaacacacatcaaaaacgacgaaaacagagtaaaagaagaagaaaaaaacggaggaggaacagttagcgccgtccatggcgggtcttcagagatccaccatctctttccgtcgacagggctcttcgggtatagtctgggacgatcgtctcatcgccgagctaagccaacaagcggccaacgaccggaaaggcgagactctacaacaggacgaacaggccaagctgattacgtcggaagtacaggatcagacaaccaaacctatcgccggagaaggactcaaacctatcagaactgacggaggtatggagaggagtcgatccaacggaggaggagccatccgccaccatcgaaacacagggagagtgtctccggcggtggacccgccgtcgccgagactgtcggcgtttgggtgctgctctgccttcgggaagaaacagccggggaagaaggttaatcagaggaaaaggccagcgaagcgtagatccagataggcatgaactaaagtctaaagtaaagaagaagaacacacacaaagatgagaaaacaaaacaaaacaaaaagagagtatatatacttatactgcttcttatgaatctttttctttctgtttttgtttgtgtttttttgtttgtgctttaatgttaaaactgtttaaactcagagactatatatatgtttatatttgttttgtttttgttgcagactgatcttagattttcatgtatattcttgttttattctatctctctttctttcccgagagaattccaaatatttccaagtaagattaaagcagaggatcaacaatcttcttcgtctcctatgattaatccatcgagtaattaaatttgataatcttaatgaattcaaaactgggcagctgactgcggcggctaaagtggacctgagcctgacattctgacaaattagttgcaacaacatcagattcttcattcctaggataaaggaccaatgccattttctcatctctaatttctgattaaatatattttaatttttcatcagccgatacaaatccctcacggactcgcttctgtgttatgtccaaatcaagcatggcaccacagttcccacccatccactgctatttttttttccaaaaagttggagcctttgcaaaaaaaaaagtgaaaaataaaactatacacatattttgcaaccaataataaacacttaatttatttgtttgatacgtaaataactactagtttgcgtgaggtgtgagatatagatatagtgatcatataccagtatgagaatgtttcttgaaagttggaaggtttacatagtccatccattgtaaaagttttattgggcgtaatcatatgggcttagtttagtgcaacatataataccctgattatctgggctttagcccataaccatcaaactttttttttatttctaaattagtgataaaagggtttatcacatacatttatttcttttttttttttttttttgggtcaaaacacatacatttatttcatcttgcaattttctgtttgattatatgattgatcacctacattaatcaatcaataatgtatggaaaattttcaaagaatgtcattactaaatcccctgaaaactagaaactatcttgccatttttctttgtggctaaacataacgtcatttcaccataatcactacaatcaggaaaactaaatctcactctcaaggtagagaggagggaatctagatctgttgtaattctgattataaatagactctatctatattcatttgtttattctaaaatcatacataagcctaattatagtatcttgagtttaatgtctataaatccattcggttcctaaaaattaaaaatctaaattatg

SEQ ID NO: 8451 - DNA, 3000 bp, Unknown
  misc_feature (1)..( 3000): cDNA_ID_1989481_gDNA_ID_1971801_Annot_ID_58089 3000 nt of promoter + ATG
gatttggacataacacagaagcgagtccgtgagggatttgtatcggctgatgaaaaattaaaatatatttaatcagaaattagagatgagaaaatggcattggtcctttatcctaggaatgaagaatctgatgttgttgcaactaatttgtcagaatgtcaggctcaggtccactttagccgccgcagtcagctgcccagttttgaattcattaagattatcaaatttaattactcgatggattaatcataggagacgaagaagattgttgatcctctgctttaatcttacttggaaatatttggaattctctcgggaaagaaagagagatagaataaaacaagaatatacatgaaaatctaagatcagtctgcaacaaaaacaaaacaaatataaacatatatatagtctctgagtttaaacagttttaacattaaagcacaaacaaaaaaacacaaacaaaaacagaaagaaaaagattcataagaagcagtataagtatatatactctctttttgttttgttttgttttctcatctttgtgtgtgttcttcttctttactttagactttagttcatgcctatctggatctacgcttcgctggccttttcctctgattaaccttcttccccggctgtttcttcccgaaggcagagcagcacccaaacgccgacagtctcggcgacggcgggtccaccgccggagacactctccctgtgtttcgatggtggcggatggctcctcctccgttggatcgactcctctccatacctccgtcagttctgataggtttgagtccttctccggcgataggtttggttgtctgatcctgtacttccgacgtaatcagcttggcctgttcgtcctgttgtagagtctcgcctttccggtcgttggccgcttgttggcttagctcggcgatgagacgatcgtcccagactatacccgaagagccctgtcgacggaaagagatggtggatctctgaagacccgccatggacggcgctaactgttcctcctccgtttttttcttcttcttttactctgttttcgtcgtttttgatgtgtgttgctaaaagtggttcatcattgtgtttcagactagttcatttcttcctcctctttcttatctctttattagaaggcacttgtgtcttttctaattaattttcttttgtcgtcttattatttcaattttatatgttttttttcttctggttctcgaattatccaaccaaatataatcgcgattatcatgtttagatgcgtaatcattgtattttatttgttacgtattttaaacgggagagaaaaaactgggtcaaagcagcgggtaattatgggagtagaatagtacaaacaacgtttttgggtggtatgtgttgaaatttcaattatctttttttttaacattaaatttagctatagccacttaattatctgccaaaaatgattatttttcttttcacgtttcaggcaaagatcatcgcatagcatatagttttatcaaccataatccagcatggcttaattttttttaatatttcttaaggaaatcaagcgttggtgactcgtcgttgttcatgcttgatttggttagttcaaagttgaaacttacaagtattagtagatgactgattcatcgagttttaaaataataatcacgcaaaactcgaacctaatatttcctgaaatataatggctcaactttgagaggtgtggattattttattttgtaagatatcttgctatatggcttgctggaccatcccatttgtgtaatgtggagacaatccattcatgtgctacttttttcatatggacaacaaaatttgcgtgttcatatcgtaattaatccccaattaaatctacatcgcaaatctaatatacccatgcatttcaaatctcgctacaattatggaagtccttgagttgattattgaagcagctaaaacgtaagcatgcgaagaaaacggcatttagctttaaaaatttgatgattgtcagaaagagaaagcaaataattggaaaaataagagcgtcttatccgtaagtgtagatttgatggaacaccaaatattttctatcaattttttttggtgatggttattttggcaaaaccaacatgatcaacgggttttttttttgttaattgttagccatctaaagatatagtgcatataaacaaaacaaaataataagaataaaagaaagtgacacaatgtcaatcgcatcagtaccagtcaaatggatcatccttatcctcagacccaaaagatttacttacattagggagtagtattcggatacatgtacacgcatataacttccaaatgttgaaagatgtataaaaacatgttagacatttaccagtgacttaaaaaaatataagtgatttatggtagtatatatcacactatattatgagtcatgacactcaaattcaaaatccgtttagtacaaaaggttacaagtctagaatcgatttttgtaatttttttagtatatatgacattggtttgactgtgttacaaagtcaaagtaaaatcccaaaaaaagaaagaggaatattttggttctgagaaaagacataaaaaaaacaatagagaaaccttgtaaaatcccgccaaaattttcacagaacccctaaaaaagtttgagtgttgccgccatccatagatttattccaccatcttcatctctggaaatccttcgccgccgcgagaattgacattgttttgattgcatataaatctccgcaacagtatggtacgttttgtttagatctacggttttgttatcatccgttaattcggcgacatcagcaacgatttgcttcatccacaaaccgaataggttcggtttaaacataagcctgggatttgagtcaattatttgcatttgcctacttttttcaattttctgggcacgccagatgtttgatgaattgctcgaatagatagatgtcaaagtgaagcgaggagacccgccgattcgac

SEQ ID NO: 8452 - DNA, 3000 bp, Unknown; identical to SEQ ID NO: 8434
  misc_feature (1)..( 3000): cDNA_ID_3000102_gDNA_ID_1971801_Annot_ID_58091 3000 nt of promoter + ATG

SEQ ID NO: 8453 - DNA, 3000 bp, Unknown; identical to SEQ ID NO: 8433
  misc_feature (1)..( 3000): cDNA_ID_1989479_gDNA_ID_1971801_Annot_ID_58092 3000 nt of promoter + ATG

SEQ ID NO: 8454 - DNA, 3000 bp, Unknown
  misc_feature (1)..( 3000): cDNA_ID_1989478_gDNA_ID_1971801_Annot_ID_58093 3000 nt of promoter + ATG
aacacgcttcttcacagcagtatccgctggaacaaacacaaatcaaccccatcgtcatatttttgtttaaaactacagaaccaggttacacaattccaaaacgtagtagtatcgtatatgtcaaatccagagaccaaacccattcaaaatcaaagacaagcacacaataaatcatcaaatagcaatctggatctgtaaattacctgcagcggagccgattaaacgagagaatatggaggaatatgcgggaatggaggatgcacgagtcgagagagaaaggtgagtggactctacgacggcgtgcctgcacgacggagccgcgcaggacccgacggcggagatggatttaagatgcgatgaaacgattctcctccacataatggtctcgattcttcgggaaaattaggtttgtcgtttccgatctcagatgattctcagtctccgactacctccttcaaacggaaatgaattgaataaattgaagattgaacaagacttcgactttttggcgacggcctgttgggcctggatcatgcgacttgttgacccattatctaatttgaaacaaaaatcaaaatcaatatgtaacaagattaaagtaaaaacttctgtcgatgattaaataaatttttgtaggatatatattttcttaaaaattaattaacgcatatgatctaatactatctcttattagattttattggctcgtaaagttgagttaagacttctcagaagaaaaaatgaaactccgttatatataatatatgttgaaacggtgattaactagttaataaattttgtgggactagttcgtaaattacatttttattatgtaacatgaattacaattatccattaatgtagtatattcaaccgaatgagtcaacgaccccaactttcatcctcggagtttcccaaccgctaccagcctaacatcatcgatcaccggaccacatagcgagccagagtgatcgcttttcatgtggtaaaacgtgctcaagaaagtgacacgtgtcctggccgacactgccttgaacacaagcctcccacgtctaaacccgccttttcctttagaagcgtagtccaccatgaccttgccctgtccagcgaacgcttccacaatcattggtccctcacaaccgtctctggcgtctcccacgttgaacgtgagggcgtagaatttgttcagtgacgtcctcactatctgagaaatggcgctctctttgcctccaacaagctcgatggctcggtgtccttcggggacagcgaagtgtgctttgtctacgtacttaacggctttgagagactcgatcatccaaccgggcaatgggctgttatcgtcctcgatgaacggtgggatcagtactccccattttgccgtgggaaacacgtaaggtccttcttcgaaattcccattctttatcagattatctgcaaacagaggtcaccacttaatcaccgaatccggtttactctaaaagattaaaagatatgaatatggtcggttccggtttacttacatccagagaatctgggagggaacaaagccttgatagccacggcgtcgatcaaaggtccgcaagccgggtgctcttcaacaccagggttatggaaccggatctcgatttcgggaccaccagctttaaaagcccatgagtatgagtcccaaccatcgctgccgtacatcgtctggatagggatcacacctgactcatgcgtcacggatatattgagcctctcgtcttgagcgcaggttcgagcggcgctgaacgttattgagtacagacggccaggtaggacggatattttctgggagattgaggcttcgttgcctagtctaacggcggaggaaccctgcggtacgaccaagaccatgtcatcttgtttctgaccggatttaatgaactccacaaagccgattatgttccagtttggtacggcggttcgttccttaaccacggatcctttcatttgggagggtttaggacccaactcgaagttgccgtttggtaataaacctgaaacaaaaaatattaagaaatgttaatttataatctcggatttgagttgaaatgagctttaactagagttactaccatcgcggactggggccgataagacgacattcgaagagatgaagaggagagctaagaggagtgctgcttcttggtacatcatgacttccttgggtgatagatgaagatcagatggtgagtactatccaaagggtgaagaaaggctgggtttttatgagtttgagaatagaagacgagcactggttttgaagaaaacaacgggaatgccactggaagcatcctgggttctattgtcaggtgccacgcagacacagacagctagctcaggaaacatttgacttcatgattagcatttccatttcttcaatgtattgtttaaggggctgccttaacaaccattatattaaactatatattcaaacgtaatttgcgtttgcctatctaaattattcacataaattttcaaagtattaaaatattttttggctttttcagaaaaacatttttgaagatcagtacatccatgcgtaaacgccaaaaaagttctttttgaaaaaaggtttacgggtaagtattccttaaaaagtgattaatctggaaaaaacatacacactaattaatataaatatatagggtacgtaacaactaatgcaaacaaacaacggaaaactaaaatatgtagagaaaaaaacatatatatcatcaccactcaactataatgccatggttttggaaaatgaaagaaatataatgtatatttgagatgtctctaagattagtcatttaacgccatgcaactcatcccaactctaatcaataaaaaataattatgattttcgtatagaatgcgacaaccaaaagttaatgacgggggaaaatatgtgctgttttggaataaatcaactcaacttaaaaatgaagtcaaaaatggtattgattgatgttagatattgatcacattggg

SEQ ID NO: 8455 - DNA, 3000 bp, Unknown
  misc_feature (1)..( 3000): cDNA_ID_1989489_gDNA_ID_1971811_Annot_ID_58095 3000 nt of promoter + ATG
cctctttcatttacttggtataaatctgacaatatatgctatacttcaaaaattgttaagtattaatacaatttgtttttgttttaggctttttggtattttcaagtgcaaagcagttaaaaacatgtacctcggtcataaaacttggccacccatgtgatattgaatcatgcctaaacgagtgttttcgagtttacaataccggatttgcaacttgtcgcggagacaagtactcacaactttgtacttgtgagtacaattgctaagcttagacgtactcctcatgtatgctgttaaactaaagcaaaaaatctttaatgttaagtaccttattctattccatgtaactggaggatatggtcaaatatatatgaataaaaaaacttttaaatattctatatgactgcaatatagaccgggtttcatgtaattgacctgtttcttcttagaaatatcaaatgtcttttgagcgagaatataactttgaatagatgtatgggatgcctgaattttcaaccctatactagttagaatttcaactttccaccctaaatttttaaccactcgaaaaaccaccataaacaattttaatctcgataaaactacatgtactttcggatttgttcttaaaactacgcctccaattgaaccgaccagttaaccgataattatacattcggtttgacttacccataatttaaccgaaattaatacgattttgactttattttagcctaattttgacccaaacaaaatgtaaataaattgtcttattaagaagtaaaattatttttattaatttttatttgtgatatttgtgataaacaattaaaaatattaaattataacttaattttagcaaaaattattatgacaaaatataccccaaattatattttgagctacattttgttataaaattttgataatatacaaacatatatattttccttttggcaatcatttatattttttataaatataaagctatgtctttattttaaacaaaatattcatttttcttgaaatcataatatatgacctttgaactttatatatgtaatgaaattcaaaatatatgccaaatttatttttatatatatccgtaaacatcataatcaaagtatatattatggtatttataaatttatttttctttatagattcagttttctttttatatatttcaagatgagttatatatgtatatatatatatatatatatttatatatgattatggtgttttaaaaaagaaaatgacctttgaattattaaatttagagtatataccatatacatttatatatatatatatataacaccattgtaattataaaaggaatttgttgtctattttgttatattattttgcggtatattttgtttattaccaaaatatatactaaaattttattatataattttgtgtggtattttttttttattttattattttggtaaaattaatttatttatttttaagtttttatcaaaaataaataaaaagtatttttcttctagagaatatattttttgagtctaaattgggttaaaatagagtcgaaatcgaataagttcggttaaattttgggtaagtcaaaccggatgtataatttttggttaactggtcggttcaattggaggtgtagttttaagaacaaatctgaaagtacatgtagttttatcgagattaaaattgtttatggtggtttttcaagtggctaaaaatttaggatggaaagttgagattccaactagtatagggctgaaaattcaggcaaccctagatgtataaattatcttacttttaaagcagataacaaatcgccgtgaatctagtttattttttcgtaatagcggtatgtaattagtctaatgtggatttgttctatttttttctaaaagaactatttctggttaattgaacctcaaccgaaccaaacaagaaaaaccaaaatgggacgtttcgacattagaaccaaaatcaaacactgaaccaaaatcaaagatccaaaacaatttgaaaccttttagctcactttcttattagcatcaccaaagaatttgccttttaatttgcataagaatcttgagttcagtgtttctactttctatactgactgatcttaagatctctataaacatgttattggctcaatatgaaatggttcaaatatggcgaagcagcctctcaggaacaagctccagtattggttaaagtgggatggtgtagacttttggttaacatatgatgtatacgtttcgtttgacttagcaatcaagagcctagacttgccttgtacacttttgcttaacaatgatgtatatgtttcgttttgactaagaaattaagagcctagacttgactagttaggttgggattttctcggatcggtctgaggactatactataatcgaaattttggtctactatgcagattttgatttaaaccaagattttctccaaaaggtactccgaatccaaatgttgctttagatgagctggtgaagatcaaagagctggtggacaaaggccaactcgtgaccattcccatctcctacaagctagagacatccgatgtgagattgcttaaacaagagtttggtactaacttcaaggttctagctgatgaaagtgagcaaccccgagactaaaattgggagactctaaatctttccttttacgtagagtccatcaaatgcatatgcctatgacgttaacatgatcttagacgtgaggaacttgcttcaagagttcagtgcaggctgtggaaccatgttaaaattgttcgcatgttcggtaagagaaattgattacaagagttcacaaatattgaaaccaaacctcgattattgttttactaattgcttgtctttaattggttaaacagaccagtgagaggtggcattttaagatacactctcaattgcaacgaattcaaataaatcagatcggatcgccgttagattccgacggaggagagagttattggcgatg

SEQ ID NO: 8456 - DNA, 3000 bp, Unknown
  misc_feature (1)..( 3000): cDNA_ID_1807255_gDNA_ID_1971811_Annot_ID_58097 3000 nt of promoter + ATG
ttgttagaatctcgatcacgagatcgaaaggaatatatggcatcggttcgtggctcttgcacatgtctcttcgtcttcttcttcttattgttactcttgatttcctcttcattcttctctcccgttggaagatgacggctaggtcaaaagaaaaggccataatatcacacaaatacttgttgatcgaaaacctcacaaacttatactacgttttatatcatctctctatctatcacaagctctattatccaaaaagtaaaaaaaaaaaaaaaaaagttataaaaacactattcctccctaacatgaaaaattccttaatcatattgaaaataaaagaatttttcctaaacttttatttgggtgattttgaaaattgccctaattttgagtttttgtttgaaaaatatactctaccctatttttaattaaaatatataattttaaatatgttaaatgacaattctgtccagatttaaaacaaaagaaaaatatttttcataaaattaaattaaatacgattttttttaataaagaataaacttaatttaaaattttaattattatttttttaaccattttaagatgaatacaatttatatattttaaatattaaaatctaacatgatattatcaaaacaatattcttaagtttatcacttcatatttcccacattatataaagaaatcaatctaactccaaacacataattctttaactctacacttttttttaaatctaaaattctttaactctacattattaaccaagttttgaactaatttagctttgtttgtaaatatttgtaatttcaattataattcaattataagaacatgaatacatgataatgaaattctgcatggtgtaacatatatatatgtatggtgtaatttatacatatatatacgactaacttttttcttttaaagaataattcttgttttttctttgtgttgtaacaatatttttcttaaaaaatatatttaagataaaattttatgtaaaattgttagttagttagttacgtcaaatatttttaaattaaattataattttttttggtgtcgataaaaaataaaataaaaaaatgatttttgttttaaatataaatgttttaaaattattagtaaattttaataaggatatatttataattttatatttcttttatattttagaaaatatattttaaaagagaaaaaatggataggttatttttcaaacaaaagcttagaaaagagacatttttccaaattttctctttttatttttccccttagtaaattttcctaaacaagttaacaaatttatccctttctttttcctctagccactttctatttctatgactatatgtctatattgatcgatcattttcaacttgtttgaaaatttgatgttcaattatctgtatttaaaacagagagaataaatacagatttacagtttcagaaaggtagtagggcataaaaattaaaattctgtttacaattttgctttgtaaatgctacagatttttttagatattttgtgttgtaggaaaaggtttgaattgattccaaattttatttcggttaggttttaagactttccttttcattaggacgttggtttgaattggttttagataaaattagtacgaaagttcatttaattggttatatttagttaatgtaataattttttttgtatttcaagattataagatgtttaattttctttttattatgaaatcttgtttacttcacataatcacattgatcaaatttcgtttggttcggttcggtttcacaatgtccgttagttttttgttttttcaccctcgtaaatagtgtatcttttgaaaacagaggtacgcaaacgcccttgtgatcttctcttaaaggtttgcagaatcagagaggtgcttacgcgaggcggtgaagatagctgagcgagtaagggaagggagactcgtagcaatccctgtcttctatgtgggtttccagaaattactattacaattcttcttcaactgaaatctcagtaagaaatattacattttaggatcagtataaagtaaagaaaccaaatagtgatagttgacttgtcgtcttctcgagtcattttaccaactttttaacgcagataacaaaatatcaataaaagtaaatagaaagagttcatatactttgttgacccaaaaacgaattttccctaaaactaaatatcaactcactaataattccatatgtaagcagtaagctcctagaatggaggtggaattctcttggcagcgaaaatgaatttcgtcgattgatcgcggaaacttcttccttgcgaatatcataattgtagttttgtgttgttgggatggtctatgactgactgattatctctacaaaataaagacttttgtatgggtgtagactccggtaacgctttgtggatatgtacaaataatagatacatattctattggtgttaccaaccgcaatgttgatcatgattttatattaccttttctttagttttatattactttcttaatgggatctaattggaaatttcccaaccactgtagtggactagcgattaaaacatatgaatgaggttaacttttggaaaacaacaaatggttggaatgagcagagtagattgaacattgaacttttcaaattaacttttgtaaattaattagtaatgatttccaaaattaattaacttttgtaagtattctggatagtaagagaaaatggaatccttattcaaaatatgaaagcataaataagaaaagacgaagaagattcatcaaaatgtcattagtattaacgtatttatattacaagagaaataataatattggacgtctgtatatttttaaataaaaccaatgactctataaggctatacagtcgcagaggtaattaaacacaaaacataatcaccaatcattttatgaaatttatttgttctctttttgcctatatatcaaacttcgtctacgtcccatgacgatg

SEQ ID NO: 8457 - DNA, 3000 bp, Unknown
  misc_feature (1)..( 3000): cDNA_ID_1820484_gDNA_ID_1971811_Annot_ID_58100 3000 nt of promoter + ATG
ccgtgtgcttgtgattttcgatactcattctgaagaatttagtatgctccaagtacctggagatatcttttggaaatataatggtcttctagaatacggtgggaaaatagctattttaaactataccaaagttgatatcgaaggtgtgatggaactatgggttgtggaagatgaagagaagaatctttggagcagtaagatattggtggtcaatcctttgcaactgcagatggtcaatagcattattagtttgacggtactaggaacaactcgaaacggcgaagttatcttggtacctggtcctgaagacaaaactgttttcaacattttactctatgatttacaaaagaatcatattagaaaaatcgaaatcaaaggaggaccagaccgctatcttaacaatatttgggaagtcgttggaatggatgatgttgagaacttaatgtatctttaagttcattggcttgtgtgttaattttttttcttttttaccaatttgtttttctattattttagttgttttgttatgctacctaatttaattgtgaagaattcgaaaaatattggacacgattagggttgtcaatcgggcctccccgcgcccaaatggaccatccgcatcctgcccgcttttcttctgatccgcgacggacctgcctgccaacgaccgcggtcttgaaaagcgagtcctaacccgccccgcagagcccatcggttagacgggctggcccgcggacattagtaaaactcctttttttaatcctccgtctgctgctttctagtgtcctgacttgtgcgaaatagggatgagcttgtcatcaattcataaaaccaatttaaccaatgtagttcttgattggtttaatcaaggttcaacattgaggggtccgaattcttgattaaaccaatttagattagctaaatagaatcgaagcataatctcaagccaaaaactaattcgattttggtagattctcaacaaaaaccgaatcactcaggaacatcataactatttcaataccaaaactcggaatcaaaagtgatcaagcacaaaaacagatcaacattagtaatatttcacaaacatcaatcgatcttgctagagtaacataatttttggcaagaatcaatcacagatctaagatcaatcagctatgtgatcgattgtaagtatattagagcatcgaaagcataatctcaacacaatttggtcgaatctagcaaaaaaacacccaaaatttcacacaaaaacctatcaattttggtagatttcaacaattagaactcaaagaagctaaatctactctttagaaccatgatcgatccctattacaccaaatttcgaaacaaaaacgcaaaatctgatggaattttggatcaaattcaactttggatctatctacatgaatcatcaagcttccacaatcgaattgaacaatatattatccaaaactgaagagaaatggttaccagaagaacttgggagagaatttctcttcatggcttccttgagagagagtgagaattagaaattttgaaatttgtttctgagagagagagtgcgcttaacggcaaatgaaagtttctcgtctcagatatttatttggcttaagcgggaaagcccacactttatttttccgtacaacagaaaaaacaaaaataaatactattgtttcagacggacacgtgtaatatcgcattagcccagtggctttgatacctcgtctgcccagccctgggttcgaatctggtttaatacccatattcgttatctttttccttcttccacgctcaaactatttcctcttttaaaaactcatacaatatcatattcgaaaaacaaaatgcgacctctttttttttttttttccctgtttctaccattttttaaaaacacatgaaagaaaagaagaaatgcaaagtctccttttaattcaaatatatctacaaatatccaaaaaatatgaataaaaacaaaccagattcaaagctacacatcaaacaaaaagcaagacaacgatccaataatcatttgatctctcatattggcaacgttgtcaatacttaggaaacgttggagagaagaagcaacatatttgatgagatggtttccctgtttatatagaggaggatattttccaaatttttttggaaaaagcagagcataaaggctaataaagctcgcaaacaaaaatcaaaagcaaaaaaaaaatagtttttctgcattttcaaaagtttgatttttatgtcacaacttgttaatgtttggagctgatgttgcgctgagttttgaatgttttgatttaaatgattcgcttccttatctgaagctgttttgcttgcaattttgaggtttttgtgctctgattttgctgactccaagtttgttgtacgcgatatggaagcaagaaaagagaggaaaggaaaggacatagatgctggttcagttaaagaccggatttaacatccctctcaagcaagaaaacggaaaccctttttgaaatactaaatttttaagtccactactacaaaaattaaaactcattccttttatatgtagtctcgattcatattttcaaaaaatttaaacaattgaaacaaatagtatctgtataaattaataaaatattatgatccaacagtaataatttatagaatttttacggtgtagtgttaaaaaaaagttttactgtatataccacttcttatatcaatctaggaatgaataaatattattatcctgagttatttattcttgccatcatatatatatatatataatatttttttctgatcaacttattaatcttgttctctaatttgtattaagtaataaactaattatttcctaatatagaattggtctctatcccaataaagaaaatgaagtcaccttcttcttcctcttttctcctgtgttgatgaaaaagcttcaagattcaatcaaatcatcaaaaaaaaaaactataacttctattgatcttgatatctaaatccgcc

SEQ ID NO: 8458 - DNA, 3000 bp, Unknown
  misc_feature (1)..( 3000): cDNA_ID_1820480_gDNA_ID_1971811_Annot_ID_58101 3000 nt of promoter + ATG
tgtgttttactatgtttgcaagagttttcatcatcaggagattgataaatccgctttgcacgatcatctcggtgggtatctcggtgaatatgtgcctcttaagagcaacattcaaatggagaactttgaagtttgactgcatcatcaaacagagtaaatcaggttttttgcagtttgaaaatgtctttgtatgtttgtaatatttgtaatcttttcactaagtgaatttttgttttttacttgcatatccaatgtaacgagggaagagacttgtttttacagagtttctgttacttgttagatacttcttgttcttgcattcaggttatacaatgatatgagagaatattttgacaaaagaaaatgggctatataatggttcaagagtctggttgtgttctgtttcattgagctaattagtttcaagatgaatactctgcttcattctacattatacttgggagatatatgactttgatcttgtaggtatgagttgtgaattacttccatgaatgctcattattaatgtattaccatgtacaagcaatgactcaaagagtggcaacaacaaattcctcaaaagaacttgacttggggactgtgagcaaaatatcacaccactcaactttcccatacgtaggaagccaacgagactgaggcggaaaactacgacttgtaccgacaccattagattccttgttgtgcgactcttactagactaaaacgggaagtgaaccatcttgaactagggctggggattcgagttggtccacggctcagagtaaaccaacgtggcttagagctaccatggaacattaaacagagataaggacaactctcggtgcttcctaatagtctccgggtacggggtatcgtgaagatccgtggaggcgaggagagagcagaatatcttggaagctaaggagagagttgggtagtacaacctcgaaaggcgggctaaacagttcatccgtatatgttaatttaccatagttttgtttttcgtagtttttctattgaatggactcaaattaatatcgtgtgaaacttttgaaaatactgaaaaggcccttttagtgcaataattcaaattgaatatgaccttgaattgttttaaaatcatttttcttctcttgattgaacctaattgaactacaaaactatggtcaaaatatatgaatggtattgagtctattgagttttgtcctactcatataatttggcagttcatgaaaagaaatggatcttaagtggaatatgcgtcacctgtcataattataggttgaatgatgaatgtttagttttatttgtcaactatttttttttcgaggataatgtttgttttttgtcttttccagtacgataatgcttaaactaacattctcaactatcaaaacattccaacgtataccgaaatgaaagttgacgtgataaatccgatcaagaacacagcttcttaacgtggctactgtcgtcgaccgacgtttattaaattaagttttcttatatacataaaattcgttcaatttaaattaatgtggtgaattcgcaagtttaaaatttcacagaaaaaatgttttttataactataaacgcttaatctcatgcacgttctcttttcaggagatatgtaactaactaatgtattccatgatgaatgtttgggaaaattaattatagtggatacttgttataaaacttgtatgagtcaatggccttaatatttgataagtatacttaaaactttatttggacattaaaccgccactaattttccatagcacatatagtcaacttaacaaattataggttagtgttgtttggtaataaattagtaatttagtaaaccaaacaatttataaccattttattcaatcagtgtaggcaaagaatcttgaaatagtgttttctattcttatgtatatatttgacaacgtggtgttttgtcaaccaataaaattttctaacaccataacataaatctaaacttgacatgttaaatttccttagcttagtgaaacttgattaaattatgcccttccaatttttctcaccatttttaccctccaaaatttcttaaacattccacacatcaactatttcacagctttacaatgacgagccatcactttcgtacaacaacaaaagtaataatagattttctggtacatgtatcgaaaagttgtgcggcctgcgtcagaaaaatctaagaaaaaaacaaagagtaaacaaaaatatccaaacagtgaatctaataataaattctgtttactttctgcaaaaaataggataaaatcgaatttaattctttttatcgaaagtcggaaatatatcctatgtcgcaatcaattaatgtacatatgcaagaaatttaaattaaaaaaaaaagaacgcaaaaaaagaaaaagaaaaagagagagagaaagaaagaaatcgagtttaactgctcgtgtctctctgtgccactcgtcttcagttttgtcagcgtcttcataacttataaagtcctatcgatctctcttcttctttctttggccactctctgtgtctttctttgttaataatatctcaaagaataagaaaaaaaaaaagaaaagaacaaaaaaaagcacaagtttcttgaaaccgtgttgttttcgtgtaatatacacagttgttacagattctctccttttgggtttctttttgtaatcatcatttgattgactgattctctgttctttttttcccaaaaagagagtccttttattacaaaaaaaatattaaggttctgttttgtttggtttagcttttttatccaattccatcagaaccagagttgtttgttgctgctctgtaatatactcgagtcaatctttatacttaaggaaaaaaaaagtttcaatctttggtttcatctcaggcgaaaattgctacaaatggtaatcgatttctagggctctgactggttttgattaaaggaatcaattcaggggaatttcgagttcttttgttacaaaa

SEQ ID NO: 8459 - DNA, 3000 bp, Unknown
  misc_feature (1)..( 3000): cDNA_ID_1820476_gDNA_ID_1971811_Annot_ID_58102 3000 nt of promoter + ATG
gcatactgtggacaagctgcttatcttgtgattcataaggaacattatcaagacgcgttctatgcatctatcccgggtttgccttaaatctttttaaaacattactggtcttgaagtcatcatacatagtgctcttataaaacagtgaaactcttttttgctttgactccacagatagtgtctattggccaatgtttatagtcgcgacaggagctgctattgttgggagccaagctacgatctccgggacttattcgatcgtcaagcaggccgtggctcatggatgttttcctcgagtaaaaattgttcatacttccaagaagttcctcggtcagatctattgtcctgatattaactggatactcatgctcggctgcatcgcggttactgctagtttcaaaaagcagagccaaataggaaatgcatacggtaagatgacaacaacttcaaaatacaagaaaaattattttagtcaatgttaatcgttttaagttagttatcataagaatttttggataatctgtactaaaagaattttggtttatgataatgataatctttaaccgtgactgttttgttttcttggacaaattagggactgcggttgttctcgtgatgcttgtgaccacattactaatggtgctgataatgctactcgtgtggcattgccactggatccttgtccttatattcacctttctctccttctttgtggagttatcgtacttctcagccgtgatctttaaaatcgatgaaggaggatgggtgccgctcatcatagcagcgatatctcttttagtaatgtcagtctggcattacgcaacagtcaagaaatatgagtttgaaatgcacagtaaagtgtccatgagttggatactcggcctcggtcccagcctcgggcttgtccgtgtcccggggatcgggttagtctacacggaattagcaagtggtgttcctcacattttctctcatttcatcaccaacctccccgcgattcattcggttgtagtctttgtctgcgtcaagtaccttccggtttacaccgtccctgaagaagagaggtttcttgtgaagagaatcggaccaaaaacattccggatgttccgatgtgtagccaggtactgtactttattcttctctgttctttagtagggttgacaaaatcaataaggagttttaagacccttgaaatatctcaaacatttttaacagatatggttacaaagatctacacaagaaagacgatgatttcgagaacaaactgctgactaaactctcctcattcattcgaatcgaaactatgatggagccaacttcaaactcaagcacctacagcagcacgtattccgtcaaccatacacaagattccaccgtagacttgatccacaacaacaacaaccacaaccacaacaacaacatggatatgttctcatcgatggtggactacacggtatcaactttagacacgatagtttccgctgaatcactgcataacacggtgagtttcagtcaggacaacacggtagaggaggaggagacggatgagttggagtttctaaagacttgtaaagagtcaggtgttgttcatataatggggaacaccgtggtgaaagcaagaactggatcatggcttccaaaaaagattgcgattgattatgtttatgcatttcttgctaagatttgtagggccaatagtgttatcttacatgttcctcatgaaacccttttaaacgttggacaagtcttttatgtttagtttagtttttattattttgctttgtaaaacaattacagagaaagggtaataaaaggataccaaatttaagatcataccactgaaactgttactggcctaggtcacgtagaagttctctattgaaagtcctgacccaatccaatcacgcccaagaagcaatccgatcatgtaaaaaacttaagttttatttatcataacatttgcaacatttagtaatttacattatatgcgaactttatatctctagttacatttagatcaccatatttatatttaagactttcatcataaaggttttcacttttcacttgttttggaccaaaacttttggtaattcacaacagtcaagtcaacatgtccgattcaatctataaccacaagaatatgatgtcttatttaggagaggtcaacattataatcaatctttaacttttccctacgcaaattcaactagaggaccaatagaaacaggtatacacaattgccatttttcttagagcttttcctagttgaatattgtagcgaattattgacctttcaacgctatgtaactatatcgttacgatcccctaaaccgaacagtttaaactggcagtagttaaccgattaagcccctacagctgaaccgttgtacttgttgtagcatattataccaaattgggaacagaacctacggataccgagtttaagagaaatgtgatatagttacgtctacctagaatccgaatttgtacggttccctagatcttggtttggtaattatattattaattaagccactaatgactagtttcttagtctcgctaatcgaccaatatgaagtaatctcactcaaatacaattttcccaatcggttcgtcagaacgtgattgtcagaaatcaaaatcgtttacttttctcgccatagcactgatattttcgataaaaacaaatctgttcgcgtattatattgttttattatgctcatttcgacacacaacaaaaccgaaccggtaaaaaatatatgaaccggtttggtcatcatattacactgatatgtatattcaaaggaaacttcccatgcggaagaagaaaatatcttcattaagttacaatcacaatattcgttacaattttcttgacaagttaagttatataattaagggaaataggaaaacaaaattcaaaagaaaaatcaagactattaaatgaggctatataagtaacatgtacaaagaaggaaaaagggattcatagccaaaacc

SEQ ID NO: 8460 - DNA, 3000 bp, Unknown
  misc_feature (1)..( 3000): cDNA_ID_1820473_gDNA_ID_1971811_Annot_ID_58103 3000 nt of promoter + ATG
gttcccctgacatctgcagaacaatcatcgcgtgcctacaaagaaaacctttcaactcaaacaatcgacaagaacagacaacttcagatgattcagagttccagaccacaacgaaagaacggttctgttcataatcttgaaccctgaaagtcctcttgttaaccccatcttcttcactttctttcttcggatgacaagcaactcctcccaacacctccacctgaaacttcttgaacatctcacgagtgtatacctcagccatttgcttcccaaatggtgaaggtgacttaagtcccggttgtttatacaatgtctcaatctccgatttctcttcctcttcgtacctctcttgtatcatcttcttgtactgctcaagaaatgctttaaatgtagttttcctttgaatgtatttatctaaaccagagttcacactgtctgatctctgagctgtacacattcccgctagagatacatctttcatatatacaggaacccaatattccctatcttcatacaacgactgaagccacacgttgtctctcatatgaaacctatcaactacctcccaccaattcttttcaaagtcctcgctctggcaagacccgtaaatagcatcatttatctcatccacaagttttttctctagtctgataacatgaccaagcttttccggcatctggccaagagtatcccacatataaaagcaatgtctagaagatgggaacacctccaagacagcttccttgagcatttggtcatgcttagtaagtataactctaggtctgcatccgtgcatcgcttttaaccatgcccggaaaagccaaacaaatccagatttagactcatccgttagtaataatccaaaaccaagcaacaggaactgtccatggtggttcacgccagtaaaagcaacaagaggcagtttatactcattcttgatgaatgtagtgtcaatagatacaacatcagagaaacaagtataatcaaatctaccttttgcatcaacccaaaagatgtttcttaaactctgctcctcactgagatcaatggaataaaagaagaaaggattctcaacttgcatatcagtaaagaagtttaaaagtctttcaacatccccatcctcaagcttcctgcttttcacctctttaacaatagcaccgtttagtttctcgagttttctcctcccactcaattctcttaaggaatcagcttgaccagtgaagatttcatggttatgttcttttaccaaactacgaacaacccacctcccatcttgccttctcttaacatgtaaaaaagctttacaatcggttttcgacgatgaccggttaattctaccacgttttcttgcttgaggaatgttaaatccatcagtacctaaaccagtatctatgtcttctttcttgcttccatatcgcgtacaaacaaacttggcatcaataaatttcccggtcattcttgaacgacgactagctttaataatggtagtaaaaccaacagagttagcatattctttgtagaactcaaaagcttcctcttttgattcaaattctctcccttcatcaatctctaagttattcttcctatgatcatctaactgcacattgctacactctcctgacgacatttcgaaatcaatacctgattagttaaaagtcttcacccctctaaaccaaagcttgtttgatcaaattatacctgttgaaacactatgatcagtttccaagttgcaaacttttatgaaaaacataaatttgagtatcaatggaccagatgaaacttataatcagcaaaatcagaatactaaaacctcaaaatgtaagcaaaaacaacttcaaatacataaatgaatcatctttaacatgataagtcaaccattcaaaaccaacaaagtcagctccaatcttcatcacttaaaatagaaacaaatttaggaaccaaagcaaaaacccagaaatgatatttaagcaaactcaaaatgaagatcgagagactatttacagaattacagtatgaaatagacaaaatcagaaactaattaactaaagtgcaaagatgatataattgggagggcaaaaaaggaaaggtttattacatgatgaagaagacttgggaagttgagaaacgaccggaagcgagtacagagtcagatctttgggcaaagagtcttcgtcctcgccgtcgtactcgcttttttatactcgcggttatgttggtttcttcttctctcctcttcctccggttatcgttgcttaaacctgtttttattttcgataaccggatccatttcgtcgataaccggataatttttcttgcacgagaaaaaatcttgagccacacatttttttggtgttcttcttcttcacctctgctgatggaaaaatcgtgagtttagaagcaaaaatggttgattttcttcgagaaatttgacagaactttccccaggtttcatatttttatcattaatcagataattcatagagatttacgcttatggtagttagtattctcatgaaattttgagtcttggaatgttgattgagctcgatttctgagaaatttgcaatcttttgttcattgtaaacgtaaaaattgaatctttgagtagaatgtgtattttgtttagtctatagtttctcttcaagaaataactctttgatagatttctgtaaggtttggtaattggtactgtgagttttgattatcatgtcatgtttcctgattagatggtgcattattgtgtgaccaagattgcttaaggaaatgggtttggtgggttgtgttggtaagtcttctcttgtatctatggagttgaggtgggcaaggaggagaaaatctgataatgctgcatcggcattgcctcgatcgatacctatatatatctctacgttgaagaaagacataaatctagaggaattgaggaatttgtattcactttgtaaccattcttgcaaccgtttgtctgagaaagacagcaacgttgaaaagattgttgacatg

SEQ ID NO: 8461 - DNA, 3000 bp, Unknown; identical to SEQ ID NO: 3418
  misc_feature (1)..( 3000): cDNA_ID_3071141_gDNA_ID_1971811_Annot_ID_175762 3000 nt of promoter + ATG

SEQ ID NO: 8462 - DNA, 3000 bp, Unknown; identical to SEQ ID NO: 3405
  misc_feature (1)..( 3000): cDNA_ID_1820436_gDNA_ID_1971811_Annot_ID_175761 3000 nt of promoter + ATG

SEQ ID NO: 8463 - DNA, 3000 bp, Unknown
  misc_feature (1)..( 3000): cDNA_ID_2176867_gDNA_ID_1971811_Annot_ID_175758 3000 nt of promoter + ATG
cttccaaatagttgttgtttttatggaatcttggaactcttatgaatgaaagatttttcagtatctcttgatgcaaaattggttttcttcttctatgcatgttgaatatgagcttagatctgctgttctcaatcacttccctctgttgtggtcttcgctgctcacatgttgtgtattgacagtgttcttaattaatgatgtggtttggcttaacgcgcatagatttgtattccaaattagggtttgaatcttaagttccaagtctcttaaaagtttattaatatagggtttatatatttgccaagaaatgggtaacggaatgtggaagcaagaagccagagacttggtcgaggaaccatcgcagagtaatgagaagctggaagatcagagaccacaagaatcttcatcctccatcccacgacatgtttgggctaatcgggtaattggatttgattgtggatgtatgaactttaggtctcatcactcatagagatatttgcattttaaagcttatagattctgtgttttgtttagagagaagaaaagtttgattataacaaatactacattaaacaaagggctgacattgcaaaatatggaggacctcatccaaatataatcctcttcggtagagttggacttcattgctacaatctgcaaaatgtaatatattcctacacgttcgttctagtacgattcaagtgaactttgtttctgtcggagtactctcaccagatccttatttttgtctttgcttcttttgatcttgtagggcacaaacttacaatttctgactgtacacaattttgactcatggataacctcgattctttctcatttcataagtttggaggcaatggatccagtagacaattcgatctgtgagttcgaaacgcacgttaggtatgccgttgagaataaacactgcttgagcacaattacaacgggaggcagaataaagcccaaaattccaggtaaatgtaaatgcacctttgttttccgtcatacctagttagttcatacggctatattagttatgtcaacttgtgtctcttagaggaggaagacacatattttggatggaacaaagatctcgtggatgatttcttcaaaggtggtatgcccgagtggatgccggaagatgcactaacgggaagggacaagctgcaatactatgaggtgagatttttcatgtgttaaagattaaaatattaaggatttgatgttgttgatatggtacagatgaaagattcagagttagaagaagagaaggaatggcttcatctatacgcggaactcgcattgttctccaaactggtaaggaaaaaagacttgatcaccgaaagaaagaggggattttgtttattaggctatatatgatctgtttaaagaaacttggtttttggtgttgtcttgtgtaaacgcagcatgcgcatgcgctggagtctgcaaagccatttgagatgaagaagatagttgtgagaaccaaagcaaacgtggagtcgaagaagaaggtgaaggcggagaatgcaatcttctacactagcttcagaacccgttgtggtcgagactgcaattgtataataaggagaacgactgatggaaagcgagaccatttttctcttgaagtcaaatgtttcttgtgagagtagtagtccccaaagttatacaataaataacatattatatataactagataaggcccgcctatttaggcgggtgtacccgaaattttcaaatactcgaacggatctaaactttaaaactcgaaaaactcaaacccaaacccgaataagtatccaaacatatctcaaatataagtatatattagttatatttatacttatatatagaaaatattaggatttttttggatattttagttatttttgtgtatttttagatatattcaagcaaaactactcatgttgttttgagaatttttgaaaatttcaagtaatttaatagatttgcacacaaaatttgatatttcaatatataaataactcgaacccgaacccgacccgataatttttttttgtttaaaaatacatacaaccaaaatcttatttctacccaatttctttaagtaataattatattaataaaacctacagtctaatttttacagcaataaaacttacaactacagtcatcacacctacaacaaaaattctacagcagtaaatctacagttacagacgaaccaatcacccacgtaatctcgtaagttaattttacatcatgcaaattaatattaaatgagttaaaattaataaatgaaaaaaattgaaaagttaaatcctataagctaagctatttttctcaaagtgttctattttcacttatgattacatgagttaaagacaaatttgttaattttgtttttgttgaataaatgttaattgtttataaatatatagacatataaattagtatatataaatttgtttactttttaagattttctatttttttagagaataaaaaagttaaattttgaatgacacatgtaaacatctgatcgtttgatttgacacgtggcacaatcctatgagttagcaattttgaaaaccatatattttatataataagatccccaaaattattatgtatatgagattatttaccatttggatttgattacataaattttataaattaaaaaaattattggtaaatgaattagaaaatttcactttttaatagtaattaagaagtaattaatcaattaattgagaggaaacaaaaaaattgaaatttattgataactcttagtggcgaagaagagaagaagcagaaatcaaatgtcatcgtttatcaacaaacctctaaattgatcgaatatcttcttcaatcttcatctctctttcaaatctgcaaatgagagagctgtaagagttgcatcatctctatctctttctctctctctcttgcgaaaacaccaaacttttgaaatccccaaataagggtttaagcataaaccctacgagttcatg

SEQ ID NO: 8464 - DNA, 3000 bp, Unknown
  misc_feature (1)..( 3000): cDNA_ID_1820456_gDNA_ID_1971811_Annot_ID_175755 3000 nt of promoter + ATG
cttttaagataacagtagctggaagaaacattagattgaaacagctagaaaagaatttttaaagtattgattaaattaagagcaaccctgagagataacgacaccatcaaacgaggttattaatcatgttggtcaaacgagaaaacaaacattccaaggcatatgtcataagaaggtataaaagtgtatagatttgacattaaattacagattgaagagtacaatcttaaaaacagagtataagtgaaagctaagcaatttgaatttattttttgttgggttgatgaatacctgtccaagctcgtgtaatcttgctacagcttcgtcccttaggatcgcctgatgcagatcatgcttcgtcccttctgtttcaccgattcctatttcgacaattgttacaaatgtaatcaaattggtaaaaaacagagtaaagagatgtagctacacagaatctaacgaatgagagaatgttccggaatcaaaatcacttttttaagaagtgggtatattaagattcgattgataaaatagatagagaaagaatacaaatttacctaaagagatatgggaggacgatgatgacgacgagtctgaggaagaagaagaagacgaagatgatgatgagagagcgagaggagataatagagaaaacacgaggcaccagaagagcacaagcgatggatgattatgatgatgatgatgatggaagctagtgtgatagacatgggagaggaaaggatgagatctagaggaggaagaagaaggatgaggaaccgccatggctgccgatttaagaggttgagattaaacgatgataaacaaagacagccacggaacggaactacaacaacacaaccactggctcttgggaatgagagacaagaaggagaaagagctattctttatggcttccatggctgagaagagaagagagaggaggcagctgttgggacccagtagtccaacttggacgtcagatggggcccatataaattgatgacgtggtgattctcagtggaatcttgtggagacggtcacatttggggtgaggaatcatgtgcatgcgaagtcgacaataacaatgttttattgtttttgtttattcacttactgtgaaaatgcacactaatcttgaatctaatgtgtaaaaaaaatataaagtgataggtgttaagcatttcgtcaattatcgtctaacgcataaaagttttatatactattttgaaacgatttaaactgtgagtataatatagtaacatgatttaataatggcattcaaatctcaaaatgatataatttaaatttaaactaaagtataaataaaaattataatttgtaaacgtgaaattttataattattaaatttaatagattagcaacacaaacttaaacatcaaatcgtttttgtatttatatgttttttctctaacaaaaaaatagtattttatattttttcgactattgattcatttcttttttatacaatatttttgtgatctgtctttaaaatagtagttttcatattaaaatgtctagtgaatcgtgatgcattttgcctttcacttataaagcaaaaaacgggatcaccaccataccataccatataacgaagaagattctaccatccaaccactatcacacgtgatcgacgcacgtgacaccctacctttgtctctgtctgtgtgggataaattaacattcttattcgtctattttcagtagaaattgataaaacaatactactattggtttagaagtgtttattatatgtattttgttaacaaacaaaaaacaaatagaaggatttgttatcagtttcaatgagagatcaaatagtctaaacttaaattccatttcagaaagaccactacaacttttttttatccgatgaatctgatccatgctctttaagcatcaagaatacctcaaggcatgtttatcttagctttgaaaaatataaatttctatttgattctaataccaagaagaaaaaaaaatcacataatttcaccacgatgggagtatttggtttcagttcaatttcaagtgatcaaatatcataatgccaccacgagcaacttttggagtctaacaaacaaatattaaagatctaaaattagttccaaatccataaatttcggatatatattttcaatttaacaagtaacttaattttgggttgttctcttaaatattattatcaacttacgccgacacgtaaaccattttgttaatttgaataatccgagtctatatgtttgtaaattgtccaactgttgaagaaaacatatataattgcccgactttagttattgcttacctagtcatgcacattaacattcgttaaatataataaactaaaaggccatataattgtacatgaacatgtttgttgttgatacgacaaatccattttcaggataatccacatatattattaccaaaaacgaatgcttaatttatcaagattgcattgccagacctaggatgagtgttagcttactcatcacttagtgcggaagcaattaaaatgtaatcctatataattaaacgagacaacttacaatcatattaacaagcctacaagttacaaagaaaattaaaatacagttttagtcacaatataataaacgaaatcattattgtacgattgtagtctaaaaaaaaagaagttgtgttattgtgcaaaccaaaaggacctacgaaagtataaaaacctaaagatacaaggcccaatagtggtgagcccatcacgatcgcgtattctcttaaaccggatcacttacctgaaccgaaccggaatcggcagctaataatttgaagtcgggtttggtcctcgattgaatttttatgttctgtaaattcgtgagaagaggcttcttcatctgcgtatggcgtgaaaattcgtaatctttcgtttgacagaactcttctatttatcatcaatctccggtttcttcttctttgtaagccctaagaagccaaaaagtgctaaccatg

SEQ ID NO: 8465 - DNA, 3000 bp, Unknown
  misc_feature (1)..( 3000): cDNA_ID_2176859_gDNA_ID_1971811_Annot_ID_175753 3000 nt of promoter + ATG
agatgaagatctgattgaaatgagtaacaagctgtttcatcatgctataaagtctggtaagaagccggacgtctcaggtcgatttgattgggccaagagtggtgtttctacggttgtgcagttcgaaccaaacgagagaggacaagggttttcaagctgcttgttagacgtttcgcgtttcccggttggttcatatcaaataaaatggctaagctgttgcgttgatcaacatggttcttactggaatcttctacctctcaatggcaaacctgtgtttacggttaagaaagcgtcatgactagaataagtgttggttttgacatggcggaagagtaaaaagatctaaggaggatctagttcgggagcaagcaagaaatgagacagagattggctttaagactaatctcgaaatatgcagctacacataagagagatgtttgcttcaacactatttaggtgaactaatttttattggtatgttgttatgttatgttaactagattgtagactaaaatccatgaaaattaaagcttgaaaagctaaagtcaattccatctaacactgatatgtgataattagctaataagtaataattaaagcttttaatgaaagtaaaatttttgttggtgaccaaatattactcaaatatatatttactattgttcagattattatacaaatacaagaacggttcagaaataacagagataaaaaactgatattaaaaatttaattttctttcccaaatcagtacctcatttttccattaaaatgataatgtaatagtaataatactcaaccaaatgaataattgttttcagtcaatgaaaatcattttaggggaatgaattgagttagtcaaaatgaataatgcattgaattgaatatctttgaatgggaaacaaatcaaatttacttggaataggaagattattcacaggacttccaaaaccaagggcagaaaaacacataaaatcagattaaatagaaatgaacttgttgacaacaacaacaaccaaatttgttttgctttgaaaataaaagcaaatgtgtgaaatatatgactgaaggaagaagaagaagaagccaaaattaagtttcgtgtaagtacttttcattgttttgtttgattttaagttttcttttcgtttctaaactaatttgtgaaaattgatcataactgaaattctttgcaacttatatcgtttgctatgcgactgttctttttattgaggtgaaaattattagttgggaaactatcaacgcacattaacttttcgttttgtgtaataattttcataggtataaactttatcttgcctcaattaattttttatttttttgtcattactaattaacacgagttaatatggggaaaaacgttaccgtatgatcattaccgttgattttggtttgcatttaattaacttcgtgtaacctacttactttgcatccattttcatatgtttttctttgttttggttgctaattaactataaggtacatataaataggtagatttgggaacctaattgttttaccacctaacatgactctagactaacttttcaattttgctatgaaaataaaaggccaatttcatatatctggtaagtaatcccaacatttccccatttcattacctatcattctttttttttgctaagaaattacctatcattctttgattaaaattttctctgtttttttttaattcttttaagatgaagaagcctctttcattgtccaacagagaaaccttttatttgtatatcatataacagcatgatttctttctttgtagatacattatacacatacattctctatatatacatgttcttttgaatttcttacttttaatcaatttttccaaattaaaagtgcttcttttctacatctgatttattcgatttgcaatatccatccttatatatagagttttttttattgcttatgcagtaatatcaaataggtaattaacttttcgtttggctctgttttacattcacaggcctcaagtataaccccattcgaatccctaaacaatagagaatctcacaatcaagatcaattcagaggtaacgttttactttttttcttgctttaaaaatatatattataatccgttttctgatatttaactagacgagagaaagtaatgtttcttatgtcaatgtcatattaaaaatcagttttatatatgaaaattttcatttttttatttatgaaaaatgtgcaaatgcaggtaaccaaacacaaaaaaaaaagttttgtttcatcctccattgttcttaaaagcattagtagttatcaacataataagttactccattcttaagcatttcaataaatcttaactttggaaatcagaaaaagaaagagtggacgaaaatacctttagttggaagaaatattcaaataaagaagaaaaaactctaccaaaaacctatccaccactcaaacctccccaaccaaaaccccatgacctggtttacccttttacatacaatatctaatctcataatgcatgaatctatacctttatgcacttttgcggatctttttccaacttccgcatactaactagcatatctatctctaagtcctccctatatatttaaattaacaaattaaatcaacgtaaaaatgtcaaaaatatatattaatgttttgaagagaggtaggtttcaaggtaagttatatgatagagtttagtattcataacaaagattcattatagtacaaataataagttatagcgtaaaccggtagagaaatagagaggaaaaagaggatcaaaaatgtacaagagtgcgaaatgtgtgactcccattagaaaagacacaagtttgtataatgtttcattggtaaccttagttaggcctttctctttccatgtgctaacaacaacatacgtatatatataaatgtctcacaaacattaccttcagccattctcttatttggctcattcgattattataggaggaaaccatg

SEQ ID NO: 8466 - DNA, 3000 bp, Unknown
  misc_feature (1)..( 3000): cDNA_ID_3091118_gDNA_ID_1971811_Annot_ID_175750 3000 nt of promoter + ATG
tttgccttttaatacatatacacacacgcacatatctacctgcatcttcttcataatcattcctaagaaattctctctctcacacactcaagaacaagacaagagtcaagaaaaatcagatgagtctctatagcttcattagcttgttgttactgtttctcatcacgatttcaatggagtttaaagagacatcatccttaagaagagacatgaccaagcttttaaagctccaagagaagattcaagaaagactcgcagtcactcccactctctcaccagtgtcttctccttcttctcactctcccaaaatggtaaagtcctcttgttcagtttctaatgtattacaggcacgtgtgtgtgatttgtgagcgtgtgtgagtttggtttgtgcaggttgggaaggtgatatacccgattggttacggagctgaccctacaggtggacaagacagtagtgacgcaatacttgaagctttaactgatgcttttcagttacaaactggacttgagatgctgccacgtgtcgctgatttaggtggtctagttattgatctccaaggtggcagttacatgatcggaaaacctctcaggttcccttcctccggtggcggaaatcttgtggttagtccctcattttaaaatttgacttaagaaacttatgaaaaggtttgagtcttttaagacattgttcggtgtaattcaggtgaaaggtgggactttccgggcatcagaactgtttcctggtgataggcatttagttgagcttgtagcatcaaacgctaagaaaccaatgaaaatgtcgccagaggagtctttctccgatcagaaagaccagagctctgggatcttctatgaggatgtgaccttccaagatgttctcttcgactcaagattccgaggaggtggtattttggtgattgactcagctcgtatccgtataaccaattgttatttcctccatttcacaacgcaagggattaaagtccaaggaggtcatgagacatacatttcaaactccttcttggggcaacattcaacggtaggaggagacagagaagaaagaggatttactgggacaggaatcgatatctcgagtaacgacaatgccattacggatgtagtgattttctcggctggtatcggtatctctttgaatggtggtgcaaatatggttacgggtgtgcattgctacaataaagctacatggtttggtggcattggcattctagtgaaatcacatttaacgaggatagataattgttaccttgattacacaggtatagtcatagaagaccctgtccatgttcatgtcaccaatgctttgttcttaggagatgcaaacatcgtcttgagatcggtacacgggaagatttccggtgtaaacatcgtcaacaacatgtttagcggtaccgccaaaaacaacttcccgattgtcaagctagaaggagagtttcatgatattaatcaagttgtgattgatcaaaacaatgcagaagggatgatgctgaaatcaacaaccggaaaggccatggtttccgcaaatggaacacgatggatcgctgatttttcccctgttttggtattccctaaccggataaaccattaccagcattcgtttttcgctcaatccggacagatccctgcaaatgcagtgaccaatgtctccaacaatatggtggttgtagaaaccgatagagctgtaactggaaccgtgtcaataattgcttatcagtaaaacaacattcttcacattgatcatattcctaataagaaagcatgatttgacatctgatttatacaagttcagttacagtttggtgagcttgatactaacaactaataccagcaatcagcaacctcatcattagcggcttcttctggctcatccgacttctcaggtggaccagaagtcctaggcagtccttggaaatcacgtttacctggtttcgcaatgtctatataaatcattctgccattgtacatctgcaacagaggaatgggaaacatttaggttgatttcaagacataaaaatgtaaacttgtgattgaaagaagcttttacccgacggtccatggtctctatggcaagaaaagcatcatcttgagacgtgaattgaataaaagcataaccttttgatctcttcattgcctcatctttgataagcttaactgttttgaagtataagagtgaacatatcaatgccataaaactgaaccttaaagcaacaaaacagagtaaaattgaaaccgcaaacataccttcagctatctctccaaaagctgaaaactctctctttagaaaatcttcacttgtagaaaacggtaaatctacaaattcaaagtgaagaaacatcagaaccgtagagtaattaccaagttgaagttacaaccaacttcaacttcactaatgattgctacaagagcttagagctatcacatatgactaccgtcacaatcctgactcaaatcaactaatttcaatcaaaccagaatcataaattacttttggaacaataacagaaccatgtcctaatctcagctagaagcgaattcaaatataaaccaaaagataatctgaatcttacttctgaccatgattttgctcgctagagggtaattaaagagcgaagctttaatctttggaaacctaaggttcctgtaattaggtagagaagatgaagaagccacaaaagaagggaaagataacgtcgccgaccacataattcacagtcgccggaaatagagagggagaagaagaagaaacaaacagagagttataaaacgacagcggtatagtaaaaagctaaggcctaagttttttggcccagtgataaatttgaaactttaggcggaaactaaaaacatttgaaacaataaggacttaaaaagtaatttactatttatttagatattgtaaaacccacacaaaaaccctaatttcatttctccaaagctttccagaatactctccactccttcataatttctctggcaacgatg

SEQ ID NO: 8467 - DNA, 3000 bp, Unknown
  misc_feature (1)..( 3000): cDNA_ID_2176847_gDNA_ID_1971811_Annot_ID_175747 3000 nt of promoter + ATG
agattttgaatttaagaagatgatcgatcttaaccaagttcatacaactctttggaatctgaaaaagaaattaccaatatttactatatattataaatatataatagctaaccacatcaagaatgtactcataaagcatacaagcaaaataaagtaaatataaactatagtcttaaatcctcatcaagtcatcatcattgaccaaaagtatatacataattacatatagccttagtgtgtaaagcacgtgatcagcaatgtaattagcactgcccatcatttgaaccatcaaacttgttaataacaaattattatgtcaagactcgagagaattcactataagatattatagttgcttattcttctaatcgaagacaacttatattcttaagaaagttttgttggctctcattcatcactttgtttagaacaattctgcaaatttcctcaaaagataaataaacgggggaataagagagtgactagtgaataaaagtcaaacatgggactaagtagatttcccttacatggaaagagataagaaggaaaaaagagagtaaaccactagatatcaattccaaatgcaagaaagactctgaatctttggcctttctcgttggtcatcatttagagatcaatataacttgctttgacctgcagtttctgaagatccatcagcattctcgctttgcttttatgcctccaagctctttgtgaacatcattgttgtggaacccatcctgtcatctccaaacccacatgctttgaagaatggcctgacaaaaatgtttctttctcatcagtacaaatgcataaggattctgcattcactaaaatcaatcccacacatattgtagatatcattagtaagctactatcaccaaattcttggtcagaatagatcacactactatatccttcgatcctaaacctagtgtgaaaggacacaacaaagaactgacaagctactaaagatgggtattagttatctcagaggaaaaagcggtacctttcatcctcgaagcagagagctgctatgtcgtaaatgtctctgcttgtgagtagcctattgtaacagtttttgatgaatgaggatctaacctttaagagaagtttaagggttttaagtaaagcaaaatcatagtggaaaataccatcagacctgacaattctgtttactatcagtttaccaatccccatcctttgtagtgaaggtaaaacctggaaaacactgagaccaaatcacatatcttagcaccaaacagaagctattacagctcgactagaccaggtaatgaagcgaattccactatataacctgttaaacttgtgctataggtaaaagtaccattagatcatggatagaagcggtcaagccataatcagaataagcacgaccgaatccaacaagctgtccattggaaggagtgagaggcaccgcattctgaaacaagtctcccagaaaactatcatccttattttgtctcccaaattctgaagtatacaaagaagaagataaactttcttcttctgaatacaaaaccgcatcatcaacatccacgtgttgtggtttgcaaaacacagatacaataacatcactgcgagagatagctctacgcagctttttcatgtcaacaatcttttcaacgttgctgtctttctcagacaaacggttgcaagaatggttacaaagtgaatacaaattcctcaattcctctagatttatgtctttcttcaacgtagagatatatataggtatcgatcgaggcaatgccgatgcagcattatcagattttctcctccttgcccacctcaactccatagatacaagagaagacttaccaacacaacccaccaaacccatttccttaagcaatcttggtcacacaataatgcaccatctaatcaggaaacatgacatgataatcaaaactcacagtaccaattaccaaaccttacagaaatctatcaaagagttatttcttgaagagaaactatagactaaacaaaatacacattctactcaaagattcaatttttacgtttacaatgaacaaaagattgcaaatttctcagaaatcgagctcaatcaacattccaagactcaaaatttcatgagaatactaactaccataagcgtaaatctctatgaattatctgattaatgataaaaatatgaaacctggggaaagttctgtcaaatttctcgaagaaaatcaaccatttttgcttctaaactcacgatttttccatcagcagaggtgaagaagaagaacaccaaaaaaatgtgtggctcaagattttttctcgtgcaagaaaaattatccggttatcgacgaaatggatccggttatcgaaaataaaaacaggtttaagcaacgataaccggaggaagaggagagaagaagaaaccaacataaccgcgagtataaaaaagcgagtacgacggcgaggacgaagactctttgcccaaagatctgactctgtactcgcttccggtcgtttctcaacttcccaagtcttcttcatcatgtaataaacctttccttttttgccctcccaattatatcatctttgcactttagttaattagtttctgattttgtctatttcatactgtaattctgtaaatagtctctcgatcttcattttgagtttgcttaaatatcatttctgggtttttgctttggttcctaaatttgtttctattttaagtgatgaagattggagctgactttgttggttttgaatggttgacttatcatgttaaagatgattcatttatgtatttgaagttgtttttgcttacattttgaggttttagtattctgattttgctgattataagtttcatctggtccattgatactcaaatttatgtttttcataaaagtttgcaacttggaaactgatcatagtgtttcaacaggtataatttgatcaaacaagctttggtttagaggggtgaagacttttaactaatcaggtattgatttcgaa

SEQ ID NO: 8468 - DNA, 3000 bp, Unknown; identical to SEQ ID NO: 8459
  misc_feature (1)..( 3000): cDNA_ID_3045591_gDNA_ID_1971811_Annot_ID_175742 3000 nt of promoter + ATG

SEQ ID NO: 8469 - DNA, 3000 bp, Unknown; identical to SEQ ID NO: 8458
  misc_feature (1)..( 3000): cDNA_ID_3091133_gDNA_ID_1971811_Annot_ID_175741 3000 nt of promoter + ATG

SEQ ID NO: 8470 - DNA, 3000 bp, Unknown
  misc_feature (1)..( 3000): cDNA_ID_1017589_gDNA_ID_1971811_Annot_ID_175731 3000 nt of promoter + ATG
caaagcttttaactttgatcctgttttgattttggtgaagcagctattttgcataccctgcaatagaagatgagagatcgcagcaagacgaatcgttcaagaagatactcaatgagtccttaacgttccatttctggaacagcgtaacttcctcactgatccctgaacctgagagccttgtggctaagttccttgatcatagttgtatcagatgctccgatgtattataaaactatttttttgataaaatcatttatatataaagattacatttttgcaactctgtctcacactcaagaggacgagccattaaagctccaatgttatctcttcttcttcctaagtcgaatcgattccttcttagaacttttgagatacccaattctctctgttctcttttcttcttcagattgatctcttccgatcatgaatccagtgatttgtctcttccttcttctccatcatcgtcaccttctcaatgtctcgttaaatcggtctgttcattggtttgtacttcctatcttcgtcaaaaccatgtcgtatcatccccacaccgagtcaatctcgacttcgatgctaattctcttacccacgagcaagcgatcactgtggtggcttcactcgcgagcgaatctggttcgatggttgctctgtgcttcttctattgggcagtgggtttcgaaaagttccgacatttcatgagattgtatctcgtaaccgctgattctttgcttgctaatgggaatttgcagaaagctcacgaggttatgcgatgcatgcttagaaatttctcggagattgggagattgaatgaggctgttggtatggttatggatatgcagaatcaggggttaacacctagctcgataactatgaattgtgttctcgaaattgccgttgagttgggtttgattgaatatgcagagaatgtgttcgacgaaatgtctgtgagaggagtagttccggattctagttcttataagcttatggttattggttgttttagagatggtaagattcaggaagctgatagatggttaactggaatgattcaaagaggatttattcctgataacgctacatgtaccttgattctcactgcattgtgtgagaatggtttagtgaatagagcgatttggtatttccgtaagatgattgatctagggtttaagccaaacttgataaattttacgtctttgattgatgggttatgcaagaagggtagtatcaagcaggcttttgaaatgttagaggaaatggttagaaatgggtggaagccaaatgtgtatacacacacggctttaattgatgggctatgtaaaagaggatggactgagaaagcgtttaggctgttcctgaaactcgttcgtagtgatacttacaaacccaatgtgcatacttatacttcgatgattggtgggtattgcaaggaagataagttgaaccgtgcagagatgttgtttagtagaatgaaagaacagggtttgtttccgaacgtgaacacgtatacaacactcatcaatggtcactgtaaagcaggaagcttcggtagagcgtacgagttgatgaatttgatgggtgatgaaggttttatgccgaatatttatacgtataatgcagctattgacagtctctgtaagaaatcaagggcacctgaggcatatgagttgctgaataaagcattttcttgtggattagaagctgatggagttacttacactattcttattcaagaacagtgtaagcaaaatgacattaaccaagctcttgcttttttctgtcggatgaataagactggttttgaagccgatatgcgcctgaacaacatactgatagctgcattttgtaggcaaaagaaaatgaaggaaagtgagaggctttttcagttggtggtgagtcttggattgattccaacgaaggagacttatacgtctatgataagctgttattgtaaagaaggcgacattgatctggctttgaaatattttcacaacatgaagaggcatggttgtgttcctgatagcttcacttatggttcactaataagcggtctctgcaagaagtccatggtagatgaagcttgtaagctttacgaagcgatgattgacagaggtttatctcctcctgaggtaactcgagtcacattagcatatgagtattgtaagaggaatgattcagccaatgcaatgattctgcttgaacctttagataagaagctgtggattagaacggttaggacacttgttagaaagttatgtagcgagaagaaagttggagtggcagctctgttctttcagaaattgttggagaaggacagtagtgctgatcgtgttaccttagctgctttcactacagcttgttctgagtctggcaaaaacaaccttgttactgatttgactgagagaatctccagaggagtaggctagtagtgattacatctcccacagttgctttgtactctctgtttgaatagcaaatccacattgtggtggatcaagaaaccgtggaatgtagccgcgttgaggcaatgacatggtatgcttttgctgcgttttttgtcgcctgttcagtagattctaaagactggagagtgggatttagactattatcaccaagtgaagggtatgaatctatctatcaagattctagacatgaacaacaaaaccaatgttcttcactctgtggtgattaagttgttactgatgtaaaagtacaaaagttttgacaaaatagaagtgggattttctctaagtggccagttttaaacagggacactaattaagtagcaaaaatgtgaactttttttttttttttattgcaaaggtttgtactttttttgaattgaatattcctccgaaagcaaccaaattatcacaggttgggcatgacagaagcagtgacatattaatacgtcgccgaaattgactctgaagccttgtggactatgtatatagataatggatcaggtgaatcttcaacttatatagctcctggttgatg

SEQ ID NO: 8471 - DNA, 3000 bp, Unknown; identical to SEQ ID NO: 8467
  misc_feature (1)..( 3000): cDNA_ID_1820469_gDNA_ID_1971811_Annot_ID_58104 3000 nt of promoter + ATG

SEQ ID NO: 8472 - DNA, 3000 bp, Unknown; identical to SEQ ID NO: 8465
  misc_feature (1)..( 3000): cDNA_ID_2176859_gDNA_ID_1971811_Annot_ID_58110 3000 nt of promoter + ATG

SEQ ID NO: 8473 - DNA, 3000 bp, Unknown; identical to SEQ ID NO: 8464
  misc_feature (1)..( 3000): cDNA_ID_1820456_gDNA_ID_1971811_Annot_ID_58111 3000 nt of promoter + ATG

SEQ ID NO: 8474 - DNA, 3000 bp, Unknown; identical to SEQ ID NO: 3405
  misc_feature (1)..( 3000): cDNA_ID_1820436_gDNA_ID_1971811_Annot_ID_58116 3000 nt of promoter + ATG

SEQ ID NO: 8475 - DNA, 3000 bp, Unknown; identical to SEQ ID NO: 3406
  misc_feature (1)..( 3000): cDNA_ID_1820728_gDNA_ID_1971811_Annot_ID_58118 3000 nt of promoter + ATG

SEQ ID NO: 8476 - DNA, 3000 bp, Unknown; identical to SEQ ID NO: 3407
  misc_feature (1)..( 3000): cDNA_ID_1820724_gDNA_ID_1971811_Annot_ID_58119 3000 nt of promoter + ATG

SEQ ID NO: 8477 - DNA, 3000 bp, Unknown
  misc_feature (1)..( 3000): cDNA_ID_1819489_gDNA_ID_1971812_Annot_ID_58125 3000 nt of promoter + ATG
tgcttgccatcaacttgtcattgctcgtgactcctttgctctttttcattaattactttttagtcttaaaggcatctccaaccataacactattttggtgctgaaataacactatatttggtgtagattcaacactaaaatattttcaatctccaaccacaacactatatatcacactaaaaataatattttctattattatattattaaaccaaatattatttttaatatttaatatttttaatttattgattaatacaaattacaatctatatatcaaaatagctttaaattttgtaagtttatattttcaatggttaattgaattttattatgtaatttcaataaatcttttgttataatttttatatcttctactgattaatatttcataatcatattatcaaaattaaaaatacataaatagttttgatattttttttttttacttacaaaattcaattaaattattagatgacaatacaaatcatatttaatatgctatacctaaataagctatattcatatgtaataattttaaagtaaaaaaaaatatatatttaattttaccgttgctacagtagcacgccaaatatagtggagtactgtacaaaataaaggaatcacactattatagtgtaatatttacagttgggttggagtgaaaaagtatattgcatcacatcaaaatacagttttaccgttacgttggagatggcctaagtatagtaattagaataagtatgctttttttgtgtgtgtgacaacaattagaataagtatgctattctttgacatttataccatctgttacccaaccaataaaaatattcgtaccactgctaaatagaacacatctttgattccaagtttcttataacgtacaacacaatttgtgtgtttgtctacacatgccttttattatccgacactaataaatattttgtagtagtactatccacattccacacttgcctttatctctatatatttgtgtagtactatcaacattccacacttgccttattctctctatatatggtgtacttaagtatatatatcaactaacacacgttgtgtaatatgtctaattttgtgtttatatgacttcaataacactacaagttaacgaaggactcaattcgtcctactccgaccacaatagttgggacccaaattagttgaaacaatatatttcatctttatcaaagtaatttttaaattccatgtagaagttattcacaaccaataataaaccacattatatgttacaaattttaacatttttatacgtatttgcgattacatgtaggttatctacaatttttggttatctatgatttctataatgtaattaggttattgatccttttttttttactgtgtcttagtcttactggatgtgaatactatagcagaattaattttaatttaaaacattttaaattgatttttggtattggaatattgtaatatagcgttgacggggacagtgaactaagcacatacgtgtgcatttttctttaaagaaatatcaatattgtgcaacgatcgaaccggattaataccacaatgttcttttacctcaaacagtagtgaattaatgttggacatgaatttagaaatcccgtttcaatagcatttgaataagctaagtagtgatcttacactaacatatattaataagctaagcactttaatatttcaggtttgatccgactttttcttgcactaacgatactgccttaattcaatctttgtttacgtatgcacatcaaaattatttaaaaaaaacattcagatgttcgacagaaaaaaaaaccccaaaagaaaaaactaaaggaggcatgatatttaccaaatgccaaacacaattgaatatccttcaaaacaagacttttcgatttcgtgtcctccaaataaaaatcaaagacttttctttagtttataaaccccaaaaagagatcaacaacgaattttcttacggccataaatgcttctacattaacaaacaaacaagatctctatgcttatattcattgactattcacatttttatataattgaaagaaataaactttatgccaaaaacagctctatcattatctcatggggtgattttgataataataaaataataaaacattccaccaaacccaatctttgtaaaactatgaaacagctgttctgttctgattcgtacttgcttcatcaacctttttgtaatcaaaagctaaatcgtataatcacaaatccctcagaaactgttcgttttttgttatcgtttacgcgtttttaatcgctaatcagttatataaaaaatcgacgaaaggtttgacgaatcgtcgtcgtcgtaaatccccaccgggtcaatcgactcgtttacttttctacggtcttctctcctcaaagagtctctctctctctctctgatatttccgcagcaataatggtatagatagagatacagaagcagacaaattattgctgcttgaaattctcttgtctgattaaaatatatatacccaagtccagaagctgtttaggttcgagaagcagagagggttcgagaagctaataagggtttcttctttttgattttaatgctaaaagggttctagattcgttgaattttacaagggttttaggggttcttagaagcttttgcttgattgtcttttatttagaaacagtggtgagtttttagtctttcactttgttcaagttcgaagctttttttggagggaattttgggcttctgattttgatcgaaacttactgatagtaagttctttgagtcctccttaactgtagtttctgtgtactgaagttattgaattgaaagtttttatcttttttggttattgaaactttcatagtttgatcaaaagagtctcttgctctgtttttggctctgtttttgtgagtgtgattgtaagctttgttgtgagtagattgaatcaaggagtgtgagagttgttaaaagtgttttcagagatg

SEQ ID NO: 8478 - DNA, 3000 bp, Unknown
  misc_feature (1)..( 3000): cDNA_ID_1819485_gDNA_ID_1971812_Annot_ID_58127 3000 nt of promoter + ATG
tgggtttagattcctttgtacaacgatcgaggtaaaccttttttttttcttgctcacatgttttttttctttacttttcagactgacactttctctgaaattcgaattttgctttttgttgaatcataacttttcttcatttgcttacgttcacacttacattaacataagataactaacctgtcaaaaagactcaaattttagcttatgttgctgtggatttagtatttaccagaaaaagctatattgtgtcaagaaaataaaaaagggacttgggattcttggctcgtgtgattcagtagtttccatgagtgtttatttttgttttgttatatacttaaattagtactatgttaactgtcttaattcttgtttagctggtcaatggtgagactgaagaaatgatttccccttttgccaacatctaatgatgatgtttggattttgcttgtgtggggataaataaaatggaattattcattgtttgaccattagatgccaaagaaaatcattgttcttttacttttttctttccttagttgcatctggattttcaatttttcaatcattgtgtcatcttgttcgttgctcaccagcttttgcatttcgtaaaatggaaaaagaaaaaaaaaacacatttttatgtaaataatctatgaggtattctcgatccatttagcaaagattagttctttgagcactatataccaaataaaatcattgttttttctcacttttttgcttaggtgcattttggttttcaactatcaatcatagtgctatcttgttcatgctctacagctcttacatttcgttaaaaagaaagaaaaaaaaacattttatgctctttttgttgttgttgataatctattagaaaagattgttcttttgagatcttctgatccatccattagcaaatgttgttctttgaccattataaaacgaaacagaatcattgttctttacttttttttttcctttgtgcatttggattttctattatcaatcataatgtctttttgtttgttgctcaccagcttttgcattatgtaattaatccactagcaaaagattgagagagtctcagctccaaatggattgtgttggttacattttgtgatatttcttacacaatttgcaataaactattgtgtagggatgcaaaccaatggatcgaatggacctcatgaatggttctacttcagctagtccatgctcatcgtatcaacatagccctcgtgcttcctacaatccaagcccttcgtcttcatcattcccgagtcctacaaacccatttggtgatgctaactcactaatcccatggctcaagaacctctcttcaaactcaccttccaagcttcccttcttccatggaaattcaataagcgctcccgtgactccgccattggctcgaagccctactcgtgatcaagtaaccatccctgactctggatggctctcaggaatgcaaactccgcagagcggaccgtcttctcctactttcagtttagtttcaagaaacccgtttttcgacaaagaggcttttaaaatgggagattgtaattcaccaatgtggactcctggacaaagtggaaactgctctccagctattcctgctggtgttgatcagaactctgatgtgccaatggctgatggaatgacggctgagtttgcgtttggttgtaacgcaatggctgcgaatggaatggtgaagccttgggaaggagaaaggatacatggagaatgtgtttcagatgatttagaacttacacttggaaactcaagaaccagatgatcatttcagagaagaatcaaagtcgtttgctatcattaagtcttcttttttgtctgtcttttttttccagtgtgatgtttaaaggtgactcagaggaaaaaaaggagaatagaaagagaaacaaaaaaagaacattttgagctctgttttcttttttttttttctttttttttttgttggcttttgactaaagttgtagttagaatctattttatatcttgaagcttctttaaaaaaaaagttatttgtggaaattcgatttgagattagtgatgttagtataatgaattttatataaaatattgaagccagattggactttagtaaccattgtgaacgtgagaaaatatcagtatctatcgctgaaaattttatatttttctatacatttaaaagataacagaaaagtggattacgttgaaagaccaaagatatgtccaagaagtcatgcgtaacccaatagaaagtcaactaacaatgaggaccacatgtgattggtcttgttaattagcgtacgtaaaacgcgacactatgacaactcgtacgtaatttcgcgaataatatgaatagtaacttcaactggactattttacaagtcaacaaattacttagtggatccaatttaaatgtccaattgttcttatttggctaaaaatgaggcccatatatacataatttttttatatgatttattttttaatgaatttatttaagagtatgtaaacagaaccctcgctctctctcgctaatttggatagatacctccgagcaagggttaagtgtaagcctcgtttgtatttgtaacgtaagttgtcatcatcgtaaagagttaatcaggttaattattttctttagtaaggaatgtgttttacccgattcttctatcattatgttatctttgttgttgaacctctcgattctcgaccttggattttgaaaattggtataattattatttgaccctttttgtttgttatgcttttctttgtgtgtgtgtgtgtgtgtttatttggttattgtaatctttgggaattcttgttttgagtggttttggaagatgtgtcgtgttagatggggatttcgttagggtttctgtgagctaaaaaagggtgtatgtttctttccctaattgattttcgtttgtaaatttattttgcagaatgataactacattttcatggataccaaaaggggttgcaaaggcc

SEQ ID NO: 8479 - DNA, 3000 bp, Unknown
  misc_feature (1)..( 3000): cDNA_ID_1819481_gDNA_ID_1971812_Annot_ID_58129 3000 nt of promoter + ATG
gtattctaagaagtatatatatcaaaattaatgcttaacccattcaagaattcattcgttttattacaattgtatattacatattttcaaaaattcaatattttgtaccaaaatctggtgagaacataaaaacagagatatatgttttctcttgacaaaaaaaaaacagagagatattgtagttttcttaatagagccagcaatggtcaaatatatcatgtgaaatagtttctaaaatacatcatccttttcttcttaattaataaaatagtcaaataaaaaatcgtctccaatctttttctctctctggatttgccaataaattggggataaccagctaccaaactcattcacacaaagtcataacagtcgtttaaagtctgatccttttcatttttctttagtgtgtgaaaagagaaatacagttatggcggagatctcgggaaacggtggtgatgctagagacggagctgtggtggtcaatctcaaggaagaagacgaacaacaacaacaacaacaagctattcataaacccttgaagaaacaagactctctcctctctatctctgtccctttcttacaaaaggttttttacttttgtctttactcctgtaactctcaatctccaaaacctctttagttttgaagaagaaaaaatatgtcttacaaatctttagttttgctctgttttttaaattgtcaaattgctctgttttcagttgatggcggaggttttgggaacatacttcttgatattcgccggttgtgccgcggtggctgtaaacacacaacatgacaaagccgtgactcttccagggatcgccatcgtttggggacttaccgtcatggtccttgtttactctctcggtcacatctccggtgctcatttcaatccggccgtcacaatcgcattcgcttcttgcggccgtttccctcttaaacaggtctatactctatatccctatataaattataaactataaggattgatcaagtgttgcatttaagtatgatttttgagtttgataaaccaacattagacattattgtctttgtgtttgataggtttagtttaaccgtcgtttgattctttttgcacgaaactataggttataataaaagttataatgttttttaataattctttattggattttaaagaagttgcatcttttaagtttttcttgtgttgtatagtgtatactgtatacaacctttaaatcatttatatctttcactaatgactttattttttattagaattctttcagtaatgaatttgtacgatagacgtatttatgagcatatgcgagtcatgagtgattgagtgtagataatttcaaatgtatgcgtctacgactctacggtgatatatgagtatagccggaaaactagggggaatttgttttttgtttaactatttgttaaaaagttaaatgtatttttgttagtttccaaattgaaaattttaaaagtgtgtgtttaccatgtaacatttgtccgtatatataacttctccacacaaacaaagtcaaacaaaattgtgttatataaacgtcaaaatcttcacaatcttccaaaattgggtccctagttaatatgatatcgcatatcaaataattggtcactaaattttatttcttatatttttgtaggttccggcttatgtgatatcacaagtgatcggatcaacgctagcggcggcgactttacggctcttgttcggacttgatcaagatgtttgtagtgggaaacacgatgtgttcgtcggaacattaccatctggatcgaatttgcagtcgtttgtgatcgagtttatcattactttctacctaatgttcgttatttctggcgttgccaccgataatagagcggttagtattcgaaatcttcttatgttgcacgaaatgatataataatcaaatttgatggatatatgttagggattctaactattgtaagcaatgttcgttttaacttcagctaatgtgttatcctttttatactctagatcggagaacttgctggactagcagtaggatcaacagtgctacttaacgtgataattgccgggtaatatactattattaattactatcattttcttttttatatagttttctttatcgacagaaaatttgaaaatgatatatggttatgtttatctttatattaggccggtatcgggagcatcgatgaatccaggacgaagtttaggacctgcaatggtctacagttgctacagaggactttggatctacatagtttctccaattgttggtgcagtttcgggtgcgtgggtttataacatggttcgatatactgataagccattacgagaaataactaaaagcggttcttttttaaagacagtgcgaaacggtagctctcgttaagaaaaagaaaaacatgactatgttgtactagtcatcggaggttaagttgtatcactaaagaagtaactggaatattttgtattaaagtgtttttaaatttggattaccgcaaatggataaacatttatggtatgtgacgaatatgtaactgatctataacgagtttggccatatctaattacgtgctatatggttgtattaactgctatattatatctttctctttttatgcgaaagataatgtcgtcatatttatggtgctactgtatcgttacacctttgaaatcattaatgcaattttggatagaaagatccttagtttacgcaaaaattgtcaaaagttgcaatttagaactcgtcaaacaaagcacaaaagccggtgtcgcaaacattgccaagtgtgcaatactttgtccaagagcttaaaatccggccacgtgtcattttgtcgccattgttcgccacatcatcaatccgaatgacgtgtcacgcatggaatcattcacgtcatgctttcctcatgcaaacatcactcctctcttataagaccaaaagcaaaacactcgaaccaaactaaagaacaagaaaaaagggtgttgttacg

SEQ ID NO: 8480 - DNA, 3000 bp, Unknown
  misc_feature (1)..( 3000): cDNA_ID_1819477_gDNA_ID_1971812_Annot_ID_58130 3000 nt of promoter + ATG
cggagaacttgctggactagcagtaggatcaacagtgctacttaacgtgataattgccgggtaatatactattattaattactatcattttcttttttatatagttttctttatcgacagaaaatttgaaaatgatatatggttatgtttatctttatattaggccggtatcgggagcatcgatgaatccaggacgaagtttaggacctgcaatggtctacagttgctacagaggactttggatctacatagtttctccaattgttggtgcagtttcgggtgcgtgggtttataacatggttcgatatactgataagccattacgagaaataactaaaagcggttcttttttaaagacagtgcgaaacggtagctctcgttaagaaaaagaaaaacatgactatgttgtactagtcatcggaggttaagttgtatcactaaagaagtaactggaatattttgtattaaagtgtttttaaatttggattaccgcaaatggataaacatttatggtatgtgacgaatatgtaactgatctataacgagtttggccatatctaattacgtgctatatggttgtattaactgctatattatatctttctctttttatgcgaaagataatgtcgtcatatttatggtgctactgtatcgttacacctttgaaatcattaatgcaattttggatagaaagatccttagtttacgcaaaaattgtcaaaagttgcaatttagaactcgtcaaacaaagcacaaaagccggtgtcgcaaacattgccaagtgtgcaatactttgtccaagagcttaaaatccggccacgtgtcattttgtcgccattgttcgccacatcatcaatccgaatgacgtgtcacgcatggaatcattcacgtcatgctttcctcatgcaaacatcactcctctcttataagaccaaaagcaaaacactcgaaccaaactaaagaacaagaaaaaagggtgttgttacgatggcatcgagtgataaggttccggtggcgtgtccggcaagcagtggagatggaaaggagccaatgggaaatccgacgaaaaccactacggcgatgctagagaaaggaacggctatgatgcaatcgatgaaaccgatcaggcaaatgagcctccacgtgtgttcattcgcttgctatagccatgatcccggtcgtcagatcgaagttcatatttacggccaccgtgtaaaccaggatttcctccaatgtgctgtctacgattccaattcctctaaggctcatctcataggtaaatatacttcgacttcgatagtttgtttacatttttttgagttaagtttcattagctaccaattaaaaaacaatgcaatatatggattgatcacgtctcttatatactattccatgtcctctaatgtgtgttggatcctatgaggttgcgttgtgtttgtttattcgtttcacacattcacaattttatatgaaaataaaataaaactaaacttcatttttttcgtatgcactattaattttaggtttatataggcggtaaattaatggccatgcatattttttatgcgtataaatgttttctaagtttgagcattgaagctttttgctagagactaatgacttctgaattttgtttgttattgtattgaatctatagggatcgaatatatagtgtcggaaaagttattcgaaagtctctcaccggaggaacaaaagctttggcactcgcatgattacgaggttcatgattttcgatacattgtccgatatgtttattatttatctgaaaaacgaaaatgatcgaatgagagttgtttttagatccaaatggctcttctagtaactccaagggtccctgagctcgttgcgaaaccggagcttaaaaatcttgccaaatcttacgggaaattttggtgtacatggcagattgaccgaggtaataaactcatcttaatatgattttttttatatatttgatatgattatagatgatatgagtttagtaacttaggttttttgttgtcttgttataggggataaattaccactaggtgtaccatcactaatggtatcgccacaagacgtgaatctcgggagaatcaaaccggagttggtgaaaaagagagatgaagaacatggaatctcgactgaatcgttgaagccgtcaagagatgggatctgtggaccagagaagaagaacctggttgctgattattgggttaggtttaggaaaggctttgcgcttgatgttgttgaaacagatatgaagagaacagctcccttcccctaacttttgtgtgtgctttttttctcagacattaattatataagttttcgtaagcttacactagatgggttgtgtacttattatgttatggagtatgataatgtcataaacatgagaattttttcgctctttgttactcattcactcactctaaataggttgtgtaccctttttttttctggtttaagcaaaagagaaagacatgcatctagaagcccaaaaactctttgtgacaactgacaatgtagccttttaccttttgcatatcagtttcctaaaaagccttttcttaatatagaggtccattgcactccaaaggtgtgcgttcatgagcccatgtagttgataacttcatcgtatgtttatgtttactacatacgtcgtcgtcaagatggaattcacatctgattaaattcatttcctttgaaaaaaagattccttccaacatggctacaatccaacaccttcacttagaaaatttactactgaccaaaaccaagagcattttggtcgtattttaatatccttagtcgttgtctatgaataattaatatgacttacagctcgttggtcgtattttcatatctttattcgttgtctattaataattactatgacttattaacgtattccctgattagtacaactaatataaaatgttaatcttcttctcataatattcttgaagcaaattagcactgaccgatcgatcc

SEQ ID NO: 8481 - DNA, 3000 bp, Unknown
  misc_feature (1)..( 3000): cDNA_ID_1819463_gDNA_ID_1971812_Annot_ID_58134 3000 nt of promoter + ATG
ctttacattaaaagtttttagtttaactaaaatataagcctacctgcggtatactgcaggttaatatctagattatagggcttattggatctaaagacgggtcatcaaacatttcctaaactgaagcaaaatatactgaatattcaaatatctatctgttaccaaattataaacaaataagttcgtaaaacaatttaatattttatatacgaaatcaattaaatcttaatcacataaaaattagcaaaaaaaaaagtattcaacaattaaaaaattatcaaatctctgtgttatataagttttgatactatattcgaataaagtataatataccttttcaatttgtattctttaactaatttaagctaactaatatatttgttttttggtggatttgggtaaaagtgtattcgggtcatatggtacattctcctattaaataaatatggtgtactcctatgttattagctaaaatgtttagattataattcagagtcatatcattaataaaattaatattaataaaataaattattttttggcaagacggatttgaagggacgggtttttgaatcaacattaataaaaaaagtaaaatataattaatccaccatttcaatacgggttaaatctttaatttattattttttaagaccactaatattaaacatatcaaatcatcctaatttagaaaagattatataaaaccaaaaatgttatgtggtatgtataatgttactatatataaaattaaactataaaatttaaatatattagagaatgatacaatttgcaaaatttttatatataaaaaataattcttcaattttaaaaattactactttgaaaaaaaaatcacgggacgggtaaagaaattacagaacgggttttattttggaattgggttatatgatggatgtatttgaatcaatatttataaaatattaaaatattattaatatgatgttttaataggggttaaaactttagttttttaacaattgtctcatggattcgtggtataacgatacttaataacaattataaactgtaaaatatcaatattttataaaaataaaatttgcaagttttaatatatattacttaaaaaaaataaatcgtcccgcggtatagcgcgagttaaaatctagtactcaatatttagcccagcgtgaccattttcgtttctaacgatgtatgttgtaatgacacgaaattttgtattaataatgatgtgttgtgtttttatgtgatcaaagcaaaaaaaaaagtactataaatacatcatcgctcatacatttaattaatatagctcaatgttgaaacagttcggccttaaataagatatagttcagtgttggaacaattcggtgaaactgaaattcgtgcatatcctactagctagatataattaaattgaagagggacaatgaaaatggacaaagaggtagacagatagagtcgaatgaattagacagaggacgaattggggtaatcatagatgcatagttttgtgctaaagacaatgacttagccaaaattttgggtacctttggacaagtgtggttcctactcttagtggtccatttgatcatttccagagaaaattaacttctatgtacacatggttttcgcaagcatatttttactctccaataatttcttgatattttgttgggttccatgtctcttatatttttttgctaaattagtcataattttgaaaccatctctttatctatatcacaaggaaaaaatcccaaaaaaatattcatccactttttatttggctatttagtacttaaagtgttttttgttggaataaaaatatttcatttaagtagatttagtctaaaagtatttcatttgaattgttagacaattcgaatgtgcgacttaacagccgttaacggcattatacgtttatactctccttttcctaaagctttttttctttagtcgtaacatgcatgaatcatagcgattgtcagggactcaaggcaacttggattatatccgaatgagtttagatgatattaagacagacatttgattgggtacgataggtggaaatagagataaggttttccttttcttgattagttcaatatcaatttgtatgggaccttcttaattacatcgacgttgatgttgcctaagaggttttttcttggtcgtgctaattatttttctaattatctattcaaccttttttcataaacttaccgacatggaaaccaatttgctaataatcgtgattaagagaagttagaaaagtttgagatagtaaatgaaattttaactaaataatcaagtactaataactcaatcatatacataaagaaagaaaagttatgctatttgagtacttgacaatcaaaaatcaagtatggcagaactttcaataactcgtttctctctgttgggctagatttgtctaaaaaggcccattaatatattcacgttctagactccaccactaggcactaacccattacaaactgacagtgacactaaattcattcggttattgatcggttctgtaattggctaaaccaattttcctcggtttactaagaaatccctaaactcgattcttctctctcaaactcaatcgatcatcgtgcaatctctctctagcaattattactcgattgattctgtgaaactctgaatgtgtttttgttcttgctgcatcgtattacttccaaatctgctctgttttgagtaaaggtatcacctttatcccttatcttcaacaactccagtttcaaaaatttaccatttcataaaattcaaattcagttcttcgttgtgttactggaagtgaaagtaatggcgctctgtaacttgaatccaactcaagggatattcccattgcaaggcttatcagtgagttactttattctctccatcaaatatttcagtcttgagataagattgtatatatgtattcagatgtgaattcttcaaattgcagaaatctcaagaatttatatg

SEQ ID NO: 8482 - DNA, 3000 bp, Unknown
  misc_feature (1)..( 3000): cDNA_ID_1819460_gDNA_ID_1971812_Annot_ID_58135 3000 nt of promoter + ATG
gtgccaagggatgagacagttgggtttgtgattgatggcaaattgtaaacaaatgatgaattgttagggccagttgcataatcttgatcatgtgtcctgtgtcctgggaagtaatcgaacagctcagattgattctggttgggttcaaattgacgatgaagaatgatgttgaggtatggatgcatgtattaatggaggtagatggcaaaaataacattaaatggcaagaggaaacactatgtcatgaagatgaacatcatgattgacataatgtggtagttggaagttcataaattctgtgtctttttgttcatgcatcttcttcttcttcagtgacacagtaagaaaataatcactttgggaataaattgtgaagcatttgtccacaaagattctacctttctgtactaagtagccacccaaaggatatataagacgattttaaaatagatttggtaagtaatgatgtagagtggaccagtagaaaaacttataaatgaatttgttgttataatgtgactttgaggtttggagtcagtgactcataaatttgaagcatgatcttgtggggttttgtgacagagcaaataagttaaagcagccatgctggattctttttcaaataaagaaacatttcaaaaaatagaacagaaaaaatgatcatatctactacactaccaaccacatgcaaggaattatgaacactataaagcatgagtgtcattgaacatttgacaattcgtttgttttctcgagaataaaagataactttataaatggagattcattttaccatcttcttgatgaattcacaaattagaaattacaatcaagggtaaaaaacttgggggtaacttctacatatacatgtgtgtggttgtgtgtgttcataagaatgaaatcaactatcttcagagaaatatcttttgactctaacccgctcaccattgaagtagatgtatttgtattcagagaggtaccttctaaggatcagttttcgattttcttcttggttgagttccctgaaggctcgtgccactctcctcgcagagtcttcgtctgggctcaccttcagctcttccatgtctgcaaagacctaaaagagaacaaccgaaagaaaatgtatcttagaaccacgtcatacttcttgcagagaggtgtagagtatcttgaggagtatcttaagtgtaagatcaagataaattctcgagggaagaaagaaccttgttttacctcgataaccttatcgtgaaggtcatggtgagcatacaacgctatcatcctagcgaacaagcgtcttgggatggatcgtgtatgtgtgtgcagaatcatgttccataaggactctgcctcatcagccctttcgtccatatcaaatgccaataagaggatatcgtatgttcccattgtagcaccttgccctttgcttaacatccacttagccaactgagtttgtcactaaaccaatcaactcaggacaccatatttagcaaaactttacacttgacataggaagccgtattacttacttgaatcacacgatgccactgacttctctttcttaagatttgcaacgccttagctgcagcaataatgggaaattcaacctcccaagctacccatttattcaaagctccataaacagcctctttttcatttgggagtccagagagctacatatcaacaaggactactttatcatcgtttcacttatgaaaacatatgttttaacagaacttttcctcacttaccattcgaacaagattaagtgctttctgtccagacccagcagagtcattcttcttccacaagtgatgctctttcttccccactttctttatttccttgctacaatatcaacattcaacacaaaaacttactggtgaatcaaacagaaaaaaacaatgtcaaatgattactcaagaaagatatgcaaccaaacataagttaatttacatatattatatatataacttgaaatgtaacaaacaacaaacctgttcacagtggcaacataacctctgtccaatttcccagcttccttctctgagaacttcaaaacaatatcaccattatgacatgttgtaattcatttcacaagctatatagccattaaacagaaagtaactacaaaaacattttttttttacctttgatctgatgcaaaagccaaaccttttcgtcttcaacgaggagtaacttccgcaacgtggagattgaagcaaagaaaagcatataaattcttgagatttctgcaatttgaagaattcacatctgaatacatatatacaatcttatctcaagactgaaatatttgatggagagaataaagtaactcactgataagccttgcaatgggaatatcccttgagttggattcaagttacagagcgccattactttcacttccagtaacacaacgaagaactgaatttgaattttatgaaatggtaaatttttgaaactggagttgttgaagataagggataaaggtgatacctttactcaaaacagagcagatttggaagtaatacgatgcagcaagaacaaaaacacattcagagtttcacagaatcaatcgagtaataattgctagagagagattgcacgatgatcgattgagtttgagagagaagaatcgagtttagggatttcttagtaaaccgaggaaaattggtttagccaattacagaaccgatcaataaccgaatgaatttagtgtcactgtcagtttgtaatgggttagtgcctagtggtggagtctagaacgtgaatatattaatgggcctttttagacaaatctagcccaacagagagaaacgagttattgaaagttctgccatacttgatttttgattgtcaagtactcaaatagcataacttttctttctttatgtatatgattgagttattagtacttgattatttagttaaaatttcatttactatctcaaacttttctaacttctcttaatcacgattattagcaaattggtttcc

SEQ ID NO: 8483 - DNA, 3000 bp, Unknown
  misc_feature (1)..( 3000): cDNA_ID_1819448_gDNA_ID_1971812_Annot_ID_58138 3000 nt of promoter + ATG
aatagaagagacgccttttgtcatgattagtagcctgccgttccattatctacaaacattagacaaatgagtaactagttgttgcagcgcaaacaattagacaaacaaaagagaagaacttgtatacacactgtatccgttgctctgtaaaaccactgaactcggaagtagctttctccatctgttgtcttaaaaaactctactatctggccaacatgggtttcttcttcttcaccctgtaccatattggagatgaacatgtaattagctatatatgttcttctcacaaacgcattacattctagaaaatccaaggctcttgaatgaaaaagttgtttggtccaatgaaaaagtgaaaagcagcgcagggatactgagctaaaaaataccatattcatgataagcatggtttacctttatgtaggcaaagtctccaaggctaaaggtgtgaccgtcgacttttgcttgcgaataatggcattctacatttgcaacaatcttgtcttcgtcatcccttcaaaaacattgctcaggatattgaatatacagtaaaacaaaccacatatgaaggaagagaatattgtagaaaaaaaacagtgagttgacaaagaaccagtacttactctgattgttggcctctactcttagatttgcgttcctgaaaattagtgaaattcataatcagaaatgaagcggatattttgagagtgaaaagaaagatatgaggtccttttatgttggattacaaatatatacttaagactatgcaatctctactgctcaaactaacttaacaattttttaagctaaagcagtcaagtgcaaagaaattaatcaactaccttaagttcatatctccagcgccatctttcttgagcctcctcgcaagaaagtggctctccaatgaaaaaacagatactacgtttgttctgctcttggacagcagtccgggttacccgtttaccctttctcttggttgatttcgttggattattcagatccagtgaaacgattccctcattacccccagaggagagggcagatccactttcgacttgtgtcaaattatctccatttaaatattcaatagaagacggttcatcgctgtcagagagatagatcacagtagaatttacatgcatttcccgagtttttcccttatcagcagcaccacaagcactagttttaccctgaagtaaagactccattgcatcttgctccactaacgcagtcgtcatagttaatccattactagtatcatttttgctaattttcaaagagctagtgtgaatatcatccgtatttaggccagaagatctgggttttcctaacgttctgtccctacaaccatttacagttttcttgatgcaacccgaaggaaaaactaatagctcttgcttggatgaaactaggccatcaccttcacatttcttcatagcctcacaacagtgatccttcttactaatttgcaccagcctctcagttcccctcacctgttctgcaccacataatgccgggccacaatcttttcttctgttcaaagtttctgtgttgccagtttccacagttccagatagccttgtagatcttcgaaatgagcaagatgccagagacatcccttttcctttagacttgcctagattttcttctccctcattctccgttcccttcatgaatctttgagatctcctcattcgtttattgcttccgagactctgtttagaactattgatgcttgaatataataatgtatcactatcaactttcctcttggctggatcttgcaatcttgatctaccttcagcaacgttgttcttatattggcactcggaaattatttccatctccaggctcttggcaattacagctatatctctgcatcaattttaacataaaacagtatttgagaactaaaatccccatttcaaggatgatttcccaagcaaaaaatacaataacaaatgctgtgaagcttttttacttacttgaatgtcagtccctcagaatctgagctttccttctgcatcaacccaaaaaaaagaacgacgattatactttccaatctctaactaagctgcattgcattgcgtggctactaacaagaacaaacaaaaaaattggcgagtaaccttatcgagagcactattactctttctcttcctcgacccaaactttccagtcaccggaaccgagcatacactgtcaaaatttccatccaccgccctaaatctcggcgacctccgaagctgacaaccgttcgtcaaagtaagcagcggctgtgacttaccacgagagaacttcctctgcgaaactccccctttggtaaccggaaccgagcatacattgtcgaaatttgcatgcagggccctaaatctcggcgacctccgaagctgacaaccgttcgtcaacataagcagcggctgtgacttaccacgagatgacttcctctgcgaaactctcccttctcctccgttctcttcaggcgaattacaattaagcgtcgtggatctcctcaaactcatctctccgttgtcggggagctttatgagttctctagtagaggacggagcagcttcttcaggattgggacaccagaggacaagagagagacattccggttcagatctagaagaagaatggagatccaatggagcttgagcctcttctgactcacatttggccggcgataacatcagagaatataaagaatctaaaagggatccaaagtagccaatagggaaacaaaactgaaaaagggaagaaatcaagtgagtgtgtattttttgactattgtactttttttgctaacagactgtcacgtgtcacacgtgatcttcttgcactctctgttcttcgaaatcaattaattgcaattagtacataataatagtgttacaactaaattaattattttactaaactattccgtcgttggtttatttcccgatcagaagtaaatattgatcgctgcagaatcttaaactctgcttctctctaatg

SEQ ID NO: 8484 - DNA, 3000 bp, Unknown
  misc_feature (1)..( 3000): cDNA_ID_1819444_gDNA_ID_1971812_Annot_ID_58139 3000 nt of promoter + ATG
ctaaaattacattttgggctcagaaagaatttttgtttccgtattgggttacaatgctttattcactgagaatcaaagaatgtgtctgtttatttcttttgatgctacaaaaccaatgaattgagttatgaaggctatattagtggatctctctgtctgctacttattaccaaacaaatgaagaaagaatcatagtcttgaagaaacagagtttgtaagaattctctttagttcctttctcaatatcttcccagttggagattttggtatagagttgaccatcaccactttcctcaccttcctgtagggtgcaacctagaacacgtaatgtataataatgtattacattaatgatcagtgttttgaaatgggaaaagccattttgaattagtgggaacctaacctgagaagctacatagcttattacatcttcttctgaaagtgttgtttcttgtctccggacaacgaatgctaccggaatctctccacattcttcatttggggcactgaaatggaaagtttggatactttcagtagagtaacagactctgtcgaattctccaaaactggatttgcagtatctttcacttattaaactagtttagtaaatgatcaagatttgttttttcgaacttacgctgttactgcagcgtcgataatcaagggatgtgaaacaagaacagcctccaaatctgctggagcgatctgcaaaaaccataaatgcaaagaattaatatttcctaatttagagttggctgaaagagaaactgctgttcctttacctgaaagcctttgtactttataatctccttaatacggtcaacaataaacaagtaaccatcttcatcaaaataagcaatatccccagtacgtagccaactatcttcaactatactcatctgagttgcttttgggttattcaagtatcctgacagacaaatgaacggtgttcagattctctccaagtaaaattaaaactgttccataaaaatatgtagcacaaaatcaagaacaagataataagcctaatctatcaacacaagcaccaaataagccccacgaaagttggaagatccaatctatatttacatttattaggatgcaagtgtttctcagtgatttgaaccattgacaaaagactttattcatgaactgagaaggaaaatctcaactattttggtaaagaagtacagtaggaagaatctatctacctttcatgacaccgggaccttgtatccagagctctcctcggtttcctggtggaaggaaagaaccagagctccaatctactaccttggcttgcatattaggagccagtagtcccacagaagaatacctactaagcttttccgagttgaagccccgtgttccaactgcagttgattcagtcattccatatccctgcaacaaaatgtgatccattttatacacactttcagctaaatgtaaagaaaataatagtgtgagtcaaaaagtcatggcctcgttaaatcaattttagttgtttcttttgggaagagatgtcaaatttttctaaaaaatgtagattctacttcttattgagtttatgaatgaataacatttaattcagttttctaaaacgacatccaaaagtaaaattcagagacctgaatcaaatcgacatgaggaagagtctgaaggaaatcttcaatgaacttcctactcaaaggagctgctccagaagaaacttgcttcaaacttttaaacacttcaccacaaactccttttgccttctttgtcaatgccatcaacataggtggaacaaccgggaaatgagtgatcttaaacctttcaattacattaacaacatcagaagcatcaaacctcttcataacaacaatagttgatcccagagacaacaatcccatcacaaagagtgataacccgtagatatggcacaaaggcaaagctgctagataaacattactcgatcccggatattcgtactgagaagcttcaaacctcacaaaaagctccattgatgctatcaaattcctatgagttaacaaaactcctttactagctccagttgttccagatgaatacataattgcagctacatcgtcttgcttaatcaacggttttggtacaaacccaaaactttctttcataatggagtaaaacttcgggttttcgatacgaatcgaatcaaaatcgtaactttcagatacactaatcacactaacccccaaagaactcagcttctcaacgttttcagtagaagtaaaagctaatccaacactacactcactaacttgcttcttaatctctcctaaactactcgaaggattcatggtagtaacaatagcaccaagcgagatcaaagagaggaaaatcatcggaaaatagacggaattaggcaagacgagtgatacaacgtcaccttgacgaacacctaaaacgtgatagatcccagccgccattgattgaaccataatctgtagctcagtgtgagatattgagaacccggttaaggaatcgatgagcgctgtatcgccgtggtgtttgtgtgagaaaagagcggagacggcgtcgagatttgggtcgacggggaggtgtagggaagggaatttgctggtgtagattcctgttttagaagagaaccaaaagggagggttttggtgagacgtttgggttttaggatttggcggtatgtgaagatgtgtcgccgccattagagagaagcagagtttaagattctgcagcgatcaatatttacttctgatcgggaaataaaccaacgacggaatagtttagtaaaataattaatttagttgtaacactattattatgtactaattgcaattaattgatttcgaagaacagagagtgcaagaagatcacgtgtgacacgtgacagtctgttagcaaaaaaagtacaatagtcaaaaaatacacactcacttgatttcttccctttttcagttttgtttccctattggctactttggatcccttttagattctttatattctctg

SEQ ID NO: 8485 - DNA, 3000 bp, Unknown
  misc_feature (1)..( 3000): cDNA_ID_1819440_gDNA_ID_1971812_Annot_ID_58141 3000 nt of promoter + ATG
caggaatactattgggcctgaaacccaaactcctacccagcccacaaaagctacagacacagtttaatctctctgttcttcttcacacgacgaggatgaagaaacaaaatttccgctgatcttatattatctcaccgttaataattatccaagtcttgaactttgacagagcttgtaattcgaaacttttcaaaatggttactttgtgttgtgttgtgtgaactcttaaaataaagaataaatgaatgttattttatttttagtcgtcttcaagttttggtctgcgatcgtgaaatttacgcagagagagatcagaatcgaagaaaacattgcaatataaaagagtcaccttcgagttcgtgtctcactccgataaagcaatgagtctattcgggcttggaaggtgaattactgattcctctccgtaatttgtccgaaaaaagagagtattttttctagagatttcgagattgtttgttatctcagatctttcgaatagttattcctgattgggtattaatatttcaatatgttgatttttgtggatttgctgagtaatggttgtgaatgaagatttgattgttcaatttttctattattcagaacttgatggaaccaatgttaacttactaccattgtcaatgtgtcctgaatgattcttgtcaaaatcttgttcaagttaatgtagaatttgcttatctgattctatgaatttgcattgtttatgttcatctgattagaaatcaaaagactttccgtcctaagaagagcgcaccatcaggaaccaaggtttgtagattcgattatttgacttgtttcttttacaaatgtgattcatgtttttgtagccttataaagcgtgttgttttgatctttttagggagcagagcttcgaaagcatatagatgcaactttaggtagtggtaatcttagagaagccgtcaaacttcctccgggagaggatttaaacgaatggcttgcagttaacagtgagcttataactacaccatcactttttcctcatggtttcactctgttgattaagttgttgtttttcttcagctgtggatttcttcaatcaggtgaatctgttatttggtacacttaccgagttttgcaccccggagaactgttctacaatgactgctggtcccaagtacagatttctcttcttcattatataagtaattttggtgctcatgattgatatagtaatttgatcactgttttctcttaagatcttgaatacaaaaaactttgaaactgctggagcaatatgggcatttgtaaagtggaaaagagtctttgtttttgagtgacaattatctcgatgatcaactactgactcatatgtaactattccattggtgaaatgcgtcggttgcaacgtttcaggtacgaatacagatgggccgatggtgtacaaatcaagaagcctattgaggtttcagctccaaagtatgttgaatacttgatggattggatcgagacacaactcgatgatgagaccatatttcctcaaaaacttggtaaaataaccttactctggcatatctttgatgattatggataaaaagacattggtctcaatccatggtaaattctgacaggtgcagcttttcctccaaacttcaaggaagtggtgaagacaatctttaaacgactattccgagtttacgcacacatataccactctcatttccagaaaatagttagtctcaaagaggaagctcatctcaacacttgcttcaaacacttcatcctcttcactcatgtatctataaaccctcttttactcatcattaatcttccattctagtcttttatcagtcactgagtttgttgatttttgatttttattggtctggttttgttttgcaggagtttgttctcattgacaagaaagaactcgctcctcttcaagaactcatagaatctatcattgcaccttactaaaccaaacaaaacccaaatcctctgtccaattacaagacttttttttttcaatcacattcatggtaataagttttaaccccaactgtaaaaaattgctgtttctgtttgtaaaaaaagaatatgcaatacactgctgaaccttggattttatttaaatggttacattcgaaatttcactggattacatatatgactcgtttacataattgctatgaagtttgttgatcaataactttgaagttttggctttcgttgaaaaggaaaagactaactttttgtatgtttgcataaatgttgtggtgttgtactgttgtcttacttaaaaactaagaataaagacgtcagccaattattgtggttcacgtgtatgtggttaacacgtcagctattttgttgatacggcgtcgttttcttctctgcctaacggaataagatggccgtcagcgaccttctcaatggattgcttcgtcacctaacgacaaaataccaaaatgcggttttgaactgatttggcatgactttaattaattaatgactcctccattaaattaaattaaaacattattcatcatttatgtttgtttaactgactaaacttacgtctttggcgtgattagttattttaatttatttatttattttgagtatacacagatatttctctctctgctgttttatttttttatagaaaatattaatttagctttggatttttttctttttttttctctgtcaaagttgaattgctttttctcttgtttttcgtcgaagtggaaaatttgattttattttttccggaattttgaaaatctgtgagctcataaatcttcgctaatcgcagagacgaatctgcgaaaattccaacaccagattccggcgccggagcgccgatgaacaatcaggtcgtttagtaaaattcgatgaatctcccgcggaaataattagattcgatttcgatttccgtggggaagttttgtgccatttgatttgttttcgttcgtccccgttggagattttttgtaatttctggggacagaaacaatg

SEQ ID NO: 8486 - DNA, 3000 bp, Unknown; identical to SEQ ID NO: 8484
  misc_feature (1)..( 3000): cDNA_ID_2176935_gDNA_ID_1971812_Annot_ID_175794 3000 nt of promoter + ATG

SEQ ID NO: 8487 - DNA, 3000 bp, Unknown
  misc_feature (1)..( 3000): cDNA_ID_2991765_gDNA_ID_1971812_Annot_ID_175792 3000 nt of promoter + ATG
tagtacataataatagtgttacaactaaattaattattttactaaactattccgtcgttggtttatttcccgatcagaagtaaatattgatcgctgcagaatcttaaactctgcttctctctaatggcggcgacacatcttcacataccgccaaatcctaaaacccaaacgtctcaccaaaaccctcccttttggttctcttctaaaacaggaatctacaccagcaaattcccttccctacacctccccgtcgacccaaatctcgacgccgtctccgctcttttctcacacaaacaccacggcgatacagcgctcatcgattccttaaccgggttctcaatatctcacactgagctacagattatggttcaatcaatggcggctgggatctatcacgttttaggtgttcgtcaaggtgacgttgtatcactcgtcttgcctaattccgtctattttccgatgattttcctctctttgatctcgcttggtgctattgttactaccatgaatccttcgagtagtttaggagagattaagaagcaagttagtgagtgtagtgttggattagcttttacttctactgaaaacgttgagaagctgagttctttgggggttagtgtgattagtgtatctgaaagttacgattttgattcgattcgtatcgaaaacccgaagttttactccattatgaaagaaagttttgggtttgtaccaaaaccgttgattaagcaagacgatgtagctgcaattatgtattcatctggaacaactggagctagtaaaggagttttgttaactcataggaatttgatagcatcaatggagctttttgtgaggtttgaagcttctcagtacgaatatccgggatcgagtaatgtttatctagcagctttgcctttgtgccatatctacgggttatcactctttgtgatgggattgttgtctctgggatcaactattgttgttatgaagaggtttgatgcttctgatgttgttaatgtaattgaaaggtttaagatcactcatttcccggttgttccacctatgttgatggcattgacaaagaaggcaaaaggagtttgtggtgaagtgtttaaaagtttgaagcaagtttcttctggagcagctcctttgagtaggaagttcattgaagatttccttcagactcttcctcatgtcgatttgattcaggtctctgaattttacttttggatgtcgttttagaaaactgaattaaatgttattcattcataaactcaataagaagtagaatctacattttttagaaaaatttgacatctcttcccaaaagaaacaactaaaattgatttaacgaggccatgactttttgactcacactattattttctttacatttagctgaaagtgtgtataaaatggatcacattttgttgcagggatatggaatgactgaatcaactgcagttggaacacggggcttcaactcggaaaagcttagtaggtattcttctgtgggactactggctcctaatatgcaagccaaggtagtagattggagctctggttctttccttccaccaggaaaccgaggagagctctggatacaaggtcccggtgtcatgaaaggtagatagattcttcctactgtacttctttaccaaaatagttgagattttccttctcagttcatgaataaagtcttttgtcaatggttcaaatcactgagaaacacttgcatcctaataaatgtaaatatagattggatcttccaactttcgtggggcttatttggtgcttgtgttgatagattaggcttattatcttgttcttgattttgtgctacatatttttatggaacagttttaattttacttggagagaatctgaacaccgttcatttgtctgtcaggatacttgaataacccaaaagcaactcagatgagtatagttgaagatagttggctacgtactggggatattgcttattttgatgaagatggttacttgtttattgttgaccgtattaaggagattataaagtacaaaggctttcaggtaaaggaacagcagtttctctttcagccaactctaaattaggaaatattaattctttgcatttatggtttttgcagatcgctccagcagatttggaggctgttcttgtttcacatcccttgattatcgacgctgcagtaacagcgtaagttcgaaaaaacaaatcttgatcatttactaaactagtttaataagtgaaagatactgcaaatccagttttggagaattcgacagagtctgttactctactgaaagtatccaaactttccatttcagtgccccaaatgaagaatgtggagagattccggtagcattcgttgtccggagacaagaaacaacactttcagaagaagatgtaataagctatgtagcttctcaggttaggttcccactaattcaaaatggcttttcccatttcaaaacactgatcattaatgtaatacattattatacattacgtgttctaggttgcaccctacaggaaggtgaggaaagtggtgatggtcaactctataccaaaatctccaactgggaagatattgagaaaggaactaaagagaattcttacaaactctgtttcttcaagactatgattctttcttcatttgtttggtaataagtagcagacagagagatccactaatatagccttcataactcaattcattggttttgtagcatcaaaagaaataaacagacacattctttgattctcagtgaataaagcattgtaacccaatacggaaacaaaaattctttctgagcccaaaatgtaattttagccttagtattttatttacataaaagtccttttaatcgttggctattgcatttatcgcccaatacttgtctttgagctcaagaaatatagtttactaaaaggctgggtttttctggatttcttactcccaaaccgatacaagatcgaagctttgccttctgtttcttcgaaaatctaccatg

SEQ ID NO: 8488 - DNA, 3000 bp, Unknown
  misc_feature (1)..( 3000): cDNA_ID_2176923_gDNA_ID_1971812_Annot_ID_175786 3000 nt of promoter + ATG
aagctggtatactacaggtgaaactcttaaattaacaatcaaactacaagtgtataatcttaaacactaaacaatatagataatatcaacaaaacatatacaactcacagtttactatacatttaaaatcaaataaaataatatcatatatttttaaatcatctttacattaaaagtttttagtttaactaaaatataagcctacctgcggtatactgcaggttaatatctagattatagggcttattggatctaaagacgggtcatcaaacatttcctaaactgaagcaaaatatactgaatattcaaatatctatctgttaccaaattataaacaaataagttcgtaaaacaatttaatattttatatacgaaatcaattaaatcttaatcacataaaaattagcaaaaaaaaaagtattcaacaattaaaaaattatcaaatctctgtgttatataagttttgatactatattcgaataaagtataatataccttttcaatttgtattctttaactaatttaagctaactaatatatttgttttttggtggatttgggtaaaagtgtattcgggtcatatggtacattctcctattaaataaatatggtgtactcctatgttattagctaaaatgtttagattataattcagagtcatatcattaataaaattaatattaataaaataaattattttttggcaagacggatttgaagggacgggtttttgaatcaacattaataaaaaaagtaaaatataattaatccaccatttcaatacgggttaaatctttaatttattattttttaagaccactaatattaaacatatcaaatcatcctaatttagaaaagattatataaaaccaaaaatgttatgtggtatgtataatgttactatatataaaattaaactataaaatttaaatatattagagaatgatacaatttgcaaaatttttatatataaaaaataattcttcaattttaaaaattactactttgaaaaaaaaatcacgggacgggtaaagaaattacagaacgggttttattttggaattgggttatatgatggatgtatttgaatcaatatttataaaatattaaaatattattaatatgatgttttaataggggttaaaactttagttttttaacaattgtctcatggattcgtggtataacgatacttaataacaattataaactgtaaaatatcaatattttataaaaataaaatttgcaagttttaatatatattacttaaaaaaaataaatcgtcccgcggtatagcgcgagttaaaatctagtactcaatatttagcccagcgtgaccattttcgtttctaacgatgtatgttgtaatgacacgaaattttgtattaataatgatgtgttgtgtttttatgtgatcaaagcaaaaaaaaaagtactataaatacatcatcgctcatacatttaattaatatagctcaatgttgaaacagttcggccttaaataagatatagttcagtgttggaacaattcggtgaaactgaaattcgtgcatatcctactagctagatataattaaattgaagagggacaatgaaaatggacaaagaggtagacagatagagtcgaatgaattagacagaggacgaattggggtaatcatagatgcatagttttgtgctaaagacaatgacttagccaaaattttgggtacctttggacaagtgtggttcctactcttagtggtccatttgatcatttccagagaaaattaacttctatgtacacatggttttcgcaagcatatttttactctccaataatttcttgatattttgttgggttccatgtctcttatatttttttgctaaattagtcataattttgaaaccatctctttatctatatcacaaggaaaaaatcccaaaaaaatattcatccactttttatttggctatttagtacttaaagtgttttttgttggaataaaaatatttcatttaagtagatttagtctaaaagtatttcatttgaattgttagacaattcgaatgtgcgacttaacagccgttaacggcattatacgtttatactctccttttcctaaagctttttttctttagtcgtaacatgcatgaatcatagcgattgtcagggactcaaggcaacttggattatatccgaatgagtttagatgatattaagacagacatttgattgggtacgataggtggaaatagagataaggttttccttttcttgattagttcaatatcaatttgtatgggaccttcttaattacatcgacgttgatgttgcctaagaggttttttcttggtcgtgctaattatttttctaattatctattcaaccttttttcataaacttaccgacatggaaaccaatttgctaataatcgtgattaagagaagttagaaaagtttgagatagtaaatgaaattttaactaaataatcaagtactaataactcaatcatatacataaagaaagaaaagttatgctatttgagtacttgacaatcaaaaatcaagtatggcagaactttcaataactcgtttctctctgttgggctagatttgtctaaaaaggcccattaatatattcacgttctagactccaccactaggcactaacccattacaaactgacagtgacactaaattcattcggttattgatcggttctgtaattggctaaaccaattttcctcggtttactaagaaatccctaaactcgattcttctctctcaaactcaatcgatcatcgtgcaatctctctctagcaattattactcgattgattctgtgaaactctgaatgtgtttttgttcttgctgcatcgtattacttccaaatctgctctgttttgagtaaaggtatcacctttatcccttatcttcaacaactccagtttcaaaaatttaccatttcataaaattcaaattcagttcttcgttgtgttactggaagtgaaagtaatg

SEQ ID NO: 8489 - DNA, 3000 bp, Unknown
  misc_feature (1)..( 3000): cDNA_ID_2106682_gDNA_ID_1971812_Annot_ID_175785 3000 nt of promoter + ATG
atcgtattacttccaaatctgctctgttttgagtaaaggtatcacctttatcccttatcttcaacaactccagtttcaaaaatttaccatttcataaaattcaaattcagttcttcgttgtgttactggaagtgaaagtaatggcgctctgtaacttgaatccaactcaagggatattcccattgcaaggcttatcagtgagttactttattctctccatcaaatatttcagtcttgagataagattgtatatatgtattcagatgtgaattcttcaaattgcagaaatctcaagaatttatatgcttttctttgcttcaatctccacgttgcggaagttactcctcgttgaagacgaaaaggtttggcttttgcatcagatcaaaggtaaaaaaaaaatgtttttgtagttactttctgtttaatggctatatagcttgtgaaatgaattacaacatgtcataatggtgatattgttttgaagttctcagagaaggaagctgggaaattggacagaggttatgttgccactgtgaacaggtttgttgtttgttacatttcaagttatatatataatatatgtaaattaacttatgtttggttgcatatctttcttgagtaatcatttgacattgtttttttctgtttgattcaccagtaagtttttgtgttgaatgttgatattgtagcaaggaaataaagaaagtggggaagaaagagcatcacttgtggaagaagaatgactctgctgggtctggacagaaagcacttaatcttgttcgaatggtaagtgaggaaaagttctgttaaaacatatgttttcataagtgaaacgatgataaagtagtccttgttgatatgtagctctctggactcccaaatgaaaaagaggctgtttatggagctttgaataaatgggtagcttgggaggttgaatttcccattattgctgcagctaaggcgttgcaaatcttaagaaagagaagtcagtggcatcgtgtgattcaagtaagtaatacggcttcctatgtcaagtgtaaagttttgctaaatatggtgtcctgagttgattggtttagtgacaaactcagttggctaagtggatgttaagcaaagggcaaggtgctacaatgggaacatacgatatcctcttattggcatttgatatggacgaaagggctgatgaggcagagtccttatggaacatgattctgcacacacatacacgatccatcccaagacgcttgttcgctaggatgatagcgttgtatgctcaccatgaccttcacgataaggttatcgaggtaaaacaaggttctttcttccctcgagaatttatcttgatcttacacttaagatactcctcaagatactctacacctctctgcaagaagtatgacgtggttctaagatacattttctttcggttgttctcttttaggtctttgcagacatggaagagctgaaggtgagcccagacgaagactctgcgaggagagtggcacgagccttcagggaactcaaccaagaagaaaatcgaaaactgatccttagaaggtacctctctgaatacaaatacatctacttcaatggtgagcgggttagagtcaaaagatatttctctgaagatagttgatttcattcttatgaacacacacaaccacacacatgtatatgtagaagttacccccaagttttttacccttgattgtaatttctaatttgtgaattcatcaagaagatggtaaaatgaatctccatttataaagttatcttttattctcgagaaaacaaacgaattgtcaaatgttcaatgacactcatgctttatagtgttcataattccttgcatgtggttggtagtgtagtagatatgatcattttttctgttctattttttgaaatgtttctttatttgaaaaagaatccagcatggctgctttaacttatttgctctgtcacaaaaccccacaagatcatgcttcaaatttatgagtcactgactccaaacctcaaagtcacattataacaacaaattcatttataagtttttctactggtccactctacatcattacttaccaaatctattttaaaatcgtcttatatatcctttgggtggctacttagtacagaaaggtagaatctttgtggacaaatgcttcacaatttattcccaaagtgattattttcttactgtgtcactgaagaagaagaagatgcatgaacaaaaagacacagaatttatgaacttccaactaccacattatgtcaatcatgatgttcatcttcatgacatagtgtttcctcttgccatttaatgttatttttgccatctacctccattaatacatgcatccatacctcaacatcattcttcatcgtcaatttgaacccaaccagaatcaatctgagctgttcgattacttcccaggacacaggacacatgatcaagattatgcaactggccctaacaattcatcatttgtttacaatttgccatcaatcacaaacccaactgtctcatcccttggcacactagcaaattaatctaaataagctaaagggtaacttagtcggtgtctccatctcaatccttgtttcaaatctcaaatctctaatcctttaaatgtccaaacatatggttccctctgaagacaactttttctggtaaactataataacagaatgatcagtttagtcgtttagacacacaagttggtcccaacactgtaaaaaaacagagtattatcaattctctcccactcgttatgtctccacataattatacagttactttacatatctacacataaacattatcaccgcgtgacatttaatgcttcttcaactgtctaaagctcaaaacttgttttgtcattccctccatattcttctgacctttattatatacatccatttacattcttcacgttatcagaccaatctctctcttcttcttcttcacgttctctctctttccggataagggtagagatg

SEQ ID NO: 8490 - DNA, 3000 bp, Unknown
  misc_feature (1)..( 3000): cDNA_ID_2176921_gDNA_ID_1971812_Annot_ID_175784 3000 nt of promoter + ATG
gcttcaaaatcactccggtactcatttttcttaccatcttttgtttgtattcaaatatcaaatgtttttttttgttgctaaaataattgaataatgcatcgacctaaacgaatagataaagaatcactagactaacacacacctgtggttcttgtcattggatctcatgtgagtgttactatacttttctatcaaaggcttaccctaaattgtgaatcctgtaaaaccacatgaaattttatgtctatcacaaaagaatacatacaccaagattcaagaatatgaaaacacacatataatatagacatttttaagagggtcccaaaaacaggctcttgatctggaaactgtattaatttgtatccaattataacctcatgggccacttttccctggctatgcacattatcataggttatacgattaagttcgtgatggaaaatatgatttattaaagttttcttcccgagtttgcaacgattttcctttcttcaaaatctaaaatttattcgattaacaaaaaaaacaattatcgacaagcaattcaaaggaaaaattgtgaaaaaacaaaagaataaggagagaatatgtcctccttctgtttttttttactaagagagaatatatctttaataggggatgcttcttgctcgaagccatcattgagaagaccttcatacttgcgggagtctatgatagatatctcaagagttaactttagatacttttatgcgatttcattttatttttaatgacttactataataattattattttttcatctaaataattcaattcacgaaatcatcttaattattatttatataaatacatggacaaatagaagtggaagaacaatgtttagaaaacaaatcgaaaaagatcgccgacctttattgatcgaggaagagaattctggtgggattttagagggaggtaagagcataggtgctagagagtgttcggagctcggaaaatgattaaaattggttttgattacacttaattagtttaatcttctagtaacacacaaatatgctaaaataaacacataatacattcatgcaaacacaaaacttggcttaatattggccaataatttgagtggcacaatcacaatcaagccaaaagcagcactgatttctctttttttttttctttctaattagtcttaattcggtccaaaaccaaacaaaaatatctttaaattatattggaacctgacgaaaacaaatcttaaattcccacaaaatgctatatatatagtatctaagtttgaatgccaattccatatttttacggaatttataaaagtacgcagaatctatttctagcagtttggaaaattttcaaaatatttgaaaattttcaaatggtttgtggtctgttgatctactaatcacgtcatactaattttgggatggaatgttacagaatatataatttcaaaacagagagagtattcttttgttttctgtgaactgattttattctaggtaatataatgtatccattttttttaatgacgaggaagaaaaattaaggaacaaaagaatatgcattaaatttgattaggtagtgtcatttaagtgatcccttctccaacacaaaatgtatgattcgacgtcaaattaatgttttaaatatttattgcttttattgatcatatataatttaatatttataatcattattacgtgggaacttatctagtacacattctatgtctttgtgaacttagtacacgagtaacggtttttctattaaattaaaaccttcaaaacaacatttgatgaaaatttcatagattttacaccaaaatttcgtaagaaaaattgttggagttcgtattgttttcttgtagtagatgacattaaaaaaatacattaagatacactaaacaagaattatgcatattgttttttggtcaaaatcgagcctttaccaaattgatcgatacattttttctgatgatacgtttagactagttggataaaatattaatctgtcctcaaaaccaatttgcagtggatcaatccatatatcttctatattattaggatctttgtctaacttccgatgtgtgatattgttattcctaagataaaacaccattgaaaaacagtattttaaatcgggtaaataattcagcgagtcacatatttttgttttaataaaaactcaaatcaaaagtgatcaaaatatggtagaaagcaaccttcgattgtggtccatcatgtaagatacgagaagattttatggtttttaaaacccacttcgaccatgaaagcttgacccaaagcaattgagttgtttcttttataaatgacctaatcaatttccatacatacaagcatacatgtgacgtaaaggaaatctaattatgtactaatttgtaaattttactagtattcaattcagtaattcttactaaacttactttaactcttgctaattaaatatactactagagaaggtaaattacatgcagttaagctatactattttttctaattgcaagaaagaaagaaaaagtacaaaagaaaagaaagcacattgcaagtggatgtatatatagttatagggaaataaatatgaatatggactgtatatacatataggtttctcttatctctatcaaattaccttaaatgggttcataaagatggagatcaaagactacacatcacatgctactctccctcttcttttggcataaccttactccatttatacattgtgctcctcaattattcaacattttttaaaaataacttatttaacaaaatgttagaaaatatctacccaatttttttcttccacatacgagctacaaagatctttatcaaataaaacaagaaagattattaatccatattttgggttaaattttaatccatttagccaattaggagaactattttaacagttagatacttttcaacaaaatttattaagtagtcacctatgtatattcatatagtagtttcacaaacaat

SEQ ID NO: 8491 - DNA, 3000 bp, Unknown; identical to SEQ ID NO: 8480
  misc_feature (1)..( 3000): cDNA_ID_1819477_gDNA_ID_1971812_Annot_ID_175781 3000 nt of promoter + ATG

SEQ ID NO: 8492 - DNA, 3000 bp, Unknown; identical to SEQ ID NO: 8479
  misc_feature (1)..( 3000): cDNA_ID_2176910_gDNA_ID_1971812_Annot_ID_175780 3000 nt of promoter + ATG

SEQ ID NO: 8493 - DNA, 3000 bp, Unknown
  misc_feature (1)..( 3000): cDNA_ID_3011901_gDNA_ID_1971812_Annot_ID_175778 3000 nt of promoter + ATG
atttagtgaggtattatagaaaatgtgtaagctttgagaatttttctttttgtgtttttctttggtcacacaaccttttgctttataattgaaactttaggacacgtctgtttcacgaaaactgccattggtaatgggtttagattcctttgtacaacgatcgaggtaaaccttttttttttcttgctcacatgttttttttctttacttttcagactgacactttctctgaaattcgaattttgctttttgttgaatcataacttttcttcatttgcttacgttcacacttacattaacataagataactaacctgtcaaaaagactcaaattttagcttatgttgctgtggatttagtatttaccagaaaaagctatattgtgtcaagaaaataaaaaagggacttgggattcttggctcgtgtgattcagtagtttccatgagtgtttatttttgttttgttatatacttaaattagtactatgttaactgtcttaattcttgtttagctggtcaatggtgagactgaagaaatgatttccccttttgccaacatctaatgatgatgtttggattttgcttgtgtggggataaataaaatggaattattcattgtttgaccattagatgccaaagaaaatcattgttcttttacttttttctttccttagttgcatctggattttcaatttttcaatcattgtgtcatcttgttcgttgctcaccagcttttgcatttcgtaaaatggaaaaagaaaaaaaaaacacatttttatgtaaataatctatgaggtattctcgatccatttagcaaagattagttctttgagcactatataccaaataaaatcattgttttttctcacttttttgcttaggtgcattttggttttcaactatcaatcatagtgctatcttgttcatgctctacagctcttacatttcgttaaaaagaaagaaaaaaaaacattttatgctctttttgttgttgttgataatctattagaaaagattgttcttttgagatcttctgatccatccattagcaaatgttgttctttgaccattataaaacgaaacagaatcattgttctttacttttttttttcctttgtgcatttggattttctattatcaatcataatgtctttttgtttgttgctcaccagcttttgcattatgtaattaatccactagcaaaagattgagagagtctcagctccaaatggattgtgttggttacattttgtgatatttcttacacaatttgcaataaactattgtgtagggatgcaaaccaatggatcgaatggacctcatgaatggttctacttcagctagtccatgctcatcgtatcaacatagccctcgtgcttcctacaatccaagcccttcgtcttcatcattcccgagtcctacaaacccatttggtgatgctaactcactaatcccatggctcaagaacctctcttcaaactcaccttccaagcttcccttcttccatggaaattcaataagcgctcccgtgactccgccattggctcgaagccctactcgtgatcaagtaaccatccctgactctggatggctctcaggaatgcaaactccgcagagcggaccgtcttctcctactttcagtttagtttcaagaaacccgtttttcgacaaagaggcttttaaaatgggagattgtaattcaccaatgtggactcctggacaaagtggaaactgctctccagctattcctgctggtgttgatcagaactctgatgtgccaatggctgatggaatgacggctgagtttgcgtttggttgtaacgcaatggctgcgaatggaatggtgaagccttgggaaggagaaaggatacatggagaatgtgtttcagatgatttagaacttacacttggaaactcaagaaccagatgatcatttcagagaagaatcaaagtcgtttgctatcattaagtcttcttttttgtctgtcttttttttccagtgtgatgtttaaaggtgactcagaggaaaaaaaggagaatagaaagagaaacaaaaaaagaacattttgagctctgttttcttttttttttttctttttttttttgttggcttttgactaaagttgtagttagaatctattttatatcttgaagcttctttaaaaaaaaagttatttgtggaaattcgatttgagattagtgatgttagtataatgaattttatataaaatattgaagccagattggactttagtaaccattgtgaacgtgagaaaatatcagtatctatcgctgaaaattttatatttttctatacatttaaaagataacagaaaagtggattacgttgaaagaccaaagatatgtccaagaagtcatgcgtaacccaatagaaagtcaactaacaatgaggaccacatgtgattggtcttgttaattagcgtacgtaaaacgcgacactatgacaactcgtacgtaatttcgcgaataatatgaatagtaacttcaactggactattttacaagtcaacaaattacttagtggatccaatttaaatgtccaattgttcttatttggctaaaaatgaggcccatatatacataatttttttatatgatttattttttaatgaatttatttaagagtatgtaaacagaaccctcgctctctctcgctaatttggatagatacctccgagcaagggttaagtgtaagcctcgtttgtatttgtaacgtaagttgtcatcatcgtaaagagttaatcaggttaattattttctttagtaaggaatgtgttttacccgattcttctatcattatgttatctttgttgttgaacctctcgattctcgaccttggattttgaaaattggtataattattatttgaccctttttgtttgttatgcttttctttgtgtgtgtgtgtgtgtgtttatttggttattgtaatctttgggaattcttgttttgagtggttttggaagatgtgtcgtgttag

SEQ ID NO: 8494 - DNA, 3000 bp, Unknown; identical to SEQ ID NO: 8485
  misc_feature (1)..( 3000): cDNA_ID_2176945_gDNA_ID_1971812_Annot_ID_175797 3000 nt of promoter + ATG

SEQ ID NO: 8495 - DNA, 3000 bp, Unknown; identical to SEQ ID NO: 8477
  misc_feature (1)..( 3000): cDNA_ID_1819489_gDNA_ID_1971812_Annot_ID_175776 3000 nt of promoter + ATG

SEQ ID NO: 8496 - DNA, 3000 bp, Unknown; identical to SEQ ID NO: 4458
  misc_feature (1)..( 3000): cDNA_ID_1824332_gDNA_ID_1971812_Annot_ID_58142 3000 nt of promoter + ATG

SEQ ID NO: 8497 - DNA, 3000 bp, Unknown; identical to SEQ ID NO: 4459
  misc_feature (1)..( 3000): cDNA_ID_1824328_gDNA_ID_1971812_Annot_ID_58146 3000 nt of promoter + ATG

SEQ ID NO: 8498 - DNA, 3000 bp, Unknown
  misc_feature (1)..( 3000): cDNA_ID_1821561_gDNA_ID_1971813_Annot_ID_58152 3000 nt of promoter + ATG
gcacatattaattaattcctccctctaatgcattagtactttcattatccatttagaagactttttttgtttctgtttcaaaaaaccagttaactaaaatttaatttatatgcatggttaaacggtcaacaaaattattttacattcactcgtgttgattttctagtcggtaaaaactaaaaaggaacctcgtcaataatagtaacatcagttagtcgttacatcatgagtaagtatcgtaattggcgccgtacgtttgttgattaaccatacaaaaaaaaagaatgataattatgtgatttcttatacactaactaacattcagtaattaaatctttgtttataccacagcgatataaattatgtgaatgataattatgtgatttcttatgttttgaatccgtaataattaaccgaacatgtttgataatcatatttaacaaaatctttgtttataccacagcgatataaattaaatgattagggacggtactaatattacagttgaatatgtattatagtttgtaagagatttgatgtgcatgtgtttatttatagtttgtacattcattttcccttgagcgtaaggacagcgtcactatgacatcacatcggtccgtgagaatgatagtataacgaatatgcacgtaactcgtaatgacataggtttctttttaaaccgttgatgttcgtgtgtgtttagtatcatatgatttacatttggccaaaacgacggaaattggaatttactaaaaaaaattggggaaaaagttttttttttataagtaataatatgaatctgtttaatgggccttcagaagtggggaagagattggagtgtgggttggcgaatgtaatcatttcgtttttattatatttttactttgtttttgttcgtatatgtatttgaaattttacattattcgttttcacatccatcacctttcttcctctcgctttacacagtttcaataattacattttcagtgatctctgtacaattgctagtttcattttaagctttatgtctaactaggaccgtaactacgactagttttgtccggttcgttcggactgttcccatagatttgagtaaccggcaaatcggataggattgacaaacaaaacttgtggtttgtttacgaaatctagaatcagcaatttggtgcctagacgagttgaaaataaaacagtaataatgagttacttagaaccgtaaacaattcagtttagcgagtgaagctggaggaatgagtccattgtctacacatgtatctaatctaatactaaaaaacattgatctcgttgactttctaacaaacaaaaaaatcggaacacaacatacttataaagttgacttttgggttaatcacaactaatgaaacccaccaaaaagggaataatagaatctttatcgtacaaatttacaacacatatatatgtgcataacaatttataaagatttagtttaatataagggacagctaaggaaagaaaagaagatttttaaaaggaagaagatttttttctgaaagaaatataagagcggggcatgaagataaatgatgacaccatgcggggactctgcgtctgttaagagttataatttgacaacattatattgatccgaccatccaaagctgtcttgtaatgtccttcctctgtcactttatgcgacttctctcaatgcctctcttatttcttctctacgcctatctctttgcatatagttttcttttgtcatatccgtaaaaaaactacagattttttttcgggttcatttaagtccaaaaatatatgttgatggttctacataactctcattgttcctttttaagtaataagtaccttcttatatttatttatttgctctaattaagcaagtaacttcaaattaaaacattaggtaccaacaattatggtcttgagggtaaaaaagacgataaaaaagcctcagtgacaaatgtcaaaacatgggaaaagaattgtaacactaattaatccacaatcaagtgaaactgaaaaccctaacatggagggaccaacaaatgattggacataactgcaccaatcaaaaacttaattctgagtttattttggcataatttagtttggtgatacgcaactgggtcccattttaatatgacataatttagagtaaattatactatgaataaaaaaaagaccttaccataaaagtcattcgttattattacttatgtttgccattacaagtttatatccatttcctttattttcccggaaatattttttcaacgaccaagcagagaagttacgttacagtattatacaaagaacatttacacacattacccaaggaaggtgcaggctcgggccacttatgggccattgaacttgtacaaatatttatttagcccatgtaagaaatatcgaggagatattttgtttacataaagcccagaaagcccaattagtttggttgataattttttataacaaaaaaaacaaaattccacgtaagcacagaaacagacgactgacacggtggtccgtgaaggcgtgaaccgaatcatcgacggaggaaaccaccaatgatttctccatctcacgtcgtcaaatgtttcatcatcatcttcatcatctttcgtacgacttctttttttttttttttggtttttttttcccttcccaatcgaagtagcgatgccttcgcgatagctctctgcttcatctcgccactcatctcaacctcttgatttgggtctctcttgctcttgctcttgctcttgatctctctcaaggtattttattgttctctgaattgtttccctggatcgaatttgttctagggttttaaggttatagctcgaaatcgccgttgctcgctgttttagcatctccttttcacgttactgtgttcgttggtgctgtgattggtgttgagttgggttataagttcgttgttcttattgaattttgatatgtgcttttgcttgtgtatagtgttaagcaaatagg

SEQ ID NO: 8499 - DNA, 3000 bp, Unknown
  misc_feature (1)..( 3000): cDNA_ID_1821549_gDNA_ID_1971813_Annot_ID_58155 3000 nt of promoter + ATG
ggagaggatatctcttatcgaggtataacatttcctaatcattacttgtcgtaagggtatcatggttctgtatgatgctaactttatttaacttcttcgttgcttgaccctgtgacaaaaaagaggctttatcctagcagccacttttgggaaacatatcttgctcgtcgaaaggaactccttaaagctgcactaccttttgactccagtgaaattagcttgcaccttggggggtcgtctttgtttcagcatctcaagattgagtgtggtgaggttgatggtgttgttctaggttcttggactaaaatcaatgagagtgcatctgagcatgcacctgatgaaaccgatgcagttgctggctactgggctgcagcagctgtgtggtcaaatgcttgggatcagagaacatttgatcatgtaagaagttttctatagtcattctttctcgttaccctctaaatgcctgaatatttatctaattgcaccatcccattatactaatacatccgtaccttggggacgttcgaattgatttcaacgtactctgcatgtattggaattggaccagttggattatctcttgatctgtatagcttaacagtgtttgtagtcttacactggttagaggattttgttcagttgttttcttgttttataaagaacgagacaaatacatacgataaggcatctgtgcttatttctcgagtagctaccctctgcttatcttttcctcttaatgaaagtgtagatgaaatgtagatctgtatttaatgattgtgctcttaactagattctatttaatgatggtccttaatcttgggttgcattttatatctttttacttgaattagcacattgtagagcattagagggctgctactgccatctgttagtcctataaacacccttaatttggaagtcgacattattagatttcagtggtgagagtaacagtgatacatttgattgaaggttaaagactatacatatcaacattttttttgttttgttttgtattattccatgaacttactcaggcgaaggttgttttgttcgtttcagataacgtctgcatttgttggtttttgagtaatgtttcttgttgaatattttgtgcagatagtcttggatcagcccttagtcatgggtgttcatgttccatgggattctcagctggagtattatatgtgtcacaatgactgggatgaagttcttaagctgttggatctcattcctgaggatgttttatatgatggaagtttgcaaattgctttggatggtccgaaacagtcttctggcgtaaattattcagtttcttcccgtagcgagtatatatgctccatcgaagaagtggatgctgtacttatggatgttccttatatcaagatatttagattgcctggagatatccggtgctccttgtggctaacaacactcatggagcaggaactagcaagaaaacttatatttttaaaagaatattgggaaaacgctctagatgtagtatatcttctggcccgggcaggtgtcatccttggtaattgtgaagtttcatttaaggaggaaacttgtacgccatcgttagatctttgtttgtccataaagaagggaggagcaaatgttgataccctgaatgctgtacacaagctattcatacattactgcacacagtataatctgccaaaccttctggatctgtaccttgatcatcacgaattggtcctagataatgattcactcagttcattgcaggaagctgtggtaagtgctttccacgtccgtaatatatttgtgtccataagtctgttctttgtacgcctatggtttgtcttttgaagacttaatttttactgagaatgccaagaatctgtccatgtattcagggtgattctcactgggcaaaatggttgctactctccaggatcaagggccgggagtatgatgcttcattttcaaacgcacgctcaattatgtcacgtaacggggcaccaaatagtgaacccagtgttccagagattgatgaaatggtttgtactgttgatgacattgccgatggggcaggagaaatggcagctttagcaactatgatgtgtgctccagtgccaattcaaaaatccttgagtactggcagtgtgaacaggcacactaactcttctgcgcagtgcactttggagaatttgagatcatttcttcagagattccctaccttatggagtaagcttgttagtgcttgtcttggggaagatatatccgggaaccttttgcggaccaagactaagaatggttaagcctggtccaccacactttttcttttattctgtgtatagtgaggacatactcgctctgactctatggtttatcagtcttgtcagagtatttgaattggcgtgacggtgtattcttctcaacggcacgtgatacctcactcctccagatgttgccttgttggtttcctaaggcggttcgtagattagttcagctttatattcaggtatctatttctgttttatctgttgtatgtgctcttctgagttgtacaacactccttcaactttctggaattgaggatctagttgaactcaatacttgcactgtaatcggcgatataacaagtttaagaatttctatgaaataatttgatggttgtgaagaggcagacataggcaaaccatttggggaatgactactaagatttagggagaaaggaaaaacacatcaaatttgttctacatcaatctttaccattttacaaaagaaatttgaggcactataccaaaagtggtagaatggaactgtaactctggtctactcaattattagtgttttttttaggtgctggcttctgtttcgtctatacaattagtaggtattctcctcatgcatcttcttccagattttccgagaatgcatagcttgcttgttgttggttctctttgacttggagaccttgaattaaccctctgatatggcctccttgtgttggttcatcatagcagaaaa

SEQ ID NO: 8500 - DNA, 3000 bp, Unknown
  misc_feature (1)..( 3000): cDNA_ID_2107183_gDNA_ID_1971813_Annot_ID_58162 3000 nt of promoter + ATG
agcaacattttgatcaatttgtattcgagagctggtggtatggtttatgcacgtaaggtgttcgagaaaatgcctgagagaaacttagtttcttggtctaccatggtttcagcttgcaaccatcatgggatttatgaggaatctttggtggttttcttagagttctggagaactagaaaagacagtccgaatgaatatattttgtcgagttttattcaagcttgctcaggcttagatggtcgtgggcgttggatggtgtttcaactacaaagttttcttgtcaagagtgggtttgatagggatgtttatgttggtaccttgttgattgatttttatttgaaggatggtaatatcgattatgcgaggcttgtgtttgatgctttaccagagaaatctactgtgacttggacgaccatgatcagtgggtgtgtaaaaatgggaagaagctacgtttcattacagctgttctaccaactaatggaagacaatgttgttccagatggctacatcctttcgacggttctaagtgcatgttcaatacttccgtttcttgaaggtgggaagcagattcatgcgcacatcttaagatatggacttgagatggatgcctcactgatgaatgtgcttatagattcttatgtgaagtgtggcagagttatagcggctcataagctattcaatggaatgccgaataaaaacatcatttcgtggaccactttgctctctggttataagcagaacgctcttcataaagaagccatggaattgtttaccagtatgtcaaagtttggtttaaagccggatatgtatgcttgctctagcatactcacatcttgtgcctcacttcatgctttgggatttggaacacaagttcatgcttacactatcaaagccaatcttggcaatgatagctatgtgactaacagcttgattgacatgtatgcgaaatgtgactgtttgaccgatgccagaaaagtttttgatattttcgctgctgctgatgtggttttattcaatgcaatgattgaaggttactcgagacttgggacacaatgggaactacatgaagcattgaacatctttcgtgacatgaggttcagattgattcgacctagcctattgacttttgttagccttctacgtgcatctgcttctttaacaagcttgggactgagtaaacaaatccatggattgatgttcaaatatgggttaaacttagatatatttgctggaagcgctttgattgatgtttactcaaattgctactgcctcaaggattccaggcttgtgtttgatgaaatgaaagtgaaagatcttgttatctggaattctatgtttgcaggttatgttcaacaatcagagaacgaagaagctctcaacctgtttctggaattacagttatcaagagaaagacctgacgaattcacgtttgccaacatggttacagcagctggcaacctagcaagtgttcaattgggtcaagagttccattgccagcttctgaaaagaggcttggaatgtaatccgtatattacaaatgctctactagatatgtacgccaaatgtggtagtcccgaagacgctcataaggcttttgattcagcagcttcaagagatgtagtttgttggaattctgtcatctcatcttatgcgaatcatggagaaggcaaaaaggctcttcagatgcttgaaaaaatgatgagtgagggaatagagcctaactacatcacctttgttggagttctatcagcgtgtagccatgctggtcttgtagaagatggacttaagcaatttgagttaatgcttcgatttggaattgaacctgaaactgagcactatgtttgtatggtatctcttttaggccgtgctggtagattgaacaaagcaagggagttaattgagaaaatgccgacaaaaccagctgctatagtatggaggagcttgctgagtggatgcgcaaaggccggtaacgtcgagttagctgaacatgctgctgaaatggctattttgtctgatcccaaggacagtggatcgtttactatgctttctaatatttacgcgtccaagggtatgtggactgaagctaagaaggtgagagaaagaatgaaggttgaaggtgtggtgaaagaacctggacgtagttggattgggattaataaggaggttcatatatttttgtctaaggataaatctcactgcaaggctaatcaaatttatgaagtgttagacgacttacttgtgcagatcagaggagttagttaataactaccatacaagaactcattttctattggagtgatggactctatttggttaaagaccaatgcagcagatgaagcttaaaagcgagccaaagaagaaagaataagccatggttaatatcgagaagctgaaggggtagctagctcaggagagcaaagatgttgctattaagttttgtaatcaagggaaaatcgattctgttccgttcaaatccgaaggaagactcaaaaattaaccccggttcagttctcagtttcttctcatcatctcctaaaaccgggttgagagagaagttgtaatggtgaatgcatgaatggtatgttgtacatgattcatttgaatttagttaaaccgtttttgaaatcaactaaaaccgaaaaacaccaattcaaaacaaaacaaaacaaaaattcagaacagggtttattgtatataaccaaactaaattctcattctgttgtaaattttattaaaccggaaaaccaaatcggacatatatgggcctaaaatgttgttgggtcaggccgaattctagacagttctgttctagttttttctcctttgtcgtaatcaggtggacgaaacgaaaaccctcgggattcctctgcttctgtctcgtccgtcgtcgtcaatttctctgcatcagagattccggtgtccttcttcctttcactcgcgtataacctcttttccttgacgttgtctccgtgagctctctgtgctttgactgcaaccatg

SEQ ID NO: 8501 - DNA, 3000 bp, Unknown
  misc_feature (1)..( 3000): cDNA_ID_1821517_gDNA_ID_1971813_Annot_ID_58166 3000 nt of promoter + ATG
gagctctctaagccgcatttcaagattgtattacccaactttctctcttgtctccaagagtttccgctctctaattgcttcaccagagctttatcagactcgctccatcctcggccgcaccgagagttgtctttatgtgtccttacggttacttaacgactctaacctccgatggtacactctctgtcgagttccggatcgaaaactaacaaatttctcaggtggtcatttattggttccgatcttatctcgctatgctcctcctgctcattggtcgagtgtggtcgctgttgattataatatctacgctattggagggcctatcaatgatgcaccatcctctagcgtctcggtcttggattgtcagtgtgagaaatggcgtgaagctccgtccatgcgggtggcacgaaactaccccactgcgaccgttcttgatgggaagatatatgtagcaggaggctgtgaagattgcacttcattggattgtatagaagtgtttgatcctaagactcaaacttgggactctgtggcaagtcctggcaccgagagatgcgagagacttgtatacaagagcgtagggatcgaaggaaagtatcacttgtttggcggtgcgggtcatgtggcttacgacccgaaagaaggtagatgggactcagttggaatggatatggagatgggtcggacatgggtttcatattgtgtgataaacaatatattgttctattataatgatagagagtttaaatggtatgactataaaggaagattttggagaaagttgatggggttggaacggctaatcaagtttctatgctatagccgtgttaacttggcggcttacggtgagaagatggcggttttatgggatacttttgtgccttctagctctaagaacaagatgatttggtgtgcggagattacgattgaaaggcacgacatatacgagatttgcggtaagactgaatggtttgatgttgtgcttagagttcccaaatcatatgaattggtacatgttcttgctgctactgtttgattcatgatgatttggagagtttgtgtagtattgggctatttaatttgatggatgattgtttattgtttctatattgaggcccattaaaaaatgatttatatattaagcccacaattgaattatcacacactcgcaatctgaacgagtaaagcaaacgcgttcgagaactctcatagcagtgaagtgaagtcaaatccctagattgacttgctcaacggcgatttcatctcgataattagccaatgtcttcaccggagaggaagaggaagagggtgacgtcgacgaagaatccatcggttaagaagaagaagaagatttcaccggtgccgacgccgataccgtcacttcctgatgatttgcttgtaagtatcttcgcacgagtctccagattgtattatccgattctctctcttgtctccaagagctttagatctctcctccgttcaccggagctttacgagacacggtcactattaggccgaaccgagagttgtctgtatttgtgtttacaggagggaaatcctgatccgaaccctctctggttcactctctgcatgaaacctgacagaaccctaaaaaatggcaagaagaagaagaagaagaagatgtcaagtggtaatcttttgatcccaattccagttcctaatccccctcttgagcactggtcaggtcacgcgtctgttggttccgatatctacttctttggcggatacatggaggagaatgtgcgttcctctagagtcgtgatcctagactgccggtctcacacgttgcgtgaggctccaagcctgcagatggaaaggtcggaccctgctgctagtgttattgatggaaagatttatgtagctggaggtgtcgacggtgatgatgcagattccttgtacccgatagaagtgttcgacataaagacccaaatttgggatcataggcccatcccttactgggagaaagactggggcgctctatcaagaagcgcgtatgttgatggaaagttctacttgacgattgggatgaaggttatggcttatgatctagaggaaagtagatgggactttgctggatatcagatgggtcagagttggttttggtcttgtaattgtgttatagagaatgttttgtactgttatggtgatgctttccgatggtttgacactaagctgagattgtggaaagttatgaaggtgaaaggactacctaagttgtcccgtaatgtcgatgttaagatagcagattatggtggaaagatggcgattttttgggacaatccttccccttctgcttccgatacgaacaaaataattcggtgcgcggtgattgcccttgaaaggcccaacagtgaagagatttgggggacggtcgagtggcatgaggcagtgcttacagttcctgtgtcatatgagtttgaacatgctctagctgttaccgtttgatgaatgacagacttgaatgtggtgaatctttaatggtttgtgggtatttgatcattttgttgtatgattgtgtcttgtctttttagctcttatgacttatgctattgacattgtttcacttgtaaacctttgatggttagctttctttctgctgctacagtcagacctatgaaacactgttttggttgaaaagaaagtttaatactttcattgtgcaagtatgtctcatgtcattgtacgttatggaatcatccaatgatgcagtagcagtactgttagagttgaaattaaacttttcaaatgtatttatagaaacgaaatccagtgtaatgaattgtgcattcttcttcaaattaacaaatttaatgctttgaggcccattaagaatttattaatgtgaaggataaacgcagaagcaacaaagtccattacgctcgataaggcttagcagtcaaaatccctaaaatcctctttgactttggttctctgcagtcgataattttattttcgccaatgtcatcgccggtgaagaagatg

SEQ ID NO: 8502 - DNA, 3000 bp, Unknown
  misc_feature (1)..( 3000): cDNA_ID_1821502_gDNA_ID_1971813_Annot_ID_58172 3000 nt of promoter + ATG
ttttttgtgtcaggccaaccaaaagatatagatctatggaatctaatagatacataatacatgtaccggattcggctcagaaaaccaacagttgaagtatgtataattcatctacaatgtgtttgagtcttgtcgtgtacgtttatgtttggatttgatcaaaaccagtatcgcttaacccaaatcgaaccgcattataattatagtaaacacatcaatctcattattttgatggcaaataaataaactgaaactgaaatcatcgtaacaacttaataaatgaaaatccatcaataagatcttttgctagaattaaaacaatattgagattaataaaagattgatttaaataagatcttgtctttcaaacgttagaaacaacaggtgactctctcgttaagatttttctctcgaagatagccttaaaacgcatcttcttcgtttgaccgtctctaagagtcttaccagacgagaacatggactattcttcaaaaagaatagataacgcatgcaaattaaaagagttggggacgactttttcttcgttagagaaaccttattgtatgactataaatacaccttctctccaaaagaaatcaaaaatcattttctaagacaaatacaaattgacatagaccaaaatatttggcttatgaacgatttatgcattgtaaaactcattatttaattaaaatcaaaatgtatcaccgcctggtttggttaattgctttgattgttctattgttcgttggatcatcaaacatagaacaagtaagtttctagttattgataaactttattcatttctcaaaccaaattaaagttatttattttattaatatattcattgtatatattcatgaaaatttcatttcaaaaagggtgcatgcatgttaactgtgaaaatgaattttatttttttctcattcatgaattcacatcttttctgcacggacgatcattagaaagcatccgtatgactctcaacatggtaattttaaatattcaaaaatattgatggttttcaatgtttactaattgtatgtgaagaaaaggaagaaagggtttgggataaaattgtgatcaaagaaatcaagattgatgttggtggaagtaattcaagacgtgcaggtcaaggaaatgcatcagatccaggcaccaagatctagcgacagtttaccaatgattattattactaactcggacaatttagaagagttccgtagattcaaattcattccattttttaaactaaaagatatatgtctataagttttgtcaattaaacctcctcctatccaatgtcatcacatacatttcctttcaggacgaagaagtgtgtatatacacacacttacaattcaatctttttataaagatcgagagattaacaacgaaagaacaacaaaaaattcttacaattatcctaaacaatagtatataacgtcgacgaccaccgccgtttccggtcatttacatacacgttacattaatttgaaccataacaaaataagtcaaactctcacaaagaaaaagctaagttcgggtccattattcccttcaggactcaacatataaaaagtctctgaatctttagacccaataactctctcaaaataagctctcatatacgccatttcgccgtcgggtccttccgactccgagtttcccggcaaaactccggcgcccatagacaccggacgtaacaactccatcacgttaagatcttcttcggtcgcttctcgtttcacaccgtaacccgttttctctcctttacaatacattgtccataacggttcttccaaaatatctgtcttcttctcggttttagaattgttattatcagctcgaggctgtttctcagtctcgagagctattctcaccattcccgtgcttagctctttttgaagcgttgtggtttgcatggcgagctccacgactaaagaaggtaaacatttagggttttcttgaatggaaagacttactcggcctttacggtatccgaataacgttccggtgattcttgacgtgttgtgatgtggatccggtaagcctaaaccgggatgtataaccgggattttgcatgctacggatggtgttgtaaagattgggaaagatcgaaacacggtgcgtaagactctgaaaacgtttgttctgtttttcttcttttttgaagatggtggctggaggagaggatgttgacgtggcggagtggttgtggacgtcggagagggtgttggagacgaaggaggaattgaggaggaggaggaagaagaacttgtagccattggatttgatgattctcccattagacgacgatcgtacggcgaagaaagaaggagaagatctttcttcgacgaccgacgacgactaaaagaaccaacgtccttgtagaaatgtagtcttttttctttttctttagctctctattcctcctccttattgaattgataattttctcctagtaccaatccttatccttgaatttgatttttttgtttttcttttctaaatttcgtttttgttaatttcttttttaagagaagttaattagggatttcaatggtggttaaaaccgaagctatatttgcaagcaacaaatcgcatttttatgttagtttttctaagcttggtcatattttataaatgtgtagtggttgctattgtttgcataatcacttgttatgaaacttttatccggttaagtatatataatgaagccaacagtacaacaggatccgtggcgcaatggtagcgcgtctgactccagatcagaaggttgcgtgttcgattcacgtcgggttcaaataccccgaaaattagatccttaacttttttattcctgtatttatagaaacggcccaattgttttgctgtatttacaaaacggcccaacttgtttgctgcttcactgaatgtaccctcaaaacttttttggttgcaactgtaaaaaccttatccgccattaaaggattaggaaaagaaaaaaacttttcgtca

SEQ ID NO: 8503 - DNA, 3000 bp, Unknown
  misc_feature (1)..( 3000): cDNA_ID_3045616_gDNA_ID_1971813_Annot_ID_175858 3000 nt of promoter + ATG
agattagctttgatttcggacttggactatacataaatatatttatgttctctggtcggaagacgaagataaccaagtaccgtcattattatgttcatgatcggagccaccgtagcttccattatcaccggtgtttatgttcccgttagccgctgccgttgtagtaggaggattagtagatggagtctgcatcataccaagaccaaactgatcgtgctcattgcttctagggtttgaaatatgagcttgaagaagagcttgcagattcatatcctcgaaaccgttgttagggttttgatattgctgaatttgtgatccggataagagaggagtcgctggagtgagtttttgagcaaacggtcgtaacaagagattgttggtgttgtaagtgtttggcgaagaagaagacaagccgaggaaagtgttgaggcgcgtggtgttcacgatggagttgttgttgaatagcggtggagctgggattccggtaaactcttgaaccatcgctcggaagttggaagtatccgtcgttagaaccgtcgttggtgctcttcttgatgctcgagatcttttctttgttttcttgattactcctatattgttagtaggagggagtgatgacgtggcggaggaggttcggaggtcgagttgagaaatcgggtcgggttgttggtttacgggtaagaacgtgttgttgttaaagtagtttggtggtattagagagttgttgttgttatggtcgaaatggaggaggttgcgatggttttgttgcggcgtgggtatagatgacacgtggttgttgtggtggtcgaagaaggcggaaatggattgatctgcggcgcgtgaatcgtattcttcttctcctcctccgccaccgccgcttgaagattgcatgctactactattaccggactccatctcgtgacaaagaaaaaaagactttgacgagagaaaacgtaagaaattgatttagaggtgagaatggatacttgagtttagggagctattgtttgtttaaggagtttatgagatagggtatcatggtaaataagacatttggtgtgacatgattttttaataattttgttttgtttttgtgtgaaagggagaaaaacagggaaggtgaaatcgcattaagtggttccactaccaccatccactattgtctactctatatcccaatattatatacatgtatctaaggtttagtttatattagatttattccttttggtgatagtcaaaattcactttgattgtagatatttggttcggctaatgctttgttttgtttctctaccactgcaggatgttacgtttacaaatcttatgatggtattacttttacttttcctgataaatggtacttacttttcttcgtgatttgtgcgtatattcatatcaaaatcaattatgcgataaaaatgttagaacaagttttaattttccgtgtgcacaaacaatcatttaacttcctctcgttattctctaaagatatagaataatttgaataatctactaatctcttacatgatgacataattaggtcagttaattcggaccaaattcaataatatatatcataattattagatgtcatcatatagctagttccaccaagataagttttttagctgattaatctttcttttcaattgaataatttcgaaatcaccaatttaaaagatgcaacaaagatatgtacatactcatttctacttatttcacccgattaatttgcaagtggaaattaatggtttgagtgtatattttgatagagatactaggtttggtcggaaaataagaatcaatcatataatatactattaattatcaaggaaaattcaaaatttatgggcccattaaccaaaatgccataaccctattatcactttacccatacggcttagttttgtttggttacccacactcatttataattgtgtttttttcgttttttttctaaatatcaaaatttcagttgacttgtaaattcgtatgaaattgattatcattgcattgcaaataagaaaaagaaacatttagtaaaaccaaccactacattcgattaactattatcactattaaatgttttgttagtgtttgataaaaaaaaaattgccgtgttagtaaaattttttacgggtgatcaatgatcatcatataattaaccaaaataatgtaagtctacatagttttagtattgaagatcacaaggatatcaaaaactaaagaatcatcactctctataatttagtaagctatgggtttgatcaaatttccagcatgtagtttttttgctacgtgtgcattttgttataacaagataaatatataaatgggcttacgcttcttcttttttgtgcaacaatgggcttacgctttatgcccaatatttacctataccaaggctccatataattagtatttgttatttataagcccacacacttttgagaagaagatgtctaaaaatgaaaatgctgagaagaagtaacaatttgtttttacaaatataaattatacctggccataaaataataaaaatctgacagcaaatatataagcaaataaaaatgggaagaattacttattctcaatataaatttgaattattcttaatatagacaaaaccatcaaaaatttcgtagtcattaataaggaaaatttcatacaatccagtggactatttttcttggtccgtaagctgccagagagagagagacttaaaaggataatttcgtaaatctaccaacccatcatataccgactcgccgagtaatcgccaagcctctcaaattatccatctcaattctcacatcacaacagataagagtcagccacgtcaacattacacgctactccgaataacacgtgattattaccccaattgttaattcccaataataacccttccctcaaataatattcgcatctattaatacacctctgcagaaaaaaaatcagagaaaaaatacaaatcgttcaccggaaaaaaacaaa

SEQ ID NO: 8504 - DNA, 3000 bp, Unknown
  misc_feature (1)..( 3000): cDNA_ID_2177149_gDNA_ID_1971813_Annot_ID_175856 3000 nt of promoter + ATG
gaaaagtaagtaccatttatcaggaaaagtaaaagtaataccatcataagatttgtaaacgtaacatcctgcagtggtagagaaacaaaacaaagcattagccgaaccaaatatctacaatcaaagtgaattttgactatcaccaaaaggaataaatctaatataaactaaaccttagatacatgtatataatattgggatatagagtagacaatagtggatggtggtagtggaaccacttaatgcgatttcaccttccctgtttttctccctttcacacaaaaacaaaacaaaattattaaaaaatcatgtcacaccaaatgtcttatttaccatgataccctatctcataaactccttaaacaaacaatagctccctaaactcaagtatccattctcacctctaaatcaatttcttacgttttctctcgtcaaagtctttttttctttgtcacgagatggagtccggtaatagtagtagcatgcaatcttcaagcggcggtggcggaggaggagaagaagaatacgattcacgcgccgcagatcaatccatttccgccttcttcgaccaccacaacaaccacgtgtcatctatacccacgccgcaacaaaaccatcgcaacctcctccatttcgaccataacaacaacaactctctaataccaccaaactactttaacaacaacacgttcttacccgtaaaccaacaacccgacccgatttctcaactcgacctccgaacctcctccgccacgtcatcactccctcctactaacaatataggagtaatcaagaaaacaaagaaaagatctcgagcatcaagaagagcaccaacgacggttctaacgacggatacttccaacttccgagcgatggttcaagagtttaccggaatcccagctccaccgctattcaacaacaactccatcgtgaacaccacgcgcctcaacactttcctcggcttgtcttcttcttcgccaaacacttacaacaccaacaatctcttgttacgaccgtttgctcaaaaactcactccagcgactcctctcttatccggatcacaaattcagcaatatcaaaaccctaacaacggtttcgaggatatgaatctgcaagctcttcttcaagctcatatttcaaaccctagaagcaatgagcacgatcagtttggtcttggtatgatgcagactccatctactaatcctcctactacaacggcagcggctaacgggaacataaacaccggtgataatggaagctacggtggctccgatcatgaacataataatgacggtacttggttatcttcgtcttccgaccagagaacataaatatatttatgtatagtccaagtccgaaatcaaagctaatctcttgacatgattactcaacaaattaaacatagcacatatagcatgatgaagttactcgtttatatattctatatttcagtataaaccactttaaaacttttttcgtgtagggtttgttaattatttaatacttaattaatatgcttgttatttgttaatcttagttttttccataactatatgttggtaagtattagttagtagatggatctcaccatttgaatcagattttcttggtatattttcttataattatatagaacttttaaattttaatgacaacgatgacttgcgatatgaaattttaatttttcaacaatcaatatacagtacgtggttttgggatcactacggttaatatttctcctaattaatattggagtgaatggtggcgaaatttggggaatcttccacggccgccggattgtggaatatggttttgggaccatagtatataattattaattaattatagacttgtggtgatttgaaatttgataaattactgttctcccatgtgcttattcatttttggtgtatcatctacattaacgtcaatttttattgacttgactctcattttaccataccaacagatttgaaatttgaaaatttcccaagcaaaagaaaaacaggtaatcaataatgataattatacatacattttggttttgacctacttttgtcatatgacaatttatctttatagacacttttacttctattattataagtctctttgtttgtgaataggggcaaatttcatttgaccgcctccgacaaccattgaccttgtcacggctctgaatgtgatgcgtctacaaaattcctaacttttttcagtcttctcattaaccaatcaatcgttagaatattcagcttaatttatatctctttctagtctctagcttaacaacacttcagaatgaaatgtcagttctttgtaagcggggttttcaataatatcatttgctactgtatagtataatagtaactcttaaaaataataattcttgtttttcacaataagatttgatgatggattgatggtcgcaaaacaaataatgacatttgatgaaaaatcttttgcttgttcttgtgtatacaaaagttcaaatgattttgatatttttttgtccacggaccagttacacttaagtcaccaatgcactgtataacctatacacatcacttacataaactatcaacaatgtgcatatatgtgtatctctatctaaatggaatatataataatgggtgatgatgatggtttaatattatggtggtggttatggtggaccatgatatcaagctattgtcgcactgatgggttttctatgtattcagatgatactcggtttcatagttgagtgataactaggtctggccattatcttactatccaaataattcgattcgggttctcaattttgtgggccgattggctccaaaagtttcattattatttttgttctgttgaaaatagaaatccaaaaaaatacgggtgggtcccataatcatatccattgtaccgttgcacactcaaaagacaaaagattcagaccaaaggctctggcttcacgcagataaggaagcagagatcgaaacgaagactcaaagaagaatg

SEQ ID NO: 8505 - DNA, 3000 bp, Unknown
  misc_feature (1)..( 3000): cDNA_ID_3084324_gDNA_ID_1971813_Annot_ID_175854 3000 nt of promoter + ATG
agctgcaacttgctcctctgacaagggtaagtaatatatcctggggatcgcttttgtcttcttgaatagatcatcaagagtgacaatgggaggttcttgttcctcaggggctataggaggagggggaggcagaggaagacgttctacaacgtgaggtggtttggccagaggtggtggtggtggaagagcagttggaggtggccgcgaaagagtctgagcttgtggctgatgctgaggctgaggaggcagaggagcttccagtttttcttttacttcttctgctctaacaaattcagctatcagatggcggcctccattaggtggccactggaggttatacactgcttctcttgttgctgctgcttcttcaaccgagggatactgcagtcacgtcacaactcactcatgttacacaaaattctttggatatttagataattgaattcgaaagtacacaaacagaatcaacatttttgtaaatcaaaaggatttgaagaagcggtcttaccgatacatagcagtgggtcttaatgtggtccatccagaaactagtgacatttccggttttacccaggagctcctgaacagctttcagtgtgaacggcctaaggaaacggtcaatcctgagggaatttgtaggctcctttggagatggaggaactgccaataaatattgaacacatctatcaaacaaagctttaagacaatgaataagagatggaaacatacatagagggggtgctgtattacatacccacacgttccttgggtccatcttcactaaccgaagagtcagaccttgagaagtcgcgcttcagaccagtcgaccttggtgttgtagtgggtgtagcactattagtgatctgtgcttcaggaactttaatactattagagttccatcggcgcctctttgcaggttcattgtttccaacagcttcttgatctacattgagttacaaagaaagacatttcagcatacatagctagaatttcaaaacagatgcttcaaaagccaatatatataagaagtagccataaacgacaaagatgaaacaactattaaacactaccagtatatgcctcaaacaccaacattacagattaaacacagtaaaagatttgattaataaaacaaatgaatatgagaggaattaccattagcaggaagctttcttttgtcagaagccaccagtgggtgacttttattttcaggggatttccctttccccgcatccatatcagcacggctttcctccttagaaagcatttcaatttttgcactcttatcatcagatgtaattgactcggattgctttgtctccggctcatcctccatagactcatcaccagaacttctatctaaattcaacttttctgagtcgcctgcatcgataatattattttctttgatcatatctgcgtttgcagcattgctgtcatccccacctccaacagatgtcttctgctcaagtggctcctcgacatccattggatgcgattcgccaacgactgttgatggctcttggaacttattaacattttgttctaatttgacattatcagcaattttgttatcctttagttctattttttcattatttgacacagaatcagtagaaatacaatcagattttacctcaaaccctgtaacggggatgacctcagatacctggttgtacatagcagatttttcaagcactgcctctgatggttgagccttagaatccccaccatccaacccactaaatggttcattattctcagatttgtgctcactagacgccacttgcacaactgctgcatcacgtgcaaccactgaactatcaagaccagctatgtctctaacatcatcaactttctctttctcatcttcatcactagcgaatggcacagcgttaacctctggttctgaaaacaccggggctggtgtagtctcaacaccagctgaagcttcagttgttatcttggtctgagttggttctggggttttctcagctgtaacaggagttgtctcagtgctaaatgccgcttcaacaggagtaacaggagtggtttgattacgatcacctacagtaacaggaaacatctgaggctcttgattggctttttcagcagcagcaacagtagcactattgatcctttcagactcttcttgctcagcacgaagtgcttcatcaagacgcctaaccaattcctccttcaagcctcttgttgttagtctccgtcttttaagctcttctttcaattccgtaaccttccacttatcaattggtcggttgtccaagactggaaaaggcgatgacgacatcttagcttatgagagagctgattctgaaaaaatattgaatataaaattagagaaacccatcgcagaggacaaaacctaaatcagacaaattagcaaagcaacgcagcaaatctatataatttaaaaccaaagcttaaatctttaacaaacccaatccaaaagagctagaagtttaaagatgacttacaacaaaatggcttgaaacttcctctgatgggtaaaagaaggcaggaaaaatgtaaaaccctaaattcgtagcataagaagaatgaaacaattagagagacaagacaacaatcaaaacccagtacggaagattacaaatttatcaaatttccgactcaaaatagattcttcaacaccagattttactctcttaagacgaagaagaaaaagaagaacgcaaaccttaaaaacgaaatccagaagcaatggaacggagagagagtgacctttggttgaagaattctaatcgagaatgaaagataaagcggacattgggaatttttctatcccgtcattacaaaaattgggaattttggaaagaggaggcgaattctagggttcttgttcgtcgagtggttttgatattggggaaaaactcgaggacctgaagtgataatgggtcgcattgtattgtgaaatgtctaaattaccctttttctcaagtaattttgtacggcgtcgtttca

SEQ ID NO: 8506 - DNA, 3000 bp, Unknown
  misc_feature (1)..( 3000): cDNA_ID_1824449_gDNA_ID_1971813_Annot_ID_175853 3000 nt of promoter + ATG
acatatgtcctggactgagtaatcaagtagagataaaaagataaacgcaccttatccaatattgctgcctcctctatacgcattagctcacgtgccctaaggtctcttaactcattttcatacttctcctgagtacaatcaaaacaattggcagtagtgtatacgttaaaacctcttataaagcaaagacactacagaaataaatactcatacgacatattctgtcttttaaccaaccttcaaggctcgtaattcttcagcaaaaacctgggcatctaaatgggcctgttgcttctcagctgcatgaatggcagccagaaaatcaagtaccaactttccatcctcagtcatgtaactatctttcagcccctcggttgagttaggaaaggcctaattcacgaaactatccagattaagaacacttttctgcaaattatcaatcaatataaagcactgaagtaaggaacagagacaggaatatcaagtattaaacctcagtttctttagttatttgctcccctattgacgaggacccagtgctttcagtatcactgccttctagattatattccttaaggagagaacctggtaattgtacttcccgctcaatgccatcctgtaagagagtgattgattagatattcatcatctcaggtaacttatataggccatagaaaaatcaagtatttaagaggggtttgaattcaactaaagcttcataagaacctcccgctttccttagagagtaataggtatctaattcaactaattttagttccctacattccttcttaaaaaatcagtttctatcagaatttgattcaggacagttaacataatgtccatatgaatatcccatttcaaccaatataataagaatttgcacaaaacaaaggagtgcttttaactccaacaatgtagcagaatccctttacataggtgtatcccctttcaaaatacaagcattctggtccaatgcaggaaaaggacgagacaagaaaaatttcatgaaacaaggaatactgagacattcatcttctgatttttaaatctgtaagctattcatttcattacttgtagttctttttcaagttcagcaaaggaaattttagtacctcaggtgtctttagagcggcaggatcctttggtgaagcagattccgtttcgctttctctatgaaccgaactagactgggcattaacaataataggactatccccaggtttgggtacagcttccaacttcacactttctgcctcagaaataatttctgatggcatgtccggcttagctcctgaatcttcagatgcagaaataggcaagtttatctctgctctatcaatgacagtttcttgaggtgtctcctcttggttagaagaaatatatgtaaaacggtcagatgatagatcagactcgggttgcagttctatgtcactctgcactccctcggaagcttcagaatgagtaacttgaggttgcgtttcaacttttccatctttttcagtagaatcttcaacaccggaaggtacattcaaatgatgagcctcctccagcttttcagttagagcatcagaatgaattcgctcacttaatttctgctgttctttccccagatattgatccaaatagccagtctgatacgctaccagaaaagccccagcgattgcaacacctcctataaccacttttgaagaatttcctttagtaggaggaggaggagtcacttttggaggatcaacttttgaggcatctggtttcccaacgggtttagctccagggagaccatttttaccagatgtagatgcatttctcgaagagctcaaatgaaacctctgatgcataacataacacaatcaatccaagagagtactcacaagacgctaactaagaatcacaactaaattcataactcacctgagctcccaaattcctcgggaatctctttattgacaaacgagaagacagctcgagaaccgacctaagcaaaagagcaacaacataaaccacattcggtatgattcacaagagaatcaaagtcacaaatagctctcaatttagaggaatcaataaaatcagacccgaaagctacgcaacgagattgatggaacaagagaagccaaaattcaacaagatggattgagataataaacttagggttcaggaaacatacttccgaagcattatcgcgtcgcgtctctggtgatacaaacgccgaacgagagagcgaagatgttacgacggacggagaagactcggagcctccggtgagtaaaataatagtattctctgaaaaccccaaaagcattgaaacgacgccgtacaaaattacttgagaaaaagggtaatttagacatttcacaatacaatgcgacccattatcacttcaggtcctcgagtttttccccaatatcaaaaccactcgacgaacaagaaccctagaattcgcctcctctttccaaaattcccaatttttgtaatgacgggatagaaaaattcccaatgtccgctttatctttcattctcgattagaattcttcaaccaaaggtcactctctctccgttccattgcttctggatttcgtttttaaggtttgcgttcttctttttcttcttcgtcttaagagagtaaaatctggtgttgaagaatctattttgagtcggaaatttgataaatttgtaatcttccgtactgggttttgattgttgtcttgtctctctaattgtttcattcttcttatgctacgaatttagggttttacatttttcctgccttcttttacccatcagaggaagtttcaagccattttgttgtaagtcatctttaaacttctagctcttttggattgggtttgttaaagatttaagctttggttttaaattatatagatttgctgcgttgctttgctaatttgtctgatttaggttttgtcctctgcgatgggtttctctaattttatattcaatattttttcagaatcagctctctcataagctaagatg

SEQ ID NO: 8507 - DNA, 3000 bp, Unknown
  misc_feature (1)..( 3000): cDNA_ID_2177138_gDNA_ID_1971813_Annot_ID_175850 3000 nt of promoter + ATG
caaagtattgttgcgtatcacggtgcggttgcgacagacgatggacggtgttctgcaatagggacgaatgttcttcgtcaaggaggaaacgcgattgatgcgtcggtggctgctgctctttgtttgggcgttgtcagtcccgcatctagcggtataggcggtggagcgtttacaatgattaagctagctaatggcacggaagttgcttatgattccagagaaaccgctcctctaagcgccactgaggtaagtaacacgttttacagtaataacgtctttctttttactcttcccaaaatgagcattttggataacgtacgtttttgagttatggacagtgtttttttaatcaaagatatttattggctgtttctcttgatgtaggatatgtatggtgataatcctgagcgaaagaagaaaggatccttgtcagtaggcgttcccggggaagtcgcgggtctatacacggcttggacacaacacgggaagttaccgtggaagcagttagtagaacctgctgagaaacttgcagctgaaggattcaagatttcaaaatatctctatatgcagatgaatgcgactagaagcgatatcttagcggacaaaggtctctctgagctatttgtttcaaatggagagctcaagaaaccaggggcgatttgccgtaacccgaaattggctgatacactaagccaaatcgctgaatacggtccaaaagcgttttacaatggcacggttgggtttaacctagtgagtgatatacaaaaagccggagggataataactttgaaagatttgcagaattacaacgttaaggttaaagaaccattatctacggagattcttggataccgattactcggcatgcctcctccttcatctggtggccctgcaatgatgcttgtaagtaaagtatttttgtgaaaatttcacatttcatcaaacctaggtttatcttttggagtttctcttgtgttgcagattttgaacattcttgctcaatatggtattccatcgggtgtttccggccccctcggtgttcatcgactagttgaggctctcaaacatgcattcgcagttagaatgaacctcggggatccagattttgtccctgaagttactaatgttgttgcagatatgttatctccaaagtttgcacaagacttgaagagcaagataaacgatgagaagacctttgatccaaaatattacggtggcaagtaggttttttcaatctttttccgcaaatcttttttcttcgattctggatatctcaatctttttctcctattcgtagatggggtcagatcaaggatcatgggacgagccatttatcgataatagattctgagagaaatgctgtttcaatgactagtacaatcaacggatactttggggcaataatgctgtctccgagcaccggaatcgttctaaacaacgaaatggacgatttctcgatcccgacgaaatccggaggtgacccagatgtgcccccaccagcaccggctaacttcatccgaccggggaaacgacctttgtcctctatgactcccaccattgtactcaaggcaagaaaaaagaaaaaaccctagctcttgtgctacaagtaactctgagtactttaggttctaaacgatggttacttctgtgttggtttacacaggacggtaaagtgaaagcagcattgggtgcgagtggaggaatgtacatcatcgccggtacaacacaagtttacttaaatcatttcttcctcaacatggatcctctctcttccgttgttgctccaagaatctaccaccaggtttttgctattttttgtccttgtacccaagatagaaactttcttgttctttgctaattttacttttgtaacctcatttgtagctgataccgaacaaagcttcgtatgagaattggacgacagtgtatagtgaccatttcgagattcctgaagagataagacttgtgttggagaagaaaggtcaagtcctaacgccgatcgccggagggacgatttctcagctcatagttgaacaatccgatggaaaatccggtggaattagtaagcttgtggcggttagtgatccaaggaaaggagggttcccttcaggatattgaaatttggatttgactttgttttcaattatatatcatcgaacttgtgatgtactagtatgaacctttatattcgatgaatataatatgaaagtaataaagtttgtttgcgataatgttgttgatccagagatttttctttaatcataaattcataatagttagtatggtgaatattggaattaaactactaaaccttttgctcttgcattagtgggggtcgtggtatgagtcgatgaccagtaaaagacaaaattaataaagatcttaatgtaaatgcgttggttgttatggacgacagctctattagcataattaattagcatgacttgatgatccttcgtcaagtgatagtcatgtacacgtctaagaccaaatgtgaaaattgtgataatcttgaaacctatatagtactatttcatattttatatacaatgttaattagctcggagttaggtccactaactaagtctaattactaaaataatacaatcttctaacttaacaactaatcatggtgcacatgcaaaattaaaattaaaaaaaaagatttggaggattaatactccaaagtccaaaccttggatactccgcctctagtcagtgacacgtcatataattagcagacgataatcggaagagatttgttacagtgtcactgtcggttgcttaatcagcaatctcattcaaatggaatcttaatacatgtaggaatctttttcctaagaatcatatttgacacgtcatcatttcttaaaaatcttttgatcctcctacttaagtagcactaatcaatccctcactaaactctagtcttaatcacactatatatatatagtactagtgtgatttgcccaacttgtcatcattatctctatctaataa

SEQ ID NO: 8508 - DNA, 3000 bp, Unknown
  misc_feature (1)..( 3000): cDNA_ID_2177130_gDNA_ID_1971813_Annot_ID_175848 3000 nt of promoter + ATG
catatatatataaacaaaacatcattgttgttggaattaccctagcatgctgaagaagaacacacataacaaacatatctggtttttggaacacaaggtttaaccattacaatttgaaagtgtctgaatcgttgaagcttttcaactgttttcctctgcaaaatcaattcattcacataagaacaaatttctgtttgtatctcataggaggaagcaagaacaaagaaagacagtgatctagaaacataccatttattgctcccatgttgtggtcttctttgtagacccccaaaggagagccatgcacagagagcatcatctctccagcttttggtagcctcagagtctttggagtcattccaaaagaaagtctttgcccattaacctgcaaaatataaaagtttcattgtagagtctctccttgtatgcccaaaatctatcattgaaatgctcattctgcaacagagaatgtaattgataaatgtcgaaaccataaactcaatttcttctctctagatcaatgtacaaacaaaatctcgaaggagaaaacatgctaaagaatcaaacaaagaattctagagtaggtacgagataatttgcatcaagacagaaatagggaatataatcataaatacataccccaggagtctgaaaagcatcatggcctggaagcatttggttctcagatgtcccctgaaagacctaataaccattggaaaatagcaaattagcgttttctacttactgtcctgaagtagttttgcatacttttggaaggccgaagaaaaatacaaggttgacaaaattaaaattgataaaacctaaacatcactaaaagaaacaagtaaaggcactactcagtttggtgaaagcctgcaaaattgataaaagcagatgacaaattcactaaatgttctacaacagttgtatctaatcattcaagtctgttctaataggattaagggaaccaccagaaagaaaatggcaggaagacaagatataaacttacaagattatcgagctgtgggttatcagttcctaacaggttagctttcactgccaccaaagacaaaaataaaagtaaaattcaaagtcaaattcctaacaaaagaacctaagtgagctttacataccgttgtcaggtaaatcatagccaccaagagatgacctactgtataaatcggtaaaacgcatcgacaagcgtttcaaaatagaataattcatgtcaacgccattctcatttccagcaaacgaatcaccattttcgtctctccactttaactcaatctccccagtttcttcgtttctcgatatcgataaatccggaagattctctttaaagaagtctaacacaggagtgtgtagctgttcctcagtaaaatacgaacgaagcaaccgcaatgcagttaacatttgttcaatctcaacatcacggattgctctaatcgcagcaatttgtctttcgactacacaatgttacccaatacaccaaaaatcagatcatgataatcctaaatttctgagttgggtattggaataattgataccttcttcgtcgacgaagtcttctttcttctcttcgattcgaattcgtttctcgtcgttcctatcttcttcagtgagtttgacacactcctttgcttttcgcttcggcattatcgatttctttcgaagaattagatgctcaattcgaggaattgattgcaatttcaaatcacaatctgaaattcaaaaccctagaaacagtgaggaagatgaaaaacccccaaaatcaaaaggggttttgaaaataatattaaataaataaatgggcgggagttacgcttaaacgaaattaaagaaacgaaattacgaaaatatccataaagttgaatacggcccatgggctcaataatattatgatcaccaaataacatttctaaataaagcccgaattgtgatatttttttaaaaatagttatgtttctaataaattcgatgtatttaaaagttgtggtgacaaaagatcggaaaaagaaaaagaatgttctttctttcacggtgtccacaaggctgacaagcatgattaagacgaccactaaagttttcttgacaccaacattgtacttactttagatgctcttcacgagtttgcttcaaatgtaataaaaaaacttcttttagttacatgaatcgagatcttattactgaactaattatgggagaatattccccatttttctaatattaatggcgaggtatcaatctacatctatagccaatttagccacgtgtgtgggccaacttttatccgttgaataagtgcttcaacgtataattaaagacttttgaaactcttatatggacatataattaaatgacttggcctcaacgtatacatcatagttttatatctcatctctaccttccatagaaactcatttgaaacttttgggcagagagtctgaacaatcgctttgttgtcgtcaagaacgatacgtccctataaatgtaagttattttgtttctctaaattcagaaatatcccacctaaaaattcgactgtttggtatttttagtaacaagcttcatgaataatattggagattttcttggataaattattgattttcatctaagttattccaagtttatgaatttcccactcatcatatttagaagaactttgattttttttcttgggtggcttttgggtcaaaacaaaagaatgataaagtctcattattattttgagcttttgttcatgtactgtgtggtcaaagacagtaacataaagtctttgttggctttgagttttagcgtatacgcgtaagactggttttaacattttcaatagttgactaatctctattttcaattttgttttcgggaaagttcgaggattcttcaaaatttattgtttatatgaatctgtttctgtttaaacgttgaacatcattttctttttgtgtttatcctctgtgattaatctctttgtttgtttctctatcaatagtagca

SEQ ID NO: 8509 - DNA, 3000 bp, Unknown; identical to SEQ ID NO: 8502
  misc_feature (1)..( 3000): cDNA_ID_3045638_gDNA_ID_1971813_Annot_ID_175846 3000 nt of promoter + ATG

SEQ ID NO: 8510 - DNA, 3000 bp, Unknown; identical to SEQ ID NO: 8500
  misc_feature (1)..( 3000): cDNA_ID_2107183_gDNA_ID_1971813_Annot_ID_175836 3000 nt of promoter + ATG

SEQ ID NO: 8511 - DNA, 3000 bp, Unknown; identical to SEQ ID NO: 8498
  misc_feature (1)..( 3000): cDNA_ID_3094008_gDNA_ID_1971813_Annot_ID_175829 3000 nt of promoter + ATG

SEQ ID NO: 8512 - DNA, 1350 bp, Unknown
  misc_feature (1)..( 1350): cDNA_ID_2177068_gDNA_ID_1971813_Annot_ID_175817 3000 nt of promoter + ATG
attagggttttagatttgggactaagttattcaatgtcccattagcagaattgatttctcttagtgcttaataggattgaacaaagtccctcaaatcttgatccatctgtcactttgtcagcagtcttaattggtttcttgctgatcattatatgatgggaaataacatataatctcgattttgattaattggtagaattgcttaatattggtcgatgaggataagatgaaggcttgtttctcaaaacattcgcagtggccgcctaaggctttcgcctttcgccgggcttgagagcttatgatgtttttatccttccttggatgtctgagaccaattatgttttagttagatgattgttgctgttagttttcggttgatgaggattatattaaggcttgtttctcaaaacattcgcagtggccgcctaaagctttcgcctttcgccaggcttgagagctaatgcagctttatccttccttggatgtctgaaaccgatgaatgttttaattctcgtttttatgtttttgtctgtaagaaagatcaatgatgataaacttaaggcttgtttctcaaaacattcgcagtggccgcctaaagctttcgcctttcgccgggcttgagagttaatgcagcttttatccttccttggatgtctgagatctttattcactctatcgattatcttgtctgtttaggttattccttctagtagattattatcgtctattttttgtgttgaatttgcaggtaatttcttggtggtagcttcttcgctttactggcttttggagaaagagttccttacgtttcctgtaatttcctttaatctgtaaaaatcattgtcagatttatttacaatctgtaaagagttctttgttgtaaacaattttgttcattggtgatgaaattttgttctcattatgaattttatttgtgatgaaataccgtgattcctttatttatcaactttgaaagcttattactgaaaactttgtttgagcttcaaagaatcaatgatctctgaaagctgtaatccacattcaacaaataacactcttatatacaaaaaaaaaatactcgaaatttagaaattctatgtttacaagttacaatagttaggaaattgtaatttcaaatcaaataagctaaaaagatgttattattaaaatgttcagacgaattaaaccggacctaatttgcttggtcttttggccgctgaccttgtctgattgatcgggatttttgtacggcgaatcaaaatccaccgaacaaaccggaaggctaggatgctcaagctttacggattgacttagagagagatcgatttgaactgtgtcattttgagcatg

SEQ ID NO: 8513 - DNA, 3000 bp, Unknown
  misc_feature (1)..( 3000): cDNA_ID_3045962_gDNA_ID_1971814_Annot_ID_58173 3000 nt of promoter + ATG
atgcatgccagttaagtaacagatctagtactacttttctcttaaatgtacgtaaagagagattaaggagttgttattagattgaggtttttaatggacttgaattggcttgataatatgtgggtttgattttaaagttcaatgttttacgtacattttgaaatacttgataaaatgtttggattgttttttcatcttttatgaataaaaatacattcaaatcctataagattttgattatttttaattagaaaaaaattaaaccctaagagaaaataaggaacccaagcaacaatttataaaaatttttagttctagtttgtaagtttaacgaaattattaataataatggtgtgattcgagggaagatgtttgtgaagttgatgtagacaaagaaataagatgtgagaggtgaaagataaaaagtagtcggagaagatcgcatgagcttagaaacgaagtctcggagaattcctataagaaccacacgacggagagagggatcaaaacccagtctcagatcgccgtgtcaagcaccagatctcccgccattgataagtctcttttaacggtctcttacctcaatccaatatcaaatcgagacacaaccaaattggaccaaaagaaccgaacttaaaccgaagaatcagaattcgatagaaataaaccgaattaatttcggttcggatcaattttatcaacccgaaccaacaaaaacccggaaacatttacagctaaagacttctcatgtctcaacactcgagagctggactcgaaaattcatctctcaaatcctctgaaaccctaattcctctctaacgtcaattttcttccggagaacagaaatggcggaatgtccgacggatctcatcaacgaaatgtttctccgtctcagagcaactacgctcgtaaagtgtcgcgtcctctcaaagccttgcttctctttgatcgacagtcccgagttcgtctcatctcatctccgtcgcagactcgaaacgggagaacatctcatgatcttactccgaggacctcgtcttctacgcacggtggagctagactcgcctgagaacgtctccgacatccctcatcctttacaagccggaggttttacagaggtttttggttcatttaacggtgtcatagggttatgtaactctcctgttgatctagcgatctttaatccttcgactaggaagattcaccgtttaccaattgagccaattgatttcccagaacgtgacatcactcgtgagtatgtgttttacggtttgggttatgattctgtgggcgatgactttaaagttgtgaggattgttcagtgtaagcttaaagaaggtaaaaagaaatttccttgccctgttgaagtcaaagttttcagcttgaagaagaattcgtggaagagagtgtgtcttatgttcgagtttcagattctttggatttcgtactattaccatctcttgcctcgtcgtggctatggtgtggttgttaacaaccatcttcactggattttgcctcgaaggcagggagtcattgcctttaacgcgataatcaaatatgatcttgcctctgatgacattggagtcctcagtttcccacaggagctttacattgaagataacatggatattggtgtgttagatggctgcgtttgtttgatgtgttacgacgagtatagccatgttgatgtttgggttttgaaagagtatgaggattataaatcttggactaagctgtatagggtgccgaaaccagagagtgttgaatcggttgagttcattagacctctgatctgttccaaggacaggagcaagattttgctggagattaacaatgcggcgaatctcatgtggtttgatttggaaagtcagagtcttacaactgccggaatagagtgtgatagttcatttaccgcagacatcctcgtgagtagccttgttttgggatgtaaaggagatcctactcaagctcagcgcagtaaagatcagaagatgatgccaaagagtactaaaaggtggtatgcccttctctagttagtgttttcttacgcagtttgtttccatgaagaattgtagaaagggtttaaccgtatcaacatgcttaaacatcttgtgttacattctcagggatggttttctgtccaagggattcaagctgaagctatgagcaaagcaagggaaacttctgagcccaaacattagattaaggtaagtgaaatggatctaaagatcttgagtatttccttaagttggcatcttcttttctttcgatgtgagatttccaatcttatcatagtttaacataaacaagcttaggagctttatctaaaatctgactatttcaagtgtttttgagtttgaaacatgtagaagaaaatcttgatctgtgtttgatttcaggtacagtaacagtagcagtggcagggggaaaggatatggcaaaatcctaaacccatgtgagatcttagtactaataagcttaaccctatgtacgtagtatgatgtcgtaaggaaataataagatagtgttcttctatatgtaatcgactgaaatttatatgtaaaactcttatcagtatggtcttttgcaatttgatatgacttgaaactatcaatctcaatcaaaagtaaatctagtcgcaaatattgttgatgaagaggatctactagagtttagagaacgcaatgttatgaacgtaaatcgtctatagctaaacctaaacacaacatcgtttatttaaaagagatgtcaaatagtccaaattggacaaacataaaccgaactaaaccgaaataattgaaataagacagaaataaccgacatcaaaggtcggtttggtcccagattcaccaatccgaagcgaaacccgaaaacccgacccgagtcatgtttctatatatataccttcttctttttttgggttaaggacagatttgtaaacattctcaaatccttcaaaaaccctaatttctttctgtgagcttattgagaacgaagaagatg

SEQ ID NO: 8514 - DNA, 3000 bp, Unknown
  misc_feature (1)..( 3000): cDNA_ID_2040236_gDNA_ID_1971814_Annot_ID_58180 3000 nt of promoter + ATG
ctatatgaaaactagatgtgtgtttcttatatcctttctacacttgtcagtgatgatatgtaagaattaatatcactaaatgtacctctaaagtcgaccaaaactagaactcacatctttatcaacaacatagagaaccttacgttttttggtttcataggtaggtacaatggtaagtcagtcgcaaggagcaagtgctttattttgggagagaatttacagcagccttggttgtcttgcagatggtaagtgtatcagacaaatctttgaaatcgtcccttgacaagtacacaccgtagtccaaaagtctagtaatctgagcctttcttcattgtccatttcatctaccgtttgccaaaatcagatgataacgtcatcgttcttatcaaatccatcatagaatgtatgcgctctccactagtctggacatatattttctcataaaatcaaacgactctacactctttggtttcgatacacttttagtacaatcatcttcttcattaggacacgaaggaattgtcattctagttgatcgtatgcttactcatatctgtttttattgccataaacttctttttgcatgtcatggctaatatgtgaacattagtacaatcatttaagttctttttttcctacactgataaccaatttattagtctttagccaaattaaataaaatataataactaattttgaaacatgtaatgactgaaaatgcaaagaaagaagacaaagatggtatacaataatagccttttaacaatttggaattttgatgataagaatgtttggatttctatatgggaactgtgctggcctagcagacataaatatagttaagatatttttcaaaataaaaaaataaaatgaagatccttatttcgaaagtaaatgtaataaagaaatttattttaatttgattttaatttaattttaactatcaaatttttataagacgaagaaaaaattgagaaattagcatttgtccctgtgctaggtttgaaaacatttttaaaatctggatccgacgtttaaaattctgattttttttatttatagatatgaaatatttaactcatttaagttctacttctagcaaagaaaaaaaaaaaaaagtttctacttctagcgaatcagttcacttgaaaatgccaaattgagttcacgggaccatgcacatgtatgtatatagtttacgtgacaattaaaaaaaacaaattaaactatattgatgtgaatgatttactatataactaccacattcacatcaattcaaatctgaattactacaaaacaattgattaactagggattatctgctaacaagaaagaattataacaagctaatgacagttcatcgcaagaatgatgtaaaatttcactgtactagtgcatgatgtaaaatgatagtatgatatttctgttgggtaatgggtctatcagttagaaagcagaaacaaaatgttttggagatcagaattgagagagtacgttcattttgagacaaactccaaacttggaaatccaaattaaggtcctgtttgtttgtccatttggatgaaccatctcaatgaaaatgaaaattgttgtttgtttttcatgttttaatagatcatttgaatgattcagttgaatgcttttatctaaactcatccaaaaaataaaaaaaatctgactgagtttgatttgttcattctgctgaagctgatttagccaaaattataaaatgtcaataataccctaatctaatatatggaattacacccaaaaaccacatctcttcttcaccctctcctcgacacaaaacactcaaaattgagattcatagccgtcaatgatgctgattcttcgccggtgatctcgccgtcgccgattcttcactggagactcgtcggatccatcgccggagtgtagcaggtttgtgtttctctctctctctctctccctctcttgcttcctctctctcgctccatgtctctctcgttgtttctctttgtatccttgttgcaatcacttgttcttgggtttgatccaccatggttacattgtttaattgtgggtttgctttactttgctttgtgttgcttttgattcttcgattagctttagtttacggcttgtgttccttatattgctttgtgttgctttgcttgctttgtgttgcttttgagtcttcgatttgctcttaagaggctttgttgtctctacattaggagcaacagaaccatttggtgctgcgactttagcatctgcactttagccctctttagattgaccatccatagttacaaacctcagctgcctccttgacgtgttcaattgcatccaaagtggaattgtttttgtgtttataggtcttttgtatttttgatgcagaaagctaggatccagattgtgttatctgatttgttttgagatacaatgattgatgatgttgtgactcgtgtatagctcattgatgaaaaactttgcattagtctctatttagtctcgaagaacaagtttggctctgagttttgttgattgatgatgttgtgactcgtgtatagcttataactgcttatttataagggagaatttcatcttataaaagattttttctcttcagtccttgtttcagcaagttttgtctccaagtaagaaagctttggtttctcaggtatgtcctctataaatatattgctttcgatattcaatagtattaattagtggttgcatttggctttctgtagtagtagcatgagttcgtctaaggtttgagttcaaatactgtagaaatagtcaagaataatatctcatgattgttcaatatcaaatagtttttctttgctttgctttgttatctctgatctttgtacacgttttatttgctttgctttgttatcataagttgtgtattgtttgctttgttatctctgatctttgttttatttgtttggtatctttgatcttgttctaacacaactacaaaacgtttgttttcattgtgtgctacag

SEQ ID NO: 8515 - DNA, 3000 bp, Unknown
  misc_feature (1)..( 3000): cDNA_ID_1823032_gDNA_ID_1971814_Annot_ID_58186 3000 nt of promoter + ATG
gccgattggtactccaagctcgccgctctctcccaccgtcacaatctcgcttgggacgccggaaccggaaacggccaagctgccatcggagtatgtattttctcctccctctctttcttctttcttacatttcccgatctgaaatctcgtaacgcgaatctctgattttttacgacttgttgcttagatcgcggaacactacgaaagagtcgttgcgacggacgttagcgagacgatgttgaatctcggaaaaccgcatccgaaagtaacgtaccaccacacgccctcgtcgatgacggaagatgaaatggtagatcttattggaggagagaactctgtggatttgataacggtggctaccgccgtacactggttcgatctcccgagattctacgcgatcgcgaatcgtctcctccgtaaaccaggaggaatcatcgccgtgtggagctacaacactgacatggtggtgaatcccgagttcgactcggtgatgactcggttcatcgctgaaacgttgccgtattgtaaattcccagagagtcagtattttttggacggatataagacgttgccgtttccgtttgagagcgtgggtttgggctcagagggaaagcccatggaactggagatgaagaaaacggtgtcgtttgaaggattcttgcggatgctaagatcgtggtctgccgttggtgctgctaaagaaaaaggagtagacttattgtcggacaatgtagtcaaagagctcgagacggcttggggtggttatgagctggttcgaaccattgtttacaagacgtttatgctcgcaggaaccgttccttagaaactagcttctttttaatttggtatggctaagtctgaaacttgatatcttaagggtatttgaaacctcatgaaataacaaaaacaggataaacataaaaagtttattttaccttttcatcgaacatcaaaacgaacatgtgaaaacgtttgtaatgttttcgctttatttcaacaaacatagattgtgataaagacgcatatgattattagagaaacatactttgcaccgatatatattactgaactggtttgcttatttagtcttatgagaagattaagggcatctgaaaccaagtgggggaattatacggcagagtctaagaacttggttaactctcacattgatagtcaagaaattaaagattgtgattctaacggcattgcagatgcaggcagatgccgtagcagcgtcaagcccagtcactagagtgcaacatggcaatactgattgattgttgatgaggattaagctgaggttaagcacgttagtacaagataggaattgggtcgagtctctgggacacaccggagcttgaggtggaggagcttgggcctttgtgaagacaaggaagacgaggttaatggtgaggaagagagctatagcgtttttcatcatgttctttgaagccatgttttgaaaatgttaattatgctctctctcttttgtttagttctgagaggagtattgagtatttagtttgggaggtgagagtttgtatttatagttgttagaacatttggttagattactgtttgatatttcttttggatgaaagtttacaaaaataaaaaataatgccaacttttcggaaaattaatttgaatttcgcattttagccaaaagtaaaaaaagaagaagaagatactatataatcaactctcaagatatttaaaccttatctactcatctagagaagaggttaggcaaggaacaatttgtcaatgcccaaaacaatacaaactctatcaaagttgttattcttgctgaacgcacactattagtattaatttaacaaatgtcttacaatagagttttggtgaccaaggtgtaatttgaaaatttgccaagtctacgaataaaaggtttggcgatgaaattaatgtaaaacgtctacccaaataaagtcaaattccacattccataacgtacttaatcggtcatcaaaatttgcaatagaattagtgatttactcatattcatatccaaagttctattgaatatgaataaatttactcatatgagtcatatccaaagtcccatttagtcgataatttagtaaatttctataatatatatggatgaacatctcagtattattatttttaattctgattagttaaaaattgttatagatgctaactgtctactcttattgtgattgaacaaaataaacaattaacactggccaacgtcaattcttcttcctttgttttttttcataactcagggttttgttgacgaatgagttttgttgaattaaaacatttattccctacgatactacccctaatcaggactttataaaggatacaatttacattcatctctttaaaatctttgttgaactcattgctgtaaatctgctaaaaaaagctcttagcatgggattattcagtttcttacttacatttaatgtgggaagcaatctctaggaagaggtatatgttctaattgatattaccaatcaaaattgctccagagacaacctagtggaaacatgtattttttgccttttccacttctctcattgctccagagaatgtaattctcggtgactagctttttgagctcattaattatgacacttggtagatgctagcatgtagagcaattttcgacgttcggctggtacagtgatgtttgtttgtggtaggcatttggttcaatcaaacatgaaaaagatagtaatagctagaacagccgagcatgtgaaacacaatccaagattcatttatttcaaacataacataaagacataattacttttttttttaaacacatatagttgcaccatgaaccgatattacggaacttgtatacttattttagtgatcttattacatataagattctgcatattgtttacttataaaaggcagttgaaaccaggttgtaccggcaaacgacagagaccaaggagcccattaagcctcaaattgaggttgacggtgatg

SEQ ID NO: 8516 - DNA, 3000 bp, Unknown
  misc_feature (1)..( 3000): cDNA_ID_1823020_gDNA_ID_1971814_Annot_ID_58189 3000 nt of promoter + ATG
aagaaaaaaataaattatcgtggcgactgactgatagacagaggctcaaagctagtgacaaaaacaagaaagcgtggggagtggaaagccgagcctcacagaattacatagacccaagtgtacttctaaatatagacttctttgaacaattacattcatcatatagtttcacactttttgtttgtttttcaatactttcacaaacctctaaatatggacatctaaattctagtgaattttatgagtttagattattttttttcagaaatatcgtgtctggaatgagcttttgaggtaacattcactacctgaaatagatgacaaaaaaaatacactacctgaaatatatatctgcatttatggaaaatgacaatatattatagtataagtttttggtattgaccaaatatttttaaaatggactggtttgtttactttaatgttaattttgtttgatacgatactttaggttatgataatcttatttagatttaatttgtgatttcttatcataactatgaaaagtgcatatatcaatttggttactagacaaaataatatcaatcatctcttgtaatttaagattgaaataattattggctatagttttagtaatttatattaaattttcaataaatagtattaattctaataattatttttgaatgacaataatgaagctgtaataaaaaatctaattagtagttttaatattaccggaaaccaaacgaatctaagttatgttggataagattatataatattacaatggtatctaagttatgttggctgcaagagaatagagaaagaaaaaattgaactctggcccgtgtgagacagtgggacaacaagccagtaccgggtcctccacgccacgccacgccggtccactgcctcaaacatcccacggtccatgctatttttgtaataaatgagaataacaaacattatgcttttatacatctgacatcaaatttataatttactgtcttattacattttgttgactccacagcttttattactcttttcaaatctatggctactcttttcttgtaaataatgcgaaaaatatactcacattgactagacaaattactcgtacatttaaacgatatatagtttgatgttcgatctggtatgataccaaatataaagaacttttcgaaatccatttgcacgatctacaactatttcatatatgttgtaggagaccgatttttggtaagattgttattctttttctcgctattggatatgacctcataccaataaagttcacgaaaaacttcagaaaccaaaaacattaatctaatgacttgttaattatttgttttgccatcttaaaaattcattggagagaactattaataatttgaatgagttactaatctaacatatttgtttgttttcgtctatcaccagaatagtggcatgttattccaaaaacaaaagtgggcttttccttgatgtacggtttgtattaactatttaacctagtgatttatttttcctcaatgataagtcattttcgtcaaacaaaatacgagaaaaatgattatagtgttccttttttaacttggaaaatctgtctccctgtttaacctatggacctaccaattttcttctaagcttacatataaatatatttgttaacttttgattaactagataatttgatatcatgttataatagatttatgcaaatgttatagtattatagtaccatcagtttagatatctaaaccagtttaatttaattcaaggtttaaagtttagatttgattaatgagtttatgattttaaggtttaagtttacatttgatgatttggatttaaaatttcagatttaaactatttcaatctcataatttaagatttaaatatagaaagaatcaaagtgagctattaacaatgttgctgtgaaaaataagtaaatgaaatgtctcgaaatttagaaatttctgaatcacatcacactactgattgaatattcatttcttttaagattttttcgaaacatgaaatttgtctacacgtcagaataattagataagactttatatgctgtaatcaattctcaatttttttcacaaagtgacaacctaacatctgaatctaacttgaacacgtctttacaacgaatcgacgtcaatttgtaacaaccggaaaagtttatgtagtctataaacactattatcaatgcatatataaagtataaactatagaaaacaagagactacaacaacaaaaacacagtctaacaaggtgatcacaacctgatttgcgtactaacaagagtttgaacaatggctagagataatcagattcatcaatgatctaatgtcttgccttgatgctgctccagagattcaaggagtgataggaatgctcaatggatgtaaaaaagagcttctgtttcgtaaaatctttaattctatgacaataagagctagtatgttatataactctcaaatgagcttgaaaatcaagctatatagttaattaatgtagtggacctttctctacttaaaataaacaaaaacaatcctctttgtaagagtatctaaattaagcacaaaatcaaagatcaccacacataattccatttataacctcttaaacataacaaaattacaatcaaaagccatcgtcttaaattttcccaacttcgttcccaacctctttctgattcaccatcacacaactatataatatatcacacattacacatacaatgtatatatctaagtttttccacataaagccatttacaaatattcaagcttactcagtctcacatttaagcaacctctctctctctgattctctctttctctgagaaaaatctcagtttctcagagctctcaggttcttttattcttcttcttcttcgatttcatcccccaaatctgcatgctctggatcttacgaatgttgctttgtagttttatgatctgagatcaaattttaacaaatccgtcaccggagacgaaaatg

SEQ ID NO: 8517 - DNA, 3000 bp, Unknown
  misc_feature (1)..( 3000): cDNA_ID_3091476_gDNA_ID_1971814_Annot_ID_175878 3000 nt of promoter + ATG
gtttagctatagacgatttacgttcataacattgcgttctctaaactctagtagatcctcttcatcaacaatatttgcgactagatttacttttgattgagattgatagtttcaagtcatatcaaattgcaaaagaccatactgataagagttttacatataaatttcagtcgattacatatagaagaacactatcttattatttccttacgacatcatactacgtacatagggttaagcttattagtactaagatctcacatgggtttaggattttgccatatcctttccccctgccactgctactgttactgtacctgaaatcaaacacagatcaagattttcttctacatgtttcaaactcaaaaacacttgaaatagtcagattttagataaagctcctaagcttgtttatgttaaactatgataagattggaaatctcacatcgaaagaaaagaagatgccaacttaaggaaatactcaagatctttagatccatttcacttaccttaatctaatgtttgggctcagaagtttcccttgctttgctcatagcttcagcttgaatcccttggacagaaaaccatccctgagaatgtaacacaagatgtttaagcatgttgatacggttaaaccctttctacaattcttcatggaaacaaactgcgtaagaaaacactaactagagaagggcataccaccttttagtactctttggcatcatcttctgatctttactgcgctgagcttgagtaggatctcctttacatcccaaaacaaggctactcacgaggatgtctgcggtaaatgaactatcacactctattccggcagttgtaagactctgactttccaaatcaaaccacatgagattcgccgcattgttaatctccagcaaaatcttgctcctgtccttggaacagatcagaggtctaatgaactcaaccgattcaacactctctggtttcggcaccctatacagcttagtccaagatttataatcctcatactctttcaaaacccaaacatcaacatggctatactcgtcgtaacacatcaaacaaacgcagccatctaacacaccaatatccatgttatcttcaatgtaaagctcctgtgggaaactgaggactccaatgtcatcagaggcaagatcatatttgattatcgcgttaaaggcaatgactccctgccttcgaggcaaaatccagtgaagatggttgttaacaaccacaccatagccacgacgaggcaagagatggtaatagtacgaaatccaaagaatctgaaactcgaacataagacacactctcttccacgaattcttcttcaagctgaaaactttgacttcaacagggcaaggaaatttctttttaccttctttaagcttacactgaacaatcctcacaactttaaagtcatcgcccacagaatcataacccaaaccgtaaaacacatactcacgagtgatgtcacgttctgggaaatcaattggctcaattggtaaacggtgaatcttcctagtcgaaggattaaagatcgctagatcaacaggagagttacataaccctatgacaccgttaaatgaaccaaaaacctctgtaaaacctccggcttgtaaaggatgagggatgtcggagacgttctcaggcgagtctagctccaccgtgcgtagaagacgaggtcctcggagtaagatcatgagatgttctcccgtttcgagtctgcgacggagatgagatgagacgaactcgggactgtcgatcaaagagaagcaaggctttgagaggacgcgacactttacgagcgtagttgctctgagacggagaaacatttcgttgatgagatccgtcggacattccgccatttctgttctccggaagaaaattgacgttagagaggaattagggtttcagaggatttgagagatgaattttcgagtccagctctcgagtgttgagacatgagaagtctttagctgtaaatgtttccgggtttttgttggttcgggttgataaaattgatccgaaccgaaattaattcggtttatttctatcgaattctgattcttcggtttaagttcggttcttttggtccaatttggttgtgtctcgatttgatattggattgaggtaagagaccgttaaaagagacttatcaatggcgggagatctggtgcttgacacggcgatctgagactgggttttgatccctctctccgtcgtgtggttcttataggaattctccgagacttcgtttctaagctcatgcgatcttctccgactactttttatctttcacctctcacatcttatttctttgtctacatcaacttcacaaacatcttccctcgaatcacaccattattattaataatttcgttaaacttacaaactagaactaaaaatttttataaattgttgcttgggttccttattttctcttagggtttaatttttttctaattaaaaataatcaaaatcttataggatttgaatgtatttttattcataaaagatgaaaaaacaatccaaacattttatcaagtatttcaaaatgtacgtaaaacattgaactttaaaatcaaacccacatattatcaagccaattcaagtccattaaaaacctcaatctaataacaactccttaatctctctttacgtacatttaagagaaaagtagtactagatctgttacttaactggcatgcatcatcaacattaatcttatgtttgttttgttgttgaatgagatatttcccatccaccaagggtttgttgtatacttgtatgtgcaagagatatgttgactagactatcagaagaattcatacgaaatgtttttgtagatagagtaaagcagatataaatgtgagtgtcaaacaaaacttaacttgtgaaggtatgttattccaaatttcccaattcaacctttacttttgtgtccttacgtctccaaaaaattattaccgtctttggtaacttgataacgtgacgagc

SEQ ID NO: 8518 - DNA, 3000 bp, Unknown
  misc_feature (1)..( 3000): cDNA_ID_2040236_gDNA_ID_1971814_Annot_ID_175884 3000 nt of promoter + ATG
tgtttgatgtcgtctaaggaaacactttttccgactcatagcaatgcatacgattgatcacaatattgtctatatatgaagtcaaaagtaacaaagatgagaaaatttttgaaaccataaaaaatgcgagatctaatcattgatcaacttgaactaattttgtacttgaatttcatatatttaagagacaactggatatttgactttaacaaaaaattttagtcgatgttccatttcagaaaagatatatgaatatgttagcagaatttctgaaagtgagatagtaactccataaatatattctttgttaattaataatataaaggatatgtggaggttttctggaataatggagtattagttaacaagaacaccttcgtcaaaatgttagcaaaaaagtttcggtataggaatatgttagcaaaaaaaagtttaagtgaaatagtatatttttatttcattataagatgcattcctagttcaaagtattacctaaaacatcatttattaaatagatattattaattttagaaatagatatctatcaccacatattggaacactttggttatttgatatgttaaaaataatcaatttttttttgtcatctttaaaaataatcaattagttaattaatatattagacatgtatcgagattttatggaatagtggcgtattagttaataaagtgagcacttttcggaaatatttgacacataaataaagtaatataaccattaatgtgtccacattttatccaaggctttcttatactcccactatattccatttttttttcttttaacatctactccttatattccatattattagatattttagaaattctcacttgttacattttatttgattttctaaaacattatgaataatttatatttgtttactctgttatgatcatttatattctacaatttatttttattgggtagttttttaaaataaatgctaaataatatattttatgttagaaaaataaaattccttatttttaaatagaaaatcttataaaatggaatagaatagtaaatgtttagtttttgtagtttatagttaactagtgtgtgtagttcaaggttctcaaaagcttctcataatgacacatcataccatttttgtgaaccattatctttttcttgtgagtaatattttttgatattttctcttcgtctcattcttatattatatcgagaatctcagtatctttaaaatattgatacatagctacgattccgaactaaaaaaaatgtttaatttcgaattggattggaaccgaaatcacatagccggtcggtttttataaattcgattatattttctttcgtattcggttatctcgggtttagttcggttatattggtccaatttgagttagttgattgtaatttcttcaacggatcgatgaagctcaaagaggaagtagagagaaacttacttatcaatggttggtgctctacatggcgatcagagattgggtttagattcctctcttcttcgtgatggttcttattggaattatccgttacttcgtctctaagctcaagcgatattctccgacaccaaagaaaggtgagtcgtttctctccttattggtcgccacctatatgtgtatagattgtttgtcgaattcatataaaattttcggagtctaaaatacttttgctatttgatcttggtccaagcctgatttttatatcattgcatttgaggaatgtcctgagaggacaagatccttgtcttgtgcaagaagccattgattgaatagaagctatttaaagcgttttgtacaattgcatttgcaaattgtcaagaactcaagtatgaagactggataaaaacctgctcctactttatttgtgtggactcatatatccatatgaaatgttagtcttcttttcctcatattacattttatttaaagtatttctattttgcaggcttgtgagacgctcaagttgtggtccaaggcatcatggagatgtgttgaattacattcttagatgtttctaaatcaatctagttcaccggtcagaagatgccattatagattttgtgggcaaagcatgtaataggtgtgcatgctaatatactccacaaatgtagcaattgtaagaccagacaaactacgatgcagattcaagagaattggttttcagcagagcatatatatgattagaaggttaccaggtcatgtggcaattgtaaaacagtggattaaggtactaggacctacctactgtaagtgaagttttgtttttcaaagtcctttgatttgagtgtgatctatacatgtgaaaactcggatttatctaacccttgtaaactgttgataacacataaggattctttgcatattcttagcattgaccggtttgggaaagctttgttggaagcatggttgtaagagaggtcagattcttctatagagggtggttgcagccagtgtgagtcactagctaatgaactttgcgctcatgaatctaaaagacagcaacaccatgaagaggtcaacgaaagtaccttttgtccagctcaagcaaatgctgataggttatagaagattgagtgcaaaccactatcattgatgttttgtttctaggcttgtagccacgactcgagaagagtgtaccttgccacatttgattggggctgccccggtctgttattgtgtaccaactggcattgatgctcttcgtccatctttcttcttcttgttagtttggttagagcatcgtatttcttaataacaattttgagggatatatattgtcaaaagtttttaggagtttggggcttcaaatcagagatcttatgacaacacaagaaatatcatcttatttatttatatatatatatatatatatatatatatatataacaatctttgtgtgtttctgagtttatttatttatgtgttaatcataaaactgcagagatagcaatttatttacataatgtcaaacataatgtcaaacata

SEQ ID NO: 8519 - DNA, 3000 bp, Unknown; identical to SEQ ID NO: 8516
  misc_feature (1)..( 3000): cDNA_ID_3091451_gDNA_ID_1971814_Annot_ID_175893 3000 nt of promoter + ATG

SEQ ID NO: 8520 - DNA, 3000 bp, Unknown
  misc_feature (1)..( 3000): cDNA_ID_1838731_gDNA_ID_1971814_Annot_ID_175898 3000 nt of promoter + ATG
acaagtacctgacaaatatattaactagtcattaattttacagagaaattgatttgttttatcaaattaaataaatcatatggcagaaattgacagaacagaggaatacaacaggaaaaatattaaggaaaatgacttttttggtaaggaaaaagactttaaagatgtgaaaaggagaggagcaaaaaaaaaatgagttagtgggaagaaaaatggttaatggagcacaactaacactcgtccacaaaatattatgagataaatccaattgattcgaccgattatagtacactccacaatctattactatcagttttactactttctttttgtcccttctttaattaatcgataccttattttctttaacctcatttccaataatttaatggattttttttcctcaaaaattaacatttttaaaaaattttacttgctaataatatttaaccttttattctagaaataacaagaaaatgtataagtgatttgttgtccataaaagtattaaaatttgttagttttttttcctttaaatgttaggttatgattttttttattttaaagtgatgttttaccaaattaccttttgcttttaactaaagaattttaatatcaggccattttaaaagcaacaaaatcagttttttgtgaacttcaattttctactgctaaaaagtcgatttcagaacttaatgtgttcatttcaatctttcgtttcttacatatgtaaatagctagactagcttaataatagaaataacaaatataccattttagtacaaaagtaaaagtggagtcacaatatgcttaccaaaagtggtcatatgaaatctagacatcatctaaaacacggaataaaagagattcgcctacttttgcagcaataacattgttgatgctactcgtatatatatatatatatatataattgttgattatattgatgttatatactataaccgatatattgtagtataatgggattctaggttatgaagataccattaaatgtatgtaagacgaatcacgctaagtattggacacctttgtcccaagttagattttgagcgatttagtgcaataattgaagaaatagacagaataaaaaacgaaaagaccggtggaaggttaaataggtaagatgcaaattccaattgaagagtggcctatcaaaattcaaaaggtggtgaacttttatcttattctaggccatggacaggtctaattaaaagctccataaaaatataaaatagataaaataaaatctaaaatagtaaagaaagaaacatcgctttcattttctatgagttttcgttacatatattttgaatatttttttatctttttagaaataaaaaaatgttccaaaaacacaatctataaccagagatttgccacactcaaaatcccactcggactttgtgcagtaaagtgagttttagatacgagagttaggccaaatctagagggtcttggtcttggtcttgctcaaactagttgatgatattagtttagattttatgtttgacgataatatcattgattttctaaaaagacaatcatttaagccagtattttttgtataacaaatgaatgacgggaacctaattcgagtttggtgttgaaatatctatcaccgggtttggatatgggttcacattttttgattcgttgatttaatagctataattaagtagaactatctcccacctttgcatgttaaggtaatatacacgaaaaagcagggtcgtttacatatattgtgtaaaaacacatagcatgcaatacatataatcaaatagtataagttagaatttactaaggtaaatgttatcgaaagttgtaaagcttaaaatcgcacttattcattctccaacttgggtttgttgactatttctttccaaataatcggagaaactctaaccacatgtttactttttaataattataaggacaaactgaaacaacaaataaagaaaaaggagttcaagcttattctaaatttctaatctacaagataagataatgaaacagaccacttgtctctctgcaatgctatagctctcataatttaacgaggacacttcttcttttaagctttttgtatttattttaattaacatgagaattatttggggatacaaaaaatcgagataatccaatgtttgaacgacacgtttaacagctttgatcatgtcttttaatgagacatagattagatatgtcttgtactagtcatcaaaaaaaaattatcttaaattttattatgttgctcttttttttgttaacgttttttaataattgatattattctatttttaactactattatgtgttactcgatttgataatttgaatttatatgagatctttgaaatgtgttgtacgattaaatatttaaattactccattacattttttatacgttgaaaatttttaaactactctattagattttcatgcataaactatgaaaagcaaatcatccaaaagattatgaaacccaccaaaaaaaatcataatggttatagtattgaacatttatataaagtatcataaataatataaaacctattctaagttatgaaacttatacaaattattttaatggcccccttataaaacctattctaattatatactttttggattttggaagattttgttggacgacatatttatagaagtttatttattatttattactaattatcttattgaactttacagttgtacagagagatttttaacacattttaaagcacactacattttaaagaacagagaatctaaccaatttttttcttttcttttaaagatataaatagtggtaagagtagtatgactgcttcactttctctttctcttttgttcaagtagtttgggagagagaagagaagaagaagacaccctttaagcaaaacagaggattttcattctctgttctgtttgaattattactaatctatcatcttgttgttctcttcgtcgacaatg

SEQ ID NO: 8521 - DNA, 3000 bp, Unknown
  misc_feature (1)..( 3000): cDNA_ID_3091458_gDNA_ID_1971814_Annot_ID_175889 3000 nt of promoter + ATG
tcaccaccatcaaaatttgtatataaaagtgaaaatgtataaatttagcctttgatgtcattgatgaagttatcaccaccatcaacttcattgatgatttttttaccaaaaaaaaaaaaaaatcattgatgatgttttgtttcattagtattggaagaaagtaaaaaagtttgaagcgctttaagatattgtacttatatttacaagtgactttatcatctttggtaaaaaaactaccgatttcgattagatgaatataatacatgtacaagtaaaacgaccgcctgaagtcaagggtcttgtagcatgggtaaatgggtgggaaatgttccgtgaattagtcatatagatgtttaaggatatccgattgagacaatctaagttaccttggcaactacgtctctaaagttaggctctatattgaacatatatgtaattatcaactatctctagttagacgttatagagaacccttcaaaatgggccatataaattttgtggccacatgaaaacagttttaaatggtgatctttagctccattacaaattttttagctaatccatggctctttagcaacggatttgctacagaacaaaaaaaaaaaccatgacatcaagccaaaaaccaaaaacgtggtcatatggcatgggttataagagctacacacgtcaaatcgccatattttcatagagcctaagttaggcctggttaaaaaaacgtacttgttaagcttgtagggttttcaaataatcacaagattgaatatgcactgcaaatcggaccatgcactgaaaatagatatcattatctttcttcttttttttttttttggaccagatgcatttactttatgaaatgaatacttcttttattatttttggaaaatagaactaaacaccatgatgcctatagtggcttctgctggttttgagctagtggtcactggaccccgaaaaattgaagtaaaaccaagttttttatgaatgaattcagagtatggaatcacatacttctgaccatcactttacaagacaatgacgagtaacctcatataaacaataaatatgtataattaattaactatatatagattttggataacacttctatatattgatctttttattgggttattatttgtaaaaatgttttaattttgttattaagtaatagtttttgttagttttgatgatttttatgtcgaataaacctgtaaattaataaaataatacgttgtcgaaaatgtatatatgtttggatcatatttcgcaattttctttttcatttcaacatatcatatgggagacaggaagagacacaaagtgttatactttatttaatattattcttcatagacattaatagatatgcttaacaactttttagtaagcatcgatagtccttataattacgttctaatcaacaacgaaacacacaccaacactgtaaaacattaatagataaacccatacttttggtaccagcaaacttatagtgcaaggaaacaccggatagggctcttatttaggggaattaagtagtagttactgtggtggtggacactggaaaccgataggaaaaaccctattgcaagcaaaaaagatttctctaacggccacatcaataccgaaaaccaacggaatcggcctgaagataaagcagagacaatcggttacttgaacattagtgaggccattgagggcagtgcaacactgtcgtgctctggggtcgccagctgtaacattggctaggccaaggacgttggcacatacgcctagttgcaatgggtttctgggacatgagccaaagttgttggtcggtgtaggcgagcttaagaggtttgcttctgcgaggctgatgaggaggatgatgatgagggaaatggtggttgagctctttgaggccatttttttattttattttgtggatatgaaagtgtggatgctttcgatgatgttgtgtagtatgtatttatagagccaagagatgccttggaatcacaaacacttgtgtatcatttattttttttgcctaacattactcttttttaattaatgaggttttagagatttaggcaagttgttggttctctctcttatgtacaactttacgctcaaaatgtctagtttggcttccaaggagttttttcttttgttttcagatttgttttttctttctttcatatattcaagagttcaacacaaattataaccagtatatacggtttaaatctaaggtcatgaatgtatgcatttttttatgaattgaatggatgtaattttggtttttttaacacttgatatatgaaccaacttgaaattacatatttacagaagtagatatagaccatcaattgatatagatgttacaaggaacacaatacacacaataaacattaataaataatttttcacaagtgcgtcttcaatactaattttatttcccggatttcatgtcttctaaataattaaaatttatcttccacattcagcctccaataaaattctatgtcttcgtaatctaacgaaatgaaaacttctaaaatctccatccccgtctttgtatggaacaataacttgatgtgtcaattgaaattctatgttctacttatagaaaccgatgccatgcatgatctagttttagaaggaaaatctttgattactgagggttctttcattgtctaagaatgaatatacttgaggtttaccgaagcggggatcaaacagaatgcaatcattttgtttgagatttgaatttacgtatgtaagttcttcaattacttttttttccagtaatatttgtaaactccaacgtgattcaaaatctaaaataaagacaatcaacactcccgtacaaactttattttattttttattacattattggaacaaagtatatatttagaaacaaaagaaaatcacggttaagtgtatagtaagtaggttttttagtttattgtggggaaaggaggtggtcatgggcaagtgaagcctggggga

SEQ ID NO: 8522 - DNA, 3000 bp, Unknown
  misc_feature (1)..( 3000): cDNA_ID_3091472_gDNA_ID_1971814_Annot_ID_175879 3000 nt of promoter + ATG
aagcgtcccattcaaactaatagggtcatagaagttgggtaagcgaacagggcatacaacttctttgtgaatccaaaagcctgtctcagacgaatacacatataaaggcatatacatttcacctttattaagaaacatattaccactcttaaccactttgaagctcaaaacaacacccacctcgtcaacacccgtcaccacaccacaaaagaaagtatatgaacctggacaggcagggatttcaacccactgttgtaatactggattacccacataatttttccaagtacccaactttctatgcatcaaaatcaatccattggaaccggaaaaccacatatattcgaatttaccgtctagttccatacattgaatataagaacctaacgactttgggagaccccatgtcccgcatccatggaagtctatgaattcttcttttcggagcagtagtgaccaacttgaagaggtgttttggtgcagagacacaaagagacgtcggaaatacacagattctattgccgatttccatgtttgactcactgatttgaatctggagatgcttctcaatggtaacctcactagtatctccgtcactatcccctctaaaacatctgtgatggtgttgtttggtttttccattggaaattgggttatggagagtgtaacgagagatacaaacatatatatattgaacagagacgtaaaacaaatttatcaaaagtggcttttcaaaaatataatatctatatttatttacttctcataatagttttcactagttttagagataaaatcttgtgaaaattaaaagccaaacttgaattcatgaattgcgacatatatattacaaactaccttagtattaattgttttaactattattgtactaaattaaattattaaattaccctgtagattttctgtcaaatcttatcagtttaagaaaaaaaaattaatatgaaagaatgattagaaacaaaaatgatgtttaaggaaaagatagaagaagaaaatctgaaattgtatgaagaaagagacaatcaaatatgaagtggcacaatatcacaacttgtatatattaaatctaattaaaataatgaaagatttaataggtacatttgtcaatatactaaaactataaaggttttttttgtttgtgatcctatttaattaattcaaagtgtattggatcacgagaatcggatataaccggagctaaaccaaaagtaagtcaagacctctacaaatcatataaattacagactaaaccaaatcatgaagatgcagattccaacaaccagctgatggacatcatcaagcagtggtggaggcagtggcggacccagaattgttttttacctggtcaatgattttttaaaacatataaaattactaaaattactaaaaaaagtgtcactgagtaggctcgaaaccaagttatcaagaatttgaccaactgaactagtatctcttcaaacacctcatatgcattaaaagttatttgtatatttaacctgagtcaactgaaccacctctcttcttaataggtccgccactgggtggagggagtgtataatcatggggtcaattgaccccatggattttagaaaattagtttaggttttgttaatttttacaaattgacccctttcccaaaattttattgacccccatcaaatatatattctaatataatccaacaaaaaatattaaatctacaacaagttaacccaattaattttataaataaaaatttacagctaaagacttctcatgtctcaacactcaagagctggagtcgaaaattcatctctcaaatcctctgaaaccctaattcctctctctgtcaattttcttccggaaaacagaaatggcggaatgtccgacggatctcatcaacgaaatgtttctccgtcttagagcaactacgctcaaaaagtgtcgcgtcctctcaaagccttgcttctctttgatcgacagtcccgagttcgtctcatctcatctccgtcgcagactcgaaacgggagaacatctcatgatcttactccgaggacctcgttttctacgtacggtggagctagactcgcctgagaacgtctccgacatccctcatcctttacaagccggaggttttgcagaggtttttggttcatttaacggtgtcataggaagagagtgattgaacggtctgattcgccacctccaccactgggtttcaacaatcatcttctgccgttggctaatgcgtacgatgatgatgatgaggaagaggggaacgagctgaagaaatcgcaagctcgtcgtaatggagttgcgaaaggagagggaaatggtaacaaagtgaacggagaagctcaagaagaggtcgatgacgaagaagatgatgatgatgatgcttccaaggggagaggaaagcattcacgccatgttgaagttcgtcgtgattgtccttatcttgacactgttaatcgtcaggtaatcatcattgaccaatttcttatgtttggtacttgtaatctaatcgttggtggatctttaagcttctgctaggttcattatgttactggtttgggattatgataggctaagggttccactagctactatgagaaagagaatgagaactggcggaagaaaagctaaagctatggagaagtatttgaaaaaggtcttgaagaaaagtggctaagagacgaaggaaagaagaaggcatagaaagactcttgttcatctagagtctttcaccatctctctatcttttattaaactcagcgttttgtctatttcgagttgtatttaaaggtctttgcctctttagggcaaccttaccaaaaacaatcatcaaaacttataacattaaagttattaattctcttctcatcttgttctccgtcaaaaacggcgcaatagaattagtttactctgtttttactcttgttcttagtatccgttgagtccatatctatcattggtgctttcattttgatgagtgcgatg

SEQ ID NO: 8523 - DNA, 3000 bp, Unknown; identical to SEQ ID NO: 8513
  misc_feature (1)..( 3000): cDNA_ID_3045962_gDNA_ID_1971814_Annot_ID_175876 3000 nt of promoter + ATG

SEQ ID NO: 8524 - DNA, 3000 bp, Unknown; identical to SEQ ID NO: 8520
  misc_feature (1)..( 3000): cDNA_ID_1838731_gDNA_ID_1971814_Annot_ID_58192 3000 nt of promoter + ATG

SEQ ID NO: 8525 - DNA, 3000 bp, Unknown
  misc_feature (1)..( 3000): cDNA_ID_1822994_gDNA_ID_1971814_Annot_ID_58202 3000 nt of promoter + ATG
gtgcaatcttttgtcaaagataattagctaactagtgcagttttaaacaagacttatttatggtatctaattgatttcggttttgtgtggcaaagcaggcaactctaatggaggagcaacgaaaaagattgttgcatcaatgggcctttttggtgtggttgcaagtctgttcttttaattcaactctacaaaattctgtgtaattgttcttctcatcatttttgtttgttttcaaatctgactactcgaacatttatcgaatcaacaaaccttaactttaataattccgcttcgtcaatgttggtattaaaacctggtctgcgtaatttgacagatgtgtatagattattttttaggtttgcattggttaatgtgattatcacgtcttcatacaaatgccccacccgaaatttcatttcaatatatattatggtaagccgtacgcagatgcagatcatttaaacatatttgttactacaagggtttcaatattcttatcaatttttagtaggtctaattaagatgtccagttatatacatttaatttgaattacagtggatttaatgaaacataccaaagtacatacattcaggtcaaaggcagtgagatattttattagtagataactatactagcaaaaacaacatactgaagaagcaagctgaaatatattttggtttgcgatgaagttgtaatttgaccattcacaaatgttcttaagaaaaaacaagaattgtttcataaacaaggaaaaaaaaaaaacgcatcatcattattcattagctaacagcaagaaattgaagaagcaagttgaaatcatcatgtatgcgaaaagcttggtaagaaccatcgagcagagagttcaagtaacgaacaatcgaaatcaaatttgtgcagtggctccatctcccgtgtctcgtaattgaacagaaagagatcttttgtggtcgtgtcatggctatcactgaaatatatagtatttctatggagtccctcaacttcattggcgagcacggtgatgcctagatccaaaagcattgcctcgtcgcccaaagaatcagcaagttcatatttatcaagaaatgtccctgacgaataaaacttgtagacgttgaatgactggattctagaccaatgtcttaacattctttcaaccaagaggacatctccggttactgtgactacaagttttgtctcagcaacgcaccatgaattacttaattgacgactacgaggacttaaccactcagatctatagacatgcataaaacattgaaaggcttttcgaggaatctctccagaaaaatctaggattgtgaaaagatttctgtagctaaatgagtaaagcttgtgatccttgtaaaccatgtcaagagaatctaaaataatttctggaatttgattccacaacttatctccgttcttggcataaaccacacaccaatatccaagcccccacagagctatgtactctttggttttctcgtcaatccaaaacacaggggtacgtacggtattattacctttgaataacttaacgtggttgtgatcgtcgaaagttagaaaatcatcatctatggtttggtcaacctttaccatgccaacttgttgtgattcaatagcgggaagaccgatcttctcgtaggtgaatggattcaaaatgtatagattatactttgaatcttgcatcaggagccaacttccataggttgctagacaaacactctttgcaaattcaacaccaagatcttgcgtttggtaaagttggtctttgtcctcgggattgaaaaaaatcgtgcatgaactgtttttgttgttgtttttgtctttggggaagagcatcagccaagggatctgatttttgggcacggattgtttcgaagcagagtaccaagacgaacacaccgatttggcttgtcgaaaattagcaaagctgaggcgtttgaaaactaagttcaagagatctagaggaagatccgaccaggtattagggttttggttcttctccatgaaaacgacaatatttgagatatatagagagagttctcttatcaacaaataattatttgagtgaggagatatctctaacaaaagattttataaaccgaatagatctcggaatttcatggtttgctttgttaaaatatgggcttttgtgaaattccgaaatattggccccattaattaatcagtatatattttgttcacttggatccaataaggtgcaagacatgaagagagaaaggtaacataggtgaacgattttgttccctaaataaaggttcaattcaacaatgtgattctcacgtcttatacacaaatgctccaccataaatttcatttcattatatacctattttgacaccgaaaagagtttggaataaatatacctattttcttcttaggtctgaaatgtccagtaaaatacatttgaattacaactgatttaatcatttaatgaaacagaccattagttatacatatacacgtcaacggcattgaaattgtattagtattcgcctttcttcatatatgattagaatgaatgaactgtcgaatccatatcaatgaatatttagttttgttataatcctaataaagatatgatctggattatattaatgacacatatctttgaattgtcagggccgtccagcttatattgattttcgacattctgtccttaacaacttcttcgcaaaacattccattttatgtattaatggttttattttaaattggcttccatatatatacatgaacatgccacataaaatattcattctcaaaatgcgaagaacatgggtactggcggaagaaagctgtaagtttttaggtcaactatgtaaaacatatttaataaatagtaatcaacaatctacatgccaagactcctatataagttaatgcagtgtttaagaagtcacatacgaaaaagaaagtgagataataatccaaaaaaaaaatccatatttttgccaacgtttttagacgatcaa

SEQ ID NO: 8526 - DNA, 3000 bp, Unknown
  misc_feature (1)..( 3000): cDNA_ID_1825633_gDNA_ID_1971815_Annot_ID_58206 3000 nt of promoter + ATG
tcgttaaaacttaaaacacttccacttatggtttttttagtcttctctatctcttccttcacaatttgttttatcgttttaccactcttaaaaaagttgttgtttggttaataaatcgggagttcatgtgttacaaagttttttttttttttggcaaccgatatgttacaaagtttgttcatgggaaaaaaaactaaagttttgttcatggacattatgtaaaagtaatcgataaaaaagcgaaatctatgaaaagtaattacaatttcatacgaatcacacactaaatctaccatacttaaagcaataacagcaaaaaacacgtgaaaaaaatcttatccccatgtttttttaacaaaaggaaaagaaaaggaaaacctttctttttttttacattcaaagaaaagtaaaaccttacacgaatggttatttactttttttttttttgtgtcaaataaacctttggtaactttatagtaagtttttttgtaactttttatgagagtttgttgcatagccgaaaattttgacttactcgccggaatatacctaacgaaaatggaaagattcatagttatccacaaacataaaatgcccaaaataaccttgcacgtcattctcatcataagaaaatggtaaaaatatgactatatgaggttaaaaaagcaaaaacagacaaaagaagaagagaatcttatacgaagcaacataaataacatttctggattttgtttttaataaaagaaattaaatcatatttttttcttcattttcacgtcacctgagaaccacttccgtcaccggagttacgagccatagcttcagcaaccgtcgcgagtttctgcaaattaagcttcacaaccgtatcagcaaacatacgagtatcatcctccgagttaccttccggcatatcaacgacgtaagattccaaaaccaccgtccagatccgattctctttctcgaaccgatgcaccgtcgtaacggatttgtaattcgtcagcctatgttcgcctccgatgatactgaatccggtaactctccgttcgtcgtcgagtatatcgagtctttccgttgatgtgttcgccggtaatccactgatgacgatcacgtcgcgcgtgcatccgacgcgcatctcgaagttttgttcgacggagcaggatttgatgaagtgtttgtatgtttgtggtttgtcgaatcgtcgtacgattgaccagacgagttccggaggcgcgtggattcgttgcgcgtggagtgatgaacagcttcctggatcgagttggtatgtgtggaactcggcgattgagttttttagttccgatcgttcttctggtgttaactccgaaggcatggttgtaatttggatcttttttttttttttgtgaagttttttttgttttgttttatttatccaattggtttgagattcaccattgaagacgacgacgagcttttagactctctctctctttatttagcgttgaaatctctctgtgttggattttagagggaagatgaagggtaaacatggaattatattaaatagtaagggtaaagtaagaaatatatatacgtgagagtggaagggtgtataatgcaaaaaatggaatctgtttatatttaaagaaagatgacctggagtttctgttataaactattggatttgttacttattcaagagaataagtcttattttcgtataagtttctttttttttaaagagtgtggtgattttattttattgtttaagaactcatattcgtaggttttatttggtgaaaaaaatgaaatcttagagatgaaaattgtttgtagttttttattttgtcatttgaaattatcaaaaacaatttcatatttttataagttttgtttatatgtttctttagtcgttgaaaacaaatatactcacgtttcattaattcttttagatatcattttggttgggtattatatttagtgacaaatctaatgaatctttgacaaatctacaatttgcaacaataaaattatttttctttaacaataaaataaaaagatttttttataactaaaaataaatatatatgcaaaggagttgtgattattaaaaaaataaattaagtgtcgttagctcaattggtaaagattttaggcgaaccttagaggtcgccagttcgagtgacgcttgagacgaaactaatattacattatgtggtttcgggtctagagggattacggacttcggtccagaacctcctgttattcaaaaataaaattaaaaaaataaaaaagagaaatatattatatttaataaacattaaataaataacattttaagaggagtttttaaaaagatgatataaagatcaacttttttggacttgattcacacttgttcttaaaaaaaagttgtagggagaaaattttgggagagaaacggtggaagaggacatccgagagagaccttattatacagtacaagatttactaggaacaaacaagtggagaggaatcttttagcaaggtggtagggaagagacttcaaagagaaaactcgcagagaaaatgctccgagaacagattgataagaaaaaggcatgaacaagtttgacaaggaagagcccttcataaggatgccattttaattttgaagttaaaagtagtaaaattatttttaatatatttattacgcaaacaccttgttattgagtttataagcacttgttgattactgaaagaatcaaagaattggtaacaaatttacatgatatatacattatgtagggaagacaagaaagatttcgagtttgaactcaacaaatgggtgggggctggagcgcaagctgtgtttagtaaaagtagagaatgattagtttagtcaagcttgcgtttggcttaatcataaagaaaagaatgtgactaactaacgatatccaatccacttggtctataagtatatgtatactaacaattttgtcggaaattgagcttaaacattgtgtgagacttgttgcgggtatg

SEQ ID NO: 8527 - DNA, 3000 bp, Unknown
  misc_feature (1)..( 3000): cDNA_ID_1921415_gDNA_ID_1971815_Annot_ID_58209 3000 nt of promoter + ATG
atagagaagctttatccatcttagacacattaggaaccacagctcttaaagaatagaatctctgattcaacttctctcttctctgtctctctgcctctacatgattcaaaggctcttctcttccattcgccggttttctccctcgtttcctcggtttcttctccggttcaaccacaactctgttactctcagcttctttagccactgaagcttcaagatcagagtgattcgagtcacatggaagaacagaggtaaaagaaagcatcccttcttcattattcgaaaccggtgatctcttcttattactactatcttcttcttgaccattctcaatcccattcttgaaattcaccatttcacaagatttcagaactttagggttagggttttcaacagagcttccattacaaagcttagaaattggttgagaatcagaattagaagttgagtcatttccaccattattcatcaccggagcagctacaagaccagagtcaacaccattaggttcactaatccacaaacctggatcattctctccttgatctggattcaaattaaacgcccaagaaccaaattcaccaccaccattgttaaaattgaaaaaggtgtcaactttatcaacaagatctgaactttgatgaataatctccgacgaaccaagctcaacgacaccattctctgtcgctacacacaccattgtttgtaacccataaatctgaccttgacgagctctctcacaacttgatccagctaaagcattagaaccagataaccaaatcgtgtctgaatttgagaaagcttgaccaggtaaaccagtacccttgacaaagctctgtgtcattgaaactaagaagaaccattcagtatctgtaacttcttcatctccagcttcatctcctcctcctacaccaccggagattaaagagttgagctctctaatcactctcttacgatgctcttgttcagctgcactagctggatttgatttcttctttctagacttctcttcttctcctttgtaataaccatctccccaacctaacaacactgtgttgttgttgttgttgtcttctccggcgaaaccgtgagatgattgccagaacacggcgtaagtccagttctcgtttgctccttcgattaaagcttggagacgttgctggagattatcttcgttgacttgaggaagaggaggaggaggaagtggaggaaaaagagaagaatgatcggagccgccgccgatgaaagcttccattaccgatgcatcgtcgtcggttgaccagagatttgttgtatccgtttttgattggttgagatggtaatcggttacttgaacattcgtcggagacataacagttctctgacgtagttataaaagagaagactttttgtttttccggtgagagacagaggagagaagtaagttctttaagcaaaatatttgtgtttggtttgattgtttcgggaaaaggaatctgtttatattcattttttttttttaactctaaagaaaaagaaatagtacttttattttcaccaaatatgaattattgattgagttatttctgaagttgggttatatacataacttgattgaaaacaatttttttctgaatagtaattgttttacaagaaaattactaatctatgtaagagaatcggatcaaatttgtcaaggagccttttacatcaaagttgataattaagaacaattaaagaatgaaaatgatatttcacttacaataatgatcttgtctccctcacttttggtattggtgtcaatatctgcttttcttgtgattaatcccatcatttaattcttgtaagcaagtagcatcaattaatttaaacaatgagtttgtagaattgcagttgttctttgaggcaggaaaatatgatttaaagggattaagggagtgttaacaccaaagatttggatacaacatttatatacaaaacctataaagcaaatattgtagacttgtagtttaacattttcttataaacatatttttgttggcttcgttattggacacaactttttgcaatgataaagaacaaaaaaaagacatgggtgattttgatatcaaaggtgaaagagacgcaagagcataaaggaaaataaaaggtatagtattaaaacagaattagatttaattacgaaaattatacgaccacacaaaaataatcacattatgtcgtgtgggtctcgtgtttttagtggccagatttcataatatgctttctttttcagtgagagcaaatgcccaaaaatgttggtctctctatgttcatatccgacgaaactatagtgtctactgtacagtgacatttcggaatcgcataaaagcaaacaaaacaaattaagctgggctttactttatattgggcctcacacattttgggtagttaataaaactagcccgcaaatatttcacatttgacattttttagtgtatggtcaacaacaagtatagcgaaacttttagcatataatatgtgtgagacatattatggaaagaaggcaaaaatgaaaaccgttagttagtttgaaaacctggagttataaaaagtcgtattttaatttactaatacatgttaacttcagatattaaaaacaaatcctgtacgtattaaaccatatgataaacataatattaatacgaaaaatgtataacacacgattagacaaattaggaagtaatctttgaattgaggtttaagaaaaggtgaaaatgataagctttcgtccgttttatatcatccatgttgcttcagaaacggaatttacacactacgtgtcgtttctacgtaatgccattttcgtaatttctagagtttattcagggtgttttcgtcagtctagtcagatcaaatgtttccatcaaacgttagtactgtttcctttagatttacagattttgaagaagaaagatttcaaattaaaaaatctttcaaatttcttcaaggaggtgatcaaattgaacaatttgatctaca

SEQ ID NO: 8528 - DNA, 3000 bp, Unknown
  misc_feature (1)..( 3000): cDNA_ID_2177058_gDNA_ID_1971815_Annot_ID_175955 3000 nt of promoter + ATG
agccggtatatgcaacatagttaagatacgcatagtcatagactaaatacttatttgataataagttttaattctctccgtgttttagctctcgggttttgtttggcttttgatgtctgaaaatgtttttttgtcaacttattctcattttgcgagtgacggtttagtgtgtctattaattatctgatttgtccggttttggtcttcgatttgtttggcttttgtttcttgaaggtccgggctaatttagtcgggtcatgtaggtttcgtttattcagttcatttagttttcaagtatttgtaacctgcctttcgtcaacacatccaagtatccaatataatctattagatgaccaaaaaaaacaaaaaaaggaaacttgtaatttacaaagcataaacattatttgttgatgtgaaatctctagttttgagatttacttctactccaatcttgagtctttaatgtcattattttactccaattttgatgttcaatttcttgagaaaaaaaaacgtgtattatgtattattggagaattttttaccgaatatctctttagtatcgtaaaagaaaaatgtttatccttgcatacataacatataatttgctcatacggtttttataagtaatgaagctttttattttcacccccaaagaacaaacatctgatcatctccaattttgacctcaaaagaatacgatgaagtttgaataattatgttaaaaggaaaataaaataaaaggatggtcacggaggaacgaacaagcgaaagcaatgatcattccaatgagtaaaaaatgaccatctactaacgaaagttttccattatattatgtttttgccttttttcaaaataatcacattggtgaactttttgtaagaaaatttatactattaaaattgagtaagaataatgacattaatgactaccaattcataactttactctgttttaaaataataatcacaattggatatggtcaaactaaagttttccatttgccgttacaagaaatgctatataagtttcgtttggttgttgaatatacctcattatgaatttaggacaatcaatgctatttgtttcatctgtaattaattatatctaacaatcaattaatgacaatagaaaagaataatgtgtttacactaattctgtattcactaatctagatttttgcgcaatttgaattttaaagtttagtgtaaggttttttttttttgggtgcacactgaatatagtttagcctaagtaatactagatatatagtagtaaaaggaaataggttttaattaaattaagaagtttggttaaattcaactgttgctttgaaaccacacacacatgtcatcataaaagttgggcaacgagtttgaaagatggaacctctgcaaaataaagtttttctttccctaccttatgcatatataattattttccacaaacatagtgtaccatcaataaaaatacatatatgatctatattttggcataaagttttccattattttcttgtgataatgattatggtaaagatttttagtgcagattaattttttggttattagattatttgttctttaaaatgcagaaacattgttgaaacttagaaccaaatgaaagctgaatattgcttgttttttttttgttttttttttcacaatattgcttgttttagtttgttatgttttcatttaccattcatttagtagaatatattcattagttaataaaaaagcttttaaaagagttttcttatcatgttagttcggtttacttcgcaccgttttgattggtacaaatgggtatagttctataccggacaataaattttgttatatttttgtaaaattattggtctacatttaataaaactaggctaattttgatataatgacatattaagggatttagatttttttttttggtaaggtttagattttttcttgtattgttataggaaattaatcctatatattgattaataaagacaaaaataataattaatccttatctcttttttcctctaacctcagttaacctttatcttagtaagactttttattctctttatctctgtgcataacccaatgacaagaacaacactagtcaccaacttattataactcttcatccattttctctctctcaaagtcaccccccaaatttttttatttttttttttaactttgaatgtgactcaggatagagagagggcgagacagataaagagagcttgaggaaggatttaagcagatctgcaagaaacactctctcaggtaaggtgagaactctaaaatatgaatttactcatttgacttctgaattgtgaaagtttgtttgtttggttttaaatttccaaagcttttcttttgatcaattacatgttcattgcatgtgatgtgagcatgatctcttatctggatataagatcttctccttcttctgcttatggaaagaaaaaaacatcagttttatcgaaagtgcaacttatgatttgatcacaattctttttctctctgggtatatatctctctctcaatttccctaaattctagggatttgcctttctccttcattagttgtcataagcctatgttttagtatttgttaaaggtcattagtctgtgttgttaagttaactaatcactgcatgcacgagttaaacaacactaaactaataatatattcactcttaaatgattcaaaagctttgttagatttcatggcatggtggtccactctttataaataacaaaatcaagttcctcatgaattattcttatctcatcaataatacacacaccttttgaatatttacttttcttgtatctttattctgtctaatttttttgtttattctattcatttcccctttttttattaataaaatctagccagtgtttactttttttccgtagaatcaaaccggcggcgacagtgacggcggcgaaaagcggcggtgttggccgcaaaaacgatgcaaaaccagctatg

SEQ ID NO: 8529 - DNA, 3000 bp, Unknown
  misc_feature (1)..( 3000): cDNA_ID_2177047_gDNA_ID_1971815_Annot_ID_175952 3000 nt of promoter + ATG
tgacaaagtctaaacatatgaaaagatatcaaatcactaaaaaaattctaaacatatgaaaagatattaaatctcttggcatatgaatcgaacgtagatctttaaactctcccatactaatcgattagttataaacactagtttgttcaatcaatactttagagaaatattataatgtagaaaattctcaatgaactatgtgataatttgtatactacttgtctgatttgtagcttggtagttggggataatgatttgtgtgagtagttatgacttcagtccattaaaagctctgtttaaaaatgatattaaaaatcaataaaattacaaagtgggattattcgcacaaattgcgtgttgatatgctattggcaggttgaagaaagcaaatgacattgacatcgttatgattctattacaaaaactttttattttgtctacaacgttactataaaactttcttacggcatgattctattacaaaaatttaaataaccagtattcaataaaaaaaattttttttttttttttcaaaaatttctaagttagttctataataatgtattaaggagacaattattccctaattagcagtattatagaactaactcaataaatttctaagttagttctataatactgctaattagggaataattgtctccttatttatgggtgcgcgtacaggtatgtggtccatatgtacctttataccggcctaccaatcgtatctaatatttgtgttggatttggtaaatttaaatgtattaattacttcatattattaatgtgttacagatcacgatagaaaacccacattttgaatattttcgaccgaccgacctgatcaaatataaataaattatcaatttcctaccgatatatattttgttagtttttaatttgaatgttttaataaaattttgtttcttttgttaaaaggttaactttatataatgttaccctctttctaaaaatatctaagggacatgatattttggaaagtggtaatctttgttgtataattttatttgttttttttatatatataataataatgaagttttaaagtgacagtctaatatttgcaactctgaaatcaacctttcatctttttttttgagattgtcattgtaatatcaaatggactcgaactaaaaaaagtttatgttctttccaaaaatcatttgatgtataaccttatagatagtaaattagcaattgatgataattaattaacaacaatgaacaaacgatctttagagtaacaaaaatagcaatatgataagaagtaaatttaacgtaaaccttaaacagtggttaaattatgaattaatttatccaaatacttattagttatcccgtcgctctagttgatgataagtaaatatatttaaatcttcccactgagcttttagtatttgtatttttttttatcccattaactattttatggtcaaccagcgtcgtcgtgtcgccattttgtgaatcaaactaatttatttaagtagctttggtcaaccgaaactttcctaatgaccttcgttacgtcctctatccgcaaattgcattgcatgggcgtcagtttttttttccttttttcttaataacgcgtcaatttattttatgatgatgattatgtttagttgaaataatcttcagttattaattagatatttcttggtaaatattttttacaaatatgctgtcagaaattcaaagttatgtatttccataccatattggactccatactttatatcttctcagttgagtatccttcaaattcacctgttttggaaattggaaatataatttagttttagaaatgttttaagttaaaacataacagttaacaaagaaaagatatagacaattttaagacttttaaatgtgagggattctcactttttcgttgttttctaatggttccaattcatagttatcgtataatattatttaacgaaacattagtcaaataaataatctatctattcgccgactgtatggctgaaaatattagctggagctagactcgtattgaaaaaattaatccatatatttgttgcctaggagagtgacattttgacctttttaataacataccaaaaaggccgtttatttaatatattatccagatagcagcgttgaatcggattttggttggttttggtttatgtgttttagatttttggttaaagcaaaccactaacttaagtcaggtcaaagtatttcagcaaaactaattctcaaataatcacttttactccgcaaaactgcttgtcaaaatatagttttgacttccaacgagccattttttgctaattcagtttaactagtatacgcaaaaaaaaaaaatgtttagataaattaaaatttcggttaacttttataaaaaagtttcagtctgtctgtttgattcggtttactttaactaaatgccactatcttaaaagatgaagtaaacatttataataattcggtatggtcggtacaatcagtctagtaaaaccgaattgagaaaaccaggtcggttcgaatatatccaaaaaccgaaaacacgtgtgagaaagaagaaatcagggaattaaatctgacagtctttatagttttctttaatatgtcttccccaaaaaatcaaattatgaataaaaaaagtggatcgcaagttgcagtttggttctttacgggcaacgaaggctgttaaataacagccatagcttttcttcgaaacgaacccaaaaaataatatcagagaattttcatcattacacctttttttttcttttgcctttgcctttgccttcacacgtcttcttgtttgtactctccactttttttttctttgtgtcctttcttcttgttcttgctctagttcgtgtctcttctttaactctctgtcactattataaatatcaaactctgacattttcttctgttcaaattctcctcgaaactcccccaaagaaacaaaatctttttctgagatctaagaagatg

SEQ ID NO: 8530 - DNA, 3000 bp, Unknown
  misc_feature (1)..( 3000): cDNA_ID_1825605_gDNA_ID_1971815_Annot_ID_175946 3000 nt of promoter + ATG
ctaggaaaaatcacatgtcggcaaaaacgagaacacgatgaccagtgtggtgggttggtaatttggtatatttggttggtccatgatatcggttgaatctatttagaatttgcaaaaatagttccgatatgactactgatatgaatttacccccggacattaattagtaacgacataatattcaaacgtatatggtactttttgatatataaaattagggctcagtatagtcaacatagaagatccgttattcgtatttcataggctaacttcttcttttcctaccatatgacgtagttattcacgctttaggcctttttcttcatttttgttcttttgtctctctttaatcagtgttaggggtcatggtgaccgttcctaaagtatcgtataattataaggtgcactttttggtatatagaacttattaaccttatacatttccatctcgtgaagtcattcgttttcccaatatttttttattttcttttcctcttgaatatttcagctatcgggtcttacacaaatgggaactaaactttaaactacaactttacatcttaaacaataacatatttccggtaaaaagaagacaataaacaaaattttcttcaaagttttgttatctcttctaatgtcttaaaagttgaaagtggttactctaataaaaagcagttttgtcttactcatactgacgtggaggaacattgttacacccccttcaaaatagtcaagaaaaagtttagaatattgaacgaaaggaaaaataaaagaattagctaggaccgagtttctatgacctagaactaaaactcccgttacatacttatatcaaagaaacgagctagaaaaaacattagagaaatgtaaaatatatctctctctttttggttaaccaaggtttactaatccgatatacaagaatgacatgcaaataaacatagggttaagttgtaaagtagtcagatatttaaacttaattatggaattgggcaaattactatttataattggatttttagtcactaacctttgaccctattacagacaaaatcaaatataccccataccaactctattatttacaaatatgccactaatcttcttcttctccaatgtcgttgaaagcaattgggatttgtgcttttagattcaacatttctctctcctcatactcacattctttgtatttctttatatatatatatatatatatatatatatatatatatatatatatatatatttatttattttttaataacctcttcaatctaataattgaaatgcttatcaatgtaaatttattttctaaattaattcagatacataaaaatctatattttttctctataatttgatatgcattttgttaataattttaaatatattatataaacatttttattagtagtcagtacagttaattatgtgtacagatttttatttatacaacttatttaataagtacaaattgaaatcgtccagccataattggaaaaatagtcattttactattcacaatttgcaaagtagtcacttttaactgtttgattcgtacacttagatctgtacaacattttttagtgtacagatgtaagtgtacgttgtgtatatttatatatatatatatacactaaaaatattgtacaggtctaagtgtacgaatcaacagtgaaaagtgactactgataattgtatactccatacaattatatactctgtacagctaatgcaacgtacaaaataaagtctgtacacataattaagtgtaccgactactgataaaatgtctgtaatatattaaaaatattaacaaaatgcatatcaaattataaagaaaaatacatagatttttatgtatatgaattagtttagaaaataaatttatattgataagtatttcaattattaaattggaggggttattaaaaagaaataaaaaaaaaaagaatatttcacttttatctttcttctctgtcaaaaggatagttcggtaatttcaaaacacatcacttaccccaccccaaacttctatttcacgctcgtctattacacgcccaaagtgagttacatgttttgtcaagtgtaaatagtaacttgcccaactccataattatgttttcaaaagtgactaatttgccaacacacctataaacatatcgttttacaaaacgaaacgacgtcttatgaaattaaaaaatagaaaaataagttttgattaattataggtgatagtattattgaatcattgatgtgtgaagtgtgaacaagtctaactttagagaccaggtaggtccactttctttttgaattttgggaactcttaagacaagcaatgtctttatccgctttcggtgtgtcgagttattttttcttctgaatattaacggcactgactattataatactgtttgtttattctacagaaaaattcatcaacatattttaagctatgattaaatttgcctcacaaagtttcgcaacctttgtgctataaatatcattcaccccacaaccattcaacactctaccaaccttctcttcttctctccgatcttaatcactctcctaatcaatactcactaataacttttttttttttttggtcttgtatagctaataagtcagagaacccttttcctcagtcagactctttgacccgcagcaattagctcttccaccaactgctcttcgttatttctgaattgtaccttaagtttgtttctattttttttcttaggtgttagatatatttttaaaaagagaattttggataattcgtttttttttttgtaaacatacaatctctttcagacaatgatattgtcacaaaaaggatgcaatcaaagtgagttgcaacttattttcaaaaacaaattgaatgtcgaaaaaagtttatatttttagattttccaaatagtcaatagatatttagttaaatattagctttcgacaactctcttgtgtcgcaagctacaagtgtgaattttgcaaatg

SEQ ID NO: 8531 - DNA, 3000 bp, Unknown
  misc_feature (1)..( 3000): cDNA_ID_1825608_gDNA_ID_1971815_Annot_ID_175945 3000 nt of promoter + ATG
tagtttttttgaaaaaacttgaataataatttggtgtagattttgcaaaaaagaaactccataggatttggtttttgttcaataattggtaaagatttgtaaaatctagatatcaacggcaataaagggtttatgtacttgaacagttggtaagtagacactagagcaaagaacagggagaaaatattggcgtgctttgcccaacgatggcctctatatcgagcgagatcacaaaggagccagcccaaaccaaacaaagagagcaaggtgagcaggtcgaatgtatcctccatatccatcttttgcggatgagcgaccaatggaacggtgatgtgattttgtcgaaaggtaggctttggagaatgggagaacaagcctagtacaaacgcgccaaaaatttcatggaccgtgcaaaaagaatctcgttccaagtagcatttgtttccattggaaccatttgaatgccgttgtgatgtacttttgagatgatccgtttcttcttcctttttaaaaaaaatgcattgagcatttgagcatcaaagacgattacttatagtataaatgatttggaacacaagagaggctatgaaaggtttttgtttcatcagcatttcaaaatattggtatcaaaccatataagaatacatgttgttgtgatacattatcgaagtactagactatgcaatgagacttggtttttcgtccttgagccaaaaataataatgactagctttataatttgacaatcacaattagttttgagatactctactggactttgtaatttgtattactacgatgatctttgtgtgtgtatacataataataatatgatcaacctttttggtttaaacatgaatccaagtttcttttttgatatctgtattggtaatattttcctgccacgtgtggaggtctcacaagagccacatggacaagacacgagaaatctgaaatctcaaaaactcaacaacacgagaacagctgttctgttgcttaggaagatctattacctctaaccacaacactacaaagagagtactagttaattagtttaatttactggatttttctaataatttctattgatattcgaatgtaaaactcgatgtaggactacaattgtccatatatgaagttgaaatacataatgtaaaatctgattatagaaaaacaaaaaattgtaggttaactatcagccacatagaagaaaaacaggatctttctttgaagttaaatttataaactaatctccccatttcaatgagctgtatatcaactcacaagtcgtaacccgtgccatcattaatattgttcacgtacattttccttttggcagaagattacggtttgagttatactatttcgtggaattacatattttaaaaaatctttctccaaaactatttattttctcttttgtttatttcgtactaaactatttcatatgatgcagaaacttaaactgatcttaccacgtaaacgtggcaagaattaatttacacaattaataacaaatatataatctatattatatttgacagtaattcgagatctttagcatttaatttagtgtttttagtttggtgttcgaagccatcaattgatttttatttacatggcggttacatatttagggggttaacgtggcttttaattcatagaatgtgattagaacacacaatttataaaaattagttgtccccgtgcaaaaaaaagaaggtatacatgtgttatgtgtcaacgttggtacgactttgaaggatctaaaaggtcaaactttagttgagagttgagacagtgataacttggttttgactttcttacatgcatcgccacaacaatacaatatttctacgaatgcataaaaaacaaattctatgctttaatttttttttttttttcttgaatgattgttaacgataaactgtaagaggataagttaaatctctttttattgttagtaaaaatagaaattcgtgtaaggacttcacatatttgatctctttttaattagcgtgacacaataactaattctcagttctcgatgtacctactaaattccttaatctaggaggacaacgtatatcggtatatgactaagatctagttcttggaactacatgtttaacaatattggtactaattgggggacacatgcatataattatacaaatttgtatatctaaggataaaaattggatctctaattttcaaactaaaagaattatggaacgtatgttagtttaatatccttttcaacagcttttgacttatttaattttttcatcttgtgaacaagagagaaaaaagtactctttaatttattattaacttcaataattgcaagtcatgtgaaacccatcaatctaatcttttctcacttgccaaaagagaatattatttctgtagctattaaaagtaattatgtaaatttatacctatcctattatagaggtaaaaaaatgtaacaccacgagaatttttatttaccagaaatgtagaatggaacctaaaataatgaacaattattaatgctataggatcgattaatcgtaagaaaaaaaaattagaaagaataacattaggcaaattttttaaaacgatcatcaaacgaaaccgtaaaatggtgaaaaaatattttacattttgtcataaaaatgacaaaacatcaaagtacacccttaaaaatccctattttgtaaagtcataggacacgtaattttttaaattactcgaacctacaagagattctcgtagttcaaccaacacaatcacacgtattaacttttttcctctagccagctacatacatagtctacgcatcgcctacgcaaaccatagatccatcactctatatatacagaaatatatacacacacacaaagagctatatatagagaatacacaacacattattctattcttgtatactctaattacacacaaaaaaaaaaggagagagagagagagagagagtaccaatttctctccctcaaa

SEQ ID NO: 8532 - DNA, 3000 bp, Unknown
  misc_feature (1)..( 3000): cDNA_ID_3045678_gDNA_ID_1971815_Annot_ID_175942 3000 nt of promoter + ATG
taaatttatcatatgttggaatatttagtgttttattcaggatgaatcatgtgttggaataacagtaaatatttcttctttttttgaagaacaaggataacagtaaatagttcagaattactttttaccatagaattggttcatctctttcaaatctagtttttgttctgcaaataaatttgatttgaacgcaaggaaagactcacaactcacaaggcttccttttgtagggttaatcactcacaaatctggtttagcattacaaaataaattgtccgttcttattattaaactccggaaataaaagaaataaattcactaatatttctaattagcatcttcacaaaattcactacctacaacatctataaccaatacaacaacaagaaaaaaaaaatctaattgccaaaaaaaagtgtataattatttcttcttcaatttttagattgcgtttgaccagagacttcaccaaaccggcgatgatcatatcctctgtttctaataagttcagcgaacgtaacacaactctctgtctggctatgtcctctcgtgaccttaatctttacatgttctggtaatctcaatgtatacttatcttcttcctccggtttatttctcactatcgagtgtcccgtagaatgcgatctagagaatttctccggcaagttttgttcctttttgatgctactggtctgtcctgaagatggccaagtatcaatctgtgttgttgtctgctgacgatgatgatcgtcttcttcgtcgtcgcttgtttcttgaatcacatctatgatcatctcatcgacagtaggcttggtgttttccggtggcggaggaggatcaagatcccgacgacaaacagggcaagttctgtgagattcgaaccagagatcgatgcattcttggtggaacacgtggtagcatgttgtcaagagacgtagcacgtgatctccgtcgaattcgagaagacaaatggcgcattcgaggccgtatttctcttcccggagatctttaacggaggagtaaggaaaagtgggaaatgagttaatgattcgaagttcaaggccgggatttaccggtggagcttccggttgctggaggggattgtcggatacggtgtctccgccgtggtggagacgccaagcttgcaccattgtgtcgaggaaacacttgcaaaaatagagagtgaagaaaccgatgaagaagaaaacgaggaggattacggtgaggatcaccgtgagaggcggtgtaacgtaatgttgttgcggaggttgcggtgccagaggtgaaggaattattgtcgacattacggtggccggagactgaatatctccgccgtgagacttctcatataccaaaaaaaaacaagaaagcgagagacaagagaaattcacttatttcaaaggttattttaattattagagttcagttttatttggtatagtgtgtggaaaatgtgtgtttggtgtgagagaaagagtgttaggaagttttggttactaaaaataaaaagtgtgttttgggtttggttatgtttgtttggtttgtttgcttaatgctatagcattgaacgagtcgtctgtgacatttgtttaacgttaagccacttcgtccttaaaaatagttaagttttttttctttttctttggttttaatagtatataagtctcgtttctaacaagcaataattaggatttaggttcatgacacatttcggctaatggcttttctttccttatatatacacaattcatcaaggtataaggatgttttgaatatacttgtttggtatgatcggtatacttcataaatcaactgatcatcaaaaactctcgatgaacgaccatattcttcgaaatcaatggtcattgagctatctttgtatttggtatacttttgaatcaacgaacatcggatcaactagttttgcacaagctcattccacaaaggtgtccacacggacctcaattgatgttttgcacgaagagacatgcatatatcggggatgtgaatttgcaaaacaaggacatcagtcctttagagctttggttgcttaatcatttccattttttctatttgaaaattttaatattatgaagaggagacaaaaatatagacccgtcggtaatcacttatctttgttttgacaataatattataagtcaagtactagtttccatcttccacagttagtaaacaaaactgttactgtattttataagatcatctttaccattaatagtgtgaaacaaattaaaagacaaagtcacaactagataacaaccatattatatgcatttgggaaaaccttatcttatcttatcaaaaacagcaaaatatccccaattgaatcagtatagtgaatccagatcttcccaatttcatagttaaagacaagaaaatgaaatgtcattttgtgtgattgtgatattaatcattcacatattaacatcattctcatcccatcgttaatccattacattttattgtatagatttgacacacaaaacaaaacaaaatgcatgcaaagacaattagtaaaacaacttctttttttgatctaacatcatgaataacatttggcatgacaacagaaattttatagtttcgataataatacagtaatactcatagttttatgattctgactgaatcgccaattgtttttcattaaagagaaaaatactatggtaaggaactaaggatccatgtggtaatcgaagagtcgtcgatcacgtgcaatcctccacacgtgttaagtcagctcgtagttgattcttcccccttgacggtcatctcatcggacggttgagatcagccaactttaagtgtatcacacggaaaagggaaatgtagcgcgagaaagtcaaaagatccaacggtcgatatgaaacaaaagtcagataatcgtacggtagaaacgaagctatatatagcaacaattggattattcttatcatcatcactctctgagatcgaagagaaagcaaaatcaaagttgtg

SEQ ID NO: 8533 - DNA, 3000 bp, Unknown
  misc_feature (1)..( 3000): cDNA_ID_3045682_gDNA_ID_1971815_Annot_ID_175937 3000 nt of promoter + ATG
tcttctatgataattcggattaatccaatagaatggttcgtgggttggtgaatttcaccggattatcaacgaggttattaaacatttgcgttgattcactctgcaaattccggaaattagagaaagctgagtctttaatcattgacggaatcagattaggtgttgatcctgatgtcgtcacttacaacacactgatcagtggctattgtcgattcgttggtatagaagaagcttacgctgtgactcgtcgtatgagagacgccggaattagaccagacgtagctacgtataattctttaatcgccggagcagctagacggcttatgttagatcatgtcctctacctgttcgacgaaatgcttgagtggggaatttatcctgatttgtggagttacaatactttgatgtgttgttattttaagctagggaaacacgaagaagcgtttcgggttctttataaggatcttcagctcgctgggctaaatccaggtcctgatacttacaatgttcttcttgatgctttatgcaagtgtggttatatagacaatgctctagagctttttaaagagatgcagagtaggtttaaaccggagcttatgacttataacattcttatcaacgggctttgtaaatccaggagagtcggtactgcgaaatggatgctaacggagctgaagaaatcaggttacactccgaatgctgttacatatactacaatcctgaagctatattttaagaccaggaggattagaagagggcttcagttgttcttagagatgaaaagagaagggtacacttatgatgggtatgcgtacttcgcggttgttagtgctttgattaagacgggtagaacgaaagaggcttatgagtatatgcaagagttagttaggaaaggtaggagacatgacattgtttcgtataacacattgttgaatctgtattttaaagacgggaatttggatgcggtcgatgatttgttaggagagatagagcggagaggaatgaaagcggatgagtatacacacacgattatagttaatggtttgttaaggacaggacagacgagaagagctgaggagcattttgtaagtatgggagagatggggattggattgaatctcgtgacttgtaactgtttggttgatggattgtgtaaagcgggtcatgtggaccgggcgatgagatattttgagtcgatggaagtgaaagatgagtatacttacacctctgttgtgcataatctttgtaaagacatgaggtttgtttgtgcttcaaagctgctattgtcgtgttacaataaaggaattaagattccgacatcggcgagacgagcggttttgtcgggtttacggatgtctggatgttacggtgaagcgaggaaggcgaaggccgaaatgaaactgaccctggttgggaattcctaacgatatccttacattcaaaagttttgaagtaaaactgtaatgtacttatgtatcatgaaatagaataaaagtcttgattctttaacattcaagaggtctctctgaaccggataaaatctgatgaacagaacctaccaattgaactatccggttgtgatcaaaccaaatgaaatctctgtagtttgatcaaacgacaaggactgaagaaagtttagatctctttacctctgaattctgaacaattcctaaaccagagtaagaggtttaggaatgcttgagttatcttgaaaagtggtcattgtactcaaaccgagaagcagatgatgaaccagctgatgatttgcttccgccgttatcagttgaagatgcagcaggactgaccggtgagacttcttccggtttctgctcatatagattctcctttggctatatattaccagaaacaaagtccaatcttagaatctgaacaagagaacggaaacgtaaatgctccaaataacaacccaagacttaccttagtaataagcttcctagcaccaagaccaccagtttgtcctgcccttttaataccaacaggtttctcaaacgtactaggcacaactgtatcagaggctataggcgacgaagtgtcactggtatcttcatatttaggaggtacatcttcctttgacagcataagcagaaaccccatcagtagtagtatctagtgcattggcttcagcaacttccttagcaagaatctgcctatacaaatcagcagctctcgaagtatacttagcttcgattttgccaccatcggtccatccatgttgcttgaagaacacctgagcacggtagttgccaccaaacatcattgccctaagctgctcagggctccatgagtctaaactcgttgatcttatacgaataaacatacaaaacaaaaaggttgtgtgtgttctttctttatgcttattgtttgatgcggaagaatttctattctgccatgattcggaaaaaaaaattctattctgccatccaaataaatcaatttttttttgatttatttttaagtagagaaatagagggattttaccaaataaccttgttactttaggaaaactacatgacccaaccacatgtagacggatagctccactgtaactgggttttcccccaaatcgtcagtttttaatctaagtaatttttttcaaaaatcaaaattgtcgctttcttctccgattaacctaaacggcgatttgttccggcgattctcgaaaattttcgtcgctttctttttccgaccagttcaccgtcaccggtttcatctctgcttcttcaccaaacgatttcttgaatttttttaacctaagtaacattttacaaaatcaaaattgtcgacatccactttgcaattccgtttaaccgccgttgcaattccgccgtgaccggtgctgttccaaaccgtcgtcgttccaaaccgccggcgttccaaattgtaagtgtagattggaacggtttttgatttttgagtgttttcgttgtgttgatttgaacggtttccttgattgttgagtggttttgcaaggtaatcatg

SEQ ID NO: 8534 - DNA, 3000 bp, Unknown
  misc_feature (1)..( 3000): cDNA_ID_1825621_gDNA_ID_1971815_Annot_ID_58211 3000 nt of promoter + ATG
aaataaaccggaggaagaagataagtatacattgagattaccagaacatgtaaagattaaggtcacgagaggacatagccagacagagagttgtgttacgttcgctgaacttattagaaacagaggatatgatcatcgccggtttggtgaagtctctggtcaaacgcaatctaaaaattgaagaagaaataattatacacttttttttggcaattagattttttttttcttgttgttgtattggttatagatgttgtaggtagtgaattttgtgaagatgctaattagaaatattagtgaatttatttcttttatttccggagtttaataataagaacggacaatttattttgtaatgctaaaccagatttgtgagtgattaaccctacaaaaggaagccttgtgagttgtgagtctttccttgcgttcaaatcaaatttatttgcagaacaaaaactagatttgaaagagatgaaccaattctatggtaaaaagtaattctgaactatttactgttatccttgttcttcaaaaaaagaagaaatatttactgttattccaacacatgattcatcctgaataaaacactaaatattccaacatatgataaatttaaattgctaaaaagttaaaaaaaaatgaatgaaaattgattacatacttaatataaactaatctaattttacataataatataaaaaatttagaatagattaaagatttatgcatgagttattttataatagatgacatgaaaagcttaatgtgatagataatagataaacatgaaatgaacaagatcgtccatctggttgaagagaaatacgaagatgaaaaatatttatatttttattcaaaaatgtaacaataagtaggttatagattatattttaagaaattataatctataacctacttattgttacatatttaaaaaatatattactatgttttgctttggttttgcttgttatcttgtaaatatagttctttcaaaattttcaatttccaaaaagatatataattattataaaaaatgttaggtttcaattctatagatatgttaataaaaataaaaactagatttgttagaataaaaataaatgaagagcaatctttggcgttttcgtgttatgcattttctcctgccgttctctaaaagtaaaatgattttcccgccgtttcgcacatcccaataaaactatgagcgaaaatggtttcaacatggcgattatgctctctctggtactttgggcaagcttctttatcctttctacaggtatcgaggccatacaaatgtagtaaggaaacttgacgtaacctcgctaatatgtggtttggtctcgattggtctactgttaagttaccttaattgaatatttttttttgttctggtcgtcgcttccatcttcgtggcaatattgctctgcggccaccgtaatatctacaataattcatttatctctgccaccgcaacctccgccgcaacatttaaacttttagtccaacatgttaaaaattaaattaaatatctttatcactcttgttttacctttttctttacgataattaatcttgtttcacatgtgttatgtttgaacgaattgttttgcatttatatttgagtaaatttggaaaaatgtcctatttttgagttttcatttggaaaataccctctccttttttctttttaaacaattaatttttaatatacaaaattactaagatagtctcattaaaatttaaacaattattatcttaaatatttttaaacaaaattttgtcgaaaaagtaaaaaataaactttactaagtgatagactttttaaaatattttaaaatattattttattaaaatttaacaaataaaataaacaaagtctttatctcagaaatagttgaaaaaatattgaaaaagtcaaaattaattcttatcttgaatatttttaaacaaaattttgtccaagaaaaaagcaaataagttttattaagtactttacaatatttttcgacattattttggttaaaattttaaatatctaaaataaataaatctttatctcaaaaaatagttaaaaacataattaagaattcaaatttattttattttaatttgtttcttctaaatttcgaatttcgttttaatttattaagaaaatagcttttattttaaatccggataaaacggtcatctaacatattaagaattatatttttttattaataatagagaaagatgtatttttcaaatgaaaactcaaaaacaagatagttttcaaaatatccctttatattttgtgtgttttactcggatgaatttacctaacctatctcgattttttgttttgttaatatcagttattgtttagattatagagtattctaatctaatttgaataagccaagtttgaattataaaaaaaaataaaaattgaataacataatgtttctgtttttattcatttatttagttttggttctaataaagaaatctgcatttgcatgttttaagccttttcaataattcttgtcgctttgatttgcaaaataacaagcaagcatgcatggtttgaaattttgctacattctttcaagttttcattctcttggtctattttttttttttcatcctttgttataacacttaaaagactcgaaagaattttatttgttggtgtatatgttaacatttataacttagggcttactttgattaaaacaaaaacttaggggtttattatgaaatataatgaacttggaagttgaagactgttcttcttgtaaaacccctctcagattgctgcttcaaagagaaaacaattttgtttcgaaaagttcacatttttccgatgccgatcacattcttcgccgagatctgcatctgaattatcaaaatttctaccattttctctgtttatcaaatcctatgtcacgaattaatctccaaatcttactccttccaccattcttctatgataattcggattaatccaatagaatg

SEQ ID NO: 8535 - DNA, 3000 bp, Unknown
  misc_feature (1)..( 3000): cDNA_ID_2999841_gDNA_ID_1971815_Annot_ID_58214 3000 nt of promoter + ATG
tttttttgaagaacaaggataacagtaaatagttcagaattactttttaccatagaattggttcatctctttcaaatctagtttttgttctgcaaataaatttgatttgaacgcaaggaaagactcacaactcacaaggcttccttttgtagggttaatcactcacaaatctggtttagcattacaaaataaattgtccgttcttattattaaactccggaaataaaagaaataaattcactaatatttctaattagcatcttcacaaaattcactacctacaacatctataaccaatacaacaacaagaaaaaaaaaatctaattgccaaaaaaaagtgtataattatttcttcttcaatttttagattgcgtttgaccagagacttcaccaaaccggcgatgatcatatcctctgtttctaataagttcagcgaacgtaacacaactctctgtctggctatgtcctctcgtgaccttaatctttacatgttctggtaatctcaatgtatacttatcttcttcctccggtttatttctcactatcgagtgtcccgtagaatgcgatctagagaatttctccggcaagttttgttcctttttgatgctactggtctgtcctgaagatggccaagtatcaatctgtgttgttgtctgctgacgatgatgatcgtcttcttcgtcgtcgcttgtttcttgaatcacatctatgatcatctcatcgacagtaggcttggtgttttccggtggcggaggaggatcaagatcccgacgacaaacagggcaagttctgtgagattcgaaccagagatcgatgcattcttggtggaacacgtggtagcatgttgtcaagagacgtagcacgtgatctccgtcgaattcgagaagacaaatggcgcattcgaggccgtatttctcttcccggagatctttaacggaggagtaaggaaaagtgggaaatgagttaatgattcgaagttcaaggccgggatttaccggtggagcttccggttgctggaggggattgtcggatacggtgtctccgccgtggtggagacgccaagcttgcaccattgtgtcgaggaaacacttgcaaaaatagagagtgaagaaaccgatgaagaagaaaacgaggaggattacggtgaggatcaccgtgagaggcggtgtaacgtaatgttgttgcggaggttgcggtgccagaggtgaaggaattattgtcgacattacggtggccggagactgaatatctccgccgtgagacttctcatataccaaaaaaaaacaagaaagcgagagacaagagaaattcacttatttcaaaggttattttaattattagagttcagttttatttggtatagtgtgtggaaaatgtgtgtttggtgtgagagaaagagtgttaggaagttttggttactaaaaataaaaagtgtgttttgggtttggttatgtttgtttggtttgtttgcttaatgctatagcattgaacgagtcgtctgtgacatttgtttaacgttaagccacttcgtccttaaaaatagttaagttttttttctttttctttggttttaatagtatataagtctcgtttctaacaagcaataattaggatttaggttcatgacacatttcggctaatggcttttctttccttatatatacacaattcatcaaggtataaggatgttttgaatatacttgtttggtatgatcggtatacttcataaatcaactgatcatcaaaaactctcgatgaacgaccatattcttcgaaatcaatggtcattgagctatctttgtatttggtatacttttgaatcaacgaacatcggatcaactagttttgcacaagctcattccacaaaggtgtccacacggacctcaattgatgttttgcacgaagagacatgcatatatcggggatgtgaatttgcaaaacaaggacatcagtcctttagagctttggttgcttaatcatttccattttttctatttgaaaattttaatattatgaagaggagacaaaaatatagacccgtcggtaatcacttatctttgttttgacaataatattataagtcaagtactagtttccatcttccacagttagtaaacaaaactgttactgtattttataagatcatctttaccattaatagtgtgaaacaaattaaaagacaaagtcacaactagataacaaccatattatatgcatttgggaaaaccttatcttatcttatcaaaaacagcaaaatatccccaattgaatcagtatagtgaatccagatcttcccaatttcatagttaaagacaagaaaatgaaatgtcattttgtgtgattgtgatattaatcattcacatattaacatcattctcatcccatcgttaatccattacattttattgtatagatttgacacacaaaacaaaacaaaatgcatgcaaagacaattagtaaaacaacttctttttttgatctaacatcatgaataacatttggcatgacaacagaaattttatagtttcgataataatacagtaatactcatagttttatgattctgactgaatcgccaattgtttttcattaaagagaaaaatactatggtaaggaactaaggatccatgtggtaatcgaagagtcgtcgatcacgtgcaatcctccacacgtgttaagtcagctcgtagttgattcttcccccttgacggtcatctcatcggacggttgagatcagccaactttaagtgtatcacacggaaaagggaaatgtagcgcgagaaagtcaaaagatccaacggtcgatatgaaacaaaagtcagataatcgtacggtagaaacgaagctatatatagcaacaattggattattcttatcatcatcactctctgagatcgaagagaaagcaaaatcaaagttgtgatgaaatctctattgatgagaaccggttcgatgccggttcttcaaaaccggttaatttcaggtggttcatcgcggaag

SEQ ID NO: 8536 - DNA, 3000 bp, Unknown
  misc_feature (1)..( 3000): cDNA_ID_1825612_gDNA_ID_1971815_Annot_ID_58215 3000 nt of promoter + ATG
gtgtaccatctcagtccctggttcaacacaagagagagctataatacagcttgtgacagaaccaatatccaagaagatatgcaagctcttaactaagaaaaattcactagtctaacattagaaataaagtaacagctaactggaggaaccacaggagtaaaaatataaacagaagtgatacagagtcgttgtctaatgtcaaagaaaagacaatgtgaaaccagtttagaggcaatgattatagttacgcttctactacatagaaagttaaggtaagccatattggtgaacttacttctactcattttctttattgcatctaactgttactactcatgagaacatctaactcaaaacctcaataatgctaaagcaagaacagagagtatcgaaatcaattttgtacactatgctaagagagtcaagctgaggactatgtagcacatgaaccatgattactaacagctaaagtagaactaaagaatgaggaatctttaatggaacttactaatcaatctcaaacccaatgtatgatgttcctaagctaatctaactaactagaatccacacttccgtataaagcaatcaaccactatagcaaccgttccagcacaggaatcccaaacctgaataccaccatctccattggcgcaaggctgaagaagaggaccaagttgagacctttcgacagcaacttgaaccggaactccaaatcctttccttggtaatccagtttcacgaaatctctgctgattacctccgtcaccgtaaacatcaatatcatcttcctcatttttcaatacttcctggccaaatccaaacacaccagctaatttcttgaaaaaacccatcctaatccttacaaatcaaactctcccaaaataaatccgttactaaaaatacaaactttctctcccagaagctacaatttgcatactagtttctagaccaatccgtcactaagagaaacaaaaaaaaaaatgatctttcctataagttaatcagacaacagatacttattagggtttatgaaactgaatcctttagacccaagttctacttcataaactgaatccgaatatctccactctctctgcgacgacaatggaggaaagtggatcaaagagagaatcttcttcttcttgcttttgctcatttctctactttccaaatctaacccttcttcttctccattaacgagcggtaaattcttatttaccacaattacatttcactagtgggctacattagtgagagttaagcccattaataaaagcccacctgaccaataattatacttttggtcaattgcttccaagttcattagtttccgtaagtgttttcatttttcaatgcaacactcttatgtgttgcagccttgcagcaccaagtgataatagagattatggatctttcaggtgacttgaatcatatgataaactctaaagtactttaaaagaaaaacattcgttatctgtctcgaaatatttctatgttcaggtactaatttttcacagcatctggttttacgtgtccagtttcttaaggtacgcgcatggcgtaaactgttgataacatttgctttttattgcttgttggtctactaaagtcaatcactttagtcgctacctagacataaaaagtttagtacttttagtcttttacattgattatcatctccaacaaaaccggatacacatcacatattttatcctttggattaaaccgggatacaaaaaaaaatctaatcggtaaattccattttctcgtgaacaagtatgggagaagagtacataaccaattaaaatatacacttttgttcctttacacagatttttgttttggattctaaagttgcatatattaaatatttggttgctacattctattccaactccagtgggtctttatctatgtgatatagtagcattaaaaattagtaacttgagtttgtcaattaatttggaatctatagagagtatatacaacagtattctgaattctgaatgatagatttttcttaaaaagataggcaatagaaggacaaaatagtcaaaataagctgctgtcattttcaaactagtgattgtttttaagatctgaaggatatacttaagaaaaaaaatctgacacatcaaagtacaaaccccatctttattatttttgcatttcccaaacacagtcaaaccaaaatctttagtttacataataatttatttgatatattattctcttattaattcttgtgcatttgtttgcattttagagattttctaaaaagacactgaactaaaataacctcctaatattttattaaacttcaatgtctcattccggtttgatttctcttccaataaccaaacttggttcattcaatgcaacaatggaaattatgtgaaaaaccccaaaaaaattgaaaaccatttattaaaacagaactagtgttaaaggagagaacaccaaaccatttacattagattacaactagaaactataactggactgaacatcatcattattaaagacacaaactctttatttcattcacattttaacaaaaccctaattatattatattttaaaagttaaattcatcaatattaaagaaaacaaaaacaaaacttaatctcctgaaaactgaaaaccataaaccaaagatttgtttcctcaatttcttcttttatttatataattaaaaatcttcaaaaacacaaaaaaaaaataaaaaaattagacactaactagatcgtccctcgtctgatgaaagaactcaagaaagagagagagagagagagagagagagagagagagagagagagagagagagagagagagagagagagagagagagagttgttagctagctcacacgctttcgcttaaaactcaaaaacctgcactttctcgtctattttctcggcattcgtaaaacagaaaagtgggtctccaagaaaattaccctaaattcacaaagattcatacttttctccacctccaatg

SEQ ID NO: 8537 - DNA, 3000 bp, Unknown; identical to SEQ ID NO: 8531
  misc_feature (1)..( 3000): cDNA_ID_1825608_gDNA_ID_1971815_Annot_ID_58217 3000 nt of promoter + ATG

SEQ ID NO: 8538 - DNA, 3000 bp, Unknown; identical to SEQ ID NO: 8530
  misc_feature (1)..( 3000): cDNA_ID_1825605_gDNA_ID_1971815_Annot_ID_58218 3000 nt of promoter + ATG

SEQ ID NO: 8539 - DNA, 3000 bp, Unknown
  misc_feature (1)..( 3000): cDNA_ID_1825601_gDNA_ID_1971815_Annot_ID_58219 3000 nt of promoter + ATG
gctcttcacgttaataacgcagctgcttctgctgttcatcctgaaccttctttttgagtctaataagtgtcttataaaaaagaataataatttatacgctaatttctgtaattttttttatacatgggattcgtttgggttttgattttgttattgttttgttccggttaatctataatctaaccaaatttattttttttacttgtcaatacgagccttttaatttatttgaattcactttatgatctactatttatcattaaaatttttgtgctatacataaatttagttgatccaactctgaaaaccatttgacatgcaaataatggaccaaacaaactctaaattaaaggagttggtctgctgtgaatcttttaaattgaagaacaaactatggtgcaaatgttttgtctcaaaataagaagttgaaagagttgaataatcattcatctcatttcgtaccatctgagatgaataagttgaaaaattcatttaacccattcaaaaaaaaagttagaaaaataaattaactataaaagaaatttgtaatgagttgaataatgtccaactttatttttgtttaattcatatttttcaatcattcatttgcatgtaaccatttgcagacttattttttaaaaactaattatttgtttcgatacccgaaaagatgccaaaaagagtatttgtttatgcattggtaataagttattttttctctacaatagttcaaaattcctatagagatatgtttactataattgtaaatataaaatatctaatccattacttgcatcttaaatcaattaaatctagaaatacaattacttcaattagaacatcaatacaacataaaattctataaaggtatgagacgtaaaccaaaactcggatttactacaatatgttggaaatgtgtatattagttgactttacgatatgttttatttggcaaagtcaacaaaagttgatgattagttagaaaaatcaactgaaattgataaatttattcaccacaagcaaagttggtgttttgtttcaccacttttggtaagttgatgtttgtttgacattttccttcttattattcggaaaatcatgtggttaatgaatcatgcagacttttgtgtttagtgaaaataagaaagtgttttctcggtctccgatgactccaaatgagattaatagctataagaagtggattattgagtttgatgatgagtatgaagtaagtagaaaagtgaaaagcatgatacaatgttcaaaaccatgttgcatgataatatgtagaacaattaagaagtgaatgccattcatgctttgggaagtcaatcctcttgaaccacaacagaggtgttgacgaaggaggccttgttcgagatcaaaaatcacatagtataattttacctttttgtttaattgaataacagaaatgtatgttaactacttttgtttttgtttttgcttttaggtaactgctggacgtagcgacatatagttacagtgcaaggcgtttgatcattaaagaggagaaaaatttctgaatttttattaaaagatatctcacatattatattgaataccatggaaatatttaagggtgaaagaaaagatgaacaccactacacaccactaccatgagttctatatctgtacatgaggatactagagatgaaaataatgaagttgcaaaggaggatactagagatgttaaaaaagaatttgactatgttatgaccccccaacggaactctccaaccctattcaagatttagaaataagtggaaattagtaaatcaaacaacttaaaagacttgtataggatgttgttgaaccaacagttgtggcgcaatatatttatttcataaatttaatcatttatttatattattatttacaaatatgaaaattaacaaacaacttttccgctttaactaaaaacgagtctaaaaaatctttaatgtcttattgagtcttgtggatcgacctcgcatatattaccttttggttaaatgtaccgagtaattttttattttttttgtacagtttattcgcgagtaatctatgaaatatacatgtatgcattattgattggttccttgtccacatatgctccatatttttaatcaattaaccttatggttagcttctaatataattaacaatgtataagatttgcaaatgagtctaacggattaggcttagctcacttactaacaatctgcatcgcataggtttacaaattctgtagtttccgcatacaatacatttacaaaaaaaaaatgttatttttgaattttctatttcaaatttagcgcatatattttcaccatttaaaaaagaattagattcattttaatattcaatttataatgttattgggaaaaaaacaagagattgtatttttggaagaaaacttaaaaatgtggtatttaagataactttctttgcttttataaaaattacaaaaaaaagtgcaagtacaaattccattttcaaacattaattacattttaaaattattttgtgattgtagccaattgtatttttgtgtggctccgtaatttagaaaacttttgaaacaattttgacaaaactttaatctaatttttaaaatcatatgacaaaataaaataatattgtaaatgacccaagaaaacctgaattattcaagagaaaaagaaaacctgaatttacctcttgttcgtgaatttacctcttgttcgtcaatctatcatcttaatttcgagttagttttttatattcttttctcaatcctagttgctatattttttttttaacactagcattttggtcattaaagtccagaaagaaaatatacaaatatcaattgaataaaaaataaaataaaaaaatggtgttttaatttgattttatgctcaaaattaaataaaaaaatgaagcattttccagcgccagagcaaaaaaaacctagcgattgaaaaaggagactcgttttcgttgggatttatcagaatg

SEQ ID NO: 8540 - DNA, 3000 bp, Unknown
  misc_feature (1)..( 3000): cDNA_ID_1825595_gDNA_ID_1971815_Annot_ID_58221 3000 nt of promoter + ATG
aatcaatactttagagaaatattataatgtagaaaattctcaatgaactatgtgataatttgtatactacttgtctgatttgtagcttggtagttggggataatgatttgtgtgagtagttatgacttcagtccattaaaagctctgtttaaaaatgatattaaaaatcaataaaattacaaagtgggattattcgcacaaattgcgtgttgatatgctattggcaggttgaagaaagcaaatgacattgacatcgttatgattctattacaaaaactttttattttgtctacaacgttactataaaactttcttacggcatgattctattacaaaaatttaaataaccagtattcaataaaaaaaattttttttttttttttcaaaaatttctaagttagttctataataatgtattaaggagacaattattccctaattagcagtattatagaactaactcaataaatttctaagttagttctataatactgctaattagggaataattgtctccttatttatgggtgcgcgtacaggtatgtggtccatatgtacctttataccggcctaccaatcgtatctaatatttgtgttggatttggtaaatttaaatgtattaattacttcatattattaatgtgttacagatcacgatagaaaacccacattttgaatattttcgaccgaccgacctgatcaaatataaataaattatcaatttcctaccgatatatattttgttagtttttaatttgaatgttttaataaaattttgtttcttttgttaaaaggttaactttatataatgttaccctctttctaaaaatatctaagggacatgatattttggaaagtggtaatctttgttgtataattttatttgttttttttatatatataataataatgaagttttaaagtgacagtctaatatttgcaactctgaaatcaacctttcatctttttttttgagattgtcattgtaatatcaaatggactcgaactaaaaaaagtttatgttctttccaaaaatcatttgatgtataaccttatagatagtaaattagcaattgatgataattaattaacaacaatgaacaaacgatctttagagtaacaaaaatagcaatatgataagaagtaaatttaacgtaaaccttaaacagtggttaaattatgaattaatttatccaaatacttattagttatcccgtcgctctagttgatgataagtaaatatatttaaatcttcccactgagcttttagtatttgtatttttttttatcccattaactattttatggtcaaccagcgtcgtcgtgtcgccattttgtgaatcaaactaatttatttaagtagctttggtcaaccgaaactttcctaatgaccttcgttacgtcctctatccgcaaattgcattgcatgggcgtcagtttttttttccttttttcttaataacgcgtcaatttattttatgatgatgattatgtttagttgaaataatcttcagttattaattagatatttcttggtaaatattttttacaaatatgctgtcagaaattcaaagttatgtatttccataccatattggactccatactttatatcttctcagttgagtatccttcaaattcacctgttttggaaattggaaatataatttagttttagaaatgttttaagttaaaacataacagttaacaaagaaaagatatagacaattttaagacttttaaatgtgagggattctcactttttcgttgttttctaatggttccaattcatagttatcgtataatattatttaacgaaacattagtcaaataaataatctatctattcgccgactgtatggctgaaaatattagctggagctagactcgtattgaaaaaattaatccatatatttgttgcctaggagagtgacattttgacctttttaataacataccaaaaaggccgtttatttaatatattatccagatagcagcgttgaatcggattttggttggttttggtttatgtgttttagatttttggttaaagcaaaccactaacttaagtcaggtcaaagtatttcagcaaaactaattctcaaataatcacttttactccgcaaaactgcttgtcaaaatatagttttgacttccaacgagccattttttgctaattcagtttaactagtatacgcaaaaaaaaaaaatgtttagataaattaaaatttcggttaacttttataaaaaagtttcagtctgtctgtttgattcggtttactttaactaaatgccactatcttaaaagatgaagtaaacatttataataattcggtatggtcggtacaatcagtctagtaaaaccgaattgagaaaaccaggtcggttcgaatatatccaaaaaccgaaaacacgtgtgagaaagaagaaatcagggaattaaatctgacagtctttatagttttctttaatatgtcttccccaaaaaatcaaattatgaataaaaaaagtggatcgcaagttgcagtttggttctttacgggcaacgaaggctgttaaataacagccatagcttttcttcgaaacgaacccaaaaaataatatcagagaattttcatcattacacctttttttttcttttgcctttgcctttgccttcacacgtcttcttgtttgtactctccactttttttttctttgtgtcctttcttcttgttcttgctctagttcgtgtctcttctttaactctctgtcactattataaatatcaaactctgacattttcttctgttcaaattctcctcgaaactcccccaaagaaacaaaatctttttctgagatctaagaagatgaaaacaagacgtgggaaacgtcctgaggtacacaagattaagattctctctcttttttattcttgtttctttaattctctgattacaaagattctgatgttttctcgtctttgatgtaaaacagaggttttggccatcaattgtgatg

SEQ ID NO: 8541 - DNA, 3000 bp, Unknown; identical to SEQ ID NO: 8528
  misc_feature (1)..( 3000): cDNA_ID_1825591_gDNA_ID_1971815_Annot_ID_58222 3000 nt of promoter + ATG

SEQ ID NO: 8542 - DNA, 426 bp, Unknown
  misc_feature (1)..( 426): cDNA_ID_3045665_gDNA_ID_1971815_Annot_ID_58223 3000 nt of promoter + ATG
tggcattggtggcaaagctttatactttctggctactgcaagctcatcactgaaaagagcttaaaccagagagatctgataagagaaattttagagtctctctgcttcaacaagatctacatcgaccaggttcaatatttttctctactgttagttcgtgttctagctctgtttcaacgagatccgattctgtgttttcgatttcagtgctaaagttacggtctttgaatctttctatgttaggattagtcttttgaatccataaactctagatttcaattgttaaaggctaggttttgattagtttgaattagctagatccttttttaacagatcttgatgtttaagctcaaagttgtgtcgttatactgagaatcaagtttgtgatttgttgggaatggtttcaggagattagaaagaatcatg

SEQ ID NO: 8543 - DNA, 3000 bp, Unknown
  misc_feature (1)..( 3000): cDNA_ID_3045717_gDNA_ID_1971816_Annot_ID_58224 3000 nt of promoter + ATG
catcaacatttgcttcctgtctcatctctcctctttgttcctcggtcagcttcatgccttgcttgatcatccatggaggcaacattttcaggctagaatctccacctgtagatgtgacatcttcatttccttcaccaaggttaacctcaacctaaccatgtaaagatcaaagaaatcaactaagggaaaaatgcatggaaaacttatcttccataataacattgtaatattatatacattgagaactgtaacgaaagatcacctttgtctctcccagaaatggcattggtgttgaaccatatccgcccaaagaccttgaaggatcatcagggttaaaatcaccattttcacgagcagccttagctgcacgagcttcccatgccggaaaaggttcaaaggcagggaacggtaggtcttttactctatttattagttccatcaggggtttcagttcaccctacattttatttccaattgtgtcaacgcacacactacagccacagtcttgttttgttttgcaaatctcaagcattggatatttaagaatgaatctcctaggaaacttaatcatatatcgttctgatttcatcatgaatttggaacgatgcacaagcttcagtgaaggcaaatcaatttgtgtttttctcatactttcattgaaatagccgctaaaacagtaaacacagacctccaaatcctgaagccaaacttttactttctcccgctgccgtctccttgcattgtcacctctatctactacttcttcggaaattagcttgttacattccataacaagttcaccattgcaattttcacaatgaaaagaatcgtcttccatagaaattaatctcagggcatccagtgcattatatctataccagaaatgagaatctatacaggtttagtgaaaataatacaactcaccatgtaaagatttaaaaacataaagaatagtggactttactttcttttgcagttaggacagccatactcctgaacagtatttctgtcttctagttcatctttgaactttttcttgagccggtgcagtttataacgaacaatatcatatatctgtaagagagaagaagtgataaagggtagtttgattaaacaaaaaagaaaccagaaagaaaaaacaaaaagcataacagcaaactgaaagaaaaaaataaatattaggggacatgaagcatacctgtgcataatcaagacagcaatacgagtgcgtgtggaacttaacattgtcctctgctcggccatcagttgtaccacccactgcataactatacatcttcgcacgctttgcagtctattgacaagattgagaataaatcaaacaccagagtaaggaaagaagtgttaccggcttatagacaagaaaacaatcaaacagaaatatacaaccacaagtttgttgagttataggcttagcaaaaaaacaatattgtgatatatatcaatctgaaagaagatagtttctgcacagacctctttcctgtggtaacgcatgacaaatttttgttcttcaaaatgtcttattaattttcgaagctccttggcattccgcttcacctcttttgccaagtcttcttctctaacccattgccgcctagcagacatagaacagaataaatacaagaaatgaaagttagtgaaaacatagccatttattcaacaaacctaataacctcaaaaaatagtctaatccactgaagagatgcatacaaacctcgtaagcgcgtccagcacgataacagcactacctttaacatttttcacagatttctgctgattatcgctttccggagtataattgtcatagaaaatccttactaaaagcctcaccagcctgaaaattaatgcaaatcaacttaggagatgcagaaataattgataaaaacgcgaagttagaacatatatattggatgtctgtgatttttggatagaaatggtatagagaaaagtacttgacaaacggctcgagcacaacggttttccgcaccaccgtgattgatttgtccatggaatataaccagacactttacaatataaccagtcgaatttgtgttggatacaaactctgcaaaatacaatgatgattgattgattgaaagataacagaggcaatggagattgattgacaaacggagcacgaaattagggttttctacgttcagagcgagtatctcagaactcaaagcaacaattagaatgccgataactctaggtcaagtttctacgataacggagaggttaaccaactacctaagatatctagagaatcgatcggaagaggaaaatcgccaatgctaaccggagagctcgagagggagcgagccagagccccggaagaagaaacggagtttttggttttggtactaatgcatataatgtataaactattgaaggtaaatagaacaaattccaaatttggggttattgggccgaatattgatgggcctaacaccgttctcaatttcgtctcccttcaatcgacagagaaacttctatttcctctatcgtcgataaagcaaaaaatcaaatcaagcttcttcttcgatcttcttcttcgatcttcttcctctcgtcaggtttcgtgtggttcgttctaatcgcgttgtattctttctccaaggaaggttcgtatcgattcgattcgattcataatcgctttcgttctataattcgagaaatggaaagtaattgtggtgtttagcttgcgggatcacagatattgaaatcgctcaccgtaattatgaggattctccagatataggctgtttctattaaatcaagctcgaactctactttttgttgattcgagaaatgaaattttattgtggtgtttaaggttgcagaatctagttattggaaaaattgcacagtctataaaccctaattttgaggaatcggcgttgtctaagttatttggtggtcatgatcatcttttgaaaacagtagatattgatggttagagttacgtttattcttcagatg

SEQ ID NO: 8544 - DNA, 3000 bp, Unknown
  misc_feature (1)..( 3000): cDNA_ID_1840079_gDNA_ID_1971816_Annot_ID_58229 3000 nt of promoter + ATG
acgatctaaagttaagttaaatgaaatgaagagatatgatacaaaccagtggagatattctcgttggtgagggttgcttggactcggcacatctggatccaccataacctttattaaacccatcaacaaccgtataagagagaagatcgattatgaatatattaaagcaatcaagaaattaaatcatgagtttgattttttttttttaactcttgaaaagtgataacacacattaagacgaagaagttaaccaaaagttaatagaaaaagaagtaaagacgaagaagcttaaattagaaaaaggtaatagtaacattttccattaatataagggtatctaaaaatactggctttactattcagattcaaaagtcgttaaaataagtgtcaattaagatatttatgcttttctaaaggtatgtatcctagaataaaaaaactaaaataaaaataaaagcgaaacaaaatcaagttaaccgtctcttgaaaacgtaatatatataatcgagaaagattcaaaattgatttaaaataataatcaaaccaataacagttatgcatgcaagaagttagaggaaacgcagcaggtatatagatgaggctacgaaagaaaagaatgatcaaatctagttacgcttaaatttggatatatctaaggtttcttcgtcaatatatggagcttacgaaaacgaaagagtgagctacgaggaactaaatcaatgaagataagaggaatgaaggagagaagatcaccaaggtgtagaaatttctgaagtcgtctcctccaatctccactattggtttgttcagaacttgagaaggccttagatccaagccattagtaacctctctatggccataagtgaccttaagagagaccaacctcgtgaaaggatcaagaacatctccaacaacactgccgaccacaagaggatctctacgacttaaagacatatttatcttggatctcaagtatctcaatcaaatgttttgcttcttaccttatgaacccttacttgctattctttatataacgttttgggaattgcaataattagctatttagctttattctctccaatgaaatcattaccagggtcttttcgtgtatagtttcgagaatctacaactcgttcaacgtacgtatatcacttataattcatgttttttttttctttccttttttctaaatttatagtattcttattccaaaacccaccagtataaaacagaaataatcatattccaaattatacatcatccacttgtttcttgctagccactagtatgtaatttattctgacttatcattgtaacttcatgaactatttaaaataatgtcacaagcatataatatgctgcatatttgcgtacgtcacgcattttgcgtcacatgtcactcatttaaatagttaaggacactacattacaccgattatgtatgatgttaatgcattttagaataactccttcaacctaaaccatcatataaaagtatatatgctccagataaattgacgccataattgttcacatatctggttggtgtgtacatacgtactagactcttttttttcttttcttaatgtagtactaaacttaattaataccatcaaaaatatcaatttaacaaaacaaaccagtaaaacttttaaaacaatggagtaaatcaaataaaacaagtaaattaacaaatagacacaaggtaacagaagtataataacgacagaaaagtgaacaattggccaaaaaattcgttttcaaacgtgatttcaaaattgtctccaaatcttaaatgttgataaagtaatttttttaaaattcattatacctttcaaaaacaagtgtattacctaaaagctcaaccgtgtattcttacactccaaacaaatttagttccccaagtttggaagacaaaaatttctaagaaatttctgacaaaacacatgagaaataaaccgataaagacttctaaaaactattgcagaccagtttcatttgctgaccacaaaaagtcatgagaatacaattagctcagtgattcttgatatttctggtacctaacaaaaagaaaagtgtgtgaggttagatggctatgatttttgctctccaatttattgtccatttccccaatttgtaatatgaaatgcgcaaattactcttcttccgatatgaataagcaaacgaaaacatacgtgggacgttatgttcagaacatttgattaaagtttatatgcgattttcatttatttattatgaattttttgtttggcagcatgtacgatttttcatttaacacacaaatattatagaattttcattggttcaaaggggtagacaaaaaataatttaatattattacaccatttgcagaaaattagaaaatatatttttacccataattaattgatctatggacgtatgcttggcataaaaattcatatttaattagcagaagccaatcgctgcgtttgtatatacgcgtttatgaccgagaaaaaaacccttacgcgtcatgtaaaaaaaaaagaagcgtaaattacgaaaaacagagagataaatccgggcattgagattttggagatagagagagagaaaaatcgaaatctattgtctatctcctcaatttggattggattttctgcatatcatcgctctagctttcgcgggttttggattcgattccttacccttctccaatcggtaagaacaagctccaaagtttgttcctttttttcaattttcgccaattctgtaatctcatcattgtccttgtttgtttgtttgattcaacacacaattcttgttttgatttggatgcagaagtttttggctttgaattggatttgggtttcgttccaaaatcagctctttttgttaatcaggtgagtttttaggtatttgaatctccaattgcttccttgcaatgactaagtattgtgaaatgtttagggtttcatctgtgtgggtcttgttttgaagcaatttgtgtgtgtttgg

SEQ ID NO: 8545 - DNA, 3000 bp, Unknown
  misc_feature (1)..( 3000): cDNA_ID_1823402_gDNA_ID_1971816_Annot_ID_58231 3000 nt of promoter + ATG
aataatttggcattcttttgctccatggaacttgaccttctcttctgtttgttgacttctaaaactccatcggcccttgtggcattgttaatgtatgtatgaatataatctgatacaccaaccaatcattaagatttgggtttgaaatctgtctcttccgtggatgagatatgctacatgtcacaagaactggtcttagctttggtagataagacttgtcttagagcaagtcttgaaatctggaaatctattttgcagtaatcttgtcacaacaaccataacctaatcagtcagtaccctccaagaacattaaagttagatgatccgacaaaacctctcaacaagaccaaactctttccatataaatactctttaacactgacacaaagtttcatcactttctcttgatcactcactgcatcaacaatggccagagagaagattgtggtggctggtggtaccacaaagagctggaaactactcttggggctgagaatatttgcattcatggctactttagctgcagccattgtaatgtcactaaacaaagagacaaagaccttggttgtggccaccattggtactgttcctattaaagccactttaaccgctaagtttcagcacacaccggcttttgtgtaagcgagtaaaaccctatacgaaatcgattcgatacatattgaaagcaaaatgtttttgagttattaacattgattcttggttttacaggttctttgttatagctaatgtaatggtgagcttccacaacttgttgatgattgtggttcagattttcagccggaaactggagtacaaaggtcttcgtctcctctctatcgccattcttgacatggtataaacattggttttcaaatcaatttactggtttgatttcaattgaattagtttgaacgtttggaaaaaaagctaaacggtttcttgataatctaaaaaaacgttggaaaaaaagctaaacgcaacactagtatctgcggctgcaaacgcggcggtgttcgtggcagagctagggaagaacggaaacaagcacgccaagtggaacaaagtctgcgacaggttcaccacttactgtgatcacggcgcaggagcaatcatcgcagcattcgccggagtcattctaatgctcctcgtgtccgccgtctctatttcccgcctcttaatcaattctaaaaacttctccaccaccgccaccacaacctccgtcgtctaaaacatcgtggccaaaaattcagcaacatgtgtgtgaccattttatagatgttgtggcttactttgtgtgtttgtctctcaagtcactagcaaattgtgtaatgcactcctttgttctatcactttcacatttgtattcaagttttcatttctctcttatctttttatataattctaaaatgacaaaaaaaaattcacaaagtatatagtacattgaaacaatgagaaaaatctacaatagatgattagataagaccaattcaagataatttataccttttatttctcaactacttcttctatttatggaaatataattctaatcaattgttagttttttacattaaaatgaattatatcaaccgactaaaaaacaaatcagtattagttctatcgcattgtagttcccatacaacttaatttttgtgttgtaaataatgatcctactgtctctaataaatgtgaatcaataatcataactattgaaatccttttctttttggttagtaaaaatgaagtgtaaatagtataactgtttaatttagttcagatatacaaatcaacaaaactacttaatttgaagattaattcagtttttttttttttttaattttctgtttataaaactactgaattttatttggtataaatggattgaagattttattacaaaacaaaatcacatttggcggcttcttctttttatgttctaaacccttttcttagatcggactccaagaaatctacttgctttaatcgttaacctaataaattcttctctaagttttttttttcttaactcatcaaagaaggaaagaaaaaaaaaaacctctttcacagatatttaaccaaaaggttttagatttatactatacgttacaaataaaattcgagagtcaaattcaatcttgggaaaagcttttgttccgaatcttggccccttcacgaaggtacacttatcatctcactctctatttccagacacaaatctatatgcgttctgggtttttttagggtttcgaaaacggcactgcatttcatcaagtaagggtttgttttttatttaacagatctttgttcttccttaggtcacgggttaaaagtatcgatctttgtgaacttaatctcactgtaaatggatcagcttgcatctctagcagagtctgtggctatggaggtttctcatctttatccttttgcttctttgatttgtgttttttgctttctcctccatttgtaacctctaatttgcatgtttgctagattcaattagcactgttgcagtttctgaatgtggaattgtgtttatttcttgcaggaagattctgagaaacaatcgattaaaggagagagtagtcttgaacctgactctactccttctagtcctaaagtaagttaattgggtttctagcaaagtattggttgggtaaagaggttgatggcttatctatgtgctaaacccgtttgagtctgaaaatccaatcaattctagttttaattaagttcgtggcttttgcttatcagtatcttccttcaaagatctcatctttctgagagtcgttcttattgtatttgttttagattaagcaaaatctatttacttgggtcttaagaatttagcaatctcatctggatcttattagattgtttgttgtgttagctatctgattgtccaagagcagatgaatctgattcatgaatgatatcgttttgttgcgtatttgaagataactgctaggtggaatccatcagaagcttgcaggcctttggttg

SEQ ID NO: 8546 - DNA, 3000 bp, Unknown
  misc_feature (1)..( 3000): cDNA_ID_1823386_gDNA_ID_1971816_Annot_ID_58236 3000 nt of promoter + ATG
ttttccttgtttttgattctttcattaaggtcccacttcccaaccaaatattattttattttgcttatatatggttttgactttgtattcattcatcttttactctaaacagcaatctgcagctaacttgatgattgctggctactgaatcttgagtttgtgtctggagttttgtctcaacaataccaaagaccataaagactttgaggtgatttgagttcagattcttctgaatctccaatgctaagtttctctagagctagaagtcaaggaagaaacacaagacctcttggaggaggttagtcttgaatcacgatatttatatattttaagtataatgagtctctgcaacattttagatgatcaatcattttcttttgattttgataattcagggatggaatacttagaacctaaaaggaagagcaatgtaatgggcaagattatcttggttgtttctcttactgctttatgcatttttatgctcaagcacgcaccgagtttcacatcaccaaccgcggtaactccacgatcctatttgctagaatctttgatatgttactcttgtcttaatggctgggaacatttctcttgcatcatggttcttttagtttatgtttttgtaatatcagtggtttgttggttttctcagttctctcgtagcgaggaaggtgtgactcatgtgttagtcactggtggtgctggatatatcggatcacatgctgcgttgaggctcttaaaagattcataccgtgtaaccattgtggtaaagtttctttctttgatggtatttggcgatccattggagaagtttcaaactgcaatgtttggttttgtaacactaatcattttgtctcacaaacaggacaatctttctcggggaaatcttggtgccgtcaaggttttacaaggattgttcccagaacccgggaggcttcaatttatttatgctgacttaggagatgccaaagctgtaatgcttcatatccctaagattcttttgagcattttttttcctggtatattgtatgaagtatgagttttgttcatttcaggttgataaaatcttctcagagaacgcgtttgatgctgttatgcattttgctgcagtagcatatgttggagagagcactctagatcctctaaagtacaatctccacccactgttctgttcataacacctctgcaagattggagttctttgtggttaatcaatctcatgttgatttttgttctgtaggtattaccacaacattacatcaaacacattagtagttcttgaagctgtggctagacataaagtgaagaagttgatatattcaagcacatgtgccacttatggagaacctgacaagatgcctattgttgaagttactccacaggtactattctaaacagtttcagaaaacactctctttcgtagtatgatcatgtctcctcaaattcggaaattatcgattttcaggtccccattaacccttatggaaaagctaagaagatggctgaagatatgatcctggatttctctaaaaactctgacatggcagtcatgatcctaaggtcaggctccacgtttcttgaagccttaacaagtctctgactctgatttgttcaaccaaacaatgtctgatgatctttattacttccacagatactttaacgtgataggttcagatccagaaggtagactaggagaagctccaaagcccgagctacgtgaacacggacggatttcgggtgcctgtttcgatgcagctcgtggcgtgattccaggccttcaggtaaataaaacacactcatctctcaaaactctctctatgcttcttttttactcaactcttataactgaaaaaatggattcaaacaggtcaaaggaacagactacaaaacaggagatggaacttgtgttcgtgactacatagatgttactgaccttgtagatgctcacgtaaaagctctcgagaaagctaagcctagaaatgtgggaatatacaatgtaggtacaggaaaaggaagatcggtgaaagagtttgtggaagcatgtaagaaagcgacaggagtagatatcaaagtagattttttgcctcgaagacctggagattacgcagaggtttacagtgatccagcaaagattctgagagatcttaattggtctgctcgttacactaatcttcaagaaagtcttgaggttgcttggaagtggcaaaagactcatccccatggatatgcttcttcttaaagacgaccaagaaagaaaaaaaagttttaattttaaactttttacataattgtttttgagagattagcttatagaaaaagaattgatttattacagaattacagttcaataagtattattattatggtaatttgatacagtttacaagagttgtcgatgtaatcagtgactttatatataaaaggatacagaattcaatagacgtaatcataagaatggtgtaaccaaactcaaatcttcatattgtaatgtcattatccacattccacaatgtctttttagtgaaaggataacatctccgaacactatgaccgggaagatttcatcatatcaccaccgattgaaaatcaaacagctgcaacatcaagaacatataaatagtttcaggaccatttagttctcatcacacaagctccaaaatttgacgggttcatttcacatgtaacattttatacataaagtatgagtgtcacacatacatgaataagagagacgtgctagaaactccgaacggcaggtatatatatatggggcaaattctatacaccaccaacctggaggggtatcttatatcattaaagtttacccaatttggcctcttcttttgcaaatgcaagtattttttttttataatcacgtcaaccttcaggtgacattttcaacattaagctaataacctctttctttcttgttatgttataaatagctttatatcagaatatttgtagttgcttgcttgttatcttaagttttcgaaaatg

SEQ ID NO: 8547 - DNA, 3000 bp, Unknown
  misc_feature (1)..( 3000): cDNA_ID_3091180_gDNA_ID_1971816_Annot_ID_58237 3000 nt of promoter + ATG
gcaagcacgcagctctggctcccagcattaggtttatatgcgttaacaaaaaaattgaggaggaggccagagctgaggctccccgtgatacaactagtcaattaacttaaagttttacttactgtcattatgtggtgctgttagatttggatgcattaatttttaattaagtatataaaaaaaattcatagaatattttgtaattattaagactttctattgtctaacactaattagaggttaaatatttaaaacaatatatattggaccctagagtaacaaaaaaaaaagaatttggaaattttgtcacatagtctctacacaaatgcacttagctcacaaaccattggggatgcttttatgtagttccccaaacctagaagcttactcattagcacatcttacatgcttatagagcccgtctctactattacattcttacgtcgaatttattgtttaaacttaagttcaaaactcaaaagcaaactaaattggagaaaatagaacgcagcttgcaagtgtttttgagactacaagcctacaatatatctaaaggagacaaaaactagtaggtaacctaatgactaaaagaattcagcagtctaaaagagtaataaggaggcctcttttagatttggttggttaggttttaggtgggtctctattataattacgctacaagactaaggatattgacgtctatattttcgtctcctttcgtttgaaaaaataaaggaaaagcaaagtcaaccataattaggccgtcgaaggaattctaattaatttcgaccagaacgaaacatgcatataattgaccattttgattatctcacaatatacaaattgataaacttgatgcaaaaatgttcgttgtgttagtaatgatattttttccacactcttgttaatcagtttgatgactattttttctttgtataagagagaatgaaaaacaaagttgcatttgtttaaactttcaattattactcacgtagaaagaatgtatccatattgagaaattattacgtagcaatattctatatacaaagtcttttatatatgacatgtctctggataattatttgtttactatcgattcgttggcctatcacgttagatggttataaagcagtcgctacaactaggcagcaaaactgctttgatcaccatctattgttttttttgtccatagtttgattaaagaatgaggatatggcaacaaatgattgcatattagttgatattacaatcattgcaatcgcacatcctacaaaactaattgaaattaatatccatataaggaagaaactcattagtgtcgacatgcattggaacaacgactttgtttttgtttgactttgattatagtcacggtttctcactaatagtttcattctcaccacccctaacaatttagaaacaaggttggttttgaatgacattctcatgataaaactaatgaaatccgtgtagatgtttggttattccgtcttttatgaaaacggataaacaattcaagaagtcatattaattaatgtaacatcatcataaattcataatgttttgacttagattgtagtcacatctctcaatattgagtcattttattatcaaaacctgctttacgtagtctagtcaacgttattttagtaaaaaatctttcacattcattgtataaaacatttttttttgacatcatgtaaaagatttgaatcgagattattacacgattatgaaactactacaaccactattttgcaaccaaaaaaaaaaacaaaaaatacaaccactatatctacaaactaaggtttaaaaatgtacaaaaatacttgggggtttaaaaataatttagttaaagttgaaggactggtttgtaagtttttcatttccataaaaaggaaagagcttaatagaaggaaggaggagagagtggtgaccaggtctcgtagttgtggtttcgttttgcattgcacgtttcttcttctttcttcgctcctcactttcttcttcttcttccgcttctcctctattttctctctctctctctttttctctttctcccaaaagtctctcttacgttcttgtctctcccttaataacgttgcgcctttctccatttcaaccatcacacaactcttcttcttcctcctctctctcaattcgtgttttcccaaattctcaggtactctctcttatctatgtcttgactcttcctatttacccaattcattaacctgattttgttctgtttctgcattttgccccacttttgaaacgaattcggattctgatcaaaataacaaaattggggattgaaagcgtttctgggtatcttatgatccgtgatttctcagatgggtttttcataaagcagagaaatttcgatcaaagtcgatgactttaacatagactctttctacatttttgttgctctgtttttgttctgttctgtgacaaacatgctctctgcctttttttctctttccaattaacatgtagattaataaataattgaactttgatcttatttttttcataaatgtaattcaaacttttgtctgtctttttccttgtttttgattctttcattaaggtcccacttcccaaccaaatattattttattttgcttatatatggttttgactttgtattcattcatcttttactctaaacagcaatctgcagctaacttgatgattgctggctactgaatcttgagtttgtgtctggagttttgtctcaacaataccaaagaccataaagactttgaggtgatttgagttcagattcttctgaatctccaatgctaagtttctctagagctagaagtcaaggaagaaacacaagacctcttggaggaggttagtcttgaatcacgatatttatatattttaagtataatgagtctctgcaacattttagatgatcaatcattttcttttgattttgataattcagggatggaatacttagaacctaaaaggaagagcaatgtaatg

SEQ ID NO: 8548 - DNA, 3000 bp, Unknown
  misc_feature (1)..( 3000): cDNA_ID_1823368_gDNA_ID_1971816_Annot_ID_58242 3000 nt of promoter + ATG
accaatctacaatgccattctggggagtccttggatctattcgatgaaggcgatcccctcgacgtaccacctttgcttgaagttcccgataaacacaggaatcttcatactatacggcaaccagaaggtctcacggacatgttacgtgatcgagaagaagcagcgaaagaaggaaatcttatagcaattaaaggacgaagagcgagctgcaccgtcggagcgaccagctcgcgagtcaatgaaggcgccaagttgcaagattatccaggtcaacatcgacgagtcggatccatctcggacggttggtatcggaagcgaactaggagagaaaggaagagctgatcgccttcttgaaatcgaggtcgtcatcttttgcttggtctacgaaagatatgacaggaaacgctccggaggtaacctgtcataagctcaacacggatccaaccttcgaaccagttcgcaacaagcgaaggcgcctggggtcagaccgcgccaaagctgtccaagacgaggtcgagcgccaaagcaatcagagttcggaagtactgcagctcgcggcattgatccccatgcagaaatccgacctgagcaatcaaagcaacgaaattcttaaaaatcatcccgatatcgaaaacacgaaccaaagcaatccttacctggttaacaaagttctgacactccgtggtatcagcatcagtagcggctggcccaagatagaacagagaaggcgtcctgggaatgaagtccccatcagcaatgattgttggattcttctcctttgaggcggcagcagcatctcgatcacagtcctcacaatatgacaaaagaatgtccggcatcggagccagaagctgaaaaccattcttgagccaatggcgaggatgcgactctctctagcatagccatttttcgagcgatatcagactttcgttcgtcatagtacctcaacatctcgcggtattccttatgtcttgactcgacacatgacaagaaaccctcggcttcacgtctttccttcgagctcgcctggaaaagaagagtccagggaactcgaaggttattgaagaacggcatcccacgttcaatcgcctcagcattcgagaaagtcggaacatttttgccaacaaaggaagacgatccagcactctccatcttgcaaataggaggaaaagtccggtgaagcaattgttgatcaacaaagaagtatttatagaagcaaatacagaaatcgaattgggaattttcttaaatgcgatctggaaattctctttccttttccgagaaacactaatatttgcattttctccaaaactgggaaaatgggaatttacttgattacgggttgacttccctcaatttccttttccaaaaaaatgacaaagctcataaatggaaaacatagagaaaatactattctgcctcggaaacaggcaagatggaaaatcatcgaaaatagaagttaaaagtaaaacaccgccccgaaagtgggtccacggttaaatatgagttttgaaatcgccccgaaagttgggtccacgatcgatgtatcaaaataaattacaaagacgatctgaatcccctcaatttccttttccaaaaaaatgacaaagctcataaatggaaaacatagagaaaatactattctgcctcggaaacaggcaagatggaaaatcatcgaaaatagaagttaaaagtaaaacaccgccccgaaagtgggtccacggttaaatatgagttttgaaatcgccccgaaagttgggtccacgatcgatgtatcaaaataaattacaaagacgacctattcagatcgtctggctcgcctcttcatcgcttacacgtcgaatatcactaccgcaaacaaggtcgacattcgagccgtgctggtccgccactggagcaacttgagaggtttgcctcgaaaaaccaagctgatctggagacatgttcaggtcttcatccccaagctcgatgacgttcaaagcattgacttcgtcggacgcccttttggttaactccttaaggctgctgagttcggatgccgcaatcttcgcgcctctctgcatcagaatacctactatctcctcagcacctttggcctgattctcagcatccacctttggcccgacaaggtcctcttgctccttgagataagcctttactctatcaagacgagcttgggctttctttgtagtacgggtgaccttagaagctcgatcattccgcagtctgttgcactcccgctccccgtgctccttcgcagcaaccaacgcgacttgaagatcgctgatctctttctgaagagcagcttctcgaccattgagcctgttgacctcgtcgttcaacgagctcatctccgccttgtgtggctccggagatcgcccgctcacttacatgattcccggagaaaatgagcgtccatggaatccccctcgagggtacgtctgtatgtatgaagcctacttcagacaatgtcacctctggtttccaattccgtctctgatcatctcctttctgagtcgccgtcatatggcgttcccccagcttactccggcggcgatctgcaattttgttgccgctctgacctttggcgctgaagaaggttacctggtaaacgttcgttgttttgaggaaatgacgacgttgaaagctatcaggtcgcccggctattgggtggtgaacaaccgcccaaagcataactttcttcccggtcccaaagtcagtaacttcaagaactgggaagaatattacttctacgtcaggtccgacctcgaatcgtatgagcgtccgttctcggggaggaaaaggatgtggacggagtttcctggtagatttcttttaaatagatagggtaaagacatgtcgatccgtactagattctcatagccgtttcttttgttgcagatcggtacaggcctagtccggagtttcccgttgagttcgaaggagttttagaggcaatctaccgagctcgacatcacgaggtcgcgcgtcaacaggata

SEQ ID NO: 8549 - DNA, 3000 bp, Unknown
  misc_feature (1)..( 3000): cDNA_ID_3091174_gDNA_ID_1971816_Annot_ID_175984 3000 nt of promoter + ATG
ccattttaaaaagggtcttcaggaacatcagattgaccgagctgccggtatcgattaggattcgttctacgtcgaagtcctccattaccagtttgatgaccaatgcatcgttatgaggatgctgaatcccgctcgcatcctccgaagtaaagatgatgggttcctggcttaatggctcggcttctggggcaaccctaacgctgcatacttgtcgagctcgcttctttaaagccgagactgaatcctcatcgtcagatagtccggccataatcatggagatccttccgcggggatggtctggagctcgctgcggttgctgtcctctccatctcttcgggggaccggggagttcgttctccgggaccctcgcctcctccacacgatcgtcctcgaggagcagtcggtgatccacgtgttgttcttcatgcgttggtcccgcctgggactgtttggagccgctcttgcgtttatttttcccattcttgggatggtagaccgcctctacttcgccggatttatattttccgaggatattcagaagatgtttacactcttcagtggaatgtcctccgccggctgttgaggtcggtcttccgaatcgactgcggcgacgatcgttcctcgcttgtttgcctttgggtcatagtgttgacgcggttcttgataatctccccgcgccttttccttggcctttggcggttgggatttgctcgccaactttgcgtcttcctcctccaggaaagcatatcgtgaagctctatggagggcgtcatcgagatctcgcggttctcttattgcgaggtcttttctcagcgggatccttggagcagccccttcctaaaagcagccaccgcggcttcgtccgtgatggtaactagacagtatttctttgaaacgacctaggtagtcgttcagtgtctcgccattttcttgagtcatgctccatagatcggaactagaggcccctggctgaataaatacccggtattgtttcaggaaggcagttgacaactgggtgaagttatcaattgagttcgcctctaatctggaaaagcaggttaaagcgtttccggtaagtccctcgacgaagagctggcagcagcctatatcacggagttcgtccgaaaagtgagctttagcgactgttatgaaagaagtcatactgtttaggatcgcttccgccctcatagatcggaatcctaagcttcacttagaggattctcgtgcgtgtaacccgatctgtgaaaggagtcctgggtttcttcgatcattcggtcgatctctggagccgaactgctggctctgtggacctgggatccgatttctcggagtttcagatagatatcatctaactgtccatcgtgatctaaggttgcgggtctcgagacatgacccgacaacgtcgagggaggcataggcggtctgccttcttggttcataggatggagtgaacctgggaacctggggttcaccctattggattgtgcatctgtgaggtcgaagctaagcccacgcggatggatgactcgcggcggggttatttcagagatcggacgttgggagattcctttagccagctcgtcgagtcggcgattagtctccatgaccgattctgagagatctttcgtcacggttgtgaggatggctttgaggtcttccaatgagaaagatagtgggtcgacaggggtctccccgtgtgttggttgattcacggtcgttttggccgctacttcgacggtagatggtggatctcctccgtggaggagacttgattccgttccatcatcgttgactggaggaatgacggggtcgatgacgatttgaaccatgcttgctttgattaaaggagcgtagagaaaatttgtttatattcccctacctggcgcgccaattgttgattctgtaatcaaacaatgaatttgtactaagggatttagacaaattcactcctctcttagctcacaaataatcaaagggagagaacaaagttgcttgaataaaaagctggggtttgctctataattgtaagattgtaaacatacatgatattaacatttcatttgcgttgaagttttcacttatcctacactttttcacatatttcacaaaatcagaatagagtcaagctcaaaagggtcttctttccttgttgattctaccaaatccgttttgccgattataattcaaaaacaagtaaagagcgatatttgatgaaatacaaaaattaaaaataaaactatatttcagtatattcctatattagaggaagatttcaaattaaatagttttgtgattgaacttcctatttgtttagtttttaaagcgctaacttttaaatatgggacgaaaaatataaactttcgaaatatcataaaattcagtttgatcttccgataaaatggcgaaatttcgttgaattggccatttcggacatgatgttaagttttgttaaccagacgatcaaatgattaattttccgttataagtttccgctaattgaaattcacaattaaaatttgaaaaagaaaaggaaaaatgtttcacacgaatacaggccgattcatgacaaacactgtaggcccattaaagcgaagcccattatcagtatatatactgcggcgtcgatataatatcctcattcagaattaagaaaccctagacgacgatatcgagatcgatccaaccaactctgcagctaacatctctaaggtaaaattctcggttcttatctcatcatgttactttgaaaattcatcgactgattgcatagatagaacacgattagcagctgtgttcctctatatctacctctctcgatcggtggtcaatttatctttctgatgtttgattttctaagcaaaattcatcgactgattgcatagatagaagaaccctacaacttctatagcagccgtgttcctctcggttctctgatgtttgactgaattgaatttgattcttttttttttaaggtttgattttccgatgatgagggtgatg

SEQ ID NO: 8550 - DNA, 3000 bp, Unknown
  misc_feature (1)..( 3000): cDNA_ID_3091180_gDNA_ID_1971816_Annot_ID_175982 3000 nt of promoter + ATG
attctcgacaacatgcacaactggtaattaagcattctagccttgttttgtcattgccctactatttgttttaccccaactagttaccctttctcactacttgtagtttttgtttgcctaaaacttgaccccatgttatcttttttcaagcagcttcaattccaaactgtcccctgtagccctggctctgtatgcaagcacgcagctctggctcccagcattaggtttatatgcgttaacaaaaaaattgaggaggaggccagagctgaggctccccgtgatacaactagtcaattaacttaaagttttacttactgtcattatgtggtgctgttagatttggatgcattaatttttaattaagtatataaaaaaaattcatagaatattttgtaattattaagactttctattgtctaacactaattagaggttaaatatttaaaacaatatatattggaccctagagtaacaaaaaaaaaagaatttggaaattttgtcacatagtctctacacaaatgcacttagctcacaaaccattggggatgcttttatgtagttccccaaacctagaagcttactcattagcacatcttacatgcttatagagcccgtctctactattacattcttacgtcgaatttattgtttaaacttaagttcaaaactcaaaagcaaactaaattggagaaaatagaacgcagcttgcaagtgtttttgagactacaagcctacaatatatctaaaggagacaaaaactagtaggtaacctaatgactaaaagaattcagcagtctaaaagagtaataaggaggcctcttttagatttggttggttaggttttaggtgggtctctattataattacgctacaagactaaggatattgacgtctatattttcgtctcctttcgtttgaaaaaataaaggaaaagcaaagtcaaccataattaggccgtcgaaggaattctaattaatttcgaccagaacgaaacatgcatataattgaccattttgattatctcacaatatacaaattgataaacttgatgcaaaaatgttcgttgtgttagtaatgatattttttccacactcttgttaatcagtttgatgactattttttctttgtataagagagaatgaaaaacaaagttgcatttgtttaaactttcaattattactcacgtagaaagaatgtatccatattgagaaattattacgtagcaatattctatatacaaagtcttttatatatgacatgtctctggataattatttgtttactatcgattcgttggcctatcacgttagatggttataaagcagtcgctacaactaggcagcaaaactgctttgatcaccatctattgttttttttgtccatagtttgattaaagaatgaggatatggcaacaaatgattgcatattagttgatattacaatcattgcaatcgcacatcctacaaaactaattgaaattaatatccatataaggaagaaactcattagtgtcgacatgcattggaacaacgactttgtttttgtttgactttgattatagtcacggtttctcactaatagtttcattctcaccacccctaacaatttagaaacaaggttggttttgaatgacattctcatgataaaactaatgaaatccgtgtagatgtttggttattccgtcttttatgaaaacggataaacaattcaagaagtcatattaattaatgtaacatcatcataaattcataatgttttgacttagattgtagtcacatctctcaatattgagtcattttattatcaaaacctgctttacgtagtctagtcaacgttattttagtaaaaaatctttcacattcattgtataaaacatttttttttgacatcatgtaaaagatttgaatcgagattattacacgattatgaaactactacaaccactattttgcaaccaaaaaaaaaaacaaaaaatacaaccactatatctacaaactaaggtttaaaaatgtacaaaaatacttgggggtttaaaaataatttagttaaagttgaaggactggtttgtaagtttttcatttccataaaaaggaaagagcttaatagaaggaaggaggagagagtggtgaccaggtctcgtagttgtggtttcgttttgcattgcacgtttcttcttctttcttcgctcctcactttcttcttcttcttccgcttctcctctattttctctctctctctctttttctctttctcccaaaagtctctcttacgttcttgtctctcccttaataacgttgcgcctttctccatttcaaccatcacacaactcttcttcttcctcctctctctcaattcgtgttttcccaaattctcaggtactctctcttatctatgtcttgactcttcctatttacccaattcattaacctgattttgttctgtttctgcattttgccccacttttgaaacgaattcggattctgatcaaaataacaaaattggggattgaaagcgtttctgggtatcttatgatccgtgatttctcagatgggtttttcataaagcagagaaatttcgatcaaagtcgatgactttaacatagactctttctacatttttgttgctctgtttttgttctgttctgtgacaaacatgctctctgcctttttttctctttccaattaacatgtagattaataaataattgaactttgatcttatttttttcataaatgtaattcaaacttttgtctgtctttttccttgtttttgattctttcattaaggtcccacttcccaaccaaatattattttattttgcttatatatggttttgactttgtattcattcatcttttactctaaacagcaatctgcagctaacttgatgattgctggctactgaatcttgagtttgtgtctggagttttgtctcaacaataccaaagaccataaagactttgaggtgatttgagttcagattcttctgaatctccaatg

SEQ ID NO: 8551 - DNA, 3000 bp, Unknown
  misc_feature (1)..( 3000): cDNA_ID_1014565_gDNA_ID_1971816_Annot_ID_175975 3000 nt of promoter + ATG
gttaaatgaaatgaagagatatgatacaaaccagtggagatattctcgttggtgagggttgcttggactcggcacatctggatccaccataacctttattaaacccatcaacaaccgtataagagagaagatcgattatgaatatattaaagcaatcaagaaattaaatcatgagtttgattttttttttttaactcttgaaaagtgataacacacattaagacgaagaagttaaccaaaagttaatagaaaaagaagtaaagacgaagaagcttaaattagaaaaaggtaatagtaacattttccattaatataagggtatctaaaaatactggctttactattcagattcaaaagtcgttaaaataagtgtcaattaagatatttatgcttttctaaaggtatgtatcctagaataaaaaaactaaaataaaaataaaagcgaaacaaaatcaagttaaccgtctcttgaaaacgtaatatatataatcgagaaagattcaaaattgatttaaaataataatcaaaccaataacagttatgcatgcaagaagttagaggaaacgcagcaggtatatagatgaggctacgaaagaaaagaatgatcaaatctagttacgcttaaatttggatatatctaaggtttcttcgtcaatatatggagcttacgaaaacgaaagagtgagctacgaggaactaaatcaatgaagataagaggaatgaaggagagaagatcaccaaggtgtagaaatttctgaagtcgtctcctccaatctccactattggtttgttcagaacttgagaaggccttagatccaagccattagtaacctctctatggccataagtgaccttaagagagaccaacctcgtgaaaggatcaagaacatctccaacaacactgccgaccacaagaggatctctacgacttaaagacatatttatcttggatctcaagtatctcaatcaaatgttttgcttcttaccttatgaacccttacttgctattctttatataacgttttgggaattgcaataattagctatttagctttattctctccaatgaaatcattaccagggtcttttcgtgtatagtttcgagaatctacaactcgttcaacgtacgtatatcacttataattcatgttttttttttctttccttttttctaaatttatagtattcttattccaaaacccaccagtataaaacagaaataatcatattccaaattatacatcatccacttgtttcttgctagccactagtatgtaatttattctgacttatcattgtaacttcatgaactatttaaaataatgtcacaagcatataatatgctgcatatttgcgtacgtcacgcattttgcgtcacatgtcactcatttaaatagttaaggacactacattacaccgattatgtatgatgttaatgcattttagaataactccttcaacctaaaccatcatataaaagtatatatgctccagataaattgacgccataattgttcacatatctggttggtgtgtacatacgtactagactcttttttttcttttcttaatgtagtactaaacttaattaataccatcaaaaatatcaatttaacaaaacaaaccagtaaaacttttaaaacaatggagtaaatcaaataaaacaagtaaattaacaaatagacacaaggtaacagaagtataataacgacagaaaagtgaacaattggccaaaaaattcgttttcaaacgtgatttcaaaattgtctccaaatcttaaatgttgataaagtaatttttttaaaattcattatacctttcaaaaacaagtgtattacctaaaagctcaaccgtgtattcttacactccaaacaaatttagttccccaagtttggaagacaaaaatttctaagaaatttctgacaaaacacatgagaaataaaccgataaagacttctaaaaactattgcagaccagtttcatttgctgaccacaaaaagtcatgagaatacaattagctcagtgattcttgatatttctggtacctaacaaaaagaaaagtgtgtgaggttagatggctatgatttttgctctccaatttattgtccatttccccaatttgtaatatgaaatgcgcaaattactcttcttccgatatgaataagcaaacgaaaacatacgtgggacgttatgttcagaacatttgattaaagtttatatgcgattttcatttatttattatgaattttttgtttggcagcatgtacgatttttcatttaacacacaaatattatagaattttcattggttcaaaggggtagacaaaaaataatttaatattattacaccatttgcagaaaattagaaaatatatttttacccataattaattgatctatggacgtatgcttggcataaaaattcatatttaattagcagaagccaatcgctgcgtttgtatatacgcgtttatgaccgagaaaaaaacccttacgcgtcatgtaaaaaaaaaagaagcgtaaattacgaaaaacagagagataaatccgggcattgagattttggagatagagagagagaaaaatcgaaatctattgtctatctcctcaatttggattggattttctgcatatcatcgctctagctttcgcgggttttggattcgattccttacccttctccaatcggtaagaacaagctccaaagtttgttcctttttttcaattttcgccaattctgtaatctcatcattgtccttgtttgtttgtttgattcaacacacaattcttgttttgatttggatgcagaagtttttggctttgaattggatttgggtttcgttccaaaatcagctctttttgttaatcaggtgagtttttaggtatttgaatctccaattgcttccttgcaatgactaagtattgtgaaatgtttagggtttcatctgtgtgggtcttgttttgaagcaatttgtgtgtgtttggatgaaagtagcagat

SEQ ID NO: 8552 - DNA, 3000 bp, Unknown
  misc_feature (1)..( 3000): cDNA_ID_3091065_gDNA_ID_1971816_Annot_ID_175972 3000 nt of promoter + ATG
tcatatagtgagcatctctacttgctttctttttgtttcactcttgattctcaaactctttgagtttttacctttttttatttatttttgtgccattttccataagaacttgaaatcaaaatgtcatatatttcttgattttctgatccttgttattcatctttgtctcgctccatatgattctgatgtggatttggtactcaacgaccaatcacttaatttgaaaccactgtgggcagattacatcaacaattcaaggagattgcagaatataacataaagaacttaaagaggaaagttgaaatgtgaagagataatgaagaagaggaaagagagagcttatggaatgcgaccaccacctctgccactgaaagatgggcctgcatcgatctcaccatttgtttgataactcctcattcttctccctaacaaataacaatcattattattgttagttttcatggaagacaataatttactaagtcatacgacttgacatatgtgtagtgtagagtgtaaaatatatatactatgagagtctatggaacactaaccagctcttgggagtgattcttgtttagaagcaagaacaagactgttgcaacgaagaagaagcagaagcaccataaagaacacaaaacccaactgtgaaaaaacctgctttaccattttgctcaatatctatgattctatattggtttttcgtattttttaaagtgttgtgtatatatagagagatagtagacgctgattagagatatggtttattttaataggatttgtttaatgaaagattcgcaatacagagtgacatgataagtaatgagatggacacaaggaatctcacgtgtcctcatcttccaacttgttcttccaatggtgagctcttatcttctataaatctataaaaatatatataatctctttcttaattttgatcttcgaggcttttgatgtagacccgtgaggatagagaaaaaatagttctaagacagagccaaaaggacaccccttttaagtcagtggcacaagattttaagattatttgcaaggttgaccatatacttcattaaacttgagagatcaagtttgtgacatcagtagagtttatacaagaatatgaagaagctgctttcttttcatgcaagaaatattaagtttcatgtcttagatcccgagctgcaaaaaaagagttaaagatgtttgaaattaatgcaatgaagtatccacgagaatctttatagtctcatgcaaatgatgtgaactcaaatctatgttcaaactcactcttgttgttggcggtagtacagagcgaacactctcaacgggtgtgagtatgattcttctgattgacattgcagtaactaacctggttagtgagatcttctgtttcctcttgagacaccatctctatctgcaaaaacatgacacagccaatctttgtgattgaaccaggcttaaaagcatgctcttaaagatattttttgtgatattttgtaccgtcatcattatcagtgagaacttgacctttgggattcaagaaccttcaaagctgcaaaacccaaaaaagaaagaagttgggccactggaagcaaagcccaagcccaatgcgcagcctttgaaagatcctcagcaacggtcatgtccacctgtcaataaagccaaaactgcagtcatcacacagctaagagaacgtacagattcaacgatacctttgaagaaccaatttgagtgtcttggatccggtgatgattgccaagactgacacctgtcattattagggtttaggctacatcaccttgtattcaatataaaaggactttatgatgtaatgtgaaacctaagtcgaaatataagaaagataagttctctatatttcagattacgttcatggtatcagagccatggcaaatcagtccatggagctctattcctatcctgttctaaacatctcaaactgtgttactgttaagcttactgagagaaattacctgctctggaaaactcagtttgagtccttcttgtctggtcagaaccttctcggcttcgtcaatggcgctaccaagagtccagatcctgtctcagctgtcacgaacattgatggtgttgttacagagatcccaaatgctgactacagtgctaggcacagatctgaccaagtggtgaagtcatggatcttaggctctctctctgaagacattctggaagaggtcatcactgaatccactgctcaacaagtctgggaaggtctagccaggtatttcaatcgtgtctctactgctcgcctatttgaactgcaaagaaaacagcagactatgtgtaagcatgatacacctatgatagattacattaagggaataaagaacatttgtgaacaacttgcctctgctggtagtcctgttaaggaacaaatgaaattttttgctgctcttaatggtcttggtcgtgagtatgaacctattaagacatccatagagggtagtatggaatctacacctgctcctactctagatagtatcactcctaggcttacaggctttgctgaccgtctcaagagctatgaagtggtgtctgtcactccccatctagtcttcactgcagatgctcctgatgctggcaactactatcagaccaactacagtggcagagggaatttttctggcaagggaaacagaggcagaggagcatacaacaccaagggacgtggctttcatcagcagaccacaactggctcttccatgtcaggagaaaacagacctgtctgtcagatctgtggaaagctaggccatcctgctctcaaatgttggcacaggttcaacaatagctaccagcatgaagaactgcctagtgccttgacagctatgcacatcacagaagttacagaacacaatggacaagagtggttccctgatacaggagcttcagctcatgtgaccaacagtcatcagcatctgcaacaatcaagaccatacaatggttcagacgctgtgattgtaggaa

SEQ ID NO: 8553 - DNA, 3000 bp, Unknown; identical to SEQ ID NO: 8543
  misc_feature (1)..( 3000): cDNA_ID_3045717_gDNA_ID_1971816_Annot_ID_175965 3000 nt of promoter + ATG

SEQ ID NO: 8554 - DNA, 3000 bp, Unknown
  misc_feature (1)..( 3000): cDNA_ID_1823762_gDNA_ID_1971817_Annot_ID_58257 3000 nt of promoter + ATG
ctctaaccgccgccggcaaagctaaaacgcgttgccccaatcgatccgttacatcactctggtgatgattaaacgagagactatgaataagattgttattgaattgacctgaatgattataactttgagaagcagatcgagttataatcggttcggatctcgccgaaccaaaatcggcggcgtaattcggtagaggcggttgtggttcaggtaacggaggcatcgaaggagagtgatcggagacagttgtaacgcaacagaagggatgcatgtggttctaagatgagaaatcgagaccgttgaatccggtgattgtgacggtggagacggtggtggagaggaggaagaaagtagcgttcatggcagagaggatttggaggatttgagaagagaatttgttgaagaagagaggttgttgaaaaaaattggtcagagaaggaagcgaaaagttcggtagcagaagaaggaagagtcaccggagaggccaaagtttttttttttttcgtttaaaaattttaatttactaatttcgtttttttattaatattggaatgacttgaacgaagaggacagaaaaatcggtgccgttgttgaggtgttgtttgctgacgtggcgagaatcgaatatgggcactaagttttttttttttttttgtaatgaaatatattaaaagtatttaataataatattctcgttaaattaagcaaatcattaatttcagttttagaataaggaaattttgcacgtcactttaaggaatgtaattaattttaagaacaataactagttttctatacatcgtttgttgattgatttaatatgaaacactattcaaatgtgatcttaaggagagattgtaatcatttagatttgatttattttcgaaaatctttaattaaaccattgattcgataatttattagatgagattacatttgattaatgctttatatcttagctgattctcttgattattaaaaatatgcatagtactcgattgaattattttcatatttttcaaaattttcaatgaaaattaaaatattttatctgcttttttcattatggttgttaatgttcgtttcacaagctttaatggtatcaaacttttactcttttgagggtgtggagaagtctcccaatgagagagctatgtttcatcatgatgattttctctcctaatcttcatccgaataatccctaacaccatctcaagcactattagggatctaatgttatttcgttcgagaatgaagacaaaaaagtatgaggtttaaaattcattcgtctctacgcttccccaatatttagaggcagtttaccatctgcgttttaagatcgataatctctagaagggatgattggctcgggtggtgatggggcaagatatggtctctaacacgaggaatgtgtacgtatatgggtatcattgtaaatcgggaaagagtaatagtccagctaatctataacttcgtgaacaaatccttgcggtgcacaatagggactttctagtaatgcgaccttcactatgagactctcacttgaaggagcaagaatcatcttcatgaaaaatattatgccatttagaacatcataagtagagtttctaatacgttaaagagatccacacagtctcactagttgagatttgtgtattcttcctaaaccttaagggataatgcatctactcaaattgtaatttagattcttgaaaccggagcattaactgctcgaatactcgaaagtagtttgtgacaagagtttccaaagttgcaaaagatctcttccatctagagttgggaggggatgacttctatgtgaatccaagatatcatggtattaagaaacacatctacaacatgcatctctccaaatcaaagaaccaatggttgaagtagtatggctttttgttgagaatcttataggactctttgaagaaatggtaagatcatcaattctcaaaaagccaaaacaaagttttctcgaaagcatgggaagatgagttgggaagatgagttctagttaagtcactaagaatgtgaggacgtattcggaggaccaaaaagctcaaagttaaagtgatgtagtaacttagccgtttataaagggaaagacgtactattttaagaggaattttgaagaaagttaccaattttaaaatttaaaagtatgtgagatctgcttttttgaaataaaataatttattaagtctttttatacatagaatatatattctttttaatgaaattctacctaagttttattcacaaacattcactaatatcatttatacaaccgttttggtcatataaatagttgttgagttttgataaattgataaaaaattattttacctaataaaattatacaaaaatattaatttgtttttttgctaactatattatttgaaagaaaattagctacatgattttctcctaaaacattcattttgcgaattatatctaaaaaatttaatcgtctctcaaacttgtcaatacattgatttcaaatcccgaccaacaataaactctccaaactcaaaccagatcgatctatctaacattttaaaaaattccaacctagatcattcacgttcttaaacaacaacaaatcacaactagctatatatcggcttggctcagacaaaaataaaacagtgcagttccaagaatatgttcaaattgcaatatacatttctcataattaaaacatgtttctttaccaaaaaaaaaaaaaaaacaaccgttagacacatacatgtgtacacatgtccctcacgccgctataaatatttcagacctctccctactctctcataacccacccaaaatatcacaagcaccgactaaaacaattcggatctaaacccgacccggtaaaaccaatcccaaattttactccgttgtgaacgcatcaaacccagaaaatttcttcctccgatctcgcattctccacttccataatccccaaaattgtttcgttgatttttccacaagatg

SEQ ID NO: 8555 - DNA, 3000 bp, Unknown; identical to SEQ ID NO: 8312
  misc_feature (1)..( 3000): cDNA_ID_1823758_gDNA_ID_1971817_Annot_ID_176026 3000 nt of promoter + ATG

SEQ ID NO: 8556 - DNA, 3000 bp, Unknown; identical to SEQ ID NO: 8316
  misc_feature (1)..( 3000): cDNA_ID_1823730_gDNA_ID_1971817_Annot_ID_176036 3000 nt of promoter + ATG

SEQ ID NO: 8557 - DNA, 3000 bp, Unknown; identical to SEQ ID NO: 8315
  misc_feature (1)..( 3000): cDNA_ID_3088959_gDNA_ID_1971817_Annot_ID_176032 3000 nt of promoter + ATG

SEQ ID NO: 8558 - DNA, 1089 bp, Unknown
  misc_feature (1)..( 1089): cDNA_ID_2177299_gDNA_ID_1971817_Annot_ID_176048 3000 nt of promoter + ATG
tctttaataactttttcttttgagcaaacactggtttcattgttgtccaatgaagtaaacaaattaacaagtgaaataggtttaaagctatcatcatcatcatctcttgaagaatctgaattaagtttaaaagcttctcttaaacattctctagcaacctcaagaccttcttcgtcaacacctggagcaacctcaactacaataacaacaacaaaatacatagaagaagatttaaaaaccctaaatatctctaaatcaaaacagaaatgaaaatcgagaaacgtgattggtggtgattaccggaatcaagaaaatttaagaaagaacggacgattttccggcagagaggagagtctgttgttagtttcgccattggaggaagagagaaagagagaaggagaagaatctggtttcttcttctctgcgatgaaagtgttcgttgaaggaggcaattgaaaagtctgtctggatacaaggttattatagttctggttgggtatagagttatattaagctgattaacaaacaaataaactatataattttacgtccttgtcctcatctggttccgctaattttagcctgttggacgtcctcgcgtcccagactgaagaagtgatgagtagggctgggaaaaaaacccgaaaccaacaacccgaatcgaaattggcccgaaaagttggatctaaaaccgaatctgaattcgaagatttattctattaggtcttaaattcttctatccgaaaaatcaaacccgaacccaaaactaaaaatacccgaatattttaattgaaaatctaaattttacctaaaacctgaaattttactcaaaaatccggatatttacccgaagttccaaaatagggcccaaaaatctatacccaaactaatccgaacccgattagatgcgaaccgaaatcgaaccgatattttagatttatccacctgggttctaaacttttctacccgaaaaatctgtaaccgatcgggttttaaccgaacccgacccgcttacccgaatgcccatcccactgacgagtgtatatcacagagattaccactggacttgcccttcttctgagagaaatg

SEQ ID NO: 8559 - DNA, 3000 bp, Unknown; identical to SEQ ID NO: 8313
  misc_feature (1)..( 3000): cDNA_ID_3046272_gDNA_ID_1971817_Annot_ID_176038 3000 nt of promoter + ATG

SEQ ID NO: 8560 - DNA, 3000 bp, Unknown; identical to SEQ ID NO: 8554
  misc_feature (1)..( 3000): cDNA_ID_3088971_gDNA_ID_1971817_Annot_ID_176025 3000 nt of promoter + ATG

SEQ ID NO: 8561 - DNA, 3000 bp, Unknown
  misc_feature (1)..( 3000): cDNA_ID_1823758_gDNA_ID_1971817_Annot_ID_58258 3000 nt of promoter + ATG
caaaattggctcgattaagtcctaaataatatctgatagcacaaacaataaaattagggttaaaaatcagaatcacaaacctagctaaaccttcgagttttggttgtaaaaagctcttaatcttctttgatgtaagagcgtaacctacaataatggatttcttcaccggaaaagcttcgattactaacgaacacggcgacgatgtctcttgctctgtcgtctccatttctcgagttccgttcatggtgatctcttcgttgtccgttagcttcatcttgtggaaaaatcaacgaaacaattttggggattatggaagtggagaatgcgagatcggaggaagaaattttctgggtttgatgcgttcacaacggagtaaaatttgggattggttttaccgggtcgggtttagatccgaattgttttagtcggtgcttgtgatattttgggtgggttatgagagagtagggagaggtctgaaatatttatagcggcgtgagggacatgtgtacacatgtatgtgtctaacggttgttttttttttttttttggtaaagaaacatgttttaattatgagaaatgtatattgcaatttgaacatattcttggaactgcactgttttatttttgtctgagccaagccgatatatagctagttgtgatttgttgttgtttaagaacgtgaatgatctaggttggaattttttaaaatgttagatagatcgatctggtttgagtttggagagtttattgttggtcgggatttgaaatcaatgtattgacaagtttgagagacgattaaattttttagatataattcgcaaaatgaatgttttaggagaaaatcatgtagctaattttctttcaaataatatagttagcaaaaaaacaaattaatatttttgtataattttattaggtaaaataattttttatcaatttatcaaaactcaacaactatttatatgaccaaaacggttgtataaatgatattagtgaatgtttgtgaataaaacttaggtagaatttcattaaaaagaatatatattctatgtataaaaagacttaataaattattttatttcaaaaaagcagatctcacatacttttaaattttaaaattggtaactttcttcaaaattcctcttaaaatagtacgtctttccctttataaacggctaagttactacatcactttaactttgagctttttggtcctccgaatacgtcctcacattcttagtgacttaactagaactcatcttcccaactcatcttcccatgctttcgagaaaactttgttttggctttttgagaattgatgatcttaccatttcttcaaagagtcctataagattctcaacaaaaagccatactacttcaaccattggttctttgatttggagagatgcatgttgtagatgtgtttcttaataccatgatatcttggattcacatagaagtcatcccctcccaactctagatggaagagatcttttgcaactttggaaactcttgtcacaaactactttcgagtattcgagcagttaatgctccggtttcaagaatctaaattacaatttgagtagatgcattatcccttaaggtttaggaagaatacacaaatctcaactagtgagactgtgtggatctctttaacgtattagaaactctacttatgatgttctaaatggcataatatttttcatgaagatgattcttgctccttcaagtgagagtctcatagtgaaggtcgcattactagaaagtccctattgtgcaccgcaaggatttgttcacgaagttatagattagctggactattactctttcccgatttacaatgatacccatatacgtacacattcctcgtgttagagaccatatcttgccccatcaccacccgagccaatcatcccttctagagattatcgatcttaaaacgcagatggtaaactgcctctaaatattggggaagcgtagagacgaatgaattttaaacctcatacttttttgtcttcattctcgaacgaaataacattagatccctaatagtgcttgagatggtgttagggattattcggatgaagattaggagagaaaatcatcatgatgaaacatagctctctcattgggagacttctccacaccctcaaaagagtaaaagtttgataccattaaagcttgtgaaacgaacattaacaaccataatgaaaaaagcagataaaatattttaattttcattgaaaattttgaaaaatatgaaaataattcaatcgagtactatgcatatttttaataatcaagagaatcagctaagatataaagcattaatcaaatgtaatctcatctaataaattatcgaatcaatggtttaattaaagattttcgaaaataaatcaaatctaaatgattacaatctctccttaagatcacatttgaatagtgtttcatattaaatcaatcaacaaacgatgtatagaaaactagttattgttcttaaaattaattacattccttaaagtgacgtgcaaaatttccttattctaaaactgaaattaatgatttgcttaatttaacgagaatattattattaaatacttttaatatatttcattacaaaaaaaaaaaaaaaacttagtgcccatattcgattctcgccacgtcagcaaacaacacctcaacaacggcaccgatttttctgtcctcttcgttcaagtcattccaatattaataaaaaaacgaaattagtaaattaaaatttttaaacgaaaaaaaaaaaaactttggcctctccggtgactcttccttcttctgctaccgaacttttcgcttccttctctgaccaatttttttcaacaacctctcttcttcaacaaattctcttctcaaatcctccaaatcctctctgccatgaacgctactttcttcctcctctccaccaccgtctccaccgtcacaatcaccggattcaacggtctcgatttctcatcttagaaccac

SEQ ID NO: 8562 - DNA, 3000 bp, Unknown; identical to SEQ ID NO: 8316
  misc_feature (1)..( 3000): cDNA_ID_1823730_gDNA_ID_1971817_Annot_ID_58266 3000 nt of promoter + ATG

SEQ ID NO: 8563 - DNA, 1089 bp, Unknown; identical to SEQ ID NO: 8558
  misc_feature (1)..( 1089): cDNA_ID_2177299_gDNA_ID_1971817_Annot_ID_58271 3000 nt of promoter + ATG

SEQ ID NO: 8564 - DNA, 3000 bp, Unknown
  misc_feature (1)..( 3000): cDNA_ID_3045734_gDNA_ID_1971818_Annot_ID_176057 3000 nt of promoter + ATG
gaatcgttgaacgaatagaataaggcgacaaatgggctagggaatcaaatccgcatattggccaaggtatgtaacgatctagcttactagttaggatagacgtttgggaatcgaccgtgaaaataggataaaggaatatgcgattgttaggcctagaatggttaccgaacaatatgcatgtcttgaccgagtaaaggattgatctaagtctaagggacaaagacgatgaaaccggtacaagagttggttagaattaaaccaaggttagaaagacttccgctgtgtaataagagagcgattatagaattaagcctcgtaaaggcaattctatgttgaatcgcaaaaaattaagaggttcggccgggaagaggcgcgaacttgagtccaacgtcgccggacgccgagacgtccggaacggggtctcacatcatcgggcttttgccttttgtgtaggaatctgccttcctctgatgtgtttgatcaaattgattgagtcgttgcagagccgagattctcccatgatgaaatcgatgcgtttcagggagaggtgctcggttgcgtttctacagaatttcgggaggcataatgggaacctcatgtttttcttttgcggggcgagaggaggtgtagtgactgatatttctgtcctaccttccagatcaagtcctgcaaagagtaggtctgtgcgctctttcctagcaggtggaggagactcacctcctttcggtgttcagtcccgtttctttcgtttgggagtttgctcctcctcctgctcgtcgggaggaggggtgtcggcattagcgtttgaaccttttttagttttgcccccggctgcgattaattttttaacgccgcgacattcctcgatggaatgtcctctctttttgtggtacttgtaatatttttcgtggtcaagttctggactctcgtcctcggctgcctcttctattgcaaataaggtatgctaccctagtatttggttttcctttttgaagggttttttagttgcaagggaagcgttttgtgctttagattctttgaatcttagggccgaaacggcgagctcctctccggactccggctttggcgaagtggagagctttgtgaagggcatcgtctaaagagaccagttgcctaacggtgagttcctcacggaacctagaggaaaaccacaagccgttgcgaagggcggctatggctacctcctcgtttaggttcgcaatctttgatttgattgctttgaatttttcgacgtaagatcgcaaaaattcgttctgaagttgggtgacacccagaggacggcttcagacgtcctgtttacgatgagtaccgagtactgtttttagaaggcgggggcaagctggtcgaaggtatcaatagagttccctttgagactagcaaaccatttgagtgcgtcacatacgaggttctctgcaaagaaacggcaatgacctgcttcattttctttgtctatcaggtacgctcgtgttatagccagacagaaggctctcagatgagcctttgggtcactcgttccatcgtactccaggaaacggagtctcccggcgtctaagatgtgacaatgggcgatcctatccgtgaatggggtgcgcctggtttcttcgatcactcgatctatgctagatgcattcgtgcccgtcggcgacgttatcgtttgcgatctgacttggtacgctagatctcattgaatcggatgaattaggatccatgatcgttggtcacaattgatgtgttagtttcggtgttggaaggatctatttcggtccccacagacggcgccaaatgtgggttctgaaatccacagtacagatttgtaattgagattatgagaaaggagggctagatcttcacaggaacattgagatttatattgctaagaaccaatggacttgtgtattgattatcacagagcttttacaatgtgaaaggagattacaagtgtaaaagtgtaagtgtgaatgtaaagctgaatttaatgtcttccaagtcgtccttgctttcttatatagatctacgcacgtggtagcttcgtccgggatctgcggagattctcttagatattcggcaggtcaattccaagatatcaggtccattctgcgaatatctccctgttagttcctaggttgttattcgcttatctcccttcatcaggtgaccgggcttatcaggcccaagtaccgatttgcgtacgtgggctcatcagttgcgcaggtcttctacttggtgggcttggtgggttggcctggtatttttgcaggtggattcctggaggaaaatccagctccaatagtgatgaagctgaaagatcaactatggatgtttgaaaaaagatttaataagttttcaatgagtattgatccagagaagatggaaactacactagctatcaaagaggacaaaagatttcgcaatagaatggtttgcaccagaagatcagaaaggagttcacttagaggaaagaagcttggagagcaagttgttgagtgaggaggaaattattccgacttattctccagaggtacctaaaccgcccactaaaccctcttctgaagaagaacacttgattcttgattctattgctgaagaactcctggagctttggattgggtataaagctcaggaggatacaattggaaagttaattcataagatggaagagttaaatagcaccattctggaacttcaagaaatggttaaaggctaccccagttttgaacttgaggattggtcaaaggagcctggttcagaagaagaagactactctgctgatcaaaaagaagcttattttgaagaaaaatcaaatgagtactcatcctaccatatgtcaagaaaggatgcaacgtatgattcagacactgaaaattcaaccactgaagatgaggacttctctgttcctctcctcaacctttttctgactaagctttgtaagagtcaagcttagtgacttaaaacaagctcacttgggggggaagtcccatg

SEQ ID NO: 8565 - DNA, 3000 bp, Unknown
  misc_feature (1)..( 3000): cDNA_ID_1823294_gDNA_ID_1971819_Annot_ID_58272 3000 nt of promoter + ATG
acatctctataatgtgccaggcaattgcctctccttcacgatctgggtccgatgcaagaatcagattttcagctctgaggaataaggtaaacataatgagatagataagcacaataagaaaaaccataggaaagaagtagttcatatcatacaagtttgaacaagccacatatctcaatagctgtacagcactttgacacccggaaagtattctagaattaaggaatatagataatagcaacaatagatttttaaagtagtgattaggcaagaaaccgtacccatttaatgcaaccttaatgctcttaatatgagtccaggcggaagatggaacctcccaaaccatgctaaaatcgtcatctggcctcactgaaccagaccttgtggccaggtccctgatatgaccataacttggcaaaacctcatacatgtcaccaagataaccctgaataatctttgcttttgtcattgactcaacgacaataacagattttccacttggcggataaagcggtttagatgcattttgacctcgatgttctatgctgtttttcatgtgttgaggaaccagcttttgttttggtgccttacttgctttagttgacttcaaatgctgttgttccgacttggaatttgatggagcaggacttttgggctcttccacagggtgattttttgccacctccttctgagaattgtactgttactctgttaggtaaaataagcaagggtaagactattacggtcctaaaactattaaagtcaaataccttagcagatgaagacttccgatttccagaaccagaatgttttggcttgggaacgcttatcggactctcatctagagagaccgcctccaaaactggtaccactgaagaagatttatcttcgactttcttgttcttggggcgccgttttgatttgacagtagtggcttgattaccattgctagcaggtgaggctgccgtggatagttccgccttgatgccactgctaccatctccaataactggttcagtagaagtcaccacttcagcttctgaggaagccaacacattatgcttctttcggttcttgttaaatttcttgaaacctactttattcccaccagccttctcatcaccaccaacaatgttatcctgctcctgttttggtgcattgcttgcttttgttgaggtccaatgctgttgttctgacatggaattcgatggagtagaacttttgggcccctccacattggttttttttaccacctccttctgagaactgtactgttagaagatatgagcaagggtaagacgatgattcaaaaaactttactagtttaatacctcagcagatgaagacttccgatttccggaacccgaatgtctaggcttgggaaagctttgcaaactctcgtctacagagacggtctccaaaaccgataccgttggagaagatttatcttcgaatttcttgctctttggctgccgttttgttttgacagtagaggcttgcttagcattgctagcaggtgaagctgcagttgatagtttcgccttgatgccactgttaacatctccaataactggttcagtagaagccaccacttcagcttttgtggaagccaaaaccctatgcttcttccacttcttattgaatttcttgaaacctattttattcccaccaaacttttcaacaccaccaacaatgctatccttaatctcagtactagcgacttgagaaaaatatctcctcgcaaacggtctgaaactatatccaaaggcccttgaagtggagctgctccaatgtgttgcataactaagagaaccgagaagacttagatgcgaaggaagtgcacaagctaacttaagacaacttgaattttctcttttaaactgaagctgggatacatttctatacactctatcgacccgaactactgaagaggaagaggaagctgggaaattttgaatcgccctgcactgcaactgcaacaacaaagaaacaagtaatcgtcagaatctccatgagttctactgttgaattttcaaacacatctaaataacataaacgaaaaattgaagctcactgaaacaaattcgactccatttcaatacgaaaacgacgagagtataatgatttagccataaaataccaaactttttaaattgagaatctaacatttcagtatctcaccagcgtaagagtcgaaacacaaaccttagccatgagaggatgaagagacagaactgaagtcgaagaagaagacttagcagccgcaagtgagatggttctctgcattgagaatactctgtttgattcagaaactttcaaatcatccgacgagtgaatccgtagcttatcataaatcgagtagaagaagagagatcttgttaatggcggagatgtctggtaaagaaattcttaagggtttactcagtctctggggtttatctgcttagtgccttctaactcgggtcgggtataaatcaggatcaagtagatccgccaaattacccggtcaactcttattagtcaaaatagatttcgggtcgggttttcgtggcccaattaaaacttttgggtcggtttttcgtggcccaattaaaacttccggatcctagcagcagagtaaaggtctctccttcagtccttcttcttcaggtgcgtttagcttctgctccatccgattcaactattttcttctcagaaagttgcgttcttctttgttagtaagtgattgaactaggtattgtgtctcgctctctcgattttcttgctgttagggtcgtgtagtcagattcttaagcgatgtcgcttttttgttaaactcttcaatttacactgtgtatagtttcggtgtttctctttgcgtagatattgattaccttctgggaattacttctctcgtattgaattatatggcccaatttcgaaagcttttgtttttacaatcttctcaggaacacttagctgaatctatacaacacaagtgttacagagtttatatacatg

SEQ ID NO: 8566 - DNA, 3000 bp, Unknown
  misc_feature (1)..( 3000): cDNA_ID_1823290_gDNA_ID_1971819_Annot_ID_58273 3000 nt of promoter + ATG
aaacagactgaactagccattaaaagatgagaactggagaatctcatctggttgtagctcttgcactcatggatgtgtgataattcgtacttctgtgtttcctgtaagatgtataaacatcatcgtactgagttggttcgttgggatcagctgttgccccaagtcccaatctcccagatccactctttttatcggtgcttccatccgcatatgttcctgtctcggggtccacctgtagattgggaggtggaggaatgcaggcacctcctttccgctgtggactatcccgctcataattatcatagtcgtcctgtgattcagatcccatgggaccttcacttgggttgacctcacctatctctttgaagaacttagatactctctcgagtacttcagattgaggcgtatcagaaggtggtatgaccgttgggatatcaagagggctcaatggagagtaaggcacaccactaccaatctgcatctttctgaccatcccagggatcaaaccaggaggaaagagaggataaggaggcggcttctcaccagcaggtggttgggttggtggtggaacagaagcgttaagcggtatggaaccgggaaaggcaccaggaggcatcacatttgggataaattgttgggttgcgaccggattagtcagatgctctaaattcattgtgctagagacattactgtttggtggctgttgcagcattcctgtaagttcataaagataaaaagttgttggtatattgtcaagtctaaaccgaattcttcttatacataggtggagttatagtttctgtctttctcacggaagagcaggagtacctggacgttgtaaggcatgtgctgctataatgggagaatgagaaaaggtatttgcaggtggtccacttttcatctctttctcaagagaggagatggtgtcttgatcaaaaacctccttagaagcccaaaactgcaaaatcttctccaaacgtgactggttttcttccttgttttgtggaaagtggtaaatcctccccagcatggaacccaaaataggtctgaaagcaagagcttcattgtcaaactcgtgcaagtttgtccttcgttgtaaactgtatttaaggaagcaataaacatgagaaaatattagggcagaagaatctaatgttgcaacccaaaattttgaaagcacagactgagactcctaataatatagaatgaacgaaaaactagtctatgccgaagtcctctagaatgatgtaaagagcgatcagggatgaagtttagatacctgtcgaagagaatgtcattagctagataaactatgtgcatctgcctatcagaatcatccattgcaaagaccctgtctctaagtgcctctgctaaagctggtgcaaagggagatctctgcatgaaccaaatcttagcacttttaatagactctttcgtgccattaaggttgcccaagacaccatttagttccattgcaacatcagcagggagtggaccagaaagacctcggaacgcatgagttgactgatcaaaatcaggacgagcatggggcgcaaaaggatgaggctgcggaagatgctgttggagctggtggtggtcatggaatggtgggaaaggaggttggcggattggtggcacagccaatgcaccaggtacattgttcattgaaggactcatcatgggatttggcggatgatgtatcataggcattgaagatgacgggaatggaggatcaaagggtcctccagggggatgcatagagagaaagtgcttatagcggtaataaccatgaccttcacccccaaacagaaacgcataatcaggattatccttctgtctatctcgcatcatagcctcaaactcaggaccgttcttaaccgaatactcaacaagcttatcaatccgtttctgcagctctggatcagctggaggaggaggaggaggagcagaatcatacggtccagggaatggcggaggaaggtgatgtggaggtaagtgaggaaggaaagcctgaggttgctgttgaccaaacatctgtgggtgaggaggatgaggaagatgctgcggttgctgctgctgatgcataggatgctggtaagggaactgctgcatagaaggatgaggaggaatgaaaccagaagcattcattggtgatggatactgaggatgttgcggatgaaatccgaattgtggttgttgttgctgttgaaagttaggaccttgttgctgctgttgctgagcataaggtaacccagaagaagcagcataatcgtgctgtcttcgatccatgtatataaactctgtaacacttgtgttgtatagattcagctaagtgttcctgagaagattgtaaaaacaaaagctttcgaaattgggccatataattcaatacgagagaagtaattcccagaaggtaatcaatatctacgcaaagagaaacaccgaaactatacacagtgtaaattgaagagtttaacaaaaaagcgacatcgcttaagaatctgactacacgaccctaacagcaagaaaatcgagagagcgagacacaatacctagttcaatcacttactaacaaagaagaacgcaactttctgagaagaaaatagttgaatcggatggagcagaagctaaacgcacctgaagaagaaggactgaaggagagacctttactctgctgctaggatccggaagttttaattgggccacgaaaaaccgacccaaaagttttaattgggccacgaaaacccgacccgaaatctattttgactaataagagttgaccgggtaatttggcggatctacttgatcctgatttatacccgacccgagttagaaggcactaagcagataaaccccagagactgagtaaacccttaagaatttctttaccagacatctccgccattaacaagatctctcttcttctactcgatttatgataagctacggattcactcgtcggatgatttgaaagtttctgaatcaaacagagtattctca

SEQ ID NO: 8567 - DNA, 3000 bp, Unknown
  misc_feature (1)..( 3000): cDNA_ID_1823275_gDNA_ID_1971819_Annot_ID_58277 3000 nt of promoter + ATG
gttgaaaaatctagctgcattttttgtggagtttatctgtgtactttagttcctgaatttcaatatcgcttaccattctcagatttatacaaaactcagaaacatgaagatgcacctctttggttattgttcattgacaataggttttattagagtttcaaatcacagttatgttgtaatgtctttactgatgatgatgatattaacgaggttggtaaaccaaattgcagtttaagcctttttggatggaggaaggaacttcaggttcacggagaacacggtctcaagttgctccagaatgggcagtcaaagattgtctagtcctcgtgaatgagatcgctgcggttgaagccgattgttcgaatgctttatctagcttccagaaatggacaatgatcacagagaactgcaacgctttggatgttagcagaaatctaaaccaatgcaggaggaaatgggattctttgatgtctgattacaatcagatcaagaagtgggaatctcagtaccgaggcactggtcgttcctattggtccctgagtagtgacaagaggaagttacttaatctcccgggggatatcgatatcgagctttttgaagccatcaatgcggttgtgatgatccaagatgaaaaagctgggactgaatctgatagtgaccctgaagcgcaagacgttgttgatctctctgctgaattaggtacactatacactatccttttcttgccccattactaaatgaaactaggcctttaaggaatcttaagaacaaatagtgcatagacagacttattcacttcttcaagatacagaatgacgaaaattgtcggtgtagttatagttgaaatatatgtagaacactttgctaccgtgagctacactatgattatattgctctttttgtagtcaccatcttcaggtaaactctgaactgctatatttggagttactcggatcagtccagaatcactgacacactgacactcttcttatgctaaccatttgaatcactctggttttaaattcagcttttgtaggatcaaaaagatcaagacagcgaacaatggtcatgaaggagacaaagaaagaagagccacggactagccgagttcaagtaaacactcgagagaaacctataactacaaaagcaacccatcagaacaaaaccatgggagagaagaagccggtggaagatatgtccacagatgaagaagaagatgaaacaatgaacatagaagaggatgtagaagtgatggaagcgaagctaagttataaaattgacttgatacatgcgatagtcgggagaaatctagcaaaggataatgaaacaaaggatggtgttagtatggacgacaagttgaagtctgtgagacagcaaggagacgagctcatcggttgtctgagtgaaattgttagtacccttaataggcttcatgaagttccacaagaaatcgagtgatttacaatgtgaataaactatcagttgtaaatgcttagccatgaatcgtaataatgttgtagacttgtagactttcaaaagctgtctgtaatctgtcaagtatacatacaaaacagggcaaaagcataaaaatccgactccactggggatcgaacccagaatctctggtttcgtagaccagcgccttatccattgggccatggagtcttttgtgtttaacaattggaaatcgactttgtataataattcgtactgattctatactttcaagctatgcaatatatcccaatgttctttagtatcttaccagcttgtggatttggtgtccccaaagtgtataagatttaacaatgtcataagtaacatagtaagaggttacatagaatttgttcagagaatgttgcaaactgcaaaaaagaagaagataaattatggctttggcacagctctcgcttgattcatggcatccataagatgagccctcaaagcatccggatcacgcaatgatgggcttgaagtcaaaagtacctggaggaagaaactccttggagagcttcctcattgcctccaaagcagccggttctatcattcgtagcttatacccagacaaagttaagtctgaaattccaattcaagatatccgatcttgcggtggtgttctcgcttccgtccagactccaaatatattttctgtctgaatatcaattacgaaataaagggatcgccatccaaaacacacacatttataacgacctatacaagacgagcgtggttttagttttacactttttaattaactgttttatgtttaccaagctcctaatttgacatgaaatatggagccaaaagttttgtagaacaaaaagctgtcgttgataaagggatattatttcagacattgcaggattgagtaacacaccgttctttgctccacaacaaaataaagtatttgattggtgatgattacaatttacaagtttacaacaagaaagcttcaaaataaagcatttctgcactttaaaagatcgctaaatctgatagaggccatttggttatggaaagatatataaacattacaacataaattaacaaaataaggatatctataagaaaatccatgaaactacactatgttttggattgcgtatatattttagactaaataaaaaatagcaactagtaatatttgcgcgataaataatgtggaatgcaatacatttgaatttcttaatcatattttggttacaaaaatctagtacatatataaacacacgtaatcaaggtatataataaaaaatctatgagtaatcataccatggacaagcttacacagtacttggttccacgttgttggcgaaaacgattgtgtgctttgacctttgctgtcattcaccatcagccgtcctttcatacttcttccggcaagtctcctctcatttgattaattcatagagaagccgtccaacaaatacgtcttccgacgtataaatctctcttcttcctctcaaatcccaaaaatttcgattatttttcaccgaaatg

SEQ ID NO: 8568 - DNA, 3000 bp, Unknown; identical to SEQ ID NO: 3907
  misc_feature (1)..( 3000): cDNA_ID_3072104_gDNA_ID_1971819_Annot_ID_176096 3000 nt of promoter + ATG

SEQ ID NO: 8569 - DNA, 3000 bp, Unknown; identical to SEQ ID NO: 3908
  misc_feature (1)..( 3000): cDNA_ID_3045752_gDNA_ID_1971819_Annot_ID_176090 3000 nt of promoter + ATG

SEQ ID NO: 8570 - DNA, 3000 bp, Unknown
  misc_feature (1)..( 3000): cDNA_ID_2177397_gDNA_ID_1971819_Annot_ID_176086 3000 nt of promoter + ATG
tacccacggcttaaaaaagtctttacacagagacttgaggttcaatataaccaattctttagacaaaagattggattgggttatgtttggtggatggtaaatggtacccacggcttcaaactttagtctttagattgagacttgagactgaacattgatccttcttggtaccctcggcttgaaaatatctagacatatggatcatgttcggtttcttgtttcactttttagacaatgatcaagttactcacggcttaaaacagtctttagacagagacatggggttcgaagtaaccaatcctttaaacaaaaaattggattgggttatgtttggtggaaagaagatggtacccacggcttccaacttagtctttagactgagactagagactgaacattgatccttcttggtaccctcggcttgaaaatatctagacatatggatcatgttcggtttcttgtgtcagtttttagacaaaaatcatattacccacggcttaaaaaagtctttacacagagacttgaggttcaaaataaccaattctttagacaaaagattggattggcttatgtttggtggaaggaagatggtacccacggcttcaaactttggtattaagattaagacttgagagtgaacattgatccttcttgttagccacgactttaaaatctctagacatatggatcatgttcggtttcttgtttcagtctttagacaaagatcaagttacccacggcttaagaaagtcttaagacagagacttgaggttcgaagtaaccaatcctttagacaaaagattggattgggttatgtttggtgcacggaaaatggtacccacggcttcaaacttagtctgagacttgagattcgacattgatccttcttggtacacacggcttgaaaatcactagacaaatggatcatgttcagtttcttgtttcaatctttagataaagaaacactcacggcttaaaacattataagtcattagacagagacttataattttaaacaatggaaatttggataataaacttacaagacgatgttaaactaaccggattttggatcccatcattgatcgttagcgattccaaaaattcagcttgtcttcccatcgttaagtagatttataatacaagtttctgttgatccttcttggtaccctcgacttgaaactcactacacatatggatcatgttcggtgtcttgtttcaatctttagacaaaagaatacccacggcttaaaacattatgtctttagacagagactcgaggttcgaaagtaaccaatcttttgtcaaaaagattggatttggttatgtttggtgcaaggaaaatggtacccacggctttaaactttagtctttcgagtgaactgaaacttgagattccaacattgattcttttggtacccacggcttgaatatctttagacatatggatcatgttcggtctcttgtgtcagtctttagacaaagatcaagttacccacggcttaaaatagtcagagacttgaggttcgaagtaaccaatcctttagacaaaagattggattggattggcttatgttttggttgatgaaaaatggtacccacgacttcaaactttagattgagacttgagattagaacattgatccttctttggtacccacagttcaaaaatctctagacatatggatcatgttcggtttcttgtttcagtgtttagacagagttggataataatggacgatgttgggttatgtttggataataaatttacaagaccagattttaaacaatggaaatttggataataaatttacaagacgatgttgaataaccggttttggatcccgtcattgatagttagcgattccacaaattcaacttgtttttacatcgttatgtagatttagaatacaagtttgtgttgaaaaaaaatatatacaagtttcttatttttttagaaaagattcccaaatttttccatacgtttagcatgctaccaaccttgtaagagggttcgtcgttgtgtgagattagtgtaatttgttatgggatcaggatcaaccaatcaagatttcaccaacttgctaatatgtgaaagacagacaaatagagtaacagtgaagactgaagatgatggttgtgatgtgatgaacaagttctaaaatatttaggtccaaaagatcttcccatggagcttggttgtgaaagtgctaactgagatttctccaacatgcacacattgttgcaaaagcttccccctgcattttattatacaaacaaacaaacaaaaatgtcaccataatggatgaatgtttgttcaccatgagtatgcgacttattaacatattacattttagcattactacatccaaatacttcaactatcatcatatattggaaatttggattgatggcttgagtcataaaaacctacaaaaggattggacgatacttttagtaaaatctcttaaaattgtccgcagtgaccaaaatgctaaaaagctagaaggatatacagacttttatcttactttatgtatcagaaaatcaatatttcttaataaatatgataaagtgtttcagtttattttgagtttagaaaaagccaaatgaattggaatcaaaataatgtaggtaaaaaagagaagtggaattaaaataaaatcattctatccaatcaaaacggtaagtagttgtgcgttttagaggcaaaacaccacagcgtttcgaagcacgtggatgtgtcgtgtgatacagcagtagcgcactattgggcattgagaatacataatcataacccctgcaatctaacggtcaaccttttaataacccttgtaggttaaatctctaccgtttattcgaattacttttccaaggtaagaaaaaagcaaacacaaaagggaatatcaaacaacaaaaaagtaagaaagagcggtaagacagagacggagaagaaggagaagaagattgttaagacgaaaccctgttgctgtccgtaca

SEQ ID NO: 8571 - DNA, 3000 bp, Unknown
  misc_feature (1)..( 3000): cDNA_ID_3045756_gDNA_ID_1971819_Annot_ID_176084 3000 nt of promoter + ATG
ttcggttacttagtgatcatgctttacaagaatgtcaacgaatcaaactttagagaattttctaacaagcgtttcaaagcacttcgtgctgtcgctcatgatatttcagatggacatatctcagtgttcaatgatgtggaagatgctatctgctatcgaaactcgtatggtcagaaccatcagatccgtaaagctgttctgagtgctgtcctcggtagcaaaaagaatgaccactgttatttctctagtgttagtcttaatgttgctaaattcctttcttggacagacatggcaggatattatgttgtcgaagaaaatcttgtttatcctgattcccctgttctcaaagctcctgagttagcaactgaagtaagcaattggaaaaaagcagatcaagcaatcaaggaaactgactcgcctgagtattacaggatcttgcatgaggatcctgcgagctgctctatacttagaagagcaaactttccgacgctcattgctgtcgcagagaagttgaagaatagagtgcttggtggcagcaacaaggtagtgaatgcagagatatctgacaaagtagactactattttgatatgcatgtcaagtagtacgcttctggccgagtgtgcgaagccaccgagcgtattgtcgactactttgaggaaaattctgagtcattagcgaagcttttctgtagttagggtctgattctacatggcgtcctgttttttttttgtttttttttttcttgtgcaccacatgtgtttaatcagatattttagtatgttgctttgatttttatttgctgtcttaaacttcattaaaaaagaattcaaggaagagattcaaaaacagaaatacaaagcatgacagttcaaaacagagcacaattgctccgaatatgtaaaacatagttgagactaagtaacagttagcccaaagaatttcttcactacacgtattgtttatgaattctaagatttcttaaacctaaacaaacctttcttgggggaaaaatagtatattcttccatgtctgtccaagaaagaatattggccacatatgaacaaatatcaccaaaagaatctccatccttggtatgattgagaaaacctttcaggacagcttttccgatctcagggttctataccataggtggaccgtaagtaggtcgagtgatcctcatcattgaacactgacacatcttctcctttgatcggaacataaccagctgcatcaaaaagtattctcatatgttgatcagagctgacttcagtgtcattcttgtaaagcatgatcactaagtaaccgaagagggccactgacttttttggttctaccaccttttgtgggacgattaaaccgtttcttgcggcagctgacgggaaacttatcgttcgcaccgtacgacccattgcacgaacagcttgttgcagagcatcagttacttccggcagtaataggtcgctctctggtccctatcggtcaggtattcattctttgcacactcaagactcaactgaaacgccgcataactgcgattcgcctccgttgcagcagacgcatcaccaagaatcatatctacttacatgctcatacagtcatacttcaaataaaaagattgaaatcgaaagagaactacttttgtttgttggctttagaattaaaagatctctataaatttagggtttcagtggagacgttttataaatacggagtagaagttggaacgttgatttgagagacgtggctcttgggctaggtacatgcatggactcgatcgggtccatgctgacttgtctttgcagtttccttctagtgaaaacgtcttgccgtttatacattcggcggggttaatgaaaacggagtgttgtgtcttgtgtgcgtgcgtagttcccaaaatacgacatcgattctactttctactagtttttaaaagcttttgcagtgcacatttgttaatacataaaggtaaagaaaactaaattttcatatatactcataagcatttaattaaattggacatccacaacaatctaatttgttgtcttttatagtgtatagttttctgattttacaaatctatctcatcaaagtcaattcttattgcaagaatctctcttgctttatttctcattaattttctctttatttatttttccttggaagttggaaccaagtaattattagttgttcaagcctctctaaaaaaagataaaaaaaatatgagttgtacaaaggttttttgccaaataatatagttggtgggattaattaccaaaagaaacaaaaaattaatatgggattatgagttaaaaaaaaaatacttgttgaaaattgaaaaaagagaagtccgttcgttcctcatttggagctacagtgaccgtttctagtgctcacagagagagagagagagagagagagagagaggcgctgtggatttgtgggagagtagggacatcagaggattcttcgatcttcagattcttactcgacgaatccttaatcgctcacctgcagttgttcttatcctccgcttattccgtcgagtgccgtggcggccaatttcggcaactctgcgccactgatgattttgatggttagatcttttaatgttcgtcctcctccttactctccgaatccattttctgtgttctttcctttctgtttcgtataaaatcatgtttcattgagctcgattatgattatatcttgtctacggtcattttgacgacgacgacagtgatgatctttgccacgcgcatcgaaaattgaattttgttttccccattttaggaattgagtcatttggatgtggttcaaatgatatttggtggttctgtttttgaatctcgtattctcttggaatatctgtatacaaggtctcactggttaatgtttcttctcttacttctgttcagtgattctaaagagtgagatgttaaagcagactataagatggatttgatacttcatccagtagtagcttaagaaatattgcggtt

SEQ ID NO: 8572 - DNA, 3000 bp, Unknown
  misc_feature (1)..( 3000): cDNA_ID_1662993_gDNA_ID_1971819_Annot_ID_176081 3000 nt of promoter + ATG
tttgatggcaacaacatcgatcctcctctgcgctggtctagctgcggttttaagcagcacatatgcagtgaagaagcctctaaacgacgctgtttttggagctcgcggagagttcatggtggctctcaagtacgtcacgatactcaccatattcctcttctccttcttctctcactctctctcaattcgtttcatcaaccaagttaacatcctcatcaacactccttttcctcctgaggagttggaggacgagatgatgatgaccgcggaggagtacgtggcggagttgctagagagagggtttattttgaatactgtggggaatcggttgttctacgcggctttgccgttgatgctttggatatttggaccggtgcttgtgtttttgtgctcggtcgtgatggttcctctactttacaacctcgatttcttcttcttcggtaaagaaagaagaaaacttgatcaaaagtctagttttggatctgtgtaaaatcgagttctggtcagtagaacaagtgatttgtaattaagtgatatcatcgtcctctttgttaaatcctggactaccgatgaacgcatgaggactttacatggaagttgaaaagttcgaagatcatagtttaggtttcaattctagatcttccgattaagaaaaaaaaatgtaattaaataacgcattataattttcatatattagggtttttcggccgtatgtatttggtgtggtgtaatatatgtcacgttttggtttattgagcgttattattggcatttccatgtgggtgactttataacgtatcagcatatctcacagctctcttggtatgtacgtttctcttttttctttttctttttctgttagtgtttatatgcatgtggcttacgttgggcaagaaacgggacaaaaaatgtgatgttcacatctattccgtgcattagtatctgtcttattaagttttgttgttatgttatgtgttaggaaccagtcgtcacgaggctatttaaatcctccctaagacaatgtagaaatatacctacacggttatttttctgtgtagtatgaaatcaaactgtttagaactcgtttagagatgacaattcagattatgatgttagctaattatatccgaatctagttctgaagcccatgttcgcctagattaaaattgtatcattgtatgttaactaactctatttttcatatatatattttcaattttggtttagattaggtaaacaaaaagctatttcatgctacaaacaaatacaattttagtgatgaaaattttcgtagttaaaactttagtttcgtacgtagctaaatagctaaacgacagttgctaaataacttactcgtgactatccgttgatacacaaatttcatggataatagctactgaccatttaacaacgagatagccagagatatatcatagagatagccaattaaactgttggcaaaagtaccatgggctgtccttaagtgggcctaaatctaataaaattataaactgtggcctgttaggcatgtgatatttttctctttttcttcaagcctttttataaaaataaatgtcaagagatgatgaaggcatttgcacttttgaagaattgaagtaggagctcaaagcgaaggattacgatgatagacatctctgtaatgatttaacaaaactcaaatacaacatcaagtttggaagatcactggactgttttgtgtttgatcatttactcacctgtaattcttttttactaatatataacttataagaaatcataaactataatcttttttttttttgggtttaatgagacttttttctgtcctttttttgaacacctgtgaatcatagactataatcgaacttcatccccttttttttttttttgggaaacttagagaagaacaaaacatttgtgaggctgatgatttgatgagaccgcaacgttggagaactttggagtatattaataatatacattttcaatattatcagtatatgcattttcaactaggccttgctttatacaccggagattataattaatgaaaagatgaattacgttaatgtcattgcttctggtttgagttggcaaactccacgtaccacgtacatataattattattgagtagttgctaattaattatacttttgtcttgttaaaactagtattataaattggttaatgccataaagcaaacgatagaccagacacatctctgataatccagcggtacttatttgtcatgattctgtgatccaatcaattaatcgtatagatttagctatcgcgaatcgtgattccaacctttacataaattctttttaaattagggcaaattgtgttggatcaagcatagtaataacataatacgtacttataaaattgttaacgtgccggtgttgtttggagagaaaaacaaagattcttagctctcaggcaattaaaaaaacgagtatcgaaaaattcagaatagaagttgcttagttaacgagaaattaaatggtgcatcgaatatctaatggtttaatctggatatagtaaaattagtactccacgattagttagcaggcaagtagatgaatgtcattaatttgatgatctgattgaattgctttcgaaaaaggacaataataataatatcgactggttaattggttgtcatattttacccaaaaaggatcaaccattggatttacgccacgtcattaatgtgaaaatacaaaagtggatccgatggatgccgcgtgtcatcgtcggtcacgacatacccacgaagccatttacctcacgtttagtaccatctatctctctctctctcgtcttggcacgctgtttctttttttcctactggttaagaaatttctacggtccatggtcaaaaacacaccttcataaatatacagagagatcgtgagagagcagagaggaaacgtttctcttgttcgttggaatctccgtccctttttgttgatcgacggtggtgaatcttagac

SEQ ID NO: 8573 - DNA, 3000 bp, Unknown
  misc_feature (1)..( 3000): cDNA_ID_1823257_gDNA_ID_1971819_Annot_ID_176077 3000 nt of promoter + ATG
aaatcaggtcttttttttaataataataacaaagtaagtttgttttctgagtagagaagtgtaatctttgtgtgtttcgaactttgttgtcttgtgtgttgtcctaacgagtgcctacttgtgcaccttttgaagaagattaaagctaaaacaaagtttataaactaacgtaagatcgaacaacatacgtcacatttcaacaaaatgcaaaaccttagagaaaacttgataacattcctaattccttcaccgtgggagcaaataactgaaatgtgtatcgagcttgtatttggaagatccatggacaagtaggtattgggcttgtatttggaagggccatgaggacaaatatgtattgggcttttatttggaaggtccatgaggacaaatagatattgggctttcacgttttttatctgtcgcctaacaaaacaaaaaaaaaaagtaaaaccaaaaaaaagaaaggagagaggccgacttggggtataagccagagttcttcttctttttcaagcttcttcttctcatcagtcatcaccggaatctaatttatactcgcaaaactcagcgattcgtttcgtttctgacaagtttccaattctacagcaatggatctcaatctcgatgcacctcactccatgggaacgaccatcatcggcgtcacttacaatggaggtgtcgtcctcggagccgactcacgtaccagcaccggtgagatttccccccttctctacttttctagggttttagttcctcttcgttgggtttgtatttgagttttgttttcgtttcaatcggaacaaagaataatcctaatcgattgttctatttgggtaatttagagaaagctgttaaatttgggatctgttgtaaattactcgcgcaggtatgtacgtagcgaatcgagcttctgataagattacacaactgacagataatgtctacgtctgccgctctggatcggtaataatctctcttagggatttcatttttgtttttgtttgacctgttctgctgtggaaactgtttagcttgctagacttcttattgaatctcttttgcttactgggtttcttactcgaatgtttgttgttcttgatttacttgcaaatgggatattgattacaacaagctctcttcttgttccttttgcaggctgctgattctcaagttgtatctgactatgtccgctacttccttcaccagcatacgtgagtgtcttgattgacgaagctgcatgacttgatacttatgctatcttatatatccggatgatttaataattcgttttcttatgatttgcagaattcagcatggacaacccgcaactgttaaggtttctgccaaccttatcaggatgctcgcatataataacaaggtacaagtttgcttttaagcttgccgtttggtttggttgttttaccagcaatttagactaagagtagtgaggaatgtggatgttgttccattttcttgtagagaaaacatacccatactcgactcaatcacggataacttttgtttggaagtttgaccctgggaaatatgacagtttgcttatgtttttattgctttattatgactaaagctgaaaattttggggcatagagattgatgttacatgtcaaacctaggatgctagtatttatgaatctcttgttgttcgtagtgttactgttatggttgttctctagtctaaagtacgaacactattaatggaaatgtagaaagtctctgttgtaatgctactgtatgtagtgctcaagaagtatctcagttttctatactccaaatcatatccagtttgttattgtatggtgattccttgttttgattacatggattgttaactgaaacattgtatgtctttgttgagcagaacatgctccaaactggtctcatcgttggaggatgggataaatatgagggtgggaagatctacgggatcccactcggtggaactgtagtcgagcaaccgtttgccattggaggtaaaaactatattgttatgagtcttatgatatttaggttttaacaaagatgtattcgattaattggtctttgctatttactaacttgaatggtccctttgcttctgttaacaactaatggaattgtgtgtgtttgtgtaggctctggttcgagctatctctacgggttcttcgaccaggcttggaaagataacatgaccaaagaagaagcagaggtaacgcggttcacatcactgtatctgcatatgcaaaaatctcacaaaccccatttgtataactggtcgttgctattgtatttacgcttgtgtatttatattgcagcaacttgttgtgaaggcggtttcactagccatcgcccgtgatggagccagtggtggtgtcgtacggactgtcatagtaagatctttctctgaccagaagctcgctgaagcgaaacttatgtaacctccttaatggtacttaattggcaaactgtttttgatgtttttgaacagatcaactcagagggagtgacgagaaacttttaccctggagataagttgcagctttggcacgaagaattggagccccaaaactcactcttagacattctgaacgctgctggtcctgaaccaatggccatgtgatctgcaaacaacgatcattatcttactctgttgggcaaacattttagatatttcattacagtttccagtgtctttaagactttaaactctgtttgaggttctgttgtaatgaatgacccgatctttctgttttaaacggatatcgtgtttcttatggctatggttttaattcctctgttctcgaatcgatccagtagaaatgttagccatcttctccgaaattgattttcagttcttttttagtgaccaagagtttatggtgaaaaaacatcgttcaaaatagtaatcacaaccttttatatgcttgacacgtggcgggacaagggacacttgaacttctactcagtcgcaggaactggacggagtaggagagacaaagaagg

SEQ ID NO: 8574 - DNA, 3000 bp, Unknown
  misc_feature (1)..( 3000): cDNA_ID_2999526_gDNA_ID_1971819_Annot_ID_176076 3000 nt of promoter + ATG
acaatacggttcggtctccatctctctctctataaatgctcttcttcccacacatcgcctcctcctcattaagatacatctcgagaagcagagcagagagaaagagattccgagagagagagagaaggagggagagaaggagcttagtggtctcattaccattaccagctccatacgaaccgaaacgacgccgttcgctcaacccttttctctgcaatctctcttcctcccacgagtttctcagcttttctcggatcatctaattaagagaggagatcttgtctcacggtgggattgatttttctcttcacgaagatcgtgttccagggtaaagttttgatttttattcatcttactcattttggttaaagtagcttctgttctcagcgattttctctgtctcgtgtttatgtttattgtagttcaggaaatgttcttactgttctgtttgattatatgattattgcaccaaatctggctagaaaaagtcaatacctttttcccttctttctagaatttgggaacactgtttactagatttttgtctttgttccaaaagtttgttcattcatgtcatttacgggttataactgcaccaccattgctatggaacgcataacctacctagaaaatcttccttgcttttcaaaataaagaaagggagaagatttgattcttttatgaactctgagctgtcctgaagagaacccaatatttgagcttatctgtttacatttaaagaggaagtgacaatagaaacgctggtccatcgtgatttgtcttacttgtttagctcttgtcttgtctttactacatggtgcctttttctggcatttaccatccacaaaatcatgatttgtgtctaaatcttagattttgtctttttttttgtgtgtgtgtatgtacagcaattaactgcagaaaatggtgatgtgggtctttggctatggctctcttgtgtggaacccaggatttcactacgatgagaaagtgttaggtttcatcaagggatataaacgtgtctttgatcttggtaacccttttctgttaagataacagttttggttctttgcgtatttgattgatttatctattcgtcccagctgttgattattgattgattgatttgtgttttgatttgacttggtagcttgcattgatcatagaggtacaccagaacaccctgcaagaacttgcaccctcgagaaagctgaagaagccatatgcgtaagtagctattcttaatatgtgtataggatcttagagtctgttcatgaggcctgcttgttactcacacattattcttttcttactaacattccaatactttcttgacagtggggtactgcattctgtgtccgtggaggaccagaaaaagaacgtctggctatggaggtatgtccttgcatctgaaaactagatcgcttgatgtatcatggtcatgcctttgtgttgatctttctatttgtacacagtacttggaacgtagagagtgtgaatatgatctcaagacaagtgtagacttttacaaggtgagtcaggactcagccgagattattgaataagcctattattccttatgctactaaaaattgacctcaaaagtttcttccttacacaggaagatgatcctctaaagccagctgtaactggagtgatagtgtaagttgtttcctatgacacggatccatcaacagctgttctcacatcgatttttattttcttctacaaatctttgtgttgtgattttgatggatgcatttctttacaatcttcagattcacttctactcctgacaaggtctccaacaagtattatctcggacctgcgccattagaagacatggcaaggtatacacttagcttccagcccaatttcttctgttcctttagtttatgtgccagattcttgtcctcacacttagctgttattttgtatattcaaagacaaatcgcgacagccaatggaccatgtggtaacaacagagattatctcttcctgctcgagaaggcaatgcacgacattggttagtccaagctccatttgaagtctttatatgaatagaacatctgcccaggctttgtagtcaaaggttctgaccttgatggttttaagagagacattgtttttgatgtgttaagccattttttatttcacacagggcatgaggaggactatgttatagagctggcaaacgaggtgaggaaggttctggccgagtcctcgactaagaaggtgacaccggtgaaggaatcaagagcaagccgtgtagctaacaagtcgaagaacaatgtccccacggctcatcagatactacctcatcatccagaagctgttgccactacaatataactcttgtagttttcttcttaattggctttagagatgagtgaaatcaggtcttttttttaataataataacaaagtaagtttgttttctgagtagagaagtgtaatctttgtgtgtttcgaactttgttgtcttgtgtgttgtcctaacgagtgcctacttgtgcaccttttgaagaagattaaagctaaaacaaagtttataaactaacgtaagatcgaacaacatacgtcacatttcaacaaaatgcaaaaccttagagaaaacttgataacattcctaattccttcaccgtgggagcaaataactgaaatgtgtatcgagcttgtatttggaagatccatggacaagtaggtattgggcttgtatttggaagggccatgaggacaaatatgtattgggcttttatttggaaggtccatgaggacaaatagatattgggctttcacgttttttatctgtcgcctaacaaaacaaaaaaaaaaagtaaaaccaaaaaaaagaaaggagagaggccgacttggggtataagccagagttcttcttctttttcaagcttcttcttctcatcagtcatcaccggaatctaatttatactcgcaaaactcagcgattcgtttcgtttctgacaagtttccaattctacagca

SEQ ID NO: 8575 - DNA, 3000 bp, Unknown
  misc_feature (1)..( 3000): cDNA_ID_3092651_gDNA_ID_1971819_Annot_ID_176075 3000 nt of promoter + ATG
aagagcaatataatcatagtgtagctcacggtagcaaagtgttctacatatatttcaactataactacaccgacaattttcgtcattctgtatcttgaagaagtgaataagtctgtctatgcactatttgttcttaagattccttaaaggcctagtttcatttagtaatggggcaagaaaaggatagtgtatagtgtacctaattcagcagagagatcaacaacgtcttgcgcttcagggtcactatcagattcagtcccagctttttcatcttggatcatcacaaccgcattgatggcttcaaaaagctcgatatcgatatcccccgggagattaagtaacttcctcttgtcactactcagggaccaataggaacgaccagtgcctcggtactgagattcccacttcttgatctgattgtaatcagacatcaaagaatcccatttcctcctgcattggtttagatttctgctaacatccaaagcgttgcagttctctgtgatcattgtccatttctggaagctagataaagcattcgaacaatcggcttcaaccgcagcgatctcattcacgaggactagacaatctttgactgcccattctggagcaacttgagaccgtgttctccgtgaacctgaagttccttcctccatccaaaaaggcttaaactgcaatttggtttaccaacctcgttaatatcatcatcatcagtaaagacattacaacataactgtgatttgaaactctaataaaacctattgtcaatgaacaataaccaaagaggtgcatcttcatgtttctgagttttgtataaatctgagaatggtaagcgatattgaaattcaggaactaaagtacacagataaactccacaaaaaatgcagctagatttttcaacattgaagaataataactcggtaccaaacaaatcagatacaaaattcaaacaagaatccagacgaacacgactggagaattccaaactggagaaagaagaaagaagaaagaagacaactttgagcataaaaaattaccagatcgccggaaactgcttctggaaaacgacacgtcgacgccaggcaagtcactttgaagtttgctccaagacgatgaggaaccgagtgaagccgaagcaaattttattgatgttatctgtcaacaggcccaaacgtttttttattgaattcggcccaaacctattttttttgtttaaatggcccaaactataattagatattgattttgaagagaaaaataatttgttgttctttgtcaaattaatagtataaatttttagacaaaaatctttactatgagtcaagcgaacccactttaacatgtagtattttactgaacatttccaaattacaagacctcatcatccaatatagaatacactcactcgcctgatgagtgatccaatcctcaaaaagcatagtaacaattataataatgcatttattccaatttgatatttgaaataaacaaagatatttttgtggagattcatctagtttttgctttctagaaatattttttatggtataattcgagaagaagcgattagtcgtgggaaacatttgatagtttagtcttatttttatgtaccagtgacgtcggtgatggcaatgtatgtatatggctttgtgtaacaaatacattctgacgtttgtgtttttgtgactgtgtctttgtttgcctcaaaattcaaattttaacactttttaaataagccaataaaaaaaaaaaggaaaacacttttttgtctttagctaccaaggtagacaaattatttgaaacttggaatattttaggaatgtgtttggcttcaaaaatagtgagatgaacaaataaattctagattttggatatatgagtttccataagaaacaaaacaaatatttcaatttatgaattagattaaaaatttcttaacatgagataccttgtttagagaacaaagatatttcttttagaaacaagcgtcttcaccggccagtcacgtgacgaatggaaaacggaacagacaaaaaatctgcagaacacaaaaaaaaaaaaaaaacatgcgtggcatgaacaatacggttcggtctccatctctctctctataaatgctcttcttcccacacatcgcctcctcctcattaagatacatctcgagaagcagagcagagagaaagagattccgagagagagagagaaggagggagagaaggagcttagtggtctcattaccattaccagctccatacgaaccgaaacgacgccgttcgctcaacccttttctctgcaatctctcttcctcccacgagtttctcagcttttctcggatcatctaattaagagaggagatcttgtctcacggtgggattgatttttctcttcacgaagatcgtgttccagggtaaagttttgatttttattcatcttactcattttggttaaagtagcttctgttctcagcgattttctctgtctcgtgtttatgtttattgtagttcaggaaatgttcttactgttctgtttgattatatgattattgcaccaaatctggctagaaaaagtcaatacctttttcccttctttctagaatttgggaacactgtttactagatttttgtctttgttccaaaagtttgttcattcatgtcatttacgggttataactgcaccaccattgctatggaacgcataacctacctagaaaatcttccttgcttttcaaaataaagaaagggagaagatttgattcttttatgaactctgagctgtcctgaagagaacccaatatttgagcttatctgtttacatttaaagaggaagtgacaatagaaacgctggtccatcgtgatttgtcttacttgtttagctcttgtcttgtctttactacatggtgcctttttctggcatttaccatccacaaaatcatgatttgtgtctaaatcttagattttgtctttttttttgtgtgtgtgtatgtacagcaattaactgcagaaa

SEQ ID NO: 8576 - DNA, 3000 bp, Unknown
  misc_feature (1)..( 3000): cDNA_ID_1444498_gDNA_ID_1971819_Annot_ID_176073 3000 nt of promoter + ATG
ataataggcttattcaataatctcggctgagtcctgactcaccttgtaaaagtctacacttgtcttgagatcatattcacactctctacgttccaagtactgtgtacaaatagaaagatcaacacaaaggcatgaccatgatacatcaagcgatctagttttcagatgcaaggacatacctccatagccagacgttctttttctggtcctccacggacacagaatgcagtaccccactgtcaagaaagtattggaatgttagtaagaaaagaataatgtgtgagtaacaagcaggcctcatgaacagactctaagatcctatacacatattaagaatagctacttacgcatatggcttcttcagctttctcgagggtgcaagttcttgcagggtgttctggtgtacctctatgatcaatgcaagctaccaagtcaaatcaaaacacaaatcaatcaatcaataatcaacagctgggacgaatagataaatcaatcaaatacgcaaagaaccaaaactgttatcttaacagaaaagggttaccaagatcaaagacacgtttatatcccttgatgaaacctaacactttctcatcgtagtgaaatcctgggttccacacaagagagccatagccaaagacccacatcaccattttctgcagttaattgctgtacatacacacacacaaaaaaaaagacaaaatctaagatttagacacaaatcatgattttgtggatggtaaatgccagaaaaaggcaccatgtagtaaagacaagacaagagctaaacaagtaagacaaatcacgatggaccagcgtttctattgtcacttcctctttaaatgtaaacagataagctcaaatattgggttctcttcaggacagctcagagttcataaaagaatcaaatcttctccctttctttattttgaaaagcaaggaagattttctaggtaggttatgcgttccatagcaatggtggtgcagttataacccgtaaatgacatgaatgaacaaacttttggaacaaagacaaaaatctagtaaacagtgttcccaaattctagaaagaagggaaaaaggtattgactttttctagccagatttggtgcaataatcatataatcaaacagaacagtaagaacatttcctgaactacaataaacataaacacgagacagagaaaatcgctgagaacagaagctactttaaccaaaatgagtaagatgaataaaaatcaaaactttaccctggaacacgatcttcgtgaagagaaaaatcaatcccaccgtgagacaagatctcctctcttaattagatgatccgagaaaagctgagaaactcgtgggaggaagagagattgcagagaaaagggttgagcgaacggcgtcgtttcggttcgtatggagctggtaatggtaatgagaccactaagctccttctctccctccttctctctctctctcggaatctctttctctctgctctgcttctcgagatgtatcttaatgaggaggaggcgatgtgtgggaagaagagcatttatagagagagagatggagaccgaaccgtattgttcatgccacgcatgttttttttttttttttgtgttctgcagattttttgtctgttccgttttccattcgtcacgtgactggccggtgaagacgcttgtttctaaaagaaatatctttgttctctaaacaaggtatctcatgttaagaaatttttaatctaattcataaattgaaatatttgttttgtttcttatggaaactcatatatccaaaatctagaatttatttgttcatctcactatttttgaagccaaacacattcctaaaatattccaagtttcaaataatttgtctaccttggtagctaaagacaaaaaagtgttttcctttttttttttattggcttatttaaaaagtgttaaaatttgaattttgaggcaaacaaagacacagtcacaaaaacacaaacgtcagaatgtatttgttacacaaagccatatacatacattgccatcaccgacgtcactggtacataaaaataagactaaactatcaaatgtttcccacgactaatcgcttcttctcgaattataccataaaaaatatttctagaaagcaaaaactagatgaatctccacaaaaatatctttgtttatttcaaatatcaaattggaataaatgcattattataattgttactatgctttttgaggattggatcactcatcaggcgagtgagtgtattctatattggatgatgaggtcttgtaatttggaaatgttcagtaaaatactacatgttaaagtgggttcgcttgactcatagtaaagatttttgtctaaaaatttatactattaatttgacaaagaacaacaaattatttttctcttcaaaatcaatatctaattatagtttgggccatttaaacaaaaaaaataggtttgggccgaattcaataaaaaaacgtttgggcctgttgacagataacatcaataaaatttgcttcggcttcactcggttcctcatcgtcttggagcaaacttcaaagtgacttgcctggcgtcgacgtgtcgttttccagaagcagtttccggcgatctggtaattttttatgctcaaagttgtcttctttcttctttcttctttctccagtttggaattctccagtcgtgttcgtctggattcttgtttgaattttgtatctgatttgtttggtaccgagttattattcttcaatgttgaaaaatctagctgcattttttgtggagtttatctgtgtactttagttcctgaatttcaatatcgcttaccattctcagatttatacaaaactcagaaacatgaagatgcacctctttggttattgttcattgacaataggttttattagagtttcaaatcacagttatgttgtaatgtctttactgatgatgatgatattaacgaggttggtaaaccaaattgcagtttaagcctttttggatg

SEQ ID NO: 8577 - DNA, 3000 bp, Unknown
  misc_feature (1)..( 3000): cDNA_ID_3092659_gDNA_ID_1971819_Annot_ID_176070 3000 nt of promoter + ATG
atatatatatatatatatatatactggcaacacacaacatttgtgaaaattttcctaaggactagactttatgtaattatcactattcatgggaaaatttgaacatattggtcttggagcctttggtgagtagtagtgagcacgttattaggcattaaattttgcatgtaataaaaaaaaatgtttgcatgtaaaagttacaatatgaaattttatttcttcttttgacaaaatatttgtggaaaatactctctttgaaatgattattagtgggcctattgataaatgggccatgtatgatgttaattaaataattcgtttgggccttaaaacaggtaacaaggggctgtgtggagcgccattgcttccgtgcagatacactcgtccgccgttcttcaccgtgtttctccttgccctcaccatcctcgccgtcgtagtgctcattaccgtctttctttccgtttgcattctcagccgccgtcaaggcaaaggacaagaccaaatccaaaaccacggcgtcggccattttcacggacaagtctacggacaacccgagcaacaacaacacagtgaaaagagctcacaggactccaaggtctacagaaaactagctaatgaaactgtgcagcgagattcaacagcaacatcaggagctatatccgtgggaggtctctctccagatgaagacaaacgaggagatcaacggaagctacatttcgttaggaatgatcaggagaggttcacgcttcaggatatgctccgtgcatcggcggaggttctcggaagcggcggatttggatcttcgtacaaagcggctttatcgagtggtcgtgcggtggttgtgaaacggtttaggtttatgagtaatatcgggagagaagagttttacgatcatatgaagaagatcggacgattgtctcaccctaatctccttccgttgattgcattctattacagaaaagaagagaagcttctcgttaccaattacatttccaatggaagcctcgctaatctcctccatggtaatattatggaactctctaagtgtctgtttatcttcatccaatgaaatgaggaatctgatgagttttgttggattgattttgcagctaaccgaacaccaggtcaagtggttttggattggccgattcgattgaagattgtaagaggagttacgagaggattggcttatctctatagagtgttccctgatttgaatcttcctcatggccatctcaagtcttccaatgtgttgcttgatcctaacttcgagcctctacttacggactacgctcttgtcccggttgttaacagagatcaatcacagcagttcatggtggcttacaaggcacctgagttcactcagcaggataggacttcgagaagatcagatgtgtggagcctgggaatcttgattcttgagattctgacagggaagtttccggcgaattatctcaggcaagggaaaggagctgatgatgagttagctgcttgggttgagtctgtagcgagaaccgagtggactgctgatgtgtttgataaggagatgaaagcagggaaagagcacgaagcacaaatgttgaagctgcttaagatcgggttgagatgttgtgattgggatattgagaagagaattgagcttcatgaggctgttgatcgaatagaagaggttgatagagatgctggtggaggtcaagagagtgttcgatcttcatacgtgactgctagtgatggtgatcatcgttcttcaagagctatgactgaggagttctcactcatgtaatagcttccattgaaaggcctgtatctctctctggtctttccactagtcttattcttcatctaattctcgtttccttgatatttgttgatcaagttcgtgtctttgtttgtaggtaatgagaattactttttattttttattgccagggttatttattcgcattcagtttttttccccctagttttaacagatatgattgatgagtaaagcttcaagcttttgttcttttgttgattttttcacttttcagctatttccccattttgtgaatattaatttcgtgccatactttggtatcatctagacgcaaaagaatgtcttttatgtccatttcgtattcaacttgtccactttctgatgcagtgttgagataagcaagaatataaaattaatggttttcacaagcttgttgctttagatattgggtaacctaaccttgtagatggtatattctttgaggatattttgatttacttttacttgttcttttgagagagacttcaataaagtttaagtttatatcttttttttttctatttatatttccttgtccccatgtgatttcatttatccccttttcttggaatttacaagcttaatcaaccgagaggcatatcatcaataaggattaaacctgtgtggaaattttgttacaatctactctgtattgaaacttgtttcggtatagtttcctcgtatcaaaggttataccaccatctctctggtatcaggtatgttaagttttgtttattacttttctcaacaggccatctgagacagttcatcgtctgtaaaccctgttataattggtctctgtttcagttttttaaagttgtatgttccttcaagttttgttctgggtttctgatgttttgtaactggtcttgatatgtatttctgtatgtttgatcatttcatgtgttcatgaagggatggaccttagtttttttttgatccagaataagaactcaggttttactgtagaactgtatagaacatctcagtcttcacaagtagtacttaactacaacacatatgctcatttctttagaagtctttcgagctggaattagcttgagccgttttggatatgtaatagcatgtactcgtacaataaggctaaggtacatgttcttgatgaagcatgttttctcatgttggtttaggtttctgatcagaagcagcttaaagagcatagtggtgttgcagtttagatg

SEQ ID NO: 8578 - DNA, 3000 bp, Unknown; identical to SEQ ID NO: 8566
  misc_feature (1)..( 3000): cDNA_ID_2177362_gDNA_ID_1971819_Annot_ID_176069 3000 nt of promoter + ATG

SEQ ID NO: 8579 - DNA, 3000 bp, Unknown; identical to SEQ ID NO: 8565
  misc_feature (1)..( 3000): cDNA_ID_1823294_gDNA_ID_1971819_Annot_ID_176068 3000 nt of promoter + ATG

SEQ ID NO: 8580 - DNA, 3000 bp, Unknown; identical to SEQ ID NO: 8574
  misc_feature (1)..( 3000): cDNA_ID_2999526_gDNA_ID_1971819_Annot_ID_58282 3000 nt of promoter + ATG

SEQ ID NO: 8581 - DNA, 3000 bp, Unknown; identical to SEQ ID NO: 8573
  misc_feature (1)..( 3000): cDNA_ID_1823257_gDNA_ID_1971819_Annot_ID_58283 3000 nt of promoter + ATG

SEQ ID NO: 8582 - DNA, 3000 bp, Unknown; identical to SEQ ID NO: 8572
  misc_feature (1)..( 3000): cDNA_ID_1823252_gDNA_ID_1971819_Annot_ID_58286 3000 nt of promoter + ATG

SEQ ID NO: 8583 - DNA, 3000 bp, Unknown; identical to SEQ ID NO: 8570
  misc_feature (1)..( 3000): cDNA_ID_1823245_gDNA_ID_1971819_Annot_ID_58288 3000 nt of promoter + ATG

SEQ ID NO: 8584 - DNA, 3000 bp, Unknown; identical to SEQ ID NO: 3908
  misc_feature (1)..( 3000): cDNA_ID_1823237_gDNA_ID_1971819_Annot_ID_58291 3000 nt of promoter + ATG

SEQ ID NO: 8585 - DNA, 3000 bp, Unknown
  misc_feature (1)..( 3000): cDNA_ID_1823226_gDNA_ID_1971819_Annot_ID_58294 3000 nt of promoter + ATG
taggtatggctgaatttggtagagctctgctttgttcattccgtacagctgaaagaacagaaaagaagagttaatttcagtttcaactcatgtcttactgaaaaacttcttccacgtgtgaataaagaaagaaaaaaaacacctccatcagcattcaaagacgaagcatttcctttgagcatatcagtcgctaaaacataggggctgtatttaggttccaaagaggctacactactgggacttttaagcatttcctcggttgctttagctctgactttgcgaatttcatcttgaatattccatgactgattagaaccggacttccttttcagctgcatttggtaaccaatgtcagaatgaataagggtaaatttgagagagccattgaaaatacatataacggtatgcaacttttctttaggaatagctggaaatagtgtcccacaaattcctcgtggttatctaacataaacaatagaagttaagcagagaattttatctcataaaccaagatgaaacgacttcagactttcaaacaacatttgaccaaaagaaaagtatgcactgctggagaacttaaaattctaaccttggatgaggaaaagtttccagcgctataaggaaggggtgtcccttgcactcttgctgatgatggtgatcgaaaatctaaattattcgcagctggagatccccatggcagacgagctcgcatataagacttggccacgtccacaggcgatccagcaccatcttcagttgcctggagatttaaactaatggctgagatggtgatcatcatttaaagtacaatggaaaaagaatactgtgaagcgaagctatcagaagttgaccaaaatcatgtaagtaaatggtcttcatagtcaaaagaagagcaacaatatggatcttttgcattttaagcggacaaaaaggtatttcccaatcaggacatttcagaattaacgtcaccagatggccacacgcagaattctgaacaacctacttttgcaagagagctttaagttgctgatcacatggattggcatataacaatcaaatcattttacccaaacagaagatgtctccttctataataataatggcttagagcacggagacaagatatcacaaaaaagttgatacctgcaggctgcagcaattagaacagttaagaagcaagtttccagaacttactttatactttgaacttgatcctgatttcttctcctccaaccattttcttgcttccatgacagctgtattggacatttcacccacattcacgtctagaaataaaatagaaaagaagacgttatcacatagactaatccggtctacttgcacagtctaccatcagtaacataccgcttgtcaatccatagtcatcatgactcgtctcaatagcagaggggacgctgggatgatctacaaccctagccttgatgatatctattaacctatcaccctcttccctgaaacaacatacacatgaatgaataagcaggatacaagatcagcttagatttggtaactacacacgtctcagaaagattctttaagctatgaggtgtaaataataagaatagtcgaggaggctgctacttatgatgtccaaaaagccaggcagagaaataccttgcaaatgtttcttgcaagagaagctgctcaattacacgcttagaactgagtcgttgaatgcttggttgctgggcactcagaaggtcctattcacacaagcacaaaaactgaaattatgcttttataaaaaaaactctcagttgaaaacgtgttagcttcacgaactttacttcaaacaattatcataggactacagtggcatagcaatcaccaaaacgaacaaggtggttagtacctcttcagtaaaatcgggattgttcttctcaacatcctcatcaccatcaatatctgcaaacaaagaagaaaacatataaaaatccatacattaaaagaataagacacaacaaagctggttggtattctcaatcccagaactacattatatgaataaaaattagagctttagaattagtatgaagtttatagcttagaagtaacctaactaaatagagtacaacaatgcttaactgctcttaagtcccacatattaaaggaaagagaaaatgggaaagctttaagtcaaacttcacatttcaaacgaaacggtagctttcagattcgaccagacaataaaccaaaaattcaaattaatcctatctaaactgaaataaatggtacaaacctgaagatgaatcctcgtcctcctccgaagatgaggaagagtcggagaagacgacggaagaaatgaattttccggcgccggaagcaattacgctggcgggtttgtaaacgagcctggagatccaactagggttttgctgaggaggatctcgggatctctgaacggggcgctcacacggcgtcctgacaacagcggtgcgtcgtggtcgaacaattttcccaccgactcgaggctgacctgctccggcggcgtaaccggagacggaatccatggtgaaagtgagaggaggagggagaagttcgttgtaggaaataatgaaagtgttgaggaaaaattggtaatttctcgttatttgtcgtcttcttgtttttttttttaattgggggtgaatagttagtttcctaaattacaggcctgcggttaaaatttcttccactaataaaattaggcaaaaacaaaacattgcgattaaaaaaaattaatcgtagtaaaatcatgtattatattcttctcttttcatattttgaacatatcacatgatgtttagatcttataaatgcagtaatttaatagagagattagaatttggaagaaaaaaaagttacatgattaaacgaagtaattaatcaagttgtaagtagttattttaaaaacaatattagaaaaatgttttttggttactcatacagtaatacttaattcgtcaactgtgtcagtgttacaaaaaggctaaaagaatg

SEQ ID NO: 8586 - DNA, 3000 bp, Unknown; identical to SEQ ID NO: 3907
  misc_feature (1)..( 3000): cDNA_ID_1823222_gDNA_ID_1971819_Annot_ID_58295 3000 nt of promoter + ATG

SEQ ID NO: 8587 - DNA, 3000 bp, Unknown
  misc_feature (1)..( 3000): cDNA_ID_1820322_gDNA_ID_1971820_Annot_ID_58297 3000 nt of promoter + ATG
taaagctaaagaatactttttttctcttgaattatataaaagaaaaataattggaaaaatgtctagtaggtttaaaggatttgatatttaaaaaaaaattgaggaccctatttttttcttttttcatttggtttattttagcagttagcaccatcttaagatagagaacttgaagttttattctgctattgaaaaacgaaaataataactaaaagaaattttatcttactactttttcaaaacatatatgttatttggaatttcaatgcaaagagtacaaataaccaaaacataaattctgctctctctttttttttttttgaaaatatctaaataaattcaataatgcacaaatataaacacaaaatactatccgagtgttgtcttgtccaatctatcaactcgtttcttcgctgtcttagaaatccacaatatctttcttcacactttctttcactttcccgggaaaacagccgagaaaataaaagaaacgaagaaaagtttgttcctttgtggggatcaaagaagaatgtactcggcgattcggtcttcgcttcctctagatggcagcttgggagactactctgacggaaccaatcttcccatcgacgcttgtctggtcctaaccactgaccccaagcctcgccttcgttggacctctgagctccatgaaagattcgttgacgccgtcactcagctcggcggacccgacagtaagtgtcccttcttagaaatttatggatcttagaatgaaatgtgtttttttttttaatctgttgttcttcagttagtacgaagaatttgacaacgagttaggtctaatttctttcagatttggaagtcaatcatcctgaaatagaatggatttcttgggtttatgtcacttagaacaatttaggaattactgtggcattctttaggttttttttattggccttgagatttgtttacaagattagtttttttgtgtgtttggtttgatgtcagaagcaacgcctaaaactataatgagaacaatgggagtgaagggtctcactctttaccatctcaaatctcatcttcaggttttgatgctactaccttcaatatcaaattatgcttctttggctacttataacaaacaaagttcattgctttttgactgtgttgttctctggttttttgctcggtagaaattccgcttggggaggcaatcttgtaaagaatcaattgacaactctaaggatggtattcagttatatctttagctaagaatccatttatatctttatggattcagttgtgcatttatatctttgtgaacttatatctctgtagtttcttgtgttgcggagagtcaggacactggttcatcttcaacatcatccttaagattggctgctcaagaacagaacgagtatggtttcaagtgttctctttattccaagtgttatattcactgtctataacactcattgtttttgtcttgagccaggagttaccaggtcactgaagctttgcgtgcccagatggaagtccaaagaagactacacgagcaactagaggttagtttcttcttcgaattcaccaaataccagagagactttggttaatgagagactatatagaaacctccattgaatttccttaaagcttatcagaacgttactacttaggaaatcttttcatgaaagttagaaccatagaaaccgcatatactaatgtttgagccctggttccacatttaataagatccattagtatacgcaggtgcaaaggcgactccagttaaggatcgaggcacaagggaagtacctgcaatcaattctagagaaagcttgcaaggctatagaggagcaagctgttgcatttgctgggttagaggcagctagagaagagctttcagagctagccataaaggcctccatcaccaatgggtgccaaggaacaacaagcaccttcgacacaaccaaaatgatgattccatccttatccgagcttgcagtagcaatagagcacaagaacaactgttcagcagagagctctctgacttccagcactgtaggaagtccggtatcagctgcgttgatgaagaagagacaacgaggagtgtttggaaatggagatagtgtggttgttggtcatgatgctggatgggttatgcctagtagtagcattggatgaagttagcaagagagagagagagagcgagaccagattttagcttatttaattttgctatgttgtatttaactctaaactctgtcatcaaacttgtcttagcgtctatgtatatatttgttgaatctgtagcctctcttttagtttgtgtatttgcttcaactttttctaagcttgccttcttttttcttttttggacaaacctaaatatagaatttatgtaattgtataacataaaaaatactcattaaatactcataacttatctccatgctatagattggatcttgtctacaaattagttggcacacatttgcgtaaatgcacaaatttgattacgtgtgtaaaataaaatgtcaaagaaaaaaaaaaaaatctcaagaggaagagagtgatggggtcggcgataaaatgacggcgtatctgctcactcgtacggtgatttgcaactgaagttttgaaaactaaaaaagaagttttgatttttgaacaaagagagaaaataaaaacggcagaggaagagccgtttacgttgtgcttgcttccccaagatttctcaacttcttcttcttcgtgtgagtttcaattctctaatttactaaaaattaatcaaatcgcaaggagtttctctgtgttaacgattgattcatcgttgagttttctctgtggtaacgattgtgtttatatataatttgattgattgattgattaacttaccaaattagtcttagatttggatatatgcttgtaattgattcaaataacaatttgattctctaaccaatttctcaaactttgagtaatttctgtagattattgtatacttgcaggtataaaatg

SEQ ID NO: 8588 - DNA, 3000 bp, Unknown
  misc_feature (1)..( 3000): cDNA_ID_3045782_gDNA_ID_1971820_Annot_ID_176113 3000 nt of promoter + ATG
gctgatattgaaaccgcccttgattattttcttgagactgaggttgaaaatgtagttctctggaatgtgatgctagtagcttatgggttattagacgatttaagaaattcttttaggattttcagacagatgcagatagaggaaattgttccaaatcaatatacctacccgagtattttgaaaacttgcatacgacttggggatctggagcttggagaacaaatccatagtcaaataataaaaactaactttcagctcaatgcctatgtttgtagtgtgctcatcgatatgtatgcaaaattaggaaagttggatactgcctgggatatacttataaggtttgctggaaaagatgttgtgtcttggacaacaatgattgcaggttacacgcaatacaatttcgacgacaaagctttaacaactttcaggcagatgttggatcgagggattcggtctgatgaagttggattgacaaatgcagttagtgcatgtgctggtcttcaagccttaaaggaaggacagcaaattcatgctcaagcttgtgtatctggtttctcatctgacctgccatttcaaaatgcactggttacactttattctagatgcggaaaaatagaggaatcgtatttagcgtttgaacaaactgaagctggagataatatagcatggaatgctctggtatccggatttcagcagagtggaaacaatgaagaagcacttcgtgtcttcgttcgaatgaacagagaaggaattgacaataataatttcacgtttgggtctgctgtgaaagctgcttctgagacagctaacatgaaacaagggaagcaggttcatgctgtgatcaccaaaaccggatacgattcagaaaccgaagtttgcaatgctttaatctctatgtatgccaagtgtgggagcatttctgatgcagagaagcagttccttgaagtctccacgaaaaatgaagtttcgtggaatgcgataattaatgcttattctaaacatgggtttggttctgaagcactagattcttttgaccagatgatacattctaatgtaaggcctaatcatgtgacgcttgtgggagttctatcagcatgtagccacataggactagtggacaaggggattgcatactttgaatccatgaattcagaatatggattatctcctaaaccggaacactatgtgtgtgtagtggatatgctaactcgagctggtcttttgagccgtgcgaaagagttcattcaggaaatgcctattaagccagatgccttggtctggagaacacttttgagtgcttgtgtagtgcacaagaacatggaaataggagaatttgcagcgcatcatctcctagagttagaacctgaagactcagcaacatatgttcttctgtcaaatctgtatgcggtgtccaagaaatgggatgctagggatcttacaagacaaaagatgaaagaaaagggtgtgaagaaagaaccgggacaaagttggattgaagttaaaaactcaattcactctttctatgttggtgaccagaatcacccgttagcagatgagatacatgaatacttccaagatcttaccaaacgagcatctgaaatcgggtatgtgcaagactgtttcagcctattgaatgaactgcagcacgagcaaaaagatccaataattttcatccacagcgagaaattagcaatttcatttggactccttagcttgcctgcaacagtgcctataaatgtaatgaagaacctacgtgtttgcaacgattgccatgcttggataaagtttgtatctaaggtatcaaatcgagaaatcatagtgagggatgcatataggtttcatcattttgaaggaggtgcttgctcttgtaaagattactggtaagagccaaagcctggtagctcactcgcctcttttgggaaggttaagtctgtgttccaaagttcgagctctggttctcgctcaaagaaggagatcatggaccaaaccttacgggtaagctgaattctcagcaatgatatgatactagacgatatacttgagcaaagagtattatcctgaaggaaagaatagtcacatgactgttcttgaggaaaagttggagttgatgcaggagttgatcatgagcaaaggagaccatcgatgacttaacaaaacgaaccactcctttgtttctactaccattgctaagtaactatcactatctttcataccccatccttttttaggggcttatatatgtgtacatattacatatatacgtgcatctatggctttaaaattgatgaattgtagattaagagaaagtgtctcaaaataaagattctatgttgccaagaaacagagtctctctttatgcatatgaatgattgatgtgcttctgatttcttaatgttttatgtggctgaatttggaaactgctattacataaacaaattttgtcaatagtaatataaaaattaaaaaactaaagctaaagaatactttttttctcttgaattatataaaagaaaaataattggaaaaatgtctagtaggtttaaaggatttgatatttaaaaaaaaattgaggaccctatttttttcttttttcatttggtttattttagcagttagcaccatcttaagatagagaacttgaagttttattctgctattgaaaaacgaaaataataactaaaagaaattttatcttactactttttcaaaacatatatgttatttggaatttcaatgcaaagagtacaaataaccaaaacataaattctgctctctctttttttttttttgaaaatatctaaataaattcaataatgcacaaatataaacacaaaatactatccgagtgttgtcttgtccaatctatcaactcgtttcttcgctgtcttagaaatccacaatatctttcttcacactttctttcactttcccgggaaaacagccgagaaaataaaagaaacgaagaaaagtttgttcctttgtggggatcaaagaagaatg

SEQ ID NO: 8589 - DNA, 3000 bp, Unknown; identical to SEQ ID NO: 8588
  misc_feature (1)..( 3000): cDNA_ID_1820318_gDNA_ID_1971820_Annot_ID_58298 3000 nt of promoter + ATG

SEQ ID NO: 8590 - DNA, 3000 bp, Unknown
  misc_feature (1)..( 3000): cDNA_ID_1820310_gDNA_ID_1971820_Annot_ID_58301 3000 nt of promoter + ATG
tactatcaattttctttataaaaaaaaaaaaaaaaaaaaaaaaaaaaaactagactaatttttatttgtgtactgtatacattattttctaaaacaaatgtctagacattatagtattttataaacacttacacaacaccaaatgtttgtcttaaccccgactaaaaaggacatatgtgttgttaatgctggatcaccggtggttttgttagtgtctacccttatttgtatggaaaaacactgccatagcccataaggtaacttataaggacatcaaagcttttggtgtttgactgcttaaatgttcagtctccagattccagcacatgcatttctcgaatacttgactaatggtgaagctagcattttttaataactttgccttaccaatcatggtggttggcggaattaatcatggtggtaagcgagagactttattttatccaaaaaaaaaatgagagacgtaaaattagaactatttttagttataatagttatattttattattttgtctcaattattctccccgcccctctatgtagacgtgtgaatattagagagattgataacgaactcctcacaacatcatatctcaagttcaccacccaaaagaaaaaacacacacacatcttagagagatgaaagagactaattttggcgagaaaacgcgcgttctggtagttggtgggacgggatcattggggaggaggattgtaagtgcgtgtttggctgagggacacgagacttatgttctccagcggccggagattggagtggacatcgagaaggtgcagctacttctttctttcaaaagactcggcgcacatcttgtggaaggctcattctccgatcaccaaagccttgtctctgccgtaaagcaagtcgacgtggttgtctccgccatgtccggtgtccacttccgcacccacaacatccccgttcagctcaagctcgtcgcagccatcaaagaggccggtaacgtcaaggtaaaaggactcatacatcactaaacacttttctttctagtgtagttgttacctttttcatcagagtttaaagcaatttaaaataccgattatcgtagctggtattccaaaaaagttgctttggcatatatacaacataaattaatagtatatgtgttaaaaaaatatgaaggtacaatgtatctgtctgcatcaatgacatatgcatcttttgaaaatagctgatatattacggctatattttgctaacaatcgcaaatgaattgaatttaactctatagacatatactcatttttaaaaatttaataattttcttggaaaagataaagatccgtttgtaagataattgtgtaacacaaaagtcacctttttggcttaccaataacaaagttttaataagcttgcatgcattattgttcaaagactatctaaaggtttttgaaataataataaatcattttagaaaaaaaaacaaaattatacaaccaatcttgtcggatgtttttttaataatattgactgtcttagcttatgttcggtggtgcttacactaaaaaattaaaatatttcagtgaaactacttacaataagttaaaaaatatttcagcgtttcttaccatcagaatttggaatggatccgtcacgtatgggacatgccatgccaccaggaagtgaaacatttgatcaaaaaatggaaatacgaaatgcaattaaggccgccgggatctcccacacatacctcgtcggtgcttgttttgccgcatacttcggcggaaatttatctcaaatgggaactttgttccctccgaaaaacaaagttgatatttatggggacggaaatgttaaaggttagaagaactcttatggaacgctctctcttcatatttttcttttttctatttgtgtcacttttataatcatgaaaattctaaaaaatctatttttgttcccattggttttattatagtggtgttcgtagatgaagatgacatggcaaaatatacagcgaagacgcttaatgatccccgaacgttgaataaaactgtgtatgttagacctaccgacaacattctcacacaaatggaactagttcagatatgggagaaactaaccgaaaaagagttggagaagacctatgtttcaggaaacgactttcttgctgacattgaaggtaaatctaatcatcatctagtaaccaaattaaacaaacctagcttttggattatagatttctatcacatctcttaaataaagcattggattaatgtaaggttggtttagtattaaaaccgaaatgtaaaagttggtcatgccaagtatttattttctatatatcacatctcataaattaaagtagacgtttttgtcttttagattctagtaaattatgagaaagagttgaatttagaccaagtatttattttctattaaatgtgaaaatgtttattatatacatgcagataaggagatatcacaccaagcgggactaggacacttttatcacatatactacgaaggttgtctcacagatcatgaagttggagacgacgaagaagctactaaactctatccggatgtgaagtacaaacgcatggatgaatatttgaaaattttcgtataatgttacatatatgtgaaacacatcgccatttccttatttttatgttttaccatggccttttgttttgtttgcttgaagatgttttccgaatttattttaaaatttaaatgtttcagttatggatatgtctggttatatatagatatacatataatctcaagggtccgaaaatttccaaaagtaaactcaagggtctgaaaagataatttggaaatttaagtccttttcctagaataccaccgataatataagggctttatacacaaatacacaagagatacttcgagaagagattaaaaaataaataacataaaaaaatggaaattatcttcccgccatgtgtatgtggtaactaacaaaagcttcgattactttatcctctcactctcta

SEQ ID NO: 8591 - DNA, 3000 bp, Unknown
  misc_feature (1)..( 3000): cDNA_ID_1820302_gDNA_ID_1971820_Annot_ID_58303 3000 nt of promoter + ATG
aattgttggggacttaacttatgcaaaccagtatcgtactattggtggtaaaggagttccatgcttctcatgttcgtttcctgatgcacctataagggagacttatcaacctcgctgggatgcttggggaaggtaaaacttactatgtgggttaacaagttaggagttgaagaactctgtgttggtcgagatcagctttggagtaattaattttttatttgtgtgcaggttcatggagccattgacttccaaggtcccaacgatggtcattgaaggcaaccatgagattgagcctcaagcttcagggatcacctttaagtcatattctgaaaggtttgctgttcctgcaagtgagagtggctccaacagcaacttgtactattcttttgatgccggaggagtgcattttgttatgttgggtgcatatgttgattacaataacactggtaaatccatggatacacttgaagtctcttgtgctcctactacaatatatctcatttctatgatgattatgtctttgttttagggctgcaatatgcatggctaaaggaagacttgtctaaagttgatcgcgctgtgacaccatggctggttgcaactatgcatccaccttggtacaacagctactcctcgcattaccaggagtttgaatgcatgaggcaggaaatggaagagcttctttaccaataccgtgttgacatagtttttgcaggacatgtaagttctcaaattatcttggtgaaaaagagttttgatactctttgatcttttttttccttgttttcttttatgcaatgtattgactaaaagtggtgtttattgttaccgaaggtacatgcatacgagagaatgaaccgcatatacaactacacactagacccatgtggaccagtttacataacaataggagatggtggaaacattgagaaagttgatgtggactttgctgatgaccctgggaagtgtcactcttcctacgatcttttttttttcaattctttgaatctttctaattaataccttttcagactacctcattttgattggaaaaatgacttcatcattatttttttattgaaataaaggttgacatggaaaaataaaggttttattttttactgtaaaactccacaatggaactcacacttatatagacaaggttttattagttaagtatatctttgacaaaaaagacctttgtttagttaaaagaacatagttacatacactagctaaataatgtgaaaattttatacatatgaggttgattagttgttgatcttaaataacaaacaaatatcaatagataacggatttttaaaatgtctcgcgccagttatctttatcttataactattgcgttgttaactgtaataataaataacggttatttaaagtatttcgcatattgtgtgctaattcatgatttcaagaggaccaatagttaataattttacaattagggacctctcaaaaattaaaattcaataacataatttttttactttttcaagtaaaaaaaatcattaatatatatttatttattttttttaaaagaaaaacagtaggaaatatccattgtgaagatgaatcacacgaaagacgaaaaacaaatagaaataaatttgtttataattactaggagtaaacgtttgtttcttcttcttaaatgtgtacttatattgaaaatactttctcaatatgcctcactatatcataaatacatttgttcttaatataggtttattatattagtttttgacagtcaagtaaattgttttaaaatattttcataaagaaaaagttgtagaagatatccatatttgaagaagaatcacatgaaaaacgaataaataaatagaaataacattttctataattagtggaggtaattgtttttcttttcttatatgtgtaattatattgaaaacttttcctaataagccccactatatcataaatacattaagatatttttcttaatataggggttttatattaattgtttaccgctgtcaattaaatttatcagagattatttcttttgaaaaaagctgtataaaatattcatatttgaagatgaattacatgagaaaaaagaaataaaaatgtttcttagtgggagtgaatgattgttatcttttaaatgttaagtttatgagaaaaatatttggaaagctttacaactttcaagtggaaaacaatgtaaaatacttttgacccaatataaaatgaaactacaaattacttgcaaattagatgttcaggtacatggaacaaaaagtgaagccgaaaatacttgcaaattagattccccttcaaaattaaagtcaaactttacattaacagcccatgaaccccatgacttaacttaagtaaaattatatcatttgcctaatattatgtctatatttttacagaaacacacaaaaattaactcatcatcttcctctctgaatcttgaccatcagatcgaatttcaggttaagattgtttttttgcataaaagaaaatctcaaaaggctttttttttccctcaacttaaaagatttttagaaagacactattaaattttattttattttccttttcaataaaagttttgtagttggcgggaaaattaagaaaccaatttatcgatattgagaaactaaaaaaaaagtgtaaaaacgtctcttcattgagagagaggcaagtgggagaagaagatgaagaaaccaattcctaaaattagggtttttggtcagcgatcgattgcttcttccttcctgaatctcagctcgattccgtaagcattcaatctattatctctcttaatttctccctaattcgccaataaggttttagattttgagtaactgaattcgtgtgcgattgttttatagtgtcgataatacttcggaaaatccgccggagaaagtggagaatcgcagcaagctgaacaaatcagtgctgtttaagccaaacaactttgaggtaacgattttctttggaatg

SEQ ID NO: 8592 - DNA, 3000 bp, Unknown
  misc_feature (1)..( 3000): cDNA_ID_1839862_gDNA_ID_1971820_Annot_ID_58307 3000 nt of promoter + ATG
aaatagagaatatcaccaagcactcttagttttctctttaaccaatatccgataaatcgaggtttaatacaatgctttctgggatataacagaaacgtacgtttggtcatatccatcaggttgaaacactggatcccatccgaaatcagttggtcctctggctggaactatcttaccctaccacatcaatcacaagggacaaaagaatcaaactttgacaataaacaaacagagaaagaacaaaactaataaaagagtggttacaatgttgaacataccggagttttccccaaaaatgtaagaggttcagcacctggaccacgcgagaaagagaatgcgcacaatgcataagctgatttatcttcataggccatcagtaagttgttcagacctgtacatgagtcagaccaaacattgggtgttaccagtgtaagagataaatgaaacaaatgctgtagtgagagaaacaagtgctattacaaaccttcgtgaccaagcttctctagaaaccactttctgcaaatatagaaagaagattaaaagtgctacaaagaagaactctagagataacaacatagctccaatacagttagtcctaggctaattagatctaatatcgaccagaagtagattccaaaaaaaatatagaggccacttctacaaatcagtccagtaataaattatgaatcagaacatacaataagatgactccatttggctactcactcacaccacttagcaaccgcctagaagaactaagaacaggtattgatccaacccaaccagacaattttccaacacattaccactcaagaaagaggtcaacacaacaaagtggaactggagaaactctatccttcaaatgaagtttgacaagcacagaatcaggagaagaatgaagaaacaaaacttacatgtatggccctgaaaaatccaacataaaacgaaatcaacaaaaacttaaacactgtgtaaccatttgctgtacatggagtaaatgaaaaaaactagaatctaaaagccaatcataccaggaagccctttcaaagcattgaaacagagacatgtatcttccacaagcactggtccatccaccttctcatttacaatcaaaacactctttatatcagtttctactatccttagtcactaacttactattactagtccgtccacattcaaaagaaggaaacaaaaatgcaacagtacataagaagcaagcttacacataaacacaaatatgatgacttttgtaatcaattcaagtaatatatctgcagattagaaaaagctaaaagcttgtgaacctgaagagcagccaaacgagccttctctttggaaatatcctcaggctcaccttggagctcaggcactgcaaggaaatacacaatgagcctagtgaaaatgagaaacaaagtaatgtcaagagagataaatcgaaaagggtacgccgtacgcacaatcgagtttgagagacttgaaaggaatggaatttccgatgatagctttgacttcttcgagcttcttagcatttccagtcacaaacgtcaccggccgtggcaaaaccaccgctgctttcgccgccgccgccgccattgtctgtgtctcagtctcagatagcgaaagcaaagtcattttgttaatttttctttgcaaaaaatgggcttaagtccattttaatttaggcccattgaaacttatactcgttcgtccaaagtaaaattacgagtaaaccgatcattggtttaagtaaacccatttttcattcaattagggtccgcagcgattttgtataatcatgactgctaagcgttagccggacggtaaaagagggtctagcgcctagtaaaaaaattataattatataaaaattaatcgaagactagttttatgattatttaatgttttgaaaatatatttatctattataactaagaaatttatataatacttttttaaaaaattgtaattaaatatataaaaataagattttaggttaaatttataattattatgcaaattacgaacataagttgaacattttagattttatatgcaggaaaatataggcatttttagataaatgtttatatacataaggggaaagaaagtacatgtagtaattaaaaagtacataattagtttgcttgtctcaacttttcacatatccttttctagtaatgagaaaatcacttataacaattttttttctttcacaaaatacataaaactaattagctaatttaatttgttttatattgtcttccatgtagcaaaatgacaatgtcagattgaactacacagtgtcgatgcaagaactctctaatggtgcatgatttaatgaggaaaacaatcagacagtagaacctgtacgacaaccagactctcgtacactaccgcttctggccctaggaccaaaaaatatgcaagattctagttcatgtgttacttttacttgtcctcaatatctacttgagctttcgttctaaactacactatgtttgattgttttctaaaaactatagttttcttaagttttctaaaaagaccattgaaaaataatttcacattagtccatagaaaaatgcgtccatggaatattaaactgctgaccttatacacacttaagagattctctaccgttaagctacgataataatttaataatattcgtaacaaagtatatttatatactaacaaatatcactatttaagtaattaaaaacttatgcaataaattaaaaataacgaaattaaatttaaaaagttggctatttttttttacattattccccttccattttacaacattttgattttgtattgttttttaatttttattttaatcatacaaatgaaaaacaacgccctgaccaaagaagacccagctgtaccgggacaagattgcacatttggttcaactttaacctctccgtctccgagtagagaaataaagaaagagagagagactcatcaaaaacatttccaaaatcaaaatcc

SEQ ID NO: 8593 - DNA, 3000 bp, Unknown
  misc_feature (1)..( 3000): cDNA_ID_1820287_gDNA_ID_1971820_Annot_ID_58308 3000 nt of promoter + ATG
ttaagttataaatttgatctatacagctttactaactattcatgatttgcgacttctcacttagttcaacctatcacttagtgtctgataaacaactttcctgtgaatatttaccttcagttcctatgtgtttggatagttaaggtttgctacagttaaatatttgtatagggtgccttgtcaaaagtgtgcaaaaatgcttaggcagactgttatcacaatggtgtttatttcatatgcttagcatgactcattagtgacgcatacgaatatgatcactatgaaaagatccttttctcttcctgttttagtaaagtaattccgtttttgttgcatataaagctgcaaaatgaccttcctgatttcaacttgatactgttcaggacacagaagttttggaacaaatagaacgcgatgtgatgcgtactcatccagatatgcactttttctctggggattcagcagttgcaaaatctaatcaggttgggtgttggttttgctatagtttaaagcctttgggatgattaaaacatcagtatactgatagtttttcttgtctttttatacatgttttgcatgtctaggatgctttgaagaacattttgactattttcgcaaagttgaatcctggcatcagatatgtacaagggatgaatgagatattggcacctattttctacatcttcaaaaatgacccggataaaggaaatgcagtaagtacttgtccttgctaatgtaccatttttttcttattttatttgtacacatattgttctacctcttttagttctttttgggtaacacaccactagttctcctcgtttgcttaacactggcattttaagttatgcaggcatacgctgaatcagatgcatttttctgttttgttgaattgatgagtgggtttcgagataatttctgtcaacaactagataacagtgttgtgggtatacgttacactataacaagactgtcgttgctcttgaagcatcatgatgaagaactttggcgtcatttagaagtcacaaccaaagtaagatatttcacacaaccttggctgatgagacgtcttgctatattcattagttatgtctctgtagaatattttgccagtatgtattgctactggttcagagctatgtgttgcatgaatgttgtgctgaaaaattcttaatccaccttaactactagattgataacaaccaaaactgtaccatcgctttcaaaatgtttaagttttcaagtttctgtatttctgtttaaatgtttcagcattttgacatttgagacctgtgtcaattttcagataaacccgcaattctatgcattcagatggatcacactcctattgactcaagaattcaatttcgtggaaagccttcacatctgggacacactcttaagcgacccggaaggtcctcaggtagtattcagcttactactattcagcttctgtaagttgtgaacgagatcaatttcaaatgttgcatttttataagtcattaaacgttcaaatacctctgagcaggtgggttttaggacagtaaaacatatacacgtagagatttgtatatgttatagtcctagagattggttttggtttgcatcttactgtaaaaaatttaaattagcagaattgagttaacgggcgcttgttatcttgcgagatatgaaaaagcttacaagtgtaactgaattttattttgcaggaaacactactgcggatatgctgtgcaatgttaattctagttcgaaggcgtttgcttgctggagattttacgtcgaacctcaaacttcttcagaactatcctcctacaaacatcagtcacatgctctatgtggcagacaaattacgcactaaataaaaatcttcaggttaataatatttcactccctactcctttataaaactctgcaactttcgtctgtacattattgtgtaaggtaattttagctgcatgagaaaatctcagatcaaactttgcttcagtgttaaagactatgatgttttttgtgtgtaacagagttattaatagagagagggttttaggatcggtctttcttatatttttgctttgatctattcacgaaagtttcttggtttgatttggtaaattattgattaaaaataaccgtaaagcttaatcaacaagtagttgctgataaatatttgtacaaagtcaaaactgttttttcattttttctttccgtgaaggagaatttacttgcgaagaaacaaagaaatgagatgtggaacaatttcactagtcttattcttgattatgatccttctttatccatactcttatctcttcttcctcttcgcttcttttctggtttgctttcttcttgctgcttattatcttctttttggagaattctaaaactgcgtccaagactcacaaatggatcggtgcgttgctcaatttggtacatgttcattggtcgaattctctgttcgaaaacttgcaatttctcataattttctaatacaatgtgacctctctttgtatttttatttgtatttttttgtattcttctcatcttatattcttatctacgacatagtcaacattataaaactatgtatcaaatattaatttcaaagtaactacaccataatccagttctgttaaacccgtccgttttggtgatataaaacaataattgttttttgtctcgaaccaattcactatataaacatcatatacctcttcaaggggggttaccaaccaaacagcttgacacgaaattgtctcgaaccaatgaacccaaacaaaaattgtcctggaaatccggatttccggtttactcaattgaaacaaaaaccggataaacctcaccctaaaccctaaccctccgaaacaaacagagagacacaaacccactctcagcgtatataaacagaactcaagacagagacgctcttaaaccctttcttcttcaacccataccgttttctttcttcttctattttgtcacttttttcctcgccgacga

SEQ ID NO: 8594 - DNA, 3000 bp, Unknown
  misc_feature (1)..( 3000): cDNA_ID_1820283_gDNA_ID_1971820_Annot_ID_58309 3000 nt of promoter + ATG
aacttatggccattgaaggcaaggtaagcgttgaaattatgtctatatcctgcagagcttctatgttcactgtcaatagcgtatagatatatcttttgatgtcttgtagatcaatgcatttattcactgcttcgttggggctagaagaattgtgaccctgcatgatttggaagtggcaatatgccggaacgagtttgttgattctttcgatgatctggaattgggacctttgctgcagcatccactggttttgctgtattttccatcgatatccagttctactggaccagttaagatcactagtgaggagataatatcatttcttgatagctatctgcacacttatatgacagaagatgttaagctcgatgaatttctgaattttgttgcaagtcaaaagtcagttacaagcaaggaaaagcttggtgtgcgtattcagagcttgcggtatgatattgttcttttttggattatctaaacttggttatgagttaaataattttgatattacagtaaggttggtattaatgttggatctggttgttcttagtatgaactgcattagctgattttatgtgatttaatgcatttttataggatgtatgtatctttcattctagacgcgaagagacaagaaggtgaaacactgaaagtcttactgactgagctgcatcagaagtatcacatcccctcatcaaagaaacaacagcgagataaatctctaactgtctctgagcgagctgactcatttgctttacatcataaggattattgtggcaagcatataagatttgattcttcaagctcagatgaaaatgataatgtttatgaggttagaaatcttaatagttctgaccatatcaatagttgtccatatccatctgttgcggaagagatgaagcgtcttgggggctccaataagaaaaggaagggtgaaagacgtaatcatgaaaaatctgattcctccaaactgcttagaaaatccccctctaaattacaaggacatgcgaaacaagagatacctaaattggctgatgattctgaagctaagaaggttttcagtgtcgatgaggctgattttacactttctgaaggagatttaagattgttcatttcaacttggaaggacacatgtaaagagctaagcatttcaacggtaagttcatgttgagattgtatgactgttttaatctgagagtgaattatcttaagtgaggtgtgagggggcttcatgtttgtttattttctaatactctcttttattattgtagtttgtcgagaaaatgttgtctttttacaacttggggggctctgaaggaagagctcagattaaaagagctaaagcgatgtcatcatttccgtttgttggattactaaatgtcgctgtgagtggtcatactacttttgtttaaagtgttttgcatttttcttgttttcttgctttcattaattcaattgaagaattttgtcaaaaatctctgttaatgcctcctatttacttttgttcatgccattcacattaagtgtacttggaggtcaaatcctcctaatctgacgtcttttttttctttgcaacacttgttttttctctctctgtgaaatagctgttttctggtatctcctaatttggatagaacagatggatgtttggttactactttttttttttaatccatcaaatgtttatgaaaaataactgcacatatattttcaaagtgaaggatgcgagattacgtttgctatatatttacatccatactcattttttgcttcacctttccgtttttactttttttttctttacccatttttttcccctcttattttgctttgtgttgcttttcccagtttgaaaagattttttgtagtttcaccgtgtaacacaggctcactattttctatgatatctccttttaaattctgaagaaatgctgaatttaaaagttagacgattttcactcatacttttacagtgttttaagttgttgctcttgttgtttttctatctctgctcttgaactaagacttagcacccagttgcaaagtcttggagttgagctcagcaaatgtggaaacttccctagttcggctttgctctttgatacatcacaatgtcactgaggcaagctggataaggacaaaaatactacagactgtggatcattcaaaactcgtgccccttgtcacctccagacccccacttattaaattaattaatggaaaccttccaacatctcatgttgcagatgttgctattatgaaaattcctttgttattcctgtttacacctgaaatttaacattgcatttgtagcatctcaatttttttacctggttctgtgtcttgtgcaaaaatcttgttgttcaatgtttgagaagtgtctgcattgtcgttattcgattctctttatttattcctggcaatcagaagaaaataaaaccacaacagtgcaagagtctcttaggtgcagtgggaaatttgtttcaggcaatagcatctcgtgtttcttatttatgatcaattcatttcatttactttgctgattgaaaaatttgcacatgtttgctgtgattgagtagtaactttattttaccccttctattcaggagtttctttatggactttgtttacttcgttttttaatttggtttgtttactataataaagaaatatgatgcattttcaaatgtaggatatagattagaaaattgaaatgtgttacaccttgtttggcgaaagagtgctgttttgtgttgttctgaaaggctatacctttttatttacgttgagcaaaaaaaaagtgaaaatattctctgttaaattgaaagctaacttgccctggaagcatttcatattatgtttaattgtaataataaatatatgaacaaaaagaaatattgatattctctcatttgcttgcatggattgggttctaacttgcttacagatgagcttcctatacccattgtctcttatttttgctttattgtttttcttcct

SEQ ID NO: 8595 - DNA, 3000 bp, Unknown
  misc_feature (1)..( 3000): cDNA_ID_3089956_gDNA_ID_1971820_Annot_ID_58310 3000 nt of promoter + ATG
tgatgatgtttactggaatgattctgctggcgttttagatgagataaaagagatcagttcgcagatcagcagtgttgtggaaccattgcgtagaaaaacattgggcaatatctatccaggtctacatgacttttttgtgaatgggtgtggagtacctgagacgccttcgtttcaagagtaccttaaaattctagggcagtttgcacataatgtgtcaccctcatctgccgccaaggctgtaagtgatttacttaacttatcagtcttgtcctgtttatcttcactctattcacttctttgctaaagtgtttaatttatgtctaggtcttcaaaattttcctgaagtggagtgatgacttgaactctggcaaatcttccgaagatgttattcattttaaagagagactttcagaactggagtacactgtactccctactgaaaatgataagtgggtttccttgcactcctcgtttggtctcgtatgttggtgtgataatgagaagttaaagaagagatttaaaaacaaggataaaattgagtttattagctttggggaaaatgatgacgaagggcaagaagtgcttcaaacaaaagtgtctgggctcatgcacagtttgggcattccaagtatttctgaggtaactaatcttctccttcacaaaaataatttgaaatgcaagccacttagttatacatgcaaagtgcctcttatggacattagaattctgatggacaagagtaggcctttcttgaactgtgttgatgcactaactctaaaaccatccgcagaaccatcatcttgtagcttatatacagggtagaactgatatatgtgtctccgtttctactataacactaccgtttctactataacactagtttccatggcctcgattccaattcactctgtggtgtttatgtaattgtttcaggtggtaaagcgtgaagcgaaatatgaaggtttgcaagataatactgtaacagtgtcacttgttaactgggctctgccttatgcacagcggtatatctttactcttcatcatgagaagtatacccaaacaaaaaagacagtccatagtcaagtcaaacgtctacaagtctttgttgttgataagttatcctataggaatgtcataccgcaatatggcatcagctctaaaaaggagttcaaatgcagttctcttctgcaggtatgtcttctttcgttctgtttcttgcgacaatttaacctaaatattttgggattgtatgggctgtgacattgtgctttgaggctatttgaaactcatctctgtttatatgcaagtagacttttgccatatcctcttgactgggacaatggttttgtaaaaatgtggttttactgatattatatgtttatttatgttgtcttcaggataaagctctgtacacaacaccaagtctggattcccattccttgttcatggaactgtctcgtttgtttttcaacggagtgcctgatctgcatttggcaaatttccttcacttgatcaaaacaatggcagaatctgggttgagcgaggagcaaatggaatccttcattctgaacagtcagaaagttcatcaggttcctgatggtgaagagatctggtccctcaaatctgctgttaaagcgaagaagaaagctggaataagcttgagctggttaccttcaagttctaaaacaagacatggttctagcaagaccaacactgatgattctaaacaagagctggacactagtagcagcaaagaggatgtaacagaggctcttgaagaaaaaataccgattgagatgaccaataccaacttggtttctggatatgataattgtgcaggcacaagttcacgagctagtgagccaaacccgttgcattctatgcatatgattagtggctcaacctcagggaatcaggctgctatgcatctcaatccaaatcttcctcatgaatggaacaattccttcacagctaatttcagcgatagagaccagcttcatacaggcacaccttgggctgcacaagcgcaacagaccggtagaaaaggtgaagaaatcgcttacagatactttgttgcaaaatacggcaatgaggcactggttaaatgggttaacgaccagagcgaaaccggtttaccttacgacctcatgatcgaaaaccgaggtggtaagaaagagtacgtggaggtgaaagcaacggtatcgacacggaaagactatttcaacttgacagtgagggaatggcaatttgcaaatgagaaaggagagagttacataatagctcatgttttgttaggaaacagtaatgcaatcctcacacagcatagaaacccggtcaagttatgccaagaaggtcatctccggttattggttctcatgcccaaccagagaaacgaggtcaacgttacattttaaacctcaatcaaataacacaatgttactatttaatattattaattttgaaattcaattctttcaaacggagatgggtattttaacagaacccaaccaaacgagaatccatgcataaactgacccaataacacaacctgtttattaacctatcaattaaataaagaaaatagttagttattattactccttccatttcaaattagattttgttttagattagttgtcattttatatttataatataaattagaaacaaaattttcagtttaattcctacttttgaaatgtacaggatattaaccaatcaaaatcattgccaataaaaagcatcccaatttcagttgttaactagtaacaataatcaagttcatcgatggagagatgctaactctatataagcagataaagtgggctaacacttctcatcatctctttataaacaagtattgataaacaacaagttctttttttcttccatatacctaaacaaaagaataagatgacaagcgttgtttttgcgtttaaagttttgtgtgtgtctttcttgttcattgttgttgcaagtcgtcctactatccgaccaaaa

SEQ ID NO: 8596 - DNA, 3000 bp, Unknown
  misc_feature (1)..( 3000): cDNA_ID_3089952_gDNA_ID_1971820_Annot_ID_176134 3000 nt of promoter + ATG
tcctaaaacgggtaaggtggtagagttagacctcatgaacagttttcttaatggtcctttgagatatgatagtagcttgtttagactacaacatcttcataatctggatcttggctcgaataatttttcgggtattctaccggattccataggcagcctcaaatatttgagggttttgagtcttggtgattgtaatctctttggaaagattccttcttcacttggaaatcttacttatctcactaatcttgatctttctgttaatgatttcaccggggagctaccggattcgatgggacatttaaacaagctaacagagttgcatcttggatcggccaagctcagtgggaactttcctagtatgctactcaatttgagcgagcttacgttgatcgaccttggttctaaccagttcggaggtatgctcccatctaatatgagtagcctctctaaattggtgtattttgggattgatagaaattcattttccggatctatcccatcgtctctcttcatgctaccttcattgacctctcttgttttgggaagaaacgacttcaacggtcctcttgactttggtaatatctcttcaccatctaatcttggagttttgtcccttctagaaaacaatttcaatgggccaatcccggagtctatatcgaaactagttggtctcttttatcttgacctctctttatggaacacaaagagaggcatggtcgatttcaacactttcttgcatctcaagtcacttacgttccttgacctctcttatattaatacaagaagcatggttgacataagtatattctcacctctcttgtcacttggttatttggatctttccgggattaatttgaagatcagttcaactctaagtcttccctcacccatgggcaccttgattttatcatcttgcaatattcctgagttccccaattttctagaaaaccaaaccactttgtattatttagacatctctgccaataaaattggaggccaagtaccacaatggttgtggagtctaccggagttgcagtatgttaacatttctcaaaattctttcagtggctttgaaggaccagcagatgttattcaaagatgtggagaattacttatgcttgacataagttcaaacacattccaagatccgtttcctttgttaccaaactcgacaacgatctttttaggctctgataatcggttttcgggagagattcctaagactatatgcaaattggtttctcttgatacacttgttttatccaacaacaacttcaacggctccattcctcggtgtttcgagaagtttaatactactctttcggttttgcatcttcggaataacaacttatccggtgagtttccagaggaatctatcagtgatcacttgagatcacttgacgttggtcgcaaccggttatcaggagaacttcccaagtctttgatcaactgcactcgtctcgagtttctgaacgtggaagacaacataatcaatgacaagtttccattctggttgagaatgttgcccaaacttcagatttttgtccttcgttctaacgagtttcatggtccaatatcttctcttggagattctttgagcttccccaagctgcgaatctttgacatttcggaaaaccgcttcaatggagtccttcgatcagatttctttgcgggttggagtgcaatgtcatcagccgtagacatcgtagatattatgccgagtaggtatgctggacgtgactcaggaaactattataactcagtgactatgacggtcaaaggatcgataatagagttggttgggagtgttttcacgatttacaaaaccatcgatgtctccggaaacagattcgaaggacgtattcccgagtcaatcggtttacttaaagaactgattgtgctcaatatgtcaaacaacggttgaatttgactgatctcgaatcattggatctttctaaaaacagattatccggtgaaatcccaccagagctcgggaaactcacgtttctagcacaaatgaacttctcctacaacatgcttgaaggtccaattccacaaggcactcagattcaaagccagaatagttcttcattcgcagagaatctcgggctctgcggtgttcctctccaagaaacttgcgggggagaagaagaagaagaaaaagaagcaacaaagcaagagcaagatgaagaaaaagatcaagtattgagctggatcgcagctgcaataggctacgtacctggtgttgtgtgtggactcaccattggtcacattctcacttcgtataaacgtgactggttcatgaaaagctttcagtattttgcttaataaaagcatgacctcttaggaggatgatgcccccttgttataatgcgtgtactctaatgttttgagttgtataatgagtgtgtgtttttttaacgagggaacaaaagtttaattgattgattcagttggcgtttgataataattgttactccaaatgttcaggagaactaatatcattcctttagctgtatttgttgttttcatttctacgtgaattagaagaaataagacagaagctttgtttaatttcagagaataaaacagaggaggtcatgcagaggaaaagtcttaacgaaaacttggaagtgaagaaatattaaagacaaagatttggagaccaaggaaatatactattaatattagttgattaattaagaaaattttaaagatataacggaagaataaaaaaattgatttcgcaaaggcaaagacttgttccgtgtacgagggttcatcgtcactttcactgtcactctctcaacccactaagagaccttgatttttgcagtgtttgaatgatttaacccacaccacacggctgggataattggtgtttgtggaaaaatcttatcttttaaagtcaagatctaatttactccacagatgtgagacaatacgttgatcaattcgtttcacagaaagaaaaaaaaaatcatagaaaaaaatatg

SEQ ID NO: 8597 - DNA, 3000 bp, Unknown
  misc_feature (1)..( 3000): cDNA_ID_3593857_gDNA_ID_1971820_Annot_ID_176130 3000 nt of promoter + ATG
tgtgtgttatggtgatcattttccgtagcgtggatgtgatttaagagaagcagacaagtgaagatgggacatgagagtttggtcgattttttaatttttatatgaatactaaaattgactttccctaactaaaacaaacttccacgtctcttctactctttttccatgtgatcttcttctttcacacatttggggctatcatttattcaagacactcgcctaagtaccactttaacccttctttgaccacttgacaaaactcaaaaggggtctcaggatgagactagtgcccataaaaataaaaatcggagaaccgtacgtactttggcccgacctgttttgtgtaaaggaaaatcatcgtatttttcttgtctcttgggtagatattttcagatattttgaatcggatcttgggcattaatgcattgaaaactatgtgttttggaagttaggtttggatactacgagtcttttgataggtacttcgtatacgatatataccttaggatgttcggatatcttgatttcctattagatattaatcagataacatataacataaccgatttttttatgaatactagtgttcagtgttcacgtttgcatgtgaataggattttggtagttaggtatggatactccaagttggatacttgctatacgatcttaatatcttgatttcagactagatatgaatcagataacatatacggaacataaaatgcttataatgttcacgtgtacaacgtttacgtcaataacttcaccactcataccttagttacttggaacacgtaaaaaccaacattgaaaagtcaatatcatcacaatatagatagaattatgtagcgttaacatgcattgctatggttgctgttacaacaaattctattaccgttattaatgttagtttaaatgtggaccattgattcagccgttaagtaaaaaaataaaatatcggtgtcttgacaatagcagctgaagacagaactaatgtagccattggccacatgcatgtaggacactcattttttctcaacaccccaacatttattaaactacatcttcctaaaatccaaacgctttaactaatctgtttgtcaaaaccatgtccttgtaggtcgcactcacaattcgtagacatattattttcaataaaacctttctaactccaccaatatatatagacccacatttccctttggctcataaaccaaactcaaagcttctcttatcatcaaacaagatcaagatatcttaactttagccattaattcaaagtttttttttctttctaatactcgaaatggctttcttaaggagttttttcgctaccaagcatatcattcgccggtcttttactacggaatcattatcaacgcctaaagggttctttgctgtgtatgttggagaaaatctgaagaagaagagatatcttgttccggtttgttacttgaacaagccatctttccaagctttgcttaggaaagcagaagaagagttcggttttaatcatccaacgggcggtttgagtttaccatgcgacgaagctttcttcttcactgtcacttctcagattcgttaatcccatacaataattaaagtcttttttacattctcttatttatagaagaaaatacacattgtacatactatacttttatatacatactgatgagaagaataattcaacgaacatcttttgctttcgttttctatatttacttagtccgtaactccatttatcagccacgaaaggcttaaatattattataggctctccactttagtattttcatcaaggctagttatactctctgagtttagccaaatcggaaatacaaacaaacccgctaaagaatatatttcaaaccgctaaaaagtaaaacaacatttgtaatgtctaatgttattcaatcatgagattttttttaaaaaagttttttttaaactttggtgttattatttaaaaatgttactaaaatcatcgttctctgtgtcgaaatctttgtgtgaagtttaatcattaaaaaaaaatctactagagatgaagttttaacgatgaagaaaatgatatgatttatcatatttatagagatttaacataaatattcctataattttgttttatacgaaataaattatacaaagaatcttaccactaacgagtgcctttaaacacttctttgacatgttgtcaaatgttagcttgtgattatagacatgattactctattgcaatttgtaggtaaataattaaacaattaaatttgcctccacatttttccctctctgacaagtataccttggaagattctgcctcttagtcatatgatagatattcttcaaccgttgtttagagaattggtacataactctcttattttaaccatagtgttatccatatgtagcatttgaaatatatgttgtgaaatgatataataacagaaagatgaagaagtccaacaatatgaaaaaagttcgcttcaagtttgggctgatagacgtggtaaatctgttttgtttaacataaaagatagacctagtcacctagcaaagagtttctataggacgtggtcatgttgtaaaacaaaagaaaatgatttaggagaaagtttccatgtaatataggacgtggtcatgttgtattttttttttttgttaatggtaatttcctaattaatatagtcactttactttagtttcacaaaagtttaataattcactaaactatagtaaagctatttagattccggtttaattccatccataccagtaagatcaatatcttgcaaatgcaattcagttatcaaaccggaaagtgaccaactttctgtctggtctaaacttaaccggatctatctgaggccgccgttacttaggtttaccatcagctaaagagcttctcttttctcagcttctctgattcgtctttctcctctgtctctgactcttcgcgaaaaccctaattagctttgtggtcttgttgttttcgccatg

SEQ ID NO: 8598 - DNA, 3000 bp, Unknown
  misc_feature (1)..( 3000): cDNA_ID_1807990_gDNA_ID_1971820_Annot_ID_176129 3000 nt of promoter + ATG
taaaaactctagaatgatagaaaggtgcatctggcttactattattggtgtgcaagtgagagatacctgctttgtgatactcttgacaactagggcaagacttttcttatttgtctttgatgtttcaataccttactattgtatgttttgtgaaggttacgggtctgtcattcctgatgctcatgatgctgaatctcattctttaacaaaatcactggcggaaaaggttgaaaagtttgtggcagagtatgttgaagccatggaaaaggtgaggaatgttatatgaaccttggcgtggtatggctatctgagtttctgtgcctgggtttttaggttcttaataaatcccctgttcatttgatgtaggttaagctcaagcagggactgaaaactgctatgctgatttcaagcgaagggaactattacttgcaggttctattctcattaacaaactagatattagctttgttgcatattaccaactatactgttttcttgtgtccatgtaggcaagccaattttggaaactttacaaggaagataaacctttgtgtgcagttgttataagaactgctgctggtttagtacaccttcttgctcaattgttagaacctttcatgccatccttttcttgtgaggtcagtttgattgtttgtttggtaaattttgtttctatttagttgtagtagaatgccaagcgtgattattgctgttattgcattttgtaggtatttaaacagctaaatttgcctccacaattttctctctccgacgagaggggagaggtattactagcaagtagaccatgggatattctgcctcctagccacaggataggcacccctcaacctttgttcaaggagttggtacgtagctctctgattttatcgatagaaagccagacttgttgtatgttataatgccatgtagcattttatttatattgaaacaatatgatcacaggaaaacgacgaagtggcacggtacagagaaaagtttgctggaagtcagtctgatagacgtgctagggatgaagcagcaaatttggcggatcaacttaataaaacaaaactttcaggttctctattatcattctcaaaatactgttttacattctttaggcttttagtaacttgattatgtactgaactgctgtttattctcccagatgccaagaaacaaaaggcatcatcaaaaggcggaggaaaacccaaacctcaaccagctgctgatcgtgaaataactatggcaagacttgatatccgagttggtaaaattgtgaaggctgagaaacatcccaaggcagatgcattgtatgtagaagaaattgatgttgggggtggtgaaattcgcactgttgtcagtggactggtcaaatatatacctcttgaggaaatgcaggtttgttcaatcaacctagtcatttgtttccttcccgatatcagtatgtaatatacattccaattgatctaatattgtttctggacagaatcgtatggtttgtgttctttgcaacttgaaaccggcgaaaatgagggatattgtgtcacaagcaatggttcttgcagcttccagtagtgatggaagcaaggtagagttcatacgagtctttgacctgtttgtagttctgctaaattcatttcgattgtatataacaaattgtttttgctggaaacatttcaggtggagttagttgagccccctaaaactgctaatattggagagcgagttacatttcccgggtttgaaggcgagccagacgatgtcttaaacccaaagaagaaagtatgggagacgcttttggttgatctaaacacaaaagagaatctagttgcttgctacaaagatgtgcccttcactacatctgcaggtgtatgcaaagtttcatccatcagcaatggcacgatccggtaaaagcttacttgagccataagcaaactaatattctccatttctatctttctctgtaagagaaacgaaattcggagattttcatttgaaaatttgattctaattacaaacatgttcttgtaaacttaaagcttggtacaattgttgttattgattgatgttgtgagaaacattcagctttttaaaattgggcccagacgcaaagcaaccacacaacttacgatttcaaatcttttatggtactagttgaggttttgtgaaggttgatgtttttcttaattttttaatattctagttctcgtgtttaaaaatagtcgcatcattctttttttctggcggttcgtaattgtgttcccttgtaatactgtatagggttgtatacaatcgaacgtttgaagtgatcatgtaattcaatcataaatttaaatctttggttattgaaaacattttaagcattctatttttattgacctttaagagattttggcattttattggcttgagttcactgagcgtttccaagttaccaactacaccaacccttcggattcaaatctgtgttgatgttttgcgattccatatcattactatatcaacgagttgatttttttttttggtcaaccagcaagttgatttttgaaaaactcttactctacaatttgcgactgacgactgtttagaattttgggtacgtaccaataatccaatatgttatattttcgatatagaaatggattgtgattgatataagtcttgggttcgtcgaacaaagttaaacaaagatttgtgtaaataacaaatagataaaaacaagaatgagtgtgactgcatgaaccactaaaacatatacgacgttagagggatgttgggtaggtgaaggtgtttattaattctaacacgtgaggtttcgtaagtaggtataagggagtaaccatttgattaaaaatttgatgtcggttaagttcggttttagtatttggtttagtttggttaagaaaaaaataagaaacgtagtccatatataattcttatatattaaggagctttgctgttcaatgtaacactcaaaagtagtaacaactaagaatg

SEQ ID NO: 8599 - DNA, 3000 bp, Unknown
  misc_feature (1)..( 3000): cDNA_ID_3089956_gDNA_ID_1971820_Annot_ID_176128 3000 nt of promoter + ATG
aaagcttcatactcttccgtctgtgtttgtaccacatggaattgcaagtaggcagaatgatatgatatcgggaatattcttgtcacttgatgatgtttactggaatgattctgctggcgttttagatgagataaaagagatcagttcgcagatcagcagtgttgtggaaccattgcgtagaaaaacattgggcaatatctatccaggtctacatgacttttttgtgaatgggtgtggagtacctgagacgccttcgtttcaagagtaccttaaaattctagggcagtttgcacataatgtgtcaccctcatctgccgccaaggctgtaagtgatttacttaacttatcagtcttgtcctgtttatcttcactctattcacttctttgctaaagtgtttaatttatgtctaggtcttcaaaattttcctgaagtggagtgatgacttgaactctggcaaatcttccgaagatgttattcattttaaagagagactttcagaactggagtacactgtactccctactgaaaatgataagtgggtttccttgcactcctcgtttggtctcgtatgttggtgtgataatgagaagttaaagaagagatttaaaaacaaggataaaattgagtttattagctttggggaaaatgatgacgaagggcaagaagtgcttcaaacaaaagtgtctgggctcatgcacagtttgggcattccaagtatttctgaggtaactaatcttctccttcacaaaaataatttgaaatgcaagccacttagttatacatgcaaagtgcctcttatggacattagaattctgatggacaagagtaggcctttcttgaactgtgttgatgcactaactctaaaaccatccgcagaaccatcatcttgtagcttatatacagggtagaactgatatatgtgtctccgtttctactataacactaccgtttctactataacactagtttccatggcctcgattccaattcactctgtggtgtttatgtaattgtttcaggtggtaaagcgtgaagcgaaatatgaaggtttgcaagataatactgtaacagtgtcacttgttaactgggctctgccttatgcacagcggtatatctttactcttcatcatgagaagtatacccaaacaaaaaagacagtccatagtcaagtcaaacgtctacaagtctttgttgttgataagttatcctataggaatgtcataccgcaatatggcatcagctctaaaaaggagttcaaatgcagttctcttctgcaggtatgtcttctttcgttctgtttcttgcgacaatttaacctaaatattttgggattgtatgggctgtgacattgtgctttgaggctatttgaaactcatctctgtttatatgcaagtagacttttgccatatcctcttgactgggacaatggttttgtaaaaatgtggttttactgatattatatgtttatttatgttgtcttcaggataaagctctgtacacaacaccaagtctggattcccattccttgttcatggaactgtctcgtttgtttttcaacggagtgcctgatctgcatttggcaaatttccttcacttgatcaaaacaatggcagaatctgggttgagcgaggagcaaatggaatccttcattctgaacagtcagaaagttcatcaggttcctgatggtgaagagatctggtccctcaaatctgctgttaaagcgaagaagaaagctggaataagcttgagctggttaccttcaagttctaaaacaagacatggttctagcaagaccaacactgatgattctaaacaagagctggacactagtagcagcaaagaggatgtaacagaggctcttgaagaaaaaataccgattgagatgaccaataccaacttggtttctggatatgataattgtgcaggcacaagttcacgagctagtgagccaaacccgttgcattctatgcatatgattagtggctcaacctcagggaatcaggctgctatgcatctcaatccaaatcttcctcatgaatggaacaattccttcacagctaatttcagcgatagagaccagcttcatacaggcacaccttgggctgcacaagcgcaacagaccggtagaaaaggtgaagaaatcgcttacagatactttgttgcaaaatacggcaatgaggcactggttaaatgggttaacgaccagagcgaaaccggtttaccttacgacctcatgatcgaaaaccgaggtggtaagaaagagtacgtggaggtgaaagcaacggtatcgacacggaaagactatttcaacttgacagtgagggaatggcaatttgcaaatgagaaaggagagagttacataatagctcatgttttgttaggaaacagtaatgcaatcctcacacagcatagaaacccggtcaagttatgccaagaaggtcatctccggttattggttctcatgcccaaccagagaaacgaggtcaacgttacattttaaacctcaatcaaataacacaatgttactatttaatattattaattttgaaattcaattctttcaaacggagatgggtattttaacagaacccaaccaaacgagaatccatgcataaactgacccaataacacaacctgtttattaacctatcaattaaataaagaaaatagttagttattattactccttccatttcaaattagattttgttttagattagttgtcattttatatttataatataaattagaaacaaaattttcagtttaattcctacttttgaaatgtacaggatattaaccaatcaaaatcattgccaataaaaagcatcccaatttcagttgttaactagtaacaataatcaagttcatcgatggagagatgctaactctatataagcagataaagtgggctaacacttctcatcatctctttataaacaagtattgataaacaacaagttctttttttcttccatatacctaaacaaaagaataag

SEQ ID NO: 8600 - DNA, 3000 bp, Unknown; identical to SEQ ID NO: 8594
  misc_feature (1)..( 3000): cDNA_ID_2177531_gDNA_ID_1971820_Annot_ID_176127 3000 nt of promoter + ATG

SEQ ID NO: 8601 - DNA, 3000 bp, Unknown; identical to SEQ ID NO: 8592
  misc_feature (1)..( 3000): cDNA_ID_1839862_gDNA_ID_1971820_Annot_ID_176124 3000 nt of promoter + ATG

SEQ ID NO: 8602 - DNA, 3000 bp, Unknown
  misc_feature (1)..( 3000): cDNA_ID_1397711_gDNA_ID_1971820_Annot_ID_176123 3000 nt of promoter + ATG
ttatccattttccttgttacttctgactaactagccacaaaaatatatagaaaccaggttaattttaaacagaaaacaataacggaacatgaaaaaaggaagaattatcatccagattacataagcacctctacaatgaccgaattctttatcattaactactatatgttttaatatgacctttaggaggtatcacatgaccagtggccctagatcagtcttcttagtcaaatgcatgacaccatttagctgacatgatgttatacgtacaagcttctggatcaaaataataaaataaaataaaaaccatcataacaccatcatgacaccatcaccgaattctactaggctagcagaacgcctaatgacagtcatcattttctattggcagtgcgttttcatcataacacccttagctactggcaacagacatgccagtatgccactatgttaacttcattgctcatttctctccggttaacagaaatgcgactgtgtctaatcgatcaatctagctagctattactttacaagaatggcatccactctaatcagaaatttgatggaatatcccgaaggggtgatcaaaagagactgccgattaagccaattgtgtaactctcttcacaaaccaatcaatacaatgttggagtatcaaatcaccaaaacggacttacagggttcatcagaagctcctctttgaattgcttgtactgagaccttttcttagctaactcagaagaccacagagagcgatccggtgacaaataatccaacaaaagctgtcaaattcaagaaaacagcatgaagcataaactgacagaattagtaatcggagaagaaactgtatcttcttcatcttgcttaaattgcattctttttttttttttttttttgaacaccaattagtaatcggagaagaaactgtatcttcttcatcttgcttaaattgtaccatttccatacactcttaaggatttcatgaaaaccacaagcaagttcaaagaaaattcaacaactcaaaatagatttgcattactaaaagcacagtaacaataatgatccataagctagactgaaactatgcgaatggcgttaccttccaaacaatggatcgaattccagcatcatcaggtagaccttgtgaagctatcttcctcaattccttcaagtctatcaccttcttcgataactgaaaaaatcaagatgtaagtatatcacaaagagaaatcaatcaaaatgcatagagcatgaggttgattttaagcaactaacctcagccacgacctgcgcttttcgagaaacatcttcaacagaagaaactgcgggagtttcaattccagcaccatcgttaccactcccattctgcaaatcgttaatctcagatttggaaggaggacgaacaggaagaggaggagctggtgcggtggaaatcgcggagggagaggaagaaaaaggaggacgctcgacgatcggaggagatggaggggtgatggaagtggcggcaggattgcggaggtggcgatcgtcgatgggaggagaggaggaccagagagaactgttgagccactctgggatacctttcttggccatggattttgattttggaaatgtttttgatgagtctctctctctttctttatttctctactcggagacggagaggttaaagttgaaccaaatgtgcaatcttgtcccggtacagctgggtcttctttggtcagggcgttgtttttcatttgtatgattaaaataaaaattaaaaaacaatacaaaatcaaaatgttgtaaaatggaaggggaataatgtaaaaaaaaatagccaactttttaaatttaatttcgttatttttaatttattgcataagtttttaattacttaaatagtgatatttgttagtatataaatatactttgttacgaatattattaaattattatcgtagcttaacggtagagaatctcttaagtgtgtataaggtcagcagtttaatattccatggacgcatttttctatggactaatgtgaaattatttttcaatggtctttttagaaaacttaagaaaactatagtttttagaaaacaatcaaacatagtgtagtttagaacgaaagctcaagtagatattgaggacaagtaaaagtaacacatgaactagaatcttgcatattttttggtcctagggccagaagcggtagtgtacgagagtctggttgtcgtacaggttctactgtctgattgttttcctcattaaatcatgcaccattagagagttcttgcatcgacactgtgtagttcaatctgacattgtcattttgctacatggaagacaatataaaacaaattaaattagctaattagttttatgtattttgtgaaagaaaaaaaattgttataagtgattttctcattactagaaaaggatatgtgaaaagttgagacaagcaaactaattatgtactttttaattactacatgtactttctttccccttatgtatataaacatttatctaaaaatgcctatattttcctgcatataaaatctaaaatgttcaacttatgttcgtaatttgcataataattataaatttaacctaaaatcttatttttatatatttaattacaattttttaaaaaagtattatataaatttcttagttataatagataaatatattttcaaaacattaaataatcataaaactagtcttcgattaatttttatataattataatttttttactaggcgctagaccctcttttaccgtccggctaacgcttagcagtcatgattatacaaaatcgctgcggaccctaattgaatgaaaaatgggtttacttaaaccaatgatcggtttactcgtaattttactttggacgaacgagtataagtttcaatgggcctaaattaaaatggacttaagcccattttttgcaaagaaaaattaacaaaatgactttgctttcgctatctgagactgagacacagacaatg

SEQ ID NO: 8603 - DNA, 3000 bp, Unknown; identical to SEQ ID NO: 8590
  misc_feature (1)..( 3000): cDNA_ID_3089968_gDNA_ID_1971820_Annot_ID_176117 3000 nt of promoter + ATG

SEQ ID NO: 8604 - DNA, 3000 bp, Unknown
  misc_feature (1)..( 3000): cDNA_ID_3089948_gDNA_ID_1971820_Annot_ID_176145 3000 nt of promoter + ATG
aagagtatatcccttatttattaggtagcttgcaaggcaagcagcattagctttcacctgttttgcataaactttgaagctaggagccataacctgcttcaacgcaacagctagagcaccaatcttgttattgtgaggaccactttgaagcgcagggaataccgcagagttgatttttgcgtcgaaatcgtagacttcaccctcgggttggcccttcttggctggttttggtccctttctataaaagatcataccagcccttggacctctcaagctcttgtgagttgacgttgtcacaacgtcacagtactcgaacgggtctgcggcttcctgagcagcaacgagggcactgttatgagccatatcacagagcaaaaaagctccaaccttgtcggcgacagccctgaatctcgcgtaatcccattccctagggtaagaagtgcctccacagataattaacttaggcctaaaatccatagctttctcctcaagtttgtcgtaatcaatgtaaccagtcttggaatccaccttgtagggaaggttttcaaagtagatcgaggtcgcggagatgttcttcccaccagagctatagtaaccatgcgttatatgaccacctgatggcaaatcaagccccatgatacgatcatgaggctggagcaaggcggtgtaggctgcgaaattcgcaggggaaccagagtaaggctgaacgttaacgccccatttctctggattgcaatggaaggcttcgagagagcgtgagcggcagagactctctatctcatcgatgaactcggtacctccgtagtaacgattaccaggcataccttccgagtatttgttggttaagcaacttccgagagcttccatgacggccacggaagtgaaattctcggctgctatgagttcgattcctcgacattgacgatgtttctccttctcgattaggtcgtagatctccggatcgacgaagtcaagatgcgtgtttccccaagaatagactggttccatctctaagattgttggaaggatagagagacttttggcgggtctttatataatgtgtgtacccacaaaactaaccatttgacttttctgaatttttagaattaagtatgactttttgatgcctttagcaagttattccaagtcaagtctgtcttttaaacagagcaaaagacataaacatttttgtactccaatgtgttcacctaggaaactaatttagtattgccatgacaactaatagtcatgacaattttattcttaattgcaatttgcaagatatatatagcaattgcccttaagatataccttaacgcaaacattattcatttttaagataaccatatgcactaatagataacgtgttgtattcctttttccccatacttcataactctttaatcattctctgcttgttttagttcagacgtttccctcatacagagtggcatgtcttagttacaagacacaatttatactgattttgtatgattgataattctttaactatctttgatacattactctaccattttcgtatgattattgtcttcgttaaaaggttgagtatttaatagaaacggcatatttataatttatgtatgcttagtcagaaccacgtctatgggacttgaatatgctatgttctcatgataagagatttttatattgagcaatcttcctttgatcagaaaatatattaagatccattctcactccatctttatgtgtcaaattaagcttgaaatcaatcaatctaaatctgtctgtttaggattcacgttacgtggctaacaagttttacgtaggatttatttcttttatgagatcttgattttgaaaatttgctgaagcggttacgatatgcagcaaccgatagttatgcttttatagcatctttaccactttttacgtgctcacaaggtaacgtttggtatatttgactgcttcagatctctacggacgattgcttgagtatagcctttggattagtcaccaaaagaaattatgttgttcagtgtggtttaagtttctcattaaagaaaagagttttttttttttttttttgtgcagcaatcgtgattagagacaaagacacaggaaggtccagaggttttggattagtcaccttctccagtgaatctgaagcctaatctttcataacagagatgaatgatcaggtttatatgactccatttgtggtagttgttctgtttatatgatgatggctttggttttgagttttcagatgatggatggtcgtaaaactgaaagtgaaatcttgctgtacagaaacatacaatgtagcatttgaaagtgaattgcatcatttaataccattacacagactttctcttgatgtcattatagtctactctaacctttaaccttccttataagcaagggacggtatcagcatatgtagcaatgcttctcaattagattcttactcaccaaagactagcttagggcagccagttccacgtaaaaaatggggtttgtttgtttctattcaagcttttaaaagaggaatagaaccaagattctaaaacaataaaacatgttccgatatttctaggaagagcggaaaatgatcaatccaaagggattgagtgattaacccccaccgtacggtcgagatattgcgtttgtggttttgaataatcaaaggaatcttcagcaattattaacccacaccacacggctggaagaattggcgtttgtggaaattatatagtttttgtggagaaatacctcatattgctgtcttcaaaggagacgtgtaagacaagctttaatctcctccacaaatgtaattaagagtcactccaatcatatagagtcaggtactcgattttctgtggaagcaactagtcttcacaggagactttttaagtcaagctttaatggtttcccacaaattttatatgagacaatccaatcatcaaatcgtttcacgtacagaaaaacagaaacaaaacaaatcaaacaaaaaat

SEQ ID NO: 8605 - DNA, 3000 bp, Unknown
  misc_feature (1)..( 3000): cDNA_ID_1820244_gDNA_ID_1971820_Annot_ID_176144 3000 nt of promoter + ATG
actcaaatcaacaatgtccggattgaaattatttcctccaagaattaatacttgaagtttagattgtgaagagatattcccaatctcaagagcgctgaagtggtttctttgcaggtcaagttcaaccaacgaagggatcatgaagagagaagagggaatggatccagaaaatgaatttccaccaatataaaaatactccagtttggagaggctactcatgttagatgggagcatacctttcaactggttagaaccaaggtcgatatcggtgagcgagttcaacttgagaagcatatcggttagtcggttaaggttccccattgaatctggtccttcacgggtgaaatcattataggaaagatcaagttgagcgagataagaaagatttccgagtgaagaaggaacctttccatagaaattgcatttaccaagattcaaaaccctcaaatagttgagattgcccatcgaatctggtatcacaccggtgaaatcattaaaagaaagatcaagatgagtgagataagaaagatttccgagtgaagaaggaatctttccaaagagattgcaaccacgaagactcaaaaccttcaaatatttgaggttgccgatggaatccagtagctcaccacccttcaaaccatcattataagaaagacttccgaatgaagtattacaaccaagatacagcttctgaagatgttgtagtctaaacaggctgctattagatctcaaagggccattgagatcactgcccgctagatctaacccaacgacattgcccgtcttaggatcacaagaaacaccatcccaagaacagcaatcagtgttgttcctccacttctcgcttgggacatggaattcgttcttgaacccccaaagagaatccctctggtctggaagacacaagtgtttagcaaaaacaagtattgagtttgaaaggcagaagattaaacacaagctccattttactgttatcatcctcctctctctacaagaatacatcatattttttgtttgatttgttttgtttctgtttttctgtacgtgaaacgatttgatgattggattgtctcatataaaatttgtgggaaaccattaaagcttgacttaaaaagtctcctgtgaagactagttgcttccacagaaaatcgagtacctgactctatatgattggagtgactcttaattacatttgtggaggagattaaagcttgtcttacacgtctcctttgaagacagcaatatgaggtatttctccacaaaaactatataatttccacaaacgccaattcttccagccgtgtggtgtgggttaataattgctgaagattcctttgattattcaaaaccacaaacgcaatatctcgaccgtacggtgggggttaatcactcaatccctttggattgatcattttccgctcttcctagaaatatcggaacatgttttattgttttagaatcttggttctattcctcttttaaaagcttgaatagaaacaaacaaaccccattttttacgtggaactggctgccctaagctagtctttggtgagtaagaatctaattgagaagcattgctacatatgctgataccgtcccttgcttataaggaaggttaaaggttagagtagactataatgacatcaagagaaagtctgtgtaatggtattaaatgatgcaattcactttcaaatgctacattgtatgtttctgtacagcaagatttcactttcagttttacgaccatccatcatctgaaaactcaaaaccaaagccatcatcatataaacagaacaactaccacaaatggagtcatataaacctgatcattcatctctgttatgaaagattaggcttcagattcactggagaaggtgactaatccaaaacctctggaccttcctgtgtctttgtctctaatcacgattgctgcacaaaaaaaaaaaaaaaaaactcttttctttaatgagaaacttaaaccacactgaacaacataatttcttttggtgactaatccaaaggctatactcaagcaatcgtccgtagagatctgaagcagtcaaatataccaaacgttaccttgtgagcacgtaaaaagtggtaaagatgctataaaagcataactatcggttgctgcatatcgtaaccgcttcagcaaattttcaaaatcaagatctcataaaagaaataaatcctacgtaaaacttgttagccacgtaacgtgaatcctaaacagacagatttagattgattgatttcaagcttaatttgacacataaagatggagtgagaatggatcttaatatattttctgatcaaaggaagattgctcaatataaaaatctcttatcatgagaacatagcatattcaagtcccatagacgtggttctgactaagcatacataaattataaatatgccgtttctattaaatactcaaccttttaacgaagacaataatcatacgaaaatggtagagtaatgtatcaaagatagttaaagaattatcaatcatacaaaatcagtataaattgtgtcttgtaactaagacatgccactctgtatgagggaaacgtctgaactaaaacaagcagagaatgattaaagagttatgaagtatggggaaaaaggaatacaacacgttatctattagtgcatatggttatcttaaaaatgaataatgtttgcgttaaggtatatcttaagggcaattgctatatatatcttgcaaattgcaattaagaataaaattgtcatgactattagttgtcatggcaatactaaattagtttcctaggtgaacacattggagtacaaaaatgtttatgtcttttgctctgtttaaaagacagacttgacttggaataacttgctaaaggcatcaaaaagtcatacttaattctaaaaattcagaaaagtcaaatggttagttttgtgggtacacacattatataaagacccgccaaaagtctctctatccttccaacaatcttagagatg

SEQ ID NO: 8606 - DNA, 3000 bp, Unknown
  misc_feature (1)..( 3000): cDNA_ID_1820259_gDNA_ID_1971820_Annot_ID_176137 3000 nt of promoter + ATG
aacaatgtaatattatagattatgaaaaagtactatactatataagattattattttttcagttaaggaataggataaaataataagttgagatgactaacacatttgaattattgccttagcttaaaatcacatactttaccaatggttgttttgttatgtttttttttttttttttctgttatgttaagtgcatatatattttctatggtactagtttccgtgtcaagcccgataactaatctggaggtaagtagaccccatatgagttttccgcaagctcacttcagataaaaaaactcatgcaaaggtcgtccaagagtccaagttgaattgaatccggatcttcatcaaccatccaagatcaccaaatgcgtgtttcctccaaaatatttacatagaaaataattacaactctgtgacttttgaaagatcgccgttggcatctttgcttattcattatcttggaataactttcaacaatcaatccttagtgccttactgcctttggagtatgcaccatccatcaatcgacatatgatctagaacaagttctctcatggacaaattaacaattatctttcatcgagtaacttagctccaattatttcgaagtggtgtcacgtatccgaaaacatatatagtaagcgtcatcttatatatcgatcaaatttatccgttcagacttcaaagtaagttttacgtttatgtatttttcgtgttttaaaattacatgcattttctttaaaaggctttgattggcgcctattgttaggatttggctggctgatttgcttttaattacggtggccagtttttagagttttaattaatagacatgatgataatatgatacaattaaaagaatttcataaatttacagaagaaaaaacagtcagagaataaatgatataaacagtgctcgaaaatattggcagagacaaatgccccactgcagatgttcactgaagtaattatattgccaaatttcaactgttcttttaactcttttatttattcaaccacatttcacgcaagatacaactaataactctcgtttcagtgtaaaatgcatagaccaagccctacttaattataccttagagttatattcaaaccctctaattaggaaaagaaaaaaagaagtaaatcagtattatactatactaatatattaatttggaatatatctacttaagaagacagtacattcagaagtacatcaataaaaatacgttcaaccttttcctctcgtaagtttatagttattattgaaaattatgtttaaaactttcttcttccataaaaaaaaagaaaggatttacgaaaaattcatcaagaattatgattaaaaccaacttttccaactgcatgccacattgccacgtaaaataagagttgaccatcaactgtttttcttggataaatatagctgtaagaagttgtgaattggttcatatatttacaaaaatttaaatctgctgttgaattgaatagaaaatgcattaaatgcgattatcagccaaccaatattctagtccttgaaattatataaaggtgtcactctttttactagaagtagaaacaaatgaaatcattacaaacgtctattgtttaagaaaatttagctaatcttcgaaaatatttgtttaattattgggtaaatctacattagttagctagcttactgaacttgattatccatctactaacaagataacttttattatagctcaaagtgtagttaatgatttgagaatgaaatcacatgttggttcaagtactatttttaattttattttgagaacccatcttccgtcatacgtacgtgtaattgttttgtttgctttctgttttcgtgtatgtttctggcttgtttggccgagttgtcttgcaaactttgttttggaacttgttctatcaatcaggcaacaaatagtcatccgtaattgaaacttgtaaatgtaggggaataattaacttgaacagggtaactagatatattctctatcagtaccgtatattgaacctagaacaatagttttcttacaataatttgacccgtagaaccaacgtgtctggtttgcttttaacttgacatccacgtcattgtttgttccacatttcaatgtcgacatttttgttaattggaggatttttttgttaaagtttgttggagggtcaatggaatcatcctcgttcccaataccataatcagaatctaatattcttaaatagttaccattaaccggattaccggacgacaatcctatcaccgactaacacgacatcttaatcatcgtcatctacatacaacaaaaacaaaagattttaatcaaacgtaaaaatacgatctatttattaatcccaaaatatcaaatccaaaatataagtataagttaatcacaagataaatatacagtatatcaaccattcagaaaactaattaatgtataatttacgtaaattatatattgatagattctattctttttgtattgcacttctattttaaatgcagaaatagacataaaaaaatagtaggtgacaaatattaaaagtatctgaacgatgaattggatcctttggtcatggaccttatcggggaaaaagaaaggctattaattaaaactctttcacctactcgtataattaacaagttaacaccatcaatcttctctatttaacacaagagcctcatcacatttcattcatcacctacaaagcagagagagagagagagagagataaatgtccaagcaaaggttcatataattttatgttattaaatttgctttttttttgttaaagtgttacatacatcgatcgacttgttagttcaaagaatcagtttaactccactgagccatcatgggtcgatctcaagaacagggacagggacagggtccggttcacagcattcggctatctaccgtaggtgcgacccggccgacagagacgggtacgacccacgaaccaaccggtttagacctagccatg

SEQ ID NO: 8607 - DNA, 3000 bp, Unknown
  misc_feature (1)..( 3000): cDNA_ID_1808910_gDNA_ID_1971820_Annot_ID_176136 3000 nt of promoter + ATG
ttcgagatcagtcaaattcaaccgttgtttgacatattgagcacaatcagttctttaagtaaaccgattgactcgggaatacgtccttcgaatctgtttccggagacatcgatggttttgtaaatcgtgaaaacactcccaaccaactctattatcgatcctttgaccgtcatagtcactgagttataatagtttcctgagtcacgtccagcatacctactcggcataatatctacgatgtctacggctgatgacattgcactccaacccgcaaagaaatctgatcgaaggactccattgaagcggttttccgaaatgtcaaagattcgcagcttggggaagctcaaagaatctccaagagaagatattggaccatgaaactcgttagaacgaaggacaaaaatctgaagtttgggcaacattctcaaccagaatggaaacttgtcattgattatgttgtcttccacgttcagaaactcgagacgagtgcagttgatcaaagacttgggaagttctcctgataaccggttgcgaccaacgtcaagtgatctcaagtgatcactgatagattcctctggaaactcaccggataagttgttattccgaagatgcaaaaccgaaagagtagtattaaacttctcgaaacaccgaggaatggagccgttgaagttgttgttggataaaacaagtgtatcaagagaaaccaatttgcatatagtcttaggaatctctcccgaaaaccgattatcagagcctaaaaagatcgttgtcgagtttggtaacaaaggaaacggatcttggaatgtgtttgaacttatgtcaagcataagtaattctccacatctttgaataacatctgctggtccttcaaagccactgaaagaattttgagaaatgttaacatactgcaactccggtagactccacaaccattgtggtacttggcctccaattttattggcagagatgtctaaataatacaaagtggtttggttttctagaaaattggggaactcaggaatattgcaagatgataaaatcaaggtgcccatgggtgagggaagacttagagttgaactgatcttcaaattaatcccggaaagatccaaataaccaagtgacaagagaggtgagaatatacttatgtcaaccatgcttcttgtattaatataagagaggtcaaggaacgtaagtgacttgagatgcaagaaagtgttgaaatcgaccatgcctctctttgtgttccataaagagaggtcaagataaaagagaccaactagtttcgatatagactccgggattggcccattgaaattgttttctagaagggacaaaactccaagattagatggtgaagagatattaccaaagtcaagaggaccgttgaagtcgtttcttcccaaaacaagagaggtcaatgaaggtagcatgaagagagacgatgggatagatccggaaaatgaatttctatcaatcccaaaatacaccaatttagagaggctactcatattagatgggagcatacctccgaactggttagaaccaaggtcgatcaacgtaagctcgctcaaattgagtagcatactaggaaagttcccactgagcttggccgatccaagatgcaactctgttagcttgtttaaatgtcccatcgaatccggtagctccccggtgaaatcattaacagaaagatcaagattagtgagataagtaagatttccaagtgaagaaggaatctttccaaagagattacaatcaccaagactcaaaaccctcaaatatttgaggctgcctatggaatccggtagaatacccgaaaaattattcgagccaagatccagattatgaagatgttgtagtctaaacaagctactatcatatctcaaaggaccattaagaaaactgttcatgaggtctaactctaccaccttacccgttttaggatcacaagagataccatcccaagaacagcaatcggtgttgttcctccacttctctgtcttcttaacaccaacaatcccattggagttgaactcatggacataaaactcgttcttaaactccaaaagagcattcttctggtcttgacgacataagtgcttaacatgagaagccaaaaccagttttgaattagaaagggacaagattaaacacaagctccatattgtcatcttcatctgacctcaacaatgcaataaactttttttctttgattttttttttctcagaaagtgaaatgaatgatgttcaatgtttataagtgatggctctagtaatagacccaaagactgtcttacattttgtggaaaaaagaaaaagcttgacttaacaagtctcttgtaaaaaaaatggcgtcatcttccacaaagatatatgaatttccaaatgaacgctccacaaagtcaattatgtctcctcttgcataaaagtattaaccctaaaaataattcaattacttgcggtgtggggttaccgcagtacaaaaagtagagcgtgtggggttacctcagctgtgtggtgagtgctacgcaattgcgcaaacgctctttaacggggcacgctcgtgactcgtgagagagtcagtcacacaccgtaaaagttaccgataaactctcaaaaagtcttttttggctttgccaaatttctaaaattcaatcaacattttctttcttcttttcgtttacatttttgtattaaaaaaaaaactctaatgggctcgtggaggtagctgaagcccaaaatatgggataagggctataaggattgtcgatcatatcttcttgcgccgtcaaaaagcttccagtcgcaaacgatgacaactttccattaaactaaaatgacataaatacccttcaaaatccacatattactctcaactgtttcatctacctccctccctctctccccattcccaaactacacattacacattaccaattctcatattaaaatccacaaaactcaaatccccaaaataaacaaaccctaaaattcaaaaca

SEQ ID NO: 8608 - DNA, 3000 bp, Unknown
  misc_feature (1)..( 3000): cDNA_ID_3045772_gDNA_ID_1971820_Annot_ID_176135 3000 nt of promoter + ATG
ttggagtggcgaacatgtgagtagatgacacaagacggttatgaaacgtatggaaaagagtgcttgtaaccgtttactttaaaacggttggagttatgtaattttcatatatttcaaaattttggcttacaatgtttatctgttttgtgtagtttggtttggttatgttaattttatttatggtaaaatattatactcaatgtttggtttataacactattttaatcataacactatttttaaccataatttttcacattattcttatactcttctccacaaaatctagaaaatctttattgattaaacaaggtcacaagtcaaatccttaagcaatttgttggaagcaatcatctttaaaagttgattagttacatatattaaggctacctcgttggttaagagtctgatggacggatgaaataattagttgtaacggacggataaaataagtggtggtgaataaaagaaacatgacggttataaaaatagagcatttacaaccgtttattttaatatgattagatttttgttattttcatatattttaaaatatttcctaaaatataataagatcaccattgaaacccttaaaaagtttatcaacaattacctctagtttaaggtgattcatattttcattttgttcaatagtttttgctcatattcattactgtatacctattatcatcagtcaccacattgcctacaaatattaccaatcgtatataattttgaaccgctatactgccatctcctgccgcttttaaccactttctccagagccacttaaaaaagcttttaaccgccgtatttaaacagaattatcactcaataaccattacaaacgttgctgccacacctagaatcccgttctccactcaaaacgtaaaacacaaaacataaaacgcacaaccaaagaaagcttatttagtaatcagggtatttatctaaagtaatgtgcttccgccgattggcataagcacatagaagagtatatacattacatatatacaaagttgctggggtattgatgctatgctttctatattacacacaaacaattaaaagactatacataacaaggctaaagactcgatgtcgtatgttaagaagattcttgttgttgacgacgcattcttgcagcccaagacatcgtgttattatctttctgattgcttcttctccttaaccctgagagctgagtttgccattttgctttccactcactcttctcttccaccacttcctacaatcacaacaatcaccaaaacccaaatcaattataagaagacccatgattgtagcaaataggatcaatgagttcattattctctattccactgctaatttgtcacctaataatcgacacatgggtcaatttattggaccatgttaaagataaggtcaattctgtcgacaccataaaggttcttgaatctaccgagtaaatctagaaattcgaaaaataaaaagaataaaaatagaatttttgaggataatactacacactatttgtccacatatgaaccaaaaatatccaaatcaataacatcaacatcacttgataaatttatcaataacacatacactaaaattattgctaactcttaaattttcttaaccataataaacccaaacaaatggtgctgattttttctctcctaacaaaaacttcggttatcgcaaaaaaattaaatttaataattaattacctgatcgtaacggttctggcgtcgaccggagaaagaaaaagaaaaccccatagacaaatcacggtcatataaaactctccggcgaggatcggagagagtttcgtaagcttcttgaacacgaataaaccgatctgtgtattcttcgacacgatccggaggagaaacatcggggtgatattttcgagctagttgtttataagcttgtttgatttctgggagtgtgactgattcggtgacgccgagaagatcgtagaaggataagtcttccgattgttttactggatcgtcgtgggttaatcgagattggatccgggtggaggagaatcgggttcgggttgggtaagagatagttgttgggattgaagttggttgaagagaggagattggttgttgtttgtagaagaatgggtggtgattggttgagagaattgatgagcttttgtaacatttcattgttttgaattttagggtttgtttattttggggatttgagttttgtggattttaatatgagaattggtaatgtgtaatgtgtagtttgggaatggggagagagggagggaggtagatgaaacagttgagagtaatatgtggattttgaagggtatttatgtcattttagtttaatggaaagttgtcatcgtttgcgactggaagctttttgacggcgcaagaagatatgatcgacaatccttatagcccttatcccatattttgggcttcagctacctccacgagcccattagagttttttttttaatacaaaaatgtaaacgaaaagaagaaagaaaatgttgattgaattttagaaatttggcaaagccaaaaaagactttttgagagtttatcggtaacttttacggtgtgtgactgactctctcacgagtcacgagcgtgccccgttaaagagcgtttgcgcaattgcgtagcactcaccacacagctgaggtaaccccacacgctctactttttgtactgcggtaaccccacaccgcaagtaattgaattatttttagggttaatacttttatgcaagaggagacataattgactttgtggagcgttcatttggaaattcatatatctttgtggaagatgacgccattttttttacaagagacttgttaagtcaagctttttcttttttccacaaaatgtaagacagtctttgggtctattactagagccatcacttataaacattgaacatcattcatttcactttctgagaaaaaaaaaatcaaagaaaaaaagtttattgcattgttgaggtcagatgaagatg

SEQ ID NO: 8609 - DNA, 3000 bp, Unknown; identical to SEQ ID NO: 8598
  misc_feature (1)..( 3000): cDNA_ID_1807990_gDNA_ID_1971820_Annot_ID_58311 3000 nt of promoter + ATG

SEQ ID NO: 8610 - DNA, 3000 bp, Unknown; identical to SEQ ID NO: 8597
  misc_feature (1)..( 3000): cDNA_ID_3593857_gDNA_ID_1971820_Annot_ID_58312 3000 nt of promoter + ATG

SEQ ID NO: 8611 - DNA, 3000 bp, Unknown; identical to SEQ ID NO: 8608
  misc_feature (1)..( 3000): cDNA_ID_1820263_gDNA_ID_1971820_Annot_ID_58316 3000 nt of promoter + ATG

SEQ ID NO: 8612 - DNA, 3000 bp, Unknown; identical to SEQ ID NO: 8607
  misc_feature (1)..( 3000): cDNA_ID_1808910_gDNA_ID_1971820_Annot_ID_58317 3000 nt of promoter + ATG

SEQ ID NO: 8613 - DNA, 3000 bp, Unknown
  misc_feature (1)..( 3000): cDNA_ID_1820259_gDNA_ID_1971820_Annot_ID_58318 3000 nt of promoter + ATG
atattgatgttgatggaaataatcaaattttaaagtggcgacaaaacatattaaaatgtttgagatgattaactactcttttttttgtgtggatagtctatcgaatataaattactagagaccaacaacaatgtaatattatagattatgaaaaagtactatactatataagattattattttttcagttaaggaataggataaaataataagttgagatgactaacacatttgaattattgccttagcttaaaatcacatactttaccaatggttgttttgttatgtttttttttttttttttctgttatgttaagtgcatatatattttctatggtactagtttccgtgtcaagcccgataactaatctggaggtaagtagaccccatatgagttttccgcaagctcacttcagataaaaaaactcatgcaaaggtcgtccaagagtccaagttgaattgaatccggatcttcatcaaccatccaagatcaccaaatgcgtgtttcctccaaaatatttacatagaaaataattacaactctgtgacttttgaaagatcgccgttggcatctttgcttattcattatcttggaataactttcaacaatcaatccttagtgccttactgcctttggagtatgcaccatccatcaatcgacatatgatctagaacaagttctctcatggacaaattaacaattatctttcatcgagtaacttagctccaattatttcgaagtggtgtcacgtatccgaaaacatatatagtaagcgtcatcttatatatcgatcaaatttatccgttcagacttcaaagtaagttttacgtttatgtatttttcgtgttttaaaattacatgcattttctttaaaaggctttgattggcgcctattgttaggatttggctggctgatttgcttttaattacggtggccagtttttagagttttaattaatagacatgatgataatatgatacaattaaaagaatttcataaatttacagaagaaaaaacagtcagagaataaatgatataaacagtgctcgaaaatattggcagagacaaatgccccactgcagatgttcactgaagtaattatattgccaaatttcaactgttcttttaactcttttatttattcaaccacatttcacgcaagatacaactaataactctcgtttcagtgtaaaatgcatagaccaagccctacttaattataccttagagttatattcaaaccctctaattaggaaaagaaaaaaagaagtaaatcagtattatactatactaatatattaatttggaatatatctacttaagaagacagtacattcagaagtacatcaataaaaatacgttcaaccttttcctctcgtaagtttatagttattattgaaaattatgtttaaaactttcttcttccataaaaaaaaagaaaggatttacgaaaaattcatcaagaattatgattaaaaccaacttttccaactgcatgccacattgccacgtaaaataagagttgaccatcaactgtttttcttggataaatatagctgtaagaagttgtgaattggttcatatatttacaaaaatttaaatctgctgttgaattgaatagaaaatgcattaaatgcgattatcagccaaccaatattctagtccttgaaattatataaaggtgtcactctttttactagaagtagaaacaaatgaaatcattacaaacgtctattgtttaagaaaatttagctaatcttcgaaaatatttgtttaattattgggtaaatctacattagttagctagcttactgaacttgattatccatctactaacaagataacttttattatagctcaaagtgtagttaatgatttgagaatgaaatcacatgttggttcaagtactatttttaattttattttgagaacccatcttccgtcatacgtacgtgtaattgttttgtttgctttctgttttcgtgtatgtttctggcttgtttggccgagttgtcttgcaaactttgttttggaacttgttctatcaatcaggcaacaaatagtcatccgtaattgaaacttgtaaatgtaggggaataattaacttgaacagggtaactagatatattctctatcagtaccgtatattgaacctagaacaatagttttcttacaataatttgacccgtagaaccaacgtgtctggtttgcttttaacttgacatccacgtcattgtttgttccacatttcaatgtcgacatttttgttaattggaggatttttttgttaaagtttgttggagggtcaatggaatcatcctcgttcccaataccataatcagaatctaatattcttaaatagttaccattaaccggattaccggacgacaatcctatcaccgactaacacgacatcttaatcatcgtcatctacatacaacaaaaacaaaagattttaatcaaacgtaaaaatacgatctatttattaatcccaaaatatcaaatccaaaatataagtataagttaatcacaagataaatatacagtatatcaaccattcagaaaactaattaatgtataatttacgtaaattatatattgatagattctattctttttgtattgcacttctattttaaatgcagaaatagacataaaaaaatagtaggtgacaaatattaaaagtatctgaacgatgaattggatcctttggtcatggaccttatcggggaaaaagaaaggctattaattaaaactctttcacctactcgtataattaacaagttaacaccatcaatcttctctatttaacacaagagcctcatcacatttcattcatcacctacaaagcagagagagagagagagagagataaatgtccaagcaaaggttcatataattttatgttattaaatttgctttttttttgttaaagtgttacatacatcgatcgacttgttagttcaaagaatcagtttaactccactgagccatcatg

SEQ ID NO: 8614 - DNA, 3000 bp, Unknown
  misc_feature (1)..( 3000): cDNA_ID_1820248_gDNA_ID_1971820_Annot_ID_58322 3000 nt of promoter + ATG
atgacttaataaagacgtttccttatcctttatcaaatctttacatctgtattcaaagttagaatcaacgatctaagaagaagagcttaccatgaacccactagtttctggacggttaaagggaccagaactagatacaatattcacaagaattgcatctacttgactagattaggtgtatcatatcatttgatgctaactcttggggttataggctaacctttaagcttcctccttcacgttatgagccactgacagcatcaggaaggtccttaagaacctaagcaaatgtaataatgttctccattagcttcttactcaccgaagataacctccaggttttcgacaagtaacagtattataattagaacgatgtgagatttttgcttcaaggtcgttgagtgtgagaagatggtttttcgttgttgttaccttgtaaagatgccatgaagcataagcatccgttgctgcgtattgtaactgctgctttgacagaggataaaactcccagttcccaagcctgattctgtttggcttcaggagctgcaaagtaacagtcagattttcaaagcgaaatagatcaatattctcacttttgatacagcagaacagaagagagttgtactgctatttctaggaagactggaaatatgataaatccagttctcactactgttatcaaaacttaaatcaagcttttgaaatcaaccagacaaggtgaataacagatacctctttgcaaacaagtgtctcagttagtgaggcaaggccccattttttatctccaccaattttttggttggctaaatctgaaagatcctcaacatctttgatactaactccatagtcatggaaaagcttcacagagtcaccatcaattccaatacctacctatatatatgtatcagaactacgttaattgagcatccatggcaaacaacaagaacttcgaccacttcaaaaaaaaaaataacaaacctttacaagtgttgaatcttcaataagatgttggagactttgagggataccagaatgaaaaatatgcataacatcacaataattactatctacacatatctggacagtcgcaaccttccccgggagaacacctgaaaataacacaaagtttcacaaaatattattagttaagatcacaaaaacctcacaaaggttcatgaatgtgtcaaaaagcattatcaagcaactatcattacaacacatatgagtagactagtctaagagatattattagtagaacaaagcttgcagcaatgagattctagactacacaaaactgcaatagtaggcatctacactttcctccgaacattcagaaaggaaacaacgaccataaagctctattcgatataaagcaagagcatcatcattctatcatcaagatatataaagagaaattagaaaagacaacatatgatccatagagataaaatacagttcgagatgcatatcacattgcatactttaagaaatgcaatcgaaaaagacaaaacttgcaatcagacacaaaacggaaaacagaagggttaacaaaagcaccttttctaaaacttggtctccactcaatatccaagccaacaaaagctattccagattcatctctcttggtatcaagaactttaataagctgcattgctcgcttatcaacctcagtagcagtcttgctatacaaaatcctaccaccaaacctcattgctggaaaattcctagctgcaacaaagtatacacattattaagttgctccgcccacataattcaaacaacacactattacgaaaaaaatcttaatcctataaattacggcatgaacagattaatacattgtaaagaacttggaattcgaatcaaatggtgagacaactaatgaattgacattttcaaagcaaaaagaagttgaaattggaaaatagaacagaaagatctctgggatttgaagaagtttcatacctcggcaacgggagagaggaaatcgtttataagatgtagaagaagtgatggaacgaggcaattggcgacggatattattggggatttgatttggatcctcctcgtggccatggacggaggttgtagcttgtacggtcggagcagcagaggaagaagaagaagaagaacgggagaaattgtaggaagcttcgatggcgtcgatagcgagaagctcttcctctgtaaaagcgtcgtcgatccaatttgacgatgacatttcttttactgaaacaaaaaaataaaaattaatgctttggacgagtctcgtcggcccctttaaatgtttgtattgtttgtttttaattttaaacgttcccacactgtacaatatagttgtgtgttttaaattgcccgagacacgctttatacaatttttgtatgattttgattattcatcacgtaaccataacctttgcttcacattagaattgtcccatgttagggatattggcataacgatgtatcagatcatgtcgatgagaaaccaaattcaatctttcagaaacttaaacccatcccatacaaacaaccacacttttgttgacaaatggagcaaccaattcctcttattttcattcaacagtagacactctttcattttcaacaaaaaaacactcctttgactaagtagaaactgtcgatggccacacgcgaaaaatgatgatgaattcttataacactcctccacagatgtagtaagtgtcatccaaggatctagcaattaagagtcagatattcaattttctgtggaagcaattatccttcccaggagacttgtcaagtcaagcaacgatcaattcgtttcacagaagaaataaaacaaggatgcattcttgtagtgagaggaggatgatgacagtaatatggagcttgtgtttaatcttctgcctctctaactcaatacttgccattgctaaagacttgtgtcttcccgaccagagggatgctcttttagagttcaaaaacgagttctacgtccaagagttcgatccccat

SEQ ID NO: 8615 - DNA, 3000 bp, Unknown; identical to SEQ ID NO: 8605
  misc_feature (1)..( 3000): cDNA_ID_1820244_gDNA_ID_1971820_Annot_ID_58323 3000 nt of promoter + ATG

SEQ ID NO: 8616 - DNA, 3000 bp, Unknown
  misc_feature (1)..( 3000): cDNA_ID_1821868_gDNA_ID_1971821_Annot_ID_58327 3000 nt of promoter + ATG
aattcatatattataagtcaaagctttgtttatacataaatctatcttatttacacaaatcagcttcgtttgatccaactaacatgtattaagtattaacattagtagaattctctgaacataacttaaaatcaaaacttgtatctactaattatgggaaaatagtctcaaattgaatctgaaaaagaattgcaaatttttaagaaaaataaagaaactaaacatcaaagtgttggtgtgttgtgttaatttgacttcttttttctctgttagcaaaccattgagcagtttttctagcgatcggcagccacaaacgccgtcttctctcctccgtctcattcccaccgttttgtaacgcagacgcagtctctgcggctgaaccgctgcaatctccatgaatcgatatactgagtctaggaaccgcagtgatgtcagacaccgatcttcgtcctggttcgatcataacgcttcttgatttcgaaccagagtctccgttttccgaggaaaacatagttgtcatcgaagttaacttgttctccaacattctcttcgcttccatctcttccttgattcgcaagatacctatctgatcctcttcatctcctctcttcacatgatccaatgaagaaaatctctcgctagaaatcgaattaaccatctcggaattcaaaaacatcaaatctgatgaactcacgttgctccaacgattcttgaaaacaacatccgacacaacgatcctatgattgaacttgtgcataagcttcttctcatctttatcgttcacgtgttcatcaagtaacgttttttctttattacctaatttcagaatcttccggaaactctctccgatgctgaatctcgacgacccactaagttcttctctgtgtattctttcttcttcttcttctctctcgatgtaaagctccaagctcgaatcttctctaatctcagactgattcaagaacctgaaactgtttccgttagtgagaacagaggaatcttcttccattgagactctatctctgcaaagaggacaagttgcgtgttgctcaagccactgatcgatacatccgatgtggaaagcgtgtctacacttaggcaacaatctaagaatctcaacactttcgaatttagacaaacagacagaacaatcaagaccttgttttgatcctttcaaagcagagaatctaaacagaggaagagactcgattgctgttttgtctaaaccagagaatcgatccgatgatgccgttgaccggttaaagaatattccttgtctgagccggcgatcgtgccttcttctgtcgccggaacctgatcggagatcgatgtggcagcacttagcgtagacgaggaggacgaaagtgagtgcgaacatgatggcgagaactccggtgacgacggctaaactcggctcaaaatttgcgacgaggtcaccgtttctgaacggaggaggagtctgggcagaggcataactgtggaggagaggaagaaagaaaaagaagatttgatacatcggagcgttcgagagaaactttgtttcttgatattcttgggtttgaaatagttttattggagatgaaaatgagattatgttagagaaagtgatatttttcggtgtatgctataaactaatacaattacgtcatatacgtgacaacaatttgtatgctattgctttttatctatgctctatttgtcttctactattctctccatttaattaaatacaattttatctttcggtgggctgttattctccgacctcatttttgatgatacttaggactacaatatatatggaacttatttatcattttataaagttacaacttgcgtcacacatttggagtgatatttttgtttagtttttggtctgcgaactattaaaaaaaactacatatataaccaaatctcttttcaattcggttccatatattttttgtcatatggtttaggttatgctatttaacaaaattattttgacgttacttgacttatttatgtctgctcttccttttttatccatacacagtgaatcacatacaaattttgaatacacaatgaatcacaaatatacatatcttgatcgttctctcgagtcattttggtttgattgatgttaaaacaagtatttatataaccgcatgataagctaaagtcgaaattaattactttccaaaacatgtgaacgtccaaccataactaaatctcaataggaggattcgtaccatggttttctaacttcacggtaagtgttttcaagttttcaaccatgaacaaacttgattttttttttttttttttttgtatgaggttatgagaagtcgtttactctccaattatggtttcataatgaatattttcgtttaataaaaactaaaaaggaatgccatggttgtacctagaactactagtttattatttgtgacaaagctactaagtatacttgctagtaataaccatgacaatgttatattataaatgttaatgaatcgtgacagattaactaagaaaaagtcaacgaccagctgcacaaaattccggtgcggcaaaataaagtcaaagttgcattactcatgattggcttcgatgctttactatttgtgaatcagagagaacctcctctacaatcagaaactttgctttctgcgaatggacctgcaacactcaacaatactttgggcctcagtcaaagtgtcaagcccatcaacctcaagtcttctctaccttgcaacggtaacaagattcctcaatttccagcgcatcaacgtacgggattcacagctaatcatttgtcccttcataacaaatttgatcctctttgttcctctgtcgtgatgtgcagctaatgacgtgtgacctagtgtctcaccattttggggttcatatataaactcttctctgtcattgtaaaccttaagctgaaatattcaataaagagatttctcttcatcatcgttttatcaatactttcatggtatcagagctcagtcgaaa

SEQ ID NO: 8617 - DNA, 3000 bp, Unknown; identical to SEQ ID NO: 3356
  misc_feature (1)..( 3000): cDNA_ID_1807786_gDNA_ID_1971821_Annot_ID_176191 3000 nt of promoter + ATG

SEQ ID NO: 8618 - DNA, 3000 bp, Unknown; identical to SEQ ID NO: 3353
  misc_feature (1)..( 3000): cDNA_ID_4262264_gDNA_ID_1971821_Annot_ID_176187 3000 nt of promoter + ATG

SEQ ID NO: 8619 - DNA, 3000 bp, Unknown; identical to SEQ ID NO: 3351
  misc_feature (1)..( 3000): cDNA_ID_2040276_gDNA_ID_1971821_Annot_ID_176186 3000 nt of promoter + ATG

SEQ ID NO: 8620 - DNA, 3000 bp, Unknown; identical to SEQ ID NO: 3350
  misc_feature (1)..( 3000): cDNA_ID_1820542_gDNA_ID_1971821_Annot_ID_176184 3000 nt of promoter + ATG

SEQ ID NO: 8621 - DNA, 3000 bp, Unknown; identical to SEQ ID NO: 3348
  misc_feature (1)..( 3000): cDNA_ID_1820550_gDNA_ID_1971821_Annot_ID_176175 3000 nt of promoter + ATG

SEQ ID NO: 8622 - DNA, 3000 bp, Unknown
  misc_feature (1)..( 3000): cDNA_ID_2991393_gDNA_ID_1971821_Annot_ID_176174 3000 nt of promoter + ATG
tatgaagacatcctcatcatttacaatatatgtctctctcctaactttagacagattgtaactcagtttcaacttgacagaagcttcatcaatcgcaaccttcttcatgatcttgtcaactaacatcgaatagctaatcttctccaaactactcgtcttaaacgatataacatatagtgaatttttaccaatccactcattcacttcagaatagtatcctccaaagtcaaaatgtaccttagtgtggatcttcttcttcatcgctcctgaaaatacaaccagttcaactccaatcaaacattttaatagttataccacatgtactcttatcatacgttgaaatcaatctctcgtcgcactcgtctctactgaacctaattcgttacctttcaattgatttccaatgttaatacatacctattcgttaaactaattggttaatctaaactttgcaaacacaaaccccccaaatctttaatatgaaatctcggaattcaaattcaactcacattcaacctacattcctttgctcatcacctcaaataacgtttcggcaacctctaatcgattactctttactttgcaaaccaatcatcaaactatcaaattgaatcgagctgggaattatatagaattcaaaatcccaatctaaaatcacaatgcaccaatgtcaaaggaaatatgagaagaaactgacctaattcgtggcttttacgccggatttcaagtcggcggcatgaggaaatcgatggtggccgacgaagaagatgaacgtcgaccaaagaagaagaacacgacgacgaagaggagaatctccgaactcgattttctttatttagcttttgaatttctttttcatttttttaatcaactcattaagggtacaactggtatatcacattttcggtggcattcagattaacttatggcagtccagatcagttttttcaaaaaagtggcataagtgataaaagtccccccctgcggtttggtttcttgtccgctccaaaacttgtgagggcattttagtcattacaacatgggaactggatttttaaactggtgaattcgttagcgtttatgtgaataatcatccatcatcaggaaagatccgaagaaaagcgacgccgttttaaaggagatggataaacaaccggcgaccagttggagtatccatacccggccggagataatcgccaagtacgagatcttcgagcgagtcggatccggagcttacgccgacgtttacagagctcgccgtctctccgacggtctaatcgtcgcgctcaaggagattttcgattaccaatctgcgttccgggagattgacgcgctcaccatcctcaatggatctcctaatgtagttgttatgcacgaatacttctggcgtgaggaagagaacgctgtgcttgtgcttgagtttcttaggtcggatctcgctgcggtgatccgagatggtaagaggaagaagaaggtagaaggaggggatggattctcggttggggagattaagagatggatgattcagattttaaccggtgttgatgcttgtcatcggaatttgattgtacatagagatttgaagcctgggaatatgttgatttctgatgatggagttcttaagcttgctgattttggtcaggtgagattatgattgttactgattgtgttagttatttcattgtttgatgcacaaatatgagaaacctctgaatgaaaaatgcttggtttgcttgaaatttggaagagttagtgtaatcaagtggctagaccttatcatttagtgtaatctatgagtttctaaatgtgtgttggcttcttggttcatatacaggctaggatactcatggagcatgatattgtagcttcagatgaaaaccaacaagcttacaaactggaagacaaagatggagaaaccagcgaaccaccagaagttattcctgattatgagaactcacctaggcaagggtctgatggtcaggaacgggaagcgatgagtaaagacgagtacttccgacaggtggaagagctcaaggctaaacaggttgttagagatgatactgataaggactcgaatgtgcatgatggagacatatcttgccttgcaacgtgcactgttagtgaaatggatgatgatctcggtaggaactcgttttcttacgatgctgacgaagcagtggatgatacacagggtttgatgacatcttgtgtgggaacccgatggtttaggccaccagaactgctctatggatctacgatgtatgggttagaggtcgatctatggtcgcttggttgtgtgtttgcagaactcttgtctcttgagcctttgttcccaggaatttcagatattgatcagatcagcagagtgaccaatgtgctgggaaatttaaatgaagaggtctggcctggttgtgttgatcttccagactacaagtcaatctcatttgctaaagtagaatctcctcttggtattgaaggatgccttcccaaccattcaggggatgtgatatcgctgctcaagaagcttatctgttatgatccagctagtagagctactactatggagatgctgaatgacaaatatttaagtgaagagcctcttccagttccagtttcagagctctatgtgcctccgacaatgagtggaccagatgaggattctccgagaaagtggaatgattacagagaaatggattcagattcagattttgatggctttggacccatgaatgtaaagcctaccagtagtggatttacaatagaattcccctgaccttggcatttaaggtacgcagtcaaaagctctggctcgcttaaacacataaatcagtctcttctctctctctctttcttcttcaaagagaatgggtatataccaaaacctgacatgtgtttctttaggtcttgattgatgcaacactctttgttgtttgaagatcttgttacagaataccgcttagaaaattgttaacttttcgttaggacattgtttaggtatca

SEQ ID NO: 8623 - DNA, 3000 bp, Unknown
  misc_feature (1)..( 3000): cDNA_ID_2991393_gDNA_ID_1971821_Annot_ID_176173 3000 nt of promoter + ATG
ccgtagatggttgtatccgcatttctcccttccttgcgggcgaggtgccttgctgcggccatagcatggacacacgggatcttgtctatatcaaaacatttgcatgaacaacttttcattttcaaatccaccagaaaacttaccgagttgagatcaatcacgttgtattcttggttgtaactgttaagctcaaacacagttaatttggctgcaacttgacatctaatgtgcaatatgttctccacagtaggcacaacttgtgctgtgattggacaagaacctgaagcttgcctatgctcgttgaaccattcagaaaacttagaaatcatcacatcaatcattggtaacaagtggtattttctcgcttttttaaacacaccattaatggactccgcagaattactagtgtcaatgttatacttgtctcctttaaaatggcacctcgaccatttctcaaaccctactttcacaagaaagtcagcagctttaggccataaacttgtaaaatgaccaaactctttctcgaactcactctcagtatatgcatgagcacaatccctgaacttgacagcagctccatccttgtcaattgtcacacgatctctcatgttttgacacaaatgccatatacaagctgcatgaagcgcattcgggtacaccgtcttgacagccttctttatgctttgatgcctatcactaataaagaccaatccgggaacatccgaatatacagttttcagcttttctaagaaccaaatccaacttacatccttctcgctatcaatgattccaaacgcaagtggataatgatgatgattaggatcttgtgctgttgcaataaccaacatcccaccatacacagttttaagatgagttgcatccacaactatcactttccgcattgccctaaaaccttcaatgcaagcgcctaatgcaatgaagaggtacttgaactttttctctccttccaactccacataagttactgtccctggatttaccttctctaacatgtaaagataagaaaataacatcgtgtagcttctttccggagtccctcgcacatcactaacatgtagcattttgcctcttaaggcagtggagtatgaacaatgcaccccaagtcttcctcttacaatcgacataatgttttttggagttggggtctctaaatttccgggataatcacaatgtaaaaccgatgctattaatcttggtgtgcctcgctgtatactgttgcttgtagtctcaacactccgagagcatgtatgcatctttctatgcactctaacactccaaaaatgagattttttagttctcgcaactcttagataccaagtacaccctttagaagcttggcggcatcgtagcataagtctcaacgggtctgacttaatagtatagactccaaaaacttctttctttgcagctctgttaaccaattcccacacagcctcccttgaacaaaattcttgaccaatttcaatacccgtaccatcatcccattctataacctgcggagtaacttctacacttcgtggaatatcgtgaatatcatcataatcaatcctatcatcctcatcttgttcctcaacagaattcaccggcctttccatcggcctttcgatagccacgatctccgtacctactacattctcacaatcattcacatcattatcatatccatcatgcaccatctcacatacttcatttaaaacatcatcctctattacatttacaccaactgaacttcgacgctccggtacagaaatttcctctctcctctcaactcctataccatttaattcctccacatgcaaaacaggaatccgactctcttcatcagattctgttaaaaatatgaagacatcctcatcatttacaatatatgtctctctcctaactttagacagattgtaactcagtttcaacttgacagaagcttcatcaatcgcaaccttcttcatgatcttgtcaactaacatcgaatagctaatcttctccaaactactcgtcttaaacgatataacatatagtgaatttttaccaatccactcattcacttcagaatagtatcctccaaagtcaaaatgtaccttagtgtggatcttcttcttcatcgctcctgaaaatacaaccagttcaactccaatcaaacattttaatagttataccacatgtactcttatcatacgttgaaatcaatctctcgtcgcactcgtctctactgaacctaattcgttacctttcaattgatttccaatgttaatacatacctattcgttaaactaattggttaatctaaactttgcaaacacaaaccccccaaatctttaatatgaaatctcggaattcaaattcaactcacattcaacctacattcctttgctcatcacctcaaataacgtttcggcaacctctaatcgattactctttactttgcaaaccaatcatcaaactatcaaattgaatcgagctgggaattatatagaattcaaaatcccaatctaaaatcacaatgcaccaatgtcaaaggaaatatgagaagaaactgacctaattcgtggcttttacgccggatttcaagtcggcggcatgaggaaatcgatggtggccgacgaagaagatgaacgtcgaccaaagaagaagaacacgacgacgaagaggagaatctccgaactcgattttctttatttagcttttgaatttctttttcatttttttaatcaactcattaagggtacaactggtatatcacattttcggtggcattcagattaacttatggcagtccagatcagttttttcaaaaaagtggcataagtgataaaagtccccccctgcggtttggtttcttgtccgctccaaaacttgtgagggcattttagtcattacaacatgggaactggatttttaaactggtgaattcgttagcgtttatgtgaataatcatccatcatcaggaaagatccgaagaaaagcgacgccgttttaaaggag

SEQ ID NO: 8624 - DNA, 3000 bp, Unknown
  misc_feature (1)..( 3000): cDNA_ID_3045794_gDNA_ID_1971821_Annot_ID_176172 3000 nt of promoter + ATG
taacaccgactttccaattgtaaatgttaccattttcatacgagggaggcagagagagaggaacaacacacacacacacacaacacatttttgacaaagtaggcgaattcaggggaagtcgggatgatcaagatgctcaaccatggactctgccaaggagagataaacacataaaactgagatcgatgagagaaacaaagcgcaaaaaaaagttgtgagatcaatgagcaaacgaatttcaaaagtttttgccgccattgatacctaaacaatgtcctaacgaaaagttaacaattttctaagcggtattctgtaacaagatcttcaaacaacaaagagtgttgcatcaatcaagacctaaagaaacacatgtcaggttttggtatatacccattctctttgaagaagaaagagagagagagaagagactgatttatgtgtttaagcgagccagagcttttgactgcgtaccttaaatgccaaggtcaggggaattctattgtaaatccactactggtaggctttacattcatgggtccaaagccatcaaaatctgaatctgaatccatttctctgtaatcattccactttctcggagaatcctcatctggtccactcattgtcggaggcacatagagctctgaaactggaactggaagaggctcttcacttaaatatttgtcattcagcatctccatagtagtagctctactagctggatcataacagataagcttcttgagcagcgatatcacatcccctgaatggttgggaaggcatccttcaataccaagaggagattctactttagcaaatgagattgacttgtagtctggaagatcaacacaaccaggccagacctcttcatttaaatttcccagcacattggtcactctgctgatctgatcaatatctgaaattcctgggaacaaaggctcaagagacaagagttctgcaaacacacaaccaagcgaccatagatcgacctctaacccatacatcgtagatccatagagcagttctggtggcctaaaccatcgggttcccacacaagatgtcatcaaaccctgtgtatcatccactgcttcgtcagcatcgtaagaaaacgagttcctaccgagatcatcatccatttcactaacagtgcacgttgcaaggcaagatatgtctccatcatgcacattcgagtccttatcagtatcatctctaacaacctgtttagccttgagctcttccacctgtcggaagtactcgtctttactcatcgcttcccgttcctgaccatcagacccttgcctaggtgagttctcataatcaggaataacttctggtggttcgctggtttctccatctttgtcttccagtttgtaagcttgttggttttcatctgaagctacaatatcatgctccatgagtatcctagcctgtatatgaaccaagaagccaacacacatttagaaactcatagattacactaaatgataaggtctagccacttgattacactaactcttccaaatttcaagcaaaccaagcatttttcattcagaggtttctcatatttgtgcatcaaacaatgaaataactaacacaatcagtaacaatcataatctcacctgaccaaaatcagcaagcttaagaactccatcatcagaaatcaacatattcccaggcttcaaatctctatgtacaatcaaattccgatgacaagcatcaacaccggttaaaatctgaatcatccatctcttaatctccccaaccgagaatccatcccctccttctaccttcttcttcctcttaccatctcggatcaccgcagcgagatccgacctaagaaactcaagcacaagcacagcgttctcttcctcacgccagaagtattcgtgcataacaactacattaggagatccattgaggatggtgagcgcgtcaatctcccggaacgcagattggtaatcgaaaatctccttgagcgcgacgattagaccgtcggagagacggcgagctctgtaaacgtcggcgtaagctccggatccgactcgctcgaagatctcgtacttggcgattatctccggccgggtatggatactccaactggtcgccggttgtttatccatctcctttaaaacggcgtcgcttttcttcggatctttcctgatgatggatgattattcacataaacgctaacgaattcaccagtttaaaaatccagttcccatgttgtaatgactaaaatgccctcacaagttttggagcggacaagaaaccaaaccgcagggggggacttttatcacttatgccacttttttgaaaaaactgatctggactgccataagttaatctgaatgccaccgaaaatgtgatataccagttgtacccttaatgagttgattaaaaaaatgaaaaagaaattcaaaagctaaataaagaaaatcgagttcggagattctcctcttcgtcgtcgtgttcttcttctttggtcgacgttcatcttcttcgtcggccaccatcgatttcctcatgccgccgacttgaaatccggcgtaaaagccacgaattaggtcagtttcttctcatatttcctttgacattggtgcattgtgattttagattgggattttgaattctatataattcccagctcgattcaatttgatagtttgatgattggtttgcaaagtaaagagtaatcgattagaggttgccgaaacgttatttgaggtgatgagcaaaggaatgtaggttgaatgtgagttgaatttgaattccgagatttcatattaaagatttggggggtttgtgtttgcaaagtttagattaaccaattagtttaacgaataggtatgtattaacattggaaatcaattgaaaggtaacgaattaggttcagtagagacgagtgcgacgagagattgatttcaacgtatgataagagtacatgtggtataactattaaaatgtttgattggagttgaactggttgtattttcaggagcgatg

SEQ ID NO: 8625 - DNA, 3000 bp, Unknown
  misc_feature (1)..( 3000): cDNA_ID_3045806_gDNA_ID_1971821_Annot_ID_176161 3000 nt of promoter + ATG
taccttttatttggttgtattcagggaaaacaagaatttaacaggaactgcacgatatgcaagttgcaatacacatcttggtattggtaaggaatgctgccacttttttctcccctttgtgaagtaaagtttttgctcacatatttcgatttctctttcgcagagcaaggtagacgggatgacctagagtctcttggatatgtgcttctgtacttcttaagaggaaggtgtgttgactttttgacttgaaagaacctagttaacattgtgtttttggcagggtattgtttttccttgtttgagatttacttaaccgttttcttgctttacattttgttcctattttaatgaacctccttttctagccttccatggcagggtcttaaggctgttgacaagaagcaaaagtatgacaaaatttgtgagaagaagatatcaactcctattgaggtctatttccctctactgtgtgagtgaattgttttttgttaatcctcattcaactgaataatatcccatcctttgtaggttctatgcaaaagccaccccgtggagtttgcttcatattttcattattgccacacactgacatttgatcaacgccctgattatggattcttgaagcggctttttcgtgatttattctcacgggaaggtactttgagaaagacatccctccatcatttttataatcctctctgctagcatcagttatctacctagctcacttaaacgttttcttctttgcaggatatgagtttgactatatatatgactggactattataaagtatcagcaatcacagaaaactagaagtcagtctcaggtatagtttatcaataccatttgttatttttttttctccaggtgtatgcatattttgtcttgttcatagagaagatttcctggggagaagttttacttggttttgctattttttagttttggtgctaaatatagatatgcctgtcttcctaacaataaactgtcatgctgcaggccgttcctgggtctagtaatgctcgtgcaataccaatggacacaagcaatcatcgaggtcagctcgagttataaattttaattgtgtcactttctgattaattttgtaatagtatatgatgtgttttttgttttctctcgactttcacactggactcaactggcatagagtgtttggctgatttagtttcccgttgcaactgtttatttcaatatcttgatgctaactctccgtttggcaggaggaactaagatttcacatgaagcccaagtctctgaccgtgtcagaccggctaatgccagtggtccaagcccacagattaataccgctgtagggaggagtctgggttttgatcaagtccacaagaatgtacgtgcttattcatttgcctcttccaaataaatgttgtatcctgcaaccctcccccttgtgttagcatctcatgcctgcatctgtgttgcttcagagttctgcatggttctctgcttaaagcttttacctgttttgcatggtcaattgtcatcaacgagctctatattgtgatatgaactacatatagcataaatgattaaaacacgatactgatcatcacgaaatatgctcttgaccattattttactgaaaacccattgcagatgaacatgccatcatccacttcattatctcctgcgggtacctcaaaaagaaatgtcagacccgaaacctcaaattctgggtttgggagcgggaataaaaccggcggttggacttcaccattcatgtcaccggggaaatgatgcaaaaaaagttggagtatatcattcatctgatctgctgagcaagattatgtgtgcctttgggtctaaactgtgatttctgcagtgaaaagctctagactgaggttgaagatctgaatggagtttttccatgaacagcttactgtttgacaaaaggcatgaagattatgtttgctttccttcaagattctcacaaatgactgacttcaacctttgtataaaatcttgcaaccgggcgtgtaatttggttcttgtgattcattctcccaagttttcttctataaaactttgttcgtatttctgtacgtagttccctgtgttggggcataacctgggtttgctgtgtcatcaacattgtttgcagaaaatcaagagcaaagcatgagcagcttcagcagagatgccttcaaaggcttgagtcaagagttgcttgtggcagggacatgtcaccatcaagctaatgtgcagctgacgagaacgtaaaaggataagctatggctagcttctggaatgctccgagaaacacttccccctttttttttctctgaatttcctattcagtttaatggtattctgtgtttgatttttcttactcgattttgtgcattgaaaaaaattatatcaaaaagcttgacttgatccaaacatgcattttcaattgctattattaaaaaaaaaaaacgtataaaattgtagtctcaatattgaaatacaaacacctagaattgatcgatttggtagagaactagttagtggattaaatttgggttggctgattttcgagccataaactatttcgattctcagctttcacacccggacttttgggcctttaaatttccaccatcaactttcatattcccaaaattacatcatctatttttggattcatgcttaaacatacatttccaattgaaccattcatttaaccgggattaaccacaaatccgcgtttactgtaccgcgattgcgattaacccaactaatacccagacccgttaagaaaacgacgtcgttttcatttcgtttaactcatcaaaaagagaaagaaaacgacgtcgttttcattcttcttctttaactctcaaatcgatttagtcgttcttctttaatctcgacactgtgaaattagggttcttgagagagaaagacaaaaggggatttggggttttcttcttcggttcgaatttttgggtctcgatttgggtttcgaatagggagaa

SEQ ID NO: 8626 - DNA, 3000 bp, Unknown; identical to SEQ ID NO: 8624
  misc_feature (1)..( 3000): cDNA_ID_1839234_gDNA_ID_1971821_Annot_ID_58334 3000 nt of promoter + ATG

SEQ ID NO: 8627 - DNA, 471 bp, Unknown
  misc_feature (1)..( 471): cDNA_ID_1989503_gDNA_ID_1971822_Annot_ID_58335 3000 nt of promoter + ATG
actctttttttaattcaaattttcaaaaagccataagaaaaaaaaaatatgtttaagtaggtgaaatgtgcacgagatttttcgatattttatatatctatattttcttttcaatccgctattttttgaataaaatgatattaaatttatacattattctcgttatttatagaaatcgatacttaaaccgtttcccatataaatattttaccactcatttttaccatttttgagccaaaatttgactatctacatatataattaactcttacaaaaatcaaattacaattgctttgatttaaatgaaaaatattattacccataaaatttagacttggatcccccaccggtagactggtagaggttactaggggagtagggacaaaaaaaatcaaaaatatcttatctataaatggatacacacacacacaaagcaactagcactcaactcaaattctattaagaacaatg

SEQ ID NO: 8628 - DNA, 3000 bp, Unknown
  misc_feature (1)..( 3000): cDNA_ID_3000057_gDNA_ID_1971822_Annot_ID_58341 3000 nt of promoter + ATG
gttagcaatgttattaaacccgacccgcataatgaaccagactactttctgggtcattaggtcatcgggttaactaattaaaattatatatatgaaagttggtcaactctttccatatgagtgacacatcatcacactagtgaatgtcatatgtcattctaaattaatattattaaaaaagaataaaacttagtgataaaaaattaaaagtttcacattgcattgaatcatccattaataatctcacacttaactatcttcatttaaaagaaaaaaatacaaaaaaatcattttaatgtatcaaacactactttcattttatttttcttattatgctatttttttaatagtcattacttgataacgactagaaattttcgtgtattacaacttagttgtttgttacttaacctttttaagtttagtaattttaacttagtcttttttttattacgctttttgtctacatgatatggttttttgtgcattacgataaattggtaacattaataattaataatgacatgcatgttttttaagtaatgatcttttgagacgttagatataccaacaagttaaatatatgatactctcgcgtgggtactcacctactttatttaataaatttaatattaatagagattttacagtttttagagttcttacaaattaaaaataatcatatcctgttgaaccggttgaaccagccgggtgtgggttttaaaatattctctttattttggaataaaatatgggattttagactttattcaatcattttagaaacaatttcagttcgtaaactcatttgatgttttagattgtgatgaagacttcacaatgtcgccttaaaaaatgaatcgaatggtgagtgagacacctgatattagttgtgtgaattcacgatgttttattagtttatttccgtcattggtgatctcctactatatttgttacggtattagacatttaattggatttaaacaatttaatcacttacggtatttacggtattagaattattattgtttgattatatatatatatatatatattttttttttggtgtaaatgattttatattttatcaaacataatctggttttatattttataaacatgatatgattattttaaatttataaaaactctaaaaactctaaaatctctattaatattaaatttattaaataaattttaattagttgacccgtgatccaacctggttgactcgattacccagtgacaaagaaagtagtccggttcattatccaggtcgggtttaaaaacattggtttttaatttttggattttggttttaggttttcgatttttgtagtttgtgatttttgttgtagattttaatttttacagaatcttaaatggaaatttatttagtttttagttctctactttaatttatagttttttattttttgtttaaaaattactaaaacaatgaaaaattgtttaaaaatcttgaatggaaattcgttaaaggtggattgtcaaagtcaatccataactgaaattagcaattttagggtaaattagcaattttctgcgagggtagtagctgtttacccaaaatcttgaatggaaatttgtttcaacgtttttaagttctctattttattatagttttttattttctgtttaaaaattactaaaacaatgataataaatattttcttaataataaaaaattaaaaagatgcagaaaaaaaataatcataggtatattgcatataaacatagattttgtaaataaaaccaatttttacgaaaaactaaaatgaaaaactcatattaatacaataatactaaaataatgatgtagaaaagaaaaaacatagcatatttaaaataataaaaaagaattaaaaaataaatatcacataaatcttctagaaatttggtttccttatgttttagaaaatctactttttattaatcataaatgagtaattattagtttttgatttaatctacgtttttcttaatcataaatgggtaattattagtttttgcaaaatcaaaatccaaaaattgttctaaacactgcaaccatttaaggcctatatcactcagaaaatttctggtgggagaactaatcgtttgtcctttctaaatctcacatattagaatttagaattagtgtgctacataaaaatattagttcagctcggaacaactattttttggtaaaacagagaacttaaacaaatgcattattttatcaacatgcattttgaattgaatataaaatttcataattgtaaagacataaattacataaaattttacatgaaaaaatagatatagaaagaaaatgaaactaactgatgatatgctctctaaattttttaatctcataacaagaattcaaattaattagttcatatttttggttaatataacatttacctgtctaagttggaactttcattttttttctgttttgtttagtcagtattcttaatgtgaaacggaaagttgaatttattcaaacttaaattcaatagcattaattaaaggcgaaagctattatctctacatgtggttcaaactagacatccaatttaattagcttattgacgttgaaatgttttccaaaactactatagtttggcaatttgaaagatgcatcagaactactcagacaggtaaaagtagaacctctagctgtgtgaattgtatgttagtccataaagaacatcttgtaaacttcatacttaagatatatattacaatatatacttgaatggtagataaaaacgattagtctgattgctagcatactcacaactatttggaaatgagtaagatattggcatctagagttactactatggagacaaaagtcgaataaaagagacctcacgtgaaaatgttacgagctagtaactaaagcatttacactaacggtaaaaaaagtatctataaatgtttacacaaggtagtagtcattagcactcaacttaaactcttttagtaaca

SEQ ID NO: 8629 - DNA, 3000 bp, Unknown
  misc_feature (1)..( 3000): cDNA_ID_2050038_gDNA_ID_1971822_Annot_ID_58346 3000 nt of promoter + ATG
acaaaagaaagaagtaggtccattatcaaactccgagtgaatattgatgatgccaccgccaaaacagttcactaatacatcttctgttgcttcactttccttcttttaataccttctctaaaccacccaattttctttcttttttcatattccaagatttggatttgagtttctctttttggaaattcctcttaaatcgaatatataataatgtcacaaaattaggactagatacaaaaaaaaaatcattgtgaaaactaaaaaagcaaagcatatcaaatatatctcttgaagctagttggcataatattctctgagttatcgaatattctatatatgtaaatggccagtttgacaattacctaaaatcatatgatagacataaataattctacaaatttttaaaataaatttaaactaaaagacaataaaattaccattatgttcacatttagtaaatatttcatggacgaatttctccacgtcgattttcgaaatctcataattttccggcgccggaatatacggtggtcgtgataccttaagcaccaaatcccaatccaaccctttaaagaaatcatgtcccttgattccttcaacattaatcctacggctaggatctttctccaacagttttcttaccaagtctcttaacgatgtcgtttctccgaccaaactcggcggttcagttaatatctttaaaaaagtctctttacggttggaccccctaaacggcgtcgctccgtacaacatctcatacaaaaccactcccaacgaccaccaatccacggcgaagtcatggccacttccggtgattacctccggcgcaacatattcctctgttccaacaaacgagttcgacttctctcctgaaaactccgactcggaggatctcgaaaccgagtcgtccggggagattccggagttacataaaccggaaaatgcgaagatagacctttctttcttcgtcgccgtcgaaagtctcggtgacgacgaaaaagaagattgtggagttctaggaggtagattcgtcgaaagatcaaaatcaacaagcatcagatgaccattctcttgaatcatcacattatcaggcttcaaatctctgtacacaattccttgattatgcaaatactcaagtgcaatcacaagctccgccgcgtaaaatctaatgatctcatcggaaaacatttcttccgactgttttttccttaaagagttgagatctcttccaggacagtaatcaatcgcgtaaccgataactttatcggtggatataacaccatgaagacgtggaaacagaggatggtcgaatcgagacaacactccttgttcgaaacttatgcgtttgtactcatctttggccttctttgactcgattgattctcttagtatgacttttaaagcaagccatttgttatcggcttttactaagaacacaactcctttagatccacgtccaagggctgagaaaatctctagatggtcgaagttgagagtcgggatcttgttctccggtggtaagaggtggttgctcatcgctcaagagtttatttttgatttttttttatggttcaatattcttttggttgtctttaaagcagtttttataagagagaaggggttaagcttttctaaaggtaggtccgtatagattttgtttccttgccgggaaagacttgaataaacgttttaaccaaaaaagaaaaatgcaaaagatttacgtagtaagacacggattacttttaccattttactccttctcgaatcaccattactaagcatcaaatattttcagtcatttcaaacatcagtttttgcgtttatatttgagtaaaattgaaaattttccatagagatacacaactatttagcgcaacatacaataacattttccaaatagaagaaaaaagaaaaaatttacttgtttcttaacgttcctactcaatacacaaactaacaaacaagttaaaacgagtaaagattcttggcgaaaacaacaacaaataatgattcaatattttaaaataacacataaacagttggtctaaatttataaataatctctaaaaaatatcataaaaatcacatggtttcattctcatatacaaagacagtaagaagattttctttttttccgaagtggtcttcaatgaatatcgagttagaaaatggatttttttttcctactaattacttacaaaattttgatgaaaaaatagagtagacgaaatttggtagaaaatttcttgcgaaaagatacaagaaattcactaccaatttatgtaacatttggtaggcaattcagaagaatcaaactagattcatgacatatggggagaaatgcaagaaacaaaaacaaccgaggatgagtcttatgctcttagctaaaaacatttatttagattttaggtgtggttgcgacaaccaaaaaaaaaaatacattacaaacgattgacgtgctgagcgagaaattaagaagtcgagtccctaaacccgtaggaaccaaccatatatggtgagaccactgtggaatctgccagacaacacccaagcatattaaccataaccacagtggctgagcaggaaactgtttgactggtaatgactcattaacagaaaaattaacattgcagaaaaaaaagttataataaggtaaatggatcgtcccaagatcattattggataattaaaatcactggccagtggaattaaagcccaaacaagcccatgataactcaaaactagatcaaccagtaatggcccatgatgtcgtacttgaggtgacgtggcaaattctgaattcgcgcaccggtagattcttttctttttccgtataacacctttcaatacttgaggtgacgtggcaaattcacaaccactttttatatgatataccgcttttaccccttaagcctctccgcgtaaaaccgagaacaaaatcttaagcaccgttgttccgattcagagatcatcgtcgtcgtcgttcagaaaccttcaaaa

SEQ ID NO: 8630 - DNA, 3000 bp, Unknown
  misc_feature (1)..( 3000): cDNA_ID_1821774_gDNA_ID_1971822_Annot_ID_58347 3000 nt of promoter + ATG
gtagtcactagcggtttctatatggatctcgttgctctgggaatctatggaaaatttgagtacagagaacacgccttttaagctagataatgtgattgagattatgtacgaaatgagagaatgaagaaaagagacgatggtggtgagagtagctcacaaaagaggaattattagtgatagttttaaattatttctctgtttttgtcgattggattggattgcagagtccactagattgcatgatgcatctcatatgtgaagtgtctctgattaagtgattattttgtgaagttagtgttctcatgtgtgtattttttttctgattaaaaggtaacattatctgtttttgtagtgtttttttcttttttttttcttttgtgatgcattcctgtatgtgtattctgtactcttttgatgataaatacgtggttatctgaatatgttctcagcatgttcaagttccggttccaacaccaaagagtaatgaggtttgcctgaaattagaagctactagtctaaaccctgttgattggaaaattcagaaaggaatgatccgcccatttctgccccgcaagttcccctgcattccaggtattctaatagctttgaagattttagtttctgtatagaagaaagaggttactttgcttagaggtcgttgagtttggaacctttgatatttgttttgaacagctactgatgttgctggagaggtcgttgaggttggatcaggagtaaaaaattttaaggctggtgacaaagttgtagcggttcttagccatctagtaagttttttcagacagacaagtagaaactttaattaccttgaaacatgttaagggaaactgattttgttctttcagggtggaggtggacttgctgagttcgctgttgcaaccgagaagctgactgtcaaaagacctcaagaagtgggagcagctgaagcagcagctttacctgtggcgggtctaaccgctctccaagctcttactaatcctgcggggttgaagctggatggtacaggcaagaaggcgaacatcctggtcacagcagcatctggtggggttggtcactatgcagtccagctggcaaaacttgcaaatgctcacgtaaccgctacatgtggtgcccggaacatagagtttgtcaaatcgttgggagcggatgaggttctcgactacaagactcccgagggagccgccctcaagagtccgtcgggtaaaaaatatgacgctgtggtccattgtgcaaacgggattccattttcggtattcgaaccaaatttgtcggaaaacgggaaggtgatagacatcacaccggggcctaatgcaatgtggacttatgcggttaagaaaataaccatgtcaaagaagcagttagtgccactcttgttgatcccaaaagctgagaatttggagtttatggtgaatctagtgaaagaagggaaagtgaagacagtgattgactcaaagcatcctttgagcaaagcggaggatgcttgggccaaaagtatcgatggtcatgctactgggaagatcattgtcgagccataagagcgttgtagccatctttgactgtctgtgaatgtgataatagatgttaaaagtttgcgtaccgtttacagaatgttttatgttgttttgtttaatatacccgagtatgtcgaaagttacatgaaaagaaaatttggatgaaataaataatacttgttaggtattttagttttaccataccgctgaagttgaaccgaaactgagcatggaatcgaataaaacagacccaacaacatcataaagcccaatagcccattaacgacttcgtcaattcccctatcttaaaaagactttctccagtagaatcttccggtaaataaaacaatagtcgaaggagatttccgtcatttcaaatggtaagaaaaccagaattatttaatatcactctcttaagggaccaccgttgccttccccaccacaaccaaccattttcctccatttttttctttttccttattaatattttaataataatacaaaaatcaataattatcttcttaaatatttaatttaattaattaattatgtatttcgttcttcttcttcttcttcaatttcttctttcttctcccatggcttcctaaacaatctgctattcctctctctcttcttcacctatagtttatctctttttttttgttttggcttctcttaaattcactttctctaaaacataaacgacattgatgtttcttcatcagatcctttaattcttctccaattctcattctccttacatcaatggtgagaatttttttttatagattatgtttttaattcttgtgttcatgtaagatttttttttttttttttttttgtgttttattgttttcttaattccgattggatttgttttttgtttatttttctcaattttatctcaatttcttggacaaattgatctttttttactctacaaataaataaagtttgagactttatagcagaatcttcatatgtagcaattgaagatttttttttcttttctaaaccgatctaaatagattaaatcatcattattgaaaacaaaagattttgtttttattttgattaaatcctttttttttttttttttttttgcagataaactttgtagttggagatttgttgtggatgaagattattgattgcagcttataggaagctgctctttttgttttgaacaatgttgctaacttttcagattcttataattaatcagtcttatgatgagaagttggttcttgattacatactacaatcaagaagtaaacagtttatgcaatcttgtgacggttcttgtgttcaaagagtagatacttgttcttcaaggtggaggttaacagaggacaattgacggggtttttaatcgttgttgtattgctcgaataaacggaatcatggaaaggtttgttcttgttctgttcttgttgttgtttgtatatatattggacatggtgagaaagtg

SEQ ID NO: 8631 - DNA, 3000 bp, Unknown
  misc_feature (1)..( 3000): cDNA_ID_1821770_gDNA_ID_1971822_Annot_ID_58348 3000 nt of promoter + ATG
cagttggtatgtttgcgaaatccttttgtgcctcatcacatttcattagtatcatgtgatcatgtcaaaagtctagctaaaccatggctaatacttcgtggctttgaatagtttaagacattttttctttctgttttgtcatctattggatcgctttgcaaatctttatagactaacatttaaaagaactgcagacatgtgggcagttggagcgatactagctgagctttacgctttaactccgttatttcctggtgaaaggtgaattcatttccctttcaaacgatactagctgagcttaatctgtgtgcacacttaagatagaccatttagtgaaaactgatataatgatttctttatgagtagtgagatagatcaattatacaaaatctgctgtgttcttggcaagccggactggaccacgttccctgaagcgaaaagcatatctcgaattatgagtattagtcacacagaggtaagagttcttaatgaaaagataagaggcttattatattaactgcacttcaatattgactttgttctttgaatatcttgtgacagtttccgcagacacgaattgctgatttacttcccaatgctgctcctgaagctattgatttgatcaatgtgagttcttgtgttcactctttttgcggatatttcttaccattcttaagaatgttgtgatctttcaatatctttatttcgtatatcatctgtttctttttttgaatcaacagcgactttgctcatgggatccattgaaacgaccaactgctgatgaggcactaaatcatccatttttcagtgtaatttgaatattcccttgcttcttttgattttatcacacactcctctctttgtaataatcgaaaatgtaatgatatattcggaacagatggctacgcaggcttcatatcctatccatgaccttgagctgaggcttgataatatgggtgaggctttatttttctttgttaatctgcttcgtatagtatgctttcatgaccataagattaagttcaattatatttgtggtattctgcagcggcgttgcctaatcttgagctaaatctctgggactttaacagagaacctgaagaatgttttcttggcttgacactagctgtgaaaccaagtgctcccaaactaggtaagtatcattccctcgtgtagagttggtcactagatctgacacaaattgacattgacattgagcatggtttcaaatattgtttgcagaaatgctccgcaatgtatctcaggacatgagcgaggtaagctcatacgcaatgaacgtcacttatatagcattgttaaacttttcatgagttgtaataaatctgttgtttacaaaagcagaattttctcttttgccccggggtcaacaatgatcgagaaccatcaggtgatgaaaacttgagcatatgttgataaaactgcagatttctgttatatttctctgtgaaaggttgttgaatatctctctttgaacatttacagttttctggtctctgctctctcctgatgaaaacggcctccacgcgccagttgaatcatctcctttatctttgtctttcaggtgagattacaagttgtctctatggatccattaatgtgtaaacagatttgcctaatgagaaacatttactgtgagcagtccaatgcagcaacacacagttggacctccacagtcgagtggcttcacaatgacatcatcaatgcaaccgaatatgttggaccgcccgtggatggccgtgtctgcgccgtttcaacaaagtcattacctctgatctaataaacccataccctagtaaaaaaagtaaataacacagaggtttgtcagaaagatttgagtttaaagaacaagatagcaaaacaaaacagaggaaaggtgttagaattttcattttttttgtcaccaatttgttcttaatttgtaaaaatttggtttggctgatgcattttcctctcagagcttgagctctatcaatatcgaacaaataatttccttattcttgtctctgtataatatatgataaaaaaagacattgaaatcttgatgtggcattaccataaagaattacgtttcattaatgttggttctgtcgtcttttaatataaaagtctttaacttgtgaatctgtcttatctacaagaaaatttaagactatatttattatgttaattacgatacttattttaatctatatttagtaaagcgaacaagtcctacaaacaaaccaaagatattgaaaaaaagtcactttggagatagaacagaatataaaaaagattctttaaatgatcttttatcaaaacaagattctaacaagtcttagaaatctcaaaacgaagaacaagtaagaagcttgtagccatgggtggtgatactttcaaagatggtaaattttttgatctttttctttgaactgtgtttgcatgtttgatttaacgaaaaataaattatttttaagatgttgtagatgaagaatcttcaagatcatcatcatcatctccttgttcttgttgtttcaggtatattattatttaatctttatcactaatttttgttgagtatgatcataatcataatcaagaaagtgatggtggttttttttttttttttttggtgtagcagtgatgatttagggtttaaggatgatgtttctgaagagaatttcaccaatttctctaatcatgttactgatttgagaaggagagaaaaagcttaccaagagattcttcaaagtcatgatcttttgcttagaaccagcaaacggaaacttagacaagccagaaatgagattttgaggtattttttatatatatttaaattcaattcatttagggaaaagttgtgtttgttctacttggtgatcatacaaactcaattatgtttttgactattattatggttgatatatgcatagctatactcctggatcatggtctgatgtcaagttgagtgattacaatattccaaaaacgacatcgatc

SEQ ID NO: 8632 - DNA, 3000 bp, Unknown
  misc_feature (1)..( 3000): cDNA_ID_1821756_gDNA_ID_1971822_Annot_ID_58353 3000 nt of promoter + ATG
tttgagtgacacgtcatgaatttatgaaatgaaactttgattgttatgagtttatgaaatgaaactttgatttttttttaatattaattgcacattaacaatattcagcaaaataaaaataaaatcatttgccttttcatcttctttcttggctaggaattaatatccatcattgcatcactttttttaatcatctgcattttcacgaccttcttgcatgggttaagcggttgggttaagcatgtcttcattttacaatgagtacttaccatagtgactattttttccttttctattttgagttgatttgatgttaatctggaagaaattggaacctaattgttattatctgccctttttagttcccagcttagctagattaacaaatcaatcaattatcaagtgtctactataagctgtgtaatttccaggggtaaaatacagggatggaagttataccaatcctagataacaaaattgttgttgaacatgataagaattagagtatttagtataacctctttcaaaaaaaattatttttttgaaatctcatcatcatgcaacaaagttgacaactcaaagtcttcctcattctgttgtttatgcgcttcaaatttgatttaatatctttaaaacctcatatagaacgcatgcattttgttatccagctcattacaatggctaccctaatctcataagatcgaagtggtagtgatggcaagcatatgtaaaatgcttgaaaataagacattaaatcgtattcagcccaagtcaaaagagcacccaatgtgagagatgattatgagcaaaacatctaagagaattttcggagagttattatacctcaaattcttgcttatgtttcatatatatatatatacagtaaaacctctataaattaatactcgataaattaataatctctataaattaataaatttttccggtcccgagttgggattagtgtaaaaagttacacaaatcgataaattaataagataataatttttttgagagtcctatataaatatatggtcccatcaatattataaattaataattgcataaatgtacaactatatatatacattatatattagaaatttctttcaaatatattcgtaatattttttttgtttaaatttgtatctattataatttgaaatttagttctaatatgttattatatcaaaagaatttggtgttattttctagacatgatattatttggtatttgtaattgattttcgaaagatattttttataatgaaaaatatcttgtttttttttaaagttactatattaggaaaatctctcaataaattaataaatattaatttattgataaattaaaacctctctaaattaataaaattttgcagtcccaacattattaatttatagaggtttaactgtatatatatattttttttttctttattctttttcttttctcttcttggtttctagcattacacacatatatgatactatatataatttaaatactaatatacatattatatttttttattagtcaaaggtatacttatataaataaactacagtaaaaccaccataaattaataatgttgggaccatatattattttatattaattttaaattatagtttcagttcttagaattttagagaaagatgaattaagatatgattttatctaaataaagttatttttttggatagtataaattttcgtagttttagacttgcaatttttatatttaagaaaaaaactcacttatacaaatgagtatctaaaaataaatagacccaaaattacaaaaactatagataaattcacttatacaaatgatagacgtaaattcaaatttatgaataatgacctcatcatcatttttgtttggacaaaagtaattaaaattatacccaacagtatttaacatataatactatcaaaatgagtataatgcatatttaaaaactgaaaaattacataattgattggccatttttatgaaaattatatttactatgttttcaaaacacaaaagaaaatttgtttgttacaataaaagttggagataagctctatcaaagtttgttttaaaaaaaacatacaatggtatattaacttttatatatgtttgtaaatttatatgataattaatttatattaataatgggactatatatttacataggtattctaaataaattattatcatacccaattttatcaatttttacactagcccgtcttgagactagaatattttaataattattttgtttattaatttcttatttattacatttgaaatattattaatgattttctcatttccactaaaacttataaatcttacatttacagttaattagaaagaaattgtttaatattttatgtcataataacattctaagttttgtaattcttagaaatttttttctttgttccattaatatcctttccttgtaaatttattttcatgaaattgtttcttaatgatatcaaatttatatagatatctctaaaacaaaataacacattatgtatagtactaaatcattttgttagatttctattttctttcttatacttttgttatctttttttcaatcttcttcatttctttgtagtaaaaacatttaaatcacccaattactaatgtataaattataacttaattaaaatctaaaaatcacataaattgaattttgggggattaggtatattaaatacaaaattagctacttaaaataattaatcgtagggtctacaaccatttcaatgctgaatgaggatgaatgcattgaggaaaaaaatctcctatcatatatatgattttcaatttagatattgtattaattttgtaaagattgcaattcaactaccaaacttagaatgctatctaattcatcctttatacacaagtacacaactatataaataagagagaattttgctctaggactaaaatatataaaaaatactcaaacgggtcaattaaaatg

SEQ ID NO: 8633 - DNA, 3000 bp, Unknown; identical to SEQ ID NO: 8632
  misc_feature (1)..( 3000): cDNA_ID_1821756_gDNA_ID_1971822_Annot_ID_176229 3000 nt of promoter + ATG

SEQ ID NO: 8634 - DNA, 3000 bp, Unknown
  misc_feature (1)..( 3000): cDNA_ID_3045814_gDNA_ID_1971822_Annot_ID_176220 3000 nt of promoter + ATG
agattgtgagagaacataatgagctttttttcatctttgagtgcatggtaaaggcgatctccgcttttttatcttctgtaggattttttagtctgatgttagagaatatattctcattgttcttggataatgatttgactaggatcacaatctgtaccatataatgaaagaaagggaacgacctttttctgaaggagaaataagaagttttatgtctcagatgctgcaagggctcgcacacatgcataaaaacggttatttccatcgagacctgaaacctggtatgttttggtactttgtattgtattaattgaaatggttttcgctctttgaatgtcttataaacaagttttgttctgtttctgaagagaatttgctggtgaccaacaatatcctgaaaattgctgactttgggttggctagagaagttgcatctatgcctccttacactgaatatgtgtccacacgttggtaagtgatttctctttgatattgccttcgcattcatgcatgaaagtatgtggtataaggtgatatcgacgtataccttattattggctctgactgcaacaggtatcgagctccagaagttttgctacagtcttcattatacactcctgcagttggtatgtttgcgaaatccttttgtgcctcatcacatttcattagtatcatgtgatcatgtcaaaagtctagctaaaccatggctaatacttcgtggctttgaatagtttaagacattttttctttctgttttgtcatctattggatcgctttgcaaatctttatagactaacatttaaaagaactgcagacatgtgggcagttggagcgatactagctgagctttacgctttaactccgttatttcctggtgaaaggtgaattcatttccctttcaaacgatactagctgagcttaatctgtgtgcacacttaagatagaccatttagtgaaaactgatataatgatttctttatgagtagtgagatagatcaattatacaaaatctgctgtgttcttggcaagccggactggaccacgttccctgaagcgaaaagcatatctcgaattatgagtattagtcacacagaggtaagagttcttaatgaaaagataagaggcttattatattaactgcacttcaatattgactttgttctttgaatatcttgtgacagtttccgcagacacgaattgctgatttacttcccaatgctgctcctgaagctattgatttgatcaatgtgagttcttgtgttcactctttttgcggatatttcttaccattcttaagaatgttgtgatctttcaatatctttatttcgtatatcatctgtttctttttttgaatcaacagcgactttgctcatgggatccattgaaacgaccaactgctgatgaggcactaaatcatccatttttcagtgtaatttgaatattcccttgcttcttttgattttatcacacactcctctctttgtaataatcgaaaatgtaatgatatattcggaacagatggctacgcaggcttcatatcctatccatgaccttgagctgaggcttgataatatgggtgaggctttatttttctttgttaatctgcttcgtatagtatgctttcatgaccataagattaagttcaattatatttgtggtattctgcagcggcgttgcctaatcttgagctaaatctctgggactttaacagagaacctgaagaatgttttcttggcttgacactagctgtgaaaccaagtgctcccaaactaggtaagtatcattccctcgtgtagagttggtcactagatctgacacaaattgacattgacattgagcatggtttcaaatattgtttgcagaaatgctccgcaatgtatctcaggacatgagcgaggtaagctcatacgcaatgaacgtcacttatatagcattgttaaacttttcatgagttgtaataaatctgttgtttacaaaagcagaattttctcttttgccccggggtcaacaatgatcgagaaccatcaggtgatgaaaacttgagcatatgttgataaaactgcagatttctgttatatttctctgtgaaaggttgttgaatatctctctttgaacatttacagttttctggtctctgctctctcctgatgaaaacggcctccacgcgccagttgaatcatctcctttatctttgtctttcaggtgagattacaagttgtctctatggatccattaatgtgtaaacagatttgcctaatgagaaacatttactgtgagcagtccaatgcagcaacacacagttggacctccacagtcgagtggcttcacaatgacatcatcaatgcaaccgaatatgttggaccgcccgtggatggccgtgtctgcgccgtttcaacaaagtcattacctctgatctaataaacccataccctagtaaaaaaagtaaataacacagaggtttgtcagaaagatttgagtttaaagaacaagatagcaaaacaaaacagaggaaaggtgttagaattttcattttttttgtcaccaatttgttcttaatttgtaaaaatttggtttggctgatgcattttcctctcagagcttgagctctatcaatatcgaacaaataatttccttattcttgtctctgtataatatatgataaaaaaagacattgaaatcttgatgtggcattaccataaagaattacgtttcattaatgttggttctgtcgtcttttaatataaaagtctttaacttgtgaatctgtcttatctacaagaaaatttaagactatatttattatgttaattacgatacttattttaatctatatttagtaaagcgaacaagtcctacaaacaaaccaaagatattgaaaaaaagtcactttggagatagaacagaatataaaaaagattctttaaatgatcttttatcaaaacaagattctaacaagtcttagaaatctcaaaacgaagaacaagtaagaagcttgtagcc

SEQ ID NO: 8635 - DNA, 3000 bp, Unknown
  misc_feature (1)..( 3000): cDNA_ID_3089827_gDNA_ID_1971822_Annot_ID_176219 3000 nt of promoter + ATG
aggctactagattacatgataaaacacaatcatgattgtaaatgattttcttcatttctgatgcttacgtagtcactagcggtttctatatggatctcgttgctctgggaatctatggaaaatttgagtacagagaacacgccttttaagctagataatgtgattgagattatgtacgaaatgagagaatgaagaaaagagacgatggtggtgagagtagctcacaaaagaggaattattagtgatagttttaaattatttctctgtttttgtcgattggattggattgcagagtccactagattgcatgatgcatctcatatgtgaagtgtctctgattaagtgattattttgtgaagttagtgttctcatgtgtgtattttttttctgattaaaaggtaacattatctgtttttgtagtgtttttttcttttttttttcttttgtgatgcattcctgtatgtgtattctgtactcttttgatgataaatacgtggttatctgaatatgttctcagcatgttcaagttccggttccaacaccaaagagtaatgaggtttgcctgaaattagaagctactagtctaaaccctgttgattggaaaattcagaaaggaatgatccgcccatttctgccccgcaagttcccctgcattccaggtattctaatagctttgaagattttagtttctgtatagaagaaagaggttactttgcttagaggtcgttgagtttggaacctttgatatttgttttgaacagctactgatgttgctggagaggtcgttgaggttggatcaggagtaaaaaattttaaggctggtgacaaagttgtagcggttcttagccatctagtaagttttttcagacagacaagtagaaactttaattaccttgaaacatgttaagggaaactgattttgttctttcagggtggaggtggacttgctgagttcgctgttgcaaccgagaagctgactgtcaaaagacctcaagaagtgggagcagctgaagcagcagctttacctgtggcgggtctaaccgctctccaagctcttactaatcctgcggggttgaagctggatggtacaggcaagaaggcgaacatcctggtcacagcagcatctggtggggttggtcactatgcagtccagctggcaaaacttgcaaatgctcacgtaaccgctacatgtggtgcccggaacatagagtttgtcaaatcgttgggagcggatgaggttctcgactacaagactcccgagggagccgccctcaagagtccgtcgggtaaaaaatatgacgctgtggtccattgtgcaaacgggattccattttcggtattcgaaccaaatttgtcggaaaacgggaaggtgatagacatcacaccggggcctaatgcaatgtggacttatgcggttaagaaaataaccatgtcaaagaagcagttagtgccactcttgttgatcccaaaagctgagaatttggagtttatggtgaatctagtgaaagaagggaaagtgaagacagtgattgactcaaagcatcctttgagcaaagcggaggatgcttgggccaaaagtatcgatggtcatgctactgggaagatcattgtcgagccataagagcgttgtagccatctttgactgtctgtgaatgtgataatagatgttaaaagtttgcgtaccgtttacagaatgttttatgttgttttgtttaatatacccgagtatgtcgaaagttacatgaaaagaaaatttggatgaaataaataatacttgttaggtattttagttttaccataccgctgaagttgaaccgaaactgagcatggaatcgaataaaacagacccaacaacatcataaagcccaatagcccattaacgacttcgtcaattcccctatcttaaaaagactttctccagtagaatcttccggtaaataaaacaatagtcgaaggagatttccgtcatttcaaatggtaagaaaaccagaattatttaatatcactctcttaagggaccaccgttgccttccccaccacaaccaaccattttcctccatttttttctttttccttattaatattttaataataatacaaaaatcaataattatcttcttaaatatttaatttaattaattaattatgtatttcgttcttcttcttcttcttcaatttcttctttcttctcccatggcttcctaaacaatctgctattcctctctctcttcttcacctatagtttatctctttttttttgttttggcttctcttaaattcactttctctaaaacataaacgacattgatgtttcttcatcagatcctttaattcttctccaattctcattctccttacatcaatggtgagaatttttttttatagattatgtttttaattcttgtgttcatgtaagatttttttttttttttttttttgtgttttattgttttcttaattccgattggatttgttttttgtttatttttctcaattttatctcaatttcttggacaaattgatctttttttactctacaaataaataaagtttgagactttatagcagaatcttcatatgtagcaattgaagatttttttttcttttctaaaccgatctaaatagattaaatcatcattattgaaaacaaaagattttgtttttattttgattaaatcctttttttttttttttttttttgcagataaactttgtagttggagatttgttgtggatgaagattattgattgcagcttataggaagctgctctttttgttttgaacaatgttgctaacttttcagattcttataattaatcagtcttatgatgagaagttggttcttgattacatactacaatcaagaagtaaacagtttatgcaatcttgtgacggttcttgtgttcaaagagtagatacttgttcttcaaggtggaggttaacagaggacaattgacggggtttttaatcgttgttgtattgctcgaataaacggaatc

SEQ ID NO: 8636 - DNA, 3000 bp, Unknown; identical to SEQ ID NO: 8629
  misc_feature (1)..( 3000): cDNA_ID_2050038_gDNA_ID_1971822_Annot_ID_176216 3000 nt of promoter + ATG

SEQ ID NO: 8637 - DNA, 3000 bp, Unknown; identical to SEQ ID NO: 8628
  misc_feature (1)..( 3000): cDNA_ID_3000057_gDNA_ID_1971822_Annot_ID_176210 3000 nt of promoter + ATG

SEQ ID NO: 8638 - DNA, 471 bp, Unknown; identical to SEQ ID NO: 8627
  misc_feature (1)..( 471): cDNA_ID_1989503_gDNA_ID_1971822_Annot_ID_176202 3000 nt of promoter + ATG

SEQ ID NO: 8639 - DNA, 3000 bp, Unknown
  misc_feature (1)..( 3000): cDNA_ID_1821748_gDNA_ID_1971822_Annot_ID_58355 3000 nt of promoter + ATG
attaatcaactcaacaatctcattccttttctcctctaacttcaaccctaaactccaattctcaaaatcacttaaatcatcaggttctctaacaaacgtgcctttatcagattgtaacgcaagtaacatcatctcaaaacgacgataaggtttcaacgacaaaacctgatttgtacggtcacgattcggttctaaagattccttaccacgagaaataatcttagccgttgatttccacacggtggcgccgatatcgtcgataacttgacctaccgattcgagagattccgaagcgacggaggcgccaatttcgagagaatcaggtaatcttgaagctactcgtcggattattgaggtttctttcttcaattcggatccgaattcgaccaaatcgcgacggtaggatccgattacagattcggattttgtcgatagggttttgattagattgccgaaactccatgaagaagaagaagaagaagttgtggattcatgcataggtgaatcggagctatgttgatgatccatgaagaagaagcacaaggaaactaggttttttttaaggaagtttaatttcgtacggaaactataataaataataatgaatcgatgattactggttctgttttaaaagtcagatgtcggtggcatgtgttttgtatgaacaataaaatatattaaacggttcacttaaccgagtaataattggaaatttgtaccaaaccggttgaattattttagaacttttgccttttttttcttttatacttgcgtcgcttatttgccatcgaagaaaacggttggtggagattattctcgttgcaggctggtccaaggctaaagcccgtaaaacatgagttttatgcagcaaatgactataacaaagtttaggagtatcattttacagaaatttattgtggtagattggttaatagctggattctctctacaaagatgatgtgtttgaaccttcattattacattatgaatatatatttttttaaactatatttaatgatggaataaaattgtttttgcttcaggtttactttgggtcggccctgtcattgcctcaacgtctaatgagtctagaagagaagtcgttgtcatcgccgtctcttgtaataaatgcctactttcatatggatttccctccggatcctaatatggacatttatcctagtagtgacaaacatttttcatgtggttatgcatcaggtttgatctatttctatagtttgtcgatcaaattagacgagtttcattacgatcatgggcctgtgatatataaccttccgatcaagaaatccttatgtcgcttcttcagatgtggtttgctactgccactacaagatacagaatcatctttgttgttctctgttgcatcatggaagaaatattcttctctcatcgtacaagatgagcatcgtagaatctcatcgtacaagatgagcatcgttttctacatgtctacgaaagagtgtgctggttcaactcccttaattgagcttatttcatcttaatgtgataatgtcattgttatgggctgttcaagatatgggcctcgtgaattaacagggccacaaaggcggtaaaataagcactatcgcgtgcacaattttaatctttaaattgccgttgactcaacaaatttgacccaaaatttagtcaatgtttactaattcatagaaaaacgttaaacaactcgattaaaacctaataagctcataaaatcctcaaaatttctctcaaactaagaagtctatgtgattttttctcaaaatcgattgataaacacatagaaattaaaatcaaattcgcatattttgatgagagtatgatgaatagatgaataaagaagcttctaattcgaatgaatgaattagatttacagagatcttagattttaatttgagacaaattttatgattttctgagtttattaggttttaatcgagtaagttatttggtatttctttcctgcaccgctacccatatttttttatttgtttcctgtttactttttacttgcctatcacgatatttattcgcatatcttaataatctcctttccttgctcaacaagatattaaatttgtgtccactcatgtttccgtatcgaatgccaatcaacattttctttgaaaatgtttgatacttaaacctttgtgaccaagattgtgtcatggttggttgggaacatgtttttcaatgatccttttgtccactgagtttctccttcatctttgaatcgtaagcattgtaacatggtttcggagggatatctccttggtttaagctgatttgtgatgttaaatctagattgacatacgtttccttggtttgatgttgtatataaaagaagttgagtattatagtttattattatcaatacaaaaaacggcttatcacgatattttgtaaaacacgttcatcttagattcatttcgatatttgtattggtagactgaatggataaaccacgacataagccttggaagctctttaaatttgttgatttttgttgataatttaggtttatttgtgtttgttagttttagatgagctaattatattttgtttcgtattgttgattaaggatgtgaaattggtaatgttggtagatagattggacgattgttggtttcttgttatggaccaaagtttttaagcaaaagtttccttttaacccaactctctcttagagaattaggctaactgttggagtttggttctttcattaagaagaagagaccttatataggccacaatacattgtgtaaaaagaaacctcaaacctaattctaaaagtaaaacttccaaaacccatgattaaaagaaacccataacaccaaaactaattaattaaaacgtcctaaccgtggcctaatcaatctaaccatagtctcgtatcatttttcttgtggtgtagagacgcgagggcattgcaagagaaggcagctagataggcaggacaatcaatgggaggagggaaccatg

SEQ ID NO: 8640 - DNA, 3000 bp, Unknown
  misc_feature (1)..( 3000): cDNA_ID_1024383_gDNA_ID_1971823_Annot_ID_58357 3000 nt of promoter + ATG
ttactttttgcatgcttacataattggctgtggtaacaataacatatactgcatcctacaggtatggatgtatcttgctgtaccagttttactctatgttggtgagaggatctttagatttttccgttccaggctttacacagtcgaaatctgtaaggtaaaatctcacttacagttacattttgaactgaattacatgaaaagacacattgtcaatcatctactattatctctataccaactcaaatgatttggtttcaggttgtaatttatcccggaaacgttgttgtgctacgcatgtctaagcctacatcatttgattacaagagtggacaatatgtatttgttcagtgtccatcagtatcaaaatttgagtggtgagtgttttatagggaaccaaaacaagcctaatagctttccttgcaatcctagaacatatacaaactctgttctttgacaccacaaagactaacttaaagattctcggtcctaaactccatctccaggcatccattttctattacttcttcccctggagatgattatctcagcattcacattcgtcagcgcggtgattggacagaagggattaagaaggcattctcagtggtatgtcatgcccctgaagctggaaaaagcggacttctcagagcagatgtaccaaaccaaagaaggtgcataaaattctttaaaattcaatatattattctcagaatgtgaattttgatactctctcttgtaatatagttttccagagctgttgatagatggaccttatggcgctccagcgcaagaccattggaagtatgatgtggtattactggttggccttggaatcggcgcaacacctttcgttagcattttgagagatctactcaataacattattaagcaacaggaacaagctgtgagtataacaagcttaaaaaccttgttgatgagtaacagaatctcaactaaacttttttggagttatgttatattctcaggaatgcatctcaggtagttgtagtaacagcaacatctcgtcggatcacagtttcagttgcttaaactcagaagctgcgagtcggattccgcaaactcaacggaagacgctgaataccaagaatgcttacttttactgggtaacacgagaacaaggctcgttcgattggttcaaagaaatcatgaacgagattgctgattcagatagaaaggtaaaaacaatacacttattcattttaaattcaaaagattgtatgatttcaagttactcactgacgtatttgtcttgtgaacaactacaagggtgttattgagatgcacaactacttgactagcgtctacgaagaaggagatactcgatccaatcttctcactatgatccaaacgttaaaccatgccaaaaatggcgtcgacattttttcaggaaccaaggtaatgatctttaatgattagttgattactttatcacaaacaacactcttttctgatcttgtataacaacttttggttattttaggtaaggacacattttgggaggccaaaatggaagaaagttttatcaaagattagcaccaaacataggaacgcaagaattggtaacacacagaaacatcagttcactgaaatgatattcgatatcgcggtgtatatttgccttgtctgaagaatgtttttttgtttgttacaggagtgttctattgtggagttccaagtttggggaaggaactttcaacactctgccatgaatttaaccagacgggaattaccaggttcgatttccacaaagaacagttctaactggtaaaaggattaatcccccacgattatggttttttgaatgaatgaatcaatgttcatgttcgttctcgtatcctacttgttgtgttttcttttcgttttgtgtatcacaaataccaacttttaaccatttcatctagagtaggactgttaaaaaatgtaaaaagtcacagttaaagcttgtgaagaaaaaaagagtgtaaaggagtaaaaatgagaaattcaaacaaagggggatgatgggatcattgggatgattggttctgtctgttcaattgttttcaaatttgagcacttattattgggcctgtctttgagctctcttattattatgggccgataactagtttggcccatttggttatcaacttgaaaatgaatgaagaaagctggggaaaagggtctttttaaacccgaactgactcaaaagcctcaaaaatttcactgttccttggttcttgaccggtttagaatcatggtttcggttttgaatcatatttgctttcttggacatgagaaagtaactgggcttcatcattgttttagctcattgggcccatattacgactcgagctaacgctgtcaagttaaatgctttttcactttctagagcattcttttttaaacacttcttttaaccaagagacggttcctacttctctaatatttttattttctagttttttggccagcagcaaaatattattttaatttagtgtcaagataattaaattatcattgtcttttgaatgcagaccgaaagtacatgagtcacataagcaagcggctacgattcaaccacgtgtcacatgaccaccggttcgaccgtttctttgtccagccgcgtgacacctgaaccagaaaagtttaatagccattttaataacagagccgttaattacacgtgacttaaaaagccgttatccttaacagcgttaacatctcggtcctgtgaaaacactttttatatgtccccacgacatttatcttttcctaagcatcgctctagttaaggaagcagcaggtttggatccgaaccaaccaacggatcagatcagaaacaaaatattcaacggctcagatttattctaattttcctccttttattgttggttttttcattcgacttcgagatctttcttctcagaggtgtaacgaaaacgctagaacaataactttgatcgttcttcttcttctcttgaatcggaaacaatg

SEQ ID NO: 8641 - DNA, 3000 bp, Unknown
  misc_feature (1)..( 3000): cDNA_ID_1814302_gDNA_ID_1971823_Annot_ID_58358 3000 nt of promoter + ATG
gaaatcaaaagagagaactcaaggaataaattttagctttacctgatgagctcggcatataagatcaaggtcatgagtttgaaggaactcagctactttgtcagccccaaatgtataagagacacctctgtcattctccccccagccttgaatctctctgtcaggatcagcccacaacaaatcacaaagaatgccctgatcaggaacgtcaataggacgaggaattctcctgatgtcatctaagctcttaatatcaggcgatagtccaccatgcatgcagaggatcttatcatcaatgagagcagaaacaggcagacagttgaagcactcggtgaatgttttccataagcgaacattatatcttcttttgcattcatcgtagaatccatatacacggttgattgaagcacattcgtgattgcctctgagaagaaagaagttgaacttgtatttgaccttataggcaagaagaaggcatatcgtctctatgctctgcttaccacgatcaacataatccccaagaaacaagtagttcgcagctggtggataaccaccatactcaaacaaccgcaagaggtctggaaactgaccatgaacatctcctgctcatcaacatataaacttaaaaccatcaacaaaattacaaatcatacagttatgatagcaacagaagggtttaatatctatcatacaccaaattcagcaactaaacaaaactattagctatcaaatgaagtaataagtcaagcgagataccaacaactgcttatgcaacagagctaagggaccatggttcctcaaagacacaaaagtaagaggtcactactcacaattccgcaagaaacactaacttaaagtggcagagcatttaactaattcacaacatacacatcttcaaccatttcaatgtacacttatatcccaaaaatctaagctttaagcttcccaaacaacaaacttacaaagctaaacccttacatcaaaaaatgtaaaattgatcaaaaacccacaacacaaaaacgaattcaagataaagtaaacagagagaaacatttctctattcagtaacattaccgcaaatcttgataggagcctcgagctcgaggagattaggctgactgagaaaaacctcttttgaagctaaacatagctgacgtatctccgtctcagtaatctgtgcttgcttcaccgtccttccattattcgtcgccaaaagccgtcgtattatatcgtcaagtaaagtctcatccatcgtagcaacaaccctaatttctctctaacgcacagaaattagataccggaaacttctcgtctaacgaatccagagagatccgacgattgttttaaccgccgacgtctctgggttcgtatcgttgacggagaagaagatacagagagcgttaagtagagagagggagagagacccaaatttcgtaaaccctagaaacttttataataaacgcggtaataattatttttcatcatccaaaactcgaagccaaagaaaggagcggagtggtcacgtgacaagttctcagacgcacgtgcgattgttgttgattagtctgcatccagttatgtggtttcatttggttcaatttaggttaggatcggttttggacaaaaacttataataaaaataaagataactaactaattttaattcatattatagttttaatatacttaaatttaaattattatattttgtgaatttagttaaatgggttggttccaaaaactttatatacaaggcaaattactataccggttaggttataaaattaatttgggtggatctcgattcgataatgttgaccctccttaatgtatgtgttgaatgtattatgagaattatgttattttggtttaaattgctcaccaaaatacaatcttaaatgtatttgtgtcatataagtttttttctctcttaattctctcaaatcttttagagataaaaaactttgaatcttgttactatcttttgctaatccgattaacatcgggctttagatttcgttttatgttttagcttttcgtcttcgttcgtatctatctccgacttattgtcggtttatcttccaaactttgtttcggttattagttttaatcacatgtttttatttttggcggaaaaatcacgggtttatgttttttaaaaaaaaatttacgagtttactttttctcaattttatcgcttatatatttaagaaatttggaaaaataatgatttattaaattggtttagatgtgttggttaaacttaaattgacattggtttagagattttaattagtttaattcaattttacaaaacttgatgtgttaattgggtaaaccattgaaaccattaaccattacaacccaactcattttactcatcaaaccaattaactcatcaactcatttgacccattaactcatttgagtcaaaattttcaactcattagggttcatggattgagttgagttgagacattttgatacctctagttttaaacactaaacaaaacaaatacaattcaaattcaaattatttagttgtgatatagattttaaccaaatgaattgtattttattgtttttatattttaaagaataaaaatcaaatataataattatacattaattaatatataaaaattcaaaacattaaatcatatatatttttaatatgctaaacaaattaaatttttttaaaaaaatatataatttcacaacaacagcgagttaagtataattaaagtgtacctaaaacatgcacaaaaatatagtataattttttgtgtcgtaactcgtaaatatagtataatttaaaaccgtatttttagaaaccaaacttatttttatattttcgttctgctttggtaatttcctctggtcgttcctttgattagtacaaaagacaaattttataataaacacaaaattcaaaaactgtatttattcagtcttctccctccttggcttctctcctctcctcccaacaaattcaaaatg

SEQ ID NO: 8642 - DNA, 3000 bp, Unknown
  misc_feature (1)..( 3000): cDNA_ID_3100683_gDNA_ID_1971823_Annot_ID_58359 3000 nt of promoter + ATG
ctcctagtcttgcattggttacaaggtagacataagaaagaataatatcaagaccaacataaccaaccaaaaaaaaaaaacatgtagctctataaaattaagcaagagggataatacaatactaaaacatataaagataatgggactcatgtaagattcattagtcaatgctgattagaatactaaacaaagaagatcgaacaaaagtaaaaaaaaaaaaaaaaacctcttttacttcattctctgtgattctaccatctccatttttaaccctgcaagtttcaaaaagtgaaaaaacaaatcaagaactttagctacatgttgatcaatatgtttaacaagatttgatgataattgataacaatacatgttgaagaagatttgaagacgagaatcgaagctttcgtctgtaatttggtaccaaaactcgtataattcttgaagattgatcttatcaaccattattcttcttctcctacacaatgcgtcgaacaactcgtctgcaaactctttggaattttcattctccaaacctttcaaacacagaacaacaaaatttacaatctctatcgattctccagagtcaaactcaatttcaaaactgtgaaaatcattatgtcgaacctatgcaatgagcaaaatcacttttgaaaagataaccatctttagaaagatgagcgaaattgttttgaacatcgttccaatcaacgattccattttctttgctgcttatgaatttcaaaccatgaatcgctctctctgtacccgatccatcccgattaggtctagttggtcgctgagataaagctcgagggagattaaccgaatcggtaatttcgcctctgtgtggaaccaccggttccggtgcagaccgagacgaataaccgtaaccacgccgtgagatcttctggatctgctgctttgagttcgtccccgccgtcagtctctccgacgacgcgctccatcctaagctaagcgaccttgatcctgaaccggaatccgagcaagaggtgatctctagatcggtacctgaaatatcggtgccggttccggtaacggagtcgatgtttattattacgccgcttgggaattcgattgttacttctaggagctcttcgccggaggaggaggaggaggagggtgagggtgagtatgttgctggtaaggatggaaagctttgggtgaattctccggcggaagctaaatcggagccccaacgatcgttgtgagtcccgccggaaaatgacattgacattttgaatttgttgggaggagaggagagaagccaaggagggagaagactgaataaatacagtttttgaattttgtgtttattataaaatttgtcttttgtactaatcaaaggaacgaccagaggaaattaccaaagcagaacgaaaatataaaaataagtttggtttctaaaaatacggttttaaattatactatatttacgagttacgacacaaaaaattatactatatttttgtgcatgttttaggtacactttaattatacttaactcgctgttgttgtgaaattatatatttttttaaaaaaatttaatttgtttagcatattaaaaatatatatgatttaatgttttgaatttttatatattaattaatgtataattattatatttgatttttattctttaaaatataaaaacaataaaatacaattcatttggttaaaatctatatcacaactaaataatttgaatttgaattgtatttgttttgtttagtgtttaaaactagaggtatcaaaatgtctcaactcaactcaatccatgaaccctaatgagttgaaaattttgactcaaatgagttaatgggtcaaatgagttgatgagttaattggtttgatgagtaaaatgagttgggttgtaatggttaatggtttcaatggtttacccaattaacacatcaagttttgtaaaattgaattaaactaattaaaatctctaaaccaatgtcaatttaagtttaaccaacacatctaaaccaatttaataaatcattatttttccaaatttcttaaatatataagcgataaaattgagaaaaagtaaactcgtaaatttttttttaaaaaacataaacccgtgatttttccgccaaaaataaaaacatgtgattaaaactaataaccgaaacaaagtttggaagataaaccgacaataagtcggagatagatacgaacgaagacgaaaagctaaaacataaaacgaaatctaaagcccgatgttaatcggattagcaaaagatagtaacaagattcaaagttttttatctctaaaagatttgagagaattaagagagaaaaaaacttatatgacacaaatacatttaagattgtattttggtgagcaatttaaaccaaaataacataattctcataatacattcaacacatacattaaggagggtcaacattatcgaatcgagatccacccaaattaattttataacctaaccggtatagtaatttgccttgtatataaagtttttggaaccaacccatttaactaaattcacaaaatataataatttaaatttaagtatattaaaactataatatgaattaaaattagttagttatctttatttttattataagtttttgtccaaaaccgatcctaacctaaattgaaccaaatgaaaccacataactggatgcagactaatcaacaacaatcgcacgtgcgtctgagaacttgtcacgtgaccactccgctcctttctttggcttcgagttttggatgatgaaaaataattattaccgcgtttattataaaagtttctagggtttacgaaatttgggtctctctccctctctctacttaacgctctctgtatcttcttctccgtcaacgatacgaacccagagacgtcggcggttaaaacaatcgtcggatctctctggattcgttagacgagaagtttccggtatctaatttctgtgcgttagagagaaattagggttgttgctacg

SEQ ID NO: 8643 - DNA, 3000 bp, Unknown
  misc_feature (1)..( 3000): cDNA_ID_1814295_gDNA_ID_1971823_Annot_ID_58362 3000 nt of promoter + ATG
aagatttgtcagacttttttttaacaaaaaccagaaaaggggattttaagaagatcaatactcccacttcttgagctccatgccatctggtggagtgctctccactttcttagtcccaacttctttccagtttgtcgacagtaccgtcccattcgactctgcctgtcaaacccaaaaaccacccgagaggaaaatctcattagtcgaagaacaaagcagagttattaaaccaaaattttaaagaccaaagatagatttgctcacaaatgatttgttcattgcccgcctcatgtcttcatctgcactcgagtatatgtcgctgaaaaatttgttcatagctgcatctccatcaagcttctcatccttctcctgcgaaattcaaaagtgataagcagaaagaacaaagtacagcaaagcctctagtgttaaggatgagaagttagcgtttgtggaacctgtttcttcacttcagcttccaacttgtcccagtcttttgctggcttagaagatgggtacactggtctctgcgacagcgctgcatatgcacataaaatcaaatgagaagagagagagaccactttgggttcagtttgtttaaggttttacgattgtggttcagaataaaatagtaaacgtaagctggtatcttctgagacaaacctgatgagacattgggtttgggcaaaacactttgccctttaccatattcaagggaggcccaggtgattatctctgctttcgcaagacggatctcaactttggtcgacaatacttcaaatctgcacttctctggtattatctgaaaaacacccatgaagaaggatttagtaaaagtgtgtgtgaaaacaccgtaattacatatgtcaaataaaatataccttcccgaacaatctcggctggagatgataagcttcctctccagcaacatcaatgacaacactcagctgcaccaaaataaagccaagatagacatctcaaatcaatacagtgttaaattacaaagagagatagtttctgaagttcagataaaagtcatgaattctctgattgaaggatactcacaatctgctcaccaaactcgacagttacgttctccttaggtacttttttggcgaaaattgtcaccaccgcttcttctggtttctggtagaactcgtgcctgttgagcaataaagttatgagtataaaatgattctggaaattaaagaagaatttacatgttagataaccagactacctgaacatcggtttggcaggtgctgcaggaattggaacaggaggagcatcagcttccgttgctagtggtgttgtagagcttgaaggcaaactcggtggcatcggctgaaccaaatctttctcttcttctgaacagagatacaaagactatatcaaaattatagccctaggcgcagacaaatacccaaaatcgtttagtaactaatttcttaagctatggagttgatgtaacatacctgcaatacgaagatcgcattcatctatcatcttcttaaactttggttcattcggtgcaacagaagctcccttttccagggctgctttagcagtactatattcttctagcttcatacaagcagtgctgcgaacacagtagcaaagaatcagaagatagaattataattccaatcaaatttgaacataacatcaaatcattcactacagagagatggtgaaaatatcatacccctttctgagataggcttttgccaacgttggctccaactcaatggctttgttcgcatctacaacagcttctgctcatagaaaccacaaaaagataaaatatcaaatcaaatcatcaaacaacaacaattcaatcaaagtacagtaactacaattacaattactcaaataagttttcttatccgaatcaacaacctcacaaaagaaaccctaaaactaaaactaaaccaaaccaataacaaaaatcaaaactttgttccactatcaacagatcgaattaaagtaacgacaaaagaacaagacccagaaccccaaaagcgtcaacgaagcaatacatctaataaagtttcaatctttaacgatgatattaacggtaaggaagagagttatatttataccagtgaagttatcgattttgatgttggcctgagcacgatcggcgaagaaggcggcgcaattgggatccaagtcaatggctttggagtataagtcaacagcaacatcgaagtcatcatctagaaaagcttctttagctttctctgctaattccttggccattgattcttatcagaggatttgagagaacacaaacaagtcagagagagagagagattatagagaaagagaccgattctattcctctaggctttttttttttttgctgtgtttgggattttttttttcttttaagaacgttttaatacctctactaggtcatataaccaaaaacaaaaaggtaattagattttattttattttctaatttccttttgattttattttttaacataagattgattcttgataagtccagattttttaacaaataaattagttgacaaaagaataatactgaaaaaaggaaagaaaactaatggtaaagatatttatagagaactacaataatttaaaataatcattttctactcattttgtttatatcgtaatcgtttactcatagtttagcaaatacaatgtgatttgtgaatttagactatgatatattttaacaagttataatttatatattgactagattaggacccgtcgtccaatacacagatttaagtattttaagttgataataatctagtaaagttaaaatatcaattatcaaacttttgccaaatatttaccttaaaaaatttatttgcaacctcgaaaaatccatctaaatatgtacagatatatttgtcgtgattactgttacgacgtcgtttaccagttcgttcttccttcttctctcaccccgactcgttcactgactcggtcgatgcttgtaccgcttgattcaagccg

SEQ ID NO: 8644 - DNA, 3000 bp, Unknown
  misc_feature (1)..( 3000): cDNA_ID_1814291_gDNA_ID_1971823_Annot_ID_58363 3000 nt of promoter + ATG
cagagttactctctttttctctttttttccattttttccatgttttaccaatcacactgccgttaaattatgtgtcaaagtaaaatataataagttaaaaataattatatatatattaaatcttaaaaaaaaacttaaaccacaatgaaatgacacattaacaacccaaaaaaaatggttcctgattcctactcttttaatacactttgatttttatacgtgttttcgtagttcattcgaactattctaggtagattaaccaaccatatgtaaatgatctagtcatcctcaaaattagtcaaacgctagtgcaatataaatttatgatcttagaccatctccatcaatctaatactgtgtgggtttctcaacaatattattttaatcaatctataataattaaattatttatttaaattttaaattataaaaaaagaattagaccaataatataaagacacgtgaaaagcagttctataagtttctcaacccaagaacggtcttctgactctttcttctacttttttattattttatatttttttttatctccagatactctatcaaatattactgatgaatatgctctaagggttaaagacccccatttctttaaaaaaaatagaccgcctttacagaagccaaattctatttttcagtacatgaagccaatattgaaattattgttttgacttttagactaggaattacgatgcttgtgccaactacgatattacaaatataattttctggtcaaatggaaaaaaaaattattaaaaaaggagagagagatgatttatcgataaaagtaaaactagagacaaaggtcgttgttattcatcgaccacccacatgtaactaactaaaatgagttcatttgttactatgtcaactaaaaccgttgacactatccaaaaataattttgaatctccttgttatgacttttgcttcaaattaagcaaatcagtggaaacttaacataatgattttcgttgagagaacatcagtctgataaaaaaaaagttctttatattcagttaatctgaaaaaactgaagaaacaaaaattacagcaacaaataaaaatacagaaaaaagatatatacatgaacaaagataagtattagtagtacactaatgttttgtttgagaagaggaaaaaaacagaaattagtctataagacaaaagtcgttgagattgtgttggtcaaagtgaaggcttcaaaatcatggtttaacagtttttgatattgactagaaaaatctttgtggaatgttactggtctttaaggctgccaaaaaattcatttatttcattcacgacattaagtggtccaatgtctgccactatcaacattactgattctagctttcatcaataagaaaattttgaaccatataatattcgcattaattcaaaagcattctaaaaatgtagagacagatggaattctacaattctatttaatacaaaagcttacacttttcatttttagcttattctaagctgtcaagtgcttagcattaattgtattgttattatgaatacgtgttttgagtgcattattgaaaagaaggtggagatctcaaccgtctccaatgagtgatttaggagtatatcttaaataatttgcatttttttggtttttgaaattttaacataaagaatcctataattaggttttaaaatcaaaagcaagaacatttctaatattaatgcctattaaaaggggcacatttcaactgttctgacctctaattcttgtttatgccgacatgatgtttgcagtagccagtaatatcagtatttttcaataaactctagctctttaatacaagatcggtaatctaggaaaagccccaattcttacatggatatttttttttgtcatcgtgacgatataaagatgacctaattggcctgacaaaatttacacaaattttattcttacataaactaaaaaaggtgaccaaataatgacaattttatgtgtaatattagaaaattgttattaaaattttcttagcaaatattgacttcgtttttctcaacgatattatatatatgaaattttatgtataagttattacaatcgcatgttctataatttgaacggataacgaaaagcaaaatttagatttcatttataaaataaaaaagaatgaaaattcgaaattcttgtttagcaaaacttttgaataaatgatgtggacaaagcggattaaaccactctatttctagagcggataacaaattacgcttatcaaatttatttctacgtaaaaatgatctgtagttaagctgtcgcagataattttttttttttttaatccgcattattatggattataacttatcaatggtaaccaaaaagcaactcaagccgcaaacggattcgtgcgtcccaagtgtcacaactattcgaactatatatgaagttatgtgtctgttagaactggatttttactattattattactattattattatcatcgattaaaggatgttttttgatgaaaaaaatatattgttctatttagccaacaaaatgaaaagaattccggtccattattttccatcaaatacaaattttaacagattctgatcttgtaaaattcaaattgatgtctcatttcttttccaaatactgaaattggacttaatgttatgtactctcaggtcccccacaatgatcactctttttcacaaatttggttcaaatccactccaaaagatacaaaaacaattcaaactttagggaagtcaaacaaaactataacaaacaataaggaccattttgaaatttctactttcttcagttctttcatggaactttcgttgtaatctatctacaacgctccacatactcggtgtgtacacctgaaaccaaacctctatatatagaacacaatctcacttcccaacacatcaaaccataacttccaaatctcaacagaaccaaaaacaaaagaaacctatattaaagaagaaacaaaaa

SEQ ID NO: 8645 - DNA, 3000 bp, Unknown
  misc_feature (1)..( 3000): cDNA_ID_2999986_gDNA_ID_1971823_Annot_ID_58364 3000 nt of promoter + ATG
ttttcctcatatttcaactagttaatctgaaaattgtaccagtcaagccatcataagaagagaccaataaattaagagtttgtctttatattaaatcacgctttgtatatttttatttaggattttggttgggtgaatattttgatctttagagataggttgttaatatttagacgttttgacaactaattttcctaacgatgaaactagtctaagttttaatgatttttaatcatgtgttctgtttattcttttaatgcttcacgtggatagattgttttcaatttctctgttagtagcatagtagccaaatgggcttagtgtttttattaattagccatgcgagattagctgtcaaatattctgttacaatgcactaattttcaaatgaagagaaacgagccttcttttctaaagggtcactgcaaaaatgcattaacattctgatgaaaaaaataaaatatagtatcagatggactttgaatccattaaaaaaccaaccctcttaaactaacactaggccaccatcatgtttagaattctatattttgaaactagtacatttacgtgttctttggtttcttgattgggatactatagtcatttttaggtttcgttcaaagttgacaatcgtataaaaataaaaactgaataagaagttttcgtgaaaagtaaattaatttagagagaaagttgtgtctgcgtaaagtatccatacaataatggattaatttttggacatatataaatttgataactaacgctaatgtcgttatgttcttgaatctatttaaaatatataagagttttatgtagaatagtgttagaaaatctcagtaacgtggacggtcttggccatggactatggcggctacaaatggtgggagtaggtctatgggtaaaatataataataccataaccagattgagttaaggattatttcttaagattttaaaattatacctaagaattatatttaattgcatgtgtatataaagtgcaaatgcacacatgactctacctagctagctagctattcgcatatagtaaaaagaaaagaaaaaaaaaagtctatgaattgataaataggtttttgaaatttgaattagattgtatatatgacccaacaaaaaataatgtcatagaacatatgatgaaattcgctatacaaattcttttacccaatgtatagtctagttttgcaccatacgtaaatgtttattctttaacgtaaaacctatatatagatttttgcgtttaatttgaactttataagccatacaatacgtaactacattcgtcaagataagttgtttttgttaattatcaacaaccatgatttaaaatatgaaaaaatggttaagggttagatatattttattttttgttaaagcaagggttagatatataatatattacaaataacttcaacttcattaaaatacgtcacatgccatgatttgtctaccaaatacaattaattaacttaccgactttctcgacgaaattaaaaaaagttatcgaaattatcatctgtgtacacctttaattccacgaggaatctatataggctaataaatagccatcgtacgtaacatcaaacaaaatatatactagctttggaatttttgttagtgtcctggcatggcaagttggataaatacaaaggaaggtaataaaaattaaaatagtaataaaattatcacaaattttaggtatatagatctccatatctataacaaacatataacatgttaagaataaataaaaaagacgaaaccaccaagcaaattctaaagatcgttggtttgaatgacattaggaaggaaatgatagtaaatatactagttctcgagaaaatgtagggatttaagcttagaacatcttaattattcaaaaataataattgaaaaccacataaaattataaatcttgcctaatagttaatattgagactaaaactcaaactttttttttttctttggttttacttttttgattatatagataaatggatgatgattaatagttttgttggagatgattttttgctaccaaatatagacacgagttatggctctattgtctctcacataaaaacgttaaacgttctactaaaggtggcatgaatcctatgcattttggaactgacaatattcagttgtctctaatagataactaagacttataactttaatctccatttttttttccgcgaatcaggatcggttatgactaaagcgttaaacagtctctattaggacaaacctaattttgttttccaataagttatttcagttaaccttgctactatcgcatatcgttacccttcggtaaggtggttgggaagctttgatcattcccatgcggacaaaccagctacagttactctagagcactcaacattccatcgaaaaacaattcaaccattaagaagatctccaaaaatctggctcgaacaaacttttaaaatatttgttaattaattttattattcaatctcagttagtatagttttatgtaaattcaactagtcttcatacttattttctatcttcattaagtaataatacattagttttggtagaattagtttttgtctggctttataagctagttagtttaatttacaatattattttcaaaatcatttgattttatctattcatgtacttatttgtttaaattttattaacatttggagagaatctatttttttcttaattatatagattatttaccataactatatcaatatttccttaagaacacattagattataataataacaataagaaaagacaaggcaatagtatctttatgatgataattgaaatcaaacaggaataaatagaacatgtttggtagcttctttcttcttgttctcttctccacattgctttatcctctcacgaccaacactatatataatccctaacttgggaactcttatcctccaaacatagttaaaccaaattttctaagtgtctcataaaaa

SEQ ID NO: 8646 - DNA, 3000 bp, Unknown
  misc_feature (1)..( 3000): cDNA_ID_2991917_gDNA_ID_1971823_Annot_ID_58366 3000 nt of promoter + ATG
caattccacacattgagaattcttatgcaatagaataattaaataaacagtgacaatttaattttcatgcaaacaaagatatatgaacgtacaagtttctacatcaaaatatatttgttaataagattatacaaaactctgaaaacctaatacatggaaaaaaactcaatggtaagagattaagatactaagtgaaagtcattgcaaacatgaaaaggtgaagcttgcttggatcacgaaccaaaatgtcaaaaaacaaattcttgggtttttcattttcgatccaagtaaacttaaccacccccatgacatggttgtcattggttactattaaatgtttaagtaaaataataaattgacttttatgtcaaaaaaatattgaatagtacaagatctaaaatttaaatactcagtgataatcatggctaagaagaaggtaaagcttgcagtgataatcataaaggttttgattcacgatcgattgaggcaaatctcactttcttccatgccatggctatcactcataattatctctcacttagatttttttttttttgttttttgcagtgtgaaaagaaaatcatgcacttgtgatcttatataggaagaatcaaggataagagataaggatgtgggaatccaaatattagataagtataaatctaacaaaatccaaaaatccacacttactattttcttatgttaataccattttagagttaaaatttgtttgaatgaattttttgaaaacttaatgaatagatataggttattttatttgattctcttatttttatcttcatctttccaaatttgtgattcaatttcactttcacttactaggtttgtaaatttaatttacacttatacaactatcgaaccctaaaagcttttatagtcgtctttgaagaagtacaaactccaactctttcttcatttgaatgtcgctccccatttccgtctttttccatgtatatttctttggatgtgatatattgtcaatttttttttttaaggtttataatttactaaacttaagatatgacagggtgaaaccatatatgttttgaaatcaaagcaaaatatatcttgtgcattgttaggtctcactagggtattgatctatgcccacatagtaaaatcatttgtattttgaaatcaaaacaaaatcacattttggataacacattggtattattatatgagatatatagacaactgttgaacactcttaagaacataattaagattaggggatgtgatttggtactggtacgttataatggattgattagatgcaaaaccatatttgtttgatcttttgtagcttgtaaatcaaaacaaccacgatgcaaataattgtaaacgagtttagtgccaagctaaagataaaatacatatataggaaaactcaagttgaaactcctcctatattggtttcctctttggaactaaattgtatatgttacaaaggtgaaactactaaaataaaaaatgaagttgaattattagttgcacttgtagttatcctctctctcttagcaaagccaatcctgagaggagctagaaagtaggtttatttttagagtaattaaacctactgaaaataaaacatagcaaaaaagtacctttatttattagggccacagtaattcactcgccaaccatgttatgggctaaacgttttcaactttatttgctatattgaaagacacccaatatgtaggaatcctaaaacatcacaatatgtaggaatctttgtaaatcatcacatgttttgaaagttataacaaatgattttttttttttttaaaacatttgagccgccttaaaaatattatcgtatacaataaaataattgtagcaaaatcgaaatctctaatcgacagaagttaacgactgaaatatggatttgatgaatcatttagatgtatacaattgtgtcggtcaagttagtgttaatgcacatctttcaacaacagtaataaatcactcttgccaactgattaaacagaaaaatactccgactattttagagcatgcaaaaaagtgagatttagtctgcgaaaatgtacaagagcgaattgtggacgaacccatacctgcttctatcatgatttcagaggcttctggtttcaaatgctatattgacgggtctttgataaccaccaagatttccactagtctcggttagatatgctttgaaaatgacgagacgatgtcatcttgaactgaatgctactattggcgatgttgtggatgttcgaaaatcaagacgttcacgtaacaaaaaaaataaactcacgttccttagctatgacagttaaataaaaataatatcaaaattaaaatatttcgcactataaaaaaaggtttataaactaattttttttgtcattaacataatttcatttgaagttattgtcgttttgcaaaaaggtttctaaataaatcgatcaacacatgctggtgacatttatgatgagtttcaaatgtatgagttttgaagaagtttcaaactcttataagggtttataatgtgggaattaagttttgttaattcgtacgttcaaatataattggaaatgttgtggtaatataaatatttttccagtattcgtacgttcaaatataattggaaatgttgtggtaatataaatatgtttccagtaggggaaaaaaactacaaaagtttcagaaattttcataatgttttgtgactcccacaaattttaacgtgttcgtcatgtagaaaatctttggtaaaagagtgactagggcagtgtcccaagcaacgatgggtcggcacttggtcactccaatggacatgtgttatacagttgttacctatctgagctctaagtactgagtactaaaaaagctgtcatatgttagccacattttacacaacacaaaatccatttttcttctttcataactatcagaaacaaacacaaattaaatcaaagtttcattagttttaaccccccacaaaaaaac

SEQ ID NO: 8647 - DNA, 3000 bp, Unknown
  misc_feature (1)..( 3000): cDNA_ID_1814276_gDNA_ID_1971823_Annot_ID_176274 3000 nt of promoter + ATG
ctattatcacttagagaaaaagtttcacgagtttgtttagctctcatacatatgtcgcagacactgtccaaaaaatctctactactagacaaaaaatcagtaggaatcaagctaattgctttttatgatgcgtgtcccaaacgtttgtgccatagatcatatgaacctttgacacttgtgctcacaactgctgccaactccatacttttaaacaaaaaacttccattctctcttttaccaactccagtcaccgtcctcgtaatgcggtcctgtatcacaagaaagtgatcagcaagctgcacaacacagtaattctcatcaatcatctgtccaacagagatcaaatctgaagtcaattccttgacatagaaaacggatttcagaaccaaactggaaccaaggcgcactgttccttcactcacagcaactcgcttattcccatcagccaatataatcaaaaccggagagatcttgcgcatatcagtcaacagatgtaactttccagtcatatggtgagctgcacctatatctaggatccaagaagagaaattagaacacgtacccgttagagtctcatgtccttgttcgttgggtttgatgttggcttcatcactttttccagcgttcaagagcttgagtacaccacgccactgctcatctgtaagaccattcaccgcatctcgatctctatcagtgataactcgattagcccgttccacagtggttaagccagttgtgacagcattcacataagaggttggagtgcgattttgtcctccattaaagcctagaccgggtttgcctctgcctcgaccagattgtcctcgcggtctatcgccccaccactctgggtatccaatgatcacaaagcagttctccggcgagtgaccgccacgattgcagtgcttacaaacgttcttgttggggaactttgcagaactaggatcaatctgtggacgagactgagtagcaaaagcagtgacatctagcttttcttccttagagtatctattgctcaacatgtcctcttcttgtctcacaatgttgtagacttcttcgagtccaggaagaggaacacgtgatgttaagctagaccgaattgtatgaaattgagtttcatcaagtccatacagaaattgttgaaccatgtcatcttctctacctttctcctgctcagcttcaagattacacacacatcttccacatttgcaggttcgaagaggacgatagttgttgatattatcccaaatcttgttgagttttccataatatccttcaacagtcataccctcttgtttacaagtagcaagatctgccttcatcttctgattctttggaccactagaaacagagaagcgtttacgagtgtgttcccaaagatctctagccacgtcacggtgggagatattcgtcaagagcgccgggtcaatcgtcatcttcatccaagacactagcaaagcattaatcgttaaccagtcctcgaggtccagagattctgacggcggttgtggaatggagccgtcaagaaaaccaaacttcttccgtgagcgcagtgctgttttgaagccacatgcccattcatcataattagtcgacttcaagatcgggtgggagatcacagctccagagttatcagcgaccgttaagtcatacggcgagatcgttcgccggacttcagttacaagaggaattaccggaggagcagccattactccaaaagaaactcaaactttatcgatttcaaatgaaaaaccccagctttagctctgataccatgacaaaatcaagagacaagagataaagataaggttttgtcttgatagcagcttaagtgtttctcagacacttatacaaagagaaagcgtttcagacctaaagggacaagaagggaaaagaccaaaaggggttacaaacagtacataaagcaacattaagcttaagagcaactaattgatgtgctctaaataagataagtagcaatatcttcaacagagagatctttgcttcgttttgttaatctttttgttgggtttgatttggtctttggttagttgcagagtgggaataagctccgcgtgttttggtgtcaacttgttgtcctagtttttagttttgtttcagttagttcctgcaatttctctttcacgtatttgtaagaagactgagtcttcatctttaggctatttaaagccaaacaactatgataataaaacatcgaagcattcagttttagtctctttgttctctcagatcaacacttttgtatgtttatgtagcaaatatgtcatagagatttgaagattgagaaaacactgcttgatggtagtcttgcaccgcttttgaaaatctgtgattacttggctttgatctcataggtcattcattcattagtctctttttcttcttttgtttcagttttggttcccattattacttggctttgatctcataagttttttttttaaggaaacccatttaaggattctacctttggagaagagaatttataaaaacttgacaaaaactctaaccttcaaaattattaatatttgttattaagaaatttaaaggattccttataaaaaacccaccaatggatttgctttaagatccattaagatacttattggaacctggaaccaaatcaaaactcttttttttttttttggttcggttcggttcagttccagttttatggcaaaacctaagtttaggggtaaattggaaaatattcaaaagttttagccaaatatcaaagtttttactaattatcaaaagacacactcgagaaattcataaatgggctaacttttatcagagagcccactaaacaatcggcccgttagccaagaaaatcgtcaccggcgtcttccattccaacatttctccgtcatcgtctctctctctcttttttttttgtgtgtgcaaaacgtctctctctctgtctcataaaatctcagagaagaaacatcgtcgggtcaggtcgaagaaaggagagaa

SEQ ID NO: 8648 - DNA, 3000 bp, Unknown
  misc_feature (1)..( 3000): cDNA_ID_3089558_gDNA_ID_1971823_Annot_ID_176273 3000 nt of promoter + ATG
gataaagcatctagtataaaaacttgaccccacctgcgatgatcatggtcagtactaaaaatgaagctaccaaaagcttatccattactcattttatgcttctcttccccaaagtttatatactgggtcattatctacagataaaaccatcaatgacgaaaaattctaaactgctgtttgaaaatagttacaaagacaacggaatgatatccaaacagaggccataccacatcaaacaagctatttcacaaccatcaacatcccctaaaccctgactggacaatggggccataaatactcaaaatcgaacagaatgcagtgaaactacggaaatggagaggacttactcagtgcattcatttagagcagtaaggagctttgtaagagtggtactattgatctcaaagatggggctactactgttctcttgaatctccgcaagggctgctacagcattggcaacaaccattggattgttatctgatatcaaatccttcaaggcttcaaggaaacctctgtcctcaactaattcagcatttatgtcgaaaagcttagcgacgcaaatagccgcagtcttcctgacatatgggtcatcatcctaaacacaaaaaatatacacaggatagtgaaaagatggactagtcaagatgaaacaggttcttaagggcaataaagatgtttgatatcagattccaatgaagatgtaacattagaaactcaaacctttaggcacttttgaagaggatcacatagatattctgtgattttatcaacacgaatgcagcccattgtccgcacagccaaagcacgaatcagcggatttggatcctgtgaatcctgcagaatacaaaccaatgattttgtaatgatcagtttatcagttcctttccccttcaggttcagaacagaacaaaggaatgccacgtggttttgtttgagttgcttgagtgttacctttacaaaggtatttactgcaagaatagcaagatctggctggcttttcgcataatttatgagatacaagtaaacaagcttcttcaactccaaattttccgtttgcatacaattgactacatcagtgaaaagtgatgaaacatcctttccaacagtcatcgccgcaataaccttcttaactgcatcttttctcttatcctatgcaacagtaaataaacaacaagggttaacaaaactgtagccaaagcagaaaagaaccattccttcttaaatcattaacataaactcttcatccaaatccactgatccagatcgaacaagttctgattcaccaacctaagcttcactaaagttactacgagattgcacacacatctccacattagccattctcaaaaacctaccaattcctctccaattctaacctatatcccaatcagttactgaaaaatgaacggaatcatcgcacttcccacaaaatcacgaaaccaatttcaattcaaaattcaaaatccagaactacacagatctaccaaaatttgtataaggataactaaattacaaggagagaaggatcatcgaccgagagatcgtgaatgtaataatggcggatcacagatccacatggaatgagacaagagtaagattaagaagaaaaaaaaaaccttatactgggaattaagctcttccttgagctcagggatctctcccttcttcgtcgtggagaagtatttcgaatcgtgaccactcatttctctcctttcttcgacctgacccgacgatgtttcttctctgagattttatgagacagagagagagacgttttgcacacacaaaaaaaaaagagagagagagacgatgacggagaaatgttggaatggaagacgccggtgacgattttcttggctaacgggccgattgtttagtgggctctctgataaaagttagcccatttatgaatttctcgagtgtgtcttttgataattagtaaaaactttgatatttggctaaaacttttgaatattttccaatttacccctaaacttaggttttgccataaaactggaactgaaccgaaccgaaccaaaaaaaaaaaaaagagttttgatttggttccaggttccaataagtatcttaatggatcttaaagcaaatccattggtgggttttttataaggaatcctttaaatttcttaataacaaatattaataattttgaaggttagagtttttgtcaagtttttataaattctcttctccaaaggtagaatccttaaatgggtttccttaaaaaaaaaacttatgagatcaaagccaagtaataatgggaaccaaaactgaaacaaaagaagaaaaagagactaatgaatgaatgacctatgagatcaaagccaagtaatcacagattttcaaaagcggtgcaagactaccatcaagcagtgttttctcaatcttcaaatctctatgacatatttgctacataaacatacaaaagtgttgatctgagagaacaaagagactaaaactgaatgcttcgatgttttattatcatagttgtttggctttaaatagcctaaagatgaagactcagtcttcttacaaatacgtgaaagagaaattgcaggaactaactgaaacaaaactaaaaactaggacaacaagttgacaccaaaacacgcggagcttattcccactctgcaactaaccaaagaccaaatcaaacccaacaaaaagattaacaaaacgaagcaaagatctctctgttgaagatattgctacttatcttatttagagcacatcaattagttgctcttaagcttaatgttgctttatgtactgtttgtaaccccttttggtcttttcccttcttgtccctttaggtctgaaacgctttctctttgtataagtgtctgagaaacacttaagctgctatcaagacaaaaccttatctttatctcttgtctcttgattttgtcatggtatcagagctaaagctggggtttttcatttgaaatcgataaagtttgagtttcttttggagtaatg

SEQ ID NO: 8649 - DNA, 3000 bp, Unknown
  misc_feature (1)..( 3000): cDNA_ID_1814288_gDNA_ID_1971823_Annot_ID_176264 3000 nt of promoter + ATG
acaattgaattttttttagatttaatcggaactagacctatgccactaacgatgtttagttaatgttaactgagtgccgtcttggcattgtttgaaacaaatttggtattcaaatcttcaatgagatagtatcatactactaaaaaattgaaacttaggtcttttttggcattgtttccttatatggttaaacattaaatacttacatttcttcttcttgatatatcgtatggtggaggttatatcacctcatttatgttttgtatttaaggatcggtggtggagatctataacatcattcatgtttggttcgtgtctttgtagggagctgttgggagttctcgacacgatggtgacaaggagaatttaacactttgactgagcaagacttgattgattcattctaataaagaaaattatggttgtggaggaggcaaaatcgagaccgcggatgagttcatatataagtagcaatggtggtcttggtatcgacaagtattatccatataaggctgttactggagcttgcgacggcccctcaagattggtagttacaaacttacaatcatagagattaggtatcatgtctaacaaaaaacaaaagtaattcttgaaaaaataaaaataaattgtaagtagcatataataccaagaatgttatgagtgatagtatgagaaccagcctgtgactgttgtcattgattcaagcgatcggaaatttcactttatttatcaataatatatataacattcatatttttcaaaataactatatcttaatagaagtctcacgattcgatacttcgatcgaccacaaccagacgtagtctcgtgtgattgtgtgactaactttaaaaacaacaataatgaaatcaaaacacgaaaatctaattcttacgtccttgttttttaaattctcttacgtcaattcttacctttgcgaccaaaagaacatgttaaatttaaacctactaatttccgatttaaatttcttaatcttgttactatgaaccaaaaattacacaatcttttcccacggaacaaagattatttattagtatccatatacatacaaatatacaatacactcaagccactcatatttcgtacttgatcaagatattttcccccggtaaaatccaatttagaattgtacaacatatatattggaagttccgttgtgtcataccgtcacactaataatacagcataccaataatagagcgcaaacgtttcacattgaatagttcaccacatatcaacttgagtaaattattatgcttagagttgttgtctttttgtttttttattttttttgaatatctggaaattcaaactcaaagaccttacattttctagaggcgggatccacaccagattaaattcatatcctttgggaaagaaatctcttccaacatgcctcaaacccagtatttctaactgagagatttacctacataattcaacaatcatgtctattatgttttcaatttaggatatctaaaaatattgtgaagataaacgaaacaaaacttgagggaaaaaaaacagtcacgtgagtcatgagttataaagcatggataatgttggagatctaattaatctaattgaatgccacatcaaattaagccaatcagtggagaagatcaataataaaagtgaattggatctgccactacacttttagcatgaatatggctaaaagagattggtattggtaatggtatcgttgtcggagattgtcgtaccaattaaataacatgtaattattggatatatattatattgtgtcggcctagtcatatttgatgtgtaagtgcgagtgatttgagttagatatggggtattttacgaggaaaatattgaacaatttagggtattttaagggttgtagtttgagcatcacaagttaattatatttaggttctgcgtaaatttgactcaaaagattaagttatcaaaagaaacctcgtataatatgatccatattaattttcttttttttatatagaaaagttgaagattatgagtaaattggtaaactcgcgatattccagagttcaaaacgtaattttaatgacaatttggtgaatagtataaattaatatattaagtaaaagataacattctattcgatattggtttaatatgtcaactgttatatgtacatataagatgttactgatatattaagtgaataatatgatattcaccaaaaaaaattgtataatgaatgtgactttgagttgaaagtttgaaaacgaagagactataacatttgaaggaatctatggaatacgggtgtggaaccaatagtggaggccctcttcataaaccgagtttcccgagatccaaattgtgctgatggagcggtttctaacgttcttgtcgataatacttgcaagcttggccgaaggaacagaagagttaccatgacgtctaccattacgctcgcaccacaaagtatgaattgattatatggaatacataccttagaatgaaagtatgtagttttggatgagaatcatcaagtagaagaggagagattaaactccaacttgtattgtatctcagtatctgttgcgaagaattcctttagtgagagatgtgtattgataggtgaaaaggaaaaggtctcttactttcatattacgtgggcctcataacatagaccagagctgatagcatacctctctctatattaaatagatgggccaggcccaaacgtttacccatctgtatttattacaaagtacacgtggctgatggacatgtgacgatacgttttgacctattcaaaatattcaaactaatgaaaaagagtcgttgtcctctgacgcgtctctctctatctccttagattttcaaagttttcaacattcaacaaaatcattattttaattttgcagagacgaatcgaatcgatctcatctccaaaaatcttgtattcaaagtttgattttctgggtttcttctgtattatctcgatatttgaaaaaa

SEQ ID NO: 8650 - DNA, 3000 bp, Unknown
  misc_feature (1)..( 3000): cDNA_ID_3089567_gDNA_ID_1971823_Annot_ID_176263 3000 nt of promoter + ATG
tattttattctagccgttgatacaacaaactaacactagccaaagttttgttttctggatcatagtatttaaaaacgttattgttttgtttttgttggatttacaccaagaatagacactaactagtaaggagtatcgttttttaatctacaaacttttgatgcatgttttgttatggtgtgaagggagttgttgggctttctcgactgtgggagcagtggaaggcttaaacaagatcgtgacgggagagttagtcactttgtctgagcaagatttgatcaattgtaacaaagaaaacaatggttgcggaggaggcaaactcgagactgcctatgagttcatcatgaaaaatggtggtcttggtaccgacaacgattatccttacaaagctgttaacggagtctgtgatggccgcctcaaggtcagtatagttacgatttatatataacaatattaaaagaaagaatcaattttgaacttattttccaaaaatatttgtgtaggaaaacaacaagaatgttatgattgatgggtatgaaaatttgcccgcaaacgacgaatctgctctcatgaaagcggttgctcaccagcctgtgactgccgttatcgattccagtagccgagagtttcagctttatgaatcggtaaaagattaattttttgttaaattttcatgtagaaaccttctctaattggaaaaagatttcatcaaattttttaatattttttttatgtcaaagggagtgtttgatggctcgtgtggaacaaacctaaaccatggagttgttgtggtcgggtatggaactgagaatggtcgtgactactggctcgtgaaaaactctaggggcattacatggggagaagctggctacatgaagatggctcgaaacattgccaatccaagaggcttatgtggcattgcaatgcgagcttcataccctctaaagaactccttttctaccgataaaagctccatcgcctaataaaatgagctaaatgtatgttatgcaaaggatccagtgagccagcaacctattcgattgtgaaatgaaaaataatgtagtcgatgggttttgttttgtaatatattttggatttgtatggagggcaatgtttgaagtttgtataatatttatggatatttcgttaggctctaattatgaatgccttctttttaggaagaaatgccaaaaatgataattgaactacatttttgcccctaataaaaatattacatttgagacggacgagattgattagcgattctaccatatttgcaacacccgatttttatcaaaaaatgttacatgcagaaaggtttaaaatagtaataattatgtttttataaaaagaagtaaaataataccaaaaaaaaagttatgcattttttttcatagaaaaattcataattaagtgtattgaaattaaataattttatgaaaaattgtgttattgaagactacaaaagaattgtaaggatatagaggatacacaacacaatgattttgtctagaacgcgccaaacaaacttttttacttattcttattgataataaatcttttacaaaaatcaattatcttagaaataatttgacctattctacatgaatgatcaactccgactaagaagaaatgtatgcctaattctctcttctgtattttctaccacacatctgtgaaaaccaagagaattacaaacactcacattttaggcttttgctaggctttgaagataacacacgtataccaatattctagaatgcttaggtggctcaatgcaaactccataatatttatactatttccagaaccctaacccttaggatctccgagaatcaataagcgggatcttctttgatcttcaagcttatctctttccttatttgttgagaaaaatattcaccaacttaatcgactttcgtctttgatctccacgctaagtcagcaaagctcttcggctcgtcacatcaaccaattcatctctgccatgtcagcttatgcgtctatgtcagcaactcaaccgtctgatgtgatctgatgcagtttcctgatatacaacaatttcctaaaatacaacaggtctctgatgtccatcaactcgttattgttagaatctacatcttcaaaaattccttgtgaactgtagagtcattcgtcgcgtatgaaatttggcgtaaaaagggagactaataggcagaatgtgagtatgggaggaaaaagatggaggtcgccagtacattacaagtgttcataaggtcacactattgggagtaacgggttttggtgcaacaaagataactatttaaaactgattttttaatattgagcatgtacaaaaaaacacggaaaaagattttgtggtgttctagcggatcacttgacaagtatatatgcaagcttttgcgccataatggttttagatgtactttaaaattctgccatattatgttatatatatgagtgttttttgttccatgatctaaatgatgacatttttttttttttttatctaatgcctatctttaaaatattttctggatccaccactaacctcaattgcattcaaaaacgaccaaattggtgtatcatcttcggaaaacacctaaaatatatagaatatcggttcaaaagaatgacctggacctcttttttactcattcacccaagcgaactttgggcatgtttctatacccaatcgaaaatatatcgaacagccaaaaaaacgaatttttagatacaacatatatttgaaaaagttcttatttacaaatcattggtgaaaaatttagacactactcgacacaaatgcatgagtaggtttacccatttgttcacaccaatggacacgttataaataacaattttaatatatctgagcgctgagtactataaatactgtcatgtgttagccaaaaagaacataacacaaaatcctcttctcttctttaataacttttagaaacacaaataaaagtttaattacttttaagcccaacaaaa

SEQ ID NO: 8651 - DNA, 3000 bp, Unknown; identical to SEQ ID NO: 8646
  misc_feature (1)..( 3000): cDNA_ID_2991917_gDNA_ID_1971823_Annot_ID_176262 3000 nt of promoter + ATG

SEQ ID NO: 8652 - DNA, 3000 bp, Unknown; identical to SEQ ID NO: 8645
  misc_feature (1)..( 3000): cDNA_ID_2999986_gDNA_ID_1971823_Annot_ID_176259 3000 nt of promoter + ATG

SEQ ID NO: 8653 - DNA, 3000 bp, Unknown; identical to SEQ ID NO: 8644
  misc_feature (1)..( 3000): cDNA_ID_1814291_gDNA_ID_1971823_Annot_ID_176257 3000 nt of promoter + ATG

SEQ ID NO: 8654 - DNA, 3000 bp, Unknown; identical to SEQ ID NO: 8642
  misc_feature (1)..( 3000): cDNA_ID_4370953_gDNA_ID_1971823_Annot_ID_176251 3000 nt of promoter + ATG

SEQ ID NO: 8655 - DNA, 3000 bp, Unknown; identical to SEQ ID NO: 8640
  misc_feature (1)..( 3000): cDNA_ID_1024383_gDNA_ID_1971823_Annot_ID_176249 3000 nt of promoter + ATG

SEQ ID NO: 8656 - DNA, 3000 bp, Unknown; identical to SEQ ID NO: 8650
  misc_feature (1)..( 3000): cDNA_ID_3089567_gDNA_ID_1971823_Annot_ID_58367 3000 nt of promoter + ATG

SEQ ID NO: 8657 - DNA, 3000 bp, Unknown; identical to SEQ ID NO: 8649
  misc_feature (1)..( 3000): cDNA_ID_1814288_gDNA_ID_1971823_Annot_ID_58368 3000 nt of promoter + ATG

SEQ ID NO: 8658 - DNA, 3000 bp, Unknown
  misc_feature (1)..( 3000): cDNA_ID_1814284_gDNA_ID_1971823_Annot_ID_58369 3000 nt of promoter + ATG
ttgatctccggtttcggattttatctttacctcttcgtctaaccacacgtagcctctcattttctttggcttataccaaatcttgatatactctttcctttgtttccatagcttcgacgacgcagcaataccgaaaaccacatggtttagatccgttgcttcttgctccgccggaaccgccttaaccgttactgtaaccgcttttttctccggtctttgttggagaattgactcggaggttagatcttcgcaagggtgtgtagtggagacgatcttgagagtgtagatgatgtaagtgacggagatgaagaggatgagccagattattaatcgaccgggtcgggtcatggatatacccgatgagctccgatcccatatgggtttctccgatgagtctttttggtttcctttcattcacagtggaacaataaaatccaaatttgtgaaaaaaaaacgagtttgtttctaactggtttggtctgaaaccaggaaaataaataaaacgacaaaattgaatttttttttctttctcagaaattttttttaagacgaggaaaatcgtgagaaaatggaaaattttatgagttgtttttttattttctatttgtttagtgttttttctctctgggcagagagagtgagagatagcttaatgctcttgtagaaacttaaatacgaaagagaacaaaaaaaaagtgagcttacgattcctaagctttcgtcgtgggtcacacggagcgatctacgtgtcaagttttgctctgattagtgattacgtcattactaaaacgatttcacacctttttttttcttttctttatttgtcaagtgttaattattgacaaaatcggtggaatataacctaatttggaacgtaactgagtttccagaagcattatacaaaatcagattaaaatcacttgctagttacataactagtttatatgaaatgttataaatacaaaaccggaagttacacgagccttttgatggaaagttgtattcgttaatagatcagttaatcctatattcttcttcttagttacctgaatagaatacgatcatttattttagctaccacattcctagtagacctccaaaatccatgattcacgaccaattgcattcttttcatgaattttttgtttcggtaattagatcccaatccatattctatttattcatgatttctaggagactacaaaaaaatctatatatgtctgatttacctctttcgattatatgttgttgaacattttcccaaacttctcgtttcagttttcctcgatttttttcgttgagtctaatatctataacaaagaaagtcgctttcatttctttaatgatacaaatttacgatcttgatatctataatagtttaatcctattcgtctgatatatataaactatttttatttagagtaatatgataggactattaaaatttggaagtcagttaaaatttaaaaccttacagaaattttacaaacttagttcaagaataataagtaaactattgaaattctatttaattaaaaaaactcacttttttacaaatagtaagaccatctccaatgtatagttctatatctatttactactataaaaaagaatatttttagaaatattctatttctaatttatatactaataccttttaattatataatttacaatttgaccccatatattatagatttgtaaacatttccaaaaaatataatattatttaaattaaacactacttatttattaaaaacccattacatcatataactataataaaacattacaaattttattttggatttgaattcctttcaaaactcacatgttcgggcatactttgagagtgaacaaggacggattttacaaaaacgatgtgtccaacgacaagatcaagatcaagaaactcctcttccatctacttcatttggacaatattttgactatcttggcggatccacatgcaatttaccggactattaaatcactagttaattttatgttttagttttcttatgttgtttattttaaattaggtacttgtttcttgttaagtttataaaattattttaaatttaatacttaatattttgttaagtttataaaattatgtgttgtaattattgtttgtaaaataattatatgtattaaataaaaagtttaaatttgagggacttaaagtataaataaaaaagttgaactcaaaaatagagtagagaataaagttgctctatatatagagtcaatctgcagaaatctctatttttgaatcaattatagagtagggttggagaagatttttgcatttttactctaaaatatagtagggttggagatgccctaaatatattttaaaacgtatatctttaattcattacatgtttctctctcttattttattttattccctctcgttattttaagttaatagttatgattgagtttagagatttcatcgattctttatttcttaagatctcaacttacatatagtacttgttagcaattgttttgcatcagctgcattttacgagtagcctattgctagttgttatcctagcatgcatatgtttatataataaaatgaagtcgtagatgaagttttatgagacgatcgcataacaataatttgaaggtcatacctagcatgcataatttgtattctctatgaacttttggtcaaacaaagtttttgaatgaaacaaagttatggtttcggacaaaagtgtttaccatggtttggtttggagaaaagatttgcaagcaacatgaatacagataaattaccgaccaagcaagggcattaaaatgaatagactacaaacagacacattatcataatattaccttgacatagaacaaaaactaaatttccttgacttaagatgatcttacacaaagtatgagttatcaaacttaagaggatctcgaggccatggtccatcgaaacctgatctctctagatgagcccttccctaaacattggaatctatg

SEQ ID NO: 8659 - DNA, 3000 bp, Unknown; identical to SEQ ID NO: 8647
  misc_feature (1)..( 3000): cDNA_ID_1814276_gDNA_ID_1971823_Annot_ID_58373 3000 nt of promoter + ATG

SEQ ID NO: 8660 - DNA, 3000 bp, Unknown
  misc_feature (1)..( 3000): cDNA_ID_3045877_gDNA_ID_1971826_Annot_ID_176289 3000 nt of promoter + ATG
aatgtgttgtcccaaaaaatgtaaataaccagtttcttttttcctaaatcatagtattacaaattatctcgaagacattttgacctccaacactaaaacttaagaataaaagatgtactagtattttgagataaatgacaaatatcttcttgaattaggtcttagcttgaagatgaacaagtgggagagtagacaaaacgtgggatagattacgagaaattcagaggtgaaggaacatagtaagagaaaggtaggttcggccacagcagattcctagaccggctctcatgcagcacgatgctttattttgtatgcctaaccatgtgactgcagtctctccatttaattcagttggccgctacttgtttctttgtttttttttcctaaccatggttagtttgtaacactggttagtggttactcacacacttgttactacttccaaccttttttttcttttttttttgttgtcttcaaaatgtaagaaactttaatacttcttaatatgttgattggttttgtcactttgtagacccctgatttttaactatttcggtaaacttttgtaaaacaatttgggtttaaatctctcatgttttattagttgtacatctcagctaatgacaatagctcaagttaacgtatcatacaaaacagcaaaatagattcgaatttgatttttttcttttttctttcaggtagttatatatataactaatgtattgcaaatatttgaaaaacataaagttcaatgaatctaaatttgataattagattaacaaaatcgacatcacatgtatgaaatcgaattcctgaatattcaaaatattgtgtttttttcataagttcttgcatgcatttgcaaacgaaaaaaatcgatttcatatgttatatatatatatagtcgtagatatgtcgtaagtacatttgggtatgaatatttggataattcatcatgggtactagatttcgctgtcgttccatttgtaaaatatcaggattttttaagaaaaagttttatacaaaactgtattacatgtttgaatgaatgatcatacatatatatatttgttaaaatactactatttaacacattaaaaatgacatcctggaaaaaattatattaaatttgaaatctctacatatttttgtgaaatattttgaaaatcatgccaatatatatatgattatattcattcagtcatggtggatcatcattttgtacaccaaaacacattccccattttcttaaaagaaaacttctatatatatatatatatatatatacaaatactactattagatgtgaatatgtagaaatatttgagtcccatgcgaactttacgtaaatatgttgggaaacgattatatatatataactcacttttcttatagaaatagatagaacacaaatagtgtgtgtaaaactcacacataattaaattccatagtgttttcggttgttgaaaaacatggaaaatgccgaggaggtctcgaatctgatgtatttatttatcaataatttggtaatgtgaaataataaaccaaaaaaaataaaaacaaatctttaatgttgggaaagagatgtgaatgaaggtacggtcaatatatagacaatggtacgtaaagcgaagagtacattgccaccctgtaaactctgtatgctctatgttttcacgctattgattttcgcttttcctctgtctctcaacatttatgtgttccatcggttaattcttgaatctcgattgtatttaattccgacagaatcttaaaaacaaaactatttgatcgtaacaccatttacgtttttcttcttctttctttattaacaacatgtaatataacgaggatttaaaatcaatgttagtgtgtgactcaacaaatatcttggtccatcagttacgtttttttaattactcgatttaattggatcatttaaagtaatcatcaacgtttaacaaaaacacaaaatatggtccatttaatactattgtatatttttggcttcttttctcggtctcttgtaaattctaatataaggaaaacaaacgttggacaataattttgatacggtacaattattccatatggtcgctctttaaaaacacccatttgcagttatcttttttcctgatttgaaatggaaatagacatatataatatatatatatatattccttttggagcaaaagttaggaaataaatatatattcttcagagattttatggcacattgtatatatcttaataatattccatagaatcaatacgggtcatgaatctctcttcacgatggaatatatatgatttattaagatggaatcatggaatcatatcatttctttttcacactaataaggaaattatcatatatatcagaatctctacattacacgatccaatctcaaaagaataatatataatcggcttaaaattcgaaacagtaattaaaaaattttcacatcttctactccgagaaatttgggttacagattagaagagaccttgtcataattactacccagtaattttatttaattaccatcacgtggttaaacaaagatatgtagcatgctaacttatccgcgcattttagctattttccacttaaaacatactactgtttactaacatacgctgagagttacagttcacacatcttttctcttccttcttcttcactgtatattaagaacaataagcaatatcagttttttttttcctctgatcgaagccgcgggaaagttataataatataaagatatttttcgtgagagttgctcgtttatgggagaatcgtgtcagattaatttctatttttgttggtttaattttccatttttaatttaataattttaaggaaatattattagagtgaaaggaaaaaaaaaaagatcttgtgggtcgccattatatatgcaggtctttctccaaccttttgctccttctctctcaagtgtcaagaatcaaacagtggcttaaacccaaaaaaggaac

SEQ ID NO: 8661 - DNA, 3000 bp, Unknown
  misc_feature (1)..( 3000): cDNA_ID_2177855_gDNA_ID_1971826_Annot_ID_176312 3000 nt of promoter + ATG
gcctcgctcaatacgtcaaaccactcctccatttctttgacacccttaaacccaccgagaaggtctgatcattttcatattatcacaatgttcgttttggtctaattattaatagtataaattatactttaatttaccaacgagtttaggatataaattaattaatgggtgtgtgcaggtgatattagtggggcatgattttggaggagcttgtatgtcttatgccatggagatgtacccttctaagatcgctaaggctattttcatatctgctgctatgttggctaatgcccaaagcactctcgatctctttaaccaacaggtttttttttcttcaaacattttaattctattttttttttaatacactaagcagccaaattttgacatttaattgccaatatgatgaaccagcaaaattgaaaaataagtgatagtgtttcttatgtgttagaaaccgtcgttaaaatctaatcgcaaccaattgattcgcagcctgactcaaattatgatctgatggaacaagtccatctatttctgtacgccaacggcaaaaagaaccctccaacagccgttgatttcgacagatcattgcttagagattttttctttaatcagagccctccaaaggtacacaacacattaggctaataaatagctgaaccggtacaattcggtttaactaaacccgacttgttttcgttactataggacgttgcattagcgtcggtatcgatgagaccaatcccgttcgcaccagtggtcgaaaagctccacgtgtcggagaaaaattacggttcaatccgacggttctacatcaaaaccatggaggatgattacgctgtaccggtttctctccaagatgcaatgatcaaatcaaaccctccagaacaagtttttcatctcaaaggctctgaccatgcacctttcttctctcgtcctcagtctttgaaccggatactcgttgagatttctcaattacctcccaagaaatcttcttgatcaatgttaccggttatgtaaactgaaccggacataggatcctgtaaaacataaagttagagataattgtccgatttgtttgcccttttaatttggagagatatgaaccaaaaacatatttcggaatgggtccctttttcatcgtgtgtaacagttttaccaaacagtaatactttgtgaaagttttgattaattaatgcaaaaagattagaaaaaagcgaaactaatttttggattacactagaaaaaggttaaaatcaataaccaaaaaaagaaaaaggttaaagttacaaaacacaccggtttatagagtgaaatgattattgttctgttgaattgacgtgccagcttagcatcaccttactattatcagtcacctatatatcacaattcacaggcttcttgctttctctcattggctcgtcttcttccctttcttctccaatcaccttagcttgctgatcaggtaaactagattggtgtttcgtgttgttttcttctcaacttaggtgtttgatttgagaagtttttctatgtatgttggcatgttgcgttcgtagcattgcatatcaacggataggtttgaataggtagaattaatttgattgatatatgaaagaatgtttgtatatatactctaggtctaggttattgaatattgagaaatttattttgttaggtttagatgaattattcttcgatgagtggttcaaagttcaattggcaagtcttttcaatgattgtagtattttggtgatgataagtaagttgttaatgactctcaagtctgaattcatgttttggttttgtttccttgtaaaaatgtgaacgtttttcttacagaagctttcacaaacaaagtatggttaattgagtgactaatccactaattctcttttgttgttttatatcgtttattaggtaatgttttttttttttgggtgtgtaaaatatgatactgactcaagattttatcatatttctgaatccataagctaaagtacatttgagagaagcaagagagatagaatggggcgtggagttagtgcaggtggaggacaaagttctttgggatatctttttgggagcggagaggctccaaagctagcagccgttaacaaaactccagctgaaactgagtcttctgctcatgctccacctactcaagctgctgctgcaaacgctgttgatagcatcaaacaagttcctgctggtctcaatagcaactctgcaaacaattacatgcgtgcagaaggacaaaacacaggcaatttcatcacggtatgtctttaattctttcgctgaatcgagtcctgtgtgctggttatcggatagcaaaaacatctgtatctttacttttcttagattagttgtctgaaaatgaaagaagatcaaatagactgatgggttttgctttgtgctaacaacgcaataatcgtctaaaacttatggtacagttactaaaacatcttgtttggttgttgttcgcaggaccgaccatcgaccaaggttcactcagctccaggaggtggctcgtctcttgattacctctttggtggtggtagcaactagctactgaggccaacttggtcactctatcttctttatcccacgtcacacttctatcattttgtgaaacctcttgttccctagcaaaaaataaaatctgtataatctctaaatttctacgcatatgtgcttcaattgttgtatgtctttcgaacgataacagtctctgatatcgttagtttttttttaccgatttatttcaccaatcgaatcctatacagattatgcaagaaacagtaatgtctttagaggtcatagacaaaacagagaattaaattaatattccagcttgcaaaatattttagttggcccattcctaatttttaaaaattatttgtcatcattaattttaacgacgagacgtattactctttgcctgactctctttctctctctcccggcgacgacggtttagagtcgccatagatg

SEQ ID NO: 8662 - DNA, 3000 bp, Unknown
  misc_feature (1)..( 3000): cDNA_ID_3019448_gDNA_ID_1971826_Annot_ID_176317 3000 nt of promoter + ATG
taaacatattggatgcaatgaaaaggtctaaataaacaaaatcacaatctatcttcacaacaatttcttagaaattcaaacttcacataagttgtttgaatccttttttaattaaaaggatatattttaatatgagttaactaaaataattagacacttaaaccaaattaaaagtaataaattctttacttaccaatccggtggagacacgtgagcccctatggcaataaacttataaccttcttccgccactgcctatcacaacacctattagctttgatgtgtggtggacagtggacttgtaatgatggtgagtggcctatattcattattctttttagaatcatacaagagtttttgcttaaaatgtttatcgagtcacggctattatattttttctgttactattgtattcattttattcttaaagacaaaattaaaatgactctggccctctctctcttctctctctcaaaattttcagagagagaatcaaaccaaaattttcgacgacggtaaattgatgtcgtcggtgatggttgaattgccgtccggtgtagtatccggctttcgtctgacatatattggcttccacagcagtacatggtcggcccttgtctagcatcatcggctctttcagcggtgatggctagctcacggtgttaatccggcgtagttcggttttcttttccttttggtttatatcacggttacgtttcgaccgttgattgtctttagatcagaattcattgggtatgtgtgttggtgatggcgttggttttcagtccaagcttgcttaattagatctaattccaacctatcctttgagtttaaggtttacggataataattaggcagtttgcgtttttgagatgaagattcaaagctctttcctcagcttattatgattgcctttagctgtatctcttatattcaagcttcgattgggtctaagtaacagaggtggttaatcgaagatcttttttctcttttgagattaatagatccgtattagatccttacttctgttttgtagttgttggaaaaattcagatgaagctaatcttcgagtttcattcgacttagtttcagtttccggcagaatcgatggcttcacggcgaaggatgatagatggaaaactttcgtctcctcaggttacatgtgtattcgatgctaacacgtgtctgagatatattagcttgatccaatcttcttctctaaatgtaatgttgggccagttggacttaaaatagtctctgtaaaccgttttatgttgttgggcttttgctcgttcgttgtatgttatgttcatcttaataaaatcgtcacttgtgaaaaaaataaaatgactctggcctttctagtttctacaattagactctctctactcaataatttataatctggttcaaaaggatcctctgagtgtaaaagcatgattcacgttctaacatgtagatgatttgggaataatacaacaagtgtggatcggaggatgttattagacacgcaagaggatccacacacccactaggacacgtgtttacaagtccgagctctgacatgcttcacgttcccgcgacagttcgttgtcaccgtgtaagaggaggtctctcagatctctgagctggccggggaggaccacgtaccttacccgttagccaattggtaacacttacgattataaaataaattactttgttatgataaaaataatattggttcatgcgatgaagatatatcacgttcgattaaggttacagaggaaattgaattttcaagaattgattctttttttgtttgtcaatatataatttggatatctagatttgccatggaatataaaatcattaatttgagtttggaggaggacgtcgacagaaaaaaaactaactattaataattttgagttcctccattttgagttgtcaagtaaatatgaagtcttattttataacaatcagttgaaactattactaattgaatacttggtcgattatcaatgattttaatttaatttctctcaaaatagacacattatttctattttgaaaagaatagaaccaatcatgaataacaacacactatagaacaagttataaaaatgataaatacgtattggaatgtttacgcattgtaggacctgagacaaagaaccataagcccattcctctgaacttaaaccgaaacagagcaacacgtgtctcctccgacacatgtcaccttctccgtttttaacgctgatgctaacacgtaacttgccagcgaatattataacaatttatttcataataagaaaaaactgaattctgtttttttaaatactagtagtaggagcaaagaaagaagcaataatagtggcaaaaagtaaggagacaaagaaattaaaataaaaaaatacaaagccgtacaaaaaacgtgtcgactcgagggatcatctgattgccacttggcacttttcacacattggctattctcgtcgctttcttttcttctacgtgcccaaaacccaacatttattttattcttactcaactttattttattaattttcctcaacaacataataattaattaattaatagataaacttttttatattatttttttgatataggaaagaatctaatttgattacaattccattttttggtgaatatttttaagagtaaatagaaaataataattacagggatttcgtttttaattgtacatgttaatgatgaagaactaaataaggtattgtcaagtaaatggtagtgaatattccgacttgtgctcaaatttgagttctctttctctgtctcatccatttaaacttttttttcttctgtctcccccatttgtaatcaatagtaacgaaacgtgtctcgtcaatttttgtcaatggactaaagagaaacttttttttcagttcttgtgaaaatattggattattatggatcgtggcataaaaatctgattactgtttcataagcttccagtattcttttttgtta

SEQ ID NO: 8663 - DNA, 3000 bp, Unknown
  misc_feature (1)..( 3000): cDNA_ID_2177864_gDNA_ID_1971826_Annot_ID_176315 3000 nt of promoter + ATG
ggtttcttctggtttggatcttgttcttgtgatatgcatcttaaagagtttcccatttttttttggttttttggtttttcttgtaaggtgtagacacgtttgtaagtgtgtgtttatatatatgaagcatgttcgtgcttgcatgtgtattgttttgattcttgatgggtgaaaatgaagagttgagactctcacgttgtgaagctgtacttaaaatgtaaatctgtttgatcgtgatagttttgacacttctgtttttcttgagactcacgaaaatgcacatatgagaaaattggtttaaagtttggattattctattacaaactaatggaaattgattgcctacaaatggagacataagaaagagggaggaacatgggagggcactttctttgagcattttgctactttgactttcaagcgcaagctatttctttacaacgataaaacatattcatcgtatttttcttgtttatatatagatcttcgtcctttgccgcgactgcgatcgactgcgactaagtgttgttctgatcgggactattgaccaatattttaggttgctaatttttaacgatttctcgcgattggttacataatgactatacaaaacgaataatatagcaatcacaaaataaattaagatacaaaatctttagaataaacaagaaattaaattattatttttttataataagttttagaatagatataacaattatattttttattttaaaatataaattctcataaattaaaatcttcaaaacaataaagcgaccaatcacatcgattgttaaataaataacaaaacaagttgctggttgcttgtcggaatcgttggcaactagtaaacggaacatgaccctagttaaaaaccgaaatttatgtaaattttttgatatagctcttctcaattcagaatcgagttctttagatgtacctaactctcactattagtttacttctaagttggttccttgaatcttaatttgtctcttgtctcttatccaagagatagagaattcattaaaataagttatctttttgagattatttacttttttccaaaaagtgtcattttaaatgttcaatgcgaaattttagacaaaattttgtttcatattttatctattaagaagagagatgaaattatataatgtattaagaaagaatataaaataaattttaaatcatcttttttatgaaaacactgtaaaaatttataaatgcaacggaaggaatatacattattcatctactcaaggtagacgaataaagagaccaacataaaaaaaacatgtgtgaagaaataaatttgtgaccgtcatgaatcatgatcttgtgcaaaatttttacaatatatattagattaaaagataagatatgattgaaaatgatgtatactaaattagtgacatattctttcacaaaaaatttttggaatcccatattgagaaatattattaaaaaaaatgattaatacatttttcaagctttgtaataaaaaaatctaatcacgcttatcaagattctttctatatcgtcgactcttctttgtagtcacacttcaaattacattgtagtctcttattaataatttttgtagccacacttcaaattttttataatgaaaattagtgttgctagtcgttgcttttgatcgttgaaccagaaagtaagatcctctttctttaacccctcttaatctaaaaccattgctttctaacgcaagactcttttactcggataatttgtagttgactatgatggaagcaaacggtctggaaaaaccaaaggtggacgcaacaaaactcgggatggctctgcaaatagcatcaagacagatggaacaagactgagaatagctctgcagaagatgacgaagatgaattcaagcaggtcagaagtcgtaggaataagaaaaatgtgaaacccctaaggttcaagcacattgatgatactctctactacaaacaccaacacaagaacacttataatttggagatttcttagaatgcaaattgagattaattttcgacattacagattcaaaaatctttacttttttaggttgccgtcgctaatttcagtcgccagcaaaaaacaaacgaatatgatttaattattaaagaagtaaaaaaagatatttgattgaaaagtaaataaacaatgaatatcttacaagataacaaaagctacaaaacaaataatcttagtattttaaataaaatatcttacaagatttacttaaatatattgatttttatttactatttaggtatctctaactaaattaaacctagattttctttatcttcaaaatttattatcattaactatatatatattcaagaattaaatatattgaattataatattaacataaatacacctaaaattctagaaacttctttttaatatcaaatctggacaagagctatagttcataagtgtcacatggtccgaaacactccgaaccctagtaatacccacacgaacaacttgtcgagtgcgttaagatattcctttttctgatttacctttttaaccctggttaaaaagttcataggtcggtcaactaaaaaaggcaaccaagtcaaagaaaacaatttttactagttgagttcggaaataagaaaagtgaaaaccaaatcctaccttaaacagaatttaggaaaatattatatatttccttcttccacatcaccgatttataccaaaatcatataatcaaggaacctctctaaaaccctattaaatcttctctctttcgttcttcttcttcttctcctcctccatcctccaaatctcgatttcccaaaaaaaaaacctaatctcgccgtactctcctcggttccatctttctctgcggccaggttttttaattgatccgaattcagatttgttttttttttttgtgatctagggtttcggcgatttgattctgaattgctctgttttgtttttgtttgtttggtaatcagtacgtgtgcagat

SEQ ID NO: 8664 - DNA, 3000 bp, Unknown
  misc_feature (1)..( 3000): cDNA_ID_2177849_gDNA_ID_1971826_Annot_ID_176310 3000 nt of promoter + ATG
aaactttataaaatgaactaaattcttctgaatttcatacggaaaaacaaaataaacttatttttaacacatctcaagtcttaaaaccatacaacaaatcatatcaactaatcaacatttttgaaccttttcgtcatcattgcatcgcatagccttgccgcgtctacattatctctaacattatgaactctaatgatattagcaccttttagtatcccagcagtaacacaagcaacagttgcagcatctctttcacttgcctcaggacgaccacaaatatctcccaaaaatctcttccttgaaggtcctataagtataggtgcatgagacaatcctatactcttcttagccatctcttccctgatttttggtagctccatgacaatatctaaattatgatctattcccttagaaaatccaattcctggatcaatcataatcctccaagctggaatcccagagagttctgcttctcttactctctcataaagctctgtggcaacatctttgcatatttcattatactccaaattctctttgttttgcattgtacatggatctcctctcatgtgcatgatcatataaggaacatcagaatccgcaacaaccttatgcatgttctcgtctaaacttcctccggatacatcattcaaaatgtcagctccatttcttattgcttctaaagcaacctcagagttaaaagtgtccactgatatgagctttcccttcatctctgccataccgcgaacaacttttaaaaccggaatcagtctatctatctcttcttgactagatattcttgaggccatcggccgtgttgactgtgcaccgatatcaataatatctacaccttcagatatcatagaccggacccgagaaaccgcggtatctaccgattgaaacttacctccatcactaaagctatcaggagtaagattaagtatacccatcacataagttttcttagaaaaatcccataaatgatctcctattggtataaccctttgtataataccgtcttttccaagcaatgactcaccacctaaccgctcccacgcttggaaaattccacctgaatgcattgagagtgaatgccaatatgcaactattttatcattatcaatatcttccgttccaagcaaatctaccaaaggtgctaaaacaaatggtctttcccagattctctcatggggaatgataagtttatcagaaattatcttgtgctttccatagaacaatatgtccaagtcaagtggtcttggtccataccttaaaccattttcttcacgacccatctctttctcaattttcttgagaacgttcaagagttcatgaggtttgagctttgtgacacctcttattgcagcgttgagaaatcttggttggtcggtcacatgaacaggttctgtttcgtacaaacaactgtgtctggttacactgatcccatagtctttcatcaatcgtaaagcttctttgaaattattcattctgtttccaacattgcttcccaaagctatcacgacttcttcgaaagttgttgtttccaaagatgtgaaatctgagtcatatacaaaacatgtttcgaaggtgaaatatgattcaatacttaacagaaattagtgtatcaaaacgtaaacgctgtttttttcaacgaaaatgaaacggatgaaaaagatacgaacccattttagaataggttcctccaaaatatcagtattgtctgcttcgatctgaccttaaagtatacaaaactatgagtttagtcttagataacaacgaaacaattattagaaacacaaaaaatgggttctaatattttaagaaccaaggaagtaaacaatacttatgtatgagagaggcaaggtggtagccaattttcacctactttttttctgaacttgttgtgttatccaagtaccttctgtctttcacgctcgtcaaaagtcagcttctcttttgaattagatatgaagatctagaaaagaaaagaaaaaagagaagaaaactttgtttttagagagattttgaaattggtaatgaatctctcataattttgaaattggtagtgaatctctcataattcttttcattatctattctatcttttaccatttaaacatatatttggatagatgatggaaaattgtgtgttagtctccagctatttcattccatttttaaaaaatatcaaaattttcatagatttgttctgactacatcaattttctttcattccactcaaggcactcatggttacattaccaatagaaattaattaaccatacaaaattctaattattataactccagacgatattattttcactatatagcaaaaaatagccgttttaccataacatatatacagtctatattttttgacgaaaaataaataaatatacagtatatatatatatatatatcctcgtgttagaattgtattaagtttttcatcacaccatctttaggcattatttctatgccaatcaaatcatttactcgtaaatcatcatagtaattatgatttcagttaatcgtaagttttttgtagctttgtgatgatgagccaattaacttcacaacaaaatattttccttgaagtagttttttaatagcaaacgatttcacgaaaaactttacataacaaatatttctacctacattaaaagaatgtcatatagacaatactaaattcactagctttaaagaagaaaaatgagccgtaaataaattatagtagacagaatagggacatcttgacgttttagtattttgatcatagaatgcttgccgtttcgttaaagcgctaaacctcctcctcatcctctcccagctagctcctcttgcggtttcagagcttaaaccccaatctccctcaaaactcataaacatattgctctcctttgttcatttctgggtttacgcttctttcgactttatgggtttcggagcttagttttactacaatttcgtttggaaaagagctcttatttgatgttc

SEQ ID NO: 8665 - DNA, 3000 bp, Unknown
  misc_feature (1)..( 3000): cDNA_ID_2177807_gDNA_ID_1971826_Annot_ID_176299 3000 nt of promoter + ATG
aagtttacaaaatcattccatatattatattatttgtgatataactcattttggactagtttttttaagagtttaagccttttatcatttacatgtataaaaataaaatctctccaattatcatctatggttttcaatcgaatgtcagccactttgcataatacgatggaaagctttctgaagtgaagtcatttaaagtaaatactatcattttcacgattacgagctcatgtgtctgctctacatagacacgatcacagttttgttttatataaattaaaaacaagaaagagaaaactataatatatatataggatcagttattaatcccgtttgaaacttggttattattggtaaatataaaatttcaagataaataactaaatatcatcggtttagaattataaaaaagatgtaaatcataaaaaacaatacaactaaaatcagtttttaatatattttcttgtgtgtttttctagaaaataaagtattaagaaacaaaaagaagagtatataggatcaatcattaatcccgtttgaaagttggtaagaaccaacgggcatgagcggatgggatggacgaagaaacaaactggtgtgggatttcaaccttgtttgtatcgagattgtatatgaagatttcattttcttcgtaatcctcataaaaatcatcggcagtgaagtagatggagttacaagtgattccttccatgtccttagcaagcactgtaatacccaaacctagaagaattgactcatcgcctagagaaacaatttcctcccatttgttcaccttggatgaatccatcttgcagattataaattcccatgtttcagccatactgaaatgtaagctcgcgacaattaagacatctccacgtacagtgactatcatgttatagatatagcgattcaatttgagtttcagtggaacttcaggaaattcatcatatccataaggatttgttgcataacctacaaactcacgtacgctaattctgaaagcttcacgcgggaattctccaaaaaaatcgtaaatatagaggttggaatagtcgagataatgaagcttgtgatctttgtatatcatgttcaaacacatgtcggtacatgacgattttggcaactcggggaattttttccacgagttatctccatttttgaaagaaaccatagtttctcgattaatcgttcctataactaggtagtctttggttttgtcatctatccataatatcggatggctaagtccaaaaatatctgattcgaaagccggtagattgatcctctcgcaggttagaagatctttaatatatagatgaaactcttgatctaaagtttgatcttctaactcttcgtaacgaggttgcatcaaaagccaacttctataagtcgccaaaacaatactctttgcaaaatcgtcaccgagatgttgagttttgtagagtttttctttatcttcagggttgaacaagagacaataattcttgtctgttgggaatagaatcatccaagggatctgattgtttggcttagattgttttgaaccaaattgccaagatgaacaaaccgatttagctcgttcgaaatccaaaaatgcaaggcgttcgaaaaccaattgcatgagatctagaggaagcttggaccagcaatgaggatttctttgagagactgaaacagctggagatttcggaggaggagattgggctaaggctaacgttggtgaggccatctttcggattatcttatccgtcaagctttcaagtgtgggagatgatattagctttttctttttttcactctttgagagaaagttcatattaagagattaaaaactaaaggagcctatcctaatccaataataagaagaaaaaaatctggtgtaattgacaataaccatatctttctttctagtaatatatatttacatggaaattattttggatatatgtccatgagagatatgtatattgtagtaccttttgatttgtttatattttcttgctcacataaacaactttccataacacactgaaatcatattagatagatggagaaaaaaatataaatgattgatacatgaaatacaagtaaatacaaatgtatgacccggtagtttggttttaccaaatttaatcatataaccatgaaatacaagtcatatggtctcagtttagacttcgatttactcagactaaaccaaacaataccgggccacacatttgtgatttgttaatcttcgtcacttataaggaatatttttattatatgcaaaactcatatcaaatataatcacataaccataaaatacaagtcatggtctacatgtatcccataaccaaatacgattattacgcatccgatctgtaacaaaatatccaacgtcgcaagctgatatataattttgatgtgaggattgcaatcatataaccatgacttgtgtttcattgtttatccatagccaatttgggagtatctttgcttaagattttaattaagagtttggtataagtctctaggtcaactagaggttttggattaagggattgctattattatttttctaaagaaaattaggaattttgatttttgttatttaaatttctgtaaaattgagggtaaagaattatgagcctacaataaatggtctttccctattatatttgcgatcatgtgatgcatattgatcgaacatttattttagctaaagttaagatgcatgatgaaccactctgtttctattctaccatggtatttaatagtatttccaattagaaaatttctttcaaaatgtctacggtctacttttgatttatggcgaacattttagctaagtttatatgcatgcatgaaccattatgtttctattttagcatggtatttaatacgtacagactgctaatttaagaggaaattatatatttatatgtacacaaagaaacatatcatagtcttccatatctcctcttgacacttttcaataattttctatcatcgatc

SEQ ID NO: 8666 - DNA, 3000 bp, Unknown
  misc_feature (1)..( 3000): cDNA_ID_2177814_gDNA_ID_1971826_Annot_ID_176300 3000 nt of promoter + ATG
tataatgtttaacatccaagatttgttttacataatcgttacggttactaaagtttaatttatgatgttttaaaacaaattgagactaaatttctaaaagaaacatatacgtacatgtgtgtagctgcgtatatatatagaatggtggggctaaaagctaatgatgtgtacattaattggacatttgatgtggctggattggacccaacttgctctttgatagagacctaactaagacaattttgctcttcattcatttctcccgtatacataattgaattaactgtacataatgtttcacaacaagcgatctagctatatatttcaaaataacagagactgatattttaatctggtcttctaagctctaacgtcaaattaaaaaaaaaatccgatcttctaattaattagaagaaatcaattatagaacctctctctttaatttcatttatttaaaactgcttggaaatttaattattcactaaagactcactattctccttaatttatgataatttgtagatcatatgttcagtttttatttatttgccattcgaatgttgagttttaattaaaccaatatgttaatattcgaattaaaaaaacttacctataattcacttatttaaaaacataaaataataataattgcatcaccgtgatacaaagcaacctcacaagtcacaactctcgtgactacaaagatcactcattaaacaaaccttcctgccttctttttttctacttgggcacctcgaccgatcgaagactattcttgggatctgcttcaaaaacgactatatgttctaaatccacttcgtatgatgacgaacatttggtttactactgaagatagagattacgtccttctaattagaagtaattaattattttagtatttggaagctaatggtggagatgtaaccgtatcttagtggatcgagatattgtatataaaatatgtatgctacatcgaataataaactgaaagagagtaaaaagggatatttaatgggaagaaaagaagggtggagatgtaacaaaggcgaagataatggatattcttgggatgttgtcttcaaggccacgagcttagattcttttagttttgctcaatttgttaagtttctacttttccttttgttgcttactacttttgctcatgatctccatatacatatcatacatatatatagtatactatctttagactgatttctctatacactatcttttaacttatgtatcgtttcaaaactcaggacgtacatgtttaaatttggttatataaccacgaccatttcaagtatatatgtcataccataccagatttaatataacttctatgaagaaaatacataaagttggattaaaatgcaagtgacatctttttagcataggttcatttggcatagaagaaatatataactaaaaatgaactttaacttaaatagattttactatattacaattttttctttttacatggtctaatttatttttctaaaattagtataattgttgttttgatgaaacaataataccgtaagcaatagttgctaaaagatgtccaaatatttataaattacaaagtaaatcaaataaggaagaagacacgtggaaaacaccaaataagagaagaaatggaaaaaacagaaagaaattttttaacaagaaaaatcaattagtcctcaaacctgagatatttaaagtaatcaactaaaacaggaacacttgactaacaaagaaatttgaaacgtggtccaactttcacttaattatattgttttctctaaggcttatgcaatatatgccttaagcaaatgccgaatctgttttttttttttttgttattggatattgactgaaaataaggggttttttcacacttgaagatctcaaaagagaaaactattacaacggaaattcattgtaaaagaagtgattaagcaaattgagcaaaggtttttatgtggtttatttcattatatgattgacatcaaattgtatatatatggttgttttatttaacaatatatatggatataacgtacaaactaaatatgtttgattgacgaaaaaaaatatatgtatgtttgattaacaacatagcacatattcaactgatttttgtcctgatcatctacaacttaataagaacacacaacattgaacaaatctttgacaaaatactatttttgggtttgaaattttgaatacttacaattattcttctcgatcttcctctctttccttaaatcctgcgtacaaatccgtcgacgcaatacattacacagttgtcaattggttctcagctctaccaaaaacatctattgccaaaagaaaggtctatttgtacttcactgttacagctgagaacattaaatataataagcaaatttgataaaacaaagggttctcaccttattccaaaagaatagtgtaaaatagggtaatagagaaatgttaataaaaggaaattaaaaatagatattttggttggttcagattttgtttcgtagatctacagggaaatctccgccgtcaatgcaaagcgaaggtgacacttggggaaggaccagtggtccgtacaatgttacttacccatttctcttcacgagacgtcgataatcaaattgtttattttcatatttttaagtccgcagttttattaaaaaatcatggacccgacattagtacgagatataccaatgagaagtcgacacgcaaatcctaaagaaaccactgtggtttttgcaaacaagagaaaccagctttagcttttccctaaaaccactcttacccaaatctctccataaataaagatcccgagactcaaacacaagtctttttataaaggaaagaaagaaaaactttcctaattggttcataccaaagtctgagctcttctttatatctctcttgtagtttcttattgggggtctttgttttgtttggttcttttagagtaagaagtttcttaaaaaaggatcaaaaatg

SEQ ID NO: 8667 - DNA, 3000 bp, Unknown
  misc_feature (1)..( 3000): cDNA_ID_2177841_gDNA_ID_1971826_Annot_ID_176307 3000 nt of promoter + ATG
aaaaagagggcatattttgagatatacatgacaaatagaaaaattattatatattaagtgtacgtaaagtagtggatgcatgaataatgggtagtattaaattgctagatagctagaggagagggtaaaggcaacgctttaaagagtcggagtaatgaagttatacgagcatggaaacctgactaaaccctaatttcttattagctctcttcccttttttggcaatcgtcccatctctcacagtcatagttgatagtccccaaccttttttaaaataaacataatttaatttcggtcacctttttaagatgcagatatagatatcgtctcattatttctagtccacgattaccctattacgtacaactaattaatcttctattttcaactgatcatattctaaatttttcagttacacctctggtctaggatgtttcaagtcaaaatttgaaaatattcacatttgtctcttaatgccaatgatgagatttggtttagttttttttttttttttatgatgcaattttctattgagaaaaatggatacataaataaaacttgaggataatttctcattgtccatagttaaagtttcttagatgcaaattaaagtatcaataaaattttaaaattagatactatatcgatcagagactttgttattgttgattttggaattagactaccgtacagtggtacaaaatatatgtttaaaagcatattaaataaaaatagttagttattcatgttttcttcttgttttttttgtttttgtttttgttgttattaactaaagaaatccatgacttttattaatctatttatgtattagttctaactttgagagcaaacttcaatgtatgtatatattggttctaacattgagaggaaaactctaatcaaataaaattgtaagtaagctaaatatgtgtgtcgaagtaggaaatctaaggaaagtgaagaatgcaaaaaagttagtcactgaaagagacgtgtgattgatcacttgtctccttccaatttccctgtgggggcagtgcatgcacaaaagatggaatccatcctatagctcctcctttcttcactatcttttcaagtttctctttttgaatatattttttttaaattgattttgatttaactcaaagcccacacttcttaatccatcttctctataattagtatgccaacaaatatatatgcttgttctgtctcaaatttcaacaataaagcgtgtatagctcccaaaaagctatgttgatgagttatcactctttttatggattggactaatagtttgtctcatgtcaaaatgattatacataactcagaatccagcagtatagagaacttaacttttatatatatgttaaccctcataacctcaaacagaaaatttgtagtgcagtgtagaaaacatccttaaacataaagtaaatcctttaacaaaaaaaataaatataagtggcaaatcaagagattctgcttttgagtccaatgtatgtatagttggatgttctgaagaagatccattgttttggttgtttctctacagttaaacgatttttatatttaacttattaatgcaattgagtgaaaatttcacgatgaagaaaaaagttgtgaatcatgacaagttttgtcctcagttttgcagtgaaatcattttgcgtgaaaattttatgagagaaacaaaaaaaaaaaaaactgatcaaaagatcaggaaaggaccattcttaatttataacatgtgggcaagtcaaggcttgctggcatcaaacttgaataaatgtaatcatattcacaccatgtattgtttaatatataattttaatatcttaattggtcatctatttttgtctttttgcatcgcatatgtgtcataattaatatctgtacgatgtagaggctagtgaatataaagtgaaaacatagatatatcgatcttaaaccaatggtatcttacaccatatgtatatgcttgtttgaaaatatttattctacgaaagtattaattggattgattgttttcactctcttgagtaattttggataagttaatagttattatttttattacacatgattaaggtgtattgttaattataaatcatatttatacgaagacatggttgaataatgtccaacacagcttattttagcaaaaactaatgtacgaggagtgacatttagggtcttgatatttttgaagcaaaattaaatacgtctgcaagattttgcagagggaggcatgtactatatcatctgcaatagtagcaacatagataaaagtcataaacccctagatccggtccctttaatttaattcatatatatgatttgacataaaattacttttgttaaaaagtttgtttttacattaaattcttctatcttttttctaaatatcagtttaatatacatttgtaatttttcttgcaatccctagccagcttaatgatatcattttttttccttctttatatccagagaaattttatgcggaaacgtagattaatatcatcgaacttgttgatccaatttgttttatcttttaaaacatttacagtgattacaaaatagaatatatagcaagtaaatatccaacgaaaacacataatgtctttaacaaaaaaaaagaacgaaaaaaaaaagaaaacacataatgtcaccattagaaactcgtgtctacaccagaagtcattagtttaagatattcattttttttttttttgataagatgatattaaatgttgttaaaataaacaataaaaatgcaattatggactgcatatacacgtccaacactttgacaatctgtatcgctctctctctctctctatatatatatatgtcatggtctcactatgattgttctataaatacaagcctcctaactcataaaataagcataaccctaactctacaaagttcttctgattctttctctctctctctttctttcaagagcggttttcaatccattcgctaaagaccatg

SEQ ID NO: 8668 - DNA, 3000 bp, Unknown
  misc_feature (1)..( 3000): cDNA_ID_2177702_gDNA_ID_1971833_Annot_ID_176329 3000 nt of promoter + ATG
tgagattagtgatgtgtcagtttatcattgcttcagttatagcaaatagtactaaccatttgttattactgccttctaatctgtcattaaccatttgacatgattgcaaatagtacaccatttgtcattactgccttttaaagagacaacctttgttataccaaaattttaagtcgatttcaaagacccttatatataaaaacttgtccatatatgccaagagacgcgccgccgcttcttttcgtctttcctcgtgaaatattttaggctttgtcggtctcgttaccttaaagtttcgatttttcctttgaatatacgaaacccacgtcgtttaaagcaatacccagatgacaaattgacatttcataactaaagatcggagctttttcgtagttaagtgatcatgagagcgagattggtggtttttccgatcaaagggaagaaatggtgtttcagcagatctgttgaccctttcgctgctcaatcaccgtctggtgttactccgaccactgtacgaggtttatggaagaagatatcatctgaatcgaaacccatcaatgccaacgcagagcttctcgtcgatttcatctctgacaaggtaaaattacattgaaattttgttctctctatagaattcatacccgtgtctctatgtggcgtctgaaacttttttctctttatagaattcatacccgtgtgtttatgtggcgtctagtgagatttattgggtgtataacatttcgaccaatgaataagcttttggttctgtttctgattaaaggtttttgacaacgaacctcatttaggaccactagaaatgagataaaagaatggctttttttaatcagtcttcctccttgatttctccaatactaagtttgaagaaatgttgttgttgttgttgtaatggttagatgaataaagcttgggtgggtcttgagaaagcgcctgatggatcaataaagaacaagattcatgggtttgtaaaatctctacctttttgtattttgagacatttcttgaggctttggtctttgtttgttgataggcttattaatgtcaagttgtggttggaatgtataggtttggattgaagcttctggctcgtgttaagccttctgagattttcttgaagtctatatctaaggaggtcacttctgtacaagtcacttatcctccgaggttctatttactctccttttcttgaaattctgtaaacttgaggataagtatctctcttatgaatgtcttcatgagtatatattctggtgaatttggattggttatcgttttagctaatccatgtcaaatgttttcagtttagatcctagactcgtacgcaggagactacggcacattgccatgaggtaaatcactttgctacccgttgtctcaaatgatgaaactttatatccgatttcacgtgtaatagattcagaatccctgttccttctaacacttatgttttctaattggatttgcagtggaacaatcctgcacaagaagtacctagttggttcagttactttgcttccattgaccagtgcatttatggtatgtatagtatgaagctagccctcaagaaccttagcaactaactcgtttattttcatcgaatctcataaccaccaaacccttttgttctttccaattaggtattgccattaccaaacataccattcttctgggtcttattccgcacatattctcactggcgggctcttcaggtctgtcataacttctcgatacatacttccattatctagaggtttatataaacccgaaatcatctttattgacacttcagggaagtgagaagctgcttaagctcatctcaaacgaggcaaatcctgataaaccagactcaactgatgatgcagatgaaagcaagaacagcaacaccaagccggaacaaaaatctcaatctcccacttgtgtaagctgatctatttgtcatcaaagatactcaaatcaaaagtttttttttttggttcttaattgtctttgtttactcataaacagattttgcttccatcggaagagttatatcagctaattcgtgaagctagcgaggaaggactcgacgaggcgaccataatagagatttgcaaatcctttgatctcaataagaacgatgttcttaaatatcgcaatctagtctaactcttttggcattttaggcttcttttttagaacataattttagctgtttgaagctataacttacgctccaattcttttttttttttgtcttttgattccttgttgctttaaaaacttctttgttacttggaaacagttgagaattttgaacgagtacaaggttactctaaacataaaaataagttttctcagaactattggaaaaaacaagagtcacagaaaaaggaaaaaaagaaatgatacaaaaacaaaaaaaaactcgaatatgggccgaaattaacagctcaatttacacgtgtgagggttgtaggcaatccggtttatggattagtttcggtttagttaaatttttttatctaataattgaaactatataaaaccatttgtaattcagttaagtttgatgcaaattccgttttggtaggggtatatgtttcaatttcgttttagttatccgaatttagaagaagaagaagaaagaaaaaaaatggttaacaaacaaattcggttcagttttggttgatttggttgcggtttttttcgctcaacctagtttgactggcacgtgggattattttgatctgacctctccaacaagacagaaaatatgggcctcgcttaaaaagcccattttacacgtgggagcggcacgtgtggttcttagcttatatcacgtcaccacgagactaaacgcaaattagaacttctttaccctttcgagaaaaaagaaaagaaaaaagaacttgttttcctcttcagcaagacacataaatcgtaatccattttctctcaactttaggaatctcaaatctccgatttggaaatccggcgacaatg

SEQ ID NO: 8669 - DNA, 3000 bp, Unknown
  misc_feature (1)..( 3000): cDNA_ID_2177771_gDNA_ID_1971833_Annot_ID_176340 3000 nt of promoter + ATG
cctcacaaacaacaacattgttaagaataatggcaccaatcaaagaattcatatccaaattctcagatttcaaaaacaacaagaaactcattctctcctccgccgcaatagccttgctattattggcctccatagtcggaatcgccgccacaacaacaaaccaaaacaaaaaccaaaaaatcacaactctatcttcgacatcacacgccattctaaaatctgtttgcagctcaacactatacccggagctctgtttttccgccgtggcagccaccggaggaaaagagctgacgtcacagaaagaagtcatcgaagcgtcacttaacctaactaccaaagccgtgaaacacaactacttcgctgtcaagaagctgatcgcgaagagaaaaggtttgacaccgcgtgaggtcacggcgcttcacgactgtttggagacaatcgacgagacgttagatgagctccacgtggcggtggaggatcttcatcagtatcctaagcaaaaatctctgaggaaacatgccgatgatctcaaaacactaatcagctcagccattactaatcaagggacttgccttgacggtttctcttacgacgacgccgataggaaagttcgtaaggcgttattgaagggtcaggtacgtaaatagttttactcttttaaaagtttagattatagtattatcttcgacatacgacttactcggtaaaataatgtagtgattatagttggtccataattagagcacttaactcttcaaatacgtacccaaaacatttgttttactaggaaatcttttaatatgtaacagctttataatattgaacggtatcaaaacaggtacacgtggagcacatgtgtagcaacgcattagcaatgatcaagaacatgacagaaaccgacatagccaactttgagctaagagataagtcttcaaccttcaccaacaacaacaaccgcaagctcaaggaggttaccggcgacttagacagtgatggatggccaaagtggttatccgttggagacagaaggcttcttcaagggtcaacaattaaagcagacgctacggtggcggatgacggaagcggtgactttacaacggtagccgcggctgtggctgcggcgccagagaagagtaacaagaggtttgtgatacatataaaggcaggagtttatagagagaatgtggaagtgacgaagaagaagacgaatataatgttcttgggagatggccgtggcaaaactattatcactggaagtagaaatgtcgtcgatggaagcaccactttccactccgctactgttggtaaatactgttcttctttgattttatttttaaggaattaagtaaacagtagtatcacgtaatagctaacaacacatactgacatacacatttgtttgtatgtaaaaagaatgtaataatgacgcatgtgtaacgttttgttggtagatgataacgtagacacgatcgtaactcatttccacggttaaatgatagtactgttttctattgactgtagctgccgtcggcgagaggtttctagcgcgtgacatcacattccaaaacaccgccggtccgtcgaagcatcaagcggtggctctccgagtcggatcagatttttccgctttttaccaatgcgacatgtttgcttatcaagacacactttatgtccactcaaatcgtcaattctttgtgaaatgtcacataaccggaaccgtcgatttcatcttcggaaacgcagccgcggttttacaagactgcgatataaatgcacgcagaccaaattccggtcagaaaaacatggttaccgcccaaggacggtctgatccgaatcaaaacacggggattgtgatccagaattgtcgtattggtggcacgtcggatcttttggccgtgaaaggaacgttcccgacgtatcttggtcgtccttggaaggaatattcacggacggtgataatgcaatcggatatatccgacgtgatccgacccgaaggatggcatgagtggagcgggagttttgcgttggacactctaacttatagagagtatttgaatagaggaggaggggcaggaactgcaaatagagtgaagtggaagggctataaggtaattacaagtgatacagaagctcagccatttacggctggtcagtttattggtggtggaggctggttagcgtcgaccggttttcctttctcgttaagtctttgaaattaaaagattgacttattattttaataaacattgtatttctctatctacatgtatcattaaatcgatgttcatatatgattctcaagttgaaccaagtcaatgcataactcgggctggtatagttttaaggcctaaataaccggactttacggggtttattgggttgattacttgattctaattcataaattaagataaaccgggaatcaaacacaatgttggtgttgtgtcacttgtcggcattaaagccctaaagagatagagatagggacgccacatgttagagacgcacatggccattttaatatttgctaagataatgttctttgttttcttttaatttgtagacattttcatgtgtttttttttggttctctccaatgtgtatgcttgaaaaatataccgaggaacccatagaattgtaaagaatgttcgctttctatggacctactacggatgtagacgactttgacatatacataatacataaaaccattttttgtctttaaaccaaattacaatataatcaagttgattaatcaaaataattacaacgttatcatgaatcttcacatgcaagatcctacacacacacttagacgacaagaagtcaccgtggaacaagcgcgtcacgttcatcattcacatttacttaatcccacttaaaaaggcaaacaacaacatgtcttctctaacataaacaacagaacataacaaagcccaaacaatcttagtaataatcccaaaaaccagaaaaaaaggagctttgcttttgtaggaatta

SEQ ID NO: 8670 - DNA, 3000 bp, Unknown
  misc_feature (1)..( 3000): cDNA_ID_3045887_gDNA_ID_1971833_Annot_ID_176344 3000 nt of promoter + ATG
gatgtgcacgatatatatttttctaatactcgaatctcacacgtgacaacgaccttacgtgtatgtacgtgttgaatagaattaagatacgttttataaacttctcttatctcacatattcaacatgtggatgaagatcttcgtattttttattttaatttttatgatacacccataaactgaattattactagctagtagaggctataaatacgaagaagatatctatatatatactatctatcagtgccaaaaaaaagtttttcaatatatgcaaatatacaatcctatttctccggtgaaaaccatggtgaagatttatcctcacctggcgtttccggtggatatggacgtcgtacaagacaagattttgccctacttaacgacggagcaagagaggttcacgatttggatgaaatctttggtgttcaatagcaaaggctgcacagtttttgattccaaaggaaacttaatctatcgagtggataattatgattccaagagttggagtaatgaagtttactttatggatttaaacggcaaaattttgtttactttacgtcaaaaggtaatactaaacatttcatcaatgttttctaagaatttataagttcctataattattattttattttaccttgcaagttcatttttgttgtgtgcatgtatatatatagaaactgggattcttcaaatcttgggaaggatataactcaaccgggaccagatttcgactaagaaagattttcaagattttgccaagagaatcatcttcgtcttacaaagttgtaatgggatcacgcatagttgatggtgatcaacaatcttgttataagattgtaaatcgtggatcagttttcgcaatcaaggatggatcgggaagattaatggcagaagttaaaaacaaactatcggatattagtggtttggatcttggagatgatgttttgacaatgatggtggagccacaactagatcattctttaataatgggtattgttatagcttataaacttaccaaatgtaaattgtgataatcaggtggtaatcttgaaggtaagcatgttttaaagctaattaaacgttggcataaaccccaaatatctggcttgaaattggatattgaaaagattgcaccagaatgcggagaagctcggcatcgttcatcctcataaaagtcaaaacaaccaatcagttctctctttttttatattttggtatggaaacctaattctcttacttaatattcaatccattcttttcctccaacttcttcgtaaatggcggatgaaactataaccctgtttcagcttattgccaaacccgaaccgcgcaccatggaatagtactgatccaacgagtatgtttgaacaagctcaagctgccattcaatcatcgctatcatgaccgtgattactcgttttcccggtcgtgagaagaccctttaagcgtgatttttatacggatgtatgttttactaatactagtaccaattccacaacataaaccaaaagtgttttgaaattagggtcatgtttctgttaacaatatctttaactagctgagttaaccataattgaattactaaaatatttatcaaactgaattaaatagatttggatggtaatttagtcagcagaaagaattggaattggtgaagaagataatagactaatagtaaaggggtcatggaagttatacgaatgcatgaaaagataatagagatatcaatcatacgattttattaaactaaaggaccatgtgatcagattgtaatttgtaatagcagaatgagccatctcatattccatacatggttttaaataggcttgtccatttcggtactgttcatatactgtatgttccaatttttatcccatatttgtgtgtttaaaaaaaataaaaatagctacttgaaattgtttatagaatgagatatatatatgtattattcgtttggttattcagcttttataaaattaatgaaaatcatctaaatatgtaagtttttcagaaatacccgtatcgaaagtgacctttaatttaaccgtcccgacatcaagccttacccaaattagtaagaatttgaataataaattttgctacttaaatttcttgaactcgttccgcgacccaaaattctcgtccctatcttatcgaaaattgtcatgaatgttttttgttatgtgaattacttgctctcgatttatgtgttattttactgtcctgatatcaagatgtacacgcctagttttaagtggcaacaacatataatttcttacgcatgtttcaattttcaaacacaaaaaaaacgtaacctgtgacactttgacattattttttgggtatgcgaatgaattgaaattaatttatagtgttctagagaataaaagaaagtgccctaaaagaaatgatatcaaatttatttgcaaatacaaagaaaaaaaaaaacacaatttttgcaaatataaacaatagcttttacagttaatcttcctgtcaaaacattcttttgtgcagtatcattccgataaactgtcagcattggacaacggatagaacacaaatggaatggaccacaactgaagaccgattctaagcctagcaactaataatttgaagttatcttattatattgtatgaacagttttttcaatattttttgctctattaatcgaatctcacaatcacattagtcacgttacaacgaccagacatgtagtaacaaacaaaaaggaccatacatttttttttgtttaacaaaaacgaccatacatgttatcgctacatgattttctctgttatttttattttgtatctcacattgaacatgtggacgaagaccttcgtatatatatattttctaatgacacaccaaaaactgaattactactactagtagaaagtatatataaatgcgaagaagacatataactatcattcagagccaaacataaaaaaaaatcaatacatatgcaaatatatagcaacaaccgaacg

SEQ ID NO: 8671 - DNA, 3000 bp, Unknown
  misc_feature (1)..( 3000): cDNA_ID_3045887_gDNA_ID_1971833_Annot_ID_176348 3000 nt of promoter + ATG
gtcagattgtacatttgagtcctgctcaaatcgtagctttcagtttttaatgaacatgctattagtttgcaacttagcattgattattttgacaaaaaatcaggtttagtttgtgtcaaaatggtagatgtgattatggcattgcattgacttgtagagttctgaattgtacttggcatttctgcgagtttcttgatcgctaagactctctggtggctctaaagggaaagataggttgaaagttttatctttcctggatgatgtgtttatggttttaatttacatcttctatgatgctatacttctttgaaatattatgtctctatggaaattggtagctgatggatttcgttagtcctgagtgtcagatggtattatttgagtagctttcagtgttttcgaggtagaactctaaaaatgtaagattgtcttcatgtttcagtcatgggacacaacgtcgatatccttaacagcgggatgtgatctattcatgcgctatgtgactcgaacatctgctttagaatttgaggacttcaactctgcgaaatcccgtgtgcttgaacgtgctgagaaatttggggaaatatcttgcaaggtcagtgttctcttcgaacgggaattgtttacataaatagttagtagaagaagagtttgaacagtaactggaaattttgcaggcccgaacgataattgcaatgcttagtcaagatttcatatttgatgggtgtactattctggtccatggtttctccagagttgtgtttgaaatactaaagacatcagcgcaaaacaagaaactctttcgagtgttgtgcacaggtacttttcttaagacttagagatcaattggatatgacatcttccagttatctcattctgattttcctaactgacaatcacatttccgttgcatccgtggaaacaaaatacagagggaaggccagataaaacaggtgtactgctagctaacgagcttgcaaaacttgatattcctgtgaagcttctgatcgattcagccgtggcctatagcatggatgaagtagacatggtgtttgttggagctgatggagtagttgaaagtggcgggataattaacatgatgggaacttaccaaatcgccctagtcgcacagagtatgaataaaccagtctatgtagctgcagagagttacaaggtaacctcccaaaactttaaaagttttaaaaacttgattgcaaaaacatcaatgatccatcatcttctttcttgttttcttgcaagcgaagtttgcacggctctacccgttggatcaaaaggacttagaaccagccttgcgacctattgatttcagtgttcctgttcctcctaaggttgaggtagaaagatctgcaagggactacactcctcctcagtacttgactctactcttcactgatcttggtgttctcactccatctgtagtaagtgacgagcttattcagctttacttgtaagtgaagctgtctaattcctatagctggtctgaaatctctcattttttgtataaaaataaaaacaaaaacaccatatttttggctatacacagacatagtttgtctctgattcttactgctaatgcacattttttttggtagtagcgagatctttgtgacttgtcatctttactcaaaatttatcacccaagtttcaatatatagttactagtatatattatagtatgatcatttctggtttttgatttcttgattagagatatgtattgctatattgttttattattgttagaatcatttgtgtttttttgcaaaagtatatatatccttttaacactttaaaatgtttgcacaaaaaaaaaaatggtatggtatgcgctggatattgaaaagttgcaattattgcagtgtagtgataaatgacctataatgtaacatggaatatcatatgatttgatgttttgaaaatgagagcatgagaaacgtgatagaattaaagatggtaaattcttagtattattttaatgcttggtctaagtaactactccctctgtttcataatataagttgttttggaacaatttttttgttttactatataagttgttttcaagtttctatacaaattatatattattttaatattttatgattatttatgttatgtagtctcttttgtgattagtagaattttttaaaagtaaatatttttaatttgcgtgtttttatttaaaacaatttatattgtaaaacagatggaatattattataggctataggcctatagctaatgtttggatctaactgctaacgttgtaagattcataaaacaccggccacttacaatcccacgttttttttaaaaatattacgttctttcctggaattacccatatacacgttttttttgttatcttcgtgctcaactgtttacaaaagtatactgtattcgggaaggtgaaaaaagataaaattatttcggaacatctaatatactaacacaataaatgaaattaaaaatatatttgtaaagacattaaagatggcaaatatatctgtccacaccacattttaattcttttttatatcattagtctataacatttgattaagtttcacgttttagaaaagtgattatgtataaactaaaaatataaatagattactttacaacaaacttttttttagcattttacatttgttcatttaacaacaactataacatattgaattcgagtttttttttccttttcccaatcattccattgaatgtatgagtttaggtcttagggttattttctgatgaatagcaaaagtagtaattcccgacaagaaattggccaatgtcgaaaaagtcaaattccacattttaattgagacataaaagacacatcactcaatacagtaaaatatctacttttatatattcccaaaaaccattcggcttctgcttccacttcatctctctctctctctcccttctcacatttctctccactcagatttccaattcctaaagatagagaga

SEQ ID NO: 8672 - DNA, 3000 bp, Unknown
  misc_feature (1)..( 3000): cDNA_ID_2177775_gDNA_ID_1971833_Annot_ID_176342 3000 nt of promoter + ATG
ttgaacaccaaagatttcatccaaatcgtgaacctctcttgctccgtcgttaagtagggcaaaatcttgtcttgtacgacgtccatatccaccggaaacgccaggtgaggataaatcttcaccatggttttcaccggagaaataggattgtatatttgcatatattgaaaaacttttttttggcactgatagatagtatatatatagatatcttcttcgtatttatagcctctactagctagtaataattcagtttatgggtgtatcataaaaattaaaataaaaaatacgaagatcttcatccacatgttgaatatgtgagataagagaagtttataaaacgtatcttaattctattcaacacgtacatacacgtaaggtcgttgtcacgtgtgagattcgagtattagaaaaatatatatcgtgcacatcgtcacatacaatatagtatatagtaatagaactattagttgataagcttagaaatggtcgtccatttcggttcattgcatttgcattctcgttgctggtaaatgctgacagtttcttgatatgatagtgcacaaaaagaagttctataggaataaccattgaccccatgttgctaacgatggtgccaagttagggagacaattcatcacgtcctcttcaattggtcacatattttggctgcttgaaggatttccaacgtcccgctatatcatcaattaattaaactatacttgttgcaacctagaagacaatgttgagtcgttgctttcacattttggcctatttggagatactttggaaattaagaaaattacttgaatttttcaggatatataaaaatctcctagcggatgtgagaaaggtacgagacggtgtaaaagagtggacgaatgtgaatatcccaggagataagtaccaaaacgatctataacattcccttacaacgaatcaggcaaatacaacttgaacttggcaccacccatctaacggatggagaaaatgcaaccacgattgcagttttaaagaagcaaataatgctccaatgggtttgggttggatagctcgagacgacttagatgtcttcatgtttgcaagaagttcatctattggacatatcaaagagcgtaaatcctattgaagctaaagatttcagtttccttcacgcattaccaatgtctttgatgtcagggaatccgtttgatcatcattgaaggtggctagcaacagcttgtgatttatgttgaagaaaagacagaaatatgtcaaacttgatgggtgtaataatcgagtagcagacaaactagctaaagctagaaacagattcaagttacgtccatatcatttcaggatcaggtccatacgttataattcataatattagatgttataagttgttgtttaatcatattttgaaaattgtggtgtagatttttctctctaaaatctatctttgcaaataaatttagatatttttattttttcattttcattcacagaaacttagcatttttctttcgtcaacgcttttttgtcaactaaacttagcaattaatattcatttgttcacatacaaaattttaactaaaaaagatcttgcatttttttttaatatgattgaaacatgtgcaaaaaaatatcttgtttttttacggtgttacctgagatggaatagctcaaccagttgaacccgaagttttaaagtttttggagaaatcagatctggtcttgaataccaaaacaatctacatttttatttatgaaataaatatatggattttggtgtggatattctcaaataattgatcgagattcgcaacaccattacgggaaggcgctttcggaagcgttagagatctctaatgttactttggatcagataaatttctatcatcaattctaagtattgtaaccttgttttttattttctttttggccaaggttactctagtttaagtaatgcttttgtaatacttccacttcattttcaatgttatttacaagtttagcagacaacaaaaaaaaacttctcaaataataagaaaagctgtttctgagatcactctacgggccctttatagtctttattaacccatgggcctttatatgatattgtgatgataatcattttacgaatatagagacaggggccacatcttttgatgcattcgtacttctcccaagagtgaagcgtccatgaccactctatatactactactctaattactctactgttatcttcttcacctattccaattctttcttctcttttttgttaaaaggcttacctattccaattctttctgcttactaaattactatccaaatctatttagttcagtttgatatatatccttcaatttattaagccaaccatggtttaactcaacaagtttaagttcttgtttttaaaacacgacatctatttttataaaaaaaaataggacttatattgctactagtattatcatttatcaatataagtccataattctgtatatatgaaatgagaacacgattaaagtgattacaatatacatttatttttcttagagtcaaacatgtgtttaagtttaaagtaaactatcagaaaaatttatgttgttttagaatttgttatttttgtttgtttgtttagccattctaccatcttcttctttttaaacattgtttattatccacaattttgtcattttatagtgatgcatatcagaatctaaagagtagtataaaacaacaagttgaaaatgatagaacaaaaaaataaagaataatgaaaatctaaatgtgtactgctatttcataaaactagtaccctttataatggtctactctgaaaaactggtcaagcctttttccttctatagacatctaaaaagcaaatgccattttcctacaacttctctttcatcactcttctaaaaccaatataacaacaacattagatgcagacaacaactaaaccaaaataatccaacagtggtagaaacaaaacaaaagaaaactccatg

SEQ ID NO: 8673 - DNA, 3000 bp, Unknown
  misc_feature (1)..( 3000): cDNA_ID_2177763_gDNA_ID_1971833_Annot_ID_176339 3000 nt of promoter + ATG
gatactaattaaattaattgatttggaagtgttttttaacttggaagtgaagtgattaattgaattaaatattaatatagtaatatttttcgtgaaagtatagaattttttttttcgagaaattaataacagttcatttaccatactgagaatgaatatggtaatataaatttttcatttcgaaaaatacgaaatatgtttaaatcatttcttagtataatttggtatattgtattgaactgttaaaaaaatgaaggataggatgaacatttttctcaaaaaatcctaggtttgaaattgattccttcatttttgttcttaatttaatagaaaacttgttatagtttttcctgattttaaggttataatttttaaaaatatctattcaacgaaataattcttttaatattttatatttttaattataatttcttttattattatttttaataccaaggtagtaaaacattagtaagttacataataagttaattttgaatgaaagttacaccactcatcctgaagaattagtctgatggtaaaactggatcatctctgattatcaatataataaataaaattgtacagtatgaaagaggaagagaaagatactcatatttatgttttaggtaacattgcattaaatgaacaaaattgtctagtaattgaattttgcaaataaacaaggcgcgatctacggagatatttgcgattataaaattccacgtacatgtttataacaacaacaaaatgcaaaaataatggagaaaatttaataatttcatgataatacggaaataattacgacgatgatttgtcaatgcattcaaccacccataatttttcggcgaaataattgattttctatcaatccaacagaatcacaacgttttaattttctataactctaaaattaagaatcaaagaaggaaccaaaaggatggtattaagtacaatgatggttctattgtattttggctttaaattattttttggtagaataagttattttctaaaattgaaatatctgaagtctgatcgatttcggacttatagctagtcccagaaacattcagtttatatatatggtcagaaaaagaaactagactaaaacaggaaaaaaaaaatgtcgtcgtcgtcgtctctaataattaagttgaatttggcttagctgaatgtttctggcgttgtccaaatgtgggtgcccaacaggcaacgctcacgtggttctttctcaataccccaacatttatatgtataagttatcctcttcttcttaatatacttatgcttcttaatacgcgtgggttagtttatttgtgtcaccaaaatatttttgaaaacgagactagctagggataaaacgtctttgtggatgaataatgaagttaacatatataagaaaccatgggattttaacaaaaaaaaaaaaaaaaaacatggatcccgtgacagtctgcgcgcgcgcgcgcagcatagtagaggccaagagcgaatgttatttgattcacttttgtttggttcttttgtcaacattcactctttatttcgatactcttgcttccgtatcatggatttttttattacgttgacaactagaatatatgttttattttttttgaaaaagatactatatgttttatcgttcaaaaaagatgagtcaagtactacaatttacctatcattttttttttttgttaaaccataactttcaaattgatccaatgtttcaggacacttactttcaaagtttatcaacacctattgcattttattttcttaagatattaaattttctgtaattgtttatctaaagcatggttagtattctgattttttgacaaaaggaaaataacgacaacatcactaatatttcaacgttccttttttttcctccacaaaattcaacgtttcattttacgcgcacagatttttattttttctatgtatattttgtaacgatttttttaaaaaaatatttgtaatagttattagtatatgctaaatattgaatacaattaatttgctaatttcctttgtagttggtcatgacatgatatctattggtttatgctagttttattgttattcaattttaaactcaaataatgcatattattgatgaaaagatatactacaatattaaacaaaagttaacatagttactgaggaaaatggaatacggagaaattaagaaatgatatattatgtgctatattattattagtcgcaatgatatctttataataaaacacctattaaagaatatttgtcgtttccagttacatctaagatatataatatatatttttttcctagcataaattcccggaaacagcatgtgatgaaggaatatatcttgaagtttatagttgttgaccaaaaaaaacattaattctattatttctatagttataaatttagttagagtatgaaaaacaacaccatcttattcatgataaacacaagacgtataaacacgacaaaaattctttaagaagagttttatttcgatatgattcaaaaagtttcaaaagctgttatagttcgatttcggtgtgttatccatataactaaaaagttggacagctttcattgaaatatactactcaaagaataagaaattactagatttattatgttgtctcatcatgtttatgacttatatgagtatcaacgtggatgaaagtggtcgcttcttcctcatcggaaatcaaaataccgcatgttcatacaaatcaagaaaattataatttacaaatattgtaaagagctaattattttataaacataggatatcaaatgtggacctaaaaaagtttgaaaatgcaccactcaaataattaatgcatacagccaagcaagtaaaacattagaaagacaaaaaataaatacttttaaacaatttatattatatagtttttcatctcaaaactcaacaatataaaccctattccaccatcttctattccctcacaaacaacaacattgttaagaata

SEQ ID NO: 8674 - DNA, 3000 bp, Unknown
  misc_feature (1)..( 3000): cDNA_ID_2177714_gDNA_ID_1971833_Annot_ID_176332 3000 nt of promoter + ATG
gaacaatccaatgcaaaccccattatcctaaatctgatggaatatgcatagatggtattttgtattatacagctgggttcgatatgcgggcaagggtttctatggtagtgtgctttgatgtgaggtctgaaaagtttagctttatcaacatacatgtattcatgttgatgaatgactcttgtactctaatcaactacaagggtaaactaggtgcacttcagtttacatgtttgtctccaaaacgtcttaggttctgggttctagtaaatgctgagaaaaatatatggaccaaatgtatctatgcattgcctcctttgtggaacaacttagttcagcatacggagttagccattgttggaatgactgatggaggtgaagttgtgttgtcacagtactgtctaatatacgcattttacatttattacttcaaccttgagagcaagagtctcacaagagttcaaatacaagatgttgaaatgttcaaacgtacgagagtttacacctctctaggctatgttgagaattttaaacttatgtaagtgttcaactattgttttaatacttggtctagtttattctttcagttgataagtgtctatcttacattcttttgttccaaggactgactatgacagaggattcaacacattttctcctcaagggaggctattttaagtcgagtctgccactgaagctagcaaggtaactttcttattagttacaaaggatcaacttaagtacttaacatttacgacttgtaaattatttatgcagcttttcatggctagcagtttcacagacaattccacaactgaatagatgggcagattttatcctttcacagaagcgaccacaacaaacagttctacctccaccacgctaaagatcttcgataggctttgtctccactctgaaaatattcctaggcaaatccaaggattgtaattggaaattgttcatcattttaacttggttaattggataattttattcctttgttggtcatactagtctgcttttcattttcaattctcttgtattttaaattgtttaggaatacttgtcttcgtttcgactttggccacgccaacaagaaacatcttatgtaataacagtcattaagctactttatgtaaaaacaaccttatactttatgtaagacaaaacatatgggcccaaaaaggcccaataataatcatttacattggttcgtaagtcagtttgatttttgtttcctcacctccccgatcgtcggaggatgtagaaggtggcggcggcggctctcacctgcttcatcgcagtttagaaatgactagaggagatcgacgtagctccccgagtttcttctccggctcgaagcggagttggctagggtttcacggtggctcacggtcgccacttctattgattccgagctgatagatgatggtggctcgaggtcaatcgtgcgtatgggtttgcggctccgatcatccctgtgacggaaatcgagcggcggatcccgcagctgaggggtgatgacggctatcgtcggaggtatttcgtgctcgctttctcttttcgggagtttcagcgacggcggttcatgtgatggggttaggtcctgcggtaagatacggttcctccggcttgcgggattggtggctccggtctcgggttgttggcggtggctgtgctcgcaaccgtcgaataagggatagcctcgttgagagaatatcggttttatttccggtttaaatctcatcaacaaaccatctctaaaccgggttgtacttatgaattgaaaacatcacgtagttttattatctcttctatctgaaaacagcacgcatgttatagcattttgaatgattttttataagggattatttagaggcctaaggcgcgtaaagaagagctaaaagcgtaacagaagaatctctctcagtcgcaacagtttccggttactccaagatcgccgtcgtgcacctttcttctctcgctctctggttctgaggttagctcgtaaatctcatcgaccatcacttcttctactactcgttccaattaccatagtacgaagacattgctcgagaatctctcagtcgcaacagagtccgactactccaagatcgccgccgtgaacctttcttctctcgctatctgtttctgaggttagttcctatatctcattgatcatctcttcttatcctactctgattcaattacgatagtaagacgacattgctcgcgaatcttggtcaggttgatgtttcttgtaaccgcaactttgcaaagggttggctatatcgttcctttgatgcttagatgagaaatttgatagcttttctggagaattcccaaaggaaatcagtggaaatgagataatttagggattaaactgagtaattgattgttggagatacacttgtgtttggatattcgatttggattgtaaagatcagtttatccagtagtctaacttttcaattgccttccaccgttcagtttttggtttcaggttcgagaaattaataaacatgtcagttctaattgacacggatttagggattgtgtttcttgatctctacacggattaatgccctagcacctgctataattttcttaagctgtgcaagtaagtgttccttttgcctatacctaagaaacatctctatctttaagggttttaacttacttgttttgtcaggataaagtactaccatcagtgccttatccacactgtaaaggatttcatagcaaaaacgggtgatccaacaggcacaggaacgggtggagactcaatatactagtaagatgacgttttcttaccttctgatgatatgtagactgcttatctattttggtcattctttatactctgtgttgcctagttgtgctgctactgctttatatttccctatgttgaatttccagacttttgggagatgacaatgctaggttttcagcgatgagattcatgccgaattgaaacattcaaatactggcaccgttgccatg

SEQ ID NO: 8675 - DNA, 3000 bp, Unknown
  misc_feature (1)..( 3000): cDNA_ID_3045927_gDNA_ID_1971833_Annot_ID_176335 3000 nt of promoter + ATG
agaaactcggggagctacgtcgatctcctctagtcatttctaaactgcgatgaagcaggtgagagccgccgccgccaccttctacatcctccgacgatcggggaggtgaggaaacaaaaatcaaactgacttacgaaccaatgtaaatgattattattgggcctttttgggcccatatgttttgtcttacataaagtataaggttgtttttacataaagtagcttaatgactgttattacataagatgtttcttgttggcgtggccaaagtcgaaacgaagacaagtattcctaaacaatttaaaatacaagagaattgaaaatgaaaagcagactagtatgaccaacaaaggaataaaattatccaattaaccaagttaaaatgatgaacaatttccaattacaatccttggatttgcctaggaatattttcagagtggagacaaagcctatcgaagatctttagcgtggtggaggtagaactgtttgttgtggtcgcttctgtgaaaggataaaatctgcccatctattcagttgtggaattgtctgtgaaactgctagccatgaaaagctgcataaataatttacaagtcgtaaatgttaagtacttaagttgatcctttgtaactaataagaaagttaccttgctagcttcagtggcagactcgacttaaaatagcctcccttgaggagaaaatgtgttgaatcctctgtcatagtcagtccttggaacaaaagaatgtaagatagacacttatcaactgaaagaataaactagaccaagtattaaaacaatagttgaacacttacataagtttaaaattctcaacatagcctagagaggtgtaaactctcgtacgtttgaacatttcaacatcttgtatttgaactcttgtgagactcttgctctcaaggttgaagtaataaatgtaaaatgcgtatattagacagtactgtgacaacacaacttcacctccatcagtcattccaacaatggctaactccgtatgctgaactaagttgttccacaaaggaggcaatgcatagatacatttggtccatatatttttctcagcatttactagaacccagaacctaagacgttttggagacaaacatgtaaactgaagtgcacctagtttacccttgtagttgattagagtacaagagtcattcatcaacatgaatacatgtatgttgataaagctaaacttttcagacctcacatcaaagcacactaccatagaaacccttgcccgcatatcgaacccagctgtataatacaaaataccatctatgcatattccatcagatttaggataatggggtttgcattggattgttctccataaatggtttccattctccaatgtcaaaacttgatgctcatcacacgtatttgggatatcatcagacttgatgcacaatacctttagctgtttgcggaccggatcatatcctaaataaggtcttgtctcagtattaatactcttcagttccactttgggtaaggatacggactctcccgtgactgggttacaaattaccatagtatctagatttctcttacctcggcgacagatgaatccacaaagaggagaaccaatttcagaaaaagaatctgtggtatgttgaacatgataacgggtgggtacaagagacgtattctcgttacatggaatctgagggtgaggtgaagagaagaagaacaaattgccatcatcatcttggaaggtgaaaagaagcaacggtggacgaatcgaagacatagtcatgaacaactccttgaaatcaggacgacaaagtatggattcccagagtttggatacgcaacgaaacctagctatagactttgcaggaactctcgaaaagatatccatgaggagatcgatcgggatatatctaaaacaggaaacataacccacctggagaggttgcccctcttgcatcatttgcttactgagaggagctaaaccagtatcagactccttgatacctgcaagttacccgtatatgcaatttaatcattcggtaaatagaagtcactaatgaaagtaacaccactatctcagtgtgcacaaaccacatagatcgttgatcttctcggtgagttccttaatttctttctccactttcttgataggtgcagagtaaggcactaacccctgcgaaggattgagattttaacaaggtcagcaaaaaaacatatggagacgcaacatatcaaaccaagtataactatgaacgtttttttttcacttggatgacttattcaaacagtgaggcagagtcacccaaagctagttagtcatataagcacaaaaatgatctaaataggatcataaaatagcaattagctcgaaattactcatgagaaaacatcaaactggttcgcaaagaaacaaaatacagcaaaatttagggttctaaaagggtacacttacataagtcttgacgagagcgatatcatcttcgtcaagcggatcgtctacaatatctctcaccattttttttttttttttcggattttgatcggagatttgagatgtgagaagaagaaatcgaattacaccaacaagagtaccaactttgtccgagttattaaggtctagtaagtaagggccacgttaggtgccttgttggagaggccagagaaaataataccacgtgtgaattgggctatgaaacgcggcccattagcccaatatgcagtgatccgggtcgggtcattagagcgagccgggtctcgttatccatcgcctccctggttgctgcgtcaaagccagacacaagtatcttcgttgaaatttgctttttgtgtggcttatccttgtctgtcaaattcctgcaaaaactctcgcctctctcagacagtaagaggaacatatttccttaatgtattgttccgtataatcttacaagacatcctggttggtgttgcagagaagagtgtttcaaagtttcttcctttttcgttttcctggtctgaatgagctccca

SEQ ID NO: 8676 - DNA, 3000 bp, Unknown
  misc_feature (1)..( 3000): cDNA_ID_1989504_gDNA_ID_1971846_Annot_ID_58398 3000 nt of promoter + ATG
tattcaaaggatagatggagaaaagtacatgaaacctaatattgagccccatctgctcgcatcatgggtgagtgactttcaactttaactaagatagttttacgctaatatataaaccaaggaataaatagcttagtggttatgcttgcatttaacattaagtttccaacttcatgcaatgttttgtttttttaatgtgctagctatgtggatgattttcttagatgtaaaacgataatgctacatgatgtaaaagttttagcatttaagaaatatgaacatgtccctacgtaaaacaacgaggttgttggtgaaaacttcaaagacatagttcttaattcgccaaagaaaggtgtaccaattcctttatgatatttttctacgacgactaactatgttaacaatctttgccggttatattaatccatccgagatttgaatttgaggaatcatgaatttgatataataattagttttgatttctttattatgcaatcttgcttgatttctatgcaccttggtgtggacacatcagaatcaaaatcatttgaaaaaaagaggcataaacatccaggatgaactgtgagagtccatcaaactaagcacaaccaaacagtaggactttttgtttatgtgtctcgtccctaccagtggatcccacatcctctatcgggcctattggcccacccttatccgactgtcggtccactatgtctgggaggttttcgtgactttttaccgatcctacaaatcaccacatgatctttctctatgctttgtcgtcactcgcatagttccgacaagcagttcccggaaggtcaccaatctttagactttcccagctcaaatatgcttaattgtggagatctctaacgatctttaaccgaaaatataattgcactttggtgatgtaggacccttaaggccctaactcttacctcttcttttattcacctaagaccacctccaacggatgggacggtgagagcctctaaaaaacaaaaaacaaaaaacaaaaaacaaaaacaaattaatcttacaattatattctaattttttagcacagattgactactaataaaactacacgtgcatattggtttgtgagaccgttccttaaataaagattttagacgctctctctcatctttctctttacttttaaatatattttttttttagttatgagagcctctgttaagagattcacgttggaggtgctttaaggccctaactcttacctttttctgtattttctgtcactttaaaaatagaaaactaatgaaataaacctgccaatgaaataccggaaaaataaagagaaggataatacaaagtccgaacgtagcacgatgcacgagcatcaactacaggcccggcccagaggccaatccactaaagccaacaattcgggcctcaaaattcaaaggcctttttaagatacaaacttgttaaggccttgtatggtactggtttttaaagttgattttggcttttgattttgcaaaatccactttttcacccattcaagattttataaaaaaataattccctaaattatagagaatccagatttttatagattctagtcatttgttcttaaaatccaaaacccacttttttgggattttcaacaaattctatcgtaaactcttttttttttgtttttgaaaaataataatttagtttaaagtaaataattttaaaacgtttctaaataataattatataaaaatcaaaaactagaaaagttaccatttaagattttgcaaaatctaaaatctccaccaaaatcaaaaacttataatatcaaaaatcaaaaaccaaaagccaaaagccaaaatccaaaatccaaaaacccacaaaaatcaacaaaacattcatggcctaagtgttagtcatattgtataactactaatgtattctgtagggccttttagaaaacaacttgggcttttagaaacaaataaattatatctttaataccaaaattttatttaataaaaaaattaaaacctaaaacctaaaacatgatgatacctcttctgcatatctgtgagtcaatttgcgttttcaacaagtaaaatcatatttttttaggttagttgctagtttttcttttgagtttatttattttttccttttgtctttcacaaattatttcggttatgattttcaatactatataaaaataagcatagtttttaagctttgcgtaggactccatcaacatctgccagggttgaaagaagctccccgacagtcgatctacgatattcgataacatcgatcaacctgtctttcttcaaatcttttgatgattcctccttacttcgccaaaagtacatgaacaatatgtagatctgctctattttgttgcatgcgagaagctttacttcgaaagcctatcaagtaaggctccatcaaagggttagcaaatatattactcccaatagaaaaaagaaatcgatcaaacaaagataaagagaaaatgttccatcaaaaaagaaaaaaaagacgataataatagagaaagaagaacaacatataaaatctgaacatagcaaaaattattctcccaaaaaacggaaaaacctaacaaatattttacaaaacaaaatccggtgaaccggatatcactttctctctttaaaacattggagtcaattaagaaagagaagttcatctacaatagaagttagaccacctccaaaggaaagagagtcttaaactttttaaaaacataaaataataataaaaagagaagaagctaaactcatttagtcacgtcgtaaacataaaacgtgattctaaggttcagacatcgatgtgggaaaccttatattaataagttacttaaaagtcttcgacgactagctaaactcattccctctagtgcttattaatgcaaagaaaacagaggtcattgactttcttcgtttcctcttgagtttctcatctcatgatcgttgttcctttcggaaaacaaaaaacattaca

SEQ ID NO: 8677 - DNA, 3000 bp, Unknown
  misc_feature (1)..( 3000): cDNA_ID_1988781_gDNA_ID_1971851_Annot_ID_58399 3000 nt of promoter + ATG
cacttaaacatatcattttcagtacccatttgtatttttatcctttgtgtgtatactcacgtttatcttaaaaactagcatacgtcatgattattaatagtgtaaaacagcatattgagtagtaaaaccgaagaaaaggaaaaagaaacaacataatgaagaggaaaacaaagctaagatcaatcatgtgtgagtcaaacttggtaagaaccatcgagatctatagagttgaagggacgaacaatcaaatttgtgcagtagctccatcttctgtgtctcgagattgaaaagaaataaatcacttgcgttagtttcataaccaccactaggtctacaactgaaatagatggaatttcttttgaatccctcaacgtcactggcgagcacagtgatgcctagatccaaaagcaatgcctcatcacccaaagaatcaagtttttcatatcctgatgaagaaatcttgaaaacccgaaaggaccatgttctatatgtaggtctccacatttttgcaaccttgagggcttttcctgttaccgtgactacaagttttctatctaacaagcataccaccttggaagttttgttgtccatctcttcagaaaaatctaagatttggaaagtaccagtactgcttaagaagtaaagcttgtgatccttgtaaaccatgtcataaaaatatgaagtttgggggatttgattccacgaggtatctcctttcttggcataaaccacacaataaactccaagtccccacataactatataatctttggattcctcgtcaatccaaaacacaggggaacttagcgaaaagctatagtgaccgtgtgaaaagtgaaaccaatcatatatggttcgttcaatctttaccatgccaagttgtgactccacaggaggaagattgatcctcttgcgagtgaatatattcaaaatgtatagatgatactttgaatcttgcatcaggagccaacttccataagttgccctacaaacactctttgcaaattccacaccaagatcttgcatcttgtaaagtttgtctttttcgtcgggattgaacaacttacaagtactgttatcggtgttgtcttctttggggaagagaatcagcaaagcgatctgacgttcgggcacgcattgtctcgaaacagagtaccgagtggagcatacggatttagctcgttggaaattaactaagctgaggcgtttgaaaactaagttcaagagatctagaggaagctccgaccatgtattagggttatggttcttctccatggcaatacagtattggggagaaaggagaaatctccgaaaggttttgtaaatcaaacgatagaatacaactagggttttatatgattttagttgttcgttttttcatcgttaatatgagcctttttggcctaatcttgatagcccatttatcaacaactgtaacaaaccatttttgtcatttatttacataattgacccaattctttttttttctcaaacttttgcatcatacactgaatgagtgaatggatttaggagaaccataacttttgagtgtcttactggaaagttcataaaagttactcactgaaattcgtagacatcttttattcaacaaatcacaacacagcttgtattcgtagaattattcattagaggttgaacaaaagactgaaagagtaaataacatgatacagttgggccttctgactttggcttttgtatttttcaggtcaatgagttccaaaaaatcaggttaagttggagtaatcccaacaaagctatactcttttccctacattcattaaagaatttttattcgttagattgttaaaaagtgcatatatagttgttccaccattatgcaaatatatataatcaacacaaaatttcattatgcaagttttcattcggtaacttatatcattgtagttctgcaatgttaccaaataccaatccaaaccaatgtttttctataccggtgagggggttttgactttaccttgtagaggactcgagttcttcaacgtctgatctcttcctcttcctctgtgcctgataaatcttatgttctccgacgggtaacgacgacatcgcttgcaaatgagtctgaagcaccatctgagtcaagtcgacttccatttccaaccttctcttctcagcttccaacctcgctgcttcacgagccttgatcatctccatctccgcgagttccgttcgaagcagagaatcagacaagactcgtatcatcgccgacactcctgccgaagttgtagagtcagagctcatgttcgactcggtcccggagctcgagtttgattcagtctctgagtcggatctgtaaggatcatcggagctatctttacccaacaagacattctccggcgatgaggtctggctccggcgaagtcttgccgacttgcccatgaagtgtaaatttgggcagagagagatatagagagagacagtggaacatgggttttgttgttttggttttgattctttcaactttaaaaactgattagactaaagtggttccactttcgattaaaagcaactttttcacgtatacgaaagttgttcattaattccgtaaaaaaaaatcaattttctcttcttaatctattaaattcgctaaaagattattcggaaataattctccatcagatcacattttctcaaacatcatgaaaaagaaaaatcctctgataatctcaaacgattacagtataacataaagcatattaacaatttaataattaaaaaaaaaaaaaaaaaaaaaaaaaaaaaaaaaaaatttaataattaatgctagttttgtttctggctaagcacacgcgcataagagaacacgctttagaattaacaaggagtgtattacacgcgcttggttttcgcgtaaaagccttgtttagcgtattattatttcataagttcgatttcctaattcctaatccgtttcctttttattccgatcaaagcagcgaaaaaagcatcggagatatg

SEQ ID NO: 8678 - DNA, 3000 bp, Unknown
  misc_feature (1)..( 3000): cDNA_ID_3091351_gDNA_ID_1971851_Annot_ID_58404 3000 nt of promoter + ATG
taaaaacattggttagctaaatacaacaagaactaacaaaaacgtttgtcaacggaaacactccaactttattggagacttgacaacgcaaaacaaacagaagcacaacagagtacaaggcaaaacactcaaaacatatgatgtgatgaaatgaaagcataaacatgcaaatagcaaaacacacacactcacacacacaaagcgacgtcgttttctagcatctgcaatcacatgctttccatttcagcactgctctctacattatggcagcaataacagacacttaaaccaggaaaacgagcatctgagcattcgcctccagtaaaattgcggcccaatgaattgcattgtgtattgcaagagaacaacatactacataaacccgctgcgctgtcacacactctacgcccatctacttgtgtccagtccatatatagaaagatgcaacatttcattaacatgtatttattctaaatcttcttttaactaaatttacgtacctgtaggagacatgaggaggatggagagacatacaactactgcaacagcaaatgtgctcactcttaagctccccattgctgatttctcagttcttttttttttaaaacactagatatctctcaattcttctttcttttttccgctttgtgatttatttagcgaaggagtctgaatttatagcactgaagggaaaatgagaggctcaaacatgtaactttattttattttatttatttatgttatttgtatttatttttaaagaaaacatcactatgcaattttatattggaactaggatttaacccgtggtataccacggagcaaatattttatttatatatataataatcttaaattttaaggttttaaatttttagtattaaaattatataattttatattaatattgtaaaaaaaaaattagtgatgatagaataataaataaagatttaacccgcgttatatcaatgcaaacccgtcccactatataactcgtctcataatattttaatatctttttataaggataaatattaataatgttttataaagttaaaatatatcaataataatataccattaatgctaatagatctctttaaaaaagaatattagtgtgtagtacattttagatttggaaagatttaaatgattgttgtgatatatttattttaattctaaattttagtaacaaaattgatttatatttggatttgagaagaaatttgttaaaatattaaatgctaatggcattggatggtaaataaatctcaacttgaggatttatttcataaaagtgctgcaaaaatgtatatgtagatgagtaaatagatcaaataactttcagtcaacatatttacaataaaatgattctccaatattgaaaatcacatctgtcattagcatcaataaaatcgaattttattatatagtatacgtaacgagacacacattgagtctaaaatattgaaaatactcactatcacatatgtcaacgataacactaatttttttttttgtataatatacgtaacgagacctgcattagatctaatttttaatcgattagagcttaaatgacatcgttttggtttgactaagagaatcgttaaaaatgttagaaaatctgttaaagcttaataactgtttgtttgttttttttctttctttttttgtcaatcgaaaattagactattaaatgacaattttccgtttaaaatggcaagtcctagatttgaaaaggtcttttgaaatctttttaagagaattaagggtgaattaaatatattcagaaattaaagggtcgaattgcaaactttcttggttcatacttggtctgcctttgtccctttcttatcttcttcgcgcgcttttgaaaaaaatagaaacccgccactgaacgtcagtcttccacgtgtcctctcctgtgctctgtttccgatcgtcggagacatcaatttgcctgcttgtagggtgattcgtcaaatctattatcaggttttaaatatactcgaattgacttccaaattcttagtctctagtgtaatgattttgagaatcacttaactccaaaaatataatccacgatcccgtgttaattattgaagaatcaatcgtttttaatttctcaccaatagatgttgctcttattacttaaaacaaattgtttagacaaatgtagcaagtgtgatacttagtgggatcttaaagacgatttctcctataacagaggacaaacaggtcggtcaattacaatgtcatccctctttaccctgtctttttttttcttcttaaaacctaaccatttgattgtttctaaaggtatttcaagaatatatgatcaatctagatgaatactataccgacgatgactacacacacaaggaaatatatatatcagctttcttttcacctaaaagtggtcccggtttagaatctaattcctttatctctcattttcttctgcttcacattcccgctagtcaaatgttaataagtgcacacaacgttttctcgaagcattagaatgtcctcctcttaattaatctccttctgattagattctcaatagagtttaaatttgttaatggagagatatattgggaccctcaaggcttctaattataccacgtttggcataattctctatcgtttggggccacatctttcacacttcattaccttatcaccaaaacataaaatcaatcaacttttttttgccttattgattgtgttggatccctccaaaattaaaacttgtgttccccacaaaagcttacccaatttcacttcaatcttaacaaataggaccaccactaccacgtacggtttgcatcatacaaaccacaaactccttcttcattacaattattatatcatctactaaaacctctttctccctctctctttcttgttcttagtgctaaattttctttgttcaggagaaatataatggacctcaagtattcagcatctcattgcaacttatcctcagacatg

SEQ ID NO: 8679 - DNA, 3000 bp, Unknown
  misc_feature (1)..( 3000): cDNA_ID_1823698_gDNA_ID_1971851_Annot_ID_58410 3000 nt of promoter + ATG
gtagggaaacttgagattcaataatggaaccagtaggagtttcgccatcaagatgatcaaacgagtcaactgttgcgcaaacgttccatttagctgcaaggctggttacagattgagctttgtgagttatcttcgttgcacttctcaaacatatgaatactcctgtaaccaaactcaacgaacataactgtatagaccaaaacaaaaaacatttagtgatgagttcaatccgaataaacagagcaaaacaaaacagaaccggtaagaactcttaccgcgagttcgccaacttcatagatattaacagcaacactagctctcgtagtagtaagcaaagccatgaactgagtagcagtaacaagaatcaaagacaaaagaataaatctcctgaatcgatgactaacaatcctcaaattacgacgaatcttttgatgctcgccgagagctgatctaacgtcagtgatctcagaagcgaagcaacgagcgaagtcatcaagacgaagagtttgtagatgacatgtgattttgtagagaatgcagacaatgatgaataaggagttacggtaaagccaagaagagagctggagagtgcaagcgacgacgtggctaagaataggattgatgatgtaaggaatctggttgaagccagagatgtaccaccagattctgtaggttgcttcgagtgttagtgatgggaggacgaagatcattagccgttttagtgatctctgtatcaatcaagaaaacagagcaaaacagttttagtaattatagttaacttctagcagaagtaaacaacatccgaccttagctcagttggtagagcggaagactgtagtctttgacagataatctttaggtcgctggttcgattccggcaggtcggattttttcttttgtttaattaaaaaaaaaaatcacaacagaaaatgtcggccagaaattaaaaaattgttaactgttgactgattatttttaaatacttactgaatatttcaaaaatttcaagcctatttaaaagtattttattattggatttaaattgtttaattaacaaacaaatgaatgttaaaagaagaaaatttcactatctaaaacaaaaaaaattgtcggtcagaaataaaaaattggtaactgttgagtgacgttttttcagatacttattgattatttcaataacttcaagcctttttttaaagaaataataacaaagattgctaatgttgatagtttcaagtcctttttaaaaaataatttatttatcaactgaaattagtaaggagtaattaatatagaccaaaacttttgaaaataaaattagtaaatgattattattgggtttactaaattctggaataaaaaacgagactcagaaattaattaactaatattttgtcagtttgtcgtctttgtcacataaatggtttggtaaagtttctgttttttttttttttttgaattttacgtttgcaatatctctttaacctcaaatcaagaaattttttgataatcaatttgtaattaatagagacgctgacctgaatttcagcttcgtattcgattctaactttgtcgctaacatcccaaagcttatcaaggaacaaaaaccgtcgcatcccaaattttctcgaccaaatcgataagctaacgaacgagattcctgcgaaaatcgataacgaaagctgcacaataacgtcgtacggacgtcggtgatggaaatcgcagtcggagcaaacgagcaagaagtgagagatcaaaggaacgatgacgacgagaaggaagaaaacggaccacgaaagcagagccgtaccgaaatttgactggtcgaaccagagcacgagggacatgaacgtgaatcgtgatgcaggaaactccggttgttgtttgttgatgatcgcgcttggtcttgtcgtctccgggagaagatgctccgacgatccgttcgtcgccatgagaggggtaattttgggaattaggagaattttgagagattcaaaagagggaaaaaggcaaaagtaatgtcgcgttgattggttttgtaagctaaacctgtaatcttgtttaaatactaaagttttgcgtaattttatatgtttaatttaaaaacacacacgtattaacataggactttatataatttgttattttattagttttcagatattatgtggttgcatcttttttggtaggtgtaaagtttttttttttcagtttctgtttaatatctaaaataatgattaaaaaggatgcagtagagtgtcatggtcaaaaactcaaaatggtttaagaaaatacaatgatttaatgagtaatgactgatttattaggtgtttaatgttttaggaatttgtctctgtatgactttgagcttccagctaaatttgtaaccctaaaaatatttaaaaaaccagatcaacagaaaagacagatgatacagtatggttccaaaattttattactatttttgagttttttttttaaataagtcaatttaaacaaataatcaaattgagttgaattcgctaattaattgtcatattttttttttcacattcttaatcatttttttttttgaaactatacacgtcattgaattcacgggattatatatcaatcagtttccaagtcagaaatgttagcaattttcacgggctagaaaatcagttgatagttttaatttcgaactatttcatacaagatggcgccatgttcagggccttttagcacataagctattattctaagcccaataagttaacccgggtcggatcatttgacttaatcggatcctaattttggtaggaaatttctccggccgtgatttgttggacgcgtcgacgtcgatggggatgagaagtagtggagaatccgctcacattgggattcgtcattcttcttctaaaacccgcaaaatttctccatttctaccaaaaatatccaacttttacttttctttcctgtgaaattatctgctcaaatctttggttcctgacggagatg

SEQ ID NO: 8680 - DNA, 3000 bp, Unknown
  misc_feature (1)..( 3000): cDNA_ID_1823694_gDNA_ID_1971851_Annot_ID_58411 3000 nt of promoter + ATG
gaaatagatttgctacctattactggtcttcgagtattgggagttcttgatgtttggaactcatctgcagacaatacagggccagtttaaaagactactaatcataggtaaaaacatctctacaactctggaggatattgataattcctggaaagacaaactcaccaaataagtacaagtcacctcccgtatagtattttactgcgatatccggtgcaggcatattcttcaactcctctgtttagggaaaccaaaaaaaaatgaagcacaacaattcagaatgtaaagatcgttgaagaattttgtgtaatatttcaaagcaataactccattaacaactttagttctaatgtaaatggtacacagaatggtggagaaagaagaaaaaaccattggtaaccaacctccactggccttgagaaatttatcataagtctcatatgcatgactctccacacattccgaaaagtgatctgcataggtgacacaaggttaacgaagtcatgtagaccagaagcaatttattcagctactttctagaagttacgcggaaaggaaacttacatgccattctagggcttaagatatacaagaacactgtcatgaagtagtagaaggttgctatgtgctgagccagaaaacgatcaaaccaccaagaatttccacccaattcctgtgattagaaacatttgttttactattactaactatgtgagtaaagagtatgaaacttgtagagaagtaacattttggttcttacttccattatgagcaagtgatgcatttcattccagctctcagcaaagtgtactttcaaataatctgctctcctccaccaaccaaaggtctcatacatatgtagcacagacataaacgctgcaaggagcatatagaagaaacaaacattatgttctagcctcggaacaacttttcatttggtatccagatccataattagtgataaacacactaaaaaaaacaagattcgattctcaacaaatccaatatctcgatgactgaatcgccttttgttgttaagagttgaactatgcttctaatgagataagaaagagtacatattcctcaaacacaactatttcgtcattgttcttcttctgcacacatctcaagtgatgttcacaatcttactgtcttctgaagaatacaaaacctaatgactagctcttaatgctctgctcaatgtttcttgcaaatattataacgaactgaaactacaattacaaatagatgcacttaccaaaataaggcactctagcaattgtctcaagaacaaagaaccttgcatatgttcggtcacgatacaaagtgtcaagtatcttaataaccgagtcctgcggagaaaacgaaaacaagacaacaatcagaagacatgaaataacttccggtaaaataacacaaccaaaaaatctatatttctagtaagacataacgtttcaggtaaataaaagagttataaaaccttactgtaaggaaaacattcactccttgctcaagcttgatgatccatgtctcaaaagcactagttgaagaagaactcatatttggctcctcaagtggttctgtaccagtagaagtctcggctttaaacgattcctccaccaccactttctcttcatcgtcttgcaaaatcgttgcttggactcgatgattgttcctgaagttttcaaaaaagttccaattttcagcaaactagaaatggacgaaacaaaagtacagcaaaattcaaatccttttcataatcacgtgtgaacaaatcaattaaatattagctgtagctaggcacaccttaatagcagacgacgagaagagagaggaagatgatgaagcaatcggtgagaggagctgtacgaaacggcggctctagagcgtcgaagagtaaccaaaggccgtgaaatcgtcaacgtaccagaggagatgcctgaaatcgccgccatctccgtcaggaaccaaagatttgagcagataatttcacaggaaagaaaagtaaaagttggatatttttggtagaaatggagaaattttgcgggttttagaagaagaatgacgaatcccaatgtgagcggattctccactacttctcatccccatcgacgtcgacgcgtccaacaaatcacggccggagaaatttcctaccaaaattaggatccgattaagtcaaatgatccgacccgggttaacttattgggcttagaataatagcttatgtgctaaaaggccctgaacatggcgccatcttgtatgaaatagttcgaaattaaaactatcaactgattttctagcccgtgaaaattgctaacatttctgacttggaaactgattgatatataatcccgtgaattcaatgacgtgtatagtttcaaaaaaaaaaatgattaagaatgtgaaaaaaaaaatatgacaattaattagcgaattcaactcaatttgattatttgtttaaattgacttatttaaaaaaaaaactcaaaaatagtaataaaattttggaaccatactgtatcatctgtcttttctgttgatctggttttttaaatatttttagggttacaaatttagctggaagctcaaagtcatacagagacaaattcctaaaacattaaacacctaataaatcagtcattactcattaaatcattgtattttcttaaaccattttgagtttttgaccatgacactctactgcatcctttttaatcattattttagatattaaacagaaactgaaaaaaaaaaactttacacctaccaaaaaagatgcaaccacataatatctgaaaactaataaaataacaaattatataaagtcctatgttaatacgtgtgtgtttttaaattaaacatataaaattacgcaaaactttagtatttaaacaagattacaggtttagcttacaaaaccaatcaacgcgacattacttttgcctttttccctcttttgaatctctcaaaattctcctaattcccaaaattacccctctc

SEQ ID NO: 8681 - DNA, 3000 bp, Unknown
  misc_feature (1)..( 3000): cDNA_ID_1823690_gDNA_ID_1971851_Annot_ID_58412 3000 nt of promoter + ATG
ttttgctctgtgtccttgtcaaatctgaatgtgtatgcgtgtcttgtttgtgggaagtacttccaaggaagaagccagaagtctcatgcttatacacatagcttggaagcaggacaccacgtttacatcaatcttctgacagagaaggtttattgtcttcctgatagttacgagatcaatgacccttctttggatgacattcgccatgttttaaacccaaggtatattagatcttgtgactactacttcatagttcttactgcattttgtgtattgatttgtgaacatgtgagcctttgcacgtagttaacaacaacaaaattgctttgactattatctcaatcagtttcttcttgctagttctctgtatcatctaccatctatttatatttttattcttgatagcttgaacatattactcttctttcatgtcttgtcaaattttctttgattttacagttcctttttatgaaggcttcggtgttatccatttacaggtttagtagagcacaagtaaacgagcttgacaagaataggcagtggtctagggctcttgatggctccgactatcttccaggaatggtaatcctttctctttgattacacttgatcttgaaattaatgtctcctaaaggttaagcttgtaaatatgtaggtggggttgaacaacatacaaaagacagagtttgtgaatgttacaatccagtcgttgatgagagttactcctctaaggaatttcttcctcattcctgaaaattatcagcactgcaagtctcctcttgttcaccgttttggggaactaactcgcaagatttggcatgctcgaaactttaaaggacaagtctgactcaatttatgcctctcacttttagtttttgttatgccctcacctgttgaggacctcgctaatttaagtcaccttgcatcaacaggtgagtccacatgaattcttgcaagctgtcatgaaagccagcaagaaacggtttaggattggccaacaatcagatccagtagagtttatgtcgtggctcctcaacactttgcacatggatcttagaacttcaaaggacgccagcagtatcatccacaagtgcttccaggtatgtgtcagtcctttgacatgtcaacctaaatgcagtttgatataattgcttacaaaaagctgcatcttcatgtaaccttctaaccattatagggtgagttggaggttgtgaaagagtttcaaggcaatgaaaacaaagaaatctccaggatgtcttttctgatgctcggtctagatttgccaccgcctcctcttttcaaagatgtcatggagaaaaacattattccgcaggtatatggctatttcaaatcttgaacgtcttgctactctgtgccatttgaaaaatgcatttcagtaaggggaacattttgatcaataagataacgtgaagtgctagaaaacttataattctcaatataataatgtcacatttggttgagatacaataaagggattcttaaatagtgccattgcaaatttactgtcctggagtaaactgtctttttcgaatctagtttatgacttgggaaagtgtagaattctctgagtccttggttgtttggagctcctgtagcctttatggcttgctacctcgtatatgcgtcttagagtgtttagtttgcaaagtgaggttagcagaaactaatttctttgatgtttgggtcaggttgctctatttgatttattgaagaagtttgatggagaaactgtgacagaggtggttcggcctaagctggccagaatgagataccgtgtaatcaaatctcctcgttacttgatgttccatatggttcggttcaagaagaataacttcttcaaagagaagaaccctaccttgggtgagtctatttggaatttttgtgacgttcatgttgtataaggatccctaatgccaattttttcctatgccacagttaacttcccagtgaaggacatggagctgagggattacataccatcattgcctagagcaccagaaggcgagaatgtgtgttcaaagtataatctaatcgctaacattgtacatgatggtaagcctgaggacggatacttcagagtctttgtgcagcgcaagtcacaagaactatggtaagctttctcaatcattaactattattgtgtttcatgttcacaaatgcatgatctagatctgtgcataagaaagacataaattcatttgggggataatgtccattgcaggtacgagatgcaggatcttcatgttgcagagacacttccccagatggtagaactatcggaagcatacatgcagatatatgagcaggaggaggaatagagcactggaaacaaactgactccatctggttttaagagtaaaagtgaccagtttaatcttggattgaggaggaatgagattagaactcaaaaaggggattcttgaacctcttttttaaggatagagagagagcctgttgttgctagtgattcatcataatgaaaaaccttggtaaaaaaacgcatattgtatgagttttgggaagagcttttggtaaaaagtcttcaaattctgcaacttttgaaattttgtagtaaaatacacatttgacttttgagtttccatttccaaaaaatatcttaaaaagaagtgtgtgtttttctaatttatttgtatcttaatacacaacctctcagccgatgaccgtgtcatgcgtctcaaagaagggtatgctatattcaacacgcatcttaaactgttattcgggttgcaccaagtatcttagccaaaatctaaaaagaaccttctattagagtcactatccaaaccttggatcattattttacccaaattagatactatctttaatagtatatagactggtttatgtatacactatcaatctttaaaccctgagtacttcagtagaatgggaagtattagactgttgatgtaggcgtttattttgactggtatcattggattttcttccacagtaatg

SEQ ID NO: 8682 - DNA, 3000 bp, Unknown
  misc_feature (1)..( 3000): cDNA_ID_1823686_gDNA_ID_1971851_Annot_ID_58413 3000 nt of promoter + ATG
ttggtaaatgcagtggacaaaattgagtaaagattcatactttttcatgagaaatcttatgtacttgctaaatattgtgcctttgcctcttaatttgtcttgtgcagatggtgcagtgatgccttcttggtttgacatccctgagcttcctcttactgcggtaacacttcttgttcaatactttctaaatttgtagcttcagattttctaatatagtttggggtcatcagtacttgtttagtagattttaaggtttataatgtacaaagaacaggctgctttagcttattaaggagtttgttctgttctagagatattttaagtcatcaagtaagtaagtttttatgtgttagggatctccgaaagatgaaagcagtttgcttaaagcagttaagaacgttcatgccattatagataaggagattgcaggaggaatcaatccagaaaatgtgtatatctgtggatttagccaaggaggtgatttctcttagcaccctccatagttacccattttcatggatttacaccttccaatttttctttaaactgcaaagctacaatgtgttgatttatttgtattgcgactcctgaataagattttctgcaggtgcattaaccttggcgagtgttcttctttaccctaaaactattggaggaggtgcagtctttagcggatggattccattcaattcttcgatcaccaatcagtttaccgaagatgctaaaaaggttgttcattcgtttttcggtttcttgtaaagggtaaatgttgattttcctgtcactgttttttgggtatctgagtctctaaattttgcatatgcagacaccaatcttgtggtctcatggcattgatgacaagactgtactattcgaagctggtcaagcagctcttccttttcttcaacaagcgggtgtgacttgtgaattcaaggtataacaataagaactcaaatcaaacactcatatatttgctcatataacagagcagtcaatactgatcacatggaaagatcttagaaaccgattcttggaaatgtatatctaaagagagttcgtttatctgcaggcttatccgggtcttggacactcaatcagtaatgaggagctgcagtatctggagtcatggttaaaacaacggatgcagagctcttcttcttcttcataaaatggtttttaaaggcaactttgtactcaaggtaacaacatcctagtacctatcaagattagaagaaaaatgataacatcagctcatctctggtccaagtttctctatcatgaaaaccggttctggttgaaccaatcttgtttggttatgtaaaccgttacttttgttaactacaacattttgcgtactttgcattgatttgaaaaattatatgtcaacactagaattcttttatttagtcaacaaatcaagtgactacataactcgaattgtgttcaaaatgcaaaatctgaccaaaacaaaacctgcatatgttcactcaaatttacagtttttgtcgggtaaatagttaccaatgacaattgtttacaaatttttgtgaaatggtgtttccgtaactataaaaattcaattatttatcgtagaaaagaagacaaagaatcatatcataataagtcaccatatacaaacaacgatctgagattctgaataatgaagttttagcatatatatggtcgacatctaagtttgaaaccatataaatagttaaatattattagatccgaccaaaaaaatccaaatgagtttgcatggtctgttgatagtacagggttattttcgtcaaaacacataatttcccatttgcgcccatattatctctttggattctctccccaagcacccaccgactataagtgattttcaagaattaccctttcaccatctcaaatattacagaatcttgacactatagtgacagctagaaataaagaatctgagtccaaagaaatattcaaatttgatttgatctagcccgctaatatttgtactgtactgtatatttttatagtgctttcaattagtgcaatcattaggaatttgattatatagatcacgtgtaatgtaaattaaaatttgcaattttagacaatatagtaacaagggaaagataaataacaattatacgtgcatgaacttgttatgattattgaaatgctggcattgggccgttggtgatggtcctaccaaagagaagtctattactttgttaatatcaatcgaatctatcaattcttgtgactccaacaacaaaactctaatcatcttcttttgaaacaaaccaaatactaacaaaaatttcgatctttcaatttgaagtccaaggttgtattgtaacaagggtcaaagtttaactttctcgtgacaattatcgaggcaaagatattggatattgatactcttttttgaaatatatacaaagaccatagtccaaaatagtaattcttaaaatatcacatgtgatggtttttttcttcttgcattggtcaaattgaaatcattatatttggattgcagtctgtgcatgaacagttttcagttgtgttatataatacatagtttttattcatactactgtataaaattttcagaataaatttgaagtaaattagtttcaaatcgaaaattaaaacaaaacaaaagtataagggtaatttagcaaattcttgaaacaaacaggaaaaaactgtaaaataaaaaagcgccaagtaggcgattactgttacaaatgaaccaatcaaagaccaaaacctctaactaacttggctacttcaaagattacgcaatcgcctgtttttaggacacagtggcacactcgtaataacgtagtccagagtgatctctttcgtcatttcacatccttcgtctttcttcttctctccaccttcactgccactcacacctacacgcgcgacttctctctcttctgaagcactcaaagagtaaagtttctctgcatttcagcttctctctctcttctctctgtagaaatg

SEQ ID NO: 8683 - DNA, 3000 bp, Unknown
  misc_feature (1)..( 3000): cDNA_ID_1823682_gDNA_ID_1971851_Annot_ID_58414 3000 nt of promoter + ATG
cttggagtaactggactggattagtgtttttagtagctgtgatttgggaatgatttgtaagatggaatcataaggtttatcactggttgaagtagatgatctttgcttaagaagctgttttcagtatcattgaatcgtgttggattataaatttggaatttgaaactttgtatatctagtttagttttgattattagtgattcatttgaagtgaagtgtgattaaaatggtgcagatagcagtacttgaggaacagaagaaggaaattacagaaattgaggaagatgataagattgaggaggatgacaagattgatgaggataataaggttgagcaggaagacaaggttgatgaggacaaaactgtagaggagtcgagcgagaagaaagcggaagtggaagtggaggaaaagcctgacatcaatgatgttccgatggaagatattcaggtaaagcattcaacatgtactattatctgcttcatcaatgtttctgttgataactccattgttcattcatggattcctgacttattacttggagcctagctgcgtttcttttggtaggattttcaaaaactgatactttatcatagcatcatgcgtacttgaatttgtggtttctagactttgttctaatgccagctataatttgcaatcttgcataatttcccttgtcattgtgttgaattgcctccaatttgaataaagaatgctttgtgatcttttgttactacgaaaagtaaatactgaacctctcatctgttcttatatagcaggttgaagaaaaaatagtacaggatgatgaagaaaaagtagtgcgacaagatttgaacgaaagcactgtggatttaggactgaacttaaatgcaaacgatgctgatgcagaaaacgacccgaaagaggacaagccattagaagaatgataaactgggtgcattgttttggttcctcaccctcaactctcaatatcaattaggaagaaagacattacagaaagaacaaagcagtcattagatatggacgcagatccttgatttggtctgtaaccccatggcttattccttttgatgttaatggaaatgactcattgattcagactgatcattcaattcataggagattcttgtctttttgtctgaattttattttgattcaacattcagaacatttaatttgtctgtggagtacttgatgatttactttaaaagcagcatatgaagggaactttttgacctcctttatcatttgaacaaatgtcaaacaggaatacttaaaaaaccttggaaatgataatcgtgatccgatcagaagatcttggaatttaaagaaaatcatatatcttgagactagattttcaaacagaagcaagatgatatccagtttcctttagaaatctcagcttcgtcatcataatcattcgctcgcaacggcaggctcagcttcggttgcataatcgtgtctgtagatcaaagcaagtgtatcagtttggcaagggagaaaacttcaactaatcaaccaaatgcttatttgactaagtcgtgtcttaagatgtacataacatgtaaaagtaagaagaaaatcagatgttctctcgatcttactttattttacgagcaagctggtatatgcctgtccctgccatagcaacattaacactgaagaggttccagtttttctgtaaacaagagtcggaatcaaagaagtcagatcaaccatgaatacaatcactaacatctcatcgcaaacgcaagggagaagatcatgataagagagtcttacaatactaaaaatagattgaattttgaaagggaatgtaaggaaacttaccggattgattaccatgctgtaacgagaccaaataacaccagtgcatgtaaccgctgatgcaagaaatatcagagaatatttgaaagtacattgaaggcagtgcaacacaatgaaactgatcaaggaacaatgacaactatggggaatatgataagcctataaaagtccacaattcaaaacagaggagtaaccttctgcagattaagaagatgatagaataatacataccgatttgttgaggataggaaagtttctctggaggtttggcaaagtctgcaatgttggcaatgctaataccccacttgaacgttggtgcccagaaatgaactgagaaaacacaaaatgagagtcttattgtttgatgttctgagacacgagtgacgtgaattggtaacggaatctatcacttatgaaacccattataaagcaaagagtgattctcctggaccataagcaacaaatcaatccatcctcgagaactaatcgaaagtcaaaattcatcaaaaagtgtttgttttttttttagtagaaacaaatcaggattcaccagaaaaatcgaaaagacgagaaagtggaacttataaaagacaaaactaacaacagattccaaggagatgtagattgctcaattatccataattgaatcgtcaattttacatgaaccaacaaaaaaaaaatgaatcatcgaaatcgatgaggaaagctaatcatcgtggaattgactcactggttttaggtccggcagggtgattccaaatagcttgaagcttcgaagtcgccatcgaaaagtttacccaattcccaaaaatgctctaaatttcaccaaccaataatcgtccctttctgtctctcgcgagattcttctcccttctctctccctgtctggcttaaaacactaacaaaaaagggctgcagctatgtacgatgtcgtttcggacataaaacgacaaccgagggtattttggtacttttcactcttgtcctagtggactttgtagtttctactttgaaagtcgtcgcgaagactttgagagacaaaatcgccattgaaatggcaaagtttcaggcgattttaacatgcgaaggaatacacagacgaagcctatcgatagtgagcacttttcatcttctttatctttctttcttcttcttcacggaactcaagcacgatg

SEQ ID NO: 8684 - DNA, 3000 bp, Unknown
  misc_feature (1)..( 3000): cDNA_ID_2177993_gDNA_ID_1971851_Annot_ID_58415 3000 nt of promoter + ATG
gctaaagcagcctgttctttgtacattataaaccttaaaatctactaaacaagtactgatgaccccaaactatattagaaaatctgaagctacaaatttagaaagtattgaacaagaagtgttaccgcagtaagaggaagctcagggatgtcaaaccaagaaggcatcactgcaccatctgcacaagacaaattaagaggcaaaggcacaatatttagcaagtacataagatttctcatgaaaaagtatgaatctttactcaattttgtccactgcatttaccaatgagggaggatttagatgactaagccataatttgataaatgaatcacacatcaaagcactaaatccaaaagaaagacacactagtatcattcctatagtaaggactagacctaaaagttcgaattatttaggagaatgcaaatttgttcagctcaatcaattcaaaaacgatgatcaaagtcaacgcctagagaagaaagaaacgaacaacaccaaaatcagaaagtaaagggcaatcatacaattgcaagagactggatttggtggagcagaagggaagagccacttagtgtttctaaactcctgggacctgaaaagtgttttgatgggttcgttggcaggtccggaatcacctagcccgtgaagccataagatgaaggttcgagccatggagtctcggttccgtaaagcagaggtagatgatacgtcagatttgtttaggaagaagaatgcgaagaagaagacagagctcaatagtgcgatagtgagaagaacaatcggcttcttcagtctacttgttcgcatgccttcaccattttctctcgagatcgatctctcaaaaaatgttttgttttggagaatgtctaaatgactaaaatgccctcaatgttaaaagattatcaaatttgttggctatgttttatgttctcatgttcacactcaagattgcaaatgtattccaatgcttgcatatacataattcaaatcgatacaatcatactagaaggacacagcaaacaaaaccatacgaggagcttagaattgtcaatcttcttcttcttgtcttcatagacgacatgtaggtattattattaccttcagtggaacatttctttaagacaattaagttggagacaagtagacgacgaacctttcaaccgtctcttgatccatgactctatatacttcagctccttattgctgatcgagtgcccgagaccaggatatgcctgcagataaacaaatcaccttagaagtataaataattgtacattggagttctatcatgcatttgtctcgaaaaagagttttgatttgaatataccttgaattcacaggtaacaccggcttctttgagaaaaggaagagcagcttgaccagcttcaaagagtaccattctgtcatcagtgccatgagaccacaagattggtgtctgcatattgcaaagtctgaagactcagaaacacaaaaacattgatcaacgtttataagaaaacataagtgaggaaccttcttagcctcttcgggaaactgactgatgattgaagaagtgaatggaacccatccacttaggacggcacctcctccaagagtttttgggtaaagcagaacactagccaaggttaatgctcctacaagaaaattcttattaggcgccacaatgcaaggttcttaagacataagtggattcagaccgatataaaaaggtctctctacaaagaatattgaaaagacaaagaattcatgaaaagagaaacaacctccttggcttaatccacagataaacacgttttctggattagttccttctgcaatctcctggtctataatggcatgaacattcttaactgcttcaagcacgctgctttcatcaattggagagccctaacatacataaaagttgcacacttattgtgatttcataaaatctcttgaaaatgcaagagtgctctgctctttacacaatctgctgaacaagtgttgattctagataatgcgtcataaggtttaacaaaccaaaaggtgctaacttggagctaccagcccattaactatttgccaattcatactataagaggcgttagatagatcaagagtgaagtgaagtaataccactttaaaaggaagttcaggaacgtcaaaccaagaacgcatcaccgcaccatctgcacaagaaagtatagaaagacataagcttttttcagacacatatggattaagagacatgacaccaacagataccacagagaaatcaaagataatcaaattgtgtacatttgactaaatgtctttcaaattaacagaatgtgacaaatctccttcacatcacagaggcaaataataacgctaaatcaaaatggcatgaagtggagaccgaaccctgtagcccaaatcaaaccataaaccatgaacaacgaaatcaatgaatgcaaatcgaaaatagaaaaggaagaacgtactgttgcaggtaaccggattgaatggagcagaagggaagagccaactagcgttacttaactccgaggatttgaattgagtttggatgggttcattagcaggtccagaatctcccaacccgtgaagccacaagatgaaagttcgagccatcgtgcttgagttccgtgaagaagaagaaagaaagataaagaagatgaaaagtgctcactatcgataggcttcgtctgtgtattccttcgcatgttaaaatcgcctgaaactttgccatttcaatggcgattttgtctctcaaagtcttcgcgacgactttcaaagtagaaactacaaagtccactaggacaagagtgaaaagtaccaaaataccctcggttgtcgttttatgtccgaaacgacatcgtacatagctgcagcccttttttgttagtgttttaagccagacagggagagagaagggagaagaatctcgcgagagacagaaagggacgattattggttggtgaaatttagagcatttttgggaattgggtaaacttttcg

SEQ ID NO: 8685 - DNA, 3000 bp, Unknown
  misc_feature (1)..( 3000): cDNA_ID_1823676_gDNA_ID_1971851_Annot_ID_58417 3000 nt of promoter + ATG
tcatcatcctgtactattttttcttcaacctgctatataagaacagatgagaggttcagtatttacttttcgtagtaacaaaagatcacaaagcattctttattcaaattggaggcaattcaacacaatgacaagggaaattatgcaagattgcaaattatagctggcattagaacaaagtctagaaaccacaaattcaagtacgcatgatgctatgataaagtatcagtttttgaaaatcctaccaaaagaaacgcagctaggctccaagtaataagtcaggaatccatgaatgaacaatggagttatcaacagaaacattgatgaagcagataatagtacatgttgaatgctttacctgaatatcttccatcggaacatcattgatgtcaggcttttcctccacttccacttccgctttcttctcgctcgactcctctacagttttgtcctcatcaaccttgtcttcctgctcaaccttattatcctcatcaatcttgtcatcctcctcaatcttatcatcttcctcaatttctgtaatttccttcttctgttcctcaagtactgctatctgcaccattttaatcacacttcacttcaaatgaatcactaataatcaaaactaaactagatatacaaagtttcaaattccaaatttataatccaacacgattcaatgatactgaaaacagcttcttaagcaaagatcatctacttcaaccagtgataaaccttatgattccatcttacaaatcattcccaaatcacagctactaaaaacactaatccagtccagttactccaaggaatcaaaatggcaaaacagagacataagcactccttcaacaatgctcaaaactgaccctttttttgtcaatattaatacggtgattaaatccctaatcactgtaacaatcacctaatcaaacttctagcaaaaaccttatagctcaatccaatgcaacaagaacattgaaccaaaaaccaaaaactaaccggaacgtatttgaatctccgccgtggaggatcttctgccaccgttgccaccgtatcctcgctcggagaattactctcacttttaccatcttcattgccgttaccattctgagacaatggtgcccacttatacagcaacaaatgcgatccattactaccgtcagaattcgaaccaccgttaacgacggaagctgcagcagcggcggaaccggaggagctattattattgtctttcttagaggaaggagagacgtgtacccacttcttcttccacttcctcaccggtccggtgaaaaccgttgccggtccgtaccgtgtcgaggacctacctaaccgtgcaccaactccttccataacgacgaatcgtttatcgttgattcactgatcaaaattcaaatttaaaatcccaccaatctgtttaatgaaactttgttttcaaatttcttaaaagtaaaatttgctctttccaccgaaggaagaactcagatctcagtttttgcgaagcgaccaattttattggtttttgcttcaagtagaagactcttgttgagcaagaaggtttgactattgacacgtgtgtgatagttataggctaatctaattatacttaacaataattgcttttgtttgagaaagagaaagactctgtctaaaccagagggtctcggctaatcgttttgacctagtagcgtcatcatagagagtttagtggaaaagactctgatacccctgaagttctctcctatataaacatcgcttcaacctttcagctacatcatctctttcattacgacgcctaggtttagggttttcaacatcaatttttttgaatcagattagtttttttttttttaaattggggctacattgtaccgagagaagggctcgatttcgatacctttactcttgaatttgccaaaaaaacggctgtagctagattgaataagaagctatctggccggtggtcgcgagagggatttagatctctccggtcgattcatctgcttaccgagtttcttacattttctttttgattttcttaacatcttttgattcgttttattgaatgattggatatagtgaatagggaatagcagattttaaaataccattttcgatagttctttctcgtgtattaaacttagggttcctttccaggcgttctgtgctctcttcatgaacagttgtgtcttattggtacctacatatgtattttttttacattgatcgcatttaaccaaaagtataacagtcgataaagatgaaagtgatttagtatggccctgaataacttatgtgatttaattcgaccaaaaaattgttccattgaattgtcataatgaagattgaattgttttggacctaatcaaaggaataaacatttgtcatttggacctaatcaaaagaaatatatttgaattgaaccaactcaaaggaaaatgttagttttgttttgaccgaaactaatcgttaattgtcgctgtcgcatatgaaacagagtacttgcaaatgaattaagaaaacgagaagcctgggaatgagtttgtgatattggtttgaaatagtagatgtgaacaataaccattttcagctccagaaattagactgaatggacctcttgttgtatattagaattcataaaacaagatatgtatattacccccaaaaattagagaagtgtttgttctcgatgaaacgttagatcttgtaaaccaaactaagtatttagatctggtagagtaaaccttctaatacactgcaatcaagtcccaagcaaacaagatttgaatttgaaaacacaaatttaaaagcgttctcatcttgcaaagctgaaaaatgaaaatccatagtaagggaaaacaatttcagtttatgtactacacaattatatagagttcacacaattgaccattccttaggttggttatacccaatctcaaaagccgccataacctttgcgcattggaatgtgttcaatcgtcaaaagaaaaattagccctgggc

SEQ ID NO: 8686 - DNA, 3000 bp, Unknown
  misc_feature (1)..( 3000): cDNA_ID_1378584_gDNA_ID_1971851_Annot_ID_58418 3000 nt of promoter + ATG
ttgttatgcactcacctattgaggacctcgctaatttaagttaccttgcatcaacaggtgagtccacatgagttcttgcaagctgtcatgaaagccagcaagaaacgctttaggattggccaacaatcagatccagtagagtttatgtcgtggctcctcaacactttgcacatggatcttagaacttcaaaggacgctagcagtatcatccacaagtgcttccaggtatgtgtccgtcctttgaaatgtcaacataatgcagtttgatataatttcttacaaaaaagctgtatctcatgtaacctgttaaccattacagggtgagttggaggttgtgaaagagtatcaaggcaatgaaaacaaagaaatctccaggatgccgtttctgatgcttgggctagatttgccaccgcctcctcttttcaaagatgtcatggagaaaaacattattccgcaggtatatggctatttcaaatcttgaaagtcttgctactttgtgccattaaaaaaatgcatttcagaaaaatgataacgtggagtgctagaaaacttatgattctcaatatacagctacataaataatgtcacatttggttgagatacaattaagggattcttaaatagtgccattgccaatttaatgtcctggagtaaactttctttttcgaatctagttcatgacttgcgaaagtgtagaattctctgactcattggttgtttggagctcctgtagcctttatggcttgctacctcgtatatgcgtcttagagtgtttagtttgcaaagtgaggttagtggaatctaatttctttgatttttgggtcaggttgctctattcgatttattgaagaagtttgatggagaaacggtgacagaggtggttcggcctaagctggccagaatgagataccgtgtaatcaaatctcctcgttacttgatgttccatatggttcggttcaagaagaataacttcttcaaagagaagaaccctacattgggtgagtctgtttgaaatttttgtgacgttaatgctgtataaggatcccctaatacctggttaatttgatacaatttctttttctatgccacagttaacttcccagtgaaggacatggagctgagggattacataccatcattgcctagagcaccagaaggggagaatgtgtgttcaaagtataatctaatcgctaacattgtacatgatggtaagcctgaggacgggtacttcagagtctttgtgcagcgcaagtcacaagaactatggtaagctttctcaatcattaactattattgtgtttcatgttcacaaatgcatgatctagatctgtgcataagaaagatataaattcatttgggggataatgtccattgcaggtacgagatgcaggatcttcatgttgcagagacacttccccagatggtagaactatcggaagcatacatgcagatatatgagcagcaggaagaatagagccctggaaagaaactgacttcatttggtttaagagtaaaagtgaccagttttatcttggaatgagattagagatttgtttcacaactcttttggaaaaagatttttggacccctttaaaggatagagagcctgttgtatcatagtgaaaaacctttggtaaaaaaacacatatatgagttttgggaagagcttttggtaaaaactaaaaacgcatattgaaagaaagcgacctcttcaaattctcaaacttttgaaattttgtagtaaaaaacacatgtgagttcccttaatatagaagtggctgtttttcgaatttatttgtaacaatgaaagaggaatagaatctaattcactatctctacttttggcgattctattctattccatcgtccaaaaaaagaattgattctttttttgttttcattaaccaattctggaagattatgagcattgaacataacaaggtaacaatttgcaactttgtagaaaagagttcataatattctcgaatttttaattgtcatttcaagttaatatagaggaggacctttacctttaattaaaatattatatccctttattaattgtggcttctagaatcaaaagttaaaagattcgagaaataaggagaatcattttcgtcttctacttagttttcttcaactcgatttctctgctccatcttcttcctcgtcttctcattctctctcgctctggcacagtagaaactgagctcacgaaagcaggtttcacgtctcttccttatttacctcattcctgaatcatatgtacatagttttgtttagatatgtgtttcgtctcctcaatcctcagatctccacgagaaactagtattggttcctctttgttattctccttagctcgtgtgattactgacaccattagtgaagatttccagtatttccataagtatttcggctgcttaaatttgggttttattcccgattttactcgtatttgtcccatttttcctgtttaattgtatttctctgtgaatcacttatgttcattgctttagattcaataaaattttgagtgaaaaatcctactgagagcgtttacttatggggaatttatcaagttcaagtttgaattgttgtatattgagtgttattaaagagtttcaatgaatcaattggatggttttttgtttgggttgctcaactacctatgagagtacaagcttcaaattgtttagaatgctggtgattttgtttccgtgttttaataaaagcatttattggtgagagagtttggagtacatgttattgatataagtacatgtcattgattgattcagatgagttttctacttatatttgcaaattgattctaaatttactcgactttttttttggcttatcaatgatttttagttgccagagtctttctatcttttttttgtattctgacgttagactaaggtgatgctagatgtactcaagttcaattttaaattttcacaggtagtcagtgtttttgtttcgaactcttccaacatg

SEQ ID NO: 8687 - DNA, 3000 bp, Unknown
  misc_feature (1)..( 3000): cDNA_ID_2178004_gDNA_ID_1971851_Annot_ID_176408 3000 nt of promoter + ATG
agcatgtcgatacacaaccaactaaaacaaagaacccaacggaagattaaaatagcattaaaggaagttaaaagtgaaaaggatcttttcttccctatcagagttctacagcaaggagtcataagtaggttccctagatacacacctgcaagagagttgtgatacagaagtcaattaccatatttggacaatgctgatatataagtatcataatctgttaaatcaaacttcacttacactagtagttcctagttaattaagtcagaccagaagatatcacgactgcttgtacatatggcgcctcagcatctcatttatccccacagctgaaatgctttcacatccaagaagatctcggagcttttcatcacactgaatagccattggatttactgggtcctgaaagaaaattgaaaagcagaataaacaaatcttaattttcttgtttatggccattcactatgctctataacataaagttatgtgaaatcctatactgtaaattatcttatagagtaaaccacaataccagctttagttagcagcaaacaggaaaaaaattcgaagcaataaggagaaaccagaggatttcaagattaaaatcattacctctaaattgttgagttttatgtattcccaaacacggcgaataatctcttcgtctgccatctccgtctcaccagtgccaaagaacttaccaagtggctcagataatgtaacagttgaactaatagcagttgaactaataggctcggtggtctcagtcttagtctccacctcagtttttgccttttttgcttgaccagagtcctctgccaaaagtgactcaaacagtcagtaaccttgaacaaaccaagcacagttggaactcagcaaaaaacgcttgtgtttaaccattacttgatggatcaagcgggagaatatgcttagcaagcaacttattcatcttgaacatgtcagtgcaatcagtctcaaaaaccacacgcaacgcatcatcacagatgatcttccgcttgttactcgggtcttgaaggttattcttccttatataagcccacaattgcctcacaatctaaaaccaaaagccaaacacagcaacacataaataacaaccacaattgcttatacacattataatcataaatgaaagacaatgataacctcagttctaggaagagcaggttcaccaacaactacttcaagttctggagaaaccctacagactttgtttagtcctccaggaccaccctttcttttagttccagccggagcactgcaaaggaaaagttgacaaatttcgttgatgtgccaaatttaggtagatcagaaagaaataatcacactataatagaacgttgtatgaatcaatgtgctaaaaatatcacaggatgataattctaaacatgagcatgtaaaacctaaaaacccgtaaatgaacaaaattgacaaaagatttagacattcctaaaatggaaaatcatgttttccatgaaagtagcaaaagccctaaattactgaaattggaacaaccttgagcaaaattacgtaccaacatttgaaatatgttgcaaaccctacctttcttttggggcttgattaacagatagagaagcattcccgccatgtgagagcatcacagaggattgttgttgtcgcggagactgctgctgatgctggtgctgttgcggcggcatgtaaaccggataaggctgccggaaatttaggtcataagagtgataaggaggctgaagagcgaaatgtgaaggatattgttgtgattgagaagaaacagagaattgcgaaggatggctaagtgtgaaatgccctttcgccatcggaggaacattgacgccggaatgcaaattctgctgctggtgagaagacggcggaggaggagggtgagattgttgtacggatgaagcggaggcgacggaggcagaagggttttggtgagcacggaggaggatattgatctgatctctgatgaaagtcgtcttctccgtgaggtctaaccctaacttagcttcaagctgctgaacaatactgcttaacgatgtgagagagctagggtcggattgtcgaagcaaagtctcgactcctttcgctagatcctggtccgacaccattgtcgagagagaatttcaaagctttttttttcatacacacaaaaaaaaaaactttttaaggagaaaaaaaaaaacaaataccccacaaaagaaaaagaaaaaaagacaacaaattctctatatctttctctctcttatcctcttctctaatcttgtctctttctctctctccttcttcgtctctgtctctttataactatttggaaagacgaatatgcccttcagggttggttagatttatcaaatgatgacaaatgtcggtgttgcccttatgagtcatggtatctatggcttgtaggtagagggtgttgtcgtattttggctaatctatttgcttttttacttcttcgccagctggctttaacttcagaactcatctctttactcgtggaatgtcgaatacgtccttgtagattttcacgcgtttatagtttgcttcgagaagcttgagggtattaatggttattcgataagtatcggatcgtgaatacagatcaattactgaatactgctgacagaagtaatataaatggaacagattgttattgggctataacagtgtggcccaataataaatattcggccttttaaccgagttaatcaatctgggtgagacttgagtcggctcttgaagctttaataggttgtttgtttaacgtctgcgttgtggcggattttgaagtttctcgagaaaattgggaacgagagataagttcgagtagattcgcgactgtcgacgcttctgatttgaagtatttggcgttttttggaagagttcattgcttctttggttgaggattcttcgtgaatcgctgggattttgtgttctaaggtttttgaagcaagctttagcttagggaaaattttgagaatg

SEQ ID NO: 8688 - DNA, 3000 bp, Unknown; identical to SEQ ID NO: 8686
  misc_feature (1)..( 3000): cDNA_ID_3091484_gDNA_ID_1971851_Annot_ID_176407 3000 nt of promoter + ATG

SEQ ID NO: 8689 - DNA, 3000 bp, Unknown
  misc_feature (1)..( 3000): cDNA_ID_3091488_gDNA_ID_1971851_Annot_ID_176406 3000 nt of promoter + ATG
aaagtataacagtcgataaagatgaaagtgatttagtatggccctgaataacttatgtgatttaattcgaccaaaaaattgttccattgaattgtcataatgaagattgaattgttttggacctaatcaaaggaataaacatttgtcatttggacctaatcaaaagaaatatatttgaattgaaccaactcaaaggaaaatgttagttttgttttgaccgaaactaatcgttaattgtcgctgtcgcatatgaaacagagtacttgcaaatgaattaagaaaacgagaagcctgggaatgagtttgtgatattggtttgaaatagtagatgtgaacaataaccattttcagctccagaaattagactgaatggacctcttgttgtatattagaattcataaaacaagatatgtatattacccccaaaaattagagaagtgtttgttctcgatgaaacgttagatcttgtaaaccaaactaagtatttagatctggtagagtaaaccttctaatacactgcaatcaagtcccaagcaaacaagatttgaatttgaaaacacaaatttaaaagcgttctcatcttgcaaagctgaaaaatgaaaatccatagtaagggaaaacaatttcagtttatgtactacacaattatatagagttcacacaattgaccattccttaggttggttatacccaatctcaaaagccgccataacctttgcgcattggaatgtgttcaatcgtcaaaagaaaaattagccctgggcatgtgggtattcgggtcgggtcgggtcgggtcctttcgggttcggatttttcgggttttgaaattttggacccgtatggttatatcaacaatttcgggtcgggttctatccgggttcacttcgggtccggataattcgggtattgcccataagtaaccaaaactatctcgggtttgagtactacttacccaaactttatttaaatatacccaaaaatacataaaagtattcataaaacccgaaaaaaccgcaattataacaagtttttccttaagagaataatataaaacaagaaataaaccttattttgagcttattccataactcatatcattagacaagtcacaaattcaagctattaatgcatatataccatcatatgtatatatatgttcgggtagtaaaaaatacccacgagtatcgcgttcggttcgggtaatacccgatacccttggttatttgaaaacagaacccgatcgggtaattagccggaaccgaagtagaatgggttcgggtatttcgggtcggattcggttcgattcttcgggttcggatattatgcccagacctaaaaaaaatcttaatgtccaaaaggtccatccgcttttgttataatccatgatacagcatcttacttcactaataaaaacactcaagtctcaaattttccaataaattgttttaccgggccacttggtcgtgaaaattccaactgtaaacgcatttgctcataatgtgtttcttctttgtaccaccaatgaagatctaacatgctcggaagagtgctcaatgtttgttaatcatccccaaaatagtcaaacaatccttcatacatataacttgtttagcaatatacattagtaatcatcaataaaaaaaaagaaaaacgaatatagtactatcactatctaacaatgtacagttaaggttaactgtctgaatatggtttcttctctttcgttaagaaacagtctcatgttaaatacatctagtcatagtaaatgattggttggtaaagttcattccctaaatccgtgcgaacttttatgtctctgactctaataagtaccaaaaaccattaaagtaaagtggatttacacgagttttctagttatattattaatccacattaagtaaaaacaggaacaaagaaggatgaccttaaacagaaattactgattcaccaaattttaccgaatcccatgtcgacggaagtgtgcgccgctcttaggtttttaatttcaattttaatattcttttacaatatccaaaattccggcaggtgataagacgggaatacccctcaattggcgaaattcagaaaaggaccaagagagagaagaagacgaaacgatcgtcagagatagagagagagaaaggtcatcacccattctcactcgcagaatatttgttctcatctgattcctccgatctgccatgtctcggcttttctaacgctaagaagtttcacagacgcggcgaaggagagggaggaaggagatagatctctttttccgtcgcgataataataaaaaataaacggtttgtttttcgttctcttgctgttcatgtggatcggatttttgttttcgtgctagattccattagttttttggtttcgggatcgactagtttcgtaatggatctgatttttctattggatctccctagttttgacctgagcaagcgtttgtgaggacttcatgttcttatgacctagattcgttgttttagatgtggaatttggtgtttcactaatcgatttattcgatttctctggtttttggtgatgattgatcaacgtgatgatttgaagatattcattgttcatgtgcattgttgtaaagatgttttcaagtttccagtgtcttgattaatcaatcactgtgttatgggaaaagtttggaatcttaactgctaccattagcgtgttggtttgttaaatcactactttatatacttattatggtatgttgcttgtttctgcaacttaactcttattggttactgttggagccttgagaaacaatcagttaataaagtcaattagcagagataatcttgttctttcttttgcgttatttcatttcatgaataaatcagatgttagtgttgtctttccctcttctgtttggtcttctcagatggtttttgactgttttgtggcttttattttggatctctagtgtctagaggctgttactgaagagttgattcatacggagagaggatagaa

SEQ ID NO: 8690 - DNA, 3000 bp, Unknown; identical to SEQ ID NO: 8684
  misc_feature (1)..( 3000): cDNA_ID_3091492_gDNA_ID_1971851_Annot_ID_176403 3000 nt of promoter + ATG

SEQ ID NO: 8691 - DNA, 3000 bp, Unknown; identical to SEQ ID NO: 8683
  misc_feature (1)..( 3000): cDNA_ID_2177989_gDNA_ID_1971851_Annot_ID_176402 3000 nt of promoter + ATG

SEQ ID NO: 8692 - DNA, 3000 bp, Unknown
  misc_feature (1)..( 3000): cDNA_ID_3045974_gDNA_ID_1971851_Annot_ID_176399 3000 nt of promoter + ATG
acaccggaggcgacatcaagaaatccggcgagctcggaaggatgttcgacatctccgtcgtcgattcagcttcttttcaaggaccaccgccgttaatcgtcggtggtaatagcagcggaggtacgtcaaggcttcaggcgccgccacgtgtctccggttcttcttcaaaccctaacagtggatccgttcgatctggtcccaactctggttcggttaagaaattctcaggtccactctctcagcttcagccaaccggtttaattacctccggttctcttggttcttcgggtccaattttgtccgggtctagaaggtcgggtcaattggatcaccaattgagtaatctagcgtcgagcaagcctaaatacgggtcgtcggtgacgagtcttaacgtagacccggttcgggtcgggtttaaagtaccaaaagcaatggtttgggcggttttgatagtggcggcgatgggattgcttgtgggagcttttcttactgtggcggtgaagaaaccggtggtgattgctgcggttttagcagcagtttgtcctgcaatcgtggttttggtttggaattgcgtttggagaagaaaagggttgttgagttttatcaaaaagtatccagatgctgagcttagaggtgccattgatggacaattcgttaaggttacaggggtaagttaaaacctaattttcagatgttaatatttccagttttagtaagtaactttaattgttctgattaaagtaaattgcttccatatttagcttttgatcattttcaactttggtgaagttagaatgtcattatcatcattggcttttcttatggatgttatactcttggatctctctgttttagtgttaattaacttcatttagttttgcttcattatgtttctgggtgctttatgatgatttttgcttttgtctgtctttgacattttatattatctcaccaaactaaagtttgctgcttgtgtttagtatagattttataagagtctttagtgaaattagaccatttataattcgacaaattggagtcacgggtatttttgtattgtcgattggattacagtcgtcaacagctagcttaatgcgttggacagaccatttatattgtctgaattaacaatgttgatgtagatatggtagtgtggtcactggtgtgtcttttatttgctggaaatgttaaaacttttgttatgtttttgtaggttgtgacatgtggaagcattcctttggaatcttcgttccaaagaacaccaagatgcgtttatgtatccacggagttgtatgaatacaaaggttttggtgggaaatccgcaaacccaaaacatcgatgcttttcttggggatctagacatgcagaggttagtttctttttctcctcttgcaaaaggaccatttgtctcagtgatttggtcaaagttttcagatcttatatgacaagaaaagatggtgaagtttgatgattcttgttgtggttatatttctttggcagaaatatgtgtcggatttttacatctcggatttccaatctggattgcgagcactagtaaaagcaggatatggatcaaaagtttctccttttgtcaaaccggcgacagtggctaatgtaacaacgcagaacaaagatttatctcccagcttcttaaagtggctgtcagatcgcaacctctcagctgatgaccgtgttatgcgtctcaaagaagggtatgttatattcaacacgcatcttaaactgttcttcgggttgcacgaagtatcttagccaaaatctaaaaataacgttattagagtcactatccaaaccttggatccttattttacccaaattacaaccttttaaaccctgatttctttagtagaatgggaagtattaaactgttgatgtaggcgtttactttgactggtaccgttggttattcttccacattaaaagtcacagtaatggaaaaagatgtgatgagacatgtattgtaggaagaaatccagcaactattgtcaacgttaacggcttaaacatctcacatcagtgcatgataagtctgaagttaaagggcttagaagtttgaattaagtctaaagctaatgagacccaaaagtcaccgtttctagtacaaatgatcgtttttagtacacaagaaagctcattggtttcacttttgctgtcaaagagaatccctttgttactgatttaaaatcatatttgattgtgtgtgatgcaacagatacataaaagaaggaagcacagtgagcgtgatggggatggtaagaaggcacgacaacgttctgatgatagttcctccggcagaagcagtctccagtgggtgccggtggtggcactgcctcttcccaacctacgcagatggcttaatcataacctgcgacgataatcaaaacgctgatgtcattcctgtctgaaaccaatatgtatgtaatgcttcttttgcccgatattcaaatataaaaatgcttaaacagttaggctcacgagactgaaggaaggaagagaagagaagagaagagagggaatgagaggacagccaaattggttcaaaaagaaaaccaaataggctttgccttttaccttattagcttttgtttttctttcttaattctgttttttttttttgccccttgtatggggtttatgtttgtgtacatagagccccaaagtgtaaatgctcttttctgttaaaataattattatgtcctatccactattcttatccaccaaggaaaccttaggcatctctgcaataggtgcatgcaatgttgtgctagtaaacaagtaagcatgaaagccgcagagaagctgatgacaacaaagcccatgtagaagcctttgattggtttccatagtggaaacttaaaacttaaagcccaaatgtggaaaataaaagacagcccaaaacttacccatttaatttacggtctctcactctgcttgtgaatagcgaaaacacaaaaccccaaactctctctacgaaggcggatg

SEQ ID NO: 8693 - DNA, 3000 bp, Unknown; identical to SEQ ID NO: 8681
  misc_feature (1)..( 3000): cDNA_ID_1823690_gDNA_ID_1971851_Annot_ID_176398 3000 nt of promoter + ATG

SEQ ID NO: 8694 - DNA, 3000 bp, Unknown; identical to SEQ ID NO: 8680
  misc_feature (1)..( 3000): cDNA_ID_1823694_gDNA_ID_1971851_Annot_ID_176397 3000 nt of promoter + ATG

SEQ ID NO: 8695 - DNA, 3000 bp, Unknown; identical to SEQ ID NO: 8679
  misc_feature (1)..( 3000): cDNA_ID_2177971_gDNA_ID_1971851_Annot_ID_176396 3000 nt of promoter + ATG

SEQ ID NO: 8696 - DNA, 3000 bp, Unknown
  misc_feature (1)..( 3000): cDNA_ID_3091499_gDNA_ID_1971851_Annot_ID_176394 3000 nt of promoter + ATG
cggttattaagatacttgacactttgtatcgtgaccgaacatatgcaaggttctttgttcttgagacaattgctagagtgccttattttggtaagtgcatctatttgtaattgtagtttcagttcgttataatatttgcaagaaacattgagcagagcattaagagctagtcattaggttttgtattcttcagaagacagtaagattgtgaacatcacttgagatgtgtgcagaagaagaacaatgacgaaatagttgtgtttgaggaatatgtactctttcttatctcattagaagcatagttcaactcttaacaacaaaaggcgattcagtcatcgagatattggatttgttgagaatcgaatcttgttttttttagtgtgtttatcactaattatggatctggataccaaatgaaaagttgttccgaggctagaacataatgtttgtttcttctatatgctccttgcagcgtttatgtctgtgctacatatgtatgagacctttggttggtggaggagagcagattatttgaaagtacactttgctgagagctggaatgaaatgcatcacttgctcataatggaagtaagaaccaaaatgttacttctctacaagtttcatactctttactcacatagttagtaatagtaaaacaaatgtttctaatcacaggaattgggtggaaattcttggtggtttgatcgttttctggctcagcacatagcaaccttctactacttcatgacagtgttcttgtatatcttaagccctagaatggcatgtaagtttcctttccgcgtaacttctagaaagtagctgaataaattgcttctggtctacatgacttcgttaaccttgtgtcacctatgcagatcacttttcggaatgtgtggagagtcatgcatatgagacttatgataaatttctcaaggccagtggaggttggttaccaatggttttttcttctttctccaccattctgtgtaccatttacattagaactaaagttgttaatggagttattgctttgaaatattacacaaaattcttcaacgatctttacattctgaattgttgtgcttcatttttttttggtttccctaaacagaggagttgaagaatatgcctgcaccggatatcgcagtaaaatactatacgggaggtgacttgtacttatttggtgagtttgtctttccaggaattatcaatatcctccagagttgtagagatgtttttacctatgattagtagtcttttaaactggccctgtattgtctgcagatgagttccaaacatcaagaactcccaatactcgaagaccagtaataggtagcaaatctatttcatatccgtttagttctttccatctctgattccgtcgaaccacaaaatgctaaaaaaaagtttatgatttatccatggttatgattctgcgctctataaatgactgagattctgtcttatgtttgtatggaggaagcattattcacagtttgtgacttactttgatgttaaaataagaatctatataacgtttttgttgttttgtgattacggttgggcagaaaatctatacgatgtgtttgtgaacataagagatgatgaagcagaacactgcaagacaatgagagcttgtcagactctaggcagtctgcgttctccacactccattttagaagatgatgatactgaagaagaatcagggtgtgttgttcctgaggaggctcattgcgaaggtattgtagactgcctcaagaaatccattacaagttaataaattagaaagtaaactaaaaaagattatttgtatcagctcatgaacaatagatataatcccatatacttgggaataaaggaataatgtgaaattcccatcgttgtgctagtgtgtgagagaatcaaataccctaatgatgtaaatgtactttgatgagcttaagtcgttgtagaccattttatccatactactagcctttgtggttgcattgtcggtttcttcaattcttatttcacaggagtaaaaaaaatgtttaaaagtacaaaatcattgaatgtatcattctctcaaaaagcatattggtattagcgtttagaatctctatatcccacacttttatttttattggttttgttggggagagtgtggcgcaaagacgacgtcgtctatgcgaacatttcacgtgggaaaagccttgattcatgcgccttctttaatttttcttctttttttttttttttttttgtctcttctttgcctttcactttttaaaatgattttccgcgggtttaataacaaaaatgttttcccgccagaaaggttttaccaaaaaaccatgttccggttatagcacaggtaagagaattcatcagtctagtataattagcagtaatcaaattcgaatactttgatcgtcgcttttatttcagagttagcgttacattaatagtacctttattcgattgatgatttgtttaatctttaatagggtttgaactccgatggaggaccttttttgttggtaatattcccttcgtttcacaatataagttgttttaactaaaaatacgtatattaagaatatttatttttaaaatgttcaaccaattataaaaaaaactgtagaatataaataatcataaagtattaaaataatatataatttgcatagaaacttgaaaacaacttatattataaaacaaaaaatttggtataaaacaacttatattatgaaacggagggagtataaacttaagtactaattcgattttgtttctattcgagaccttgaagacttttttatttaattttaaaactaagtcgtacagttacagaaacagcattaaatttttcctcttaagtaaatttattttttctctttctatcagaaattcagaagaactaacattatagttgcccccattgcgtacactgtacatcatttctcggtaaattacacataattataagttgattaaccttttaagttttaaacaatg

SEQ ID NO: 8697 - DNA, 3000 bp, Unknown
  misc_feature (1)..( 3000): cDNA_ID_3245290_gDNA_ID_1971851_Annot_ID_176385 3000 nt of promoter + ATG
ggaagtcaattcgagtatatttaaaacctgataatagatttgacgaatcaccctacaagcaggcaaattgatgtctccgacgatcggaaacagagcacaggagaggacacgtggaagactgacgttcagtggcgggtttctatttttttcaaaagcgcgcgaagaagataagaaagggacaaaggcagaccaagtatgaaccaagaaagtttgcaattcgaccctttaatttctgaatatatttaattcacccttaattctcttaaaaagatttcaaaagaccttttcaaatctaggacttgccattttaaacggaaaattgtcatttaatagtctaattttcgattgacaaaaaaagaaagaaaaaaaacaaacaaacagttattaagctttaacagattttctaacatttttaacgattctcttagtcaaaccaaaacgatgtcatttaagctctaatcgattaaaaattagatctaatgcaggtctcgttacgtatattatacaaaaaaaaaaattagtgttatcgttgacatatgtgatagtgagtattttcaatattttagactcaatgtgtgtctcgttacgtatactatataataaaattcgattttattgatgctaatgacagatgtgattttcaatattggagaatcattttattgtaaatatgttgactgaaagttatttgatctatttactcatctacatatacatttttgcagcacttttatgaaataaatcctcaagttgagatttatttaccatccaatgccattagcatttaatattttaacaaatttcttctcaaatccaaatataaatcaattttgttactaaaatttagaattaaaataaatatatcacaacaatcatttaaatctttccaaatctaaaatgtactacacactaatattcttttttaaagagatctattagcattaatggtatattattattgatatattttaactttataaaacattattaatatttatccttataaaaagatattaaaatattatgagacgagttatatagtgggacgggtttgcattgatataacgcgggttaaatctttatttattattctatcatcactaattttttttttacaatattaatataaaattatataattttaatactaaaaatttaaaaccttaaaatttaagattattatatatataaataaaatatttgctccgtggtataccacgggttaaatcctagttccaatataaaattgcatagtgatgttttctttaaaaataaatacaaataacataaataaataaaataaaataaagttacatgtttgagcctctcattttcccttcagtgctataaattcagactccttcgctaaataaatcacaaagcggaaaaaagaaagaagaattgagagatatctagtgttttaaaaaaaaaagaactgagaaatcagcaatggggagcttaagagtgagcacatttgctgttgcagtagttgtatgtctctccatcctcctcatgtctcctacaggtacgtaaatttagttaaaagaagatttagaataaatacatgttaatgaaatgttgcatctttctatatatggactggacacaagtagatgggcgtagagtgtgtgacagcgcagcgggtttatgtagtatgttgttctcttgcaatacacaatgcaattcattgggccgcaattttactggaggcgaatgctcagatgctcgttttcctggtttaagtgtctgttattgctgccataatgtagagagcagtgctgaaatggaaagcatgtgattgcagatgctagaaaacgacgtcgctttgtgtgtgtgagtgtgtgtgttttgctatttgcatgtttatgctttcatttcatcacatcatatgttttgagtgttttgccttgtactctgttgtgcttctgtttgttttgcgttgtcaagtctccaataaagttggagtgtttccgttgacaaacgtttttgttagttcttgttgtatttagctaaccaatgtttttagatttttttttctctttttctttgtgttaaacactaatgtacatgtttttgttttcataaagtttgatgcatattagttaaaaaggggttacttgtttgaacatacaacaaaagttaaaaaggttactagtaagctaactaaagtcttacaaatgtccactctagaaacaaaacccacaaattcacaaaagacggttagaagcccaactagtagagaccaaaaaggtagtaagccccacaggagtaataagccctgtcaagatgaagggagtgacgaggaaacagatagctaagggtcacttgttcatcgaagattttaatcgtggttgaatcaggttgacccaatgatctggtgatttagaagatagtccaacttaacgctcgaatcaggtttaaaaatattggtttatgtagtattttcttgaatcccatatagtatttttacttttggtaaataaatgtattattgaaatatttaacatgagggtctcgttacatatattatataataaaaatattttattgatgctatcgacatgtgatggtgagtatattacattattttagatcaaatgcaggtctcgttacatatattatataataaaaatattttattgatgctatcgacatacagttagtgagtatatttcaatactatagaccaaataataggtaggtgagtggatgcctggattagtggaaatattttaacaattattattctcttacgcgtggaaagttttaaattactaaaaaaggtaaacttggataatcattttattgtaaagatattgacaatttgacataaagtattttgatctatgtacccattccaatatataaaattgcatagtggttttttcttacaaaaaaaaaagagtaacatctagatgccctttcccttggagtgctataaattcagactccttccctaaataaatcacaaagcgagaaagaaagacgaactgatcagca

SEQ ID NO: 8698 - DNA, 3000 bp, Unknown; identical to SEQ ID NO: 8678
  misc_feature (1)..( 3000): cDNA_ID_3091351_gDNA_ID_1971851_Annot_ID_176383 3000 nt of promoter + ATG

SEQ ID NO: 8699 - DNA, 3000 bp, Unknown; identical to SEQ ID NO: 8677
  misc_feature (1)..( 3000): cDNA_ID_1988781_gDNA_ID_1971851_Annot_ID_176377 3000 nt of promoter + ATG

SEQ ID NO: 8700 - DNA, 3000 bp, Unknown; identical to SEQ ID NO: 8687
  misc_feature (1)..( 3000): cDNA_ID_1823672_gDNA_ID_1971851_Annot_ID_58419 3000 nt of promoter + ATG

SEQ ID NO: 8701 - DNA, 3000 bp, Unknown
  misc_feature (1)..( 3000): cDNA_ID_2178122_gDNA_ID_1971862_Annot_ID_176439 3000 nt of promoter + ATG
aagagttgcggcccttaaccgtttcaactctcgctcaaccgacaaatgcttggccttttacgatgtgcttcggggaaacaagaagttcgaatggacgacccggtgcgaagaagcttttcaggaactcaagaagtatctggcaacaccacccatcctcgcacaacccgtaatcggagaaccactatacttgtatgttgccgtatcggatactgcagtcagcggagtgttagtccgagaagacagagatgaacagaaaccgattttttacgtctcgcaaacattcaccggcgcagaatctcgctacccgcaaatggagaaactcgccttagcagtcataatgtcggctcaaaaactgcgaccctactttcagtcccattccatcatagtaatgggatccatgccgctccgcgctatcttacacagtccaagccaatcaggacgcctagctaaatggacaatcgagctcattgaatatgacatcgagtatcggaacaaaacatgtgcaaaatcccaggttcagccgattttatcgtcgaactgcccactaaggaggctcggaggtctctgcaagtaaccttccgacccgaccataggaacgtctcgggtgctctcaggaaaccaccccgagacgaacctcagaagcacttcgggtaaacgatttagctcgcgcgaaacgagccgtctagctacaggtcgacaagaggcacccgactcggaataaacttcgtaccaaggccaaagcaccttaaacccgaggaaaagactcagacccgaggaaaagactcagacccgacgcaaggatattatccatagggagaagatcccgcgaaaatctacagaagataaagataaatcaccaccgcctctaagataacaatgaatcttcgaagaatatcgcgaggggcggttcaccaaagccctatataaagtgcctcaagggaccaataaaggggacacgcacaaaaacgctctcaacttcaggctatcaaaaacgctctgattttgaaggcaaaacacttattttccatatttctaaacacttgtacgatcgaatcctcattatttcaataatataaccaagaacaccgtccgcggtaatcaacaattctgttgttctttgagaatctcacatagatccgttctttgaaggaacccttagtacaatttctcttgtgcgagttttggctctcacaatttagcgctaaaaggaggggaaattgagatgaaaggataaattttttttattgtttgtcaaggtatttggatgattttttctacttgtatttataacgtagattatttttagtatggttacataatcatttgaattcctaaataattaattagtatgatgattgacaagtattttcattgagatcagacctcttttttttgctttagcttttctcccaaaatgttttttgtaatttttacatgcaaatctaattgattagaaggtatatgtcaatataaactgacaaatacaagctaaaggaaaaacaaaagcgacatgtcttttcccagacacgtttatcaaagcttctcctccgattttcttttatgacgccggtgaagctccgtcttgccggcgtcggaacatctctccttcttctcagatgcaccacacaaatctctcttcttctttcttctggctaactcttcaatcatccctaaaatccaatttttcgatgggattcgaacagatctgtgatagaggaccaaggtggtctccaaagaccttcttccgaacttgctctctcccgatttcactttcgaattcgaagaagaaagatcactcccttcccgtaggtggtttttctcacaaatcagaaccctccttccctgctcttcaaagcctttatagatcctgatcttctcttgaaagatccatgcaccagttgttgcccagcgcttcacttattggattggcttctccgacgatgttggcggcggtgtacgatagagttcctctttctagaggttttctagggtttctccttttgggcgagtctcctttgggcctaactgttatcttcggcccatccctggaattggcagcctactttctccactagtttggcccaggtctgttactcttaaatctccaattagcccattagacttgatatcccgacttagcgccttaattggttatggactctgcttaagctctttgttgattttaatggttttggcgtgtaattttatctctagaacctaggccaattgtaattcctcaagtgcttcatcttctcatcaaagtttaaggctaatggacttggtgtatctaggttttagatatgctattagattagggaataacggcattatgatctcctccctacggagagacggttaccggaatttctttattcctctctccccgaatccgttgaatattgaatccgagtcgtacttgtctaacgtttttaagattgatattcatgaaagcaaggttttgagaagctatggcattatgaaaccggctctgtgtagtggtgcttaccaaatacttttcaactctatacctttaaacccattagatgacagaacccactcaactcctttccttgtcgacgaccatttcctgcttgttctacctgggacaacgagaatctcgactttggaaaccttttcaacgtcaccttgtctattatggaccattaccattacttcgtccaccgctctgtttgtggatgatgcttcgacaactcgtactttaacttgtaccagtctgttctgtagcattggccctaaagttttcatggatcctttgtcgatttatctttgctatctttgtgtagcatttgttttaacatttgcttcttgttgttgctactttgttttaaagcctttttaatttttgctccttgactacatgtaaacttgtttcagttattagatgaatgaaatcaagttgtttgacaaaaaaaaaagtatatgtcctagcaaattttcaacgtgcaaacatgaaaattacatctatatatgtcaaagatg

SEQ ID NO: 8702 - DNA, 3000 bp, Unknown
  misc_feature (1)..( 3000): cDNA_ID_3046005_gDNA_ID_1971862_Annot_ID_176451 3000 nt of promoter + ATG
catatcatgcgtcaagaagcataacaaaagaaaatgataccatgtttcgcaaataccaccttcaccttagcctagttgaagatgacaacacacttctccttctctttccccttagacaatctttattgtaaccatataatcataagctctaacttggttctccataaaccaggacctgaatccatgagtcatgaaagctcctacaaagcttcagctcaagccgagttcattttcccaatcaaacaataaaaatcgttaggattttctctatataaatctgtctcgaaaacatacgcataagtcaggaactaaccattacaaatgctatcccaccgttgaatatgtagccagtagtatcatgaataatcccacgaagtttcatcccgatcagatttcacaatatcccacgttcttctgaagatgatgcatcagaactgatatttaggtttctgcaacttgagatgattctggacaaacttccaagatcaattccggatggagcttaaatctgatggacaagctgtcagctactatgagttccttgaatcaagatctttccatagacatcttaatcgtgatctaattccttctggtccatcgggaaaacgcatcataaaaccagtagtcacacactgttcttgatttatacttaacacagatttggacaacttctgcagttacttgcccagaaagaaacactcataacttctcgaatataaacccgattgaaactctgtcagttgctatggcttcatacaacgtgatctttgcagatatgtcttatttagaaactgattctctctggtttgacgggaaacatccttgtataacctcaacttgaagctaccattctctcttcatcttcttccttatatgcttctagttttacctagcccccttctctgatttactaggatctgcttcatctcacttctccttactgtcacaacgaaatctccatctcttaatgcctttcctttgcagtggtgatgatctcttttcctctgccacgtatcgtccttcgtctccgcttcctctcatcttcctcacggttatccttcatctcttccctttctcttctcctcttcaagcgttccacaatgactaacatactcaacaacaacggtagtggctgacctttaattagggttaagattaagacgacgcggtgacgctcggtttaggaacggttgcatgaatcgctttggtttccttcacttgtgaactctcttctctctcggatatggtaacgaccccactatagaactcatgtgttgatgctttggatttgctttctcaagattcttatttggtttccgttagtggctcagagaaaagggagatagattcacctatatatatgtgcaaccaacaacacacgtaacaaaaccctttaacattagggagttgcttcacttgggtttaaatgggctccatgggttccatgggctttgctttttgacaaaacgaatagggtgggctattgatgttgggtttggagtgttacagaataagtcgttctttatctttttggttttagttaggtgtttcaactctttcttctgctaatcaaggttcagtgttaagatagtgagaaaaaatactcataatgcaagcatataatggaagccataagatcagtgtaaacttttaagtttcatgtttgatcttattgtgatttattatgagtctgctattaacaagctactattttactcctttctctttagtaataaacaatgttgtacttctttagtttgtttggtttgtaaatttacttgttgtatgttgtgtcttcaactcgggttcttcaatgatggacgatgctgttgatatatatatatatatatatatatatatatatatatatatatatataaaggattcttttgaaacaaaaaagtatgcatttgcggatttgcctttagttacttttgtacgtgtttttcaattccagtcacctacctctctataatctttattattctttttttctttttttgggcaaacctctctatagtctatatgatgtataaaaggaataaagaaaactacggtattcatttttcgaaatcggtttttattttatttgatttgatttgtttcatgtgacctttatatatgaaatgaaattataaacaaaaaactatggtattcaagaaaaaaatgtaaaaaggcccagaaaatccaaaatagatgggcccaacattgggttgtaatgcattgacaactactcgtggacaagtacacgtgaataccatttccttccatacgtataaaaccaaattattttcccaaatagtatcctcttattattctattggtcaaatcaaaaataatgaccaatagaattatgtattctactttcatttttcaaatttaatagattttgatctatcaatagagaaaaatgcatggcgatgaaaatacatattccggatccaaccaaacaacatagcttttttattagactataaacaagaaaataaaatagaaagagactagatttagagagagaaataatgatgatagtgaagctgacactttctgcaagtttcataagtattttattcttttctatattttttctgtaaaaattaaaaaattgcaattgctcgaaattttcataatttttcgagttatgatggattcttgtagttgaaggcttgaagcatgacatttggttaaacaaaagcatagcatttttggaccatcatgatctctagattactattgaggataagattgtatcttatgcgataagtttgaatcctagttgtatatgtttaggaatcgacatttaagggtttggtgtttatcttgtgttgattccctcttgtataaatagcaatgttgagttcactaataaagcaagtcagttcgatatctaattctacatggtacagagctaaagatctagcaaaaaaaaaaaaacatctaaattttttcttttttttatcgattgtttcgatctttgtttttcttgcgtgacaagaaaac

SEQ ID NO: 8703 - DNA, 3000 bp, Unknown
  misc_feature (1)..( 3000): cDNA_ID_3045997_gDNA_ID_1971862_Annot_ID_176453 3000 nt of promoter + ATG
ttacagtatatagtgtatacagtaaaaaaaatcaaacttcacgctgtttagctgagaatctcagcaactacttgccgtttcatgcctcttgtctgttttggtcggaaaagtacacatgagaagactcaaagtgacgaagagtgtttctttcttctgttattgcaacattcttttgtgacatcatttgtttgcttcttctgtttcagtttcttgtaatagtaaaataaaatcatgccacgtcgtccccatccaaacgggcttattaagcccattttcgcaaactataaaagtaaaaaacaatcaatgaataaaatatgactttgcctttttagttttttgttcaccactactcagccacattagggttttgaatagccaaatatcgccgtttcagtctcctttgaatccctaggaaattttgttatacctttgatcattattagctcttcgtggtgtttatgtcatctacttttttatacagcaagcaactttctagtttctaacgactatgaattctgaagtcgaacgtccatcgtttttgtcactacctgatgaaatcatcttgagctgtttagcccgcatatcgagatcgtactatccgaaactctccctagtttgcaagaccttccgcactctcctcatatctaatgagctcattgtggcgcgattgcacctcaaaacccatgaaaccttttgtcatgtctgcttaaagtttcctgataaacctaatccgtcaatgttcaccctctggataaaacctggtacaatcttaaccaaccaacttgagaagaacaagaggtctacaagagatactcggttggtacaaataccttcttcatattattataatgtaccgttttacctcgttatggttggttccgaagtatacggactcagccaacgcaatgatccgtcctccaacatgtttgtccgtaataagggggatatttttttgtgtaaagccccaaacatgactgtagctcgagctaaagccagtgcagttgtcttcaatgggaaaatatatgtgatgggaggttgcatggctgatgaatccgtgaattggggtgaagtttttgacataaagactcaaacttgggaagctttacctgaccctggtcctgagttccgtttttcttcaattagaaaaatagatgtgttccaagaaaagctttacgttagaagcaacgagaagaaagactctgtttatgatccaaaagaaggtaaatggaatgttggagtaaaagcacacatgcaaatatgcaatgtatgatagataatgtatggtatcattgtgataaaaagtggtgctggtggtatgacacaagtcctaaagaatggagagtggtcaaaggtttagacatgttgaacaggaatcttggttgtggtacgattgaaattgttcactatggcggaaaactcttaatcttatgggacaaggtagatctttctcatgacaaagatatttggtgtgcggtgattgcgcttgaaaaacgtcatggtagtgatgaagtttggggaaacattgaatgggctgatattgtgctgacggttcctagctcatacgttttcgtgaatagtctagaaactggtttttgatcaaatctaatcatgttttttgatttgattctcaaaggcttttttcttctttattttttagtgtattgttgcttttatacttgtaatatttgcaacatcacgagaaatattgagtcggctaatattgtgctgacggttcctagctcatatgttttcctgaatagtttaccaaataggttttgataaaatttaactatgtttttctgttttgccaatgccttattttttgtttgaattctgtagtgtgtttatggttaaactaaattgttggcaacatcacatccaacttcaaaataacagttttatatcgaaatgtgacttagtggtaggatttgtatatgatgtgaatcagtaagtcagatgtttgatagctttcatattccaattcttcgtcttaattttgtcagtttctttagtcacacaaaaccacataagtttttagttaccagttaatattggagagagactacaaaagataaatgctattgtgtgagttttgaaatctgaagttaaacataccttttttttgtccgttatagcattctctaaagaatagctcttttctgtatttggtatttaaaaagattttgtaccaatttctaataacatatgtatgatgtaaccttgagaaaaagaaaatgatgtaaaatgtgattactagaaaggcctataagatatgagagtttctattcataacaatgtatatcagatgtgaacttatggagtgcaaagaccatctgttcttcgaatgtggctacgccaaagagatttggacaggactgagcaggaagatccttggacacaagttcacaacaacatggagtgccatccacattactcttttagatatatctttgggactaataaacatcttcttgcactacaagaaaacaagcaaacgacgactacgaaaggcgactaacaatgtagtcgtccttttttgcgactaacttacgactgatggacgacgacattacgacaacagacaaattggtcgttccataatcgtattttagcgactacaagctttagtcggtacatagtcatccaaatacgactatttgacgacgacattactggaaaaaataagtagtcatattttgacgactacatgtccgacttcatacattagtcgtaaaaccggcgacgataatacgactatttttcctttgtcgtaaaatagtcgcataagtgtcgtataatacggttggaaaacgtttttcgtgttgctgggtaggtacacctaatttctgagcgtctacaatgtttagtcgtaaaatagtcgtaaaaaatcctctatataatccacgacactcttcattctcattcaccaacaaatcaaaacaacatcaaaagaaaaaaaacgatttcgaaggaaaaaatataagtttagtttatgctata

SEQ ID NO: 8704 - DNA, 3000 bp, Unknown
  misc_feature (1)..( 3000): cDNA_ID_2990473_gDNA_ID_1971867_Annot_ID_58422 3000 nt of promoter + ATG
gtgatagtcttttgatggcaacatccatcccattttttagcttttcctccggtcaaaatcaatcagaaatatttttagtataatttaaggtgaaactttgagaaattgtggaattagtcattatgacaataccgtattaaaagtgaggactagatcattcctatattgttgaccaaaaaaaaaaagatcatttactatatttgaccaacatggataaactcctagattgaataagaccttaaaaatcatagattgagtaaaagtaaaacaaaagttttctagtatcagtcaacttctgatcttatttacgaggtcaattgttatatttgctttataccttgtacacggaaccaaagccaccttctcctaacttgtttccatcagagaagttatttgttgcaaccactatttcacttagtggaccctgacccggcccaattctccaaaccagaacaaagctgctgcaatggactggacctaaacgaataaggaaagatattgggtttgtgttaaagacatgtctttattttggatcattttcagcaattcattctgatacatgcatgattaaagataaaaccatgaatcatactggaccacgtgtgtccaccccacttgtcaacttggtccattatacgtgtatgcataatctatatcacactttgccgatagaaaagatttagacaacaataaatggagtgaaatatttcaatgttctctttaggttaaaaatgtgttctctatttcaatgttcatggtttaatttactgttttttacttgagcaaatttacataactttttgatcagtaaacttagaaatgtatgcttatcgtaaaactgaagatacgtccaaaataattcttggatcggtgaaagaatctgcacaaacaacaaaatgaactagccgttgctaaaatttaattacataattgagaggacagaggatttatttatattaaaaataactaaattcgttgggatgattaattcaactactccacacacaatgttagcaaaagttagctgttggtaattactttacacatgttcgaatagttggtacgtttattattacaactgcttagtgaattactctatgttaaatgattatttttcctaatttcctatatatcctattcaatatctctttcagaacatatttttttaaagtatatttactgactgaatttttttattatggaaaatattgaatcctatacaaatgtttcgtaaagctcaattcatgatctcgtcattgattatcaagtcttttatattttcttttgaacagagcctgaaatattataattttcatctgtcaacaacatcatattttaagaacaaagttttatatgtaaaagaagcagaacaaaacgtacaattttgtattttgtaagaaaaaacaaacgtcaaaataagaagaatctctttcgttttggctggcataaaccacgtggcatttctagagtagcccaccgttgcgttgcgcaataaatcttatctctttatcagatgcctttggtcaaacggtcagatatcaaatcttaatttaaaacttgtcgtaagaatcaaatattaacacaataatgtaactataaagttactactagtacttaattcacttatttaaacctaagctagcacgcgagcagcatgtgattattgcgtacataatgcacttccctaaccgacaaattactaaatcaaaatcttcttcttttttaatgcatcattatttcataacaataatttcaccacaatcaacgtaaatgtttgatcatcaatcagaaaatacgcgttagaatattttataagaaaaattatatggtttatgaaaggaaattttacagctcattttgataaataaagcatataagagaaaatatttcggtggaaaataaaaagtatataaaaaattgtcaaccatatgggagccattcttttctggctgtcatgcagtactattatcattatatccgttggctttgtttttcttttctttttcaagtgtcaacttagtatttattttgcttaaatataataaattaatggtcaccgacgataaaaagaagattaaaactctctaatgaaggataaggtatctataaatccagtggtttaattagtaatatattaaaaagaaaagtatgaagaatgttattcgaatatatgatactaaagtgataaatgattgtcttagcaaatttaaatcatactatttaggttatatgcgctttactatttcttttgattaattaactaactacttttttaaaattaagtaaatagcttcaagtagaagaatgtgagactacatttacattgatcataatcttagtgatttcatgcaaagactaaagctttgaatggttatagcagtccaaacgaacaaaaccgtctacgaaccggattgctttttatttattatttatgaactattgtccgtaataatgagaatccaaaaaaataaaagaaaatcactgcagcctaattgaagactgtcaattaagtctgcagccgtttgttgtccgctttaaaaatactatatactggacagctgacggattagcccacactaatcgcaacatcaattttaaacctaataaagttatatgtaattatacccttaaatttatttattatctttttttttttttgacacaaaatttatttattcttttttctcatatttaggcaaatttataggcgtattgtgcggctttatttctggtaaaataatagtcaaaaagtaataataataaataattaaggagcaacctaagaattttgtagccgttctcttatgtctatatcactctctggctctcttctctttcttctatagcttctagtttctcccacttctcacttcctttttcccgaatcttgataatgtaaattcacaacaaatctgtttaaaaacaaccaatcaaaacccaacattgcttctcaacaaaaaagcaaagcaaaagattttgcgagagaaaaaaaagaaaatg

SEQ ID NO: 8705 - DNA, 3000 bp, Unknown
  misc_feature (1)..( 3000): cDNA_ID_1824499_gDNA_ID_1971867_Annot_ID_58423 3000 nt of promoter + ATG
gtagacagtttcaatggatacatttcagggaaactcgaaaaaagattcttagtcagatctgagacttatgtcttcgtgactcatcataaagtacagattcaatgatgcacgtgacaaattttaacggtttataagaaataccgctttttacaagaaagcaaaatctagatcaaaaacttgtgggtttcgataatttttgtgaagcaaacatgattttctaacactttttttaactaacaccgtttatgaccgttaactttaatgtcaattcccaactagaaaaacttgtgatttaaccgatatttacactttaaacccttccatgatccacgtgaagtgaccttttctctacacacacaagacccccgcggcccaaaagctcactatacacaattctttaccatgtgacattgtgaccactgaccagtgactaccctcaaaatttcaatttattagattcagttcgaatttccaattaaattactatattataaaaaaaaaaatgataatagtgaaaaagatattaaattagatgataatgaactatatcgcgaaggttgtaaagtgaagataatgcgaaagagaaagacaaaaaagagaagacagatcttttgttgccttttttagcaagaagggcccatctaaggcccaaataacacgtggacgcgtcaacattacacttcaacacgtgtcgtctacgagcttttagtctcttttgactcattgccacgtgtatgttaacgaaccagcttatttaacaaccaacgtcctaccgttgtaataccattaacacttctcacatctaattaaggaaaaaaaaaaatctttttcatttcaaaaatatatataccataacttaaaatttaattattgactgcttacaaatactataatacttaaaaactatcttatgtaaaaaaaaacaaaaaaagcttttgccataacaaagttcggaaaaataaatgtggtgtatttaataaatggattctcgagaacttacgtggtccaaattgagaaagaaatagtagtaatttgattacgtgaattaacttcaaaggcacacaggttttatacagtttatgttcaaacataggttacatcaagattccacgccataccaataactcacttgaaagaaataattaagaaaatacaaatatctatgtttgttctagagtttaaagcaagacaaataattgcaaacgtatctttgtcacataatgcaaaacgtttgtgaatttatatattctggcataacgaataacttaattaatttcatctcttataaaatatttcttgtatacaacaaaaagatctttataataaaaatatttgaccgaccttactaaaagtgaaataaacaaaccgccataatttgtaatcgaaccaaaaatcgtttttcgaaatctctgaaaatcgcgtatgactaaatgacaaactcataacgtgttattgattggtctatcattttaaaatgatggtaaattttggtaaataaacccaacatggatggttcttctaaaccacgtctctgtctctaatttatctcaaagtctctaaaagaaaaagagagtctataaatacgaaaaaccctccgcaattttcttctcccctttcttctcttcctcctacattctcgactctctctttttattagggttttcaattttaatcaaaaaaaaaccctcaaatctcatttttggatttggtttcttctgcgatctctgagattcaatttcttctatcaaaggaaacaaaaaacttcatctttccgaagattttttttccttccttctggagctcttttgaatcaggtttgaattaatgaatttcaacgtttttgcttaaactttataaataattcatttctgagaatttttggatctagttcagttttttcttcttctaatttaacattgaatattttctcgttctctgtatttttagttccgttttgtttcctcgtacgttacaatattatattctgctgcaaaaacaaacattttcacagttttgaaaattatcgtcatttggaaattaaaacgcacgcaattttgtccttacacctaaaattccagtttttttttgtttcattctaataaaaatataactgtatagacgagtttttgtttaacttaattcgtaagttttttcacatattagtgttacaaaaattgaagactgatttggcatgtttatttaagttttgtactttattgttaagatatacgtgtgatttgtcaaattttctagtgatgttttagaagtttgtcggtgctctttttaaatatttgacctaccatataaaattttggttaaaagatgttgaaatttccggtacttgtcacgatcacttgtctttctttttttcctttatcaacacatagggtaaaactgaaagtaacatattgaaggttacgacaaatttaaacaggagaatttgtcaacatataaaacttactttcgcttagaaaaatgaaatttcatttgtgtcgactcgttaaagaacagaaaacattatttatttttccactacttttgtgtttaaaaagcatgaaagttttggaaatcttatagaagttaatttatttattaatttccaaataaagcatttaattttttttaaatttacattataagtgactttgttgatttgttgtgtgcaggtgaatttctaattgaatctgaaagtttacgatgaacaatttgatatgatgataaggtacttagtcaagaaacaaaatattcctaaaagtaaaatataatcttatatttttttcttaactgaattgtgttttttttttttactggtaatcagttttgtttgatggagctttcaccaacaagcagtgacaagaaaacaatgaagagatggtttttcatagataaacgagttggatagagtgttattgaagataaagaaagcaaaaaacagaagttcttgcattgaagcattggttttagagtttattgaagcattgtttagagttttgattaatg

SEQ ID NO: 8706 - DNA, 3000 bp, Unknown
  misc_feature (1)..( 3000): cDNA_ID_2993092_gDNA_ID_1971867_Annot_ID_58426 3000 nt of promoter + ATG
tgtgagtaatatagaaaagagtttgattaccactaactagtatgtagatgtcagaaacctcaattagaaatttgtggatgtttcgatgtctctatgccttgttaatcgaacaagatcgaatttgaagaataatgtattaagttatgtataatgtcgttacaatctgaccctcctttacaatttcatttctctccttttatattaatattgtgagattcgtaatcacaaataatgtttttctcgtgtcgccgatcacgtctcgatttaatgttgttcgtttcgaatccttattccgccatcatcgctcttcactttactctgtgattcgtccgttacgaagcgcaaatactaatccccttctagatctttcttgggcagcgataggcattcctaaacccatgggtctttaagcaaatagacctgatatctgttctcggcccataacatgtatccgtctatattgtgggttgggtggataacaagatctgacatttacatagtgtatgagtgatttaaagcaatatgagaagttaaaactagcacttaactttgtgctaaattctttagtttaacttgttaaaaaatttcttaataaaataaattgccgaatttacttaacaatttatttctctccctaaaataaaagtatagcctataatttttttaaatttttttaatgtttttaactatctaattcgcaaaaaaagaaccctataatatcaacatataaaaactaaaaaggattagaaatatcattgaaaccaactttgttaatcaaactagaataagggccaccacattaaggacttaggtaaaagtggtgtaaaatgtaaattgttcattttacaaaaaaaaaaaaagtggtctaaattgctttttgtgatgtgaagttgtgaactaatatgaatttggtctaagtctattgcccaaattatttatccttttagtcctagaatttgttccaaatttgatagtatatagcatcatcatcaaattgatcaattaaaatacgtgacctatagaccatagaaacaaattatttagtaatttttttatggtatatagcaaatggaaattgtttttatggttttcaaaatttttttttctggtcaattttttttttatggttttcaaaaaatggaaattatttagtaatttttttatggttttcaaaaaatgaaaattatttagtaatcaaaatggaaattatttagtaattttttatggttttcaaatttttttttttctttcttcccgacctctctcccctctccttgttcgccctagccgtcaaggccatcttcctcctcgttttggccggtgattggtggcttccatagcaccgtcgccggtcctgttcttagtagtttcagtttgttgtctcttagttattctttgttctgattttagtttctcaaaccctagtttcgtcgtctcctcttcaaatctctcttttttgtggtggttccgatgtgatgactatcatggaggatgggtggcggatcggtgctctttgtagtcggatctattccccggtggagccgtctcgtttcttcgatctagttatggaggtttgtgtttccgatctggttctaatgtctcaactatcggtcttgttcttgttagtttgagaattggacttgatttgttgtatgttccggctggttctgatgtggatctattgagttctgttcttggattttgttggctttgcggtggtgctgtctcgtttggggcgtgtatttagtcggcttttcgtttccatgagttagttctgtttatccctttagtattgcagcaacggcctctttgtatgcggattcttcttccgtttttgagttcgagtgacttctagggtttgtgttttgctgtgtttttcgactggttatggtttgaagcctcaggttcagcttttgggtaggcttgtttgactcctagctctgcctatctctctgtcctcctcttggttttcggtgtcgtggcttggtggaaggttctgttttgtgggttcttcaatcggatgctagcctcctataatggcatctactagctctctgttggaacctcttttggtttcccggctgagttctggacgttgtggtgggtcgatctcttgtccttctctttgcgtggcgtaaccaatctttagtctgtaggtggctttggctgggtctacgaaggtccgtgtgtaaggatgagtggtcctttttagcgtttcccctctcggatctcaaggtcttccttgatccttcgccttctcatgttcattggcgctaaagcggttctgatggttaggttctgtgttctgatcttcttgtttcgtcgtcttcgtttttgttgtggagatggttgtgtgagctcgtattaaatctcttttcaagactcctgtcagttgcctctcctcagcgccaaactgttctatggaagtgttagtcggcggcttgttgggaagagttttcagtgttgtagctttggaggctttagctattaattctgtagctgttatctttgtatcttttcttctaaggcttgttttgtttgttcaccttttttggcctcatgtctctgggggtttctatgtacccgccgactttgtctccgaaaggattttttccttttcggctatatataactcaaacgcatccaatcaatgaaatccgtctaaaaaaaatagcaaatggaaattgttcctaaatctttcacaattttccaagtattttttcttttgaataattttagttattatcctgataatattttttatgtaataattattcgaaacgtgtcacatatatatacaccaagcacaccatttttgattatcatccatcatctcactcactgatatttatacattcaaatatttatttattttcaagttttacgcaaatctctttcactcttaaacctcataaccttagagatcatcagtcatcaatcatcttcttcgttgttatcacttctttagtagctctcaacgagatttctccaaaatcagcg

SEQ ID NO: 8707 - DNA, 3000 bp, Unknown
  misc_feature (1)..( 3000): cDNA_ID_1989201_gDNA_ID_1971867_Annot_ID_58437 3000 nt of promoter + ATG
taatgttgatattcagatggatataggtgttttagatggttgtctttgcttgatgtgtaactatgatcagagttatgttgatgtttggatgatgaaagaatacaatgtgagggattcttggactaaggtttttacggttcagaaaccgaaaagtgtgaagtcgttttcgtatatgagacctttggtttattctaaggataagaaaaaggttcttttggagcttaataatacaaagctagtctggtttgatttagagagtaagaagatgagtactcttaggattaaggattgccctagctcgtatagtgcggaactcgttgtgagtagccttgtcttggggtgtaaaggagatcttaataacattaagtatcgaaaagaacaacaagctaaagaagctagagaagctaaaattatgcagaacactaaaaggaggtgtgatttttttgttcttctctaagtccaatttactttaatatcattttcattcgtttttgtatcgatatgttcagtatctcgtttgtttttattctcagggatgatttcctgtccaaaggattcaagctggtcttataagccaaaaacaagagacaggagctaaagctgcacaaggtaagtgaaaaagttgaccgttcttaatgggtctagtttgctgctgcattcttattgcatttcattcttttctgtctctgctctgttttgtcgcggacgttcatatccggtgtctgttttgtggcggacgagcaattttcatattcgggttgggacaagagtgaaagtcacagtatgtcataggtattgagtgcttagaagttagaacattccctagaaaatgttatggagtcatcatcaggataattactttagcatatgaccatattcaagtgtggttttttcacatcaatctatctgcaaaacaatcattgggtatgattttttcagggaggagaaacgagaaggggaacaaacaataacttcaaccaaaaagctctaatataccaaaggagaataatatacaacttacctacgtatatgtgcttatagaagagaggacaaatgtttttggtttgtaaataactctttttaagtttgatatatataacttactagtactaacgctttgtatacttgcttttttaagtttctgcataatatgagatgttaaataaattaaaatttgtcatatttaacaagagctggttctattacagtaaaacctatataaattaatattaaattaataatttgtataaattaataaattcttccgtctccgagttgggagtaattgatacaaatcactaaatcaatatgataataatttttttaaaaatcttatataaatatatggtctcatcaataatataaattaataattgtataaatttactaatatatattataaatatcatatgtaaaatatgactcttgtaatatttttcttcagtttttattaattttttgtagtgttcaattataatatttaacaaaatgaatttttttttttattgtaattggtttcagaaatactattgattataaaaaaaaattacattttatatcgattttgtgtaaaaatttacgaaatttgtacaattttattaaattttcgataaattaatatctttttaaattaataaatttttttggttctaatattattaatatatagaggttttactgtaatactttgctatcttttcatttatttattaatattattaaatcatcgacatgagctaacgtttttctacaataacttttgagatcactaagtagaaagttgaatctttcatcgacaattttataagtagtcaataagaaactttctacagcttgcttattaccctcgtcgaaatattgtgtttcgtgagcaatcctattattggtcaaactaaactattttgctcaaaattcttcatatggataactacaaaaatccaagttttccatttagattttactaatcggcgctatcgtaagtgtagtcgtcattgcctatttctcgagtttttaatagtctaaatcgtgataccatttcgactaaccaaacaaaacttagtaaaaaatttggtgtgtaacgaatccaaaatatcaagtttacgttttgtcacgattcctttaccaccaagttgccaatgtttggttacatttaccaaagatctaaatagtaaccaagaagtctcactgaatttatagagatttttggctgaatctacttaattgacctagtgctctgctctacttctacaaagacagatgggcctgatatgatcgctggtggactcaggtgtgacgagcccaactccggaaaggagtataaaatagaacgattcgtattattgatgctatcattaagaccaaaataaaaaaaaaaggtgaaaaattagcaagtgataaactataaaacacaacgttttctaaatggtaagaatataaactttttatagaaattaagaaatttaataaaaaatttataggaaataagaaatctacataagaacacagacaactttttggcttttttgtaatgtttttctaggtaataaatttcataatcttccaaaaataattaatcaaaagatttgactaggcgattaacccaaagcttcaaaagaaaaagtaaaaaaaatccttaatttgtttctttatcggattcaacaatttgaaaccataaatgacatattctaattaattcagagatatttttacactaattttatagaaattcattaatctaatcacaaattaataaaataaagaggtgtgaaacgtttaacaatggcatagagagcgagagagagagagaggaaaactgtgttaaacccagacgaaaccttcgatcttcttctcctctctcaatctcttcaccttccttcctccttcttcctcacctctatactccgttacggttaattttccggccatcgaatgttggataaggttttcgcgaaagccgatagagaaagatagagacagagagagagagattctcgtcgctaa

SEQ ID NO: 8708 - DNA, 3000 bp, Unknown
  misc_feature (1)..( 3000): cDNA_ID_1018916_gDNA_ID_1971867_Annot_ID_58439 3000 nt of promoter + ATG
aagtctacttttccgtgacgcctcttcctcttcatcttcatcccctctgtcagaaacatttccttcctcttcatcaccgcctgatgacttcttacgacccctaccaccacctccactggttccaccgctctccttttcattatccacttctccaaacaacgctggaccattattcgcagctttcatcatccacctttgataaccatcagccgtttttctccgattcttcatcttctcttccgcttcttccaatgtaagttgcttatactgtgcaaccttgttgaagttatacctaacacagcacaaaaataatcagaattcggataatacaacaacagaagaagcaacggtaatttgattctccataccaagaaccagcaggaatcgcaacaaactctttgttctgcatcactaagagatagtaagtagcagactgagagccttcaagatgtccctggtactgaaactgtccagtttcatcttccaagatccaaggtttgttctttaacttctcctacaaaaattagaatccacacaaaactcattgtaaaaaccatcaaaatgattggtatgatccaaaacaaacacaaaattacccgttgtgcatctgtaaactgacgaccttgcggtatatctttacgaagagaccatttattctcagaacctttcttgaaattaggaagaccagtcacaaatctaccaatgaagtagttcttatccgtaggtgccgcagcacgaacgttatactcctaaacaatttcacccaaacaacaattttatcaaaattttcttcagaaactcaaaattgtttgaagaaacacacaaaatctaacccgaatcaaacgtgtaacgacggttccacactcgtgacacttagatttattctgcgccatggttctaccacacttcaaacacaacgtcatgtgtctacaagagcttccatataaatcggattgtgatccgcaaccaacacaagacgtattcaattgcaaacagttcgacataatgttctgatcccaaggaaatcgtcttctttctgaaaccgtaaaagaagagagaatttagggcttcacgattttcgaaaatctaattgcgaagctaacagaaggaatccaagataaaatctaacgattgtgttgttggaatctagggttcttattacctttctgagatttgagattgcaattcagagttttgtttgcgaatgattttgagagaatgttaagctttgggatctctaatgaagaggaggttataaatagtgagtccgaagacttacatgttaaaagactgatttacccttttgactgatccaaagaatacaagtgtttttttttgggtctcaacttaataacattcatttaaccatatccaatatttatatttttgatacaaacatgctagttttaatatcttgtgcttagtagcagaaggagaaagtttgtatcctacttatgataggttctacgtgcttcatttggctcccaatattacatatcaattatcccattatgcaacaaaagaccaaagtcaccaaacaaataaccaaattgaagaaactcactttaaaaggattcttgttgttcataaatgcattggcaccaacacaatatcaaataaaaagcattacaatcttcaaaaaggataggattcgttcacaagttttttgtttttctcataggctaaaaagttgcacataaactcacttcagtccaagcctcttcataaatggagagacccatcattcattcattccaccaagaatctagatgaggagcttctcaatggcatccttaaggtgctgaatttgagatttcaactgactagcctcgtttgatgtaacggaacaagcgatcacgggtctggttacatcacatgctcttccaagggcttgtttcgatggcacaaacacatacggcacattctgcaatagttcaaagccagagagagaacaactaattagtaaaagaatcagaatcagaatgttgcttgtgaaacagatttgctgaatacaaataaagatatgtttgtgcagccaaatttaaataggccaaaaaaaaaaaacttgaatgggaactgtcaactaaacattcatgaatcaacagagcataatactcagaagctaaagtaatgatattgtcaatcctaagaccaagaatcacagatttaactcattacacaagctacgttaatacagaacaaacgaacttctcaatgcctaaaaatcctaattgaatctgtctcctacattcataaactaaattacctaagtgattactacgaacatcaacaatcacaatctcaaaactggagtctaatagccaataaagtcttatctttttatcatatgaagaagatacccaagtgaatccagtaaaacttgcaagagccaaagaaactactaattgagattcataagaaagtgaaacgataagaagaaattcaaataccttatcttcagcaagaagaggaagatgaagaagaatctcgagaggctcagtatcagcagccataacaatgaactcagagatcccacggttcaatgtcttggtagcttcattagctcctttctttaactgtttgtaattcgtagcttgttgaacaagatcaagaatcgttatcgataactgagaatcagctaacggatacgccttagggttcactccttctaccgtcatcttcttcttcgtctacgagagttctttgttctaagttctgagttcagggaagaaagaagcggtgaggagaacaaggtagctagggttttagtttgggtttaatagacaaacgaattagggttttataaagggaacacatcaaagcctctctctgactcagaaggtttcagatattttttaaataaaaaaaataaaataatttccactaaattatcggattctcagctcttctctcagaatctcagatcgtgttttgtttgcttcaccagagaagatcgaagacgaagaagacgagaaagagagataattagggtttagaatg

SEQ ID NO: 8709 - DNA, 3000 bp, Unknown
  misc_feature (1)..( 3000): cDNA_ID_3000046_gDNA_ID_1971867_Annot_ID_58440 3000 nt of promoter + ATG
atgttatatgtttggatttctaaacaacaatgacctcctctgaacacacttctttttagtgaaataacccccaaaaacgaaaataaaaattgttagtgagttggttcactatttggtgtggtacacttggacatatgtatagatgacaaccatctgtcattatttctctactttagaagtttaattctctcacgtcacttctttattaactctttattccttctagaattttggaccattactttcaagttcccatgttttgatacacaaacgaaccattcgattcttttcttgcgtttgctagttttattttgatacttttgtttcaggaggactaagagtgaggtttagtatcgaaaacatggttacatgttattatcttgatgatcttattttgttatgatcaaaaaatttaaacctaattgagtgcatgtgcaaaattaaagacgacaaagttaatgaagcatcaaattctgattggcgatacacattagactatatcaaatggtcgaggactatatatcaagcttgcatctggttgcaacttgacttattattggctacggttccattattatgttttagggagagagtgaaccaacgttgattacgttcaggggggaaacgtaagcagacattgagacaactatctgtacgacctaagagtgatcgagtcgtataaagctcaggtgaaacaagactaaaactaaaccgataaccattggatctcattaattcacagtaaaccaaattgtacccaattaaaccggaaatagatagtaccatacggagaacattttctttttttgagagagtagtgagtgtcacaataattgacagatgacgaaaagaaaaccagagcggaatctacgagctgaaacacaagaactcactgttaagactcagtttcaagtaaaagtttctacaaagttcgaatgttttcaacatcgagtgaagtaaaccagatttcactgaaaaccttatcgtgtttctctctacttcacgagttttcttaatacagattctgcgcgctgctcaaatcgaggtagtgcccattcgtgctggattatgtctaaaccatccttctctgcacccagactctgatcaattttgcaaggcaacgataccaaatcaggtatggccacggagcgaacaaaacaacaacacttagcaatcatatattcatatatagtttgattacctttgatgcatcaaatccaaacccacccatttgcatcatacgttgtgtgtcatcaatggctgcatacgaagcaaaagtaaaagattatgaccacagtttagtttttgaggaatgtggagcaaattcgtatgtgacagctaaccattttcatctccgagaatgagactgaacaagcctcttaatccaaacaagttcaagaagtacctgaagagcgaaagaaaaactcataaaaaaaaaaaagagaaagggcaaatatccagaagcaaatatgattagcatactgaaaatctgaagaggaccggataacacaaagtcctttgtgtaatttgagtacttaccaggaacgactactcacatagctaacatcgacagtgctcaagtcaatgccattctgtaacattgatctgaacctctgagtcagtggaaatggtattttggctgcaagataaacaaagaagccttagatgctatggaattataaaaaaattagagtatcatggaaacaattaactggtttctcagatgaaagcagtgaaacagccagttataaaatcaaatacatgattgctgtttatgaagtaaccaagaaaaataattgcaaaacactttgtttaggaaataaacctgcaacaaatccagagaagaagaagttgacccatgcaaaagtgagtgtctgcaaaatggtaagtgatatcagtttcttaaatgaccagtaacgcaaaaacatagatgaaacatttcaaatacaactcacctgaggaataatcatagaaagatttttcttcatcatatccatggccatgttaggatcagaaaacatagcagcttgtggattttgagcttctcccttgggaacatgtagcaaaccattctcctacaacaaacaaaaccacatacttctcacattccatatccatcaatacactcatcagaaactattgaacagattacttcctctagcaaaacaaagagacaatataagaaagacgatcacaaatgaatgctaagtaaaaaggtcaaagatcaacaacaaactcaagctttcaatggaatccacacaatgaatctcttaaaatcagaaaaccagatcaagaccaaatgtcaaatcttagaaaactcattacctcgttgctgaagtagaatctccgagcacggaatgatttcggcgggataaaattagcaccgactttaagattccgagctctaataacaacttgcctatcaaacaaatcaaatcgaaatcgaatcagctaaacaaaaactcatagatacagacttaaaatctacgcatagagaatacaatccagagaaggaggaagaagactcacccttctttaaccatcttagcatcaggagttggagtagaacgcataagcttagagacaaagtatctcaaaataccgattagaaccatcactacggagagaggaatcagaacccaatctctgatcgccgtatcgagaactagatcctccgccattctaaaccctaattatctctctttctcgtcttcttcgtcttcgatcttctctggtgaagcaaacaaaacacgatctgagattctgagagaagagctgagaatccgataatttagtggaaattattttattttttttatttaaaaaatatctgaaaccttctgagtcagagagaggctttgatgtgttccctttataaaaccctaattcgtttgtctattaaacccaaactaaaaccctagctaccttgttctcctcaccgcttctttcttccctgaactcagaacttagaacaaagaactctcgtagacgaagaagaag

SEQ ID NO: 8710 - DNA, 3000 bp, Unknown; identical to SEQ ID NO: 8708
  misc_feature (1)..( 3000): cDNA_ID_1018916_gDNA_ID_1971867_Annot_ID_176505 3000 nt of promoter + ATG

SEQ ID NO: 8711 - DNA, 3000 bp, Unknown; identical to SEQ ID NO: 8707
  misc_feature (1)..( 3000): cDNA_ID_1989201_gDNA_ID_1971867_Annot_ID_176502 3000 nt of promoter + ATG

SEQ ID NO: 8712 - DNA, 3000 bp, Unknown
  misc_feature (1)..( 3000): cDNA_ID_2036841_gDNA_ID_1971867_Annot_ID_176498 3000 nt of promoter + ATG
ctcatcaatctgacattccaaaatatgattccttaaagttaaaacacacaagctctcagataaagtttcaaaaaggaaacatctctaggtaagagaagcaagtacctggagaagaacagatctaatatcagaatgcacaaggaagagttgatccaattcacaatcattgtattcttcttcttcttctgcatgtaacacttgattaactgcaagataatcactcactcactcagagaacaaaaccatctccaaagatgtttgatttttgccaaatttccaaattgaacaagaagagtgtagatagagatatacctgtatctcttctggttatataaggttccatttcactatctagctttcactatgaattttgtaataatctggatctggagagtcgcaaacaaacagacaaacaaaaaacattacaaatcggtatctagatatcgcgtgcttcttcaattgagaaacaaaattatccagatttcgaagaaccaaaatctggtattcaaaaagggatttcgaaattgaaattgaaaacgatgatagagagattgaagagaaaggacctgcttaaacggagaattaggtcaagtatatgttgagttaacaggtatggttaccggtcggcggcgagagtagacgatttcaattgcaccgtcgttagggtttttgtagaagaagacgaagagcgggattttgtatttttcgaatttggggtttcaagtttggagaagatgaaagacagagagaaactacgcgaaattaaatgtttttttttttgtcttactataaaaataatttatataagtgattgggctaaagtttaaagtggcccgccctgtaattaatattatcaatgaagcccaatattatggttgttattacaagcttgatctgttacgtaattatggttcaactatgatttaatctacggtacatttttaaagattatttctataattatgtattaatattatggttatataatatatatatatatatatatataaatgaatgaaattgtgttattttaatagtatttacattttataattacattttcatattatgattagataaaaagaacaagacgttttttcagtagtagtataatattgctctaatattgctgcaatcttcgaatgagtatgtatgtcgccacaatattccgagttggaagtactgttgtggggtgggttttgatcgttgaataaaagacgtatgttacattctttacagactgctctggattggtgaaaatgttgtatacaccgatcaaatggccatgttttgaaacatacttagaagatagtgaagaataagcgtgagttaatttacttttttattttcagtttttcgtaatgccaatattaatatgtataaattggcacgaaatgcatgtatatatcctacactatatttatatatatatatatatatgtaaataatatttctccaacttgactttttgagccttttaatattaatgaagttgttggtaaacaaaaaatagctacattttttaatgatatggtactaatcacacccataatattttaggtctcgtttttctgatgtgggattttcaatgaaaatgatgatatttctagctattcataatttttctatgaaaacctaagcacaaaggtcgtttggtactatcggttatgtgataatgtgaatcaaatatttgcaaatcccataagtatcgggtcaactttcaaaaaataaaattacacagatgattaaacttggtttcagttgatgattgtttctgatcattgacgattttatgccactattatatgtattgtggtgaactggtgatcgatgatattgtggtcatgatcatcgacttgttacttattttttgttagttaacccaacgatttcagatggaaacatatattaacacggtgacataaaaatgattttgttcatcaaggattaactttaccttgatcaacaagacgatgaatcattacttggtttaaagtttaaactaattgaaccatatcaacatctttcattttcacttcttttagaaatactatgtttattaaagagaaattaattataaaattaaatagtaaaacagaaagttagttaagttagacgaatttggattttcacttttgatctcaaatttgtgtcaaactctttttgggacatttctaacgttggaattatacgactgagatatacctctatttaattaaaaatatatatatatccaaactagtctattgtccatcttgtaacccctgatatacagaattatttaataagtccatttgcgattacaaaaacaattatcacatgaaaatgaaatcataactttgtctttgtgtgagagttaagtatattaaattatgtttttaaaataatggttttatataagtcttccccgtgacaaacgggtttgttgaaggggcataagaaatgttcacatggccaacgtgaaagaataaagaacaattgttcctttttcgatatccttagttatgtacatattgggtaaccgaatgttaacacaaatctctatatactatatagacttaacatttggattctgtgccaagaaaacctttatatttgtcaatttttgaaattttaatcatcgtgaaggcccgtacatatatattgatagaattcataaatttgggagtaatgtctaacaaacttataccaccaaattgttagagtaaatattttgattttcgacatgcagttaccaactaagttgttaattagaacaatatatttttagaaattgccacctaatttgaaccatttaagtgttctcaaataatcaaatcatatctataaaaaaattagtcaactaaacccctattaagaaaaatcaacaattaaaaccttctcatttttctcctaatgaatatcctataaatacccactaaacacttatatttctctccaccaatctcaaagcaaattatatacactactacttcttgatcttttgtactatacaaacat

SEQ ID NO: 8713 - DNA, 3000 bp, Unknown; identical to SEQ ID NO: 8706
  misc_feature (1)..( 3000): cDNA_ID_3043224_gDNA_ID_1971867_Annot_ID_176484 3000 nt of promoter + ATG

SEQ ID NO: 8714 - DNA, 3000 bp, Unknown; identical to SEQ ID NO: 8705
  misc_feature (1)..( 3000): cDNA_ID_1824499_gDNA_ID_1971867_Annot_ID_176477 3000 nt of promoter + ATG

SEQ ID NO: 8715 - DNA, 3000 bp, Unknown; identical to SEQ ID NO: 8704
  misc_feature (1)..( 3000): cDNA_ID_2990473_gDNA_ID_1971867_Annot_ID_176470 3000 nt of promoter + ATG

SEQ ID NO: 8716 - DNA, 3000 bp, Unknown; identical to SEQ ID NO: 6812
  misc_feature (1)..( 3000): cDNA_ID_1815595_gDNA_ID_1971867_Annot_ID_176468 3000 nt of promoter + ATG

SEQ ID NO: 8717 - DNA, 1949 bp, Unknown
  misc_feature (1)..( 1949): cDNA_ID_2036894_gDNA_ID_1971867_Annot_ID_176466 3000 nt of promoter + ATG
aagcttatattactttgatccgtcttctcgaagatgggattttagttacacctatttactgccatgtccttatatctcggatagatttagttaccagtatgagcggaagaagaagagaattttcttggctgtgcggaaaggagtgttctttaagatatttacatgtgatggtgagaagccgatagtgcataagttagaagatatcaattgggaggagatcaatagtactacgattgatggattgacaatctttacgggtctttattcctctgaggtgagacttaatctaccatggatgaggaatagtgtttactttcctagacttcgttttaatgtcaagcgttgtgtatcatattcgcttgatgaagagaggtattatccgcggaagcagtggcaagaacaggaggatttatgtcctattgagaatctttggattaggccaccgaagaaagctgtagatttcatgtgaagataaaagtaatggccaagcttggttatggtggaagagtaagatcatctcaattatcttaggactcaactcttggttatggttgaagctttttatttgtttaactgctttgtattctcagattctgtttctttctactctttggatttttttttttttttataaatatctttggatcagaataaagttttcatttttttttcttgaactctgttggaacataacaaaacttctgtatttaattatggaacacgtttcataaacgtatgtataatctgagagccgagatgataaattggctaatacgcaggttatgataatgtatcaaattgagccaaattacccatttttaaaaatcaagatagaaacggtaggggctatatacgtacaatatgctaaactttattttttgtattctgtctttatcaaatgtttccgtgatgggtttgggtgttttggtggttttcaaatgagcaaaggaaggagcttgaactttgttgctttcacataaaatagagttagacgtagtgagaaggaatgggcgaaggcatgggcaatgttgatacacaaatcaaacaagtacgagtggaatgtttagggaaggtgaagaatcaatcacgagatcacgagcttcaactaaagtcgactcactacgagctggacggctggagaacgggctgaatgccttggcaacgaactgattacttggtgacgagctggcgacctagtgacgagctgatgacttgaacaaagaagccaaagaccaacatacgattcaagggcttggacaaccccaagtccccaagtcactttcgtcagaaaatcctcgttcatcaccggaataaatttagttttgtaaattacaaatcgataagaaacctagcaacaacaacgatcctccgatgagacattatccgaatttggttctcgagtacacaaaatgaaagagacggattattaaaaaaaaaacaaaaaaaagagaaagacaaaaaaaattaaaaacataaaattagatctactgattgttattgaattgggcttacccggcccatagaaatatttataagcccgtttgaataactgacgtcgtatgatccaaaaaaaacgaaacaatcgcttccttcttcctcaccttcaagcgccgacttcaatcttttctcttcttctttgtttttttgctcttggttgatctctgtatcgggtacgtttcttatctcgatttcagtcttcatttgtttgttttttcttttcttatgtagctatgagaaccagaaccagaacgatgcaatagatactaaaaagcctttagaaatttttaaccatttttctccatttcacctgttgttgggttctagattaaatcaaactagagtatagtttctaatttctataggcatggttttagattttttgttttttttttggtttgatcactttgagaataatttaaagttgattgttttgtagatttcaagatatg

SEQ ID NO: 8718 - DNA, 3000 bp, Unknown
  misc_feature (1)..( 3000): cDNA_ID_2036810_gDNA_ID_1971867_Annot_ID_176511 3000 nt of promoter + ATG
catagtctctgtatacccattcggctagaaatccgaggaagcagcttctctggaagatccatagtgtttgctattcccaacacaactaatttggagttaggcttggtaggccaatcaagaatgttgtataaaacagactggtttctagttactagaagatcaagttcgtcgatgagaagtatgcaaggcttctcatcctctttaccaatcctttttccttctgcaaacctctcatttagacactgtagagctttcttccaaccgactcgatgaccactcaatgcttcatagattacactgtaaatgttctcaggtgaagccaatttgagaccattgatctccacaaagcaataagggcttacgcttccctcttcaacctcagccttcagattcttcataaccgataacacactaatagtcttcccagtcccgggaacaccatgaatatacatacatcttcctaaacactgatcatccgagattgaaccttttataaacgaagtgatctcttccatttctttgcttctacaaggaagagacttaggacgtgtagccaacaacaaagtagctttcgccttttctaactcactctgcttatgacatctcacatgttcaggaatcagcttcatccccaccttctcaaccccaaagaatctccctttacgagagttcgcacctcctcttgcactagtcaaacctcctcgcttactcttcaaaacttcatcatcaagctccatctcttcatcactatcatcaacctcctcctccttcctaccattccactcttgatcactatcagaatctccatcagccaattcagccaaacgcttaaagctacgccaatgaacatcatactcatactcacacaagaacacatcatcaccatcattactagctttcgaaaactccttaggacacttgacagaacaatgcctaagaatacattccatctctatatcagcaaaatcattcgtcaaataaagctctcgtttcagattatgcggttgacgccccgaaacggtctcttcaggtatcatataccaacgagcacgaatccaatacacaccatcatcaacttctttccataacttgtcgattcgagcagcccatagatcaccggaaagtagcttctccctcatagttctcgctaacttcttcccttccggtggcttaggaaggtcaagtgtttgactttgaccagactttttaacctcacagaattgacagatccaatcaccttcaggaacttccttcaatggcggtttcaagcatttcaaatgaaatccacctaaacaatcatcacactcaatcattatgttagtatctgatttgaaacaaatctgacaatcttcaatttctggatcttcttcttcatctgaattcgaatcttctcttctcttaacgtaaacatcatcaccgatttcgaattcggtttcgtcgaattcgactttattgtaataaactctcttcttcttcttcgtcttcttaatcgtctcagatctaattggtgaaacaggagtgaaggaatctatcttcttcttcttcttcggagtttctgttttcttcgacttcgatggaacgacatcagtggttggttttctgggggcacgttctcgttttcgaattagattcattccttcgattgggtcatttcctggagcatcaattgggtcatttcccagatcgattttacgagaaacatgacgagcagatctacggagaggagtgtgagtttctggggtttgaggagtgtgtgaggttgaagatggagatagatacgatttgcgatagatgttagacggagttttggttggggatttgaaggtttttgctcttggagttgaagccattgatggtgtaagctagggtttttctgggtgaagaatgaagagtgaatgaagaggaagaagaagacgatgatgatgatgaagaaggaggtagagagagaaagttggcgggaaaaggtggcggacacttcttcttcttcgcatcagacaagagtttgcgagaaaagggtttaactttgggccgaatattgggcttattaacccaactcatcactttaggtttatccaaattaatcataacattttgggccgatttgataagaaatcaataatataggtccttttgtgaaagaaaaaaaaaaaaacgaagagcacaaagtgaaatggggaattgttttttgtagagccctaaatagaaaatctccaactgtagtgaaagtgaagaagaagaagaagatggtggagatctgaaaatatgcgatagatctgacgaatgcagatctaaaatggtctaattctataccaatctcctctctcattgtttctactaagttcaagttggtgtactgatcttattttgtggcggtgtatatacagtcatctagaggaagggagaggatgatgatgaaggaagacggtagaggaaggaatccaccgtcgcgacatctttgggttggtaaccttcctcatgggatacttgaacgagaattagccgatcggttcttaagatttggtgaattggaaagcttagcgtttcagcctggacgaagctacgcatttgttaattttaatcacgatgaggatgcgttcgctgcgattgagtcgcttcaaggcttcccactctctggaaacccacttaggatcgagtttgctaaggcggttagtgttgaaaactcctttttttttttttttttttccaatgcttgcttaatttggcttggtttttgagtcttgaggttgattagagatgacatgaactaacttattaggagtgattgaaagttatcagttagtgtgtcttcaatagatgactagttatgtgattacttacacgtaaattagttccagtcagtaccattctagaaattaatgattgttgactacgcaaaggtaacaagtctcttaccttgttctggataagttgttactcggatgatacttaatcattgtctaagtttatagaacttagcaatcagtaccattctagaaatta

SEQ ID NO: 8719 - DNA, 3000 bp, Unknown; identical to SEQ ID NO: 8709
  misc_feature (1)..( 3000): cDNA_ID_3000046_gDNA_ID_1971867_Annot_ID_176506 3000 nt of promoter + ATG

SEQ ID NO: 8720 - DNA, 3000 bp, Unknown
  misc_feature (1)..( 3000): cDNA_ID_2036810_gDNA_ID_1971867_Annot_ID_58444 3000 nt of promoter + ATG
aggaggtagagagagaaagttggcgggaaaaggtggcggacacttcttcttcttcgcatcagacaagagtttgcgagaaaagggtttaactttgggccgaatattgggcttattaacccaactcatcactttaggtttatccaaattaatcataacattttgggccgatttgataagaaatcaataatataggtccttttgtgaaagaaaaaaaaaaaaacgaagagcacaaagtgaaatggggaattgttttttgtagagccctaaatagaaaatctccaactgtagtgaaagtgaagaagaagaagaagatggtggagatctgaaaatatgcgatagatctgacgaatgcagatctaaaatggtctaattctataccaatctcctctctcattgtttctactaagttcaagttggtgtactgatcttattttgtggcggtgtatatacagtcatctagaggaagggagaggatgatgatgaaggaagacggtagaggaaggaatccaccgtcgcgacatctttgggttggtaaccttcctcatgggatacttgaacgagaattagccgatcggttcttaagatttggtgaattggaaagcttagcgtttcagcctggacgaagctacgcatttgttaattttaatcacgatgaggatgcgttcgctgcgattgagtcgcttcaaggcttcccactctctggaaacccacttaggatcgagtttgctaaggcggttagtgttgaaaactcctttttttttttttttttttccaatgcttgcttaatttggcttggtttttgagtcttgaggttgattagagatgacatgaactaacttattaggagtgattgaaagttatcagttagtgtgtcttcaatagatgactagttatgtgattacttacacgtaaattagttccagtcagtaccattctagaaattaatgattgttgactacgcaaaggtaacaagtctcttaccttgttctggataagttgttactcggatgatacttaatcattgtctaagtttatagaacttagcaatcagtaccattctagaaattaatgattgttgactacgcaaaggtaacaagtctcttaccttgttctggataagttgttactcggatgatacttaatcattgtctaagtttatagaacttagcaatgagcaaaacaaacgaagatggtggtatctcatttttgtctcctcttcataggcctcacactttattattacaagaagttttttttcacattaactgtgaaagttctgtagtttctatatatggaaacttagaatcattctttattaaaccatatgcctccacatcaaaagtatccatgtgtaaccgcacaagcattcacctttatcattcacagcacaaacattcacctttatcattcacaacacaagcattcagccattacgttgtgaagcattcagaatgttattgacaaataatacaaacttggtagttgatcccaagttggagttctttgttcatttaaagatgctcttagctcacttgaggtcaagtgtgttccaggaacatcagcatgtgttgaagggaagtggaccagtgttcaactagatcttacaataaagataacagaaaattgtcaataagctttatggctcttagagttaatgtttacctaacaactttggatgattccatatgcttcagcgtcagggtcacattcatgcaaaagtcataaacccaagttaatagaattatgttggcattggtccacatgttgtaagtttgattgcgttgctgcctgacttcagttgcctctcagtacttacgaaggtgtgacttgatcatctatattgtgtctccgagtaacttttcctgccttctattatgtcattataaactgagaagttacagagtatagaactattattcagctagcagttggtgacattttacatattttctccataatatgtgagtaacaacccaccatacgttcgaggcattgttaaagttcattctcatcttcaccatgtttcatattcctctgcaacttgccagtgccaaacagatacatgcttttgaaatggttacctatacatagacattgttaaaagcagaatttgattcgtatgtaccaattccagcttgcaactgcccaataaaattgatcattgttatttttttagattatacaaaaattgacagggccaaatatcttaagcttgatgattgtttgtgtttatgacatgtttactttttgccatgattacatcttggtcatgtcttaaattctccatggctagtgatgatgtgtaaaattgaggagctaaatttgtataatgtttaggattggcctattgtctgatacctcaatatattaatattgtaacttatacattgcagggatattctttagctcaaattaatcaccataggcagctcttccttccttagacttgctgataactagatactcgagttttttcatcggttaatagtttaaagagtttctatctgctttatattgttgatattaatgcatattagcttttactaactgtgaggcagaagcgttttctgttgcacagtgtttgttgcctggtggactttcttacccagctgtgttagatgggcatctcattatctagttatgaattaaaatagcgtatggattttaataatcttgtgatggatttgaaacttgattctatttattatttctcttgataacagtagctactgcatagctatttagtttgttacttgaagtaccatataaatacactgctgaagtttccttctgattagctttcatttagagcctactgaagctgatgctttattttcttgatcatgcagtgaagtaggccgttggttaatacttctatctttgtgatactctttatcgcaggaaaagtcatcaactggatcacgcactgatgatatatatcgccatgatgaacagcggtctgcagcaagagggtcgtcttttgtccaaagggactccaga

SEQ ID NO: 8721 - DNA, 3000 bp, Unknown
  misc_feature (1)..( 3000): cDNA_ID_1989203_gDNA_ID_1971868_Annot_ID_58446 3000 nt of promoter + ATG
acggcggatgaagaaaacgcggcggaggcgagagacggcggttgagagagagtggattcaccaccaagccgtgcaaagcttcgtgctttgcttatcaaacactttaaacgactcacacagttcattaggaacgaatttacttgcaaagacaagacctttgattcacaccaaaaaaaaaaaaaaagacaagacccttgattttgttttgattctcaaatattttgggttttgagctttgcgtaaatattgtcaagcttgggaatttgggcaatacagtaacagaagaatggaataacttggagatcaagtagtttttcttacatatcctccaaaccagaatgattcttccaaattgaatcattctgtagaggtcgacgaaataaagaatataatcataaattaaatcattgattgctatttctttctttattgacttttaaaacaacataagagacaaatttagaagaagagaggaactaataaaaagtgtacacaaaaagcctgtgaaactggttcaggacacacacaagacaaatgcctcaaagacaatatgagcttagagctttcctttaaccagcagagctcaaaggaaagcatccttctcaagcagcttcaccacctccagctggctgttgagcttcgctacatcaattggcgtcttctcgtctaggttttgcagagtgctgcaaccacacacatcaaccaaagcacatataattaaagtcctgaaacagtgtttaatggagttgtttcattataagtactgtgttgtgagacttacactgcagcaccattctccaggagaaggcttacacactctttcctcccgtaaccagcagcataatgcagaggtgtgttcttgtttttgtcaaccgcattaacacttgctccagcatcgataagaacttgagcacatttcaactgttgatagggctcaacagggttaaactcagttcaatccatattcataagcaaaatctttagtatgcaagtaatcgccagttccatctcattgctctttcaccaaatatttgaacttgctataagtaattgtgtcatgaaactcgtagacgtaagtagactggttacttttctaccaattgaatgattataaagattcttaacttcacagctactgaaaaaaagagaaccatctaaatccgaatatttaattgccgtgaattgataagagaattgcatacctcgccgtatccacaagcaaaatgcaatgctgtccttccttcagaatcttcttcatctttgttaccaccagatgccaaggcagctttcaaaccctaatgaatcaacgaataaaaatccaataacgagttcaacaaaacaaaacttggaacatctaattcctcaagcaacacgcaagataaatctcacatggtcaagcatattaacgtaggaagcagtctaacctcaacatcaccaagactggcagtttggtgaacaatagactcttcttcttcaccttcttctgctacctcaggttcagctgaaacagtctggtctggtaagccagcaacaggcatacccattgcttcacccagctttttcagcacttctggatcattccagtacctaaaacagaataaataattcttccttcataaacagaaacaaactctacagtttctctaaaaaacattgaaagaagtttgtatcactcacttcatcatggcagaaggaccaccagcatcaatctcatctagtataggtttcaactctggatcttctttcatccgcgccatacgctcagtaaagtgttctgctgtttcaggattcgagaaagcatccaaaaaaggagacatttgtggatcctgtaggcaaaaaaaataaataaaatcagataagacacagagcttcattcaaagccacacctcgattagatggaaaaagtcatcaattcctaacctgaactaaggcggtaccaagtttctcggccattgtcttaaactcagggttatgcataacctgttgcattgtattgacatactgttgaggatcaaagttagggaaaccaccttcctggccagcgttaggaatagatctctgaagctgctcagccaattggttaaacgcaggatctttagctatttgctcagccatttctctgatgctaggatcctacaaaaaaaaccattatcaattaaaaaaaaactcaaagaagataacttttcaattgtgctaacagcaaaggtaacttacgttgagaatactagccatattagagaaatcaaaagcattgaaattcaagccaggcatagctgatgaagttgaactcccagaagctgattccggcttagaactcttattctcctccgtcgatttgggtttctcatctacagtaaacaaattacaatgaaccaataaccaaatctgactagaaacgattcattatcgcagatcagattgtatactgagaagaaaataatcacctgaaagaagaggatttttctccgaattggaagccattaagtatgactaaaaccctacaaaaaacacaattttgttttcaggaaaaggtgtaaacaagagattcaacgaaaataagcgaagaggaagacaaagaaatcgaatcgacaactacctaagagaatttagtaagaaaaggaagaagaagaagaaattaacccgaaaagacaatgttgtggtggcaaacgctcatgaaacttgaaatacagataatctttcttttttttaatatgacgacaagagaaaaattatttatttatcagctggattttggattgagaagaagatcaactgcgagggacaacagccactgcttctccattgaagtttgaacctaaagctaagaggccttttatttttaatcaaatttattgttattggcccatataaacctgtttacctcaaggcccaagcccatgcgtttgaataataagatcagccacgtaagatttgtgatttaagatcaaattatccgttaatggataaacacgcgtcacttcacggaagcagccgttcatg

SEQ ID NO: 8722 - DNA, 3000 bp, Unknown
  misc_feature (1)..( 3000): cDNA_ID_2999328_gDNA_ID_1971868_Annot_ID_58447 3000 nt of promoter + ATG
tgatacattctctatccaggaccccaacagggtgtattctgggagcatcaatgctgcctgaaacgactgcaacatgagaaagttcatgcttgttcatgattgtttgggcagcgagaagatccatatcaggtgtaacagtccatggcactttacattttcctccactcctcgaacagatgtcattaacaaaaatatcctaagccaaagaaatgcttcaattaatgatcaaagaaatagttatttcagactattcaatttcgtaccttgggtctattatttccttcttttcttgctttgctgaattcctgaatgtctgaaagtgtaagtataccgagaaagatattgtcaggatcaacaatcaaggcgcaggattgtttctctatcagcatacgagttaatgcctcttccaaagaagtgctcatcataactgtcgcaaatcttgttcgcatggcttctgaaacaaaaatactcttcggcagctcctcagattggttgagagaatcatcaaggcaaagagaactttcaacttcacaaaggttattcgttgatgattcatcatcagatgacgtcagagactgtacagcttcttggctctttcttttcctagtttcttttgtttctctagtttcttgtctctttgattgtccagatgtaatccatgaagacatgcctacagctcccagtagaggtaacactatacgataatcctgtgtaagttcaaatagcagtagtactgctgtaagaggaacttgacaaacccccgcaagtgtagcagccattccaacctgttaaacaatgagacaaacaggatcattggcaatgaagctacaaaaaaactagcatccattctcagttaacccgaaaaaatattctgttcaaagtattgataggtaaccaatcaagaaagtctgaaattaagacaattttgaaacattgaccacataagaacagtaccagaccataagcttgtggagatgccacttccaagatagagagattgaaatcagggttctgagccaaagcaagtccaataaactttccataggccattcctgctgccccgccaataaagagagaaggagcatagtatccaccgacaagtccagaagcccgacaccatgcggttgcagctatcttgaccgctaccagctgaagcaaaagatcagctgaaagacccttcacaaatggacgtttctccaacaaaatatccacattctgaaaaccccagtataatacttcagggtataccaaagctatgataccaacacttaatccacccattacaggaaatacagcctttggtatcccagcatccttgttaagactgtcaacagcagatgtcatggatgatgtacatcgagataatgccaacgagaccaagccacacagagcgcccaataaaagatagagtggaagttctgaaaatcagtgaccagctctcataagtttggtttctggttcccttgcgtaaaaagcataagaatggcaatgcatattacctccaggagagcggaagtcatagtcaggaaccttaaacgcaggttcagagccgagaccgatttcggaaaccacagaagcagtaacagcactaagaataaccatagaagttgtgtttggaagtgaagttgatgaatcagttgatgaagaaggccacaaaacggattcaactgcaaagaagcatccagccacagctgcattgaaccctgtaacaacatataacaaagtcctcttaacgaatcaatcaagagttccatacgcaagagagaacaacattagcaaatatcagatgaacaaaccagaggaaatgccagcagctgagccagcggcaagaagtgagaagccagtctgaggacttttattgaacagagaattcacacctttagcgattgacgctccaatttcaacacttggaccttccggccccagcgaatttccagtcccaagcgtcacacatgcggcaacagtcttaaggaaaggacgcaacactgcctttacgcgatcgagactagaatgagaatctccagtagattttccagcagattctcgaagctgattgaggatgctcaccaccaaaccgccgatagtcggaacaaggataacacgcaaccaattggaaccgatcggtgcctctctaagccacgaagctccacgatcaggaatcccatcccaggaaaagtctcgaagcaagtgaacacagttgttgaatagaaccacactaactccagtgagaacaccaaccaaacaagccgacgctatcgcaagctcctgagacggctgctgatcaaatccaacctcatcctgatcagtctcctgcttcgccgccggtaaacgcgggaaaattctaccgccaatagcgacggaaccgaaaaacggtgaaaggacgacattgaactgaaaaggaacgtcggttttgtgaattggagcgaatctccgggaagagacgggagatcggagggcagcacagagtggaagcgtggctgccatgaacggctgcttccgtgaagtgacgcgtgtttatccattaacggataatttgatcttaaatcacaaatcttacgtggctgatcttattattcaaacgcatgggcttgggccttgaggtaaacaggtttatatgggccaataacaataaatttgattaaaaataaaaggcctcttagctttaggttcaaacttcaatggagaagcagtggctgttgtccctcgcagttgatcttcttctcaatccaaaatccagctgataaataaataatttttctcttgtcgtcatattaaaaaaaagaaagattatctgtatttcaagtttcatgagcgtttgccaccacaacattgtcttttcgggttaatttcttcttcttcttccttttcttactaaattctcttaggtagttgtcgattcgatttctttgtcttcctcttcgcttattttcgttgaatctcttgtttacaccttttcctgaaaacaaaattgtgttttttgtagggttttagtcatactta

SEQ ID NO: 8723 - DNA, 3000 bp, Unknown; identical to SEQ ID NO: 8722
  misc_feature (1)..( 3000): cDNA_ID_2109585_gDNA_ID_1971868_Annot_ID_176525 3000 nt of promoter + ATG

SEQ ID NO: 8724 - DNA, 3000 bp, Unknown
  misc_feature (1)..( 3000): cDNA_ID_3043238_gDNA_ID_1971868_Annot_ID_176530 3000 nt of promoter + ATG
ggagaagaagaatctgatccaagttataatagagacacacacatacacatctatacttatataagacatgtccaaattgcagattaaaattaattaaatattaataagtagtgttcatttaattccatgtcatatcggcaaaaaaaggttttggatgaatagaagaaaaacttagttttacaacttttccgaagataaataatgagattgcagtatccataaagacaaacatatttgaatctttatttaaaagtaaaaaaaaattgatcactttttatttttttttgggtaattcaagtttgatgttctacaaacaacatctttatttttaggtaacccaaagtttactcgagtggtccaaatttaaatgttcaacccaagattttaaatttttaatgcatgctttgaactttggaagtttataaagttctgatttacaaattgataaatcatataagtatgtgtagttaaactaatagaatcatcaactgaatttttttaattatgccgttacaaaaatttacagaattaggtacttttgtatgcaaaactatatatatcatcattccattttgttatttttgacaaaactaatactttaatataaaaaataaacatttcctcgtgtgattcaaagactatagattgaaatactttatcatatacaaaaattattatgatttctgatttaagacagaatttatgtctcaacgaataagttatcttgtttaagaaaaatctaaagtactaatacaatctgttacgactaaattatttcttagccgcatgggagatcttgggcaacatgcctcaacatagatacgggttttaatttaaataatgttctcctccaaaatacatttagataagagatttggaaatatcgtaatcgaatacaataaagaattaaattgccgtatattattagaaaaccagacatggaaaaagatgggtaggtgtgggcgctctttttaggttctgtttgacgaactcattatcaaaaggtgtaagtgtaaattactttcttacctaaacctacttctattagactcttttattctgcattcttcaaattttttgggcatcttgaaagattcctttaaaacaaaaaaaagggtaaaagattgagatcagaagatggttttgttgacaggtggtgctgaagtttggattcaatgaatttcgaagttcttgcgatattgtcaagttttcctcttggaataccatatttgttttaatagatatactgtagttgttagtttagatatattatttttcataaccgagtttgtttacatttgtatatgttaggatagaatgatgtagccatgtaggtgggatcttgataagtgataactatcaatttacagaatctttgaaatgaatctacgtgtcctcaaaggtagcataatatatttacattatagtattaacagcaggtaccaccgtccacgtgtgcataaagttttggtgtttctagactctcttgtcatactactaactgaaatattgtaatatggttttcacactaaaaaatcgaatcaacccaatatattatcaaatcaaaccaacgacgataaattttacctaaaactttttttttaaaacgattttcagccgaaatatcacaagattatcggtcttgggctagactctagagagggatagatagatggaacttagaaaataataaatggaaaaagatattaaaagaataataactttgaagttcaaagtacaatcggaatggaatatcagtcttttgcgtgaatgcgtgtgatgtgagtcttgacgtcgtatatggaaccaaaaaggtgaaaaagcaaaccgagttattaaaccactaattaaaactataagacattcttagcacatcggattaaatagaagaaaatcaacaataattgagaacggaagcattaattatgacatgtaataaacgggaaaaacaacgacaattatggactttggaagcatcgattgtactggggtttggagcatcaataatccatattttggatacaacaacaattttgtttgttttttactcaaataaagatgctatatttgttatgttcaaaatctctatacatctttcggtctacggccaaataggcaaatacttgcaccaattacaagcaagtaagtttatatcttgacatataatcaatatatgatatagtccatgcgattccagctaaccacatataactaattcatactttagtggagctagccagatataactttattcatatagtagtgtggttatgaatccaatatataattgatagagaaatggtagtttcgaagtaacgaaggttgacaatttcaaaaagcccatacaatcagtttgagagacttaaaagagttgaataatgtacagcaacaacgagtcaaagtcatgcttgtgtgttacgtgttctatatgtgtccatgattataacgcaatagcaatatcatgtcggtgcgctaacttgttttgactttttggggtcattaaactaaaacatcagtttcaatatacatatacatgacgtcataaacgttccattcaatcgctatgccattttaatataatagaattttgcaacttttttttttcctcaaggtagaattttataactatagattaaaattggataattaaagttctttgttcgtttatttgattagtttttctgtagtatagggtcaaacaaggcaatgttaaaagtcaaccatcttctttatttatatttgttcctagttaattacacttaacactgtttgttaattcattgaaattgttttgtcatgtactaactattgattattcagtcaccgtcccatgacatgataatcccaccaaggtaccaacacgtccaaaacaacgaaataggaaattattatttagaatctaatgggctaaaaataaggcccaaataaaaagcaaaggcccaatatatactgtcacaaaaaccctcaaagaacagtgaagctctcatcacgatcgcaaca

SEQ ID NO: 8725 - DNA, 3000 bp, Unknown; identical to SEQ ID NO: 8721
  misc_feature (1)..( 3000): cDNA_ID_2178077_gDNA_ID_1971868_Annot_ID_176524 3000 nt of promoter + ATG

SEQ ID NO: 8726 - DNA, 3000 bp, Unknown
  misc_feature (1)..( 3000): cDNA_ID_3043234_gDNA_ID_1971868_Annot_ID_58448 3000 nt of promoter + ATG
atgaacggctgcttccgtgaagtgacgcgtgtttatccattaacggataatttgatcttaaatcacaaatcttacgtggctgatcttattattcaaacgcatgggcttgggccttgaggtaaacaggtttatatgggccaataacaataaatttgattaaaaataaaaggcctcttagctttaggttcaaacttcaatggagaagcagtggctgttgtccctcgcagttgatcttcttctcaatccaaaatccagctgataaataaataatttttctcttgtcgtcatattaaaaaaaagaaagattatctgtatttcaagtttcatgagcgtttgccaccacaacattgtcttttcgggttaatttcttcttcttcttccttttcttactaaattctcttaggtagttgtcgattcgatttctttgtcttcctcttcgcttattttcgttgaatctcttgtttacaccttttcctgaaaacaaaattgtgttttttgtagggttttagtcatacttaatggcttccaattcggagaaaaatcctcttctttcaggtgattattttcttctcagtatacaatctgatctgcgataatgaatcgtttctagtcagatttggttattggttcattgtaatttgtttactgtagatgagaaacccaaatcgacggaggagaataagagttctaagccggaatcagcttctgggagttcaacttcatcagctatgcctggcttgaatttcaatgcttttgatttctctaatatggctagtattctcaacgtaagttacctttgctgttagcacaattgaaaagttatcttctttgagtttttttttaattgataatggttttttttgtaggatcctagcatcagagaaatggctgagcaaatagctaaagatcctgcgtttaaccaattggctgagcagcttcagagatctattcctaacgctggccaggaaggtggtttccctaactttgatcctcaacagtatgtcaatacaatgcaacaggttatgcataaccctgagtttaagacaatggccgagaaacttggtaccgccttagttcaggttaggaattgatgactttttccatctaatcgaggtgtggctttgaatgaagctctgtgtcttatctgattttatttattttttttgcctacaggatccacaaatgtctccttttttggatgctttctcgaatcctgaaacagcagaacactttactgagcgtatggcgcggatgaaagaagatccagagttgaaacctatactagatgagattgatgctggtggtccttctgccatgatgaagtgagtgatacaaacttctttcaatgttttttagagaaactgtagagtttgtttctgtttatgaaggaagaattatttattctgttttaggtactggaatgatccagaagtgctgaaaaagctgggtgaagcaatgggtatgcctgttgctggcttaccagaccagactgtttcagctgaacctgaggtagcagaagaaggtgaagaagaagagtctattgttcaccaaactgccagtcttggtgatgttgaggttagactgcttcctacgttaatatgcttgaccatgtgagatttatcttgcgtgttgcttgaggaattagatgttccaagttttgttttgttgaactcgttattggatttttattcgttgattcattagggtttgaaagctgccttggcatctggtggtaacaaagatgaagaagattctgaaggaaggacagcattgcattttgcttgtggatacggcgaggtatgcaattctcttatcaattcacggcaattaaatattcggatttagatggttctctttttttcagtagctgtgaagttaagaatctttataatcattcaattggtagaaaagtaaccagtctacttacgtctacgagtttcatgacacaattacttatagcaagttcaaatatttggtgaaagagcaatgagatggaactggcgattacttgcatactaaagattttgcttatgaatatggattgaactgagtttaaccctgttgagccctatcaacagttgaaatgtgctcaagttcttatcgatgctggagcaagtgttaatgcggttgacaaaaacaagaacacacctctgcattatgctgctggttacgggaggaaagagtgtgtaagccttctcctggagaatggtgctgcagtgtaagtctcacaacacagtacttataatgaaacaactccattaaacactgtttcaggactttaattatatgtgctttggttgatgtgtgtggttgcagcactctgcaaaacctagacgagaagacgccaattgatgtagcgaagctcaacagccagctggaggtggtgaagctgcttgagaaggatgctttcctttgagctctgctggttaaaggaaagctctaagctcatattgtctttgaggcatttgtcttgtgtgtgtcctgaaccagtttcacaggctttttgtgtacactttttattagttcctctcttcttctaaatttgtctcttatgttgttttaaaagtcaataaagaaagaaatagcaatcaatgatttaatttatgattatattctttatttcgtcgacctctacagaatgattcaatttggaagaatcattctggtttggaggatatgtaagaaaaactacttgatctccaagttattccattcttctgttactgtattgcccaaattcccaagcttgacaatatttacgcaaagctcaaaacccaaaatatttgagaatcaaaacaaaatcaagggtcttgtctttttttttttttttggtgtgaatcaaaggtcttgtctttgcaagtaaattcgttcctaatgaactgtgtgagtcgtttaaagtgtttgataagcaaagcacgaagctttgcacggcttggtggtgaatccactctctctcaaccgccgtctctcgcctccgccgcgttttcttcatccgccgtc

SEQ ID NO: 8727 - DNA, 3000 bp, Unknown
  misc_feature (1)..( 3000): cDNA_ID_1989202_gDNA_ID_1971868_Annot_ID_58449 3000 nt of promoter + ATG
ccatgcttagtagagagatcattgattgttttaggtaacagtctttagagtaaagagtcttgttttcacaatgttcaatgcttattctattcatagagcaataatcgtcattgcaaactctgtttgattgattgtgtagggtgcatggcagctttggatgcagagcattacttacaagagattggatctcagcaaggtaagagtgattgaggaaattgttggaaggctcaggtcattgagttattgttgattgatccctgattcagttagacattgatggaccagaatgagacttgatctttatcatagaacaagttaagatacattgatttgtttattccttaatattgcagttggaattgagtacgggtattgttcaaagttgtagctctaatggtaaaactagctacgacaaaagtcctcttaaaatatgagttttagatgatgccttaacatttcatatattcagtgaacatgatttatccaataatgtattatgtattcttataaattagtataatataaaaatgggtttccagaaatctttaagacatttctgatcttgaagccgagtcatttccagagcttctagaggcttttgaaatgatcacagatttttcagaggaaacggctttggtgaagctttaacactttgatgtcaagaaagagagaaatgacggcttggaagggtcttcaaccgatgacgtcgttcactcctacatggttgaaatattcaaaagagttcataaaatccttcccaaaagtagtcccgattattcttctaaccattcttaaaattcgaaacgatgaatgtgattcttaaatgtggatttttctcaaaattatgtagtcaacaagattgaactatgccttaaataaaaaaagctgtttgattaaaaggttgaattaaatctctactttataataaataaataaaagttcctgcattttatctttgttgttttttctttttgtttgacttgatttagaaatattaaacttttctaatcaacgatataggtttaaagagtttttaaagttagttataaagtgtattttcccgaaatgtattgtgaaataggacttctaaaaaaattgaggttcatacatttttaaagtaaagtttgtgcttatagtagaaatttggaataatgatcaaattcctcgataatagtatgtagcattcttgtaatgcttgaaattgcaatgtgttgcgaccactgaaaagtgcaatggatatatttctgttttatcttattttattggaatttcctataagattttaatcagttatatcaaaacaaattataattatagccagtatagatccgacgttggtgtgtcaagccacttaaaagatgatggaaatggatcagatttactgaataactgacacacgaaattcctaaataattgttttctgtagaagaatatgtacaactagaagataatatatgattaattattcagattttatcttaactttttgttgtaaacgtaagtttttatttggaatggtcatactacaaataatcttcaagcattttataaagagtaaatttaaatatcttcgacacaaaaataaaatatatattacaaaggaaaaaggtaaaagaaaaatatattaaaaattaaatttagtactacattaatgtaagtattaaaaaaaaaaaaaaaattggttcaaaatactaaacaattttagatgagaaattcatccaagaaaattctcaagtaaaagtttttgtttttacttaaaagtttaaaaatctcttcataccaaaaaaaaaaaaaaaaaaagtttaaaaatcttccagatatgcaaatgcatatgcaagtgggggccatgaatgtgacagctggatacaggttaaaggacaacacatcatcgaccacatccccgacacgtgtcccatctcacacatggcgttttcctctctctttcaccatttttttaatttcgcgtctccgtttttacatctttttttttggctaaattgttttctttttcttattattcatttctatatattatattgaaaataatttgattattagtagtactgtagtattattatttcatacaaagtatatatatatatatggcaaaaaatagttgtttaatgcttgtttttttcttcacaaaaattcaccttctacttctccttcttaggacataatgggcctattgatttatctttgttaatccctataacattccaacttccaagtgtaatgcttattttccatataagaataacaaagcttaaaaataaaaaaaaattaacggtcacaacacaaacactattttaacttataaaatggaaataggcaattaggcattgatctccgcagaatctattgcactagcttgcactatgtttattcactttaatctcaccctttttgtcttctcgaaaatcagttgataatatccataaatacggtcaaaatacgtagaaaatacgataaggagagtgtaatagtatagggagaaaatgggaataacgtgatatacatatccacagataagcaataggtcaccatcccacggttcacgttatttccgtcggtttttaaaatcaaaaaatttcctctactgataatgttaattaagaaattaaaattatgtcttcaacttttaataaaacaattaatgaaaaactatcattattgtagtttcattagtgacaaatgacaatattaaaaaaaattaagaaaagtaagcaattattagttgaagaactgaagaagcagaagaagaagaagcagaagaagaagaagagaaaattttgacagagataatacacagatagagagaagagacagagacagagagtgatggaaacagctgtatttattatgagacgaaacaagaacctctgggtttctacttaaactcttctctctttcctctctcactttaaaaatccacactttagagcacacaatacaaaaaataagggtttctttatcttttcgtttcttccaaattttgta

SEQ ID NO: 8728 - DNA, 3000 bp, Unknown
  misc_feature (1)..( 3000): cDNA_ID_2113730_gDNA_ID_1971869_Annot_ID_176541 3000 nt of promoter + ATG
caccatcgttttcgctagggtttgatcttgatgctgcatcggatctccaatcggaaatccatcaaaaccctagctccaccggcgaccaattaatcggggacggcgataacgagccagagttgggacttactgtctcagattccgatcgggagcttgaaccagattttacaagcccggttctcaagcggttgcgacgagggattaatcccaacaagtgttctgtgaaagatgatagaagcgtagctgtagaggatcgggatgatgacattgaagagttctcttctcctgaggattttcctacgggtaattacaattttgagcttctgcttcgtcttttcgaatatgggtcttacttaaactgctggaataggaatcgagcattgttagatctcttattaaacgtcaatgagctgattagcctatctttcattcattaggcgtcttggatcgtgaacacattgatagaaagaccatcccttagtttatcatagagaacttaaaactgatggatttaggaagcctgatgcaaaccctcttctatttagatatcaggatcagtttgttgtggctcaaagatgaaaacttgattgcagttgttgacactaataggtagactagagtgggtttggagccttcaggctgagaatttgttatttataaggacattgattaagcttcattccactcaaactggtttcttttggatttctttagtgtaatattttaagtcatccatattgtgttggtttcatcttggtataaaacttgtgttgcttcatgcagacgcaccggcctcaacaagaagtcatttttctagttgcagctcaagggtgccacttcatggttctggggttttatctaatcaaccttctatctctcggggaaaaagaaagcagtcggatgttcaagcatctgctgcctctgggattagttctgttgcatcgttgtttcagatgtcaagtcgtagtcctctacgaaggttccagctactagattcagattctgaagatgaccatccatccaccagcagagatttaagcggagcaactaaaaaacatgattcattctcaaagaatcaaccatctattgcaagtaaaccgaagagaaaggaacctggatctatcccctgtattaaagatctgtggaaagatttttccccggcaagttccaagattcagacaccagctttcgatgatgtttgtcaggactattttatctccatcaagacgactagcacagctcagaaacaaagcagtgctgtggcaagtagtagcaatagcggaaatcataacttgactggctttcagcaaactgagctattccacgatttttcccacccttctcctccatctcatcgtttcttcttgcatagtgatccaaggatccggaatctagctcgacagcggttaccaaacttctttcctctgggaattgtcaatgatagggagagccagcgagaggtgttccttgttgattatatgtaggttactcctaatctatttcttattttgatacttacaatcttctgcttcctgtggattgacacatctttcgaatgccattgtaggaatcaatttggcagcaaagggagttctaaagctggagactctagcagcaaaagctgcagaagagggaaaacaaagtcaaaggtttcaaagagccaagagagcgcacacaattctgaaggctggttaaatcctaaaacgagagctgcagctccaaaggatgctgggaaaaggcgtgtatctgctgacagtggctctgcaggtcattggttcacatccccagaaggaagaaaggtaggtttctgtttccactgttctaaaaatacatagaaaatgactgggatgaatgtgttatacacacacgcattcacatcttttaagcatgagaactatttgttaaagaacacatagacaggaacgtctaaaaatttgttgtctctgaattttcttgctctttgtaggtatatatctctaaaagcggacaggagttttcaggtcaaagtgcttatagatgttacaaaaaggtcagcatccactgaagctggttgataccatctgataatgttatatgcataaaccttctctgtgagctaattcatggaactttattgtccacaggagaacggagtcgggtttaagaagtccagaaagaaacgacaaccaaagaaaaaggcgaagaattgaagaaaggaagccattgtttccttgtaagaactcaggtaggatactgcgaacttaagtctctttcacacatgtattatttgtcttagttaaacattattgtaacccaccaacaacttcattagcaacgtgtgttctttaggaagacttagttatattagcaacgtgtttcaatttcagtcttaaaaaaacatacgatatgtatttgttttggcacaccaccattgactcctttctatctttacctctggtgtgtgaatcttatatatttagacaatgtaagcaaatgcagagaacctgtaaagcccatgcgtctgtgaagaaaaagttgatatagaatcagagattgatgggtttcttgtctaatattttcagctgtttcgcaaaggactcctctggatctggagattacacctgcgacgctggtgtttgtgttctaagaagctccaagacaaccccgaaacttcaaaatggttaaatacatttacgtagctcttgaagcttcgcaatcgtttccttgcgataatttgtatttcttttatcagttgtgtaaaaatgcatattgaaagagatcttggttcacgggttagcacagatttttatatccaatttagtctgaaataaagtttaagaatatgatccatgagatcgatctcacaaagtttgcttattttaccaatggttaaaccgaaagactgaatttgaactaaaaacggttggccaacgaacaaatttacatacagtacacagtagttgaaatcgcagagtcagaatctcgtacagtaagtagttgcagagtcagaatttgcatatg

SEQ ID NO: 8729 - DNA, 3000 bp, Unknown
  misc_feature (1)..( 3000): cDNA_ID_2178224_gDNA_ID_1971869_Annot_ID_176543 3000 nt of promoter + ATG
tcattgacaattcccagaggaaagaagtttggtaaccgctgtcgagctagattccggatccttggatcactatgcaagaagaaacgatgagatggaggagaagggtgggaaaaatcgtggaatagctcagtttgctgaaagccagtcaagttatgatttccgctattgctactacttgccacagcactgctttgtttctgagctgtgctagtcgtcttgatggagataaaatagtcctgacaaacatcatcgaaagctggtgtctgaatcttggaacttgccggggaaaaatctttccacagatctttaatacaggggatagatccaggttcctttctcttcggtttacttgcaatagatggttgattctttgagaatgaatcatgttttttagttgctccgcttaaatctctgctggtggatggatggtcatcttcagaatctgaatctagtagctggaaccttcgtagaggactacgacttgacatctgaaacaacgatgcaacagaactaatcccagaggcagcagatgcttgaacatccgactgctttctttttccccgagagatagaaggttgattagataaaaccccagaaccatgaagtggcacccttgagctgcaactagaaaaatgacttcttgttgaggccggtgcgtctgcatgaagcaacacaagttttataccaagatgaaaccaacacaatatggatgacttaaaatattacactaaagaaatccaaaagaaaccagtttgagtggaatgaagcttaatcaatgtccttataaataacaaattctcagcctgaaggctccaaacccactctagtctacctattagtgtcaacaactgcaatcaagttttcatctttgagccacaacaaactgatcctgatatctaaatagaagagggtttgcatcaggcttcctaaatccatcagttttaagttctctatgataaactaagggatggtctttctatcaatgtgttcacgatccaagacgcctaatgaatgaaagataggctaatcagctcattgacgtttaataagagatctaacaatgctcgattcctattccagcagtttaagtaagacccatattcgaaaagacgaagcagaagctcaaaattgtaattacccgtaggaaaatcctcaggagaagagaactcttcaatgtcatcatcccgatcctctacagctacgcttctatcatctttcacagaacacttgttgggattaatccctcgtcgcaaccgcttgagaaccgggcttgtaaaatctggttcaagctcccgatcggaatctgagacagtaagtcccaactctggctcgttatcgccgtccccgattaattggtcgccggtggagctagggttttgatggatttccgattggagatccgatgcagcatcaagatcaaaccctagcgaaaacgatggtggctcaatcgaatccatgagaatgaatttagggtttggactaggagatgaagagacttcaaagacatggaattggcgccttggtgtgccgaagaagcttgagatttcgtaaaaattccccgcctagcgcacaatccatgattttaaaaaaatttcaagtgattctcaatttctcatgtattaattttcgtcgggatatttaccgccgcagaaaataattattttggaaagaaaaaaaatcagaatgggccgtgaaatttcaaagttggataaagcccataatttaatttggtgaacggtcttcttttttttttttcccggcaaataatttcattgatatcaaactgaaattacaaagtcagtatacagaacattagaaaacaaattattacataagcagatatatgcgccatgtagtgagaaagatgcacaattgggaagtgaatttgacgatgctttccttagagaagccttattcgctaatgaatcattagattcactattttccttctccatttctgatcttcctctaatgcgaaatgtatgcatccatctactctaatgttgttcttaattgtataatcaactaatcttttttttttattcggatttataaattctgatgatgatgacatattgacaacacttttattattcgattacaaatactaatttcaattaattatttacaaaatttcaaaatcatgttaaatattttgtaatgtataaatacattatacatatcgattacaatttttttattattgtttatttctatatctattgcaataatatgttttaagacaaaaattggacatatggaagttcttaattcacgagttattcattacaccgaaaataaatttgattggtgacacgatcacggtattactaatttgacatatgaacacattttatcataattgttcacacttaacgagtgctcgaactcgaattaccaaagacatcattggccttaaaaagtgtaaaataaagatgttttaattacgaatccaatgtcatcttttatttttgtatcttgtttttgttggtcgactttgtcatttatttttgttttatcttcattcattgcttataagttaaggcttgtcctccattttttgtcatttgctctcgtgacagcatctcgattcaccgtttttactttttctctaactttctatttttatttatatcattttacttcttcaactttattttttcatttttttgttagtcattcttggattagtgttttctttcattcttggaccatactaatattcagataatacttcatacattgcaaaaaaacaaaaataaataaaccaaaattcataaggtatcataagaaatcaattataagaaaaaacaaaaatcattggacaagacaacagactgaattatcgttttatccttttaaaatgaaaatcaacacattcatacgagatatggtaaggacaatttagtcatttagacacgtgtcgtgcccgcgtcgcaaaagcctataaagaatccatttaccttttctcactgaatctgaaagaaaaagctcgcagag

SEQ ID NO: 8730 - DNA, 3000 bp, Unknown
  misc_feature (1)..( 3000): cDNA_ID_3043275_gDNA_ID_1971869_Annot_ID_176547 3000 nt of promoter + ATG
cccaaatttaaccatccatttatcaggaaaaaaggaaacataaaataaacaatcaaacataagggaaagattctaagtggcaaactcatttttgtttgttccttctttcttttgaggccaaaagagaccagattcatttttggtttcttcaaaggccaaaccttattttcttattttctcagacaaacccttttgccatattacaaaataaaatttattcgtctgagaattatcttgatcccttttggattcgaggttcaagaacattcatgaacttcgagtaaatcaatcatcttcttgtagtaataatccaggaagatacattatcaacacacataaaacagaatgaaaatcaattgcttgttctgttgtatgtcccacagacgatttaacagacgatcatcatcgagacaaagcatcaaagactgcattgatgcaaagaacaatataactacatttgacaacatctcttttaaaacaggtcccattttctaacctttttcattatatgcattctcaaatcccttaaaagcttttctttctaaaagaagcgaggcgtatttgcacatacctgcagatagcagtaggcgaagatacatatccgaggagatagcaaaactcggtaaagggaacatcagtgctcatatttttacattcagagagctttgcgtcgctaccaagaacttcaaccccgataatcagctcggtgaaggcgggtttggaagggtttacaaagggcagatagaaaccccggaacaagtacttataacattctctctcatacaacatcgatccatcatattctgctcagtggtttgattctgattcttgcgtgtttaggttgttgcggttaagcagctagacaggaatggttaccaagggaacagagagtttcttgtggaagtcatgatgttgagtctcttacatcatcaaaaccttgtcaatttggtcggatattgcgcagacggtgatcaacggattcttgtctatgaatacatgcaaaatggctctttagaggatcatcttctaggtaacatatatctaaacaccatcacaacatactttcacttccacacattctaaagatttaccttttttatacttcagaattggcgcggaacaagaagaagccgttggattgggacacaagaatgaaagttgcggcaggagcagctagagggcttgagtatctacacgaaacagcagatcctcctgttatctacagagacttcaaggcctcaaatatattacttgacgaagaattcaacccaaagctttcggatttcggtttagctaaggttggtccgaccggtggagagactcatgtgtcaacgagagtgatgggaacatacggctattgtgcgcctgagtatgctctcacaggacagctcactgtgaaatccgatgtatacagcttcggagtcgtgttcttggagatgatcacaggaagacgagtcattgacacaacaaaaccaactgaagaacagaacttagtcacttgggtacgcaaaagttcttcaatctgaacaaaaccatttgattggttttcttaatttggttttgctaaaatgcgcaggcgagtccattgttcaaagataggagaaagttcacgttaatggcagatccattgcttgaaggaaagtatccaataaaaggattgtatcaagcgcttgcagtagcagcaatgtgtcttcaagaagaagcagcaacgagaccaatgatgagtgatgtagtcactgcgcttgagtacttagccgtgaccaaaaccgaagaagatggacaaactgtagaaggagaagaagaagaagaagaagacgaaagatccaaactttgagcaaatttttttgtttgttttcgtttgtaattttcaaatgatcggttttaggaaatttgataactttacgaattcaccaatgaaaaaagaagattaaatgagagttttcgtgttccccatcgaacattttaaaggatttgctgagaattttgtatctgggtttcaaaaagtttcagacttgactcatcgctgaacaaaaattacagaattaaaaatcccaactttatcggaaaaatgtcttttttttttggtttatgtatttttttttaaaagtgaaatgattaattaaagaagataaaaggggaaaagggtttaagggtttgtcatagagcaatggctaccagctcagctttgtgataaaacgacaaaattggacaacgataaaccctacttttatctctggaagactcaaaattccttcaagctggggagattagcttcacttactacggccatgggggtttctcttcgtcacttgtctccttcctctttctgggtttcgcgtcgtcctcgtgtttcttcttcaattctttcttttcttgtccctcgccgtcgaatcctttgcaccaggttcacagcttttctcatcttatctgttcccttttctcatttttgttcatcgagaattagatttactcattcattagtcaattgctctgttccgtaaagttggttgttagttttatatagtgatgatgattcacgttttgaggttgttgaagaagcaggttaaaaatgtgtgtttgctcaattgctctgtttcgtaagtttgttgttagttatatagtgatgattcgcgttttaagtttgttgaagaagcaggttaaaaatgtgttttgctgcaatttggtttcagtttctcacttagtctaaattgttcctgtgttaaagttatttaggagtctgcttttgattaagcagaagaatgtattttagttgaggtttggttattattctgagtttgaaggtgtttttctttgtgttgatatcattttttggtggttatgatttgcaggaaagtagcaatcataaagggaaatgcgggatattcgactgctactgattgtggtggttctcatgggtttcatcattcaggtcatcaaaggtcatcctctgttgagtttagtggagagtggaaacttaatttgggatctaagacggcgaga

SEQ ID NO: 8731 - DNA, 3000 bp, Unknown
  misc_feature (1)..( 3000): cDNA_ID_2178264_gDNA_ID_1971869_Annot_ID_176552 3000 nt of promoter + ATG
caaattaaatttctttgattaaaattatgtgaaactaaaattattttataatataccacatgtgaaattcttatattactaccaaccaatgtaaattgtgtcacatggttcactgaatagattcgttaggaaaatgatctagaaaagattattgtttgatgtaatcgatgtcaactttcacaataaatgaataaacgaaacaaaatgttttaaaatactaccgcgtctttttaaattataaatctgatgtagactgtagtgctgtttcatgcaaagatatagatagtttttatgacccaaacaaaataatttttaacagactaaactgactcgcaaagtcgtactaaaatattttgcacagttaacaatacaatattcaattggttagtatcgatcttgaaagttaagataactaccccaaatatcgaaccttcttctatggagcatgcatgtcatttttcttgacttgttgtcaattttataaaaatttagcaatgcttacggtttcaattttgtgatagagaagtaaataaatttattcgttattgcaataataatatcaaattttagtaattgtttttggaatttattcatcattgttcccttagtcatttatggacttaaaaaaaaaattatttccgtatttgaacggttatattggtatatatatactttctttttggtggtatgttctttgttccttgattttgaaaccacagatagataatgatataattgtacatatacaaaatatggataattaattttcaaatataattttattgatggaaactagtacatagttaaaacaaaaacaacaagggaatgcaatgagtacttggtcgaatttagaaactatgaagaaaatggaactaggacagaacaaaactcatgaaagagtcaataatcaagatcaacaaaaacaaaagcaaaagttgaaatcaaacaccactaatcaagttaacgaatagcaaagaatacgagcaaattcatcaaaacaaaaatcggaaaagagcttcttaatggtaaagaagaatccgatttcttcgtcttacttcctttcttttgagctccatcaccggtgagttcaacatcatcgtcaaaaccaaattcactccaatatccatgagttttccaaaaattagatttctccatcttaatctctttctcattagctttaactccatcaccgttgacttcaacatcagcaccaactttaattctcctataccatttagttttccaaaaaacaatcttgaatctcacatgagtcttgagatccagcctgaaaaccgccgatccattaggcaaaacagctcgtaaaaccgtctggttgtttagcggccaaacttgaccccacttcttggccttcttcttgtgtccttgatagaacttaggcactgtgtagttagcgactaagacaagatcagatgaattggtcgtggtcgtgttgatggtggagaaagtaaggtggacatcgtcgtagtagattcctttgtctttattcggattgtcacaacgaaccatgaaatttagagtggtattgtctcgtgagcttaggtttttgctgagggcaggaatgtaaaagttttggattgagcatttgggtttcttggcacggagactaagccataagataagagcgccgagacgagttgtgaagatgaacttgaagaagcaggtacaacattttcgaccaagttcttcttctggatctatttttgtcatggttttggtatttttgcctgaaagctgaagaagatcgttatagtttttatgacccaaagaaaatgatatttaatagaccaactgactggcaaagtcataccaaaatatttagcacagttagcgatacaattggttaaatattgaacttgaaagttaagatatcaaccccgaaatattgtacatcgaacctttttctatggagcatgcatgtcatttttgttgacttcttcgtcaattttataaaaatatatcaatggtttacgatttcagttttctgatagtaaattttaaactttcaaattttaaagttaatagaaagtttaataacacgagatatatttatatcgaaatgagttatatggcggatttttttaaaatagataattaaaaatttaaaatatcattgatcagatactttaatatgggtttaatcttcattattttactttgttaacattaccaatattatacatatcaaaacagattgatataatcaaaattatgtgaaatcaaaattatctccctatataccgcaagttaaatcttagtttttgatatcatgaacaaaattatccgtcatatgtatgtaaaagttgtttggccaattcaatctagaagtttccaggtaaattgaacaacttgtcttataaaatattttaaaaactgttaccacataaactgtaaataaaataaaaatcagtaagaaaatttatgtaagaaaaacaaaaaaaaaactgaaaatttactaaattgataatactacatccatattcgctttattcaagaaagctcaaaaactctgaactgaaaacaaagaactagtatccaaattattctggaacccaccgagtaaatttatgaccagagtttgtttcatatcgaaaataatcgaagcggtggttatttagttaggaaacaaatttgctcaaaaaaaaaaaaaaaaaaaagttaagcaacaaatatgaaactcttgtgtccaaaattagcaattgccttaacacacattcttaaatgtctctccgcgtgaccaccaaattaaaccagaggctcatattaagacatcttcttttccaaccatcttcgtttctttgcattaaacttttggattttgatacttttttacagatttttcacattaaaccttattcgttgatcaatcttcgtctttgtttaaaaggcttggttgattcctagtttttttttctctctcgctgccttgcggttccagtaatcacaaggcggtggggaagaagaaaaagattgataacgatg

SEQ ID NO: 8732 - DNA, 3000 bp, Unknown
  misc_feature (1)..( 3000): cDNA_ID_3043263_gDNA_ID_1971869_Annot_ID_176557 3000 nt of promoter + ATG
ccttttttttttaaatagaaacttttaaggtcgatagggtttttaacatttggattgaggtgacccatgtgactagtttcggttccaaaatcttacatgtggattagtaaatttggttcacttgatgattttatctgtggaacttcgtcacaaattttaagacccgtttagaagctaaacatcattcgctgtctttttaatttgcctcctcagttctcaactactttcagttttttttttttttcttttggataaaagttttgagcttttccttcagttttggcatcattggtgcttagatttatgaaaaatgaagatataaaaggggaatcataagtgtttttttttacattagcagaaaaactgttgattaaaatatttaatctcgggatacactgaaattggagatcttttaattagtttttaagatcaaaaagtgggctaatttgttatatagttaacactggccatcattataatctcgaagagaaataacacgaattgtttcttcttctccaaacacgtgttcttcaaattcgctcatattattctcgattcccacaaacagaaaaagaagatactaaaaattataaaatcccgataatagaatcatgaaattgtttccgtttatgggtgttttaattgcgtctaatcggaatctcttgccgttatcgtctgcttatcaggtaacgaaaaacagatgctgttctttactcttttattgatttgggaatccattttcaaagcgttatacgatgttttagggatttatggtgaaatactgagaccatatagaattgaattttatgtgaaattttggtttaggttttgttggatttgttgcttttattataaaaattgaagactcatttttatgaattttcctttcaaagggtaatcaaagaggcactactgatttcatggatcattgtgattgaagttttgagagttggtgaatcagcaagcttctgttacaggttggtttcagcctctttctctgtttgcatttggtatttctcactgacatttaacaagtagacaaaacattgctaagtttgctaaagtaaatgaatatagaagagtgtgaaaccagcaactagaaatgtttttcatatctacactatttttgctattccttgttattttcatatgtccgtccatttctcttgtttcttccacaagcagtgaacattttccacagttgaaagaagttcctttagctcaaattcttgtttggtggtctttacaagtttagactgcttgtagttgtatctctaagatagaatgactatcatctgttgttcatgggtgcatagtggggtttgcagttccatacgagatgaaacagactttttccctttgattccctggaaagtcttcccttttgaatttaaatagacaattttcatcagatgtaagtggacctatgattagccatctaacctaggaactattggtttcatatgctttcatttcttttagctttttcctcatgtttgcacttgagatgcgaatttgtttgagctagtcattgttacacacatacaaactgcattttctgaaagcacacattttggaactcaatttcttcagaaaagttgtttctgttcgttttcttccctgttctgtattaagtatctagatatatgaatggtcacagtgatgaattctaacatctttgtaatgagtgtccaaggatttcctttaaagttagtgcatgttttgattagtatattatttcttatatcataaaactgtcgatatgtgtactgttgacaagagtaaatctttttggactgtctctaaacagacttgcaggcatgctctctagtcaaattatatagtaagttaattatggtatgagactattgtacgttgactgtgtatatgagaaatgttttaatgtagttattcgtggtgtgcgactaaattttactatgctgctagattttgattcatgatatatgactaaatgttatacataactgttattagcagcgagatgagattcttacatatgtccctttgtaattagatgaaaagtgatagaagctattatatataaagagttggtttcaccctttcggttcatctatcctaccctagccgtcacgcgtgaagatcgaattgtgagtcctctccggcgatcgagaaagttttgattcccgatcgcgcaaaagtatctcatatctcgatgatttcatcaactcctgcatttataaatttcccttcagtttcttgatttgttgccttttgattaggcttttgcataattactttaatacaattcagatcctgtgtagatatgtaacacgactgaggaacaatttttttgttttggttacaaatccttgatttcgtgtaggtgcataatgttttctctatttcgatctgtcttcgtaactatcgccttgattattctgatttctgatcaatgtttctaggtactttagattttgtatccttcacaatttgttctttggatcaattcagtgttgatctcgtgtatatggtacatgcagatagaagtactcttctacatgaatgattgtgatgcattttcttttcattttcaaacccttttgcttagttctgatggttgcctcgtgctttttagcagtatttttggtctttaccttgaatggtactaatgcgtttctgtattagtagttagcagttctgtgctcttctacatgcagatagaagtactcttctacatgaacgattgtgatgcatttttctttcattttcaaacccttttgcttagttctgatggttgcctggtgcttcttagcagtatttttggcctttaccttgaatggtactaatgcgtttctgtattagtagttagcagttctgtgctccttcgggatgtagcctgttacagtcatataaatacgcattcatgttgcataaatatctgtgcttgagtcccttttctgtgctaaccgttgtttttgttgatgcagagccttagcaacagaaagcaaacagaaaatg

SEQ ID NO: 8733 - DNA, 3000 bp, Unknown
  misc_feature (1)..( 3000): cDNA_ID_3043271_gDNA_ID_1971869_Annot_ID_176550 3000 nt of promoter + ATG
aatatgcacaagtaaaacccaaaacaaaaaaaaaaacacttctgagattaagaacatatccaagctaaagaaagaagcagaaatacctcatcatgccttgaggcaatagctctttcaggtgaacgcctactactcctgtgactcctatctgacggtgaagtagacctctcatgtcttcctctagagtatctctcatcatctgttcttgtccttctccttttttcagtatcctctctccctgatcgtcttctcttatccccaacttccctatctctttctccttctccttttctctccctatccctatctcttcctatatctctatccctttccctactgtttctcttctccctttctctaccatcatcttctctctctctacttctcccaatttccttctctcctcgagctcttctcagtctcttcgtacgtggtgaaggagacctagaactaggagccattattggagtcagggtcgttttctctcttctttgcctttggaaagatcacaaattgaaaccagggtcagaaggaaaaggcatgtgagctccagataacacagtaaaccctaattcccaaatgcatagaaactagaaatggagcaaaagccctaaaccaaaaaacgtaagctacagatttcaaatactaaattcagaagttccgggcatagtctagggttgcaagaatcgttaagagaaaaaatcgctgcataacgagaaagaaaaattttacctggtggccggaactgtgactacttcggcggagagaagaggagagagtgaataataataatcgcagagataaaaagaatcagagccaaaacgagaagaatcatttatttggcctcttttgcaaataaatggaaactgaggggttcaatatcaaacaaattgtagacggtatggtaaaacttccattagttgacacgtgtcatatcttgtttggtagaaaggatatgtataattagggcagaagccgcttgtaacgtcgtacccttgtacttccttcgagatttttgtttcttcgtcctagtttgcaacaaagattttataattgatcatcaaacaaatcggtgagcctgtaacaaatcgagtgcaccagctttaccaccaactttgataggatagaagacaaatacaagatcatagatatagttgaggtggatagctaaacgacataaaccatcagaagtgacagtgatcttgttctgattgtaacagagtgcaccaggtttaccaccaactttgatcctctcatgaaggaacttgtggagagaaattttcaacttcgaggaacatatgtcctgaaatcccatctgtagttctccttactaccgatttgtagtcgcaactgttggccttgaagcttatgtggaagacagcattcatagactcgagctttagagacgggtcagtatgagtttctcgggtgatgctttggtttgtcgggtgatggctcatcgaatcccaaatcatgtctccttgtttatttgatgtatctttagtttcatgtatatactagtgtacgccaatattatagacgattaaaaactaattcttgtttacgtatgaacaaaacgatatgtactttgtcattattatattttttgtcaaagattgagaatatttatttttttcgcatcatagacacacaaacaaatgttgtctaatgatctaccagccggcttgtatatctaattcaaatatcggtcatgcatcatgcacttcattagtatcttatgttttgcaaaatactggctagactgtcacatatatcagaatcggtcaccgtcaccttcttcgttattgtcatacggtttcactatgacaaagtccaaattaggtcaaattttaagcgaacatacgtagcctcttacgtcatagattgctgatgaaaaagaggcaaattattataacaaccatcaaagattcggtactaactttacaaattcacacaattcgtatctcacaatctaaaagtgcaatatgtcgtacatgttttgtaagctagacaatagtaaaataattatcctgccggactataaaggttcgagaacgtggaccgactatatttatatatcaattagctatttgtggtgttagcctaatgttgccttcatcacgttttctgtttttttgttgaaggattttcaaatagatgaattgactatcatcaccttgtcacgttataaaccatatatattatcgttaaacacttagtagcagttccccacgaattacatgtctccatcattgacaaatttatatttttgtttgtaagaacactttttccttcctcaacaaattcttgtacttaatacagatatatacttataaatgttacatcaaacgctagataacggagaatataagctaaaatgaaattaatatatcttgtttcagcttctatcgaaattattttcattaatggacaatataaaatttgatccttatctactgtttctgtgaatttgtgattatcatcaggcaaatgtatcattaggcaaatgtttttatctaaattaacacttttattggaaaactaccaaaatacatttaggttcacccatcaaaagtactttatgttgttatgttatatattgtgtgctaactaaaaagattacaatttagcaaatctcaagttgatgtgtacatttataatctccactacaacaagaaggtgatccacttctcttgtatatctttatttgttcttgcacgtacataaagaaatcaaactgttcaactgccatttagaatattaaaaccaacaaaataatattataacaagtaaatacttaaacaataataagaacaaagggccaaaatcgtgccaaacctacaacattcctgacctctgcctcccccactatatagaggtcacatttgagagaattaggcaaataaaaatctaagaaccattttaatagcttctcacatctctctattataatatcaaactactcttcaccagccctcttaattatctaagaaagtctca

SEQ ID NO: 8734 - DNA, 3000 bp, Unknown
  misc_feature (1)..( 3000): cDNA_ID_3043281_gDNA_ID_1971869_Annot_ID_176545 3000 nt of promoter + ATG
aaactatgaacaagaattctctgatgtgtccatgccaaacctctgcatcttagtgtctgagattcttgagctaattcaacatattatctacatgaaactaatcacacttacggtgcagttgttatatgatgaaagtagttgatacttatcatgaagggatcgtgtttttttcactttcaggtacaaagatccgtcaccagagtggtcagtcttcagggaagcaagctttggacatggggagcttcagatggtgaattcaacacatgcgctatggacctggcataggaacgatgatgacgaaccaacaaggtctgatgaagtttggttaaactctcttgtgaactccggatgcttgaagaaaaggcctcaagaactcaggaaaatgctcttggaaccttaattatatccataaagtgagaatttcagtaaaatagtccattaaatatagaaatctacaagcttgtaatgttgttagcaatgggactcttaatcacaccattgaagaagattttcaccaactctatagaaatcatagttccaactttaaaattttgtaaacttgcactttgctttgtgttgtttttcccactatttataatcttaaaaaaaaaaatctagaagctaaagtgacatacgttagattttgtcaatgtagatggttcaacgaatgtgacatacaaaacaatgttgaaaactatttccttttgaacattactcacattaggtacaacaactgtcactatcttaaaatgcaatactaaaaaacattcttcatcacattaatataaagttgagatacatataaaattacaaattaattacaattaggccacaaaaatgatggaccgtaagtggaggattagttgtctgaagaccgttgacgaaaaaaggcggaccttttccacgcgctcaccacacaacactttcataaaatcaattcatcgatccatcgtctctatcagatcaattcatcgattgcgatcgctctttcaattttcttcatcaccggtgaaaataatcgaaacccagcacgagaaaaatgcatgatttttgcttcactatcccgtacgggatgcttctcatcggcggaggatttatcgggtacatgaagaaaggaagtataacatctttcgccggaggtgcaggcactggattattactcattctcgctggttatatcagtctcaaagcttttgagaagaagaagaattccactattgctatggttcttcagacaggtttttttcttgcaaatttctttcctttttagcgatctgggtttatatgtctttaacagatatttatgtttaggaagatttattcgtatgattccgttagatgtccatagggaagactttcaattacaagatgtgaatagcttttagtgacttatcacttgagccaaggaattgtttcattttgttttcaatttgttatggttcaatgtgttggatcatgaacttagcttgagagttgatgataggttatgttataaggttaaggatcttattggaccactaacgatctggatctgaataagtgatttgtgtgatgatgctaaacttgctattcaaagataaaaaaaaattaatattttggttgtgtttggatcttcaattgcagcagtatttgaattggtttgctaattttttccactaatgtaatagtgtctctcttggacaagatgctgttttactgcagatgaacattcaatttgagttgttagatgttgtagttgagtagctgtttttaattagtgttcttgccattgattgacaatagaaccaacctcaaagatataacaagcttgcaaaatcgattttcattatctatggtgactgaaactcatctgaatgtttctttttttttcgatacagtcatcgcagctgctctcacactagtcatgggacagcgttacttgctgactggaaagattatgccggctggtttggttgctgggatcaggtaaaaatccttcaacactggctggctagtatctttgtttgcatcaagatttggtatttttaagtttttacaccattgacttaactctagaaccatatctgtattgcagtgctctcatgacctgtttttacgtatacaagatcgctactggtggcaataaatttccagcaaaagctgaatgatggttctgctacatgcagatgatactatccgttgttgaatttgtcgattagaattctttttggtgtacacaatgcggttgtcataacgccttaatagcttgtattagtcaaagaactgcatatggtcttgtgttttcttgtcatcgtgtttttgtaaccacaaactgttttgagctatactactatatatattgagatatatctgccgtttcgatacacacttgggatctggggatgagcacatcgtaaaacaaaatagaagttgatcctcaaaacttctttgtaaccttgtgtcatcacaacaaaaaatcttcaatgtgtttgttctctccttaaagtatatcttgattcatgcagtaacaaaggcaaaactcttttgcaagagtatagaaaccagactcaagctgtgcgatggtgattcttttggagaagttggatttgtgctctgatgtaaagggaaacttaagctaaaaggtccatcaatggaggtgacacatagttttagaaaatgtgcttttctcatgctagaaatgttatggagacccaaaaatgcttttcggaaaaaattctcatgctagtagctaggctctacttaacgaggtgacagctaaaataagttctttttattccattttcagaatagtgacattcttctcacaaatatagaaaaactacaattaatgctactgcagagtctgattacgttttaagctaatttttccatttttaggacgtggtagattgtgtagattattgctaaacagctcatgagttcaataattcacttattcttcactccatcttcagcaaaaaaaaaaaaagtaagaagaaacactgaaagctctccactacc

SEQ ID NO: 8735 - DNA, 3000 bp, Unknown
  misc_feature (1)..( 3000): cDNA_ID_1715025_gDNA_ID_1971869_Annot_ID_176542 3000 nt of promoter + ATG
attaaatccaataagtgtaacagaatctgctgatcttaaaagattatctcacggaaaaagattaattcaaccaagcactattttactaactacttagacctattgtggcaataaaggggagatacacataacagatggatgtcaagcaataatccttacctttaaccagctgtattgatctgagtaccgatcataatctgtgtatgagccaagcatgatcgcatggacaccagcaacctcaaaggaataataaagatttgaatttgacccactttcctcatacggcatcttccacctcgagttgaaagacacaaattcatcaactataaaaggaatactctctttctcatggtttccctgtgtcaccatccacggccttacacttgccagaggctgaactagttccccaaacgtgtcccacttatgctgcatatagtccgcatacgatagatcccctggaagtagatgcacagcatatttgcattgatcaatatgatctagagtcgacttagtccaaccggtttgtccaagatcccccgccactgcaaaagtaatcgggaactgagctggtggtgttttcaaatggaactcaggtccttctccaccacaacggtaataataaacagtatccgcttccaatggcccaatgacggtatgatgtatcttccctgatctatacattatatagctgtaggaggtgctttctccttgaccaagataagagtatttccctggcgatgttccatattcaacaaatgaaggagacgatttgtcattcgtaacccaagtaactcgcatatgtttatctccagccaatgagatatgcacctgcaggtaagaatctcagtataagaaacaggaccaaatgaatctaaaaacagaacctttgatgttcattatcaagtatcaactgtatcatgcactccatagctacaatttcactcaagcatcaatgttttcttcagaatgaaacaacacaattcatctccattgttataaataatcatttaggaaaaggccatttttacccaaagtagtgattagtgaagattactaatggcgttgatcaaaactacacagtcattagatttatccattagaaaactagtgttgagaagacttcgggacactagcaaatgggattctctggagtaagcataaacccaaaaatcggatctttcggagaaaacaaacagagacccacatgcagttacaagaatagaaagatttcagacaattaaaaacatgattttttcggaacaagaatcatcaaaacagaggagagcttaaggaattctaatttatacctgctcgggtacagaagaggacttttgtttccatggaaactgcaaggtttcacgaggttttggtcggacgtaatcatctgcggccgcagaagtaaagattattgacactgataatgttacgagtagcaaaatcccccatttttccatctctgcgagctttttctttcagattcagtgagaaaaggtaaatggattctttataggcttttgcgacgcgggcacgacacgtgtctaaatgactaaattgtccttaccatatctcgtatgaatgtgttgattttcattttaaaaggataaaacgataattcagtctgttgtcttgtccaatgatttttgttttttcttataattgatttcttatgataccttatgaattttggtttatttatttttgtttttttgcaatgtatgaagtattatctgaatattagtatggtccaagaatgaaagaaaacactaatccaagaatgactaacaaaaaaatgaaaaaataaagttgaagaagtaaaatgatataaataaaaatagaaagttagagaaaaagtaaaaacggtgaatcgagatgctgtcacgagagcaaatgacaaaaaatggaggacaagccttaacttataagcaatgaatgaagataaaacaaaaataaatgacaaagtcgaccaacaaaaacaagatacaaaaataaaagatgacattggattcgtaattaaaacatctttattttacactttttaaggccaatgatgtctttggtaattcgagttcgagcactcgttaagtgtgaacaattatgataaaatgtgttcatatgtcaaattagtaataccgtgatcgtgtcaccaatcaaatttattttcggtgtaatgaataactcgtgaattaagaacttccatatgtccaatttttgtcttaaaacatattattgcaatagatatagaaataaacaataataaaaaaattgtaatcgatatgtataatgtatttatacattacaaaatatttaacatgattttgaaattttgtaaataattaattgaaattagtatttgtaatcgaataataaaagtgttgtcaatatgtcatcatcatcagaatttataaatccgaataaaaaaaaaagattagttgattatacaattaagaacaacattagagtagatggatgcatacatttcgcattagaggaagatcagaaatggagaaggaaaatagtgaatctaatgattcattagcgaataaggcttctctaaggaaagcatcgtcaaattcacttcccaattgtgcatctttctcactacatggcgcatatatctgcttatgtaataatttgttttctaatgttctgtatactgactttgtaatttcagtttgatatcaatgaaattatttgccgggaaaaaaaaaaaagaagaccgttcaccaaattaaattatgggctttatccaactttgaaatttcacggcccattctgattttttttctttccaaaataattattttctgcggcggtaaatatcccgacgaaaattaatacatgagaaattgagaatcacttgaaatttttttaaaatcatggattgtgcgctaggcggggaatttttacgaaatctcaagcttcttcggcacaccaaggcgccaattccatgtctttgaagtctcttcatctcctagtccaaaccctaaattcattctcatg

SEQ ID NO: 8736 - DNA, 3000 bp, Unknown
  misc_feature (1)..( 3000): cDNA_ID_2178419_gDNA_ID_1971870_Annot_ID_176590 3000 nt of promoter + ATG
taatctcctcaaattcatctgggcttttcttatttcaaatcagccaatacttatttttctctcttctttcaattgaggttaaaccctagatcttctcatttttcaattagagatttcctcaattcaattataatgctaaagatttagggtttacaattctagtgctaaagatttagggttaactcgcaggtacgattataccaactttttaaataacgaaagttttaataggcaactaaaattaactaaggtatttttcttccaaattaaatactagaggtattaaacggccaaattaaaaataaatggcggtttttttgggttttttcccaataaaaaaacagagacttctacttgccacaaataaatccaaaaagcaagttttgataatcttaaattttcaaaaccaagctgtggattgatgattcctttgtagagataacaagctgcaggttatatactcaagcttaaaatcgcaattccaagctgaggtagcaccaacgtaacactaaatttcgaacctccacagagaattcaagtgatttttctctgttctcaaaagaaacacgtccaagacacgcaaattctgtcacagtgagtttgacgtttaacgatcgcaaccagtaaagtcaatgtacatactcccaagcttcccacgtttttgaagtttcaattccaaaccgttaatgtttatagaacaaaacgaattcaaagggttaagagggtaggagctaaaattagcaaacactacataaaggcaattgaaatcgaaatcacaaacattaaggtaagaacgtgagaggagtcgagttatgaactcttttcttaaccctttgaatcacccgtagtgtgacggtttctgtgtgattcaaggatcccaggatataacctttataaacttatttcgcatcactcgaaacgcagctctagcgaacatagttattacgatactctcgagacttacttttgagagagagagattgttagagcttttgctgtttgtgtgtaacgatcaaatacttcactatgtctctcaaagacttgaagagttggtttttatagaaatttagattactaggttttgaatttgtttttcaacaaactcaaccgacatcaatcggaagtctaggagtagtggacttgactctcaacgactcctattctcatggtctttgaagaagcgaccagcgagtctctaggaacttgaaacagaacgacttgttttgtcacgttcactatttgacccgacatctccggagctccaccacgaactggacctaaccattaaggcccatttcttattcacacaacttgattatactaaacccaattgggattagtaaaaaatcagcccaacaacttgcgtatcgattttacattgaagccaccaaagacgagttcccaaagcaagaaatcgatggtagtatgttgaaaatatggaccaaacggtatatacatataaccattcaatttcctatgtatctcacggattgcaagttttctgaatatttcaatttgcagcaatactttgagaacagattgaggtatcttgcagtgcagaagtaaaagggacagaatccattgccaagtatactactttaagcaaagaagagtctgttgaagatgacgaagtttctctagccggtatgatacacccatccatgaagtttgttgtactgaaaaaaaagtttatatgttcaatgtttttttgaattttggtaggacgaataatgagcaagagatcttcctctgacaagcttttcttctatgatctacataatcgtggttctaagatccaagttatgactgatgcgaggtgactaattggttttaattagagagatagttgttcttttttgttttttatatatgtagtttaactagagtttttttcccttgtgatgcgtcagtacttaacattagcatgttaagcgtggagatatcgttggtgtcactggatttccaggttcctatattttctgattacgacatattattctgtatctttatctgaacacatcactacaagaaatatgagtttcggtagcaggtcgttgtagcacgaattcacgaactgctactaaagtgccaaaatcgtattgccaagtatttcgtagcactatattaccgctagtatatagtttactttaagcgcgaacataaatcagtattatagcgggtaaaggtgtattttggaggcaaaataattgggcttttcccccaaaacaaaaaagtgtcaatttcatatactaaattcatctcttttacacttaggaaaaaaaaaaaaaaaaaagaggtgaaatttgtgttgactgaatctcgattctcaacacctccattcgatccgtcgctctccgcctccgtctccattcgctccgtctctctccgcctccgtctccattcgctccgtctctctccgcctccgtctctctccgcccccgtctctctccgcgtccgtatctctctgcctccgtctctctccgcctccgtctctctccgcctccgtctctctccgcccccgtctctctctgtttccgtctctcgccgcctctgtctccctccgcctctgtctctctccacctctgtctctctccacctccgtctccctccgcctccgtctctctctctgtctctgtaacaaccctaaaatctctcgaacccaactgatctcatacacctgaaaggtataaaacatccagttaatgtatttgagttcttgagtatttacaagtatttgatttttgaccgttttaaacattgatcacatatcacagccggatcttctgcctgcatcttctgcctgttggcatcagaacacagaggctagttctcacaatgaaattcgtatttgattgatttgtttaagatttgactgatgaattggttgtttgctatttggttttaatgaactgttgctgtgaatgtgaaaatatgaatatatatttttgtttggtgttcttatgggtctgtttttttttttatgggtaagcacaaataatg

SEQ ID NO: 8737 - DNA, 3000 bp, Unknown
  misc_feature (1)..( 3000): cDNA_ID_3043333_gDNA_ID_1971871_Annot_ID_176600 3000 nt of promoter + ATG
agtaggggctaaaactcttaactaacattacaaatataattgggaaaacatataacctatttatttccttagtggattagtcctaaaagatcattaaacctaacccaagtcgttggtgctagttatagtttggtaactactttctgtattcaatctgaagagagtattaaaatgcactgtcgaaaccgaccagtctagtccaataagacttgaccaggagggttttcttccttgtcgggtctaactcatgtaacaaaacttttacaaattctgaacttaaaatgatccttcacatttaaaccaacaataactgaagttactcttaaacatttagcatgacccttcccctttgtgttggtaaaatcgctataaaaaatcttgtgatgtatagaccaaaactactagttagtgaaaaatgacaagaatagaattgcacttgtcatgtgcttaagaatttgccgtttccttaaagaaacttgcagacaaacaaatgacttagctgtaagaattaatctcatacgtacccttaagccccacaaaagggtaacacaaaagtcaatagaactgatcaataaagatgtataaatgcatgggtaaaatagtaaacttaccgactaatttctgtaaataacgcttacccgttaccaccaatcgtggtcctcttctgctcgtacacactctttttatataatctctttctttcacataaagagaaagcggaataaaaagtgttcaagagctcataacatcaagaaaaagtatatacattcttctgtatatctctgagaaatattatgattgttgtctgacattgaactttttaaaaagaaaaaaatcataaacttctctctgttttgccagaatcttatattataaagtatattctattcattacagatctgctcttggatttcggattctcctgcaaacgtaaagacgaaggtgttttatctcttcactgcaaaaaaaactcttgaattttatggttttctatagagctgaaatagtaaacgagtcttgacaaaaaaaaaagttcgttttcttttctaatgtttttgtggtagcggaattttagtctttagcctctatattaaataagttttaatctaggcgattttttttttttttttcagttcacattctcattgtttgtgctttgaatcggtgaaagatgattcaaatggatggtggagataggctgagagtgactttattagatcgtatgtcaacggttgagagtagccggagctgtttaactcttgaagctattctaatggctgataaaaacagaacctcgccgcagattctctcaccaccgccgtcgaggagccaatctaaccggtcacttgttgaagtcatgcaaagagagcaccgacacagtagagataaaaccgcttggaaaagtctccgtgaaaagctccgtcttaaacgtaacggttctgtttggatctcgtctaattctatcccgagtttggatacgcctattcctaaccgggataacgttagccaccaacttggtttcctcctttctaactctggaaatgtaacagaggaagcttcgtcggtggagggaaggattcggttaggagctgtgttggcagaggagagagcattatcggctagagaagaggaaacgccggcggagagggaagtggagccggcgaggatgtcattgatggagttgttggaagagaatgaagggcaaatgagttttgtaagtgtcgacggagaggcggaggaggaggtggcggcagtgacggcggcggagataagttgttgtgtgtgtatggttagaagcaaaggagctgcgtttattccgtgtggtcatacgttttgtaggttgtgttctagagagctttgggttcaaagaggaaactgtcctctctgtaataccacaattttagaagttcttgatcttttttagacttttcagtttaattatcttaatttatcataatcaggttgtttcctttgttgttgtaatgtgtcgttgaatatttgatgagtaatccttttgtagaaaattagtttccctcttagctccatggaatcctagtttgtttatgttatttggagtaaacacataaattagatcaatcaaactattatcattaatcagcaacacacaatgttcgaatggttgaaactgttgaggtgacaaatccgtttgtgaattgcaccgtttttatttaccattcataaattataatttatagcgataaggaccgaacaaaataattttttcatcgcggaccaagtataaactatttttacttaagattaaatttatcattgtccgtttcaaaattagagtgatctaatctgctaaatggtaatgatttaatccggttcgctcgcaacatgcattcaaaacttaagtggttagtacttgttgtatgatttgaatggaaaacttgaccaaacccatctatattgcgtataaaatatgtcaaatcaaattaaaatgaaaaaaaagttggcatagtaaaacaaaaggttgatggttgaaccataaattcttaatttaatttggcttgtcactgatgtgtttgatttgaacaagaacaataagtggtcgggctagaggtgaacaatcctccaactacacttatggttacggcaaacacctaactggtggaaagcgtcactggttaactaactcttacctatcttttcaatttgtactttgctttggttaatttagataaccaccggtgttaaaccaaaccgattagcatccggttggctagcccaaaactaggcccataacgagaagtcatgggcttgctttcattagtcaagttttcatttatcttcttaccatttattttccaagaaaataaaaaacagaaaaaattcgtggaaacgccattaacgagatctagcacaaactcgtagtgtggtgtagaagaagacaaaagcaaggagcttcataataaaaccctagagatatttgtttctccaatttcaaaagacgagacgtgaagaagacgatcgaag

SEQ ID NO: 8738 - DNA, 3000 bp, Unknown
  misc_feature (1)..( 3000): cDNA_ID_2178493_gDNA_ID_1971872_Annot_ID_176613 3000 nt of promoter + ATG
atgcacacaaacctttaatgtctctgtggatctttccctcattatgcagatattcaacagcatgaagcaaatcgcgtgtgatacaagcgattgatgtttcatccaacggattattagattgaagctgcaaaagatatatcagtttaaggattataagttgcatcaaagagaatataagtgcaggacaagatctccaccatgcgtgcatgatcacacacaaagttatacttccaaattccaagagttctgagctacaaagtagtgagttaacatacaagatcagcaacagagccaccggccatatattccatgatgatccacaacttggtctgatgaaggtaagaaccatagtattcggtgatatatgggcaacgacattgtgacaatactgaaatttcctggggtcaacaacaaaaactgagcatgacaatcgccacacaaaaatataaagcacagaaataaacgtcaataagaaataccttctgaatatcttcgatctcatcttctctgccagatatcaagtaaaaaggttagttagaaaattactgagcctgatggtattctcaaccaaaaatcctattcgtatagtggaaagccaaggaaaggttactgtcccttagcctttgagaaccgtgaacaagtaacattcatagaatcataattgtagttactcaacttataagacgataaacgttatacaactcaaaatcttaagaggagaattgcatatatgatgagaaaatactaaaataaaaaatatactcacgattcttccaggtcgattactttaatggcaacttctttattgaggtccttatcaaacctgataagcagcagcagtagttgttcagaatacaggtaagatagacctcttatacaaatgttcagaatagcataattctaatcagatatattatatacgagtataatggacgaacagaaaataaaaaaaagtcaagagtgtgataaatacttacgctttatagacatcaccaaaagagcctcttccaatcaactcaatctggctaaatctggctccagctgcctcttgtaaacccgcaacatcgtccatctccacatacaaggaaaaaccaccttctctcccgctccaaccactatattacgaagataacaacagagtcagaacaaactataatactttttaccactccctccccttttcattacatctaaactctcccctcataaataagtacccagaagaaagcaccaaacttaaactaaatcccttatactcaaagcaaacaaaatcagcaaaaaagttaggtggattggagcaagtgacagctgaccaataaaaatttgcaagtagccgagaatattcgtcactctaggacactgaagagaaacatcttcactgatgtttttctcccgttcgatcaaaatcagacttaaacgaaaataatcataatcaaattctctaaagttcaagggatcgatccaaattacctggtaattcgacagagaagacgaaatgggatactacagatctctctgttgctctttcctttcgtttgctatgtcattttgccagaaagcactctctcgagcaccaaagagatcgacagaaactgtttgggagatgaagtcgaatttatttttcatgttgtttttccttccaagtttcattatggaaaccatttgttacgaagaacaacccaacccaactgttaaaagcactaaaagcccaataagctttgaagctcatttaacggcccatatactaggaagtagaactagaaaccaaccattgtttcggcctttgcagcaattaacatgatctcatattcgactttctttacccacaaattgtttttctttttcctaataaacggtgggtcccgcaaaagaaaaattgtaagtaaagaacagagccggtcaatgcggagctaagactcgtcagggtttcagactgatgcaatccagaccaactctctgttactcctgtcctatttttttaagtttacgtcactcacacttctcactcgccaccctttggtgtattcatcagacgattttgtttcttcttcctggtttgtctctgtgtttctatgcgtagtttatacgcgccacgaggtcaaaaccagacgctgggtcatggttgatgacaaagccactcgagtcttacacacggcacgtgcacacgtgactcctaaatctcttcttcctatatattctctttgtcgtgcccccttaatttgcgtgcgtgtcacacccgtagtaatatgaatcttggtcctaaaccgaatcccaagtttgacgacaactaaataaaagcctttttcttcttaagaaaaaacactttcacatttcatggttttaattgtatcactagagttatatataatactaaaactaaaagactgtgttttttagtggataaaaatgtcgactgactaattatgtcattgtaattgtatctttaatcataacaacaacagtttatccactcgaaaccatatgattatttctctttcagaaaagcaatatgaagtatagaaaatcaatggttgataattggattccattcaaacaaatataaagcgaactaaaatgattttttcaggaagattttcaagtatctttgactttcttggcctaagagataaaaaacttttacatgcaaaaaactttaaccttgtgttcaattggttctctgataattaattatatattacttattgttaactataccaaaccccaagaaattcgtatccttgccacaagattgtaagattttatcaaaaaagtaataagaactaaaatagcatattattgtgtagacaaacagtaaatgttggtttggtaatcatataattagtctaaattagaaaaaaaaattataaacattgaaaataaaagaaatttagaacataaaagagtccatgagaagcttgagcaaggaaggcagcaaagaaaacctagaaggccaaaactagaggagaaacccatataacacacaccgacatattcatatag

SEQ ID NO: 8739 - DNA, 3000 bp, Unknown
  misc_feature (1)..( 3000): cDNA_ID_2178537_gDNA_ID_1971872_Annot_ID_176626 3000 nt of promoter + ATG
tgttggaaaaaaaatgcaggaattattcaaaaatttccgtatttattaaagtatcttgaaaatgttttgatgataaaaatgaaacatttagtttaaataaatttacatgtcctgatatatattaaaattctattttgaaaagtacaaaaccatatcttcatatcttgtcggatagatggtttgtaatccgccgacattgcaacttaaatttaaatagaaattattaaactaaatagaatgttttaacgataaaaatgaaacatctagtttaaaataaatttacgcgtcacgatatatatcaaaactacatttcgaaaaggacaaaaccgtatctctgtatcttgtcagatagatggtttatacttcgacaacatcacgacacaaaaaattaaatgtaagttataatgccaaactagcacaattgacacatttgaactagccatttggaaaattccgttatttgatacgagctataatttatgagaatccgacaaaaacgatttcattaaaaaagaattatagaatatagtttatagtccgaaaacatagcgacacgtaaaattaaatggaagttataacttcaaactaacacaattaacatatttgaatcagccactgaaataattcgttatctaaatgcgaactactccctccgtcccataaagataaattttttaggaaaaatatttgtcccacaaagatagaagttttatatttccaatgcaaatttttaaactgttttcccgttttacccttagataaatatttattattatttttaaagtatattaagaggttaaaattgtctttatacaatatttcttaaagaatgtgaaatttaaaaaaaattcatcttagtgggacggagagagtataatttatgagagtccgaaccgtttttcactaaaaattaaattatagaacaaaaaaagggcacatttctcttttgtatacatacatattactttttgactttgaaggatttttttttccacagattttgaaggatattatgacctaacatttaagcatgtatatgtcccgccacactgtcttttgaaaaagaaagggattgaaagtctagtttgttgggcttcagtcgacgtcaagaaatacactgttaaagcccatcaaatctcaacagtgaccgatctcgtgatagaacaaagttacccagagtcactgaaagcccatcaaatctcaacagtgatcgatctcgtgaccactccacgcgcttgttggcaactgtcaacacgtaattagcgcaacatacaataactttaagattataaagtcgtattcgaatgccaataatattcaagctactcatgtgtatgaaaccaaagatttctcgagactcctgctgtggacctcacttaaaataattgaaagcaacgattctcgtataataataattttcaaattttacgaatttctatgactatgactatattgtcttttcgttaaataaaaaaaaaatcgtctttaactctttacaatttttgttttaaaagattcgagtgaaaatacagttacattaccataaattcgtcaagagagcatctttttaagaaatgtaataaattatggtaagtgtatgtaataaagaagtatgttgatgttgctatcaacattaccatacgtgtctgttactatactagccccaatgactacgcaatagatatgtttttttcgaataaggacaagagctcgtaatcagctacacgcacgtccacatatatacttcaatttcatccattggatctgattatgattacgttttaaccattggatttattaatcatacaggtcttaacataaacgagaagtaggtaataaatactagaagctaccccagtatcttaaaactctgaaaacgtgtcagccaaacggtttctttttaacacttcgtgtaattaattaatgggattgaaaacttacttattaaaaatcgttatagattccagaaataaaggaacagagagacacacacaagataaaaaaaaaagtaacgaaattgagagctgaatgaaaccaaagatttggaatttttctttgtatagtttttccacgaatcggagtatcacacacggtcttggaattttccagcttaatttctaagatttaaaatcgtaatttttatttggaatttcactgtctcttcatgttgtctatataacttttactcggaaacaggagtgtcccgtgttcttgagcacaaacaaagtagcagaacaaagcatatacaaaagcttcattgcctcgagattaaacagcatcaagacaacatccaaaaattacccaggtttcttcattttcttaatatatcgtttttgtttctggatctcctttctaaatctgtagattcaggcgtgtgtagatttagtttttttgttattgtttggatgagtaaagtatgttctacaatgcactagatctaaatctcttcgagattctgatggtgtgttggtgttgtattaaattgattttggggataatctacgacaagggtttcttttaatgttccttaggaaaatggtaatgtaacgtttaaagggttttaagagttgcttaatatagctgttgagatgtctgattgattatgaatcccgatccaagagtttttttatgaatagaagagccatgtcgttcttgattgaattaatcttaatcatactgtttcgtaattcttaaactttgagcttgatgttgcgtgagaatctgggaactttaaatgtgtcggctgggttctctagtttgcttcttctttctgtatttggctctgagaaacttactagagctctaacatttgtgcttgctgataggtttttgtgtttgaaactcgaagattgttgcggattcctgaaagattaaggcttttagctccaagtttccaagagtgctgtgaatcagctcccactctgtctctgcatattgcaagacaccggttttgtttcagaagtttgtttcttcttgtctcatgatcactagttttcagca

SEQ ID NO: 8740 - DNA, 3000 bp, Unknown
  misc_feature (1)..( 3000): cDNA_ID_2178550_gDNA_ID_1971872_Annot_ID_176629 3000 nt of promoter + ATG
actaaataaagatttggctccggttaccagtctctgagacaatacctaaactggattggaccggtttaggtttagctgttcttggcgctgtttctcgaacgaccaactcaaatgtgccatgatactagcaaaaccggtggaccgtggacatgttttcaagaaaaaacttaagagcgatctccataacaaaactaaatgtcagaccaacatgtctccaatgcgatcatatttgacagctaagatgttgggttttgagaatgccattgtcggttttgttgagactatccaggcatggtttcgaagttaaatttgagagaagaattggtgtcaaaaagcaagattacagagttttgtgaatcgtcatttcgtcactgtaagacatcgagtttgaaattgttttacggcagaacaattatttcattcgaagcgtcatttcaataacgccaagtgggtgcgttacaaacgccaccagagtctccaacaaaattgacctatctagtgtgtttatctatccgattggggataaaaaaacgatattcttgattattgaagtcgaataataatcgattctactacttgtaattcgtgtcccctatcttaaatgaaacatttgtttaattcatatttcgtgtataaatctaagacattccacgtttataatcttctgcatgggaagatatattttatattttattccgtgaagaaaacaaacaaagctaaattatcctccgtttatttaaatataaaccgttttcattgcgtggatgcaataatttgctccttttattttatcatcttcaatcgatagaaacatgtatgtatccaactatccatgacaaatacaataagacgacgtctagagctactgatgttgtatagagcttaatacaatctcctaccttgcaaatcatgcaaatccagttactaaaaaaaaagaatttggaaaggaagtttattttattgaaaacctctgaattattcagactgattacacaaatatgaaaatacaatgcagagtaagccacaggtcggcttattttattcataccttaattattcactctacaacaattacaaaaacaaagcaaacgatacctagccaaactgaaccgaaccgaaccggtttacttagttttcaaacgaccagctccaaacatcgtgacgctcaccggcacgtcccatggaaccagcaaaaccagcgtacatgttttgaagaagaacatcattgagtactctcgaaccttggatcaaaggcctcttcggtttcttaacgttttcaggggcgatggtaatggtattcctagagtctttgcttctgaactcgatccaagccttgaacctctctccactgctaagattcacatctttaaacgaccaaacttttctttttccgactaatgtctgaacccaataaccagctttctcagcgacaagagaagtcatcgagttgatgttgattccgacatggttaccactaatgtcattagactcattgttcttaaacgtgtcgaattcgataaatatgaggttgttttctgactttccatcgttggttttgttgaggattccgagatatcctccgccggaagcgccggagttatcagcggctgggacaatgacgaaggcaaggccttgaccagaattaggtttggtgcgaggagtgatggagaaagtgaaagaagttttaaaatcaaaaggagaagaagtgtttgaagatttgaattggattggattgatgtaaagaccctgaccatgagagaatggggtttcgtctcgggtcatggaaagagctccggatcggcttacgccatcagaggaaggaccaagctcagcgtctccaaggaataacaagttgctgccatcgaaggaatcgaagttgaatttgacggcaaaagctgcattagctaagaacagagcaagaaaacagagtttgtgaatctgcattgtgtttcttttgttgttgtttgtgattcaagtgtggagaagattgatgatgaaaatatttggaggttgataatatgtttatataagagttaacataagccatcgagcttgaatattcaaaatctatgattcgaaaaagtggtcaaataaacaatgccaagtggatgcgttggagacgccaccacaaggggcttagcagtgaaatggacccacccagatgtctttcaatgaacaaaatcttatccttttgaaaaaatattataatggattcgagtaataataattggttgattatattatgtgtttcttgtccccttctctacgaaacattgtgaattttaatgtctcgtgtacaaaaaaacacattgacaagcttagttgatatcacgaactcgtttttggatgcaaaaaagttactctgttttatgactttatcatctcaaattattaaataggtatatttttaaataccaaataaataaaatttacattttcttgtgctacgatacgacggcgggaacgatcgcacctttcaatggtatgattagtgggccgggccttttatagcccaaatacctagcccataactcaactcgggggtttaatgtaatttatattgttaataaacttcgtccctctcattgcgtcaccgagattctcaccggacctctgcttattaaatcttcgtctgtaaatccatttaaaggttattattttgtttctgagttacttcgtctcgccctcttgttaagatgctgcaaaaatgaattaaagaatcgttttacacttttgttggtgttgtggttgccttcgttattgcatcgtaggaacgagagattttgtgaattaggttttagggtttcggaattcagggttttaaccatttagggtttatcagaattgttaatttctataatcgtttctctgaaattggatgaaatcattaatcgtatcaatattgaaaaatttgggaattcaataatcactctatagaatagaagctgaaacgatggtgaaaggtttagtatgatgttggtacatacatacaacgaaaac

SEQ ID NO: 8741 - DNA, 3000 bp, Unknown
  misc_feature (1)..( 3000): cDNA_ID_2178556_gDNA_ID_1971872_Annot_ID_176631 3000 nt of promoter + ATG
cttgacatcacattacataacaaaaacaagtctataacaactttaacagtcaatttctagtgatcagaaacatgaaacgttagaaagtgatcgccgaaacgaatgacgatccttcaaagagaacatacacaaataaaaaacataatgcaagtgagccaacaaaacaaaagaccccaatcacacatcagcaaaatcaacgatgatgactcactaaaaccaataaatcaacaaagacctcaaaacccagattgatgatcacacaatcacacaatccccaaaatcaattttaacttcaaattaggtaaatcagtgaatttaagacacagttaaacagaattaccctctagagattaaaatccgatcaaattcaattcaattaggtaaagtaataacctttgttggcgttcgaattctcgagcaagaagcggcaggaggagtagcgatctccactacgttgggctccattgaacgatcccaaactcaaagaactaaaaacggaaaacgagataattttccagaagaagaagaagaaatcgatcaaagaaaccttggcgccgtaatatataccaacacacagtgagattgcgcaaaggcttttctctcttaacacttaaaaccaattcctctttctctctattaatcctaaatcttaataaattaaagacctaaattaaaacagtgatgattaatgaaaattttccaatttgtgcgtttttattcaacaagtcaatacggaaagtctacgcatatggggcccactttttacattgacggttgcgattgaagtttatattggaaattattatttaacggtgatgatgaaggtactactagtactagtgtggtctgctgctgtagacgaaatagaccgagcttaaacaacaaggttaggtgatttcgaccaaggctatgattttagaaccgttcgatgtgagataaacaagttattgggttaatccaacggttgggaactatttttttggttccgttttttttttttatagtaacagaataatcatagcaaatctaatgagaagatataattgagttgttttttaagttataaagaatacactgatattttttctaaagaagtacgatgaatctgactagtatcattgattaaattataaatttattttaaataaaaagaccagtaaatgaatgatcaatcaatgtaaaaaaagatgtaatagtgctattatcaatgatcatcaatgttatagtgctattattatttgtgttttggcccattatcttattcttactttcagctattaatagattaagtttgttaataacaacaaaaaaaaagatgaagtttgtttagatatataaaaagaaaagttgaatacagtaagtaataaaaatgtattaatttaaatttaaaataattaaactggtgtgacatactgacatatgtcgttattgatttttttacaaaatttatctctttttttttgtttgaaaagagatttttttaaaaaaattagaaaagagatttttttaaaacaaaagaaaaaaggagagagagagagagatccatgctggtcttattttgggcctatgtacattatttcttatgttatgggcttttacaaatgggcatcatcagtaaaaataaacaaaagaaacaaacatgataacataacataagttaaaagaagaaaacaaacaaacaaaagaaacagtcgaactttttgatcgaaaaataaacatgagatagtcatcagtcatcacaggctttgtaatctactgtagttgaggataatgaagttgtttgttttattaagtcactaatttctgaaacatatgctctgctaattttcaaattagagaaccaaattaataaaagttgaaagagacagaaagccatctttttggtctttgcaagttagtggatagatttttattcacaaaacgacatgcatttctttgctcattcttcttgggacatattcgtcatttcgtgactgaaaaaatgatgtttatgtaagaaatgccgaggacattaatatttcagaattcagacaatgtacacaaacgcaagtgaatattataaggataatctaagtgaaagagtttaaaatggaacagaatggtttttagttatctacaatctttcctcaatgattaaaaaaaaatgatttcgatataatcttcttctttttcttttttggggaaacaagatatatcttacgaaacaaaaatagtcatgcatcaaataatgttagttctcccataaaatattgtatttgaacttagattagataaatcaacttttattcttctaatgattgtatttggattctattggaaataagcttaatcatcagtaggacactagtcatatttcatatttgggaaaaaggatatagagcactacattcaaatcatatccttttggaatctttgagtaatcatgagtttcgcaaagttaaaattaccccgaatcataggagtatagatttaaaattgatctattataaaaacaaagatcttgttcaaaactttaaatcttgttcacgagtacgtcacaattttgtctgggaggcaacgactttaaattgtcacctatgatttgaggagcacgcctctatttaaatatttcaactagattatttatactaatagtaattccaactacatatgctaaaattcatatattttgatttcagttgttaatcaactatattccaaatttgttatataaaaaaagagttgtaatggattactacaaaaaaagggaagaataacgaatatagtgggaaaaaaggagtgaaatggacacgagaggttggcaacgaaaggcttttctctccataacccaaaaaagattcggttgtcacataatttgcagagattctccactctctctatccttctataaattacatagccatcggatcacaaaacagaacaacaacaacaacaacaaacaagaactcaaacacttcataactaaacatcctttaaagccttttcaaaaactcaatcatg

SEQ ID NO: 8742 - DNA, 3000 bp, Unknown
  misc_feature (1)..( 3000): cDNA_ID_2178541_gDNA_ID_1971872_Annot_ID_176627 3000 nt of promoter + ATG
atattttcatcatcaatcttctccacacttgaatcacaaacaacaacaaaagaaacacaatgcagattcacaaactctgttttcttgctctgttcttagctaatgcagcttttgccgtcaaattcaacttcgattccttcgatggcagcaacttgttattccttggagacgctgagcttggtccttcctctgatggcgtaagccgatccggagctctttccatgacccgagacgaaaccccattctctcatggtcagggtctttacatcaatccaatccaattcaaatcttcaaacacttcttctccttttgattttaaaacttctttcactttctccatcactcctcgcaccaaacctaattctggtcaaggccttgccttcgtcattgtcccagccgctgataactccggcgcttccggcggaggatatctcggaatcctcaacaaaaccaacgatggaaagtcagaaaacaacctcatatttatcgaattcgacacgtttaagaacaatgagtctaatgacattagtggtaaccatgtcggaatcaacatcaactcgatgacttctcttgtcgctgagaaagctggttattgggttcagacattagtcggaaaaagaaaagtttggtcgtttaaagatgtgaatcttagcagtggagagaggttcaaggcttggatcgagttcagaagcaaagactctaggaataccattaccatcgcccctgaaaacgttaagaaaccgaagaggcctttgatccaaggttcgagagtactcaatgatgttcttcttcaaaacatgtacgctggttttgctggttccatgggacgtgccggtgagcgtcacgatgtttggagctggtcgtttgaaaactaagtaaaccggttcggttcggttcagtttggctaggtatcgtttgctttgtttttgtaattgttgtagagtgaataattaaggtatgaataaaataagccgacctgtggcttactctgcattgtattttcatatttgtgtaatcagtctgaataattcagaggttttcaataaaataaacttcctttccaaattctttttttttagtaactggatttgcatgatttgcaaggtaggagattgtattaagctctatacaacatcagtagctctagacgtcgtcttattgtatttgtcatggatagttggatacatacatgtttctatcgattgaagatgataaaataaaaggagcaaattattgcatccacgcaatgaaaacggtttatatttaaataaacggaggataatttagctttgtttgttttcttcacggaataaaatataaaatatatcttcccatgcagaagattataaacgtggaatgtcttagatttatacacgaaatatgaattaaacaaatgtttcatttaagataggggacacgaattacaagtagtagaatcgattattattcgacttcaataatcaagaatatcgtttttttatccccaatcggatagataaacacactagataggtcaattttgttggagactctggtggcgtttgtaacgcacccacttggcgttattgaaatgacgcttcgaatgaaataattgttctgccgtaaaacaatttcaaactcgatgtcttacagtgacgaaatgacgattcacaaaactctgtaatcttgctttttgacaccaattcttctctcaaatttaacttcgaaaccatgcctggatagtctcaacaaaaccgacaatggcattctcaaaacccaacatcttagctgtcaaatatgatcgcattggagacatgttggtctgacatttagttttgttatggagatcgctcttaagttttttcttgaaaacatgtccacggtccaccggttttgctagtatcatggcacatttgagttggtcgttcgagaaacagcgccaagaacagctaaacctaaaccggtccaatccagtttaggtattgtctcagagactggtaaccggagccaaatctttatttagttttaaatatgccttattgttttgcttttgcatttgttaattgggtttataggagactcaagagaggactacatgctttgaactttagtgattcactcctcttaaaaggatctggtctttatttttgtttttgttttcataagaacctcaattatgtacccagaattagttgctgttctgttgggaagaaataaaggagcctaaaacaaaaaaaaatgtttcttaattccagagcaaaagtttgaagatttgaccctcaatgtttgtctaaatttatacatttggcacaaaaaaaggtcattccttttacgttctgttatttgtgaggtcgaagattaaccacgttgcttgcgtgtaaagagagggtgggtgattatcaatattgaaaaaaaaactgaactgagagatatattatataaatatattaaagaacgatttcgacagtgaatcgtttctttcagcagtcgtttttttgtttttattctaaaaggccgagaatttatgaggctgagagagagagccttcttctgcttttttttccgagtttaaaactgtgtttggtgtttgtttgttgtgtggctctgtttcaatctcgtaaagattatttctgggtggcctctctcctttagatacttcttatcttctccctctcactaattttgcggtaaagaagcttcctttcttttttttggctctttacatgatcaaaagatttgcattttttcttgtatatatttttatcttttgagtgttgttgttcttaaatgggtctcctaggttcttgagttttcttctgtttatagcctagggtttgtttcttgagtgggatcacttaaaaaaggggctttacattgtgagagtctaagttcttggcgaatgtgtaacgatctttaagcaatgagctgttgaatccgaaatgattccagttagagttgggaatacagagaagtcattggttacgtgttggtttctggttagcttttggtggatgttaaatg

SEQ ID NO: 8743 - DNA, 3000 bp, Unknown
  misc_feature (1)..( 3000): cDNA_ID_2178530_gDNA_ID_1971872_Annot_ID_176624 3000 nt of promoter + ATG
acagtgtggcgggacatatacatgcttaaatgttaggtcataatatccttcaaaatctgtggaaaaaaaaatccttcaaagtcaaaaagtaatatgtatgtatacaaaagagaaatgtgccctttttttgttctataatttaatttttagtgaaaaacggttcggactctcataaattatactctctccgtcccactaagatgaattttttttaaatttcacattctttaagaaatattgtataaagacaattttaacctcttaatatactttaaaaataataataaatatttatctaagggtaaaacgggaaaacagtttaaaaatttgcattggaaatataaaacttctatctttgtgggacaaatatttttcctaaaaaatttatctttatgggacggagggagtagttcgcatttagataacgaattatttcagtggctgattcaaatatgttaattgtgttagtttgaagttataacttccatttaattttacgtgtcgctatgttttcggactataaactatattctataattcttttttaatgaaatcgtttttgtcggattctcataaattatagctcgtatcaaataacggaattttccaaatggctagttcaaatgtgtcaattgtgctagtttggcattataacttacatttaattttttgtgtcgtgatgttgtcgaagtataaaccatctatctgacaagatacagagatacggttttgtccttttcgaaatgtagttttgatatatatcgtgacgcgtaaatttattttaaactagatgtttcatttttatcgttaaaacattctatttagtttaataatttctatttaaatttaagttgcaatgtcggcggattacaaaccatctatccgacaagatatgaagatatggttttgtacttttcaaaatagaattttaatatatatcaggacatgtaaatttatttaaactaaatgtttcatttttatcatcaaaacattttcaagatactttaataaatacggaaatttttgaataattcctgcattttttttccaacataaaattttcaatataatataactgatatgatctagtatttatttttattttagttcaaatagccgatgctttcaaattcacttgttcgattacatcagtgaaaactttcaaatgtataaatatgaaacgtttgttcaattttcggtgatatatagaggataaatattggtgtgagtgtgagtttcacttgtagagtcaagtaatttaaaaaaaaaatccatgatattcaacattttttattagaagaaaactcagctatacgataatttgacagctttttaattgaacaagcaattaaactagttaaaatatttaaataattcttgtttttagtccgttgcatactttcttgcgtaacgtatataagtgtccacttagaaattgtgtaaccgatagctaaagccgtaattaaatgctagaactcttttgtttttaggtggttagggatacgtggagattagttctatatccaaacatagtaaattactgtaattaacaactctttttgcaattaacacaccaaccaaaaatcgaattttgccctgtaaacccttcaatagagattttcgttaattataactattatattaacgtcaaatattagatttgtttgagaacaaacttattattgtttaattagaagcatttgaaaacaatatggggcaataaatctaatcatgttagtgagttagacaaattttttcagaaccatctcaaattatgtcaaagtaatgggtcaatggttatgctttgtcagcatttatgatcccataacttaagtaaattatctattgaatgcaagaaataaggtttatctagacagataattaatctctctctttttctgccaaaatcttctatattattacatatagtatatgaattcatgcaataaaatgaggattttattaattaactagtcaaattcatataaagtcaacagtcaacttatataaacaagagttgactttgaatatgctaagcttagggacacagattgtttccttattgtcattaaacatcatggacttgcccttcctggttagtcaaaagcaagttatattttgtaactgtaaattttgtaacaataataattagtgtttttttattttttgttaactagtggtttttttgttaattaatacattagcataacgcaaaattaaagtattttttttggaaaaactagaaataatgaaaaaaattaaagaatatgaaaaggtccacaattacatttttaaaaaacgtaacgtatagcaaattttggatagaaacaaaaaaaaagagaaagtgattaactacaagaaaatctatatttccttaatatgattttaggatgaacaagaggatctttttttaaaagctagaagatatagatttgaagaaatagccaaaagaaaaatctctctctattgataggaagaagaaaaacagggtgtctctctttctcaacatagattggatcaccagttttttttttctctctttagatttcatttctttttttttttccagtaatcaaattaaactttgcctcttcagcccaaaaaccctgagatttttgggagaatctgtgtgacactcatttcttctttctaggtaaattcccaattactttttcggttaaagcttaaaaagtcgattttttcttgaaagtcttaaaatcttgttcctgcaaaaaatctctagctgaaaaatattatcattggctttgatttaaaagacatatctttgttgttgattgcgttacacatcttttttttcccctaaattctcgaatgttctaaaatcttctttatttaaatttgtagtttttgtaagacaaatctttttgtgggacatctctttttaagtctctgtcttgatctcagtttcatttcgacaatgtcacagttcttacagtgagttttttcttgttcttattttaaaggaaagaatcaaaaatg

SEQ ID NO: 8744 - DNA, 3000 bp, Unknown
  misc_feature (1)..( 3000): cDNA_ID_2178501_gDNA_ID_1971872_Annot_ID_176614 3000 nt of promoter + ATG
ctgcaaggtgctttgctgcagccttcgcatcttttattcccttgattgagtcaacggcttcttggtttgacatgacctatgagattttaaataatcagcgaccatacaagtaagttgttgaaaatagatattgatagatcaaaaccttccatagtccatcacttgctaggataagaaattctgcatcatcatcaattatctccaccgtaacatatggttctgaactcaaatgcatctttaaactcttatcaccaaatgcccttgccacagccagttgaccatcaactcgaggaacatcccctgaagtggttcaaaacaaatcaaaatcaaacatatgcgacatatatgatcagattatatatgtagaaatgtaattgattagataccaggaaagttagaaacgaatcctcctctgttctcgatttcatccttctccatgttcggctcatgatcaactgagagtggcttcgcaacaccattttggcaaataacagctcgagagtcaccaacattagcaaccaccagcttctggcaattgatcaatatcgcagtcacagcagtagaacctccttttcccaaatcatctgccttgtctagaatcgttgtatccgttatatagtaagctttctttatcgctttctcaggttcttgccagaaattcggcttcacaattaaaaacaaggacaacatcaagttcatattctcaagttaaaaaaaaaaacacttccgggtaaaactcaattacctctttcaagatgttctcaaacaaatgggagcacaagtagtccggaatctcgtggctaagatggccatcgaagatagcaaacagaccaagctcattatcatcaacttccttgaatttggcaaccacataatcttccatctcgtgaaaagctttccctttcaccaaatgaaaaccatgtgtgatctgcttcaacatcttgctcttacctttccctgaatctgcagatgaagcagatgcaccaagcccaactttctcctgctcacagagccgaaatttcaaattacaacagagacagaatcaacagccaatgttgaaacctaatatctagtatcgtatcggggatcaataacctaaattaaatttgtggtatcacaaattccaacaagtatatctagatctgacgttacagcttcacatagatttttcgctacgctctactatcaaatccaatttcgaatcgatctactcgaatttactggccatattctcgaaactatcgaattggaagcgattgttcaagcgacatggagagaagaaagaatcgattaccttgacggattccttcatcttgtggaggatttctctaccggtcatggttggaaaatgaagacactatctatatatgtgtatgaagaagaacgaaattaatgttgaatcgcgagtgtaagagagagagaaggagaagaagagaatgacacgaacgccattgttgcatgtctcagcttccaccgccgctttctttgcggcttcgcgccacctatgacttttccttccttttttttattacaaacggccaaaaatgttgttagatgggccgtttcaaagcccaaactattatgggcttacttctaagattcatatctctaatgttaattataaacaaaatagccactagtttactgaagatctaaaatatgattagcactaatttaatgatgataggttttccttatggtatgggtcctaaagagtaaagagagacactaaaaaaatggccaatgggagacaaaagccttagtgcgagttctttgtctttaaatttttgtttttaatttcttgttatttaaaaaactattagattttaaaatgtttttggttagattaccaacagagaatctttcccacttttgttaattgtctaataataagctcattttgataagtttgtataaataaagttagtgttgcttttgctttaacccaaagcgtatctttgggaaacttgtgtcccctgcgtaaaacatgtgagctacatatagcagagagatttaacgatttaaaatagttgtaagtgctaagataaactaaagattttaataaatatggatgataattaagaagattaattatcgtatttaaactttatattataagatcaatcttttattaatccgtgatccggtcgacagtcgacattaattagacaagatgattacgaactaaggctgggcaaaatattcgttcgatccgcttcgattcggtatttgatttgatttgattcgaaaaatccgaatatctgtaagatttttgagtaaagcaaataggaaaatgtagtattcgtaaaaaccgaatcaaataataaatattattttttaaaaagtcgaatatccgcttcgatccgtatttttttataaatattaaaaaatatagttatatctatatatagatatcataaatagtttatgtattgtagccattttatgtttttatgttaagatgtttgtttgatcatttttttttcatgttatgttttgatcaatggcataaaaaattatcgggttttagtttttggaattagtttgataacattttgttgaccggtgataccaacaacggttatgtttgttatttagaacttattttgaaagcatgttaaataaaaactttgaatatctgatatgattatatagtatacatatttttttaatatttaaatgtattaaagcggatatccgcaaatatcacaaaaaaattcggatattcgaaatttcggatatccagaaattttcgaagcaaagcaaatcacaaaatcaaatattcgtttagaacgaatcgaataacaaatatcacaaattttttgaatattggcttcgcgtccaggcctattacgaacaccatcaattcactttgccacgtgtagtcaaaacctgacctggcttgacttccacaccacttccgttcccaattcgccacgtgtcttcccctctatttaaacaagaatccgaccgcataaatcaaacacaccaaaagaaatg

SEQ ID NO: 8745 - DNA, 3000 bp, Unknown
  misc_feature (1)..( 3000): cDNA_ID_2105435_gDNA_ID_1971872_Annot_ID_176616 3000 nt of promoter + ATG
ataaggtcgcagtggaattgaaggatgtgcaacagcctgtggatacgacggagtatagaggtgtggaggatctacatcagcaaaccggcggagaagttaagtcaccctaagctaatgtgttagggtgtctatcctttctttcattgttgtttcagtgagaggttgcttgtgcctcgtggttcaaattaaaggtttatgaatggaccgtggcttagatcgcattacaatttactcttattactagttgaactaaagcaaaataaacaactactccgattctccgaacaaatttctagatgtttttttctaaaatttatatgcacatacattatctcataattattttacgtcaaaatctcccaaatatttttcatcaaaggataatacaaatatgatgtgattgcatgcaagaactgatacgataagtgggtgtgtaaattgacatatatctacggagttttggtgtggggttgggactgaacacagctggatcgcatagtctgcaaggaatctcacgttggcaaatatttaaagctggtgtcattgaaaattcccgtaaatggagggacaaattctctaggcttacgctctaacagatcagacaccaatcgtgtactattatttactaaaactagtaattcaacttcttcctctaaaaacaatcaaagtatttatatacacagaaaaaaaatcaaacaattgtgaatacataaaaatatgaactatcactagtcccatttgcttttgtttataaacgcctatcgtgaacaaatctacagttctaacaaatttttaatgtaaatatattttagttatttaatccatgattctgtcatatccagtttttggcatctatgacaaataaacataacaaatgctctttggttctgtaggggacaagtggaaccgaaaacgagaggaggcatctctgatatttggtgtagtagtggcttaaggatagctacgtgcgttttgtttccttacgttaagtgacaaatgcgaagctagaaaatttcgccatgaaggaaatatgactgcataaatatattctccacttcagggtttatacgatagcatctctttttttcctctttgtaagttcgggttcgaatctgttttttttattgtagggccaaaacttgaaagtggcccgagcagacggagacgagcattagcttatcatatcctacgttaagttcactctgttttttgttaaatggtgtgttcactttgttctttacatgatctcaaaaggaccacttcttgcccacacaaaaaattacaaaacaaaagcaaaactatatccttaaaactataacgtattctttgaattttagggtgctaagaaaaaattaattataaggaccaccaacaattgaaaatgaaggaaaatcgaaggggagatgtgagaaaaaagggacaacgcttatttattctgttattgtaaataacaaccccaaaagcttaggtcatagactcgagacatgagtacagtttggcatgtgaaaccttttatgtcctgtctctttcactacccactaattctaactatttcatctttcttacactgccctattgtataacaaaaaacatttacaacaaaaaaaaagagaagcaaagaaagtttttcactgttaaaattttattcccagaaagaaacagacttagagataatcacagagttgaaaaggaaaaaaagaaaagagtaacatagaggtgataattgcatcttacagaggaaacgcccatacttgtgattctttctttagctggtccaatctcaaagactctttacttgtttaagtgaccagtaagacttgcgatgaaagggatctgcagtctgcagaggtctcttctcctatcaaagcaaaaacaaaacaaggttaaaagttttttttttttttaaacctttatcgttattattactcttttgagcagctaaactttaaaccttaaacatcaaagctctctatcataagaatatagttccacgtgtcgtttgcattgaccctttatagctaaagagatctcattgtttacttttaatctctgattttgcactcccacaaaatagcatctttataggaaatagtgataaatgccttgcacccgaaagaaagaaaaaaagtgcaaaggcatcaactaaaatgcgttgatatgctatggtccagaacagacgatattcatgctgccaacatcatataccacagacaaggcaattttaaaaccagatacaaatcagtatgtaataataaagacaacgatgtgtttaaacagaacataaccattttacctctcatcctaagctaaccttaaatgcctatactctagatgggtccaacaatagatgaccactagggttgcaggaagaggaatccaatagtctacatcgacaaaggatgtcaccatttattaggacctttgtctgtttctagagatatattataaagttagatgagaagaccatgggtaaattatgatattccagctcttcttccctgtactatatgtctacagttgcactgatcaataaggttcaccttaattacctagaaggacatcaatgttaaaaacaaaagggtccccaatttgaataagaaattcaaattaaaattcaaaacagtaaacccggaagtacaatatacagctccaatcttgtatcaactattaattgcatcagaagaaaccaaaaccacgaaaggcctatgaaatagttacaagaaatttttcacttgtgtaattccaatctattgacctatactctccatttttaatttcttcttttttggggaagcaagcacatcacgtaatcatgtacttattccaccagagaagcatacaaggacacagtggtccatctcccgacttttcttcctctttttaaacacttcaaaaaacattcattccatacccccaaagcccatccttcaacattgcttcctaaccagaaatccaccatcatcttcccacgaatacaacttaaagctttaccagaaaatg

SEQ ID NO: 8746 - DNA, 3000 bp, Unknown
  misc_feature (1)..( 3000): cDNA_ID_2036938_gDNA_ID_1971873_Annot_ID_176644 3000 nt of promoter + ATG
ctatattggacctgacatgttaaccgatctcactttcccattttatgaagacaccatccctatgtgggctgtcccggtaagtaaacttgtttcccaagaaacctttgtcttcattttgcattccatcacaaggaagtatttcgattttcgctgattgattatttgtatgtatggtgtgtgcgtgtagattatttgtatattggttccgatatgcatcttcatagtgtactattactatcgaagagatgtttatgatcttcatcacgccattctcggtgagttaatttctactactgatcaccctcaaatgtatctagtcctatagtacttacaatttcaaatcgaaatccatactatcatatattattgatgatcaacgtgacaagaatatttggaaattgcgtataggtatcggattctcatgtcttgtgactggagtcaccactgattccatcaaagacgcggtcggtaggccacgccctaacttcttttaccgatgttttcccaatggtaaaccggtatgtacatttctatggatccatctcacttatacgttaatttcccggtttatcatgagggaattgtttcttattttgtgcaaatcggaaagaaatgcagaaatttcatccggatactaaggatgttgtgtgtcatggagttaaaaagataatcaaagaaggttacaagagtttccctagtggtcacacttcatgtaagttgttctaaagcattaaaaagacaagtaacaacatctgaattgattccggtttatgttaaccgcttgattacggtatacatgcagggtcattcgctggtttaactttcctagcgtggtacttatcgggtaaaatcaaagtctttgacagaagaggtcacgtggcgaagctatgcctcgtgttcttaccgatactcatatcaattctcatcggaatatcacgcgtagacgactattggcaccattggaccgatgtcttcgccggagctatcatcggaatttttgtcgcttctttctcttacctccacttttttccttacccttacgacgaaaacggtattaaaccaaaacaaacaaaaaattaccatcatgttattgctttcttgataataataacggttgatgacaatattttaacaggatgggctccacatgcgtattttagaatgttggcggagaggagcactggtcgagccacgacgatgactcgaaccggttctcgaggaatgttgggcaacgacgttgagcctggcaactccgcgtcctcgccgcacgatcgccaccgtgaaagcactgattctgacttttgaaaatttcctccacaatgttttaaaaaaaagaagttaattatccgtgtaatttttaattgtatgattgttttcacttactgatatataatatgtatacttttcattaggttgacattgttgttcaccatgtttagaaaagtttgatttggagatgtttgattaacacgtacatgcttcattttggtttatataatggatatataattagtgtgttattaagttgatattgttgttaactatgtttagaaaagtttggtttggttcaaattggtttacttcgattccccaatttcctctcttgggttccggtttcaacttgcatccacattggatccgtagtaattaagaaaagtgattcttcgtcccaatttgtattatttttggggaaattaaaggtactgtattatgttttatttttatagtactctactataatatgagctcaccacatttttgataaaataaaaatatcttatgaagagtcattagtaatgttcaatgtgcatgattgtggcaactggttatgtttaatcaagtttcaatagttacgtctaatttggagaggaaaactttgggaaccgaacaatgtaacgtccggttgaagtaaaccggacacggtaaccgaaaattatccacatgggtttggtttagttttcccaataaggtccagattcatccgccttcttagggatccacttcagcttaacataaagaattttgcctttgcaaaagaattgctcccgacaaattagcaattagactaggtatcccaaaaagcaataacagaggattaaactctctcatcgcaaaagacgttacgcatccaatttgggtaacccgaggctacataaaactgaagcgtcccgtcagacgtaacactgttagcaatgagactagttcctctatttgctgatgcaccttctacgatcaaccgccaatcagagatcagactcaaaatattcaagattagttgttttcatctttcttacatgaactgtgattttgtgaacataattttgtttttcttctttcctcgttacagttttataaaaataatttgtgaattgcagcaagccatcaagctaggattatgttggaactcgtaaagaagttaaaccatgtcaaaggacacaaaataatcatattatacagtactaaacattctacatcaaataaaataaaattatcttaagtacacagctttctaaaacacaaacatcaacattatatattcggatacaaatacatttatactaatttccaaattgtattgttttatcagatgtaacaatactttaaccaattgccgacaaaaacttagatctttttaataattaattaaaaacagaaaaaccaatcttaaaatctcagaaaaactttaatttagatacgcgtaaacagctttatatgtactttttttgttgtcattacgttaataaaatataaatctgatggtaccaaatttataaatataaattacctggcgatgaatcatcatctctgtaaatttctccagctcactttactctgcagagaatctaacgtttcatctttattttatttttatacaaatcacaatttatttttcttattaataataataatagtgattatgttgacgattaataaaggattagtttcgaattatcaatatataaatccgtccaactaacctatcccgtcgttatcgaacca

SEQ ID NO: 8747 - DNA, 3000 bp, Unknown
  misc_feature (1)..( 3000): cDNA_ID_2990010_gDNA_ID_1971873_Annot_ID_176651 3000 nt of promoter + ATG
agagagttaccggagatgaaactcggtaatgttcttcaggagatcggaagatttcttcctggtcatcagtttgcttctgtaagtctgacatcttgtatagttgatgctaaagttgtgattttgaggtcaagttaaagttcaaattttgggtctacattggctttgatctttctctcaaggaagaaaataagaaaatttctgaagtgggttttaggtaagagctgggatggagatggctatgattgatgcagctgctaagagtgtaagagtgccattgtggaaactatttggtggagcttcaagtacgattactacagacataacagttcggttctaactttagctcttcctgctacaatttcctttcaatttttgtgtgtttgcaaacaaattcctaaagtttatagtcattggctcctaaagtgattcaactatgactataacttagattatgtgtgttaacactgcattcatagtttctcaagtatgaaagtatggaatgttaatggcttgaaatttggagcgtatgaagttttgaattgtttgtagaatgttaatggcttgaaaacaccgggaacactaataaattactcaagtatgaaggtttgtgtgatttgtggttctcagattccgatagtttctccggctgaagcttccgtattggcctcaaagtatagaaaacgaggttttgaaaccttgaagctcaaggtgggaaagaatcttaaggctgacatagaagttctccaggctatacgtgcagtccaccctacttgttccttcattttggatgccaatgagggttatcaaacagaggaagctgttaaagttctcgagacgctgcatggtaaacaggtttctgaatcatttttggaattttctcagttaggtattgagcgctagaggttttaaaaaaggataggtgtttggaaaacttctagcctgttcaaactttagtagctggcgtttcttttctcggttaaaacctgaattgttgtgattgttttgcacagaaatgaaggttacaccggttctctttgaacaacctgtccacagagacaattgggagggtctcagtcacgtgactcgaactgcaaagaacagattcggagtctctattgcagcagatgagagttgcagaggcttgactgatctcaaaaaaatcatagaaggtaatatcgtagatgttgtgaacatcaaactcgccaaaaccggaatcctcgagtctcttgaggtaattgaattggctagatcatctggcattgagcttatgatagggggaatggtggagactagattagcaatggggttctctggtcaccttgctgctggccttggatgcttcaggtatactcaaatttgtaaacaccacatttctttctaatgtgaacatcataattctaacaagttaagaaggaatacacagattcatcgacttggacactccgcttcttctggctgatgatccagttcaaggtggctacaaaggtaaaatagtctctgttttcttcatcttgcatttttccttgttaaaaagatgattgaaattcaaaatgaacaagtctaatgcttgtggttttgttgacagcatgtggtgctgtctatgagtttaaagatgaaggcggtcacggaggatatcttcagtggaatgatgttgctcagtgaaattccttttgtctacttaggtcccttttcttttgttcaataggattttaatcgtaagtttaatgttggttttgggttttgtaaaggctaatcttggtcctaaattctcagtatgtgttagttgagagtgtatgtaatctagaatctttgtaacttcagccccagggagtaataagtgtatgaattcattacagtgatctgcttgatatctgtctgaaacacacaacacaggtctaagtcacagagcttataatagatcacaatatgtgattcttgtttcgatctttgattattggggatttcatttgcagagtctgttttgtcaactaattccagacttttattttagtcattatttgtgagtattgatagagagaaagtgaaaatgaaattgcttttcttgtggaagaaataagagcaaaactggtaggtgtagtggtgactggtgaggcgtgaaaatctcaacagatgtacagagatttctggtaaaggtccaattaaacactggactagctatttatttatttttaattacagaaaatattatttggctaattacagaaaataaaatgtcaatttttatggtcatctgagttttgaaaagaatccaaaatagaatacaaagcccaaccaaaagaatttaagccctaaaaaaaaaaatacctataaactaagtcgaaaaaaaactttaaatttttcggaaactaagctatatgcaagaaaaatataaacactagaattataaagcagaactcttaaagccaaaatccaaagatatcgaaatcatatactaagaatagagacaaacaaacttaaacccgaagaaacaccactaaatccaaagacaaaacatggtctttttttgaaaaatttacgaaatagatttaccaatgttttttttttgttttttttttagatgtaccaatgttgttcatggccaacccatcaatgacatatgcctcctcctattacgaggaaagatgatatttcgaatccaagtaaccaagactttataacttggcaagcaaatgcaaaaaatgagcttaatacttggcaagtaaaatgtcaacttgccaacttgtcaagaatatggcttaaatgcgtattcaaaaagcttaaaatgtcaaaccaaagttgacattggtggctagtccggaatggatgaaaccaccctttaaaaaagttttaccaaaaaaaaaaaagaaaaagtaaaatgtcaatataaacagacaaatacaaatgtttattcaaattgtattggtaaaagctaattttgagaatcgttttctaaaaacaaccagcacaatcaacaattttttatataaaaaaatctctaat

SEQ ID NO: 8748 - DNA, 3000 bp, Unknown
  misc_feature (1)..( 3000): cDNA_ID_2036904_gDNA_ID_1971873_Annot_ID_176654 3000 nt of promoter + ATG
atgagatgaaatgtcttatctttatttagtgcaatctgagtattgaaaacaatttccccagtttttttttttttttacgtcaaatattgtgtgcttattttaaagagaagaaaccaacaaagagatattccagaggacacggctttgtatgtatctgactaagaacaagacacacatgaatgatgaaggtgttggtcgggattgatgttaaagatgtaccaatcacatcaatatatacatatataaagaaaattaattttaaaaatcaggctaaaaattaacgatacaatattttataaaaacattttctcatgagtttctttgaaaacacgatatatgttcacttttgatatgcagacatgcagtaaactttaaaaatatgttgagatgcatatgctcattgtctttatcttcttttctctcctttttttttgttaattatatatggtaaagtagacttgtaagtaaaagttcttatacagaaaaaggtcgattttttttttgggtcaaattttaacagatttttggaatgaaaactgacgtatcctcttacgaagtgctaatttaaattggagttgaacaagtctcatattgaattagcaaaaatttagagtcaaccaaacatctagacctaaaaaacttcatgaaatttaatttttccaatattgcaaaaccggttcaatcaagttatattggtagaaacatatagtgaaagatatgtttttctagatctactacatgaacagaaatggcaattctaatggaaaaaacagatggaaccagaaaaatagagtaagaacgaaaacttaaatatagaatgttgaaacaagataagtgtaaggatgcatttaaaaggaagagacgaggcaaataaacattatccttagacgaaaaaaataaaacaaaacaaaagagggaaaaaggatacatgaaaagagattgatcactatattgatggatcacaattcacaaaaagccaacccattgcctattgtacacttgcacgatactcgaaatttccaaataattcggaacaaaaaaaacagctatattcattttttaaaataatcaaccaatcgaatttagtcttaaattgtataattgttttaatcatttaggtttacgatcataattaggtggtcatagatgcctatatcgttgcattaattgaagaagggagaataataatcctaccatctatgatcctataagattgcaataaagctatatatatatatatatattcatatagtatatatgatctaatctcttgttaattactatataaattaggtaaaggttaccgtagaaaattacgtggaacaatgttgaaatgcttacataagttgactagtccgtgttgtttttgttctttatagaattatagtcaagaacggcgaattattaagttgtttctgattataaaataaataggttgttgtgaaatcgggggaaaaagaataatgaatacttgttaaatattggtcccctaataaatgttatttattttggttataagaaaaaaaaggaatgtgttgtggagaagagagcgcgagtggaacttgttgctacccaattgtcgccacacttcccacacgtcccctcttgtatcttttttttacttttcaccacttcctttgtcctctgtttttttcccaccattttctacttcatcaatctattccttttgtttttttggtaaaatatgtaaatatcatctatttaaaaataaaatatgaacgaatagatttataaatatacaaaattgaaattttaagatacttttaatcgaaaagagttcccaaatatttacgtaattaacatttttcaaagtttatttaggtttaaatgtaattttctggtgtaccactaactagactatacataatataaacacgactgtgaaacatgatcatcattagctgttgattatctactaaagaattgtttgttatctctacataagaatatatattgaacacgatttctattatcttttactaatttgaaatagaattgtttctagtaatgacacaaaattaattgactcaatctagtaaaccttggagcacatgcaaactcaattaaacaagtttaaacctttgtatttgcatttattaatcaaagcaaaactgtgaagcaataatttaatcaatggtttaattaagaagctaattagctatttggctcctttagattacgaacgggtgctgctacatctcctctctgtcattagtcattactaaatatttaaaccaagttcgaatctgtcttacattatcttatttcataaaatctcaaagccaaattcatcttttcttttgaaagtgctccctcaaaagctaaacctcaaacatataaaatagcaaattcattttaacaaaagcttaatgaattccacgtaagcaattacataacgtttttgcccctagtcagtagagtccctccttctaactccgagaaccagcgtccatgtctcgcggaccaaatgcgttcgtaggtaagacgcttgcacgtgtcgagatgtaatcggtcacgtgccaacctgggttggttgcatcagcatccgacgtggcgatgtgaatggccacgtgctacaaaacctatgtatagaaacacccacccaatccccaagcacttttattcattttctataaaaaaatttacaaggatcgtataatactactaacagttttttttaaatattttccagataaacattaataaaacgataaaaggcaaaaaataaaaaagaaaagaaagcaaaagcaaaatcaaaatcgatatatcagacaacgcctcgacctttctttctttttttccttctcatcgtctccgttgaacaacaccacacaaacaccagaagaacaccagataattcccatggtgaaccgagctcagatttgaaaattgaaggtcgtagacgaatcataaggaaagagagaagtggtttgagatttcttttttgacggacgaaaacggagataagctttgggggaa

SEQ ID NO: 8749 - DNA, 3000 bp, Unknown
  misc_feature (1)..( 3000): cDNA_ID_2178466_gDNA_ID_1971874_Annot_ID_176671 3000 nt of promoter + ATG
ggccgtctcatgtggtagaccttacttcagtgtgactgtgctgatgaaagagcatgtgcctctattaatgacatatatataaattatacatatggttctcgtaactaattctataacataacacaaatacaattcgaaaatttgtttgtaggtcacgcaattaagaaattaaaacctaataaatgcttagtgggaggaatccccatcagcaagaaaactcaaaatcatcaacaaaaaaaaggagagattattcataaaatttgtttgataaaaacagatatgaataagtagctttagtaatgctataaatctgtaactcctagtcttgtttgtaatgttataattatggtgcaagagaaaatatgttttagatattcaaaatcagattgatgaactattacatttacagtttaccagctcaaacacgttttagatcaaccgctaataaaaactggtcaaaatataacacctaatcacaaaagcatcataagtatgtcataagcgaccaaaatcaacttaataaaaaaacaaagtggtaaaacactagggcctgataacttgtatagctgtcttgtacagtgtaataatcatcatatatattctcttcttaagtctaatgggttattcaacatttatccaccatctatttcagattaattaatagctgccgtcaaaaataaaaaggataataataatgttgtgatataagatattatagaatatatattttaatataataatattttatgttcgtaaaatagaaacttcccatgtgattttcttctctcaccgccggttacggttattgtctttttcttagacttgaaaatattaaatctttttgttatggaattttactacacagcttgtattcatatagttttgggttaatagttaaaacataaaacatatatcgtgattatagtttactcacattttacatgttgttacactgtcgatatctatcaaatatattactgttgtaatttcttttcaaaaatactgttctaatttaatcctgcatccaacaaactttttgaccagagagaaccaatatatatatcagtatgtctataaaaaaatatgataattgtgaaaatgagatccatatttttgattatatatataagtgaaatagatttgatttgatttactttgcaacgtcttgtgacacaagcatgacataatcgaacccatctaacaataacatgcagtatatcgttgagcttctagcaaaatcaacaaaaatctaaaatcttttagtaaaataatattaaaccttttatcattaagaatttttttaaaattaacaataaacccatgacatttgtctaatctgccatagagttgaggtgggacttctaacatgctctattatctcttgtactccgttgatcatcgatgataaatcacaagctaaatgtttgtgaataagtgaaaatttatcttggaaatgaaaaattatccaaatcaaagggttacagtaactggataattcatttaacactttgaatcaacaagatcaaataaaaaaagttggaagacagtgaagcgacaacatagtccattactttgagttaaagtaatattataatttagtaaagttgatctaattacatttttataagtttaatctggtcatcgctggaccaagttgtcatcctccaaattccttaccaatcatacaaattgatttttggccttttcttggaatcatctcttttttttctttgtgtttttcttctcattcattttgtttttctttaatacacacacatgcatgtataaacgcagttttatgactggacatatcgcgtaagatccataagccaatagctttttttaagtaaagtattttcattttatgggtataattataaagatgtaaatttccccaaaataatataaacagcagtctctctcctacttaatcaaatcactagacgcggatttgcttaacaaagtaactttaaaccaaatcgttccacctaaaaggctaaaaccattaggattgattttggtcaaaaaaatcggttactattttttaatttacttagaagactggcaaaaaaaaatgattccaaactactaacatataagataaaatgtatttaacatcaaattaaaattttcacgttaactaatataaaaaaatgatatgaaagaaaacccaactaatctttgattatatgcgttagccttcttcattagccttctttaaatactagattagtacttgataaacttttattgtctatacaatatatcaaaaaaaatgcctctaaattaactacataaattagtaatttctgaaaattaataaaaaaaacacgtaaccataacttccgagtatgtttactttaataattttcacgggattctgaactctaaataaagattgattgataaaaaaatattaaaataaaattcacgggatttacaaattagttatcatttgaatcatttgttatagaatctaaaataaaatagtaaattgatcatatagtaagaaatcaaattttctttttttgtcataaataaatataatttgttctttagttatgcacgctggaaatagatcccactaataaaaattggacttttcaaacaaagaaaataattaaataaaatcttcctttacaaaaacaaaagaggaaaattcaaagaaaggagaactctcttcttcttcttcttcttctcctctcctctttatttacttagttggttcacttcagcacatgatcctcgtctctctttctttctctctctcaatcacaagtttcagttacacagctgaacccaaagtatctcacattctgatctaatcagaacactgttttgtctgtgtaacataaacaaacgatcctgtttttatggaaaatttaatgaaacagtgacgattcttctacacttctttataatgacaaacatttcatagtaccaaaatacacaaataccttttctttattcttctcacccttctctgtttctttatcattc

SEQ ID NO: 8750 - DNA, 3000 bp, Unknown
  misc_feature (1)..( 3000): cDNA_ID_1394861_gDNA_ID_1971875_Annot_ID_176681 3000 nt of promoter + ATG
atgatgcatgcattgttgctaacaagcatgtgcaattaatttatgatttaatacgaataaagaaaagaagctaaggctatacactatagttttagtggccaataaccatatcggaaggtatgacaaagaatataaaaacagttttctgaaaattgtaaattgttatttatggaccagattaaataatacatgtgctaaatactaatgaaggcaacgaatcccacatggaaggattctcgtttccccaactatttctgctctgtgttcccacacataatgccacgcaatatttatacagagtggactgatcaagagattagttaccaaaataaataagaaattctgacttaatcaatcatcaaatttttgtatcaacccctaacaatataccaatattcaatccaaatcagaacaattaaaaatttgtaactaaaaaaatgaaaatgaaactatggttgtaacgaaaaaaatcacacaagaattaatagtcgagtattagatttttaaagataaatcttctttcttgatgacttggtcgtgatcggtcaacaaaagcggttttttaccggtcaacggactcaagatctcttcgtcgacgattggattgtgatgaaggctgagttcaggtaacgccggtaggtttagatcgatgaatccacggtggctcctttcttccgataccgtgctcgacacgcttccactgtgactgattgatttgcttcctcctcctcctccgccgccgaggttgccttcgtagtgacaacgtttgtgaccgcctaaagcttgacccgtcggaaacactttatgacagattgaacactcgtggatctttccggaggcagcaatcggatgtttttctccggcgacgatggagatggtcggagctgttgaatcatcggcggttgttgagattacggttggtggtttgattcggtgacttgctttgtgaccgcctaaagcctgataggaaggaaacgctttttcacagacgttacacttgtacggaaggttctttgattctggcggcggcgttaacgattgcgactgttgatgaaatcgcgtttgcgacggttgatctttagcgagcatgaggagacaaagagcgagatactcttcttccgtaagatcttgattctgggatttgggtcgagatcgaggcggtgaggaagaagacgaagaagggctgtgagaacgctgacgtttggagcgtttgcgtttaagccacggctcaatgaaaacggcgtcgttcatcaaatcttctttcgtttcgattctggtgaaagaagaagttggagtgttcatcgcttcgagggccatgatcagatgaatcttcttctaactgttggatcaaaggatcagaaatttgagagaaaagttgagagtttttaatcgcgaatatggtgagagatagagagaaggaaattagagagtgaagtgcttaagaaatgttttggacttgttgtttttatatggaaaccacgtggcagatgtgtttttaagtcggtcaaatttttatcttctttttttttgtcaatatactctctataagaaacctaacactatagtgtaaacatggaagaaaatttcacaatgtttaaattggattatagtatcaacaaatatgattttattagtattcttattttaaagcattttttgataatatattatctatagcatatttagctttagatatgtgtcagatatatatctgatagaaaattattttagacttatcaaatcatatatattttgttatctaattttgagagatttatggaaataatcacttaaaagtaagtaccaaaccagcaatggtaaaccaaatttgaccaaaaggaataaagagaaatttactgtaaaataccgggttgtttttggtcacggctgacctaataagttttggtcatcaaagagtgagagaccggttcaaagtcaataaccagaaaagtaacaaattggtaaacccgcaaatagattttagcttatattaaacaattaaaaaaagaagcatacctttcccgtggagctgacttatgtgttagctacgcgccacgagtcgtgtgggtcacgccttaaaccaaacgcgtacacgcctaattacgtttttttttggtactaatcttcttgaagatttatcaaattttctagatttttttaaatttattatctcttatcatgaatcatgatcttatcttaattatttattaatcactcttcccatgctaatctatagcaaataaatcgataagattcgtttaataaaacacctggattctacccgaaaaatacgtagggaataaattaacggaaagaaacaaatcggaatttttgttttcagaaaagaaaaaaagaatgttgagctaacttcagtggagttgagtgtaggtgaggtaaaaattgggtgaggcatggcgtaccgtattagtaactaaaacggggcgtgattataggacacgtgggagttccgttaccacttgtaaggcccatgtcacttttgttgttatacccaacaagcaaaaaaagtggacgtaatttatccaaacgcgttggcggagacgtcacgtggcaatttatacacgtgtcacttcgattgcgcagacaacatcttctcaggaaacgcagttttagacgttttctctcattcagattctatactcttcttacctttttgggcttgcaaggttctgtataatatgggctttattagcccaatcatctcgaaatatgtaagtccgtatcagacatctaacggcccatcttcgttgaactcgtgttttacatgattcattttggatcattgaagtttcgaccatttcgctaattcgaattcaaataaaataaaattagtttttctgtttggatatgtagagtagatctaatcgacccttgtacttctgcaatttgaattcaaaatttaaaccactctacttttgaatctctctctcactaaacctagaaagtagaaaaccctagcatttgtgatcttcaacgggaaaa

SEQ ID NO: 8751 - DNA, 3000 bp, Unknown
  misc_feature (1)..( 3000): cDNA_ID_2026192_gDNA_ID_1971875_Annot_ID_176686 3000 nt of promoter + ATG
cttcttgagcagtgatgattgccttgatatgctccaaattgatgacaatcgctctctctctacctaaaacagtagatggatacgacaacagtggatcgagaatcctaagatcacgcgccggtaatcccgttcgccgcatgatggagtgtttcccttcttccttcggctccgattgccctgacgagttaagtaccaaccacgtcctcacgccaacgccttttttccttccaccgccgccgccgccaacaccggcggggtacgtcggtgtcggctgaccagtgtttggcgttgatggattcgtactaaaattgaattcatcgggtctagctcctctcatcgcttatgattgttgtgatcagagagagatcgagcagctgaggaatgttggaagtgaaaattggggaatttatattccggctcgtccaccacaaaggacaaaaacggttaagacaaaccggtttttacttttcccccaaatatcaaaatcaaaccgggtttagattttccaccaaaaaccaaaccggttttagcttcttctttgaatttttgttgtgacggaggggatttgctttaaaagtttagggcttttaaaatcggcgacggcgagcggagaattcccaaggaagagtcgatgaagttgaaatcggtgttcgatgcttcggaaatcaaatcggaatttgaatcagcgggaataaaccctaaattcgcgattcaaatctggaagtatgtaattcagaatcctgattgcgtttgggacgagattccttcattgccttccgctgcatactctcttctccattccaagttcaagactcttacttcgtctcttcactcgctatttcattcctccgatggcaccacctcaaagcttctcatcaagctccaggtactctatactctgttactgtatacaacacattgcttttatggattctgaaaaacttgtaatgtctctgtttcctgacgaactcatattggattcttgcttttggttttgaaattgaagaatggagcttttgtggaagctgtggtaatgagatacgatactcggttggggatgttaggagggaaaccacgtcctggaggtataagatctacgttatgtatttcatctcaggtattgatttttatcacgcaatgttatcttggttttatcgaatgaaagacatgtgatgtgaaagtatttatcaataggttggttgtaagatgggttgcacattctgtgctactggtaccatgggatttaaaagcaatttaacatctggagaaattgtggagcagcttgttcacgcctctcgcattgctgatatacgcaacatcgttttcatggtatatttctgcttctgttattgcattttatctacactatgtgcaccttgccttatggttatttattttatatactctgcattgatgaattttattcaccagttgttgccttggtttgatgattgtgatcagggaatgggagaacctttaaataactacaatgctgttgttgaagctgttcgtgtcatgttaaaccaaccatttcagctgtcgcccaaaagaattaccatatcaactgtaagtactcagaaagctaccttgaaacattcgtaaaacagagaaacttattcactgaattttgtaggaatactttagattatggaatttgataaagggaactgatagataaacttcaatccattaaacctcgcagtatgcagcttccaagacatctttcagctttttttgtctagttggttacttttaaattttggtgttttgggattttcttctgatttccttgtccttccgtaatgcttgtaccgtatattccaggcataaatctaaatcatgcaatgctgcctgtgttgacacttttttttactagttagcaaataaatttccctgtatcctaatgtcatttgcataggtcggaattgttcacgcaattaacaagctacacaatgatctacccggtgtaagtttagcagtatccctccatgcaccagttcaagaaatccgctgccagatcatgccagcagctagagcctttcctttacaaaagcttatggatgcacttcaaactttccaaaagaacaggtagttcatgtactcttgactggttcgttgctgttaaatattaaaaccacaatcccttcagttacattgacgattataacattatgccacattgtcattggatttaacagtcaacaaaagatcttcattgagtacataatgcttgatggagtaaatgatcaagagcagcacgctcatctactaggcgaattgctaaagacatttcaagtggtaaatcttcgatgtcttaatactcttaaaggttctgcaattatctgatgatattttttatggaaactctgtgctcttttcttgaacaggtcataaatttgataccatttaatccaattggatccacaagccaattcgaaacaagcagcatacaaggcgtgtcaagattccagaaaatcctgagggaaacatacaagatccggactacaattcgcaaagaaatgggtcaggatattagcggcgcttgcggtcagctagtggtgaaccaaccagacatcaaaaagactcctggaactgtggaacttagagacatagaagatctgcttctctaactttaggaccagagacatgaaacagacatttggaatggttgtgtagtatctttgaagccactcttcaaaacccttttcttaaacttcacattttgtcctctcatcactttgtggaaaacacttggctcactcttatatgcaagacaaacagagatggtccttggtccttccacactatcacatggaggtttaacttctcttataaaatattcaccaacaagtgatgttatgtcatcgttaaagttggaagtaaatgttaaactttaattttaatgaagtaaatagtagctaattagcttctcttcccgcctataaaactagctcctcactctgtcttctattccataagagtaaaaaaaacagagagatg

SEQ ID NO: 8752 - DNA, 3000 bp, Unknown
  misc_feature (1)..( 3000): cDNA_ID_3043431_gDNA_ID_1971875_Annot_ID_176687 3000 nt of promoter + ATG
tgcttcaaagttataatagaagatgaagatagagcaggaatctccagaagaagaagacctgggttcgcgatcgattctagaacggtgacgtctagggtctgaatctctgctttctcgcctcgtcgacatgtttctctcaccgaagaaattttagggctttgctcttctctcttcccacgcctgcctgcaacattttatctaattttcccgtcagaaattgtcaatttcctcaatattacagtttccgccttatatttcttcaagtatcagaaaaaaccccataagttagaattgtgcacagaaacgatctgcgataccattataaaatccggttctctaatcagtctatatctaaattttgatgtcgaaataagcaagaaggaaactatgcaatttgctcttttattaaatcgaaagaaatgcaaatagtgaaggagacggataaaaaaaggtttgagagtagtaaagatcctcaagaacaaaggatatacataaaagtcttgttagcttaaatagatttgtggcaatgcgacattattctcctctcccaatatgttgttggtcgactcattcaagaaggcgcttgtacttgcaccacccgatggcaccaacgtagaggcatatactgccgatagaacctccaatcacagtccaaatgaatctacttggaccatgtttattatccgtgaacaactctatggttatattcataccaaatacaccagcaactgcgataaaggcgctcatcaccagagtagctgttgttagcatcacacccatctgcagaagatgattctgcttgtcatctagcattatgttgatgtagtcctccgtgtcatccacatattcccttagcttttttcatcataacaacaacaaaaaccacaatgtattagaagaaggatatcatcacgacaaagagtaccaaagcatctggtctatttacttactgttgatagtttgttcagtataccatcgatctgcacgaaatatgcttccaaaagcatttcaagctcttccacatctaatttgttggtcatggcactccgggttgagcttgtgtgagtcccacggctatttctgctaagtgcactttgagtactcataagaagctcgtgagcatcatttgcttgaagataccttccatctctgttagcctctgatgcaaattcgggaggaagcctggagtaaaaaggcagatgttaaacttatatcagaacaatagaaggtactgcaagctcagaaagttgatacatgcctgtcatcctcatctccttgaggaagatcaacctcgaaggtatcactctcattcatagaggaatttgacgaatcctcaagtttctgagctaacttctctgtaagatacatctcagccatatcttcatcatcgtctagcagatgttctagctcatccctcacctagaacatgtaaagagaaaaagtgttattagtataggcaaacgtggttagaatatggtgatgtcataggttcacatctataaggaaacatgataaatccttatcataatatcaaaggagccattttaatgtccgaatcatagcaccttctgaacacgtccagttattgcaaccagcctgcttttaatctgtcgaacccgctccaaattaagggtactgatcttggaagtaagcttgtccagggctggatgagcctctaactccaatcttaaggcctacattagaagaatgaatcaaataccaaacaagagaagaaatatgctttgtctcagagccttaacataagtatttacctcatgttccaaactgcttgatgcagcttcaagacaggcttccagagcaacaaactcaaatggaagaaccttcgatccatcttgattctcaagactttgcttcgcatccttcttggcttcactcccttgatccccagaagattgttccgttccagcttctccttgggcaggatctaccctcgtatgaggctctcccccagagttctgctcctcctttacacaacacatacaaagagagtatatagtcaaccatagctaaactgacaaccataatcttcacatatcatcaccattgcacaaatcaaatagtcaaccatgtctcaacaatacattagctattatatacatattccattgtcaagcgaaaatatttctacttcccaattccaaaacaatgcaattaggcacaaacaaaaggagacaatacaaaagccaactccttgaataaacaaaaagagctccaaatgaacagtgggaaaaccctaaattctccaattacctgaggtttagtggcgtgatggtgacagagaatccgcctctgcaactcatcaataaagggtgagaccgaaggatccttggaattaagcaacaaaacttcttgagcagtgatgattgccttgatatgctccaaattgatgacaatcgctctctctctacctaaaacagtagatggatacgacaacagtggatcgagaatcctaagatcacgcgccggtaatcccgttcgccgcatgatggagtgtttcccttcttccttcggctccgattgccctgacgagttaagtaccaaccacgtcctcacgccaacgccttttttccttccaccgccgccgccgccaacaccggcggggtacgtcggtgtcggctgaccagtgtttggcgttgatggattcgtactaaaattgaattcatcgggtctagctcctctcatcgcttatgattgttgtgatcagagagagatcgagcagctgaggaatgttggaagtgaaaattggggaatttatattccggctcgtccaccacaaaggacaaaaacggttaagacaaaccggtttttacttttcccccaaatatcaaaatcaaaccgggtttagattttccaccaaaaaccaaaccggttttagcttcttctttgaatttttgttgtgacggaggggatttgctttaaaagtttagggcttttaaaatcggcgacggcgagcggagaattcccaaggaagagtcgatg

SEQ ID NO: 8753 - DNA, 3000 bp, Unknown
  misc_feature (1)..( 3000): cDNA_ID_2036973_gDNA_ID_1971875_Annot_ID_176692 3000 nt of promoter + ATG
gtcggtagatttattttagatttttggtgtgtggcagttttgtatagtcggtagatatgggacaatgataaaatattcatttgatatgatagtatgatttttgaaactaaattgattataaaataaataattgtaaaaaacaccgtggacgcaaagaggttaatcgctgccattggatgaataatacgaggtagggtcgagagatgaataccatgcagcctcccttacgcaatctttatctatctctctgttcatcacttggagcatgagctggccccaaagtggagcacgtaagtcatttagttggcatcatcttcactggcttatactattattctatctatcttaaaaataatactaatatttttttaatctactaaaaatgtttatatgctaaataaagaagatgtttcgaaagctttccacacgtattaactttgtgtcgttttgctctggttcccacacgtatggtactatgattgaatctgtgttgttaaatttatgcatggggttgtaattaaatgttgagtgataaattatttaaagagtttgagagataatataataaaaatagaagtcaagtgattaagaagaagaccaatctgtcttacagagaggatcgtgaggagactgtcgagccgcagctgtataggggtctctcattcatattgtaatccaaatttcgattttgttagttagtacaccaatatatgacacatgcgtacaagtgaaatcatcaaattcatcagaaataatataatattcattataaaaataaatcttcttgtttccatacatttctttaatattgactatgtaaatacgttttctagtttatagattattaatactttttttagtatacgtactatatgtatatgcgataaaatcgtaactattaatatacaaatatgttgatgtatgtgtataatatgttattatacaacatgatataaattatttgtaaactatatttttacttagaaatatcgacttgtaacggtgtaagacttttgaattacaatcatgaaacgatccaagttatgttattgacaaagaaatttagtggatttattagaaaagaaaaaccaattaaaagaatttacaatcacatatagtttttgttaataaaaccccattaagttgacaaaaaaataagatccccactaaaagtataactttgtttaaactttaaacccaattaaacaaagctcttactcaatctaattttaatttagtagctatatagttttcctttacccttaactcatacattatacatattttaaatcagataaaatcttggatatactaggcatgacaccattctaattgaactattataataaaaattttggtttttactatggtatattttgtttttcatgatcctaaattctaaaaataacattttttgtgcattctaatttggtttaaatcataaatttttcagttatttattataatgatttgtgaagttatgagcttgggctatacattattattaaagcccactaaatattttggtatatcaccatacgataagaaccttacatacatctacgaaagcccatcaaccctttgaccaacttgagcattatatttttcgcattgaacataggacgattttggttttctatagtcgatattttgttggaaatagaattttataaatcttctgttattggaaaaacacattttgtccaattttattgtaattatgttatttgacatagtgaagtagattagaatacaagtattttgtaacaatttaataaatataattttataagatgtaagagttcggtttacaggggttgattatcaaaccaaactagaaataaaggtagctcggtagctaaaaaacaattggtctgatttcaaagaatgtatgtatctctatattagtagtaaaccgagctaaaatacactaaaccgatcaaaaactaaacgaaataatcctaaaatttacacgtggctaccaattgggcctaaactgggttgtctggcccaactaaagacaccgaattgaccttttttttttaattttaataatttaataggtgaagcgcagtaccgctccgtcgtgttggctctgaactttgagttcaacttcatcctcgccggcgatttggtaattttccgcaattcgtccctctcttcgccggaatttatagttgttcctttggtcttgtgttcgaattctgcgattgactcaaagcgcaattgagaagtgtttgaagttttgggatatttcttcatttctatattgttctggttagggtttggcaatccttttctataaagtgagtatcttcttggtagaatttgattgaatgagttcgtctctactctcagtttcttatatattagttgtaagtttccaagtaatctgcaagagtgaaacctagagttgaaaaacttttcatttctggatcattttcaatagtttattctcatgttatggcatattaagttactccacacgatcatgaacatgttaatactacctatccaatccaaacagtttattatctgtttctaaactcgattttatgatcagacggttatcaagtagaaattatgaacttgtttggaatcacttagaattatggttaagtaagacatggattttatgaacagatgatggtggccgatttaacaatcttagaacagagacctgcttgaatgccatgcttataccttgcgtttttattgtattggggtttgccgtttttcaatatagaaatcgttgtatgctatgttggatattctatgagaaactttagaaggcgaggggtatcgttgttgcttgcatattgcaaataaatgtagactactactagttcacgtcctcattcctattttgtgtttgttgtacaggtctagttttcttctccatatttcaactgagcctatatagagcatatacgtgcagtttccattattatttggtggatcttccattggtttcactgaggctaatactgctggaagatg

SEQ ID NO: 8754 - DNA, 3000 bp, Unknown
  misc_feature (1)..( 3000): cDNA_ID_2036956_gDNA_ID_1971875_Annot_ID_176700 3000 nt of promoter + ATG
gtgaacaccgatggcgtgatattgacaaagcaaagtgtgtaactcctatgaaatacctggtttattatgtatgttattactcgttatgtcttagcattgttaagtatgttaaagttgctgattgaggatatcaagcatgccttaactgtatgttatgtatctcatttgttgctagtattacatgaaataggatgcagttccatgtgattgaccttgatatcggtcatctcctatatgattaatcatttaattttagttcttgctttctgtgatgaaaccccaattacttatattgtgaccaagagagctcagaaacttgtttattttgtttctgcaggagcggagaaagttatcggttgggccagaaaccactatttatcttcttgtcctagcccatcgattaaagagggccgcctgattctcccccgtgaaaggtaatggcatggttgttgattgatctttggggtctatgatttatctttgattttcttatatcttactattgtcttcctcttttgaagcattgagatttcagttaaaaggttaaaggcacaagaagatatttctcgaaagcccacacaaaacttgaaggtttagtttcttcccccctctggtagtctggcaattggctgctgaaaactctgagtaataattatgttaaaaagagatttttgtttttgcagaatattgcgaaggatgagtttgaaaccaattttgtctcagccgtggttgctcctggagaaattggggtaaagtttgacgacattggtgctcttgaacatgtgaaaaagacactaaatgagttagttattcttcccatgagaaggccagagcttttcacccgtggaaatctcttgcgggtattacattctgttatatacatgtcattatgttcttgactatggacttggaattttctcgtctgggttttcttgaatgcgtgtgtctttgttttttccagccatgtaaaggcatattgctttttggtcctccgggtacgggtaaaacgctgcttgccaaggcgcttgcaacagaagctggggcaaacttcattagcataactggctcaacgcttacctcaaaggtacatggaaccttaaaactatgttgtttgcactgtcacgttgatattccactttgtaaacatcttcatataaataaggagaatatctaatgacataagaaaaacttttccaccccggtcatcgacttattattgtcaatgccgattgtaacttagagtaaatctctttccaactttacctctgattggttctgatttaagtcaatttcgtccattgtttggcacagtggtttggagatgcagagaagctcacgaaggctttgttctcttttgcaagcaaactagcccccgtcattatatttgttgatgaggtgagaaattgtttagctttatatcacttttcaatttcggttattgctttttatgaggaatacttttgtgatgcgtaaaatgtgttactcaaggactaactgtaatttattttgttgtcgtataggttgacagtttgttgggtgctcgtggtggtgcttttgagcacgaggcaacacgaagaatgagaaatgagtttatggcagcttgggatggactcagatcaaaagatagccaaaggattctcattctcggtgccaccaaccgaccttttgatcttgatgacgctgtcattcgtaggctaccaagacggtaatttaagctttcaagtaatttctcctttggaatatttgtatcttttcgataattgtattgaggcttgtgtttataggatatatgtggatttaccagatgcggaaaaccggttgaagatattgaagatatttctgacaccagaaaatcttgaaactggtttcgagtttgataaacttgcaaaggaaaccgaaggatattcaggaagcgatctaaaggtttggtcattcggggtttcatttacaagttcgagtatgattcaacacagtagttctgattccttttcttttcttacattgcagaatctatgcatagcagctgcatacagacctgttcaagaattgttacaagaagaaaacaaggtaaggacatgcataaacccacacagttgatttctgttgttacgaaaaataatttttgtactcactccatgcttttgaaacgtcgaattatcaggactcggtaacaaatgcgtcccctgatctacgaccactgagtttggacgacttcattcaatccaaagctaaggtattgatcaatctcttaaaaaacatcatcatcatctctattcatgttttttcccctggtgtttgcattatcgaaattgcgtcattgtaatgtaatttgcaggtaagtccgtcagtggcatacgacgcgacgacaatgaacgaattgagaaaatggaacgagcaatacggtgaaggagggacccgaactaagtctcctttcggcttctaagccacagttttgttacattcatcaatgtctctctttaacaatagaactcgttgatttgttccatgtcgtaacaataaaagtcactatttcaattttaatcatagttacacaagagagacctttaagaaatgaaaaaatagtaaattaacaagtcgtcatttgctcaaaatatttctggtttctcatccaataatcacaattctgtactacatagttatcacaaatcctttgagataatatttctgcatatactattggtcaagacaaagcaaatcctttgtatttgccgaccaaaaaaaaaaaatccttaaactctctccttacgcgctcttttatttaaatttagcggagaactattacaacgttgactcaacgcgccatggatgcgcgtgagattaaaacacaaaaaatatttcttttgacaaaaattgaaattagccgtatctgctaattccatggcggaaaaaggaacggcgacgaaaactaaagagtagaagaaataagagacactctcttactcttactcttcctcttgctcattttcgtaagagacgatg

SEQ ID NO: 8755 - DNA, 3000 bp, Unknown
  misc_feature (1)..( 3000): cDNA_ID_3043420_gDNA_ID_1971875_Annot_ID_176702 3000 nt of promoter + ATG
tcagccttcttagaaggtccaacatattttacacgatctcctgcaaaaagcgtaaacacaaatagaaatgaggaaaagtgaaaaaattgaccacacaaagagaacttagcagtctgacaagtagaagaggaaagagtgaaaggctaagatagaaagacaataccaggaaaattatgactagatagaatacaaaattactaaatcaaacttatttagcaaactgatacattcaagtgtacctagcacttgtaatgatgaagatgccttccagagccttgatattgatgattacctttctttgccggtcgcctggctttatcagaatgctcaacagctgctgcttcgcaagcttcaccatgtagttcttctgctactagctgccacaatttagaggaggtaagcaaatttcagcaatttctgaaactcaatttaattggaagttcaaaaaaggaacaatgcaaagagtcgcatgtagaaccaagaaacagcattcaaacggcaggaatggtgaaaccttctaattcatgcatagtaactctaataacaagttcatacaaataagataaatcaagaatcagaaaacttatatgacagggtcccaagatcacattgtccacggggtatcgcaaaaagaaaaagaaataccatggtattaccaactaaattaggaaaagaacaatcagtacagactaaaatttctgaatctcaattaatgcaatcataccttttcgaactcttcaagttttggcacaattttcttgatagcttcctcagaaacctcgagacaagcttcctcactgtcactcccatctgctttcgcttcagaatcctcttcgctctgagcactagaatcttcctcagcatcagactctgtcgtggattcatctgcttccgcttctgcgttctcaccatcagattcagattcttcattgtagtcatcagcaaaatcctgatccagaattaaaaaatattacataaacaccaaaaagaacgaaagaaaaatggtggcatgttataggcaaattactcataagaatctcacatatggggcaagaacgctgctgtcaagaaccaacaggggaacttgtacatctcgagcaagtgctcgtaccaacctctcccggtaaagctcagtacctgaataaaattcaaatttcttattggtcatctaacatttcctcaatatttttacttgataacagaagagcaacatcaaatcctggtctgccatttttattctatagtcaataacaaacctggaacactctggagcaatattcttccacttgaagaatctaaacgggcaccatatatggaagcggcattcttttgtcttatatgtgaggtaacacattccaccaaaatatctttcgtgtggtcgctgtgaaaagataatgagcagaatccataagcagaaatggagaaagaaacacaacaagcgagaaaaaaaaacatgttgtagattattactggatgtagtaagggaaggtctcccaagaaagctgtattttttcccaaggttggattctccgtaagaactcgtttttgaatctttctcgtctattaacgaaaggtgactccttctttttgcattcactagcaagcttctcattattgagccattctatttggtcttgttctccaagttgagcatgagaatccaaatgcccaacaccgttattacttttctccttcccggtttttccatcatctacaccattctctttgttcaaagagatatgtttatcctcactagcattccttccatcaccctcagaactaaaactacgcaactggctattcttcaaaatacttaaatgatttcccgaggcaatagtaccaccgcggggagaaaatgaaccaagtagagactttcttgtcaaattttcactattggttaatttatttgtgaatccacaatatctggaaaccgtatagtcacgaacgactggcctaactaagtacttggcttgctgcaataccaaaccccatctctggttcctctttaatgcccttgtatacatcacaaagtcccttctcttccaatataactacaaaaaaaaaaacagagatcattgatttagaatcactttcagggtccatttcttgtactatccaacctaaatgcattgcaacatgtaattgcaccattaaaaaaaaaaaaaaacgagatcaatatcaacgcaaaacatactatagtaactcggaaagaaacatagattctatacaatttatttcgactagaggaataacaacacacttcagggaattaattgattaagaacagacatcaattaaaatgaacgattatgacgcataacggaaaatccaatgtaacaacgaatatgaggcatcgatatagaaatgatgatatattcagcttttgtcatccataactattacaaaacacgaaccgtttaacagagatggacaacaaaactggttctattcatcccccaagctctaagaatcaggcttggtgcaaagaggagatgtaattaggaacgagatagggtgaagaagagagagaaaatcccgacagaggagagagagataaagaccgatctaaagtctgtaggttcttcttctgaagctgaagctgggttcgaagttcagcttcgttgatgcagtgttgtcgttttgacgcaaaattgctacttgccttcctatggatatgggcctaactataaaggcccactaaacatataagagtcggtattttcctgacaaaaaagccctaacaagttgtcggatttacaatcgtacccctatttttaagccgcgcttatctcgaacctatacctgtagagaggaaataagcatttgggggaaatcaatcgaaaaccctaggagagataaaaacaaaaatctagacggagatttatggcgacagcgaatcctggccgtggaggtggtagaagaggcggtggagctatggatgacgataagttggtcttcgagactaccgatggaattgagcccatcacgagcttcaatgat

SEQ ID NO: 8756 - DNA, 3000 bp, Unknown
  misc_feature (1)..( 3000): cDNA_ID_2036952_gDNA_ID_1971875_Annot_ID_176701 3000 nt of promoter + ATG
cccaatacgatggatgtagagctcacggttgttggggagatcataattgataacaagagaaacctgttaaataaagattgtcatgtcaattcacctttaccataagagaatggaacataatctgagacctcaataacagagattgaatttattccgcgcattgttatctagacaaaatatagcggataagtaatgacttacttgttgcacatcaatcccacgtgcccatacatctgttgttatcaaaacacgactatcacctgaccgaaactcattcatgatggcgtctctctccttctgaggcatgtctccatgcattgatgagacagtgaagttgtgacttctcattttctcactaagataatccacctataacaaatgcggagttagagttgagtaaaatatagaaaaggaaccataattcaagaaccctaattacaagaaacattgaaaaaggttttaaaagccaatgcaatctaatagatatctgcaggtgagtacaggttgcaagtactctagcgcagtggacttatattgttaatttcttttagaaataaagaaatacatatattcacaagatagtatgaatttttgagcaattacaagattgcaaatcaagttcagatagcagtgctagaagcttaatgttaacaagtttgagatacagttgcatgagaaccacaattacctttcgtttagtattgcagaagataacagcttgagtgatagtaagcgtgtcataaagatcacagagtgtatcaaatttccactcttccttctcaacagcaacaaaaaattgtttgattccctgaaaagattgtacacaaaaagatagccaatgaagaatatgagtgtcaacctactgtaaaagtaaacatgaacgagcatacagaagcataagaagaaacatacttcaagagtcaactcatcacgcttcacaagtatcttcactggttctgtcataaacttggatgtcatctccaaaatctcgtgaggaagagttgcagaaaccaagcaaacctacaaaaaaaacgtattaggattgaactattatagagtggaatttagctgttcataatacagataatagctaccaaatctacacataagacattcaagcaacttaacagtggctaaaaggtttttaacaacttataattctctcaatccacatagagttcaagaagccaatccataaaataagaaagctaatgcaataacatccaaagaaactagaagttagccaacacataatattgagcagtgaaattgcacctgaagatctggtggaagatatctgtaaacatcatagatctggtccttgaaccctctgctcagcatttcatctgattcatcaagaatcagaagtttaatagctctggtacgaagacttctcctctttatcatgtcacagacacgaccaggtgtcccagacacaacatgaacaccatgctccagcttcctgatgtcttctccaacactattcccaccgatgcaagcatgtgcctgaatattggcatgtaatccaatagcttgtatcgtcttctctgtttgtgtagccagctctcttgttggggataatatcaaggcctgaaccctgcagtccgagataccaaatacatgagtacacatataaaaagatcttgcagcctaaaagaaagtattactcaatcactctaaccgaaaagctaataactatcacaaattttcattgtcattttgattgaacattaatgaatcataattcgttcatctattctacaagtcagacaaacaaatcccaccaaatttgtgaaatcgataagaaacaaaacctaatgatttaggttagagaacaatccgagcaaagcaagtaaagttcaaaattgaaatgaagggtttaatccagctaaaggaacagaaaacatactctctagaagaagtatcaacgacttgacaaacggagagagcaatcatagatgtcttcccggtaccggactgagcttgagcaataacatcacgtccttgaagaatcggcataacagccctctgctgaatcgcggaaggcttctcgaatccatattcgtagacaccgcgaagcacatcttccttaatgcccatatcattgaagctcgtgatgggctcaattccatcggtagtctcgaagaccaacttatcgtcatccatagctccaccgcctcttctaccacctccacggccaggattcgctgtcgccataaatctccgtctagatttttgtttttatctctcctagggttttcgattgatttcccccaaatgcttatttcctctctacaggtataggttcgagataagcgcggcttaaaaataggggtacgattgtaaatccgacaacttgttagggcttttttgtcaggaaaataccgactcttatatgtttagtgggcctttatagttaggcccatatccataggaaggcaagtagcaattttgcgtcaaaacgacaacactgcatcaacgaagctgaacttcgaacccagcttcagcttcagaagaagaacctacagactttagatcggtctttatctctctctcctctgtcgggattttctctctcttcttcaccctatctcgttcctaattacatctcctctttgcaccaagcctgattcttagagcttgggggatgaatagaaccagttttgttgtccatctctgttaaacggttcgtgttttgtaatagttatggatgacaaaagctgaatatatcatcatttctatatcgatgcctcatattcgttgttacattggattttccgttatgcgtcataatcgttcattttaattgatgtctgttcttaatcaattaattccctgaagtgtgttgttattcctctagtcgaaataaattgtatagaatctatgtttctttccgagttactatagtatgttttgcgttgatattgatctcgtttttttttttttttaatggtgcaattacatgttgcaatgcatttaggttggatagtacaagaaatg

SEQ ID NO: 8757 - DNA, 3000 bp, Unknown
  misc_feature (1)..( 3000): cDNA_ID_3055352_gDNA_ID_1971875_Annot_ID_176699 3000 nt of promoter + ATG
actattccaggtatcataggattgactgacatgcaacacacttctcaatttattgtctttgcatcccagacccctttcagtatctaatctgagctgcaacgtttgtcatgttttctatggcctcttattctctttctcttatttgctgttgtagaacagcttgtgttatagcagttgcgaaggctcgtgagacgtttgaacctttccttcatcaggtgacatagatatagctacttttttctttttctttcgtggaggatggaaagcaattttactaattagttaaggtgtactgtacgtaaaaaaaaaaatgaaatataacgttatatattgaaatcatactaccattcagttttgagatttgctggaacttatttgtgcataagagttatcgagtaaacatgttctgcttacagaaactatgtttgggaatactttcatctgaaattttgttattcacatgtttctctttccatacagaaagttttttccagttctcattttcgtttgttttgcgttgatatagttaggggcgaggcttctacacattctcaagagattgcttccaatttctgtatatcttcttcaggtaggtactgttttctttggtttgacggtatcatactcatgatccctttccagcaaattttttgatgtatgttctaaatttgaatagaaagaaggtgaatatttaagtgggcatgaggtgtttctcaagcgggttgcttcagcattcaacagttttgtggagtccacagaaaaatcatgtcgtgacaagtaattctatttccaattcctgttcttaccatgtcggtgcctcctacctgtgttctagtgagctttagtgattgatcaccctttggattttatattgtttgcagatgtatggaggatttagcaagtacaactcgctatgttacatggtctcttcacaacaaggtcattgctacagccctatagctctgtttcaatccaattgagttgtgtacataccatcaagtatccgtttctgattgagtagttttcgtttctcaatgttatgtagaaccgagctggtctacgtcaattcttggactcatttggtggaacagagcataatacgacatcaggtaatgccataggatttagtcttccccaagatgcattaggtggcacaacagacaccaagtcaagatcagatgtaaagctaagccatctcgcctcaaacatcgattcaggttccagtattcagacaacagaaatgcggttggctgatcttctagatagcacactttggaaccgcaagcttgctccttcctctgagagaattgtgtacgcattggtccaacagatattccagggcatacgagagtactttctcgcctctgctgagttaaaggtttgctcctacttcagtttttactcagattcttcttgcttttaaaatgacttttcttttaaaaagtttgtatctgtgttttcttttgttctgcagttcaactgttttcttctaatgcccatcgttgataagttacctgctcttctccgggaagagttggaaaacgcatttgaagacgacctcgatagtatcttcgacatcacgaatctccggcaatcacttgatcaaaagaaacggagcacagagatcgagctcagaagggtaaaccaaactgacttctatgatcaatgtctcttttttctatttgccattggaagtatgcaggagaactaacattatgttatgtgtcatgttttggacagataaagaggataaaagagaaattcagagtgatgaatgagaagctaaactctcatgaatttgctcaaaatctaaaggctccttcggtgcagcattgagtgactcaagttcaatattgcttaattatattaggttaagaaacaatcgaagagtgagggaacatcttatgtgtactttgtatgtccaaaaacatactaaagaacgttgtcgtttcaagtgattaaggtttcgctttttggtccaatgtttgcaaatttcagttttgtagaaacgacagtcgtatcatttatttctaaataaattataatcagtaaatctaaaaggaaaaaaaaatgtcgaataaaaaataccatctagaaaattattttaaaaactatatggatgtgaaaaagaaaaaaaaaatgtaacatgtggatagaggatagctattcttggaacttagaaatatgctatttgaatcgaaagtatttatttagttaaatggttctttgattatatttctatgttcttttattagattatttacagcttgaagttttttttatgtttttaatttttatccatcactaatacacatatgacctaccctcctacccattaacctccacctaactacgagcgcattcacattttaaacactctctttctttcaaccatttcctcaaaaatataataaagaagtaaaaaataagcttaacgttttctccacgtgacaagaaccaaatgtttctccacgtgatgattatctcgtgatctaactagagtttccgattaatcttaatagtaaattaaccgaccaatttttagtcatataacttgaatattaagaaggaaactacaacttatttttgaataaacgtaaaactgatcactgagtaaaaaaaaaatcattttctttttacttctaccaagttatttttgattaataaatacgtacgtacactataatcgtaatataaaaaaaataaaaataaataaatagatgatatatacctactaaagactaaagagttaagatacgttgaagtactacaagctaatttcttttttaagaaatagaacaaagagatattatttattttcgtttaagtttattattataataaaaaacaatttgttgtaaaaatagaaaaaaaaaaaaaaaaaaaattgttgtaaacgtatatataaagagaagtattccaaagctttatagacaactcaagtttcttgcaattacctacttacaacaaagcaactcgactcgaacaaacacatccatg

SEQ ID NO: 8758 - DNA, 3000 bp, Unknown
  misc_feature (1)..( 3000): cDNA_ID_2036987_gDNA_ID_1971875_Annot_ID_176688 3000 nt of promoter + ATG
atgtatgttcgtattcatctatatacagtaatgatgtttttacccctggtccaacgtcggagacgccatggagagcttccgaccaccactcgtacggcggaacaccgagccttggaactcctgtggctttgtttacgagttgctggactttttccttaagggagagacgtgagaccaaatctttggcacgtgcttcatacgacaatgagacgttgcagaaaccatacttagccgtcgctggggcacttatgtcacacgcaaagttcttttgagactcgcaaagtgatgaaactagagctatgattagcagagagagacgcacaaatcttctaatactcatctctctgttttttttactcttatggaatagaagacagagtgaggagctagttttataggcgggaagagaagctaattagctactatttacttcattaaaattaaagtttaacatttacttccaactttaacgatgacataacatcacttgttggtgaatattttataagagaagttaaacctccatgtgatagtgtggaaggaccaaggaccatctctgtttgtcttgcatataagagtgagccaagtgttttccacaaagtgatgagaggacaaaatgtgaagtttaagaaaagggttttgaagagtggcttcaaagatactacacaaccattccaaatgtctgtttcatgtctctggtcctaaagttagagaagcagatcttctatgtctctaagttccacagttccaggagtctttttgatgtctggttggttcaccactagctgaccgcaagcgccgctaatatcctgacccatttctttgcgaattgtagtccggatcttgtatgtttccctcaggattttctggaatcttgacacgccttgtatgctgcttgtttcgaattggcttgtggatccaattggattaaatggtatcaaatttatgacctgttcaagaaaagagcacagagtttccataaaaaatatcatcagataattgcagaacctttaagagtattaagacatcgaagatttaccacttgaaatgtctttagcaattcgcctagtagatgagcgtgctgctcttgatcatttactccatcaagcattatgtactcaatgaagatcttttgttgactgttaaatccaatgacaatgtggcataatgttataatcgtcaatgtaactgaagggattgtggttttaatatttaacagcaacgaaccagtcaagagtacatgaactacctgttcttttggaaagtttgaagtgcatccataagcttttgtaaaggaaaggctctagctgctggcatgatctggcagcggatttcttgaactggtgcatggagggatactgctaaacttacaccgggtagatcattgtgtagcttgttaattgcgtgaacaattccgacctatgcaaatgacattaggatacagggaaatttatttgctaactagtaaaaaaaagtgtcaacacaggcagcattgcatgatttagatttatgcctggaatatacggtacaagcattacggaaggacaaggaaatcagaagaaaatcccaaaacaccaaaatttaaaagtaaccaactagacaaaaaaagctgaaagatgtcttggaagctgcatactgcgaggtttaatggattgaagtttatctatcagttccctttatcaaattccataatctaaagtattcctacaaaattcagtgaataagtttctctgttttacgaatgtttcaaggtagctttctgagtacttacagttgatatggtaattcttttgggcgacagctgaaatggttggtttaacatgacacgaacagcttcaacaacagcattgtagttatttaaaggttctcccattccctgatcacaatcatcaaaccaaggcaacaactggtgaataaaattcatcaatgcagagtatataaaataaataaccataaggcaaggtgcacatagtgtagataaaatgcaataacagaagcagaaatataccatgaaaacgatgttgcgtatatcagcaatgcgagaggcgtgaacaagctgctccacaatttctccagatgttaaattgcttttaaatcccatggtaccagtagcacagaatgtgcaacccatcttacaaccaacctattgataaatactttcacatcacatgtctttcattcgataaaaccaagataacattgcgtgataaaaatcaatacctgagatgaaatacataacgtagatcttatacctccaggacgtggtttccctcctaacatccccaaccgagtatcgtatctcattaccacagcttccacaaaagctccattcttcaatttcaaaaccaaaagcaagaatccaatatgagttcgtcaggaaacagagacattacaagtttttcagaatccataaaagcaatgtgttgtatacagtaacagagtatagagtacctggagcttgatgagaagctttgaggtggtgccatcggaggaatgaaatagcgagtgaagagacgaagtaagagtcttgaacttggaatggagaagagagtatgcagcggaaggcaatgaaggaatctcgtcccaaacgcaatcaggattctgaattacatacttccagatttgaatcgcgaatttagggtttattcccgctgattcaaattccgatttgatttccgaagcatcgaacaccgatttcaacttcatcgactcttccttgggaattctccgctcgccgtcgccgattttaaaagccctaaacttttaaagcaaatcccctccgtcacaacaaaaattcaaagaagaagctaaaaccggtttggtttttggtggaaaatctaaacccggtttgattttgatatttgggggaaaagtaaaaaccggtttgtcttaaccgtttttgtcctttgtggtggacgagccggaatataaattccccaattttcacttccaacattcctcagctgctcgatctctctctgatcacaacaatcataagcg

SEQ ID NO: 8759 - DNA, 784 bp, Unknown
  misc_feature (1)..( 784): cDNA_ID_2178622_gDNA_ID_1971876_Annot_ID_176713 3000 nt of promoter + ATG
gatcaaatattttgaaaatgatgaaatcttattaaaaattgaaattgatatacgacctgtccagatacaatgaagttgttaggttacaacatcagcatgtttcaaaaagggtcaagcaggtacatccaatcaatttatataacgtaaatcctgattttcagagcaatattatttgtatcttttataacctccctagttaattagtaataaaatatttaatttagtagtatcacaagatggagctttaaaagttatctttaattcccacttttgaaaatgataacgtccataaatacatttcaaaacgtttttattctcccaataagatatcaaaaagacaatatcaacaacaaaaaagacaagaaaaaaagacaaaaaataatgatagataaaatacaaaagcaaaagaaaacgtatagtattgcttagagaaagaacaaacatattgtgaattaaaaagaaaaaaaaagagggacaaaagtagaaagacgtggcaaaaagcaaactaaatttcgaccaatccacatctaaaatctaaccttcttcatcagatggaaggaagctacttcaccacccgcagattctgccatgtggcttctctctcttctacagctcacttcttctctctctgtctctctctaactacattgaaaccaaaccagagtgcttcaatgtcattgctgtgattctctttaagtccagacataactcccatatcttcttcttctgtctttttttatttctttgaaccggagaagaagaagaagaaggagaaggatatatg

SEQ ID NO: 8760 - DNA, 3000 bp, Unknown
  misc_feature (1)..( 3000): cDNA_ID_2178639_gDNA_ID_1971876_Annot_ID_176719 3000 nt of promoter + ATG
agatcaacaccttctgatgctatgagacattcgcatatcgtttttgctttattaatctacacaagcatactgaatgttatgctttataagcagatagagtagagaagaaatggaccaatcagtctaaatttaacaaaaggaaagaaaacgagatataccgtttcattttgcttgcctgaaaatccaacagcgatgtgaccaagtaacaccatgtagaaacaattaaaatcaataacaactctttgattgtgggattccagtgattttttatttttccgtgtaatggctaaatcatcccatggaagaagatcgacaatctctgtggccaataacctgctaattgcctggctcaaaaagcatggccagtcttgaatttgacatgaagcttcaacactaaggccctgtctgagcagttcgcgtagcgcggcaattgcacctcgcctcctctctgcattttctggcgtgcgtggcaggcccagtagatccaatgtgcaaggtggtgcaagctcctctagtgactcctcaatctataaatatcaattttaaccccttaaaacccaatatgctggtaaattatgcttttggacaatacgtacttatatgtgaagctcctaaacatgatgcgatttacagtaaggcatgatcatgcacttttaataattcaagccagtaacagggctaaaagtaaactcagagaagctttatatatactaatgcaagacagtagaacctgttacctgagttaacaatgcaagtttcccaagagtaactttactcttcagaaaactttgagcacgagcaagagcttcaaatccttgagagaccttgttaacctcgaaagcagccttggcaattgcacactaaatggaaaacaaacatattagagatagaagaagcagaggatagtgaaagtagataactagttcccattcttagttcatttgattttacctcagcaagtgccatagataagaatatatcatgaatatatggctttgaatcaaggttcctgagagcagcccggccaatatccagcacaagtttttcttgtccaacctgaagcatagtagcagaaagatcagtacaaaacatttgcagggataaaacgcaataaaaggtcagaagtagtacctcttgaagaaggcatagagcaccaggcaaccatgcccacggaattctgagaggagatttaggagcaatcttttcttttaggttaccagcatattctgattcaaaaagaagtttatccctaacatccatgagaagatcctacacattaagaacaaagtatcaagaaactgaagccacattccctgtccaactctagtgatactataggtcttaacctggcgagctgcagcagcttccattgtataaccctcttcagcatcagtttttttcaaatttataaccgacttaacgacctcgtctttctcagcttgctcagaaactccgataagctgcaaaatcaatacaattaacagtatcctggaataatgtctaacaaacgaaacgctacattctttacactctattgcagaaatgaactatgatacaatattaaattgccaaatcaatacatccatctcgttctacgcgctagagactacaaattggaggaaaatgtttctatttcaacaaaatttagaaggataaaaacaagttccacttgcacttcaacgaggagctaagtagcaaatcgcgagagatagtagtatctacagagattccgaaaagtaagtcagtcggagcaaaatacctggtaacacgtaaccgggagttcgattgtagaggtagatgcagcgagagaagaagtacgagacggcgcattgtcgacgacatggataccaccaccagcagcattcaacctcctccgtccttctcgctgaaaccgccgcaaagataaaccagaaccgaagaattcaccggattcagaacgaacgacgaggagacctgagatctgaagctccgggcgatctacgacgaagctggtgctgcgattggagattccgcaaagcagacaagaagaagggagaactggaaatgtgtaagctactggcattgcgcaacagctccagaaaacgaacgaaccctagaagaagtagagtgaagctggaatcatggtacaatttgttggatttcttcagaggagaaaaaatcggaaatttggtctcaaggcttttgagttttgacagtgatttttgcctttttctgaaagtttcgtcttgtgacgataataaggtaacccgctggccgaaagagaggctctgctaatctaggactagacgagacgagacgtggtcacgtgatcacgccacgtggataataaagaaacatctggaagattattttatccgtccctggacatgggcctagctctcggcccataactaatgtgcgagagaaactactgcaagctcatcgcatgctaccagtagtctagtactgatcaaaggtttaatttgtgtgtaagaaaaaacttatatataatttaaaatttgtttaaatctgatcaatatgattttttctgaatcaaatacctggaaagtatatgtctggtgtaaacttttaacttgatcagattttgtaatactttcacttaagtttaatatcatgaaaaaagatttaagatattttgtagtcattatatttttggaggatagcaaattgcaacactcaaacacatttggctatatgagaaccacgtttcctttcttgcaaatcagcacctcttttttgtcccgacttaaaaattcagaaaaataaaatgccaatttagtaaaatagagaatatttttcacaataattttgtgtgttgtacaagaaatgaggtatttcattttattttattttacttttttcctctacaagcaaaaacacacaactacacaaggataaaacctcttgccgttgggtttatttagcttctttgcaatatccttaatttcgtctccgtcagtagcagtctccgccgggaatattttttttccggtagctatg

SEQ ID NO: 8761 - DNA, 3000 bp, Unknown
  misc_feature (1)..( 3000): cDNA_ID_2178651_gDNA_ID_1971876_Annot_ID_176722 3000 nt of promoter + ATG
atccgatatattctgaagaagcaagaagatggattgtggaaattctgccaaagcgatattcaaatacagaagtgaaaatcccccagaaaaaaaagctcatcatctaactaaaggttgtagcatcaacagtagaacatgggatcatttagctaacggttgttcttgtttacctaacggtgtaggaaagtctcaggtttgtttctttattccttagtaacccacaggatttgtctttgtagattcttttgatttcaatgtgtttatggataaacaaacttcttgagtattttttttattattattgtaaagcgttactgatcaaatcaaatgttttcttaaaatagttaaaaatattaagggatctcaaaataattgttaattatggagggaaaaaaaagaaacgtcttttaagaagcccatacctgcttcacgtatcacgatggaggcttactcagaccttccactgttgagaatttgaaatttcaatttgtttgattagacacaatgattaagatttttattacataaaaagaaaaaaaaaattggagaagtataaacacatacatagcggtgaaagaagaaacccaacggtcactcaaaagcgcattgaagagtcaagcaagacttggatctgtctctttcgtttctctatctctgtttcggattcctaagagaaatggtggaatcggagctaagctatgaacagattcgtttgaatagggtggaagagaacaagaagagaatgggggagcttaatctcaacaagcttgctcaatctcttcgtgtctcttcttcttcttcttcttcttccaagccctcaccagtaacgtttcctttctcttctcttctcatttcttcttttctttttctgaaattaaccaattttttttatggaaatgtaggcaaagccaagaacgatgcgtattccagtggatttctcggaggtcaggagatcaagccgtgccaaaggtccacctccaagttataaagaggtcttttactaccatttatctttacttgagtttccttaaggatttcttaaggattttgtatgagatatgaaatttgtgggtttgatctttttgtgcaatttttcttagttataatttgcgtgagttgtttctcttttttttgaataaaaacgtgagttgtttctcattactcattatcagagttatctgatccttactcgcagtttgggctagaaccactggagaggaggccaagaaggttgaccaatccacactctctatgaatacattacttctcttacactatttgatgtttgttttcacttttcagtataagttatgtgttttgctttgcaggagctctcgaagaagagatttgctgaatcgggtatatgcttcggacgacgcaagaatgtacgcattcgacagggcagagaagctccagtcaagcttagattcagaatatgcaagctttaccaaaccaatgctccaatcacacgtgaccggaggattttggttggtaagtgaacaacttgaacattcaaagatgtctgaaactcagccatagtagtatgtaaaagtccactgatgtcatatgttttcgtaaccagggtttgccgcttcctttttgcaaggcacatatgccaaaacgtgatgtaataatgactttggttgacgaagaagaggaggaatctcaggcgaaataccttgctcagaagaacggtcttagtggaggctggcgaggtttcgccattgatcaccagttagtcgatggagatgctgtagtgtttcaccttatcgctcgaacaacgttcaaggtaaaggagttttacttagagatcttgaaatacaccctggtagagagactttggcattgatgttgaaacatattgcttgttccaggtgtatatcattagggtaaatgatgatgcaaacaatgattcagatgggaatgaggtaaatgatgatgattcagatgggaatgaagaagatcgagataatgataatgaatcaaacgagaaacagaaggaaactgtttcagaaggtagacagttgagaagcagtggtaagaggaaaagacgaggtaataatgtttcaaatctatttacctcttgactcttgtaataatatctgttcgataagataaaactaaatttgttgattgatgtgtgcaggaagaaagtagagtttgaaggtttaaatgggacttctagttctatggaaggagtgggaagatgaactaaaacttaacataacagctttttgcgagttttttggctgaacagtgaagttgtgcaatgaggggattgtttttgtgtcttgttatggagacaaacatggaacgttacggctaaatattttgattttggtaactacgattatttcatgatattttatgatttggataagggaaagagaaacaaactttaagaaaaaggttgaaagagaagtcccaccaaaccaaaaaataaatcgtaatcacacaaaaaccaaaaaactttataaccgaactaaaccaaactaaaccagataactaaatggccacctacagatttgtgtagtggaatttaagccattaaaaataaacagttttaaaattatgttgataaaccctggcttgatataataagataagggattgaagacataattcgttgagaattgacgcatttaccccttaatttatgatgtgatcaactaactaattagagcccaattaggattgagaaccggtttttgagtaaccggtacaataatagatccggttaaggaagaaagaatagaaagagacggcacttattcctccacacggtaaagcaaaagcccgtaggacgaagacgacgacgacgaaagtctactcaacttttttgcttccttctgattctctctctctccgcaatccaatcacgagaaaccttcacgtcaccatcccttagaaaaaccctaaaatctcatcaaatcccaaaatcagggtcttcgactagagattctctaatcccgcaggggaagggaacaacaaacaaacaag

SEQ ID NO: 8762 - DNA, 3000 bp, Unknown
  misc_feature (1)..( 3000): cDNA_ID_3043463_gDNA_ID_1971876_Annot_ID_176728 3000 nt of promoter + ATG
aaaactttagtttctcttataactatagtgaacacttttggtcaggctatcagattcgcatgtctaggcttgctgttaaatgcagagaggaggggaaagacaagtttacagtgtgcggagactagggagctttgcaagtgactcaggaattgctccagtgaactgattgtcctctaaatgtctgcctcatcccacaaaacaaaacggtaagtccaataatctaaatctcttgcacaacacttagaagtttggttgcaaaaaggcatacagagtttccaatctcgtcattggactcaaatctgggatcggtcctgtgagcttgttcttccccaaccatctgcaaatccggaagttgcagctgagtcttatttaacaaaaagaaaaaatctcagacaaaattttaggatgtgaagtccttacagatctttaagggcagtcatcttgtttatgcttggtggtagagacccagatagtccaagatttgtcaaatttctagcaagagaaccaggttcttggagatttagacttagtaattgacgacagctgcataaaaagcttcactagagtattgagttttgacttacagagaaatcactctggcgattttgtctttggagcaagttaggccagtccacgagttagcacgagggaggcatgggtcgccggaccaatccactggaggcttcatgatgctctctaacagatcttccatagcaattgctgcagaagagaatgtttttgttccagtggcttcagttattacaaaatagacaaaaacatgaagaagaaggaaacatttacagtaccatctttaatattagtggttccaccaagaggaagaatttgaaacacttctccggcgttaatgaaaggtccaaccggcgcatccttggccggagtcaatgtgatctgagtctgacccgataatggccactggccagagtaaaccataaccccattagtgctcacattgagcttccttaaaaaggaaagtccattgactgagacatcaaaagccctccagctcatggggcctggactccgattgtcctgaaaatacaaagctacatagtactttgtggccggaagaggaaaaggtggccattgaagctctagaggcttccctttacttgctgtgaaaccttccacaaaggcttcagcaggtggaatgttccagaagtttgacgggttaattctgcttcgagaagtcaccgtcagatgcttctggtccgaaaacggttgccataaacggttgtatttgtcatctggatagctaggtttccaacatgtaacataccatcaaaagtcaggcaagaaaaagtgcttttcagatcaccaaactatggaatcaaaaagggcacctgatgatctccccatctcctccaaagctgttcctggctatgaggctgagcttgtaggacccgaggtctgtggaattgtacattgtatcttcaagagattggacatctaaagacgatataaaaggagaggaagaaagggtatgtgcattcttggctagacaaacacttagtctgttcccaggaacaccaacaatgatctcgtaataagaactctgacccttggcgtaatcctctgacgtattcacgacgctccattttgtgcctccaatgatctgatcaaacacaggtgggttgtttttaccgtcaaagttaccgtagtagtaagtggttcgaataaggtacttggaggtctttgcgacagggaaattataacagtgttttcgcgatgacttgtcgggaaagtaacgtagtgtggagaggatcggaacgaggtctttttgcttaatggtcgtcgtatttcccacggaaatgaatccttcgtccggtgtgtattctatctcgttgaggtttgttgaagaagatgatccacaatttaagaagaaacctttcacatggaatgaaactcgacgttttagggtagtctataacaattgtaagcatggattcaagagtgtttttggaaattctgtaaatggattatcaagattcgatcgaaaatgtaaaaaaaaaaatcagaaaaataataaataagaatcgcaaaaacgaaatttacctcgaggaggagggagagcgtgagagatggagaagcataataagagaaagaagaacagagacattattgtgacgtattttgttgaagaaacagacaaagaagaagaagaagaagatcagattctttccattgtcgttaatggagatcatacaaagattgaaagtagagaaaatgtctgaaaaatgttaatttcttttttttgcaataaagttaagagttaatttaataagacatacaatatagaataagaaagcgcctgtagctcagtggatagagcgtctgtttcctaagcagaaggtcgtaggttcgacccctacctggcgcgtttttattttggccttatctattatttttcatgtaaccttttctctgtgtttcatactactttcaattatctcgattatcatctttttatacgtgaataatgcaaaaatatttgtattttcataggagagtttacaaccttttctctttgtattttcaaatgtatgaatttaaaaatattttaaatgtacaacctttgtaacaattaaatatataaagtgaaagattattgtgagttctaataagttttaacaatagtaaatggttttttttagaacgactctgtctgcaacagagtgactcggagtgaccaacgcgtcctaaaagcgttgcgtcatgttgaagcaaacccaactttattccgacgctaaccaacagattcacgaaaccctataaatacttagaaatccctaatcctcctctaaatccctaacttcttcccctacactctctcacacaattttctcgagaaattttccaatttcctttcgatttcgcccagaaatttcggtaactttcagattctgttcagaacgaagaaacttgttatttttggctacttctctccgattctgttcttcttgtagtagctgatcgcattcc

SEQ ID NO: 8763 - DNA, 3000 bp, Unknown
  misc_feature (1)..( 3000): cDNA_ID_1450412_gDNA_ID_1971876_Annot_ID_176732 3000 nt of promoter + ATG
tttaacgacggttttttggtctccaatcataattagcttgtattattttgtttttttttctttgaataatttcgtacacaatctaaatgagtgtgattcataagattatagaaatgttggtctaaaacatttgttttcattccgctcggatcagttgtattaaccataaacaactcaaaaatattgcattgtcaatcataatctcgtgaatcgcatataaacttgtaaacgataaaagatatttgaatctattatacattttcaattaaagctattcgatgtaggtgataacaaaggaaaaaaccttatgtagaattacggtcgtcgtattatcataatcgcgtatatttaagaaaaatggttgccgttgcgttatggaagtctccagatccgaccaactagaggaaaaaaactgaaatgtgttgttttccactaattttgtcctttgttgtgtccatacgatctcaaacccttaagaattagatcccccaaaccaaaacagtaacacgagacgaatcacctgatgtcacaaccgagcgtgcgtcccacgctctttggcaaggtttccacgtgtcagttttcctccgtacggtttcggacccatttgttccaccggaaacgacgggtggagagaggttcccgccatcttatggtaatcggaaaatgagctgtattgcataaaaatgagtcccacaaagtgtcacgtcatcacgtgaacacaatgcgccgactccaccagattatttcttcccctctccgcaaattatttccattttcgttgattttctatttctttttttagatcacccaattgacggcaactaccttcttaaccacaatttttttctggcagccatcgacttttgtttcgtatttaaaagtaaaaagatccatttcaaagtacaaataaaaatcttatcattccaacgtataatataacacaacttttaaaaacattatgcatgacaagggtctattacgtaaggcatattattgcaaatgacaaccattttggccagtttagaaaatgtaccagaaaaaacatattagaaattttatttttgttaacttgtgatatagttgtgataaacgttagcctataggtttaaatcagacggagacaattggtaagtgtaaggcaccgccaccgactttgtcctcataggtccatttcatttaccctcgtaatatttcattctaagattgtgacaaatatgcgtcagttttcatttgatcattgatatcatacatgtattcatctaaaatatttactagtcttaaaaatatcatagtttttttttcttatatataatgaaagatgttccaaacctttttgatgtatatatacttaagagttacattcattttatttcttgggcataaagatgtacatatattactatattattcactagtgtaaattacacgatgcaaagttttgatttctgacattgatatgtaatttagtggtttgtaatattattgatgtgtcactagtcgtattcgagtttgaaattatgatttatgcatatttttaaaagaaaagaaataaagcaatgtaaaatacacgactaatatatttcgtagtaactaagattatttcagtcaagatatttccgtataaaatgtattaaactcgaacaaagaagaaactactagatcaatctctaaagaatgctacacaaattgggcaacgtcaatcttaggttatgttactaaaagtggcaaatcccatctagaaagggattatgccttgtaaggaaatactttgtcacgagcaaaatgccatgttcttttctagatctcgatatgtaagcttcaaaagctattgatggctaatttgagatccattattcaatttgtactatacgtaattaagacacccgtaaatgttgtcatgtagaagaaactagaaacgttaaacgcatcaaatcaagaaattaaattgaaggtaatttttaacgccgcctttcaaatattcttcctaggagaggctacaagacgcgtatttctttcgaattctccaaaccattaccattttgatatataataccgacatgccgttgataaagtttgtatgcaaatcgttcattgggtatgagcaaatgccatccattggttcttgtaattaaatggtccaaaaatagtttgttcccactactagttactaatttgtatcactctgcaaaataatcatgatataaacgtatgtgctatttctaattaaaactcaaaagtaatcaatgtacaatgcagagatgaccataaaagaacattaaaacactacttccactaaatctatggggtgccttggcaaggcaattgaataaggagaatgcatcaagatgatatagaaaatgctattcagtttataacattaatgttttggcggaaaattttctatatattagacctttctgtaaaaaaaaaaaaatgatgtagaaaatgctattatgtttcaaaaatttcgcactagtataatacggaacattgtagtttacactgctcattaccatgaaaaccaaggcagtatataccaacattaataaactaaatcgcgatttctagcacccccattaattaattttactattatacattctctttgcttctcgaaataataaacttctctatatcattctacataataaataagaaagaaatcgacaagatctaaatttagatctattcagctttttcgcctgagaagccaaaattgtgaatagaagaaagcagtcgtcatcttcccacgtttggacgaaataaaacataacaataataaaataataaatcaaatatataaatccctaatttgtctttattactccacaattttctatgtgtatatatatacccacctctctcttgtgtatttgtgtatgtttttgttccctattatatcttctagcttctttcttcctcttcttccttaaaaattcatcctccaaaacattctatcatcaacgaaacatttcatattaaattaaataataatcgatg

SEQ ID NO: 8764 - DNA, 3000 bp, Unknown
  misc_feature (1)..( 3000): cDNA_ID_3043469_gDNA_ID_1971876_Annot_ID_176725 3000 nt of promoter + ATG
aatttgacaaatcttggactatctgggtctctaccaccaagcataaacaagatgactgcccttaaagatctgtaaggacttcacatcctaaaattttgtctgagattttttctttttgttaaataagactcagctgcaacttccggatttgcagatggttggggaagaacaagctcacaggaccgatcccagatttgagtccaatgacgagattggaaactctgtatgcctttttgcaaccaaacttctaagtgttgtgcaagagatttagattattggacttaccgttttgttttgtgggatgaggcagacatttagaggacaatcagttcactggagcaattcctgagtcacttgcaaagctccctagtctccgcacactgtaaacttgtctttcccctcctctctgcatttaacagcaagcctagacatgcgaatctgatagcctgaccaaaagtgttcactatagttataagagaaactaaagttttgacctgtaacacgattgcaacatcatcataactagcatcatcattgttgatgttaattgttaatctgcaggtccatcaagaacaacaagcttaaaggtacaattcctagtgtactcctccagagaaagggcctaactatccagtaagaatcataaccatgttggtaccttaaaaagaaacaccatttttcataagcattttgatgtcaaaaaatatccttacttgttgtagggcgtctcctgagaacatgccaagcacaaataataccggccaatttcgggttgctaacagctgattcaagtgctcgttaatgataaatccgattctataaactacgcggtcatctttcatggcctcgaaaattgaagtgcacagatgtcatggagaaagggttcgatcaaggaagcatctgggaacgacacttctacttttgtgagtttcttctagatgaccgtattatatccttccaaatcatggaatttaagtatttatctgtttatgttatcgaaccacctttgaacccgtagagtaacttgaaccaagaggtaaagcacacaaagataattaaatggatcgtgttacagctatcttttctcttgatgtacataagtcagactgaaacagcctaaaaacacaaacaattcctgcagttcgtggtgtctcgaggtctgatacatataaaacagaaattgcctatatggggactattggtgaaagaagaagccattatctgagcaagaatcagtagtttttgtctatacctccgatcagcttgtttgggccaaacatcccaaagaagcacttatctctcttctggttatagttttgtacgtgcaacggatacacttcaataacgaacccaagcttacatgcaaaaatgggccatattcaaggtcaagatggttcattatccaaatcttccatcacttcaatgtccgtccgagatgttatcttctgcacatatcctgcaattagtttaaacttcttaagtcaattgcatgtaaaacactaaatctaaaccaaactgcaaaactcagaaagtgtggctttgtttactttttcacaaataccaatcaagaaaccaactcatagatactctagaatcttaaaactatcataggaaaaacatggaaaaagagccacactcagaaacttacctatcccttggcagggtatgcatttgcatataacctctttaccccttttcttgtaatagctgacagttccagatccttggcaacttctacactttccagtccattcataaaccacttcccggcaatcctaaaaattggtcgggttatattgtgatcagaaaaaacaatcccaaaaaggcattctaaagcaaatactgcatcaaaaagaaaatattgcctaaacacacccaaaactggggtgaagagtaactcggagcaaatctttccgaaaaaggataattcatgtcaaaatttaattcctatcttatatcgacaagagcttgcatctatatttttcatgtttttgacacacatgcttttataaaataagtccattgttgagtttcacatttcagaaacatcattcaccttccagaatctaagcttatcgctccataagaaagaccaattaaacttaatgtcattcgtcaagctacaagatcaactcatatatttgtgcatattgattggttcgaagattaaactatagagcaaatcaaacagccaatcgtcagctaaagcaattaaaatgttcatctaaattaagtgcaagtatgttgagtcttattcaatcatcaaaattagtaaatgaaagttgaagcaaagcaaaaaacctcgactacaggatcacattgcaacctccggtcaatcacatccggcgacacaggggatgtatcaggataagtcataggaagaggaagcgcgtcgccatcatctaccaagtaactctctccacttttcgaccagagcaacctcctcttcctccacttagcaccttcaccattcccaccggcggcgacggaaacatcccgagacctcgccgtgtcagaggttgaatccgcttctcgaggtaatcggattccgtcaccaaggggaatatcagcggcggcgcggcaacggagggagcgagaaggaagacgaggaaggaaaacgagaggtctgtgagaaggcagagagcaattagggtataatcggaacattgagacgagaagtttgcaggtgcggccatgaaattgggtgaagtaatcaacctcgacgaattaaaaaaattcggatatttttgtttttgtgtgtaaatacttaaaaacttggggaaaattacaaatttacaatcttcatgaaactaactgttaggaaaaattgtagcgtcccatatactctgaaggatattttagtccttttctgataaggttattttatttcaaataatttggtttttctttgtttttgtttttggttttatttcttgccgccaaaagagttttaggattggtcaaaagcggagctctgggctcgtaggtgtaacgaaaatg

SEQ ID NO: 8765 - DNA, 3000 bp, Unknown
  misc_feature (1)..( 3000): cDNA_ID_3052858_gDNA_ID_1971876_Annot_ID_176720 3000 nt of promoter + ATG
ttaatttgacttctaacaaaccttgaattcctcaaatgtcagattaggaatatcttttggatcacctccactgtcaacaccatatgtattttctggggataaggcctaataaaagtgaaaacagtagtagctgatttcatcagaaccactatatcaaggaaattcaaatatgtctcagattatctaacaaggtttttgttccaagtgtccaaacgactctttcatgatggctatatcatttagttgattaataaggtcaaaacccaagatcaggttaaaccaacaacgagaaacttctagttatagtaagcaaaacacaatacttgcctgttgagcaattcgccctaaaatattatcaggctgtgaatagacccctttcatctcattaaaaacaacacctgaaatcaaacatcaacaatgagataggatgagtgggtatctgaagtagctgataaactaaaagatatcatcgatactaagaaaagtagaggaaaagagctctaaaatggaatcctaggtaaataaaacctttgtaagatatgtcttccgagggatcattaagttcatagtgccagccctcttgctgaaaggtgtgagcgtcatccacacacttggggaagaagacagcatccaaatatacatcgacaagattgtaaaaatcctaccatagatagtgatagtgatgagttgtgatcagaaatagactcactttagataacaataacagaaagaaagaggttagcccactgaggacaacaaaagaaggacttaatgtttggctcattgtacctttgtattggtggaagcaactgggtagcaggtcctatcaggatatgtgaatgcatttagaaaagtatgcaaacttcccttgagtagttcaacaaatggctcttttaccgggtactttcttgacccacatagaacgctatgttccagtatgtgcggaatgccagtggaatccttcctgcattaacaacgaaactatgatctaaaattgcttccattattagtttttgcaagtctttcacaaggaggtgcctgtgggaccaatatctactgaaagtgcagttgctcatatcgacttttaacaaagcgttaagtaatttgacaagttgtaacctccaaaacttagaccactttacaagtaccaatatattagaagaagaaacgaaatgactaggtctaatcagaaaaaaaaagctttgatgagtagagataaacttgaccatttcaattagttaaattcaaggagtgaagctttaggtaccaatttcaattgcctaatacatactcaggtcaaatttacagagagtaaaaattattatgaagtaaacttacggaggagttctgaaaacaacaccgaagaccttgttctcatcctcatttgacacagacatcacctcgcaaccagttttcttgtgtttgaagagtatcgcctttgatttacactctgagatgaattcttccgacactttttcaaatccaagcttctcagcctcatcttgacctacatctgaatccaaacaaccaaaaataaggaaaatcacgcatcagcagaggttacacatggctccatttgattacaaagtagacacaaagcatgagatgaaaaatgcaccacacggaccacacctatctacaattcacaacctatcctaaagtaagaaccacaatttcacaagtgccacaaatcaacatgtccgaattaagagaacaaatcaattagcaattaaacttcaaacagattgaaaaaaagaagtatatgtgaaaaattccaaccaggataaagtggagcgggttgtgtggcgacggcgcgaacagagaggcgagagaactgcccattgacactgcgaactgcggcggagggaatcctcaaacctcgtcggagcaaaagacgtctaccggcgactgagggagaggaaattcggcgaagattgcgactggggacacggagagctgccgtcgacgatgtgagagacatgtaagagcgagggaactgacgaaagaagcgaaagaatagagaggacgagctgcgcgaagctaaacaagagacggttcggagcatagctaccggaaaaaaaatattcccggcggagactgctactgacggagacgaaattaaggatattgcaaagaagctaaataaacccaacggcaagaggttttatccttgtgtagttgtgtgtttttgcttgtagaggaaaaaagtaaaataaaataaaatgaaatacctcatttcttgtacaacacacaaaattattgtgaaaaatattctctattttactaaattggcattttatttttctgaatttttaagtcgggacaaaaaagaggtgctgatttgcaagaaaggaaacgtggttctcatatagccaaatgtgtttgagtgttgcaatttgctatcctccaaaaatataatgactacaaaatatcttaaatcttttttcatgatattaaacttaagtgaaagtattacaaaatctgatcaagttaaaagtttacaccagacatatactttccaggtatttgattcagaaaaaatcatattgatcagatttaaacaaattttaaattatatataagttttttcttacacacaaattaaacctttgatcagtactagactactggtagcatgcgatgagcttgcagtagtttctctcgcacattagttatgggccgagagctaggcccatgtccagggacggataaaataatcttccagatgtttctttattatccacgtggcgtgatcacgtgaccacgtctcgtctcgtctagtcctagattagcagagcctctctttcggccagcgggttaccttattatcgtcacaagacgaaactttcagaaaaaggcaaaaatcactgtcaaaactcaaaagccttgagaccaaatttccgattttttctcctctgaagaaatccaacaaattgtaccatgattccagcttcactctacttcttctagggttcgttcgttttctggagctgttgcgca

SEQ ID NO: 8766 - DNA, 3000 bp, Unknown
  misc_feature (1)..( 3000): cDNA_ID_3043507_gDNA_ID_1971877_Annot_ID_176758 3000 nt of promoter + ATG
agaatcgtgaaacagatgctgatggatctcttaacgatctgattgagtctctggagagaaagaagaaggttcagatagctcaagtagatgaacacaaggaatatagtaataagatagttgaagcatttcgcaagttattttaagcttgattcatgatctgattcagtttcttttcactattgttgtcgagtcttaacataaaaattcacagataagtaaacttgtatcgctgcacagaacattgatgattaattaagttagtcccgtttggtttacctgtgtagattttctagtcagtttcaagatgactgcattctagtgactcttagactttctccaaagctctcctttggtgttgaatcaaagcatcactctgaatcatctcctcatctttcttgaaaagatcttccatctcgattcaaatgacgaagctgcagaaactaaacaagggaagctttcatcatccataaacatatatacattcacaaggcaatgttcaattcttagagatgaagaaagatggtaccttgacttacagaatgcaagcacaaagccatggtcttcctgtacttgaagcttttgcaccacctctgatttctccatagtgctgctttaatctaaatcaacaacaagctctttacttttcaaattccttgaaaactatgaatcaaaagctcatgccttaagcagaaacctcaatgtaaccaaaaagctcatgcctttttgaagcagaaacctaaatggtaatcaaaaagctcaacaagcactttgctttttagattccttaagatctacaagtcgaaagctcgtgcctttcgaaacagaatctaccaaaatccaatttatattcataagcatgaagggagaagagacgatgacgaaccggcgagcgaaatccgacatatgttttgatgggttcggtcgtggagagaatgagataaacggaccagaccaggaattagatttggggatctcttgcgattggatgcgaagaagaagatggactcggaacttgggtttggaaagttttcaaatttttgaaacccggagctttagagttgcagcaatggggaacgtcatcacaattctctcgccatcttcatcatcttccccataatcacatacgcagaataattcgacttgcaaaaccaagttgaaccgaaccgaaccgaaccaaaccgaagctgaaaatttaattggattaccggtttggttgggttcggaattgatttggtttaagctctgctataatgaggtatgtttataccaacaaaaaaaaggaaatacaacaatatatgaccgttaaaacatgcttaaagtaaaaaacaataaggaaattagaaagaaaaaaggaaattagaaagaagaaaggaaattaggttaacgcgttacaacaaactataatcagaaaattttgcttatataaacacaacaatacactttttgtgacatctccacaattacaattttctcaacaatctctcttccttacgaatcatcatcatctttcactctgtctctgatcagttttgttcaaatatcactcgctcgacaatggaaacagaatctttcaaactcgatgttcatgtacaagctttgtctcaagatcagtcgttagggttcgtaagtacggtactaatcagtcaatacagagaagtagaggaatttctcatcaacgagaaggatgatactgtcacaagtctcggatcttacccggaggattcttctactagtcacgacccactaatctctctgaaactcccaagtttcaaaccaaacgacgtctatcaacgtctccagacccatctccacgatcatgacttgtccgaacaattatcttacaagattgtccaagcccaacaacggcaaaaaagacaaagtttttacttgccacaacaacgacctttattcatgatcgtctctgtcaaattgacacacaaggtttacaacgttgtgtcttgtgattctgctccgttggcaacagatttcgaccaagagagccaacaagaagaagaagaggaatcgaagacttgtgccatctgtttggagaatttgttgagatcggaggattactgcgagatgcctacttgttcccattattttcatgaaccatgtctcactgagtggttgactcgagataataactcatgccctctctgtcgcaaacctgttgacaaactacacagttgactacatgtttactaaattagggttttcacttttatgttttacttgttaacttgtttcacgtttatgttttgtcgaagatgcagattagggtttttcatagtttatgtatctgtttttgttggcaactatgtaatacagtaatgattttatcaatttcatttacaagtttgatactagtatgcgacacatatctcttgcaacacaaatcactgacttaaaccaaatatagtttcaggagtaaactagatctgattcagtctctggagaggaagaagaaggttcagagagctcaaatagatgaccacaagaaatctagttacaagatagttaaagcatttcgcaagttattttaagcctgattcatggtttaacaattttagcttataagtttcgactctccataagtgttctctttggatgtgaattactaatattagatgacatgaaatcccattcaaatataagtactttgctgtttcctaatatgcccttaataacaatattaacaccacaaataagaaaacaaagaaacctcttttttctctaatccaaatgaaagaaactaaaaaagggttctaaagtacctgaaattgtttcacatgaatgatcttcaatccaatccttggaggtaaaatcgcagctgtggccatcaaaagatccctgtttcaggtatagccaaagcgaacgtcgatatcattttcgaattccaacatgaatgttttaatgaaatttgctggaaagagattggctttaaaggattctgtatacaatttgtgacagatttttgtaattttatacaaaagaacaata

SEQ ID NO: 8767 - DNA, 3000 bp, Unknown
  misc_feature (1)..( 3000): cDNA_ID_3043496_gDNA_ID_1971877_Annot_ID_176765 3000 nt of promoter + ATG
gaataaattaatatcaaaaggggatgtagctcagatggtagagcgctcgcttagcatgcgagaggtacggggatcgataccccgcatctccacttttctttttcttattttatatttataccacctcaatgtttcaataattgtatagtttgaactgtttatttgttggaatactaatgttaaaagttttaaaaaaaaatcttgttagtaaaacttgaaataaaaattacgtgttctatattttgttgtactttattagttactttacatcttcgattaattaataattcttttgtaataataaaatgtatttttgtatattatttttttaaccaggcctttcccaaaatctccttcaattttaaaacaaccatattaaataagttgaactttgaaccaaaaacataagagaactaaactcttaattttatttcactagaccaatatcttattaataaaatgtatatttgttacaaaaacaataaaaattaaaaagataattgtcctaactcctaacatcacaagtttcaacatattgaaaaaaaactcaaattcatctcttttaaaataaagctctccctttttttctacaaaagtttatgtcgccacctactaagattatcggtttcaatggctttttcagccggggtttctttgttttagtctctctaattttgatttcttatgagtttgatgttatctgaatcttattttcttccaactatttcagatctaactctataaagtctaaatcctttattcttctggatttgctgtttattttgtctccttcatccttcatctgcagctttagttccgactgttccaaccataaaggcaggttttgtcgatccttcaacgcttcaaatacatatttttcactattaaagatctcgatttccttcctttcttcataagactttggggtaagaagagccttggttttattttctttagatagatctctagtctcagatatgtttttattttttaatttaattcggacttacacttatactttagttttgaaatctttagttatgagtttgagaaatttgggttcagtatcaatgttgttgtttttttatatataattttggatttttcctcctttggatctatctttattcgagagatatcgtttgctcgtcgacttagtttttggaatgattgttttttttgctgacatatgtatttcaccatttgtattccatctctctatcaatgaaactagtgaaaaaataaataaattaactcctcacatcttgttgagtataagagatagtcatttagttggtaaggttccatttccactagaaatattcatggtatcgttataacgttattcaacaacacatattctagatgttagatttgtcttatattaaaatccataaacaaaacaccttatacatgttaccatcggtccttgtacgttcgccgcatatctccgacttctctccgccgtccactggtgactctacgctcactctaaaaatctgtttactatataaaaaaaactaaacaaaagagaggattagattcattggtctaagtctagagtcaagaacaccaccaccacctgtaatcccaacaagtttagttgcctaccgtttatcgttatctaaaacaccttaatgtttccacgtgtcatcatctcacaagaatgtcacaaaaaagcttatattcttctagatgtaacattagcataactatatcccaaaaaagtctaccctttcgtcttgtttattttaacctcaattattacctttttatacatataattatgggactatatatgaactgattaatactattttcgaatcttaaaatgagttaataaagttatcaacatacactcatactcgcttaaactaagatatcttaacatttctaagatctaaagaataatttggtgaaagagaacaccaaaatatatcatcaaattttacttagattatgttacaataaaaaaaaattaaacatgtcaattgtaaaaataacattaccaattattcttatttttcatagaaaaattttatgtaccaaaataatctattttaaaccacaaacaaaatacatattaaattattattccaactcttttttaatggtaagaaattcaaatacttgtagaagacaaccttgttttgtcatgtgttataatatctatatattaattggaaattaatttctgttaattaaataatattttttaaagagctaataaataatattcttacattcaatttattgcattgaattattaacatatggtaaaaagttcttacaaataaatatataattttttcgaaaattgttataaaaaaaactttatataattggccaaagattatattgaccaaatcaatcatcattaaatttctattcttgtacgcgtattttataacaatttaagtaagattagtgtaaacattatacaagattataagttttcataaaaataagatttgtaggcgtactttatttgttgcccaagctgaccaaattacttatctctcttactcaagctgcccaatctgcccgttgctgaccactttcactctctctctctctgaagatgccctttcgtagctctctagctctcacgcacgcaaaaaaaatctccccttttgactaaaactttctccaccaatttgttttcttttgttcttccttctcttctttgtccccaattaaggagctcaaattcacttctactgaactgggttttaccatttgcttttgatctttggtttctgttcgattttggaggaaaaaaggatcaaactttatattaagagagaattgggtttcgttgatcttcatctttctattgatttcattatctgggtttgatcaaagttttgttttttggtacataaatatgtgatcagagagagtgatctactctagggttgattcgcttgactttttttggtttttgaattattggtgtttgtgtgttggctatggtgatttgatttggaattagggttc

SEQ ID NO: 8768 - DNA, 3000 bp, Unknown
  misc_feature (1)..( 3000): cDNA_ID_3043481_gDNA_ID_1971877_Annot_ID_176769 3000 nt of promoter + ATG
cctgatgtactctaaaaaggtagacattggctcagtagcttggcaaagcatatgcttgtagtcatcaacaagcttgagcgtacacttctccacaattgtagtggtatgcagaggtgatggttctgcgttacaaaacaacgattcagatgcaaaaactagaaactgagactcaaggaatcaatttgtcgtctaaacatcagatttcagatccacaaacaacattttgttaacaagactacaaaatttcacatcgaaatttcttcaattcgcagattaaattggtgatttgggagagtttgaaatgcctaaaacccagaatcgaagtcaaattatcaaaactgagtcaaaattgtgagagacaatcaggaatcatcatcataacgcaccgttttggaggtaaggaccgtatttggtggcagagagatgcatcttgatatcgtctaggttctcacactgacatagattgttgtaatcggcggtggtgagaagcccagcacggtggcctctgacgatcgcctccaagtatcccccatggatattgaacgtaagcgcctcgaatccgtacatctttctctcctgattgtaagaaatttcagatctcaaagattatcgccggagatctgatctgaattctgaagaagaagaagaaatcgaagcagagattgtgatcgcgaagaagaagataactttgaaattgactggatttgtttgcaagctttaaaccagtatccctaaaccggtctgctaaatcgaagacacgcacacccggttaaatatttctctgtccaactttaattcattaattttctctttaaagtttaaattttaatttattgaagatctcagttcccatttctcaccaatgaaaaaaataaatgaggaatcgaaaaaaagttaaaaatatgcaaaaaaatatgtttcaattgtgaactttagaacttccaaaatatcatttaaatgttgagattgttatcgactttaaaattaaacaaaagatagtgttatcggacagtacaactctacgtacctatcttttgataatatgatctaaagtatgatatctagagaaatatctttccatgtacaaacgccttgctttggtcgactcgacttctttcatctcttcatatctagcttctcattttaatgtacctgagtgatattacggtaagtttgcaagaagtatcaattaaagagtccataagaggtctaagatagaatcttacgattaaatacatttgcccatataattaggattttagctagtagagatttctaaaaatatgtgtttagaacatcaatataatgcattttcctttcatttttataaaagtattaatcttgaatcattatgttcttggtggcaacctaagttctttcatctctttacatttttgcacagtaaaactctaatgaactatttcaatttgtagaattttctatatcattatattcaataaatttttcttaaatttttccaaattctaaaataaaatatctttgatcgaatatgttacctgaaaagttcaaactacgtttaaataaacgattgagctatgaaacctcttttactatgcccctgaataaactaggggaattaagacaaatagcactaaaaactttattattccaaaaatagcatattcttttgaaacttccaaaaatagcatataaagttttaatcctctataaattaattaaataataaaagtttttttattaccatttgtatcaatcctccaaataaaaatgagagcaaatactaatctaatattaaattgaatcaaaaaacttttaaatagtagaaatatatactctaaattggaaataaaaaaacccaaatataatattacaaactaattttaaaatgaaaaatctcttttaaatggtgaaaatatataccctaaattggaaataggaaacccaaatataataccataaactaatattaaaatgaatcaaaatttcttttaaataattgaaatatattctctaaattggaaatagagaacccaaatataatattttaaatttatttctaatttattttggttgaatagattttatataaaattgtagtattattattgtccataaaacttattttagtgctacttttaggaatttctcaaataattatttaagtgctatttatgtctaaaaaactttttcatgctatttttgtccaaaaaacttaaaagtgtgctatttgtgggagtttctcaataaagtattaccgcttctttcataaaactaatcttcaactaatttattattcatttctacttaaagtaaataaaaaataatgacaaaccatttttagtttttcaacaccatcttaatacaatctacgattttctagaggtccagataaaagaaaaaatgtagataaattcacttttctatgagttgaatcacataatctatattaccggtaatctaacacaattttggtgttctctcaaaacatataaattcgaatttgcttatccaaaaaatatcccaagcattttgtgttttgtgttggatttatttcacatatttttttgctacgaataaaaatatttaaaaaatgtaaatattccatataaataaaagtttgttgtttttcacatattagttttttatttatttattaaagataccatttggatatcaagatatttgttgcatctggattttaaagtatcagaattttattaaagtactggatttctgaaattctgtctttatatttatttattatattatatcgataaaccaaaacaaatcaaagcaaaattgagagacgaaaataattttgcagcgtacattcttcggtttaacacaccggtttaaaggacacaaccgtaattaaacgtgccaacacgagtttgcaaacaaatccaatcaattcgaagctatcttcttcttcgcgttgatctctgtatcgatttcttcttcagatctccggcgacaatcattgagatctgaatatcttacgttaaggagagaaagatg

SEQ ID NO: 8769 - DNA, 3000 bp, Unknown
  misc_feature (1)..( 3000): cDNA_ID_3043477_gDNA_ID_1971877_Annot_ID_176770 3000 nt of promoter + ATG
agtagcttggcaaagcatatgcttgtagtcatcaacaagcttaagagtacacttctccacaatggtggtggtatgcagaggtgacggttctgcattagaaaacatcagattcagatacaacaaactagcaattgtgcagacctcaagcacaacaacagtagtatttatggagatacaaatacagtgactcaaggaaccaatgtatcgtctaaccatcagatttcaaatccacttaataagatgaacaacatttctaataacatgatttccaaatgcctaaaacccagaaacctaaacgcaatgaagcaaaattcaaagtcaaatcatcaaaattcgtattacaacaactgagtcaaaatttgagacaatcagggatcatcataacgcaccgttttggagataagagccgtatttggtggcagagagatgcatcttgatatcgtctaggttctcacactgacatagattattgtaatcggcggtggtgagaagcccagcacggtggcctctaacgatcgcctccaaatatccgccatggatgttgaaggtaagcgcctcgaatccgtacatctttctctccttaacgtaagatattcagatctcaatgattgtcgccggagatctgaagaagaaatcgatacagagatcaacgcgaagaagaagatagcttcgaattgattggatttgtttgcaaactcgtgttggcacgtttaattacggttgtgtcctttaaaccggtgtgttaaaccgaagaatgtacgctgcaaaattattttcgtctctcaattttgctttgatttgttttggtttatcgatataatataataaataaatataaagacagaatttcagaaatccagtactttaataaaattctgatactttaaaatccagatgcaacaaatatcttgatatccaaatggtatctttaataaataaataaaaaactaatatgtgaaaaacaacaaacttttatttatatggaatatttacattttttaaatatttttattcgtagcaaaaaaatatgtgaaataaatccaacacaaaacacaaaatgcttgggatattttttggataagcaaattcgaatttatatgttttgagagaacaccaaaattgtgttagattaccggtaatatagattatgtgattcaactcatagaaaagtgaatttatctacattttttcttttatctggacctctagaaaatcgtagattgtattaagatggtgttgaaaaactaaaaatggtttgtcattattttttatttactttaagtagaaatgaataataaattagttgaagattagttttatgaaagaagcggtaatactttattgagaaactcccacaaatagcacacttttaagttttttggacaaaaatagcatgaaaaagttttttagacataaatagcacttaaataattatttgagaaattcctaaaagtagcactaaaataagttttatggacaataataatactacaattttatataaaatctattcaaccaaaataaattagaaataaatttaaaatattatatttgggttctctatttccaatttagagaatatatttcaattatttaaaagaaattttgattcattttaatattagtttatggtattatatttgggtttcctatttccaatttagggtatatattttcaccatttaaaagagatttttcattttaaaattagtttgtaatattatatttgggtttttttatttccaatttagagtatatatttctactatttaaaagttttttgattcaatttaatattagattagtatttgctctcatttttatttggaggattgatacaaatggtaataaaaaaacttttattatttaattaatttatagaggattaaaactttatatgctatttttggaagtttcaaaagaatatgctatttttggaataataaagtttttagtgctatttgtcttaattcccctagtttattcaggggcatagtaaaagaggtttcatagctcaatcgtttatttaaacgtagtttgaacttttcaggtaacatattcgatcaaagatattttattttagaatttggaaaaatttaagaaaaatttattgaatataatgatatagaaaattctacaaattgaaatagttcattagagttttactgtgcaaaaatgtaaagagatgaaagaacttaggttgccaccaagaacataatgattcaagattaatacttttataaaaatgaaaggaaaatgcattatattgatgttctaaacacatatttttagaaatctctactagctaaaatcctaattatatgggcaaatgtatttaatcgtaagattctatcttagacctcttatggactctttaattgatacttcttgcaaacttaccgtaatatcactcaggtacattaaaatgagaagctagatatgaagagatgaaagaagtcgagtcgaccaaagcaaggcgtttgtacatggaaagatatttctctagatatcatactttagatcatattatcaaaagataggtacgtagagttgtactgtccgataacactatcttttgtttaattttaaagtcgataacaatctcaacatttaaatgatattttggaagttctaaagttcacaattgaaacatatttttttgcatatttttaactttttttcgattcctcatttatttttttcattggtgagaaatgggaactgagatcttcaataaattaaaatttaaactttaaagagaaaattaatgaattaaagttggacagagaaatatttaaccgggtgtgcgtgtcttcgatttagcagaccggtttagggatactggtttaaagcttgcaaacaaatccagtcaatttcaaagttatcttcttcttcgcgatcacaatctctgcttcgatttcttcttcttcttcagaattcagatcagatctccggcgataatctttgagatctgaaatttcttacaatcaggagagaaag

SEQ ID NO: 8770 - DNA, 3000 bp, Unknown
  misc_feature (1)..( 3000): cDNA_ID_2105868_gDNA_ID_1971878_Annot_ID_176773 3000 nt of promoter + ATG
cgagatcctctaaaactgacaaaaatgagtttttattgtaaccctctgcctattccatattgctttgtggaaatgcttcattggatttgattctctcgaataccaacatttaagtgcaattttagtggcagtggacatatatgcgcaagtgtgcacatcttctcggcagtggatgttacagtcacttttcgagagattttcagttacatggccttcctcgatcgatgttttctaatcgttattgtgtcttctcataacaattatttcgtctagtattgctttccacctacaagctggtggtttttactcatctatgatcgatttgcttcttttcaacttaacaagtggtctttttggcatgcatgtacagagttttggaataattcatccatccattcttctttacaatatacacatgaccatgaaaaactacattttctatatcgtctattctggttctggtacaagagttcattatgaaacttctacaattctttcatatttctctatgttatgatcaacaaaaaaatttgaaacgacgacattagcattggcatgcacatgtcaaatagtaaacactgtccgatcccaactattattatatcaacaacaagttttttttttttttttttctcaaaacaacttttgtatttacatttgctaaaaacatcagattatttggtagatagaaatgtgtgattcattctttaccgcaaaaggttttgaaccgtatacgaagaatccgcggccttggccgaagaaggcggtgaatgaggcagcctagcggagaagttacgtagcggaaaacggtcgatattgtcatcctcatctcctttatcaaagttaagcgcatagctcgacggatcgtaatgaaagtcagcagtatggcggcgaatatgcttcccgtgaccgccaacgccacctactccaccgcccattcgatggatcagactcttacatttttcatgtgacttggacaacgtcctagtgagtcttggagatttggtcttcattccaccaccatgtgggctttgtgtagatttctcggtggtgaccggggatgatggtaggtcgtcgggaatgttgtcgtggtggtgatgattggtcgtacgaaaacatccggcgatgcaaaaccttgatttgagtttcttttgtagagacaagttggtcattgtttcgcttcccattttttttttacaaaaccaatgtttgttggttagatcaacaaaggaatgcaaaagagaaggaagacattgaaagaaagatcaaatctgtattagaggaaagaaaaacaaaacagaaaacaagtgatcgacgagatatttggttgattttcatttattattttttcttgaaatgaactgtttaaccaaaacttcggaggagaagttgaaattctttactattttaggaatatttgaatttccaattaaaatgaggttcaattttgtttcacgttaaatattaatgagtcttttgactttgtgagcaaggggggacatatttagggtaggaaaaataatatttatagtaatttattaaattagttaagattataaagttaaaaggataatatgaaaattttggaccaattttgatttgtgaatatagtaacggcatagctaaagcctaaaaacatttaatattaaaagacctcattggattttattttctcgactgtcacatttttgttttggcagaggtcttttatccatgtaactctattcagtatccacaaacagttttggaggatcaatatgggccttagaaatgaattaagatcatacttcactagagaatgtgcactcaaagaatgtgttgcgaggtttcatcgttaaatttgcattaaaggtaaggaacttgaagatcccatagcaaaattccatctctttggtgaagtcgttgtctagttgtcaccgaagctataaaggcatacttggaaatccttcatttgaaccaaattatttgctgccaggctgccagcagtgcctgtcttgtgaaaaatgaggctcaaaataactttttttttatgggtttatagaagaattttttttttttgagaccaaatcttaaaatgttatgaaaatgaaacctatgtattcaatagaaaatagataaaaattaaaaattgagactaaatctaaaaaatttagaaaatgaggcaacaaatatttttgaggtataattttgatactaaaaaccttaaaacttttggtggctcaatacccatgtttcttagaaatatgtcatgggccgggcctgactgccagtcaatggaaggaccatgagggtgtagataatgctatatatttgagattgtaaatatagctgataaactatatttacaacgaaaaatatttaaattctgacttagttaatgtaagtttaggcataatggaaacttttgtttataaatacgataaaataagccgtgggaaaatcgttttcgcactttcgctttaaacttttactcataattggtttgaaatttaaatcaatgaaaaaactaagttaaaactttaaattgcttcaaccttagttggttttttgtaagttcttcttatttttttcttgtttatgttagatatgatttttcatcaataaaagtagacgttaaaaaaaaaaaattacaaatcatttatataaaattgttgcattttcgaaagaatttttttatagtttccatttgatttttgtttctagaagtgtaataagaaaataaatccacttttaagttttgatgaattggataaccggtttgaacgaaacctggttttgatgaaatttttcccgacactgtaacacgataattagatttgttgagttataacattacgtgtcgaattttaattggatgtcctgcgtggccgtcttattagtcacatcaccgcagctaataacactcgacgagcgacctcatcgtctacatcgccgtcgcctgttaccgtccggtgctattctccttcacaatctcacatttttcgtaccggttagaagatg

SEQ ID NO: 8771 - DNA, 3000 bp, Unknown
  misc_feature (1)..( 3000): cDNA_ID_2730189_gDNA_ID_1971889_Annot_ID_58452 3000 nt of promoter + ATG
ttctctgttcattgttgcttttagagcttaattcatgttcctgagattcaaatttgcaacctttttcccacttatgtaagaaaaaatggctttttatatattcttcattcatggctgtgttgattaggaatctctaatctctatgtctactgttagattaattgtttggtattgatactcaaattgcatatatttaggttcttgcattggttttttatagtatcttttctgcaactgagtctttgtatttaccaaaaaaagaaaaaaactcaatctttgtggggaacttaaaggtggcactgagtaatatttgaatctcattgctgcagttttgtcttgaggtttatctggaaaaaagatggaagtttgcggggatctgaaatctgataacttaaagaaccgccccttgactccgcttaggattctgaggggcttgatgatcctgctggtgtttctgtctactgcttttatgtttctgctgtactttgcaccaatagctgctctaggtctacggcttctgagtgtgcaacaatctagaaaagttgtttcgttaatctttggtctctggttagctttgtggccttacctgtttgaaacggttaacgggacaactgtggtgttctctggagacatcattccggttgagaaacgtgttttgcttattgcaaatcacaggacggaggtggattggatgtatctgtggaatattgccttgagaaaaggctgtcttggctacatcaaatacgtgctcaagagcagcttgatgaaattacctatttttggttggggctttcatgttttggaatttatcccggtggagaggaagcgggaggtcgacgaacctgttttgcttcaaatgctttcatcttttaaggatcctcaagaacccttatggcttgctctattccctgaaggaaccgatttcacgtactatatgctccctatctgatttaactgctctagatatattagctaatacattattaatctgaatcttcgaagatatctttcagtttctctttggtaggatatttaacaccatgcgcatctgtcttgcaaatatcttaaaccagtcaccctcatttacaataatttgcctgctattgcatgaatgtttgaaatgctgctcttagtatatcttctttctattactgagaccttccttatttgatatgcagtgaagagaaatgcaagagaagccaaaagtttgcagctgaagttggtcttccagcactatcaaacgtacttctaccaaaaacaaggggttttggcgtttgcttagaagttcttcataactctttggatgcaggtatggttcatgaaattttgttacaaatgttggtgtacatatagtagtatctcaagccacatgttatgcaaacacttatgtgttttgacgacattatgatggcgtgcatatcttctatttttccaatgacccatgtgggacctcatgaccacaattaactgaacaaggcatttccttttattgcaatgcagtatatgatttgactatcgcatataaacctcgctgcccatctttcatggacaatgtattcgggacggatccttcagaagtacatatccacgttcggcgagttctactaaaggagattccagcaaacgaggcagaatcttctgcttggttaatggattcatttaagttgaaggacaaactgctatccgatttcaatgctcaggggaaattccccaatcaaagaccagaagaagaactctctgttctcaagtgcattgcaacatttgcaggggtaatatctttgacagtagtgttcatatatctgaccttgtattcacatagctgtttcaaagtatatgcttgtctaagcggcacatatttaacttttgctacatattacaagttccaaccctcacctggctgttttagagaagattcttgtaaagttaaaaaccattaactttgttgtaaatacaattctttctttgtatacaaagaaataatattacaggcagaaaatatctctgggatgcctttttcattgtaagttctttgatcttcagttagttaaaattgtattccatgttgttctcttgaaagttgaaactcacatagatagtttgtgtagtctttagtcacattttggttatgtcaaattgtttgagtcttgcaagtgccactgttagcacttttcattcaaaactgtcacggagcaaacagaatttggaaggaaaagttgatatgttggaactgtagaactcttgtgtttattgagttagaaacaacaacaggtcactaaaccatcttgtcaaaaggtgttcttacttctgaatcagtcaagtaaaggaagtttccatctgagcaaaactttgtcggtgatcgacaaagcatagtagaacccactttgtcccaaaagaatgttaccttctttttgcaggtgatgaaaaagagagtaagaaggccgttgctcagcaccctttcactgatacattggatcatctttttcaggtagagcatagcatctcctgttttctttatatgcatatctataacttgtccacgtgtcatcttatctctttatatgagtaggtgcagatgagctcaggttagttttgactaaaccaactttcatgaactttctttacttttttggttgggaaagatttgagaggcacaaaacaaaacaatgtctattgatacatttctcttaggacaatacaagctcatgtagaattgtaattctatatctaaccacacaaagacacatgtacaattgtaatcgataactatgagacataatcttctttttattaacgcaagaaaaaaaaaatcatcaaggcaaataaatgttacactgacaaagaaaatgggctaacagagtaggcacagaaaattataattaattgaagttgataaccctaactttaaacctctgagtctccagcacttataaatagagaatcggtgccagagattcatcatcatccacatcacataaacacaaaatccggtttttaataatg

SEQ ID NO: 8772 - DNA, 3000 bp, Unknown
  misc_feature (1)..( 3000): cDNA_ID_4266408_gDNA_ID_1971889_Annot_ID_58457 3000 nt of promoter + ATG
agtaacgctataccacgaatccatgagacaattgttaaaaaactgaagttttaacccttcttaaaacagtatattaataatattttaaaattttataaatattgattcaaatacatccaccatataacccaattccaaaataaaacccgttctgtaatttctttacctgtcccgtgattttttttaaagtagtaatttttaaaatttaagaattatttattatatataagagttttataaattgcatcattctctaatacatttatattttatagtttaattttatatatagtaacattatacataccacataattttttggttttatataaccttttctaaattaggatgatttgatatgtttaatattagtggtcttaaaaaataataaattaaagatttaacccgtattgtgaattaattatattttacctttttattattgttgattcaaaaccccatttctccaaatctgtcttgccaaaaagccatttatttaataatattaattttatttatgatatgactctaattataatctaaatattttagctaataacataggagtgcaccatatttatttaataggagaatgtaccatatgacccgaatgcacttttaccaaaatccaccaaaaagtcttgcaaaaatactatagagataagaaacgatagtcggttttgataggtataagattaacaaatatattaattagcttaaattagttaaagagtacaaattgaaaagttatattacactttattcgaatatattatcaaaacttatataacagagagatttgataaaattgtaattgttgaatactttttttttgtgctaatttttatgtaattaagatttaattgatttcgtatataaaatattaaattgttttacgaacttatttgtttatatttggtaagagataaatatttgaatattcggtatattttgattcagtttagaaaatctttgatgacccgtctttagatccaataagccctataattaagaaatgaatattgtcgttaaatgaattttggtaaccttaataacgtcattaaaagattttgtttttgattaaatttttctaatatcattgtcatgtaattaattacaaaaattaaggttacatttcaaatgtactttccaaaataatataataggatttctttgggtacaaggtgaccaatgatcatctagaatcccgcaaccgtcaaaatcacaagttttagcgtaaacagtttatggattgtttgactttaataattggacaaatgttgtaaacaataatcactactacgtgttttaacgttaggttgggcatttttcaagtaacaatgaaactaatttatttattttggtagggataaaacaaaatttaatgcaatgttcaatatgtattagtattgtttttgatcgagtactaaaattctgtaattcgttcacttaatttaaaggtatagaatcataaaacgataattatttttggtaaacaaaactattagtcaaaagtcaaaactgacatttaatttgaattgaaaccaaggaaataaactaattttatttaaattatgttattaaatctttaaaaatcatctgataattacatgaaggaagcttggtcagccataagaagaataacaacttttttccttttttttttgttttgttaatccgttagtatataaacaacagtattcctagtttctttcaccgactcttctaatctctgcgatcgtacatcagaaacctctatctcatcgccgaggtaaatctttcagacgctgtcccttctcgtaaaaatcgaaactttgaatcaaatctacgtgaaatttttgtatttctctgcatgtttgatcaattctatatgaaaccgcgtttaagggttttagagtttttcatctcattcgttaatttcattgcatgtgtgcaggaaaaaagatcttacaatggctattaacaccatcacgaacgaagaagatgatgcatcaaacaactttggatgcaatatctgtcttgaattggcaagagaaccgatcgtgactctatgtggtcatttgttctgttggccttgtctctacaagtggctccattaccattctaaatcaaatcattgtcctgtttgtaaagctttggttaaggaagatactttggttcctttgtatggaatgggtaagccatcttctgatccgagatcgaaactcaatagtggtgttactgtccctaatcgaccagctgcgactaggactgaaacagctcgacctcgtcttgaacaaagacatcatgggtctagtttctttggtgggcattcaagttttgctgccatgccaactggtttacggttttcaaatttcttgttgtaatggaaagtatcttttgatgaatctgagtctgtttttttgacaatgtttttgaaactattattatacattgtctacgatttttgttattttgacaattaatgtttagagctacttttacattcttataaaaaatttgcatctgcttgtaatatttgattctccaatcttccgctttgtgaaaaatcgtcataagcttgttctcgtgctacatctgcagattgatcaacatgaatgctgattatagtatatgatccttaatatatgattatcgcacagatgaatttaaagcttcacatttaatcgtgtaatttggagtagatggcaaaagaacatggaaattaactaaatgacaatgatgtgatgtaaatttttgttttgaccattttgtttttgttaacatatgtaacgaatctacacagagtatttgtgttttcaagctccttgttaagcccaatgaaggtttttaatgggctctaatgggccgattcaataagttggaaagctcatgaagcgagagggaccgtgcctaatctcatcttcactctgctcgttatcttcttcctttttacctgttcaacgaaactcctgagctcagcttcactttgctcgacgttatcttcttcgttcagcgaca

SEQ ID NO: 8773 - DNA, 3000 bp, Unknown
  misc_feature (1)..( 3000): cDNA_ID_1989222_gDNA_ID_1971889_Annot_ID_58458 3000 nt of promoter + ATG
cactggacgacgtaagtgcgcaatcgctagagttgttcttcaggaaggtactgggaaggttatcatcaactatcgtgatgccaaggtaaatttatttctaatttcattatcttattggcttttacactgttgcttagtcgcttgatgtgtttgcttaggccttgaatttggagtttatacagctgagaattgactactcatatgagattaagatttgaacttgaaattggtattttaacagctaaagctatgaaagcagtccacttacccccgtttgaacatattcttggtttatatgaatatctgatacctgcaagagactgacatcatgcatagtgtgtaatcgattgaagcatttagtagtataaattgtagcagtttgtaggagagaaagtcttgacctttatgaagatattctctgttatgtagggtatactagtcttgtgatcaaactgtatctttatgtacttctttttgatagatgagttatatcagcgcgttacagattaagttgaaactggaagaactctctgaacaaatagtttatatgatgaattctaggctatttagactttagactaggataagtggctgagaaagtgatcaaactgtatcggtattagtcttgtgatcagacgttatctgtatgtagttctttgtgacctgggagctgcatcagcacgttatagattaaggtgaaactggaagaaatttctgaacaaatagttcatatgataaattctaggctgtttagacttaggataagtggctgagaaagtgttaacaaggagagattatgataaaagtttggggggttttgacaagctgttttgttgtgaatgggaaagatttgaatccatacgtatattgctgatgatgatcattgtaaacctttttcaggagtaccttcagggaaatccattgtggcttcagtatgttaaagtaccattggtgactttaggatatgagaatagctacgacatatttgtgaaagcccatggaggcggtctctcaggtcaagctcaagcaattaccttgggagtcgcacgtgcactcctgaaggtaagtgcagaccacagatcgcctttgaagaaggaaggtttgctcactagagatgcgagagtggttgaaagaaagaaggccgggctcaagaaggcgcgtaaagccccacaattctccaagcgttaagagttttacatatcattggatcaactcttcaagtagactcctctgcctccattttttttaaaaacttttcttgtctattatcggtcttttgtttcatgttaatgtttatgtgtagacgaactaatacaatctctgttttgtttgaatggaacgcaaagttgatatgcttttgtaacaaatgcacttatgaattgtgatcagacaaatgcacttctgaatcgtttatcagttagatttcaggtgaaagtgaaaactttgcttctttcaaaaggtgttcatggatagtggataagcagcaatacctgaacacacttgtatcactttgtgtatctatctaattcctttgatattgaagtagtaatgttgattttgatgggctcataccgaacgaatcagaaatcgacaagtgtgagatagtatgtatgtgtgcataaaataggctggtttagctgggaatggtgatgcgaaaatggaatgttaggtatgagagagcttacccactttgactctttccatgcatattcgcttgctcccctctttcctgcttcctctgttttcttttattccatttccatcacttaaaaacaaaacaaaaaacctgaactcttgggttggatttcaaaccaacataaaccaattctctaatacaacttggtttgatacaatattagagctacttgatgtgtgtaatgtttcgatcagtaggaaaaacaaatcacgtgtatcctatcaaacttttgattatacacaagtcaaaagagacattcattgtgtgaatttaatgaatttgaggggtctattatatttattagtcagctttaacgtatcaaatccatgacttttatcaatgttttttcttcttttctttctggatctacttcccaataccatcaccggaccggaccacttgatgatcttcctatttatgaacactactactagtaaactcatgtataaaatacgtactttatacgtgtatttctgaagattagtcacttcaaaaaatcatgagagtaataaatgttaaaaaaaaaaacagtggcgctcctttgccatatcactatcccaagtctgtaacacttcactgccacaaaaacaaaaaacaagtaatccaaaataaaataatgattttccaagtgtccttccttcgattaaaccgaggtcaccaaatctgtgtatgtaacaaaaattgtagtggaacatattgaatcagcagcgttactgtataattattttttgattatatcattacatcaacataaattatgatttcctatcattctgtgaaattactgttttcaattttgtgatttgtacttgaaaactaaacctaataaaagaaaataagttaggaatattttgttttttagttttgaaaagtggggctattttttgataaaatatcatcaactttaacaaaaatagataaaaaggttatagtatatattttttagttacaaaattgagattgagataaaaataaataaaatttaatggtcatcgataatattgagatttgaagtgtcgattggtatttgtatagtgttgtatctctctctctctctctctgtctgtttgtttcagagaaggatttttggcgtctccacgcacgatttaacgcatcgaagctctctgcacgcttcctgaaagagagagagaagagagagatcgcagatcgatttctcttaaatctctcgtgaatcccatttgccttctctctgctagattctctcttcttctcttcacccatttctcgctttctcctttgttctctcatctgggttcttctcaaagcctcttcctttttatgcc

SEQ ID NO: 8774 - DNA, 3000 bp, Unknown; identical to SEQ ID NO: 8771
  misc_feature (1)..( 3000): cDNA_ID_2730189_gDNA_ID_1971889_Annot_ID_176800 3000 nt of promoter + ATG

SEQ ID NO: 8775 - DNA, 3000 bp, Unknown
  misc_feature (1)..( 3000): cDNA_ID_4266404_gDNA_ID_1971889_Annot_ID_58460 3000 nt of promoter + ATG
agtaacaaacgattttcccaaaatggaaattgattattgaatctaagggagactgttcttacacaaggttgtgtcacaagttcattagtagtggctatctcgagcaaagtataatgaaagttagtagtggccactggccttcaattcaattattgctccatcttgagaagtgggattaaaagaaggtaactttttttaacttatttggaaaacagaatgcgtaaacaaaagagatagctactgctctaaatagtgttcatgtatgaaacttctgttttggttccacctttcttcttctacgaatctcaagttatgatcaacagacgactcgcttctttcttcaaaacagtgagtcatatacttgcttcttaacttcttaattagtgtccgcatcaaaaatgtcatgagcctaaccattgatgcaaacatttataataacaatacttatgtgtgtccgattcaacgcccaataatctctaaaatacaaaagaagaagtagtcttaaaattctagaaacagaagtcgcgacgaaaatctcagtatttaaaacaaacgtgcctaaacaaatagagataatcattcagatataatgcaaaaagacaaaagagagttgaattaaatcacgtggaaaacaaggaacacgacaaagcagaacagtctcactattcccgcgttagccactcaatacaatccgccacgtgtcccatcttcacgcgccagtcagcgttgatcttcttcctcacttgccacttccacttcttcatatataaatcccacacagccgcaaattcgaaatcaaccagatataacagaattaacctacacaactgaaactcgagttaagaaccggaaacagaatccaattcaaccaaaccgaatcgaaccgaaccggagtttttatccaatggtgaagcaagcgatgaaggaagaggagaagaagagaaacacggcgatgcagtcaaagtacaaaggagtgaggaagaggaaatggggaaaatgggtatcggagatcagacttccacacagcagagaacgaatttggttaggctcttacgacactcccgagaaggcggcgcgtgctttcgacgccgctcaattttgtctccgcggcggcgatgctaatttcaatttccctaataatccaccgtcgatctccgtagaaaagtcgttgacgcctccggagattcaggaagctgctgctagattcgctaacacattccaagacattgtcaagggagaagaagaatcgggtttagtacccggatccgagatccgaccagagtctccttctacatctgcatctgttgctacatcgacggtggattatgatttttcgtttttggatttgcttccgatgaatttcgggtttgattccttctccgacgacttctctggcttctccggtggtgatcgatttacagagattttacccatcgaagattacggaggagagagtttattagatgaatctttgattctttgggatttttgaattcccaaacataatatttttttagagcgaactgtgagattttccttggagtcatggagaaatctggagattttttgtaacacggagctccaatgacccgggaatttctttcgtttcggatccgaatttgatgtggatcatattcacacctatattttttcatttttttgttgtaaagaaaaatcggataagattctagtaataaatgttaaaagtccatttcattattctgaagaatatccttcgaacacgatgagtttggaagattatattatccggcccaaaatcttatagttgggccttagtcattaaacatttttctcagcccattgttttaaaaattgattttcgtgataaagtagttaacttaagtgaagtacgaaggttcccttggcctaattaaaacacaagggggtttctataaatgaaatatgataaaatatcttccaagcatttcgatagtattgatgacaattacaaagttcaacatcaataagtcaagaaattaggattggaaatcaaggaagagaaacggtcttcaaagaaaatagaattgaatcgagaaaaatatcagtaatcggaaaaaaaaatgaaaaaaaattggggtggataagattcccatcattttcaaattgccacctgattttcggcttaaataagaaaaaccatcactttcaatataaaccactatttcattcgagacaaaataaaaaagaaaaaataaaaaccactagctaaactaatactaataatctaggtgctaataaatactagaaaacaatccacatttcaagtatagatgaattggtctattaatataaaatacggtgaattaaaaaataacacaattaaatttacataaaatttaaaaatatatatcaggtacatcacagaatatatttttacattagagaaagtcttggattcccaataatataaaacaaaatatcagaaaaagacatttgaattcttgatgtgggtcctcacggtcctaccacactccaatgaaatgcttaaaaaaaaagaagaaaaggaatcattacataagaaaagaaaaaataatatctgagcctgctcatatcaataattgtgtatatatagaattatatagatgatgtcgataaaagaaaccaaacaagataaataaatacaaaaataataatggtgatggtgggccgttctataaacttcaatcattaatcatagcacacaaaattccaaacttgagaaatataatcagtgggctaaactctaaagtctctctacctttctccatctccttcttcttcttctatcagattctttctttcctattacctttgccttcttcttcttcctttcctctttctctatcttcctctcaattcttttactgtttattttctttgtaatcaacaacagtttaactcttcttcttcttttctttatcaagaacagtagtttctcaattcttgattatgatactaagcaagagacctcatctaatgatccgtaaattgtctgagatg

SEQ ID NO: 8776 - DNA, 3000 bp, Unknown
  misc_feature (1)..( 3000): cDNA_ID_1394832_gDNA_ID_1971889_Annot_ID_58462 3000 nt of promoter + ATG
agtattagtttagctagtggtttttattttttcttttttattttgtctcgaatgaaatagtggtttatattgaaagtgatggtttttcttatttaagccgaaaatcaggtggcaatttgaaaatgatgggaatcttatccaccccaattttttttcatttttttttccgattactgatatttttctcgattcaattctattttctttgaagaccgtttctcttccttgatttccaatcctaatttcttgacttattgatgttgaactttgtaattgtcatcaatactatcgaaatgcttggaagatattttatcatatttcatttatagaaacccccttgtgttttaattaggccaagggaaccttcgtacttcacttaagttaactactttatcacgaaaatcaatttttaaaacaatgggctgagaaaaatgtttaatgactaaggcccaactataagattttgggccggataatataatcttccaaactcatcgtgttcgaaggatattcttcagaataatgaaatggacttttaacatttattactagaatcttatccgatttttctttacaacaaaaaaatgaaaaaatataggtgtgaatatgatccacatcaaattcggatccgaaacgaaagaaattcccgggtcattggagctccgtgttacaaaaaatctccagatttctccatgactccaaggaaaatctcacagttcgctctaaaaaaatattatgtttgggaattcaaaaatcccaaagaatcaaagattcatctaataaactctctcctccgtaatcttcgatgggtaaaatctctgtaaatcgatcaccaccggagaagccagagaagtcgtcggagaaggaatcaaacccgaaattcatcggaagcaaatccaaaaacgaaaaatcataatccaccgtcgatgtagcaacagatgcagatgtagaaggagactctggtcggatctcggatccgggtactaaacccgattcttcttctcccttgacaatgtcttggaatgtgttagcgaatctagcagcagcttcctgaatctccggaggcgtcaacgacttttctacggagatcgacggtggattattagggaaattgaaattagcatcgccgccgcggagacaaaattgagcggcgtcgaaagcacgcgccgccttctcgggagtgtcgtaagagcctaaccaaattcgttctctgctgtgtggaagtctgatctccgatacccattttccccatttcctcttcctcactcctttgtactttgactgcatcgccgtgtttctcttcttctcctcttccttcatcgcttgcttcaccattggataaaaactccggttcggttcgattcggtttggttgaattggattctgtttccggttcttaactcgagtttcagttgtgtaggttaattctgttatatctggttgatttcgaatttgcggctgtgtgggatttatatatgaagaagtggaagtggcaagtgaggaagaagatcaacgctgactggcgcgtgaagatgggacacgtggcggattgtattgagtggctaacgcgggaatagtgagactgttctgctttgtcgtgttccttgttttccacgtgatttaattcaactctcttttgtctttttgcattatatctgaatgattatctctatttgtttaggcacgtttgttttaaatactgagattttcgtcgcgacttctgtttctagaattttaagactacttcttcttttgtattttagagattattgggcgttgaatcggacacacataagtattgttattataaatgtttgcatcaatggttaggctcatgacatttttgatgcggacactaattaagaagttaagaagcaagtatatgactcactgttttgaagaaagaagcgagtcgtctgttgatcataacttgagattcgtagaagaagaaaggtggaaccaaaacagaagtttcatacatgaacactatttagagcagtagctatctcttttgtttacgcattctgttttccaaataagttaaaaaaagttaccttcttttaatcccacttctcaagatggagcaataattgaattgaaggccagtggccactactaactttcattatactttgctcgagatagccactactaatgaacttgtgacacaaccttgtgtaagaacagtctcccttagattcaataatcaatttccattttgggaaaatcgtttgttactattatttatttgttcagaacccacggaacagattgcccccaaccctccgagttaccaactttataggttttcgctgagcaacaacatcccattagaacggtgaagctcatcatcatgagcatgaaggagaagattcttgttgttgtggtcgccattatcgatcaaaagatcacaaattaagaaaatcgaagaaggaagattgaggaatataagtcgatgagttatttgagtattgatgaggaaaacaaagactatacgaactctctatttataaggtttacggaacctaatccttgccggtttaggattttactcaacgtttggaatatattacatgtttatttcctttttcaattttgattcacctcttatcttgcaaaaaaacaaaacaaaaaagtgacgtttaaagatctctaatccttttctaattaactttgtgtatgatttttagttcttctaatttctatatatttttgttcataatatgaaaatttgatctctgttttaattattttggaactaaatacacatttttaattagattagtaaaagagttataattaaaaaaagttgatctggttggtgtcagcagaacaaggaaaaaagagaggctttttcgttttgatcctcctactcttcttcattagtgaaagctacttataaagtccaaatcttgaagtgcgtgcacggtgcaccacgaatccacgatccagtgagcagcagcaactccatctccggagctctagattcagataagaaca

SEQ ID NO: 8777 - DNA, 3000 bp, Unknown
  misc_feature (1)..( 3000): cDNA_ID_2037321_gDNA_ID_1971889_Annot_ID_58463 3000 nt of promoter + ATG
catggttctaaattcagtacttgtttggagcttgctgatatttgtcgagaagttggtcttcctcctggggtcctcaatgttttgactggtttcggttcggaagctggtgctcctttggcatcacatcctggcgtggacaaggtattggtctttgagaatacagtaaacataagtcccaacaaaattaactctaaaggctatgattaaacattcagtttaacgtctgcgtttcttaaacgcttcaatgctaagttatgatttcgttgcagattgcatttactggaagtttcgccacaggaagtaaggtcatgacagccgctgctcagttggtgaaggtaattccaatttttgaactttctgctgtatattccttctcctccttttgtttcatcaccaatgtcaatgacacattactcatggcattgttgcagcctgtttctatggaacttggtgggaagagccctctcattgtgtttgatgacgttgatcttgataaaggtgaatgtcacaaaaagtagtttagtggatttggagtttttttataataacttcttcttgtgctatattcaagatagtactaatgcttttgttgctttgagacgagtagacatgacttaaatttgcttaatcttaaaattaaactctttgtatgttttgacgccggcaaatgatagctgctgaatgggctcttttcggttgcttctggacaaatggtcaaatctgcagtgcaacttcccgccttcttgttcacgtaagtcccaatcttctacttgctttaaggttttacctgatcttcccaatatgacatgcgaatatttattactggagaagtgaatgttccaagtcatacgggaagatgtttccattaaggtcaatgacaatgacatttatttcagatcaaaccttctggtggatatgccaacagggatacaattgctgactctcttgtctaaatttttttattttatatcttaggaaagcatcgcatctgagttcatagagaagcttgtaaaatggagcaagaacattaaaatttcagaccccatggaagaaggatgcaggcttggtcctgtagttagcaaaggacaggtaaaatcccagtgatcgttttttctgtcttcatattatttgtcaatttcccatcaggttgcaatacaacaaccaggactaaaaaggaaaagagaattgagttctgtagtatagtgattaacttttgtccctctaattctgaaccgtttagcttttagagcatcaatcaaatcacatctagcatatgatatttcatcacgcttatcatgttcttacttggtaggtgtgcttttcttctatgatcatataatctgattgagctgacaaatgtaaatattacagtacgagaagatattgaagtttatctcaacggccaagagtgaaggagcaacgatcttgcatggtggttcccgacctgaggtattacatctccctcccttacctatccttgatgcagtttcttccagactatgatgatgaccttttatatcatatctatatttcacagcatctggaaaagggcttcttcattgaaccaaccatcataactgatgtaaccacttcaatgcaaatatggagagaagaagttttcgggcctgttctttgcgtgaaaacatttgccagtgaggacgaggcaattgagctagcaaatgactctcagtaagttaacgtttctccagaaagtgaaatctgatcaaatcccatccgctgacactggtgtttaaatcaaatttatcatttaagatcttatgtggctgaaaattattcattgattaatgacagttacggactaggagctgcagtgatatctaatgacacagaaagatgtgaccgtataagcgaggttagtaccggtttcttgaaccattcagatttgtttttaatgcctagcaagtgaaataacaataccatcaaataacacaaacaattggtgtctactttgttaggcctttgaagctgggattgtctggattaactgctcgcagccttgctttacccaagccccatggggtggtgtcaaacgcagtgggtttggacgagaacttggagaatggtacatttctttttctatctcgaatcttgtttttaaaagactatatcttgatggcttgtactgaacaaatcttggttatggctggtttcttgcgtgcttcaggggacttgataactacttgagtgtgaagcaagtgactctctacacttcaaacgatccctggggatggtacaaatctcccaactaagtaatgaatacattgtcatggaaatggaaaccaaaccaaatgctgtctgttcaaatctttgtgcttttattatcagtctgtctagttcggtcctgaaactcttttgtaaaacctgttgaatttataatgaataaaagatgctttgctgataattattggttgttctataaaggccagtattgaggcaccattttaggctctggtgcagcagtatcaagaacatgaaccattttatgtcaccttcaagtcacatcaaagttaaaactcacatggcaatcaattccaaatcataacttttttttttactataattgcttgaaataaacattttatgagatctgaagatttgtggattttttttccattttttaaatagtaaaatgtttggcaaccaaatctgaaaaagaggtaaagacgagaggtctcgcgcttatccttaaaggactgtggtgaatggtgagtgtgacttggagggaccccatcaccgcaacaatacagcttcttagatctcgataaccacaactaacctgtcacagtttcgattagatcttctcaaaaacttcacctttttttgtttttccagtttctcagaggagatcttccttcaaagctcaaatccttttgtctgaattgtgatactgctgtccccatttttctgcaagttgggaaatttctgtcaaagttttgtgggtctgttaaaaagatctgagctttgaacatggggagctca

SEQ ID NO: 8778 - DNA, 3000 bp, Unknown
  misc_feature (1)..( 3000): cDNA_ID_1989792_gDNA_ID_1971889_Annot_ID_58466 3000 nt of promoter + ATG
tagctatggcggcggaatctgccggcggtggtttgagattggctccggcggccgaagtacatagcgatttgctaaaaagacgtttcatcgattggtttgttttattttgttttgaaaaaagtctttttaagtgacttcttgggtaatttggtgtagttgtatcacatttgtttaccgctaaataatgttttaaccgttttatggaacgtttctttctttttcagattgtacagagttagttggtttatgggtctaattgggcattctttggaaatggtctcacaagacattgtggagttcaaagaagagttcgacgattctcacaaaccaaacagcagagtcgattgctaaccaggcctttccatctaaaacatattggttataattgatgcattgcggtaggagtatagcgtatccgttgtaattgattatgaaaataataccaaagcgattaaaaagatactttcaccgcaccgttctttctatccgttactttataccacttttaattatttacatatcgttaaccgctttctctatctgcttaaatttttgtaccgttttatgttattaatcaaaccttgaatggatatgtttgtttttgtaatggtgtccaccaaagtttatttgatgagttacaaaaataattatattttaaagttttgagaaaaaaaatcatgtttgtgaactttcaattgattcacctcatgaagattttataagttctatatagattttgtgaatcttcaaaagtacaaatatatgtactctttttccaacataaatgtagtgaaaattttattttatgtgaaagaatgaaaagaaaccaagtgaaagaaattaatagacagtacatgtaattactgaatacgaaagataaaaagagaggagagtagtcattgtcagatagaaagaaagagcagacaaaaggatcgtaaaatcaaagaaaattgggtccctaaaaagattatgaccgtgaagacacaatattacgttttctgacaagacataaacacatcactcatcgcctttagattctcttccgaccctcacaagatcttaacaacaacaacaacaacatcaagatccgatcctccagattctcttctgtgtatttccttaaatctcctcctctttctctttcctatttatttatgtatctcactcaccgcttctgcctctctctctctctctctcttatttatgtaactcctcgtcttccttcttcacattgatttctgcgtcctttgacgttcaaactttaaacgtttcttcatctgttttgttgtttactttcccgagagaaaacaatggctctcagagatttatcttcttctttatcttcttcttcttcaccggagttacatgttcttgccgttgatgatagtttcgtggatcgtaaagttattgagagattgcttaagatctctgcttgtaaaggtaaaaggcaaaactgtttctctttacgttttctgcttttcttttgtttggtttctgattcgtttttttggataaatttggtgggtttctttatatagtgacgactgttgagagtgggactagggctctgcagtatcttggtttagatggagacaatggatcttctggtcttaaggtatatattcattcatttcttagaatctctctgttttctagcaaaatcaaccctagacgttgaaacttgaagtgttcttatgctggtttggctcccaagaaatctaaggtttcacaatgtggatcaaaagtttaacctttagaggatgattttattatttgtttattgatgccgtttatatgaacaattttgcaaattttgataacaggatttgaaagtgaacttgatagtgacggattattcaatgccgggactaacaggatatgaactcctcaagaagatcaaagtaaatttctattttgtgtcatttattagagcaagatttgaataagctcttctcgtgttttccttacaaaaattctgttgtatatttgccaggagtcttcagcactcagagaaatcccagtagtgataatgtcttctgagaacatacaacctcgtatagaacagtaagtcactatagctaaagatacaaaactgaatcaatggatcttaacactgtaatctgatttttttgtctatcctctcttttgttgttgttgttgttgtagatgtatgatagaaggagcagaggagtttttgctaaaaccggtgaaattagctgatgtgaagcgtttaaaagaacttataatgagaggtggtgaagctgaagaaggaaaaaccaaaaaacttagtcctaagagaatcctacaaaacgacattgattcatctccatcatcatcatcaacatcttcatcatcgtcgtctcatgatgtttcctcccttgatgacgacactccatcttccaagaggatcaaattagagtctaggggttaaatgattgagctcaatcttttctcacgttttctcttgatttccttgtgtaatatacattatttttgatatatgcaactatgtaagtctagattctaatgctcaccttattactctgttttttttttttgttaaaacaaaaggagatcaatgtgaatatgatttaaacaattttataaaattaaatactttgcctacagtatatatattgtttcctacttcacaaccagatcaattagattctataatgtaacatataatttaaaagtacacgtaaaaagattttgtatatgatcttccatgtgacatacacgatttcacttgtatgtgtttataattcataaactttcaagcatcagaaaacaaaaaaaaacgaatataatctttgttggaatacattatctattactatattcctagttgtatagcagaggaaacttgtttgcacttacgtggcatcttatgattggttcagtgatgtctgttttagaccgttgagagacttggataccattgcggtcttatcccgaaactccaagaacacataattttttttcttggtggtctctcca

SEQ ID NO: 8779 - DNA, 3000 bp, Unknown
  misc_feature (1)..( 3000): cDNA_ID_1989218_gDNA_ID_1971889_Annot_ID_58469 3000 nt of promoter + ATG
tcgctaatctccagctttctgtcattttcatgttccctcggaggagatgttttcaaggatataagagtgccgacatccttctgagaagagtttggagacactattggggcttctccatctttaacagaagatatggagtcagtagcatcagcacaaccagacatttctaagctctctacaattttacaagacgaaacttcgtgaagacatactccatcattcacatctcctacttctacagaggaagacagaaccccattggccatactgctatctactgtgtggatcatctgagctaaaccttcagtttccctgcgttttgtcagtatagatggaagagtgtagtgacattgatccttgttatctttataagaacaccggttaatactatttatgcgagtcaaagacggtacttttatcccattagccaccactgatccattttgttccactgggatgcaaaaacctacagcttctgtgttctcgtgactgcaagaaacctcaggcattacagaaactgcagcatcacggttattccaacagaggttttcctcatgattctttttaagatgtttctgaccatccgtaagtttcttgagctcatcgtgaagtactctcaactccaacctcagctctcctacaatatcttcagcttctccaagctgagcttcaagttcctcaaccttctgttgctgcttcaaggattgcatctctgtctccttaacctataaacacaaatcggttttttaaaaattagagttgaggaggaaacgcaaagccagccacaaaagaaagatatactccattagggaaagctcatcctcaagcaaacgtgatacagtctctaagatgaaaaagctatatcccccacactgaaaaacctttaacttaaaaatttcacgatgaaatgagaattgagagcataagccatgaaatatgtgtaagcctcactgccaacaatggtacaacgaatctagaacttgctgacactaagctacacttggttacgctcattagttttaggccttaggtttcatgaacaaatatcaatggaggaagagaaaagctatatctgcaaagtatcaatgtaatagtctcaagagtgtcaaaaacaatggcttgtatcaacgttcaatgaagtgaatgtagtgaaaaaacatagcaaaaatgatagtctcgaagcatatcatttgaatgatggaagattttagtcacttcaaatgtcaaagactgaataaacaaaactcagagtcacacacacacacacaacattaacaatgcttaaaaccatgaaagcaaggctgaaaaacttaatttcaaaagccatcttcatatgaagcaagaaaaaagaaatgcctctaagaccccaaaaacataatcaggcagaaaccaaataaaacaaaccaagaacccataaacaaatgaaaataagaacaaagtgatagtaccttggaatcaagcatctgtttaagcctaaccaacgtatgaagtgcttcatttctaaccgtcacaagttcttgctgatacctacgcgccttcttctcagaaaccatcacacgtgccgccgcttccttcgtcgtgttcagtatcgtatcggcgtaggctctcttcaacgccgctaaggtctgtgttaacccaaaacaaaacgaacaaaaaatcatcgcaaaccccgaaaagaaaagcaagacaaaacccacatcgtgaaacccaaaatttaaacaaaattagcgaaatcagcaacaagattctgtccgataagagaaacaaggtctagaagaaacagaacgaaactaaacgaagaaaaatccgaaatcgaaaaaaatgaactcgtgagaggaggagattgagggggtttaaggtaattgtacctctgggtctgccattagagccgataatgcgattgcagagaagcgattgttgattttccgaccaaggtcgcgaactcgccaagaagaaagaaaaagctaaaaaggtttttttttttttttttgtttctttttgtgtttccttgaagcgtctgtctgttaggaacagaaagaagtataaagacctatttacccctaaaaactcgatgttatttctcaaacgccacaccacacgtcacgtcagcttcagcatttcagactgcaaacggcggtacggtttcccgttatctccgtcactcttttcgtaatctctcttttgctttttacatttttcggtgataaatttacaatttcaaaatacactggacttttaatttttacctcatttagacaattagaccactagatttcgtagcttttaccccaaacaaaagactatattgtagctagttctaattattgaattttgtatcaactattccaatacgagacatgatataatgttccatatttggtagatacattcaaagaaaaaaaaaatggtagacagctaaaaaagaagctagctcatgggattaaaccaaaattaagatatccaaatgattttgaagtttcgattgcctagaagatggatggacaattaaaccgacttatagaacattgtctagtttacaacatatattaccaatgtaattgtattctactatttactagtgtacactaatactacttttcttgcaattttaggcgccaattttttttgatcgaaaaatatcgagttaaccaattaaaaccgggaagtaatcattaaaccgggtaatgaccgggtgattactcgagactgttatccacaataagaatccacgtgtcttcttcaagcccctccctcttcttccatttttccgccatttcacctagagagcgagcttttgggtgagaaaatctcttcttctaaactattctactgccaatcttaattcgtgcgtttctgtctagagcttggtggtgactagtaacttagccgttaatcttaaatctctgattcaattcaaatcgaattgcgattttcccgagaaaatctcgtttcacttgctggaggatttttgaatccttatgtgaactctagttacccaaa

SEQ ID NO: 8780 - DNA, 3000 bp, Unknown
  misc_feature (1)..( 3000): cDNA_ID_2995025_gDNA_ID_1971889_Annot_ID_58470 3000 nt of promoter + ATG
agtgtaatgtagcaccctagttaattttcttgcagctaacttgagtgttctggataagcagtaactttagccattgttttgtatataacatcttaagattttaagcaacacttcaaattttttttttggtttataggtgggacgatgtcaatgagttattggaggagatgctttcaaatagagtatcaaatattcatcaagttattgggcaaatgatcaagggagattatgatgatgactcaaattggcagatagtggaatacgtgttggacaaactcaattcagaaggatgtggtttgggaataaggttttacaatgcacttctggatgctttgtggtggctgggccagaaagagcgagctgcaagagtactcaatgaggcaacaaagcgtggacttttccctgagttattccggaaaaacaaacttgtgtggtctgtcgatgtacataggtagcctaagatccctacactggcttcgtttcatgtgtatgaaatggttgagtaccagtcaatctaattcttggttttcaatgttctgcaggatgtcagagggtggcatgtatacagcactatcggtttggctaaatgatataaatgatatgcttttaaagggagatcttcctcaactagctgttgttgtttcagtgtaagtattttgatactgggtacctacctcattgcaagatgccttcaagctttttatcttgccttttgccttttttaattctttctttctaacctctcagacggggacagttggagaaaagctctgctgcaagagaatctcctatcgcgaaagctgctttctccttcttgcaggatcatgtctcgtcctcattttccttcacgggatggaatggaggtcgcattatgtgccagcgatctcagctcaagcagttactgtcaacgaaagagccaacttcagaagaatccgaaaataaaaacctagtggcattagcaaactcgccaatatttgcggctggaacaagagcttcaacaagcagtgacacgaaccacagcggtaaccctacacaacgaagaaccaggacgaaaaaagaactagcagggagcacagcttaagaactagacaacgtagtttctgttgccaagtccagaaatcaaaggcctcttctgccttcctccatatagactggtgggtgaaaactgtgggcgtatttcacaagcactccatatccatgataactatgctatggtttcaagcagtagagtcaacctctgttagacagaagaagctggagaagaagataaatggtgatcttagtttatatgaagaagcgtctatatgaaaatctcaagtaagtagccaactaagtgttttgatggattgttagacccatgattttgcagccatagattttttttcgtttttttttccattcaactatgtttttgattactataaagctaaatgctaatgtaagatcaaagctctagttacaattaaaggatctattaatcaagattcctcagggaagctctagtttttgcttgtgacctcacctgatgaactctctctgtttcgaaatctaacttattacatagcaatgacccaactccacccagaataaagaaaacaatctgttgtgcaagattccttcttcggtctgattaatctttttctctctctcgtcctcagatatgtgtttgttttctgatttaggaaagtcactacaagtttgtcatccaaattggtaataaaataagaaaaagattggagaaagaaaggatcttcctatagtgcttcacacattacaactttaagattccactttgtgtgcgcataaaagtaatggtggctttgctttctaaccgatgctagtgctttgtgtgattttgctgtcttccaaaactatttaccaaattttgtaaatactttttagaatcttttccctacaaatctaaaatagataaataataatagtatgtgatcatattgcttacagtcaaatcacatcctaacattctactaaaagactaaaactatcacctttttgttttttaatgctatatagttgtgatcaagtctggacatacgatcatgctgtttatactacaattaggtccttaacagcgtcttaaaatttactcttagctagaaaacgacaaattcgactacacaatcatttttgttgttgaattagattcctgaaattgtaagtttttgtgttgaaattcaaagttataatttccaaaaaggattcacctgtctcccaagatttttttcttaataatcaactcatagatccacaagatatagtattttagaagaaaaaaaagtacaaggatggagctgtaactaaatagattattagagcagagtacagaatcatttcagaagctgactatttttctaagctcaagttgcatgcgcttaggccttagagacattgcgttgaccagtacattataacctgtagatttttatcataaaaatacatgagggtaacgttaagaaaaataaaagcgtcgatttcatttcatttttctcattctgttatttcatttttttgtatttaactttgagtttgcgaaagtcaataaatatttcttcgttatacgacctacattttttggtcgacatagcgaaatacttttttaacttcttattataggataacatttatttaactcttttttcgtcatcctataagattaattaaactactaacaaaaaacctaataaatctagtcagccaatgaataaaaaaagtctatccaaatgaaaactctgtagagagacaggcaggtaagaaaaaaatacaagaacagacgaataaaaacaaaacacgtgtcatatggtaccgtcaccaacacctacaacatgtaatagtttaaaaaggaaccacgtggcttttggcttataaaagggtccccaaagaagctcagatctaactcacaccactccattgcccattgctctgtgtactttgcttctttaggagaaagaaagcacaaggggcaaaatcggaaagattatc

SEQ ID NO: 8781 - DNA, 3000 bp, Unknown
  misc_feature (1)..( 3000): cDNA_ID_1989217_gDNA_ID_1971889_Annot_ID_58471 3000 nt of promoter + ATG
ttttgtgttgaaattcaaagttataatttccaaaaaggattcacctgtctcccaagatttttttcttaataatcaactcatagatccacaagatatagtattttagaagaaaaaaaagtacaaggatggagctgtaactaaatagattattagagcagagtacagaatcatttcagaagctgactatttttctaagctcaagttgcatgcgcttaggccttagagacattgcgttgaccagtacattataacctgtagatttttatcataaaaatacatgagggtaacgttaagaaaaataaaagcgtcgatttcatttcatttttctcattctgttatttcatttttttgtatttaactttgagtttgcgaaagtcaataaatatttcttcgttatacgacctacattttttggtcgacatagcgaaatacttttttaacttcttattataggataacatttatttaactcttttttcgtcatcctataagattaattaaactactaacaaaaaacctaataaatctagtcagccaatgaataaaaaaagtctatccaaatgaaaactctgtagagagacaggcaggtaagaaaaaaatacaagaacagacgaataaaaacaaaacacgtgtcatatggtaccgtcaccaacacctacaacatgtaatagtttaaaaaggaaccacgtggcttttggcttataaaagggtccccaaagaagctcagatctaactcacaccactccattgcccattgctctgtgtactttgcttctttaggagaaagaaagcacaaggggcaaaatcggaaagattatcatggccgacggtagtactagttcttcggagtccactaccgcctgcgctggaagcggcacaagaagagagattatgctgttcggagtcagggttgtgcttgacccgatgagaaagtgcgtgagtttgaacaatctgtctgactatgaacagacggcggagactccaaagatcgacggcgaagatagagatgaacaagatatgaacaaaaccccggccggttacgcctcggcggatgaagctcttcccatgtcttcttctaacggcaaaatcgagaggaaacgaggtattactcttcgattgaaacttttttttatcattccataaatttgatcactttaaacttagggatttgttagatatggtttgagaaatggactatgaacaactttatgttcatttggatttagaaagatggctaatttattgggtttctttctatttcttaggagttccatggactgaagaagaacacaagctgttcttgcttgggctgcagagagtcggtaaaggagattggaaaggaatatcaagaaactttgtcaagaccagaacctctacacaagttgctagtcatgctcagaaatacttcctcaggcgaagtaatcttaaccgtcgccgccgaagatctagcctttttgacatgactactgatacggtaaatctctaatcctttgtgactctagtaagttaagtggttaggtttagtttttagcttagttgtttaaaagaaactaatagagagcctttgtgaattgttggttagtgaaaacttaagtataacaaaactgattttgcttggttttgttatcaggtcatacccatggaagaagatcaccaagtgcttatacaggagaacacatctcaatcatcttctcctgtaccggaaatcaacaacttctctatacatccggttatgcaagtctttcccgagttcccggtaccaacagggaatcaatcatacggacagcttacttcatcgaatctcatcaatttggttccattaacttttcagtcaagtccagcaccgctttctctcaacctctcactagcttcatctaatcttaatgaaccatctccttcaatgcatccagcattcaacacgattggagtcgcttagagcttatcctaaaggtgaaaatctgcaacacaccctgtttgtttctttgctgtacagataggtcttgactttgttataaaaaaattcgtcaaatttatgtatttggctaaaaaaaatctgttgaaaagaagaataataaacagagtttggagataggacttaagtggggttttagggttcataatcatcctgtgtttttccttccatgtttggaagttgttgtaatactctctaagttcattcgtgtggatctatcaaaacttataaatcatattaacgttatgtttgttttattcatgatctcaatcataaacagagtcgtagtacttgcttatcatgtggctatctaaatcatgttagatgattcatggggttttagggtttttataatatatctgatttccaaggataagatattttatgtttgtagaataatgtcattatctttaatgatgccaataatgtcaaattttattggtcacttccatcatagtggagctttttcttttcccatcagatgcttttaatatattttgtgtgggatgattacatattacccctgttgcgtaagcaataatcttccaatcacagaacatgatccccattcattaatcgaccaatcaaacagcatcatttttatatgatgatgatgtatatgtgtatgtcatgtgtgtgttggcatgtcctctgtttctgtcgtgtatggttgtattcagttttagcgtcaacgacaaacttctcctcacgtctaagcggggaaaaaaaaaaaaaaaacgaatccagtttatctttgtttgttttgtatctctctgtcttttgacattgtctctaaatttatcaatttcaaatctgcgactatcctttgtttttgggtactttatctcatcaaattccagcccaatctagactctctaaacccagaaatagaaacacaaatcacaaaagattgagatagatagatcatgatctctgttctttgttgatctttgaccaaaattcgatctcctatgtatatacaattgctctgttttttcttgttcttgtttctgcttttacaagccaca

SEQ ID NO: 8782 - DNA, 228 bp, Unknown
  misc_feature (1)..( 228): cDNA_ID_1989204_gDNA_ID_1971889_Annot_ID_176839 3000 nt of promoter + ATG
ttcttctggttcctaaaaagtggctgtcaagaagagtgagacatgcatcaaactctctcttctcctgccatggcgtcaaacctccggaaaccctatttcctcaggtacttaactattcttccccaatcgatgatggtcgaaagctgaaacctttttctgcaaatcgattaaccgacaagaaaatccaacccaacccacccactttgttttgtttggatgataaaaatg

SEQ ID NO: 8783 - DNA, 3000 bp, Unknown
  misc_feature (1)..( 3000): cDNA_ID_2028729_gDNA_ID_1971889_Annot_ID_176834 3000 nt of promoter + ATG
ccaccggaagtgaggaagatgcaagtaggaagacctcccggcggagatagaattagggttacgaagagaccaccgaatggagattattcacctagggttatcaatagcaaaactggaggaggagagacgacgatggagaagaagactcatcatccttacaatcttgttgagccaatgcagtatctcttcgttcggattgtgaaggcgcgtggcttaccacctaacgagagcgcgtatgttaaggtacggacgtcgaaccatttcgtcaggtctaaaccggccgttaaccggcccggcgaatcggttgattcaccggagtggaatcaggtttttgctcttggtcataaccggtctgattccgctgtaactggtgcgactcttgagatctctgcttgggatgcttcgtcggagagttttctcggaggagtttgttttgatctctctgaggttccggttcgtgacccgccggatagtccgcttgctcctcagtggtatcggctcgaaggctccggcgcggatcagaactctgggagaatttccggtgacattcagctctctgtttggattggtactcaggtagatgaggcatttccggaggcttggagctctgatgctccgcatgtagctcacacgcgttctaaggtgtatcaatcgccgaaactttggtacttgagagtgacggttcttgaggcacaggatttacacatagctcctaatctcccgccgttgactgcgcctgagattcgtgtgaaagctcaattagggtttcagtcggcgcgtacaagaagaggctcaatgaataaccacagtggttcgtttcattggcatgaggatatgatctttgttgctggagagccgttggaagattgcttggttctgatggtggaagaccggacgactaaagaagcaacacttctaggacatgccatgatcccagtgagctccatcgagcagcgaattgatgagcgttttgtgccgtcgaaatggcacactctggaaggagaaggtggaggtggaggtggaggaggaggacctggaggtggtggtggtggtggaccttattgtggaaggattagccttagactttgtctcgaaggtgggtatcatgtgcttgaagaggcggcgcatgtatgcagcgatttccgtccgacggctaagcagctatggaaaccgccgattggaatacttgagttggggattcttggagctcgtgggttgttgccgatgaaggcgaaaaacggagggaaaggttccactgatgcttattgtgttgctaagtacgggaagaaatgggtcaggactcgaaccataacagacagttttgacccgaggtggcacgagcagtatacgtggcaggtttatgatccttgcaccgtgctaactgttggagtcttcgacaattggaggatgttctctgacgcctccgatgatagacctgacacacggattgggaagatacggatccgggtgtcgacgttagagagcaacaaagtgtacaccaattcatatcctctgttggttttgttacctagcggtatgaaaaaaatgggtgaaattgaagtggcagtccggtttgcatgcccgtctctgctgcctgatgtttgtgcagcttatggacagccgcttctgcctcggatgcactacataaggcctctaggtgtagcacaacaagatgcattaagaggggccgccacgaaaatggtagcagcttggctggctcgagcagaaccaccattgggaccagaggtagttcgatatatgttagatgcagattcgcatgcatggagcatgaggaaaagcaaagcgaattggtacagaattgttggtgttttagcttgggcagtgggtttagctaagtggttggataatatcaggcggtggaggaatccagtgacgacggtgctagtccatattctatatctggttcttgtttggtaccctgatttggtagtcccgactgcattcttgtacgtggtgatgatcggagtttggtactaccggtttagacccaagataccggctggtatggatatccgcttatcacaagctgaaaccgtcgatcctgatgagctagatgaagaattcgacaccataccaagctcaaggcgaccagaagtaatccgagctaggtacgaccgattaaggatcttagcagtgagggttcagaccattctaggagattttgcagcgcaaggagaacggattcaagcgttggttagctggagagatccgagagcgacaaagctgttcatagcaatctgtttggtaatcacaatagttctgtatgcagttcctgcgaaaatggtggcggtggctctagggttttattatcttcggcatccgatgttccgagacacaatgcctacggctagtctcaattttttccggcggttgccaagcttgtccgatcgactcatctaaggagagaaagatgtcaagatagtaaatgttaggtgtttttgagtatccaacagtttcttgggctgaggaggaaatagaataaaaagattcattatgggttaagaattttatcatattattatgattcttcattttattattcagattctgtcggaaactataatcagatggcatgagctttgagacctgtaatattttgaaggaaacgagagagatttcagatttgagaggtgaaaaaggaagcaaaacttgtcagtaaagttttttgaccacagatttgcttttggtatctctgtagttttctctgtaatctaaaatgatttactaattcctcatttaacttattttgtttacgcctaaactattacatgtaaacattgtctgattatataaattctaagtgaaaaaccggagataaagcgctaacgaaaatgattggttgaaatcacaaagacatcatctgacgtggcagtttctctgtctatcagagtttcagatagtgtgccaacggcgaaacaagacacgaaagaatctctaaagaaatcattttcatcgcttcgcttcgatttttcttcaatg

SEQ ID NO: 8784 - DNA, 3000 bp, Unknown
  misc_feature (1)..( 3000): cDNA_ID_1989208_gDNA_ID_1971889_Annot_ID_176833 3000 nt of promoter + ATG
tggtgtcgaattactatttttaaagttagtgattgaatttgggaataaaaagaatatttggatttagctgtaaaaacctttttttgaacttttcgtcttttattactttgttccccttttgagcaaacgtttcggttctgtcctcctcaagtttctctgtactactttgaatatgactgttttgtgactttcatttcctttactattttagagtttagagagagattttgtgggtatgattcgatccgaactaaatttccgtggcctctttaatttagattttagaacggctccttttctttaagatagattttataaacttttaatccaaaagaaatataaaaaatctgaaaaaatctaaaaatgtgaaagcacaacaaagttttaaataatattttgaaaaagatacttttatgccattgtatttgtgcatttatgttctcctttgcaagtgtattctctttaagctaagaaaaatatattgggctttcctatcagttatcttatgagcccatttcaaactttgtttttcaagcccaaatagctgctgtataaaagacatttgctcgttatatgatcctagtagcttcgacaaactcatactacagcttaatctgaaaccccatagaatcttaaactaaccctaaagtattcactcccaaacctcatcatttactataagtgtgcaacatatggaaaacaaacttagtcagagacatactacaatcattgaaattaatgaatttcagattccaaaatgtaaataaaacggacctgtgtcacttgatccatgccaaatcacttgctgtcattttcttgttcttcataacactaaaagttagactgaaacatgactaatctagaaacttattgagtttccttattacttgaaaagttttaaaagagatatggatggtaaacaaaccatcccgccggtatatcactattcaaagcctaaggcatggatgatggattcattcatttcttttctttttttttgaatttaagattcattcatataaaaatattaattatcccataaagtatatatagttttaggctgtagataacagttttatgcaagaaaagtgatgggacttgaataaatcgaatagttggcatgacaacgccacatacacatgcaatctcaaacattctagttgagcccatcatttcatacacaatctcatgttttttccttcatcgacgaaagtccctttttccgaataataatttttcgtattgttagtttctttttaaatcctttttgccagctaaaaagttgcacaagataaaacatggtccatcatttcctctcttttttttttaggtgtgaaaatcaatctcatccatactaatctatttgtaattgatttatctttttttatggaattttatgtcttaataatttataacatattactatatgcataaacataacaaagttcgagtaaaatataaccaagttttaaaacttggggcttatatagctagttttctctaatgtattgatttacaaagactcgctttttttattttttgcatgactttcaacgtttcacactctttttgccaattgcactaattgttggttgaaagtataaccgggaaataaataaaagaccttcttttttacctactgatatcaatttgatgagtgacataaagtgataaaacaaaaatatttatattcatatgcacaaattttatcgtttagacgatgtacatgatgatcaaaaagagtttcggtttcgaacttccaattagttgttgataggatgtgaatgtaaacccgatttatagaaagcaaacgaataagatcacgacatggcgacacacttgtcaattagtttcgaatataaaaatgagaaatatatgagagaaaacaacaagacgatcgcatttgtttgcatttttgttgactttgatcaatggaatcttcatatattagttttgattactatttttttacacaaaacaaagtccgatagtaagctgactcctttacattgataaagtctacacctaataatatctcatatcttagatacaaatttgatagcttttgaaattatcttcaccaaatcttttggtagaaactttcaaatcacacataaactactagggtttttttttgttaagaaaatccaatgccagtttttatcttgaatttgacaacccaaagttatttattttcatacgaaaaattaatgaagacattttccactcgataaatctgtaaatatacatatgtatgtatattggtaagaaaccagtttttaaatattgtatttaagaaaccaaatagcaaaaaaaaaaattgtagattcaggtagtttaggtaatgctatagacatataatataagacaagaagacaataataattactgaattgaaaacaaaacaaaatattttggtgataccaaatcaaatgaaaccaacgtcacactttttgacaatgtcaccgtatccacttctacggtcaacaacttcatcaaactctccccttccacgtaagctacatctctacccttcattttaccacctatcaacagatctaaggctataatttttttaatagttattttaattacttactcttttagttacaacaccagagactaaaacttgttctgtaataataatacaattaattaactgttaatcactgaaaatattttacaattttttataaattataggttagaaaatggctcaaaattacagtttctatgtaattaatttgtttaagtatataggggagatagatcaagtcgctttaacttattttctttttgatataaataaaaaaaattataatcattttgatcaattttacgaaaaggtcgaaactttcttcagctgaacccgtgtttcctcttctctgcaactcaccggttcgccggaaaactctacgccgtcgccggattttgcaccaacgaaaacttctttaaactactttcttcattattcttctgctgagtttcaaaaactcagcc

SEQ ID NO: 8785 - DNA, 3000 bp, Unknown
  misc_feature (1)..( 3000): cDNA_ID_2037281_gDNA_ID_1971889_Annot_ID_176829 3000 nt of promoter + ATG
aaacccaaagaacgcaacagatgccattataataaatgacagcctgaagcaatgagagccataacatgtgttcccttccccggaagcagtcttatcgtagatataaccgatcaatcttacagagaagatataggaaccaatgggactagccacggatatggtattgaagatggttcccatgtgccgaatcccgaacagctcagaggtgattgtaggcatcagagaccactgtgaaccataacaaacgccaactataacagaaccaacatagagatttccttgaaaaccagaggctatgattaggtggcctatgctcatcgttccaagtgttgcagccattagcaatggacgtggccatccctttttgtgtagcaatgcatctgaggcataaccagctccaaatctaccgagaaagttccatatactccacaaggagaccaatgaatttatctcaactgatgagtatcgaagagactcacctatttgtcggatgttgtttatcgttgaaagtccagagcccattccgcaaatcatggcaagaaataacaaccagaagcttagttttttcatagcttgcagaagattcaggttctcactcagtccagcttccactttactgtcaccttcagaactttggttaccggaggttgttgcctttggactgcttatgagaggggaataatcatgtggtactgttttttccatgccgtctcgttgtgctcttctcgcaataagtagaggcaaggcaagcatgacgagtagacatacaagtgtgacaatgttggcccacgatgacaacccaaaagtgttcttcaatatgataatgatcataagataagctgcgatgattagagatacagctgaaagaccatttaaatgctttttatcatcggctacgcttgtctcatagatcctgaccagaggcatgaccaagagtgagagcactgttggtgttactgccagtaagagaatgaagctggccggatctccagcgcacaatgtctcgtacagttgaatcagtatcgctccacttagaccaagaaaaccctgcaaagaaagaattagaggtaagcttggatgcttcactataatcaaaaattccaaagttgaaaccatgaatctcccactattaacatactttggggtttagttgaagtttctcatcttaaaagtggaggttgcatcctcatttgcaaggtttatcagaaaagaacaaatatttactacgcaatatatatcaactagaagatctagatctcgattgatccaaagttcaaagcatcaatctctttccaaatgttaccaaagcctcctcatttagactctaccaggatcatcatcatagccaaatattggtctttaggtcccaaggaaacaaactgagacgtgatccaacaatacagatccattcaatatatcgaaaagcttcatcaaaaactcaccttcataatgccaacggctgtaccaccatagtcagcgaaattctcaacggcactaacaacattagccgtattgaagaacgtttgcgactgagctgctaagaacataaacaggcacatcagcggcaccggaggctttctaataagtccggtaacagaagcccaaatgagaaagtaaccggcgaagcactgaattgccccaacagcaagcaccacccaaggtcctccagcgcctccaattcctcctccccgtccacggagacgattggacgtagcgtatgtgtataaaagcccagagaaaactccggcgtttgctccgatgtccttgaagactgagacggtatcgagggtggattgatcgtacgattgagtcgattttaggacagcggaatagattccgaaggtgtaggaagcgccgcttgcgcattgtatccatatactagctgtcatagccacccatttcgttcttagtatctccatcgccgccaattaccaccaccttcctcgccggaaaaaaagagaaagccagagctttttcccctgctcaaggacgacgaagcgacacgatcacaaaacttttttttctttttttctttattcaaacagattgattttggaaaaactatttaaaccttaatgggctggaaaaattggtatgggctcattagttatagaactcgtagtattgattttgtgagcccaattaactggaatgacacgtggagtcagatggagagcacacgacagccacaagacggcttgtggaagagagaagacggaacgaggttaattaacggattaaactaacggagtcaacgttgactggtcaaggagtattgagaaaactgtacggccggccaaggtcacgccactctctcgaccaatggttttataatcacgaggctgactcagctaatctcccgcaaatcacgagatttttcaatgttactcaattacaaaactattaacaaactcaatactacaaaatcatgtaatgtgattatttagttagtcggatcactaattaatgttttttcatgcattatactatggtcaacgacgttggagaagtaatcttgaatacttgacaacaaccaaaatattgattctttttttcctctcataaaaaaataatgtttaacaattgtaaatgatctaatatattatctccattcttgttagattaatttaatttatctctgttcatattttcacaatctaaatttcttttaaaaataatataaatgaaaacaaattagttagttaccaaagaaacagagacaaaacagatatttaaatatacatcccgccataaatatgatataagctatagttggttttcagctgcaacgtctcagtcacttctaatataataaaactcaaaatctcaaattgattaaacaaactggcttacgcagaagagtgacgactacgaaaatgtatcatgcctttaaaaaccttctctactcctttaatcggttccttcttctttcccttttctcctttcgcttcacgacgacgaaatttttgatttcagtcaccgttattgttgttgcggtgg

SEQ ID NO: 8786 - DNA, 3000 bp, Unknown
  misc_feature (1)..( 3000): cDNA_ID_1989212_gDNA_ID_1971889_Annot_ID_176828 3000 nt of promoter + ATG
ctctgtatggcaaattgctttgttacttggattataagggactcaagttcctcctgaagctgcaatagaaaattgtccgtctttgttttatcatcagcacttttgtataacaatctctgaaaattctcaagacaatcatctatgttgaactgtttggcagttgaagagcggcgagctgtcatttcttctaacactgggtgaaagaacttcttaaatgcattgctgcaacaaaacaaaacaaaacattctgtaactcactcaaagaaagaaggaaggaaagtaaacaagagactagacactataccaaagagaaaaattaagttaatccgagaaactattattacctataagaaacaaggacatcagcaaggaagtttaatctagccatcagtacatcaagatccaaaataagggtttggaattttgcttggcataatccttcttgaatatctctcaaatctttttcaattgcattttgaaaaagtctaagaccatgaattgggctccgtcctacatttggaattgaaagggactttttactccactcccaaaagcgttgaaaacatccgcttgacggatgtgactcaggtgatttcttcaaacttttagacacattaacatactggactcctttcatgatctctgtaggagtcccacaagaagattgactatcgtcaagcagccaagagcttatgaccttcagaaaattttagcttatcaaaaggaaagaagaaaaacatagcatatctcagcaaaggggatatgtatacctgttgcaatgagtcttcatttggggcaacatcttttatacaattctcaacttcaattttctcctcgtgagagagatgagagatcatccatggcaaaaagtcttcaagcaccatcactggaacactacaaatgaattgccacacaagtgatgcttgttctcggaaagaaaacttctctattaacaaaggaaacacctacatgaagcatgactcgttaggcaccactatgaaaagtgatagagtatctgtaactgaaatgttgttttccattaaaaagtattgtagttgtcaaaacagagttgaagtataacaagactatatacctgccgctcttctttaagcatatgttggcatatagatgactggatggtgcctatgcataaaataacttcacgaagtacatcgcttctacttcctatttcttcttcaagaacatgtagccagtggaaaattgaggtaaagagatcatctgtgccagcatgctcaagtgagtaattagaaactatgtttttcactcgtttatctagcgccaaaaatataacctgccagtaagaaaagcatatcaaaagccactgttacttatcatgataaggatttcaatctaagagtcagattcttgacatcaataaaagattcacaaactgaaactagagactgcaacacgaatttagacaaggtcttttaccctagtaacctagtctaaccaagaattcaaaggacaatctttatttctctagttgtaattagcttcaggaagcaagagagttctaaactcgaatttaatttgtgaacataaagaggagtaacagagattaaaacagagcaactcatttagggaaaaaaaaacttataaaggtgataaaatctaacctcatcttcagctgcgctatgatacttatatacaagcttcaagaactcaaacttccgggagagctccaccgccagatccccactaaaggaatcggcttcagcagcgtcagtagcgaaacgccggagctccaccagctgagcacggaaagccttgtggcagtaaacgaagaaaagaaccggagcatcagaaagcttggtatttccaacggtcaccgcataagatgcagaaacggaagcgttttccggcggaagggaatgaagatttccgcctcccatccaccgcaacaacaataacggtgactgaaatcaaaaatttcgtcgtcgtgaagcgaaaggagaaaagggaaagaagaaggaaccgattaaaggagtagagaaggtttttaaaggcatgatacattttcgtagtcgtcactcttctgcgtaagccagtttgtttaatcaatttgagattttgagttttattatattagaagtgactgagacgttgcagctgaaaaccaactatagcttatatcatatttatggcgggatgtatatttaaatatctgttttgtctctgtttctttggtaactaactaatttgttttcatttatattatttttaaaagaaatttagattgtgaaaatatgaacagagataaattaaattaatctaacaagaatggagataatatattagatcatttacaattgttaaacattatttttttatgagaggaaaaaaagaatcaatattttggttgttgtcaagtattcaagattacttctccaacgtcgttgaccatagtataatgcatgaaaaaacattaattagtgatccgactaactaaataatcacattacatgattttgtagtattgagtttgttaatagttttgtaattgagtaacattgaaaaatctcgtgatttgcgggagattagctgagtcagcctcgtgattataaaaccattggtcgagagagtggcgtgaccttggccggccgtacagttttctcaatactccttgaccagtcaacgttgactccgttagtttaatccgttaattaacctcgttccgtcttctctcttccacaagccgtcttgtggctgtcgtgtgctctccatctgactccacgtgtcattccagttaattgggctcacaaaatcaatactacgagttctataactaatgagcccataccaatttttccagcccattaaggtttaaatagtttttccaaaatcaatctgtttgaataaagaaaaaaagaaaaaaaagttttgtgatcgtgtcgcttcgtcgtccttgagcaggggaaaaagctctggctttctctttttttccggcgaggaaggtggtggtaattggcggcgatg

SEQ ID NO: 8787 - DNA, 3000 bp, Unknown
  misc_feature (1)..( 3000): cDNA_ID_3043556_gDNA_ID_1971889_Annot_ID_176827 3000 nt of promoter + ATG
gatggagatactaagaacgaaatgggtggctatgacagctagtatatggatacaatgcgcaagcggcgcttcctacaccttcggaatctattccgctgtcctaaaatcgactcaatcgtacgatcaatccaccctcgataccgtctcagtcttcaaggacatcggagcaaacgccggagttttctctgggcttttatacacatacgctacgtccaatcgtctccgtggacggggaggaggaattggaggcgctggaggaccttgggtggtgcttgctgttggggcaattcagtgcttcgccggttactttctcatttgggcttctgttaccggacttattagaaagcctccggtgccgctgatgtgcctgtttatgttcttagcagctcagtcgcaaacgttcttcaatacggctaatgttgttagtgccgttgagaatttcgctgactatggtggtacagccgttggcattatgaaggtgagtttttgatgaagcttttcgatatattgaatggatctgtattgttggatcacgtctcagtttgtttccttgggacctaaagaccaatatttggctatgatgatgatcctggtagagtctaaatgaggaggctttggtaacatttggaaagagattgatgctttgaactttggatcaatcgagatctagatcttctagttgatatatattgcgtagtaaatatttgttcttttctgataaaccttgcaaatgaggatgcaacctccacttttaagatgagaaacttcaactaaaccccaaagtatgttaatagtgggagattcatggtttcaactttggaatttttgattatagtgaagcatccaagcttacctctaattctttctttgcagggttttcttggtctaagtggagcgatactgattcaactgtacgagacattgtgcgctggagatccggccagcttcattctcttactggcagtaacaccaacagtgctctcactcttggtcatgcctctggtcaggatctatgagacaagcgtagccgatgataaaaagcatttaaatggtctttcagctgtatctctaatcatcgcagcttatcttatgatcattatcatattgaagaacacttttgggttgtcatcgtgggccaacattgtcacacttgtatgtctactcgtcatgcttgccttgcctctacttattgcgagaagagcacaacgagacggcatggaaaaaacagtaccacatgattattcccctctcataagcagtccaaaggcaacaacctccggtaaccaaagttctgaaggtgacagtaaagtggaagctggactgagtgagaacctgaatcttctgcaagctatgaaaaaactaagcttctggttgttatttcttgccatgatttgcggaatgggctctggactttcaacgataaacaacatccgacaaataggtgagtctcttcgatactcatcagttgagataaattcattggtctccttgtggagtatatggaactttctcggtagatttggagctggttatgcctcagatgcattgctacacaaaaagggatggccacgtccattgctaatggctgcaacacttggaacgatgagcataggccacctaatcatagcctctggttttcaaggaaatctctatgttggttctgttatagttggcgtttgttatggttcacagtggtctctgatgcctacaatcacctctgagctgttcgggattcggcacatgggaaccatcttcaataccatatccgtggctagtcccattggttcctatatcttctctgtaagattgatcggttatatctacgataagactgcttccggggaagggaacacatgttatggctctcattgcttcaggctgtcatttattataatggcatctgttgcgttctttgggtttcttgtcgccattgtactattctttcggacaaagacgctatatcgacagatccttgtaaagaggttgcatcatcgatagagttcttgtgaatactatacttttggagaaaaacgaatactgcttctcttgctacatccatggtagcttatgcttccaaaggtacacatcaatttctttacctataagtttgattgtaagttatgtttgtatcaaatgtctgtgtttagagatgggaagaaagaaagctgagatctttgtctctctttctttttgtagtttcttccaaaaatgtgagttttgtgaattgtatagacatctcaaagttcccaataatgttgaaattttttaaaattcatattgttgactactatgcatttaaatagtaataatttgcaggccatcaagtctcgttcattcattattcagattaatccacaaaccaatctccatgcaccaacactcttattcaatgcgttttcaattatacttttgatcatttccacataaattactttgttaatcaatagaaagttatggtttggaataaaaagtagttttgcagtcttaaatgggaagagaacttgaagaagacaagtccttttttcctttgttctaccaacttcaaacctacttttcgaaccccaataagttcctagaaatccaaaacccaaatgtataaagtcaactactttgactatcacatctgaggacaataatcaaaagctagcaaagcatagaaaaagacagaacctttgttcatcgtctctctctctgacacgagaaagttgaaaaattcaagttgaacatgattatattcattaattattatatgagaagggagatttctggggatatggttgttggtagtcatgggaagacagtaaacgccatcgcaattgcatttattctgtctgcagagtcaaacaaactaattttattatttgattttcagtcctatctctcttctcttgtcttgtcctgagatcagatgtataaaaaagagacttcttttcttcttctctcttgattctctcttccactgtcattatcttcaagatttgtctcttgcgagactcgatg

SEQ ID NO: 8788 - DNA, 3000 bp, Unknown; identical to SEQ ID NO: 8781
  misc_feature (1)..( 3000): cDNA_ID_1989217_gDNA_ID_1971889_Annot_ID_176821 3000 nt of promoter + ATG

SEQ ID NO: 8789 - DNA, 3000 bp, Unknown; identical to SEQ ID NO: 8780
  misc_feature (1)..( 3000): cDNA_ID_2995025_gDNA_ID_1971889_Annot_ID_176820 3000 nt of promoter + ATG

SEQ ID NO: 8790 - DNA, 3000 bp, Unknown; identical to SEQ ID NO: 8778
  misc_feature (1)..( 3000): cDNA_ID_1989792_gDNA_ID_1971889_Annot_ID_176816 3000 nt of promoter + ATG

SEQ ID NO: 8791 - DNA, 3000 bp, Unknown
  misc_feature (1)..( 3000): cDNA_ID_2037321_gDNA_ID_1971889_Annot_ID_176813 3000 nt of promoter + ATG
ttgaacacgtctcatggttctaaattcagtacttgtttggagcttgctgatatttgtcgagaagttggtcttcctcctggggtcctcaatgttttgactggtttcggttcggaagctggtgctcctttggcatcacatcctggcgtggacaaggtattggtctttgagaatacagtaaacataagtcccaacaaaattaactctaaaggctatgattaaacattcagtttaacgtctgcgtttcttaaacgcttcaatgctaagttatgatttcgttgcagattgcatttactggaagtttcgccacaggaagtaaggtcatgacagccgctgctcagttggtgaaggtaattccaatttttgaactttctgctgtatattccttctcctccttttgtttcatcaccaatgtcaatgacacattactcatggcattgttgcagcctgtttctatggaacttggtgggaagagccctctcattgtgtttgatgacgttgatcttgataaaggtgaatgtcacaaaaagtagtttagtggatttggagtttttttataataacttcttcttgtgctatattcaagatagtactaatgcttttgttgctttgagacgagtagacatgacttaaatttgcttaatcttaaaattaaactctttgtatgttttgacgccggcaaatgatagctgctgaatgggctcttttcggttgcttctggacaaatggtcaaatctgcagtgcaacttcccgccttcttgttcacgtaagtcccaatcttctacttgctttaaggttttacctgatcttcccaatatgacatgcgaatatttattactggagaagtgaatgttccaagtcatacgggaagatgtttccattaaggtcaatgacaatgacatttatttcagatcaaaccttctggtggatatgccaacagggatacaattgctgactctcttgtctaaatttttttattttatatcttaggaaagcatcgcatctgagttcatagagaagcttgtaaaatggagcaagaacattaaaatttcagaccccatggaagaaggatgcaggcttggtcctgtagttagcaaaggacaggtaaaatcccagtgatcgttttttctgtcttcatattatttgtcaatttcccatcaggttgcaatacaacaaccaggactaaaaaggaaaagagaattgagttctgtagtatagtgattaacttttgtccctctaattctgaaccgtttagcttttagagcatcaatcaaatcacatctagcatatgatatttcatcacgcttatcatgttcttacttggtaggtgtgcttttcttctatgatcatataatctgattgagctgacaaatgtaaatattacagtacgagaagatattgaagtttatctcaacggccaagagtgaaggagcaacgatcttgcatggtggttcccgacctgaggtattacatctccctcccttacctatccttgatgcagtttcttccagactatgatgatgaccttttatatcatatctatatttcacagcatctggaaaagggcttcttcattgaaccaaccatcataactgatgtaaccacttcaatgcaaatatggagagaagaagttttcgggcctgttctttgcgtgaaaacatttgccagtgaggacgaggcaattgagctagcaaatgactctcagtaagttaacgtttctccagaaagtgaaatctgatcaaatcccatccgctgacactggtgtttaaatcaaatttatcatttaagatcttatgtggctgaaaattattcattgattaatgacagttacggactaggagctgcagtgatatctaatgacacagaaagatgtgaccgtataagcgaggttagtaccggtttcttgaaccattcagatttgtttttaatgcctagcaagtgaaataacaataccatcaaataacacaaacaattggtgtctactttgttaggcctttgaagctgggattgtctggattaactgctcgcagccttgctttacccaagccccatggggtggtgtcaaacgcagtgggtttggacgagaacttggagaatggtacatttctttttctatctcgaatcttgtttttaaaagactatatcttgatggcttgtactgaacaaatcttggttatggctggtttcttgcgtgcttcaggggacttgataactacttgagtgtgaagcaagtgactctctacacttcaaacgatccctggggatggtacaaatctcccaactaagtaatgaatacattgtcatggaaatggaaaccaaaccaaatgctgtctgttcaaatctttgtgcttttattatcagtctgtctagttcggtcctgaaactcttttgtaaaacctgttgaatttataatgaataaaagatgctttgctgataattattggttgttctataaaggccagtattgaggcaccattttaggctctggtgcagcagtatcaagaacatgaaccattttatgtcaccttcaagtcacatcaaagttaaaactcacatggcaatcaattccaaatcataacttttttttttactataattgcttgaaataaacattttatgagatctgaagatttgtggattttttttccattttttaaatagtaaaatgtttggcaaccaaatctgaaaaagaggtaaagacgagaggtctcgcgcttatccttaaaggactgtggtgaatggtgagtgtgacttggagggaccccatcaccgcaacaatacagcttcttagatctcgataaccacaactaacctgtcacagtttcgattagatcttctcaaaaacttcacctttttttgtttttccagtttctcagaggagatcttccttcaaagctcaaatccttttgtctgaattgtgatactgctgtccccatttttctgcaagttgggaaatttctgtcaaagttttgtgggtctgttaaaaagatctgagctttgaac

SEQ ID NO: 8792 - DNA, 3000 bp, Unknown; identical to SEQ ID NO: 8776
  misc_feature (1)..( 3000): cDNA_ID_1394832_gDNA_ID_1971889_Annot_ID_176812 3000 nt of promoter + ATG

SEQ ID NO: 8793 - DNA, 3000 bp, Unknown
  misc_feature (1)..( 3000): cDNA_ID_4266404_gDNA_ID_1971889_Annot_ID_176810 3000 nt of promoter + ATG
ggagggttgggggcaatctgttccgtgggttctgaacaaataaataatagtaacaaacgattttcccaaaatggaaattgattattgaatctaagggagactgttcttacacaaggttgtgtcacaagttcattagtagtggctatctcgagcaaagtataatgaaagttagtagtggccactggccttcaattcaattattgctccatcttgagaagtgggattaaaagaaggtaactttttttaacttatttggaaaacagaatgcgtaaacaaaagagatagctactgctctaaatagtgttcatgtatgaaacttctgttttggttccacctttcttcttctacgaatctcaagttatgatcaacagacgactcgcttctttcttcaaaacagtgagtcatatacttgcttcttaacttcttaattagtgtccgcatcaaaaatgtcatgagcctaaccattgatgcaaacatttataataacaatacttatgtgtgtccgattcaacgcccaataatctctaaaatacaaaagaagaagtagtcttaaaattctagaaacagaagtcgcgacgaaaatctcagtatttaaaacaaacgtgcctaaacaaatagagataatcattcagatataatgcaaaaagacaaaagagagttgaattaaatcacgtggaaaacaaggaacacgacaaagcagaacagtctcactattcccgcgttagccactcaatacaatccgccacgtgtcccatcttcacgcgccagtcagcgttgatcttcttcctcacttgccacttccacttcttcatatataaatcccacacagccgcaaattcgaaatcaaccagatataacagaattaacctacacaactgaaactcgagttaagaaccggaaacagaatccaattcaaccaaaccgaatcgaaccgaaccggagtttttatccaatggtgaagcaagcgatgaaggaagaggagaagaagagaaacacggcgatgcagtcaaagtacaaaggagtgaggaagaggaaatggggaaaatgggtatcggagatcagacttccacacagcagagaacgaatttggttaggctcttacgacactcccgagaaggcggcgcgtgctttcgacgccgctcaattttgtctccgcggcggcgatgctaatttcaatttccctaataatccaccgtcgatctccgtagaaaagtcgttgacgcctccggagattcaggaagctgctgctagattcgctaacacattccaagacattgtcaagggagaagaagaatcgggtttagtacccggatccgagatccgaccagagtctccttctacatctgcatctgttgctacatcgacggtggattatgatttttcgtttttggatttgcttccgatgaatttcgggtttgattccttctccgacgacttctctggcttctccggtggtgatcgatttacagagattttacccatcgaagattacggaggagagagtttattagatgaatctttgattctttgggatttttgaattcccaaacataatatttttttagagcgaactgtgagattttccttggagtcatggagaaatctggagattttttgtaacacggagctccaatgacccgggaatttctttcgtttcggatccgaatttgatgtggatcatattcacacctatattttttcatttttttgttgtaaagaaaaatcggataagattctagtaataaatgttaaaagtccatttcattattctgaagaatatccttcgaacacgatgagtttggaagattatattatccggcccaaaatcttatagttgggccttagtcattaaacatttttctcagcccattgttttaaaaattgattttcgtgataaagtagttaacttaagtgaagtacgaaggttcccttggcctaattaaaacacaagggggtttctataaatgaaatatgataaaatatcttccaagcatttcgatagtattgatgacaattacaaagttcaacatcaataagtcaagaaattaggattggaaatcaaggaagagaaacggtcttcaaagaaaatagaattgaatcgagaaaaatatcagtaatcggaaaaaaaaatgaaaaaaaattggggtggataagattcccatcattttcaaattgccacctgattttcggcttaaataagaaaaaccatcactttcaatataaaccactatttcattcgagacaaaataaaaaagaaaaaataaaaaccactagctaaactaatactaataatctaggtgctaataaatactagaaaacaatccacatttcaagtatagatgaattggtctattaatataaaatacggtgaattaaaaaataacacaattaaatttacataaaatttaaaaatatatatcaggtacatcacagaatatatttttacattagagaaagtcttggattcccaataatataaaacaaaatatcagaaaaagacatttgaattcttgatgtgggtcctcacggtcctaccacactccaatgaaatgcttaaaaaaaaagaagaaaaggaatcattacataagaaaagaaaaaataatatctgagcctgctcatatcaataattgtgtatatatagaattatatagatgatgtcgataaaagaaaccaaacaagataaataaatacaaaaataataatggtgatggtgggccgttctataaacttcaatcattaatcatagcacacaaaattccaaacttgagaaatataatcagtgggctaaactctaaagtctctctacctttctccatctccttcttcttcttctatcagattctttctttcctattacctttgccttcttcttcttcctttcctctttctctatcttcctctcaattcttttactgtttattttctttgtaatcaacaacagtttaactcttcttcttcttttctttatcaagaacagtagtttctcaattcttgattatg

SEQ ID NO: 8794 - DNA, 3000 bp, Unknown; identical to SEQ ID NO: 8773
  misc_feature (1)..( 3000): cDNA_ID_2730172_gDNA_ID_1971889_Annot_ID_176807 3000 nt of promoter + ATG

SEQ ID NO: 8795 - DNA, 3000 bp, Unknown; identical to SEQ ID NO: 8772
  misc_feature (1)..( 3000): cDNA_ID_4266408_gDNA_ID_1971889_Annot_ID_176805 3000 nt of promoter + ATG

SEQ ID NO: 8796 - DNA, 3000 bp, Unknown
  misc_feature (1)..( 3000): cDNA_ID_1989215_gDNA_ID_1971889_Annot_ID_58473 3000 nt of promoter + ATG
ttatactacccaaaatgaatatttaccttattcttttgttgatcgctgcgacaagcaccggcggcacaaaatataaaagaaaaaagaaggaaagatgaaggtgagatgaatgaaagagtcgcagcgatagatctgaagagataggagaaagggaatttgagacgttgaaaattccagcgtctacggaatagccgaattacagtcgctgcggcaaagatgaaagagaggaaaaataaaagtgaaagagagatgagagctttttttagatcgcaggtagctgacgtagcgatcaatcaaagaacatggtcattatctaataaaaactatttaattagccattaggaaatttgaaggctagacttgttaaaaatcttttcgtatgggcccatccgtgccttcttcaatgggcttgaagaagtagacaagacatcccattattgattattttccttagcttgatgaatgtttttggagttattacatactacattataaatttcttgttcttacagtcagtatatacacaatctgcactgaagataccttaaaaagctagaacgtacggctttgctgaggtttgtttggatagagttgttaaatccaaattcattttgaagcatttagagaattcacaagaagcccaattatgattcaattagaagcccgcaaaaccatgtaattagaaatttctagcaagtttagattcacagaaatatgttgttataacttataagcatcaatgtagctaattttggaagttgccagccactatccacaactctccttcttcatcatttcaagacatcaatctaagatttactgattaagcttagcgttctttatttccccttgcactaaataaagctcttactgagttattttattttgtatctttgctatccatcttatattcagctcctttgagcaaaaatcgatcgtgatttggattctcccacaaatcctaggggagttaattagccacgtaacaactttgaaagtcaccagtctctccccattcctcatctaaatatcaaaagtcaaacgttcaaatccccttgagtccttgacgttaattttttgttatagaaaaacgaacggaaaaagaaaagtgagattagaagatcatttatagaagagaacaaaacaacgatggttgttatacgctcacaatcaagatccccttgatcaacatgttgctaaacgcagacaaggactcgcggagacaacaatggttgttacgtattcaaaattaagaaacaagctaagaaaaaccttcatattcttaagcatacattaaaggctacataatcaatagtactgacaacgatcataacttcaaaataatgcattaatcacttgagatttaccaatagttggattttgaatctcgagttctaactccaaagctgcattttcattgtttttttaatactcatccatcgtacggcgtttattatgcgatctaccacccatgtgcatgtatttatctcacttaatggttttattattcaattcttgtaattcctttttgtttttcaaaatgagatgatctaccacccttgtgtatgtaattatctaacttaagtatttcatttacgttactcatgataacactcgatgatctaaagtttagttacattttatagaatgctatacttcacttagatatcagatgtgggttcaaaaccataaaaaaatatataaaatcatgacttatattcaacgcattcgcggagacgttgatattgtttcacaaaaataggaaattaacacacgcgtagaaatattcatgtatctatttgtgttcatacaaattaaagatgtttaaaataagatattgttaaaaaaaaagatattgttaaaaaaagaaaagaaaaaagatattgttataataagaaaaatataaatattgtcaatagtagcatgtaatatgagaaattgaatcaaacgtaaaatcgtgatcataaaaaataaaattcaaaagtaaagaaaaacatgcattgtccattttttttaatacttgaatttgtttaataattaatcctcgagttacgtacgttcactagttatttccaatcgacaaacaaattcaacggtttcgaaaattctgaacagaaataaaagatgtagtttcatacaaaataaatgttagttttttattttgtttgtgtgatgatattcagccttccaaaacatatttgttggtgaaagacaagtttttggctgtcggtagtacgaccatttaaattaaggaaaatcaactccaagattcacggatgtataaaatccaccatttgaatactgccacgtggcagtagaccaccagaagacgtgtacaagtgtgtctcctcctctccatgtataaagatgaccgttgccacttgccagtgccacatatgatcgtcggctccggtgattttcgctctctctgcggccacacttgtttgcttggtctctttgtaatactttaacatcacttagtatattgcatgtttcattctttctttctctgattttgttttcgtgagatattaaagagttcataacatataatttcgatgtcagaccgtattaaaaaagttttttttgtggattagattcacgatgcattttaatcagtggagtttaatgaaagaattagattcttaataattttgggtacatatgcaatttcagattttctttgtcataaaaggaaaatttcatttctttttgcttgttttgtgcattgcgatgtttgtctaattcagataagcacatagcgttttcctattttcagctactaaagtacccaaaaaacataaagactttgagattcttctctacatagtgggtgaaaaaaagactacatcataaaaaaaactacacgatatgaagtcatttatatgtgttatataacttcctttgtgtgtggttaggtcatataaagacctgttgcaaaggctaacatctgatcagagcgacgtggtttagaatctccgagtgatttgaggggatatg

SEQ ID NO: 8797 - DNA, 3000 bp, Unknown
  misc_feature (1)..( 3000): cDNA_ID_3043560_gDNA_ID_1971889_Annot_ID_58474 3000 nt of promoter + ATG
gagagcgaaaatcaccggagccgacgatcatatgtggcactggcaagtggcaacggtcatctttatacatggagaggaggagacacacttgtacacgtcttctggtggtctactgccacgtggcagtattcaaatggtggattttatacatccgtgaatcttggagttgattttccttaatttaaatggtcgtactaccgacagccaaaaacttgtctttcaccaacaaatatgttttggaaggctgaatatcatcacacaaacaaaataaaaaactaacatttattttgtatgaaactacatcttttatttctgttcagaattttcgaaaccgttgaatttgtttgtcgattggaaataactagtgaacgtacgtaactcgaggattaattattaaacaaattcaagtattaaaaaaaatggacaatgcatgtttttctttacttttgaattttattttttatgatcacgattttacgtttgattcaatttctcatattacatgctactattgacaatatttatatttttcttattataacaatatcttttttcttttctttttttaacaatatctttttttttaacaatatcttattttaaacatctttaatttgtatgaacacaaatagatacatgaatatttctacgcgtgtgttaatttcctatttttgtgaaacaatatcaacgtctccgcgaatgcgttgaatataagtcatgattttatatatttttttatggttttgaacccacatctgatatctaagtgaagtatagcattctataaaatgtaactaaactttagatcatcgagtgttatcatgagtaacgtaaatgaaatacttaagttagataattacatacacaagggtggtagatcatctcattttgaaaaacaaaaaggaattacaagaattgaataataaaaccattaagtgagataaatacatgcacatgggtggtagatcgcataataaacgccgtacgatggatgagtattaaaaaaacaatgaaaatgcagctttggagttagaactcgagattcaaaatccaactattggtaaatctcaagtgattaatgcattattttgaagttatgatcgttgtcagtactattgattatgtagcctttaatgtatgcttaagaatatgaaggtttttcttagcttgtttcttaattttgaatacgtaacaaccattgttgtctccgcgagtccttgtctgcgtttagcaacatgttgatcaaggggatcttgattgtgagcgtataacaaccatcgttgttttgttctcttctataaatgatcttctaatctcacttttctttttccgttcgtttttctataacaaaaaattaacgtcaaggactcaaggggatttgaacgtttgacttttgatatttagatgaggaatggggagagactggtgactttcaaagttgttacgtggctaattaactcccctaggatttgtgggagaatccaaatcacgatcgatttttgctcaaaggagctgaatataagatggatagcaaagatacaaaataaaataactcagtaagagctttatttagtgcaaggggaaataaagaacgctaagcttaatcagtaaatcttagattgatgtcttgaaatgatgaagaaggagagttgtggatagtggctggcaacttccaaaattagctacattgatgcttataagttataacaacatatttctgtgaatctaaacttgctagaaatttctaattacatggttttgcgggcttctaattgaatcataattgggcttcttgtgaattctctaaatgcttcaaaatgaatttggatttaacaactctatccaaacaaacctcagcaaagccgtacgttctagctttttaaggtatcttcagtgcagattgtgtatatactgactgtaagaacaagaaatttataatgtagtatgtaataactccaaaaacattcatcaagctaaggaaaataatcaataatgggatgtcttgtctacttcttcaagcccattgaagaaggcacggatgggcccatacgaaaagatttttaacaagtctagccttcaaatttcctaatggctaattaaatagtttttattagataatgaccatgttctttgattgatcgctacgtcagctacctgcgatctaaaaaaagctctcatctctctttcacttttatttttcctctctttcatctttgccgcagcgactgtaattcggctattccgtagacgctggaattttcaacgtctcaaattccctttctcctatctcttcagatctatcgctgcgactctttcattcatctcaccttcatctttccttcttttttcttttatattttgtgccgccggtgcttgtcgcagcgatcaacaaaagaataaggtaaatattcattttgggtagtataatatacagtagtgagacatgggcttatgtcacatacactcacatgtgtcacacatacacctatttttgattattttagtcttgtttgtgtccattggaccttgagagaatcataattcattatctgtatcatgaagatttcaattcaagaatttatattcttacaggtccattactcaaaaacaaaaaagtaaagaaaaagagagcgagataaaatgatttcaatgaaaaataatttgaaaaagaaataattaataataaatatattgtactaacatacgcccaaaaattccactatagcgtatctcaagattcaagatctccttcttcttcagctctcgtcatcatcattctctgcttcttttcatttgctcctgttaacaaatttgccaactttcttccattttcgaatccctcttaacgcaaagttaggttttttgttaattcatttcattgcttggatcctaaggaaaaaaaaaacagaaatgaaaaaacccaaattgtcgaaagtggaaaaaatcgacaagattgatctgttctcttcactatggaagcagagatcggttcgtgtaata

SEQ ID NO: 8798 - DNA, 3000 bp, Unknown
  misc_feature (1)..( 3000): cDNA_ID_1989213_gDNA_ID_1971889_Annot_ID_58475 3000 nt of promoter + ATG
gctggaggaccttgggtggtgcttgctgttggggcaattcagtgcttcgccggttactttctcatttgggcttctgttaccggacttattagaaagcctccggtgccgctgatgtgcctgtttatgttcttagcagctcagtcgcaaacgttcttcaatacggctaatgttgttagtgccgttgagaatttcgctgactatggtggtacagccgttggcattatgaaggtgagtttttgatgaagcttttcgatatattgaatggatctgtattgttggatcacgtctcagtttgtttccttgggacctaaagaccaatatttggctatgatgatgatcctggtagagtctaaatgaggaggctttggtaacatttggaaagagattgatgctttgaactttggatcaatcgagatctagatcttctagttgatatatattgcgtagtaaatatttgttcttttctgataaaccttgcaaatgaggatgcaacctccacttttaagatgagaaacttcaactaaaccccaaagtatgttaatagtgggagattcatggtttcaactttggaatttttgattatagtgaagcatccaagcttacctctaattctttctttgcagggttttcttggtctaagtggagcgatactgattcaactgtacgagacattgtgcgctggagatccggccagcttcattctcttactggcagtaacaccaacagtgctctcactcttggtcatgcctctggtcaggatctatgagacaagcgtagccgatgataaaaagcatttaaatggtctttcagctgtatctctaatcatcgcagcttatcttatgatcattatcatattgaagaacacttttgggttgtcatcgtgggccaacattgtcacacttgtatgtctactcgtcatgcttgccttgcctctacttattgcgagaagagcacaacgagacggcatggaaaaaacagtaccacatgattattcccctctcataagcagtccaaaggcaacaacctccggtaaccaaagttctgaaggtgacagtaaagtggaagctggactgagtgagaacctgaatcttctgcaagctatgaaaaaactaagcttctggttgttatttcttgccatgatttgcggaatgggctctggactttcaacgataaacaacatccgacaaataggtgagtctcttcgatactcatcagttgagataaattcattggtctccttgtggagtatatggaactttctcggtagatttggagctggttatgcctcagatgcattgctacacaaaaagggatggccacgtccattgctaatggctgcaacacttggaacgatgagcataggccacctaatcatagcctctggttttcaaggaaatctctatgttggttctgttatagttggcgtttgttatggttcacagtggtctctgatgcctacaatcacctctgagctgttcgggattcggcacatgggaaccatcttcaataccatatccgtggctagtcccattggttcctatatcttctctgtaagattgatcggttatatctacgataagactgcttccggggaagggaacacatgttatggctctcattgcttcaggctgtcatttattataatggcatctgttgcgttctttgggtttcttgtcgccattgtactattctttcggacaaagacgctatatcgacagatccttgtaaagaggttgcatcatcgatagagttcttgtgaatactatacttttggagaaaaacgaatactgcttctcttgctacatccatggtagcttatgcttccaaaggtacacatcaatttctttacctataagtttgattgtaagttatgtttgtatcaaatgtctgtgtttagagatgggaagaaagaaagctgagatctttgtctctctttctttttgtagtttcttccaaaaatgtgagttttgtgaattgtatagacatctcaaagttcccaataatgttgaaattttttaaaattcatattgttgactactatgcatttaaatagtaataatttgcaggccatcaagtctcgttcattcattattcagattaatccacaaaccaatctccatgcaccaacactcttattcaatgcgttttcaattatacttttgatcatttccacataaattactttgttaatcaatagaaagttatggtttggaataaaaagtagttttgcagtcttaaatgggaagagaacttgaagaagacaagtccttttttcctttgttctaccaacttcaaacctacttttcgaaccccaataagttcctagaaatccaaaacccaaatgtataaagtcaactactttgactatcacatctgaggacaataatcaaaagctagcaaagcatagaaaaagacagaacctttgttcatcgtctctctctctgacacgagaaagttgaaaaattcaagttgaacatgattatattcattaattattatatgagaagggagatttctggggatatggttgttggtagtcatgggaagacagtaaacgccatcgcaattgcatttattctgtctgcagagtcaaacaaactaattttattatttgattttcagtcctatctctcttctcttgtcttgtcctgagatcagatgtataaaaaagagacttcttttcttcttctctcttgattctctcttccactgtcattatcttcaagatttgtctcttgcgagactcgatgaagcttcatcaatttcttgtgttccttttcttgttcctctcatgttttgctctttcttcatgggctcttcctctctgttccgattcaagtgagtgatttttttttgttatcctattgatttgatattagttctgctattgtagattgatgcaacattttgttttttgatggtttttcaggagctccctcggaggtgaattcgacattgagcttttgtccttacaaaggaaaaacatgctgcaatacaatg

SEQ ID NO: 8799 - DNA, 3000 bp, Unknown; identical to SEQ ID NO: 8786
  misc_feature (1)..( 3000): cDNA_ID_1989212_gDNA_ID_1971889_Annot_ID_58476 3000 nt of promoter + ATG

SEQ ID NO: 8800 - DNA, 3000 bp, Unknown
  misc_feature (1)..( 3000): cDNA_ID_1989210_gDNA_ID_1971889_Annot_ID_58478 3000 nt of promoter + ATG
catttcagttacagatactctatcacttttcatagtggtgcctaacgagtcatgcttcatgtaggtgtttcctttgttaatagagaagttttctttccgagaacaagcatcacttgtgtggcaattcatttgtagtgttccagtgatggtgcttgaagactttttgccatggatgatctctcatctctctcacgaggagaaaattgaagttgagaattgtataaaagatgttgccccaaatgaagactcattgcaacaggtatacatatcccctttgctgagatatgctatgtttttcttctttccttttgataagctaaaattttctgaaggtcataagctcttggctgcttgacgatagtcaatcttcttgtgggactcctacagagatcatgaaaggagtccagtatgttaatgtgtctaaaagtttgaagaaatcacctgagtcacatccgtcaagcggatgttttcaacgcttttgggagtggagtaaaaagtccctttcaattccaaatgtaggacggagcccaattcatggtcttagactttttcaaaatgcaattgaaaaagatttgagagatattcaagaaggattatgccaagcaaaattccaaacccttattttggatcttgatgtactgatggctagattaaacttccttgctgatgtccttgtttcttataggtaataatagtttctcggattaacttaatttttctctttggtatagtgtctagtctcttgtttactttccttccttctttctttgagtgagttacagaatgttttgttttgttttgttgcagcaatgcatttaagaagttctttcacccagtgttagaagaaatgacagctcgccgctcttcaactgccaaacagttcaacatagatgattgtcttgagaattttcagagattgttatacaaaagtgctgatgataaaacaaagacggacaattttctattgcagcttcaggaggaacttgagtcccttataatccaagtaacaaagcaatttgccatacagagaacagaggtaaactcttatgatacttactcgtttctataacataatggaagtttttcacggattcattttgaagatgttacattgtgtgtatattatattcaattgtctcattgttgtccaggtattcccaatcatcagcaagaattgcaaccatgaaatgcagaagcagctcctatacacaagcattcatgtcttacctcttggattactaaagtgtgtcatactttggttttctgctcatttatcagaagaagaatctcaatccattcttcatttcttaagtttggaagattcttctcccaagaaatcatttccacgcctcttgctacagtggcttcgttttggctattcaggcaaaacctctgttgaaagattttggaaacagttggatgttatgttcaaagtaagatgttcctgccaaaaggagcacactgaagaagcatcaggatcattttccaaccaaacacagctgcaactatgtaaagtatctaaagatgtttatcctagaaagaaagataagtcttcaacctgcttcatgtcaatggatctagctgttggagacatgtatgagacaccttactcaagtcgaatgaatcaacaaatgactttctcaggaaagcttaagcctcctctccatctcccagatttttttggtgagaagaatatggatgatcctatgattatggatgttaaaccaattgacctccttttcttcttccacaaggcaatgaagatggatttggactaccttgtttgtggatcaacaagattggcagccgactttcgtttcctcgcggagtttcagcaacggttccatatgataaagtttttgtatcagatacattctgatgcagaagatgagattgcatttccagcattggaagccaagggacagctaaaaaacattagtcactcgtttagcattgatcatgagctagaaactaaacacttcgacaaagtttcgttcattttgaatgagatgtcagagctgaacatgttggtttctaccatcaataccactgcagctgaccacgaccgaaaaatgaagtatgagcggttatgtctcagtctccgagagatttgcaaatcaatgcacaagctattgtctgagcatatccaacatgaagaaactgagctttggggtctattcaggaactgcttctctattgaagaacaagagaaaatcataggatgcatgctcgggagaataagtggggaaatattgcaggatatgattccttggttaatggaatctttaacctctgatgaacagcttgccgcgatgtccttgtggcgccaagcaacaaggaaaacaatgtttgtcgaatggctaacagaatggtataacggtcatgttttacaagaggaagcaggagaagcaaacaacgatccatttggggattcagatccactagagattgtctggaagtatctctttgaagcatctgctgatggggaaaaagggagcatgcgcagcagccttctcaaactcccgaagacgaattttacaggtattatgaatcagcctcctcctaattacaaggttgaagttggcaaaaaagaggaaaaagatctagaacggtcagaaagtaaaaagatatgcagaggatctaaccaagagggggacaaagaacaaactgacaaaatgtctcagaaggttagccagtttggtccatccaagaaatatgaacaactgttaacaatgagtgaagaagaacttgtggttgtgattaagaaaatatcatgcgactcttccctggatcctcagaagaaagactatatcaagcagaacttgttaatgaggtaagctctactaactctcttttggtgtcctgttccaacatatttagataagcaggaaatctatttagtcttgtattgagactaaactaatgtcaggttcttctttcagtcggtggaatatctcacaacgtacatataatttggaaccatcctctctctcgagcaac

SEQ ID NO: 8801 - DNA, 3000 bp, Unknown; identical to SEQ ID NO: 8784
  misc_feature (1)..( 3000): cDNA_ID_1989208_gDNA_ID_1971889_Annot_ID_58480 3000 nt of promoter + ATG

SEQ ID NO: 8802 - DNA, 3000 bp, Unknown
  misc_feature (1)..( 3000): cDNA_ID_2028729_gDNA_ID_1971889_Annot_ID_58481 3000 nt of promoter + ATG
gaatcatgttcctaccaaaggagcttatttccctgctgtagagaaggctttagagatgattaaccagaaaagttcaccccttaacaaggtagtttagactttagagattgtgttcgtatctattcttaaaacaagtttataggtttcgttttaactgatgtttttggctcgtggaattaggttgttcttgctcgtaacagcaggataattacggataccgacattgatcccattgcttggctagcacagttacaggtgtgtttttatctctggatattatatagtagtcagttttcaatgtttagatttatatctcactaatttttttgtgtgacagcgtgaagggcatgatgcatatcagttctgtcttcaaccacctggtgcaccagcttttatcggaaacacggtaggtctttttatatgtagtctgtgataataagttctgttgataaagatatgtgcacatttgttatttatttctaagaaatatgtttgtgacatacatctttgtgaaacagcctgagagactattccaaaggactcaattaggtgtctgcagtgaagctttggctgcaactaggcctagagctgcttctagtgctcgtgatatggagatagagcgtgacttactaaccaggtcaatttttacttcaagtgctttgaacaattacagaatccagttctccattatcattttactgaatttttgctaaactgttgcagtccgaaagacgacctcgagttctctatcgtacgagagaatataagagaaaagttaaacgtaagttcaatcttgatgctctgcagcttcaatgcttcatttcttggataatagtttggtatattttttcttattatgctttcttctgctttgcagggtatatgtgacagagttgttgtcaagcctcaaaaaactgtgaggaagcttgcaagagtgcaacatctatattctcaattggcagggagacttacgaaggaagatgatgaggtgagataatagtattggaatagtttttacatttccaagctcttcatttcttcgaattagctttaaccctttttctttctatctgtctatagtataaaatattggctgctctgcatccaactccagctgtttgtgggcttccagcagaagaagcaaggcttttgattaaggagataggtaaaatatctaccttggttcaactatcttctagtaactatagatgtagagattaagaattatgctgactcaaacattttgcttcttctagaatcattcgatagaggaatgtatgcgggacctattggattttttggtggcgaggagagtgaatttgcagtcgggatcagatcagctctagtcgaaaaggtgagcttatttgatctctttctccctttaaaaaacacactttaacactaattgttatagcaaaatcgatcattacggtttttgctacaacttgtaaaaaaatgctgaactgtattttgatttacagggtcttggggcattgatctatgcggggacagggatagtagctggaagtgacccatcttcagagtggaatgagcttgatcttaagatatctcaggtacgagcttttgtccagaaaatgtttagtgacatcatggttctctgttaccaaaatcctaatttttattctctcttttgttgttgtttttgcagttcaccaagtcaattgaatatgaagcaacaacatctctacaggcgattaattgaagaaagagtaacatttgtatttgattgttttgtttgtatgggggataaggggttctcacaataagaaagcaatgttgtctctcttgtaaattaaaaaagaaatgctttaatttgttaatgggccgagccttttcgggttgtaactagggcaggcctatcatgaatgttcataggcctagctgttatgattgttaatgagcttctatagtgtttttcttcaaagacagatatattcaatatggatctaaaactgaactgaatttaactgacatgacaatcgaatcaaattgaatttattttttcaattttcatttagcaagaagtgacccatcttcagagtgaagtaatctatgcttattatctcgattaagcaaaaatccgtagaatgcttgggcctttcaacgatgatgtagccgtgtaggacaggtttacggaatctgcttttatgcaaatggtaaatattaatattcctttataagttagcgtttcagatcatcttctttcgttagattaagaaactactttgttattatataactataaataccatccaacaaccttactcgccatatcttttcatgtgtggtggtttataggaacattgaaaagtaccatattataaaatgaagaatcaacacgtcaacaaaaacacaaataaaatgagatagtacaattaaaaaaatggagcgcatgtaaaaagtgaagaatcaaacgaaggcttggcgatagagaatggaatcagatttcccattatccccactctaacaccatatattcctttccctttttaccctccacctcaattaggtttattaatcatatttaacactctaattaaccaacccatttcatctcttttattttactaatcacaatgctttggcctcattacgttttacctagatttactttgtcacaaactacacaaatatgaacctaattatctacactcgtgtcagaaacagttttagctaatatttagtaagttttaattaaaactaatgaaatgaataaatagtgtatagtacataggatttgtttttagtttattaatggaaattaagatttcattagtactaaaaacatgtaaataaaataaagctttaaagaggaatatattcaaataaaaaaagcaagacctcgaaaaaaaaactttctattatctctcttccgcgattaccgtaatctctgtcacaaacaacaaaaccttctctctctcactatcttaatgagagaagaagacattctcgagaaatgagaagactaccactacgatg

SEQ ID NO: 8803 - DNA, 3000 bp, Unknown
  misc_feature (1)..( 3000): cDNA_ID_1989206_gDNA_ID_1971889_Annot_ID_58483 3000 nt of promoter + ATG
gttggatagagctctcaactacaggattatgtaccttcctcaagctacgtttaaccttttcaagttcaatctgaggatcttcgacagcgggtggctctatcgactggcttgaaactttccggaaactgcgtttgggtttctcaaactcaaaagatgtctgtactgaggaactttcaaagtttgaagcaggaactttacggacactcttcttgggtttagcagactcagcctcgactaaaagcctgttctgaggttttctgcttatcgttttcttcggttgaggaactggtttccagaagcatgaggctgaccagttctctaaccagatcaagtttgagtttggattggatgtatcatatgcgtgtacaggtagcacttttggtgatgaagcgagaagctgtaaacaaaattatccatcaagatctttaaataaaattagagactccatagtataaaagagatattggatacagtgaacatcattataataaataactctaccaacaagcgtaccttctgagcaaaagcattggctgttagtttcttgattccaaggtaagcatctgtaggatttgcaagcttgttcccctgataaaaaaagccagttctaacaattatttccccaccaacccaaactagaatatcttcctcgactaagtttgtatttaagtgtaagtttgaacttacaaagaaatgaaagtatcattacctgaagtagctgcaatctgcatttcctataaacttgaactccaatgtcggacttcctgatctctcttcctcgagcaaatgcttgcaacctgacaattcccatgacagagaaaagagttgcaacagcttgtctcctaacaaggtgaccacggataagcgcttgtagccttattatgcctttgagtgcccaaaaagcacgccgagccttcacacaaagagctcatgttaggatatacaaaaagacaacacaccagaagcagcaatcaagagagagagagagacaagcctaataaaatcgaaacagctggaattattaccaagtaacctctaaacgcagcctgcacagacgttgctgcaatctctcgttggattctctctgcatcagataatgaatgatcttgaacaggtgcaacattctgagaatctgttgattttccttcaggaagctcaatttcatcatctgagatctcttcaggtcctacattttgagtctctaacataccaccacttctatcaacggtattggtctctgcaacttcaaaagatggaagatctgataccacatctgattcttccacctttgaagtaaccagtacctcttttccactcacaactctctgcgcattattataactataattagaacaaaaaaaaaaaaaaaaaaagacaatcataagcaaattggtagcctaaaaccatcactgttttctcaattatgatccaaattctccacatacagtatttaatcatcacatacataatatagaattctcttacaaaagcgttacctctttgtctttggaaccactagatttagaagtttttttcccaagcaatacattcttcaaccattttgtagacttccccataatgtatagaactaaaacaaacctgcattgcccaagaaacaacacaagccaatattagtatgtgaatatggcaactactagtctaccacaatagtcaaaatgaagaagtcttttaattcattaattagttatggcaaaaaaggagagtaacacattatcttgttctaatcaactctaataataagcttataaagataaacctaatgataactaaatgtaagaatcaagaaagaacaaaaaaaaaaaacaatgattaccatataaatttatgaagtgaaattaccagatctggaactcagactgaaaaagaagaaccctaaatgactcaaaatccactttccaaaatgaaaaacaacaacaaacaaacaaaaaacaccgacagagtcaaacaacaaatcccaaacagagagatccttctaaaacccaacactactcgaacaatgtcttaaaataaagtcggtttaaagttggagtaaccgtcggatctccgttctaaatccaagtccgattcagaccaaacaaaaacaataacaaagaaggagataatataccgtaaattagaaatttagagttgtgttagttcaatgcttccatagcgtctctctctctcttcctcggagctttgatgctctctaaagaactgtttttctctttggtggtggtttcagagactttcagtgaccagacggaaagagaaaataaatattttgcgcaaaataatatttctaattttaaccaaaaagtaagcgagcatctccataactccaatcttacgcagttgatttctagccgttggatcttctctgaaatttagtatttttgtcaaacatttttagtttaactaaaattaatttttacagaaaaattcagaactcgaaagagggaaaattaaagaagagttaagagagcaatctataaagaaaaaaagctgaaaatcattaaatgcgataattaaaatagaagaaaaagggtaatttagtctaaaaatttggttatgtcatcagtagtctagattttaaaatacaacagtaacagatatttaattgaaattgctcagattttgttatagtcgtcgagattacttcgaaaacaagtgtaagaataccgcgacgttctaatgaagcattcgaagtaaatttacaatcatacccttgcactgtcgttgaatacgaaagaccaacttttgcaccagaggcacgtgggaaatttattaaccagtgcctagtggttcccgctccagtgaagtagtctcgttaaccgttatgggcctaagcccaatccataaaattattaaaaaaaaaaaaaatgatcatggaagaaaaaagcttgtgattgtgagacatttcatcgaacacttggtgatcaatatttgaaaacgaagagcacagccaaaattcgataaaccctaaggaacagtgagatg

SEQ ID NO: 8804 - DNA, 3000 bp, Unknown
  misc_feature (1)..( 3000): cDNA_ID_3043560_gDNA_ID_1971889_Annot_ID_176826 3000 nt of promoter + ATG
aaaatcagagaaagaaagaatgaaacatgcaatatactaagtgatgttaaagtattacaaagagaccaagcaaacaagtgtggccgcagagagagcgaaaatcaccggagccgacgatcatatgtggcactggcaagtggcaacggtcatctttatacatggagaggaggagacacacttgtacacgtcttctggtggtctactgccacgtggcagtattcaaatggtggattttatacatccgtgaatcttggagttgattttccttaatttaaatggtcgtactaccgacagccaaaaacttgtctttcaccaacaaatatgttttggaaggctgaatatcatcacacaaacaaaataaaaaactaacatttattttgtatgaaactacatcttttatttctgttcagaattttcgaaaccgttgaatttgtttgtcgattggaaataactagtgaacgtacgtaactcgaggattaattattaaacaaattcaagtattaaaaaaaatggacaatgcatgtttttctttacttttgaattttattttttatgatcacgattttacgtttgattcaatttctcatattacatgctactattgacaatatttatatttttcttattataacaatatcttttttcttttctttttttaacaatatctttttttttaacaatatcttattttaaacatctttaatttgtatgaacacaaatagatacatgaatatttctacgcgtgtgttaatttcctatttttgtgaaacaatatcaacgtctccgcgaatgcgttgaatataagtcatgattttatatatttttttatggttttgaacccacatctgatatctaagtgaagtatagcattctataaaatgtaactaaactttagatcatcgagtgttatcatgagtaacgtaaatgaaatacttaagttagataattacatacacaagggtggtagatcatctcattttgaaaaacaaaaaggaattacaagaattgaataataaaaccattaagtgagataaatacatgcacatgggtggtagatcgcataataaacgccgtacgatggatgagtattaaaaaaacaatgaaaatgcagctttggagttagaactcgagattcaaaatccaactattggtaaatctcaagtgattaatgcattattttgaagttatgatcgttgtcagtactattgattatgtagcctttaatgtatgcttaagaatatgaaggtttttcttagcttgtttcttaattttgaatacgtaacaaccattgttgtctccgcgagtccttgtctgcgtttagcaacatgttgatcaaggggatcttgattgtgagcgtataacaaccatcgttgttttgttctcttctataaatgatcttctaatctcacttttctttttccgttcgtttttctataacaaaaaattaacgtcaaggactcaaggggatttgaacgtttgacttttgatatttagatgaggaatggggagagactggtgactttcaaagttgttacgtggctaattaactcccctaggatttgtgggagaatccaaatcacgatcgatttttgctcaaaggagctgaatataagatggatagcaaagatacaaaataaaataactcagtaagagctttatttagtgcaaggggaaataaagaacgctaagcttaatcagtaaatcttagattgatgtcttgaaatgatgaagaaggagagttgtggatagtggctggcaacttccaaaattagctacattgatgcttataagttataacaacatatttctgtgaatctaaacttgctagaaatttctaattacatggttttgcgggcttctaattgaatcataattgggcttcttgtgaattctctaaatgcttcaaaatgaatttggatttaacaactctatccaaacaaacctcagcaaagccgtacgttctagctttttaaggtatcttcagtgcagattgtgtatatactgactgtaagaacaagaaatttataatgtagtatgtaataactccaaaaacattcatcaagctaaggaaaataatcaataatgggatgtcttgtctacttcttcaagcccattgaagaaggcacggatgggcccatacgaaaagatttttaacaagtctagccttcaaatttcctaatggctaattaaatagtttttattagataatgaccatgttctttgattgatcgctacgtcagctacctgcgatctaaaaaaagctctcatctctctttcacttttatttttcctctctttcatctttgccgcagcgactgtaattcggctattccgtagacgctggaattttcaacgtctcaaattccctttctcctatctcttcagatctatcgctgcgactctttcattcatctcaccttcatctttccttcttttttcttttatattttgtgccgccggtgcttgtcgcagcgatcaacaaaagaataaggtaaatattcattttgggtagtataatatacagtagtgagacatgggcttatgtcacatacactcacatgtgtcacacatacacctatttttgattattttagtcttgtttgtgtccattggaccttgagagaatcataattcattatctgtatcatgaagatttcaattcaagaatttatattcttacaggtccattactcaaaaacaaaaaagtaaagaaaaagagagcgagataaaatgatttcaatgaaaaataatttgaaaaagaaataattaataataaatatattgtactaacatacgcccaaaaattccactatagcgtatctcaagattcaagatctccttcttcttcagctctcgtcatcatcattctctgcttcttttcatttgctcctgttaacaaatttgccaactttcttccattttcgaatccctcttaacgcaaagttaggttttttgttaattcatttcattgcttggatcctaaggaaaaaaaaaacagaa

SEQ ID NO: 8805 - DNA, 3000 bp, Unknown
  misc_feature (1)..( 3000): cDNA_ID_1989205_gDNA_ID_1971889_Annot_ID_58484 3000 nt of promoter + ATG
atatcatatgcgacaaaaagtaatacgtatgagtttacaaagcaaatttgcttctttttttttaataacttctggttgcaaggtgatatgaaaaccccaagtccgttctggctaaatctaattattaaaatatgattttgtttgtaaaactataacgaatatcattcttctgcagaaatcaattttctttatttttctaacaatataatatcctgtattcatgattaatttcttttaataaaataaaagaaaattgatctctgcagtcaataatttacatagcaatcttgggagatggtcttgttacacagaaaattgattttcaaaaccaatgatttacataacaatcttgttgcagggaaataataagatttgggatcccatgagatttcctctgaatttatctgatattggtgtgctcgtctgtattctctacttccacacttcattctttatcgagatagaagaaatcttaaaattaacaacagaatacaatgtttacatgtggaatacaaaaacaaaagtatgtaaaacctataagagtgttataatgtttagaatccttgtgttagtgcaaacacacgtccctctaaaggtggaggcaatgcagaaaccgcatcttcgatttcctgtgaaaactcgcaaagattaattaccactacaaggtaagagagtaactgatttcctactgcttcataaccaggttggataaagaagacacaccttcactgtataccgagccgaaaagtggattagcaggattgctttgttttcaaacttttcagcatgatttactatctgcagtttaaggatatatgaaatcttctatgaccatcaagagacagaaagtaacaagaggtgtcaaagaaaggaggatcctgacctcagatatatggatatgtccataatctctcgcatgctctaccgataccgaatcatcaagaaatgtgctctgcacaagaggaaatagagacagcttcccttttaatacaaagccatgaaacttggaccgggaagaactatatcattataaatcacgcacattgtccaaattcatatcagtagcagatattcacctccatgacgagaacctttgccttgagagcatcagcattagtttcatcaactacaaaatccgacgttgtatctcccgtaaaagcaacttcaggagttattatgctgtctgtaatctacaatccacaatccaaacttattaaacaggcttatatactttggaaagaccattgcaaaactattgactttgtgatagacaaacataagaaaaaattgacaagcaatattaagcaaatcaaagacaaacctcaacacctgaaaccttcaagttcttaatttcatttccagataggccaatatattccttcttgagtttatatttagttgaatacactacataaccctgcaaaatatcaaacgaaagcatgaattcaacgaagacacataacgctaagatatcgaaaatctcatgcgagtttactaaaataaacctggctttggatgacatggaatgtcttaaaggctttgactttgagatctttccttataataaactcctcccctgcatgaagaagtgtccaaggtttaacaaaaaagccaaatcttggctgcaatgaatgctagaggttgagttaccacctatgtccaagccaacaagattgtgctttagctctgaagaatctaactttctgtgaacttcgaataaactctcaacagtttctttaatggatgcgggtactataatcgttggaggcttcattttgtacaagcctctagtagcaacatacattggtaatccaccctaacataacaatacgaatagtttagctcacaatttgagaatgtaacacccaaacagtaacagagcaataggctaatataacataacaatttagctgacaattagagaatgtaacaccaacacagcaacagagcaatatgctaatgataataaacacatggtggctctcaacaagggtttatcaaaacagtaacagagcaataagctaatgataataaacacatggtggcagtctcaacaaaggcttatcaaaattgttcttaaaacaaaaagtcaaaagaaggatctttgcaaaatataatccgaaatttcaagtctttttatagaagattcaagatacttacgatatgatccatgtgagagtgagagatgaagaggaagtcttgagaaattgcgcgatgtgggcaacgaccaatgtcgaaagctatccgaagagatggaaatatgatgcacgtctcgtgcccaccaatcgacaatccctcgatcgggtaaccttcaatttgcattgctttcttcttctccatctcactgttccttagggtttatcgaattttggctgtgctcttcgttttcaaatattgatcaccaagtgttcgatgaaatgtctcacaatcacaagcttttttcttccatgatcattttttttttttttaataattttatggattgggcttaggcccataacggttaacgagactacttcactggagcgggaaccactaggcactggttaataaatttcccacgtgcctctggtgcaaaagttggtctttcgtattcaacgacagtgcaagggtatgattgtaaatttacttcgaatgcttcattagaacgtcgcggtattcttacacttgttttcgaagtaatctcgacgactataacaaaatctgagcaatttcaattaaatatctgttactgttgtattttaaaatctagactactgatgacataaccaaatttttagactaaattaccctttttcttctattttaattatcgcatttaatgattttcagctttttttctttatagattgctctcttaactcttctttaattttccctctttcgagttctgaatttttctgtaaaaattaattttagttaaactaaaaatgtttgacaaaaatactaaatttcagagaagatccaacggctagaaatcaactgcgtaagattggagtt

SEQ ID NO: 8806 - DNA, 228 bp, Unknown; identical to SEQ ID NO: 8782
  misc_feature (1)..( 228): cDNA_ID_1989204_gDNA_ID_1971889_Annot_ID_58485 3000 nt of promoter + ATG

SEQ ID NO: 8807 - DNA, 3000 bp, Unknown
  misc_feature (1)..( 3000): cDNA_ID_3043625_gDNA_ID_1971893_Annot_ID_176859 3000 nt of promoter + ATG
ccggagactgagattattattacgaagacgcagatggtgaatctcaagtgtgctgcttgtgggtttatctctgaggtcgacatgagggataagttgactaatttcattctcaagaacccacctgagcagaagaaggtgtcaaaggataagaaagcaatgaggaaagctgagaaggagaggcttaaagaaggcgagctagctgatgaggagcagagaaagctgaaagctaagaagaaagcattgtctaacggcaaggattctaagacgtctaagaaccattcttctgatgaggatataagcccgaagcatgatgagaatgctctagaggtggatgaggatgaagatgatgatgatggtgtcgagtggcaaactgatacttcccgagaagctgctgagaaaagaatgatggaacagttgagtgctaaaactgccgaaatggtgatgctctctgcaatggaagtagaagagaaaaaggcgcccaaaagcaaatctaacgggaacgttgtgaaaactgagaatcctcctccgcaagagaagaatctcgtgcaggatatgaaagagtatctgaagaaagggtcaccaataagcgcgctcaaaagtttcatctcgtctctctctgaacctcctcaagacatcatggacgcactcttcaatgctctctttgatggtgtgggaaagggattcgccaaagaagtgactaagaagaagaattacttagcggctgctgcaacaatgcaagaggatggatcacagatgcatctgctcaattcgattgggacattctgtggaaagaatggaaacgaagaagctttgaaagaggtggctctggttcttaaagcattgtacgaccaagacatcattgaggaagaggtagtgttggattggtacgaaaagggtctcaccggagctgacaaaagctcgccggtttggaagaatgttaagccttttgtggagtggcttcagagcgctgagtctgagtccgaagaggaggattgagtcacttttttcttccctcctaacttttctttgcggcatttcttataatacttcgtcagttttcagaattcttaaatctttttgctgtgttcttataaagaaacatcatctattaaagttgtcttcgtttggatttggttttgacgactttgggaaatatttatgtttaagaaggtttcattggtcattgacttttatatattatatcgtaaccatgatgtgatagtgggccttagatcaacaaacatgcgaaaaacagaagcagaggcccgtttcaacggagcataataaattgcattctctgtcttttgtttttaggttttttttttaactgatagatgtgccgtcgaaaataatattgatatttaaaaattcacaacaaacattcttaactgacccacccatctatctgctattcccacgcgccaaggaaaataataataatagcgaaattgatttttacatttatttattgatagataatttgtgtattgttaagattaacagattttaagggattaaagtggaaaaggtaaaccgaagacaacttgccatttactgatttacaacaatccaaatttaaaaacaaatggtcccagtttttagggttgtcacttaaatttatcgaaatatttacactttaattgggtaaaacataatggacagaaaaacaaatattgtgacaaacaaaaaaacatgttttcaccaagaaaaacaaaaacaaaaaagatgtaaagcttttcttacatctgtacaaaataaaagcagacgaaattgtactttattttccttattaaattgtcggtatgttttatatgttgtgaaaagtagaatggataaccaaataaaaattactgacatcttaataaagttggttcaaccggtttaaaatgtatttttttagtgttaacaacttaaagcttttttcgattatcgaattgcaacaaacaaatatattaacagaaaaaaggaatcatgtatctatttcaatatcctgttttttttcttccatttggatatttagatctttttctgaatttatcttgttcttaaattaaaacagaaaaaaagattaaaagtaagacagcttgctaatggcaaccgcaacaaacaagataattttgaaacggatccacttggattttctttgattttgtagaaaaattgacaaattgcttttgtataaaaacaaaaaatgtaccgtaaaaacacacacataaaaaataaaaagtgataatgacaaacaaataaagtggtatttttcttttatctactaatgtgattataaaaaaatcgacattgaaaatttcaacacatctttttcgccaaaacctgaaaatggtcttattataacataaattagtttttttgtctttctattatatattcaataactcatcccaacttgaacaaacctatttcaaatttttttgtcttgaataatgataagttccgtagtgttcttttctgttgtgacaaaaaatactagctaacgagggataagcacaaaaacatgattaatgtttctctaatcattctaaaaatctacaggaatattcccttttcagttttttctttcttaaatgcatttcttagttcttcataattcagtgagttttaataacaataataaaaaaaagagcatcattaattgaacctaaaaataatgagaagaaaaaccaaaaagatagagagtaagatgcacgcgctaaagatcgaacggttaatagaatcaggttagtgaagagagatattaaaagtttgttgtcgtgtggcaaaaactataatttccttctcacaaacaaaaaaaataaaatcaaacacaaaatcccgtagcatcgtaacagtaattcgctattatctcctcaccctccgctttcgcttcccttctctgcccgtttcaattccttctaagacatcacggtctctctctataaaaacagtacctacctcttcttcttcttcttcattcgctgacttcgtttacactgaaaacaaatacct

SEQ ID NO: 8808 - DNA, 3000 bp, Unknown
  misc_feature (1)..( 3000): cDNA_ID_2039641_gDNA_ID_1971893_Annot_ID_176867 3000 nt of promoter + ATG
atatggagctttattatttaaatctttgataccttcttctgtaattatgaaacacagataattatgtaaattagcaggcaatggagtaaatatggtgacattatgagtcactgatctgcctaatggagtttgatgatacaacaatgaaggaaggtcatgtgcacttgtgtgacgtgagaatatcctccggcttgtttggtctttaaaaggaaaggacaccacaataacaattatcaattagaaaacaaaaaatactccttttattcttagtcaccaaacaaataaaatcagctccttttttcataccacacaatgggaacaaaagcaatgataaaagaagcccatcaccttcctttgcttttaaattattcataatttatgaaagaaacaaaaaaaattattatttttatttttgcttctcttccggtaagtcaaaggagataatattaagagtttagatattaatctcttaaattctgtgttcattttaagattttgtagcaaaagtttattattactaatcatgtggttgtactgcatgtttaaccaacatgaaagaatatgtattcattttttcggaatgcgaaataagagaatcaatctcagttcagttcaagttcgaatctttgaacgacatgcggtttatataaaaggaactatagtatataaatatatatttatatatatgcctcctttaatagattttcttatattccttctttgttttgtaatttatggagaatatttactatgtattcttcatgaagcaattttacaaatattcgaattttaatttttccttttttgaacgtctgatgatcgatcattcgcgtgcacaagaatctcatcagggcatgatagattcgaaattttgatttgctcagttacgatatatctttgattattcttcctacggcggtttaaacctaaaaacaagttttcatgttttattcacctagattggtttcaagtgtattttctaaccactatttttttcaagaaaacgggaaacaaacagaaactatttctggtgcaaaatatagtctgaaaatagtagaatgcaatccatatcaatcttgaaagatatatttttttaaagtgtacttgagaagaatgtaagaaataagagattaaaaaaggtacggagaagataacgagaaaagcaataaaatgcataacttttgtagtcataacgaaaaaaaggagaaagaagataatgaaaatagtggaagatcggtgtcttcgtgatgaattaaagtagaattgtgtgtacgtaacttttgtaatcatactttctttttcttcatcaactataagacgtaacaatgatatctataatgcatgcatatagttttaaaattatctaggttcttgaccaaggcttagttagctcggtaagtttctaagaacttcgatttaccaataaatcaagccaaactatatatgatctttcgcgatgccaattgatattctgacaggatcatacaatattgttgcttttcttgtatttatttatttgcgtatcaccgcaccgattcatatttattatagtatatagattggaaaaacaatatagagggactctttattaaagtaaaaccaagagaggaaataaaactgaataagaaaataaacaaacatgcttgtctttgtcgaacacacagatttttattacacaagtggttccgaactaattaagattcctaattttaaaataataaagagatttaaaaatgttatcttttgtgtttggtaggccattaaagctccaattatttgtcactaagtcagggaaggagactaagcataaagacgccactgcataaaccttatggtcccctcaaaataaacctaaagttgtaaaagaaagaaaataaaaacataacgttgataaaataaaatttgaagaaagaaaatcctacatctttgtaccacctatatgaacctaacttatagggaaaaagacattgattcttttgcagacccatcagcgtgcatgtccaaaaagatgtgaaaatggtttcgaaaattatggattggtcatgatcagttagacgataattcgggctatgattatgaatatatatttatatttaaaaggatgaatcttttcaactttagatattctaattatagtataaatcatgatcattttatcatttacgacatgtttaaatcgccgtaacatacatagaaacatatgaaacgattttacatatatgacaattcaatttatatatatactacaaaacgtacggttctatatacactacatttatgataaacttcgaacttgtctatagtttaagaaaatctgttgctgctgtcaaaagcactaaatctttgatcaaccaataaatcaaaagtttcccacgataccaaaatttaaagaaacgggggaaaagtatatttgttctgttaaaactatttattatttgaaccctaaaacataagactctttccaattctggaatgcaaataaattatacaccaccggaataatcgactgaacttggtacgtgtcgacatcggaaggtatttcagctcttggtagatgacatcacgtcgtgcgtacctcagaaattaaagcgcacgataaggtcaccttctcggctttgccaaagatgcatctctctcttgcgttttgtttgtcgttaaacgtttcgttcctttaaattgattgtgattatttcttaataaacttgattactattattaattctttaacttaaatattactctaatggtgatgccgtgatggtcacaaataaatgaaatagaaaaagaccaaaacaaaaaaaaaaaatccttttttcctctcttttacatgatgggaactcttgacctttaagttttttttttttgtgacaggaagtgttcaaaggaacgaaatacacttcttcttccatttgatgtctgtggtccgaatgaaaaatatctctgtattaaccagaaacgtgtttcataagcatctttaactcttcagctctcaaattcttc

SEQ ID NO: 8809 - DNA, 3000 bp, Unknown
  misc_feature (1)..( 3000): cDNA_ID_2039866_gDNA_ID_1971893_Annot_ID_176870 3000 nt of promoter + ATG
cacaatgtctattgctcataaaattttgagagactcgaatacaaagacgggtaaaaagtctgggaaaaataaaatctgaaaattgtatcactggtcaccaggaattgacttgataatgtcagaatcacctgaaacaagtcgaaagacaaaatcattagtagatctatcaatgaagaaccagcagcaatatataagcaagtagctagctcttttaccaggatcaacaatgctcagacaagaaacacggaagtactttccgcaagctgttcccaaatcaacgttatctgaaagccattaacaaggagagaagaaaaacacagttaagccaaagtggtagatacaagaggaataaccgatgaatgagcgttgaaacatgaaactatgttcaatagaataaacattcatctactttctttgatgaaatcatcaagataatgtattaaaacgctccttcgagtattatcatcgagcaagatcaagttttgtctaagagtcaaaatctaacaatgcgaaatcatagaccaacagagcaatctttggtattatgaaccatgtcaatatttgcaataaccacatacagagacaccaacagcagttcaaaccgatcgtgaacttgcgaaagatcaagacttcacgtcaatatacattacagtttcttcgacttgagatcatacttccatcatcagtttaatggtctatagaagcagattttaacactttcatctacttaagattatacattctcagttattatacacaatgaaaaccttcacaaaaacaagagaacaatgaatctttaaaaactggacgagctaaagaagaaaggaacttacttccattgtaatggtggacaccaactttagcgagcattgcgtagtactcaatctctgatcttctcaacggtgggcaattggtggagattagaatcagtttccctgtgaacataagcaaaaaccagaatcaataacaaactacaaaaagctaaaacatttaggtatgcagaccaagtgttcgacgcaattacctttggagccacggagggatttgagaacagacttgtaaccaagagtgtatttaccactcttcataacaagagccaacctactgttgataccctcatgagacttcttctgcaattaagcaataaacccagaaacatattagtacattgagatcgtaaacgatatctagatgatgaggaaaagggataaaactttgatgggagagaataaggcgcaccgttttcttttccgtcaccattttcgccggcgatggagtgtaatcaaaatgtcttggatctgtgcggtggaggagaagaggagcacgatgaccaaaccgaaaaagcgccgcttcgtcacctttttatagtccgtgtcaattttctagggtttttgctcttcaatttattggaaatttcaattatgcccttaatgtttctatagttttgtaatttgtcaattaaaaaagtaattactcgatttattcgtttcagtgaattgacagtgattaaattagcataaaccacttgtacattcaacattttgtcgacatgaaacgtatttgaattactttttaatttacaaaatatgcagaaataaattggataattggtaaacatatattttttatatttttttttatacttttattagattattcaatgtttcaagtttcaacaagttttgtttgtggatgaaaaaaaattcaaattacttttctattttctttctatcggattcaacgtataagttgaattctatagaaatggaacgaactgatcaatctcagttatgactagtgtgacaaaagacaaagtttaacaatatttatttaattaagataaattgctaattttaagtgttagattttggtagacaaatattaatagataaattataattaattatcttggaaattaagaaacaagtaatcaaaagtggtttaatttttattatgatttgaagaattaatagaataagtcgaaagatgtaaaaatatttatatacacagagcaaacttcacattgaagatctctctcttttttccccctctatgttaatatcattccccttgtcggcacgtaacaacaacgaccgagacaacacaaacaaacaaatcccccacgtgtcgtaaactgagaccaggtggtcgtcatgtacaatatttctataaaatatatggtaacatcaagaattattccatagagccctaacctaatttgcttccttttgaagctccttcatcgagaggcaccttcgttataagcttcaacttcactcgctatatgtatacccatcatgtctctcttacaccatctaatatctcatacacaccattataatgtgtaatggattgtgcttgttttgttgggttaccaataaattcaaacacatgtacatgttattgacaaaaagagaaaacacataaggtttgagtctttaatttcacagaagagaaaacacacagtgtatatacaatgtacaaatcacactagctagaacaagctatatataaaaattagaggcagactaggaaatatatatgtgtttgatgtatttactatatatattatccatacgcatacgcacccacgtatatatgagcctttaggcaagtgccaagaaacctataatgttaaatatgaacattgaataaaatacatcttttttttgggttaaagttttaagtaacaacacttggttatataataagagtaaactacatttttacaaatattatataaaatgagtataaatgtaagggatgtacctagccatatggcagattcgtctaaattaagatcaaaaattctatccgctcaccatttgtaactctctctctctctctctctctctctctctctctctctcttaacacaaacctaaaaactctcctttcgtcgactcatttacttaaatatacaattttgcattcgatcaatttctctcgtgccaactaataatagattgtgttttgattattttgcagtgaccatcggat

SEQ ID NO: 8810 - DNA, 3000 bp, Unknown
  misc_feature (1)..( 3000): cDNA_ID_2037390_gDNA_ID_1971893_Annot_ID_176873 3000 nt of promoter + ATG
tgtacgtatgagtatgttagcttggttggttagaactctcgtctataaagatttttttatttattaaatagtttatcgttttgtaccgatgaataaagtttataaaaattattttgattggttgttcgacatcaagtaccaagtaatgtaacatttgcatgtaaaatatcaaaacatatactacatcataagtttgccatcgcaaacgctgacaaaaagtagtttcttattttatttttaaatttttgttaagggacaaaaagaagttttaatttaaagtattttatagaggtaaaataatgtgaagtggtctttatgactaaatttaaacgcagcaaccaaaattcttagaaatgttatgttttgttcggatctaaaccaactttattcacatgtttttagtatttgttaactcatgattctatagaataatctataactatattttataaataaagttctgaaggcacagttgatggacgcggccacacgtagaatttgccttttagataaaggtcatcatgcataatgcgttatctcagtgaatagattcgttcggtgcactgaacaattggtttggtacagattaattcttcagatatcgtgaactacaggaacaccagtgtggccaaaagcactatataacgttcacgtacgtcaaaataattaaccgatgaagtttggtatgttaataacttaatataatgagatatattatagtctattttccgggtgctttcccctttataatctgaaaacagaaaaaatattacacatatattttagagtttaagcaaattttctcactttggctgacttcattcacacaaattggtctttttttttttactaacactaatggttctaatttttttcgtgaacacacaatgcatccaaaacatggcgccttccattattttcaaaattttaaccattattattgacgggcacataacacgaatttgttgagttgcgttagaccaaagaatcctacgtaccataggactatggcattaaagtagctagtttggaggattctggtgggtgaaaaaaagtaaataagtgaataagaattggttcatagtggaaagaacaacctatatgactcatgcgtagtggaaagatagagaacaacttatatgactcatgcgtagaccatgatcgtacgatgaatagattccattggttatgattataagtaagcaaaattccaaaacggaaaaagaaaatgtggaccgaacatgcccagtgaccacatcacatccgttcaattccatattcttccatataaaaagataaggaaaaagagacccaaaaagaaaagaacaaccttatatgcataatcaaactttcatttgcatttctttttcatcttcgttttccttcgaaatcaattatatagtatagtgccttctttctccatcaaaccattcttgttttgtttggcaacgctgacatctccacttaaaatattcgttttggatcaaagctcatatatgttcttgtgttgatgatattttggatatcgatttgtttgttaatttttgagcattttattaagtatatactagttattaaatattaaaaagtacacgaaattttctgatcatctaacattgttggtatgctacaatcgcacattttaatatatgttgcgatcaaagtttgaaaagttgaatagaaatttcttaaagaaacgatgtgataattcttgtggtcaggcactcacttttttacctccagaggttaagatgattttatgaaggattaaaataaaatctcaaagacaaatgcagtttttccccttgatcttatacgaatgatccatataaaatctctaaaagtatttcttgattcagtcagcaatgtgtccgagatcaccaaacaaaatagtcacaagatagtacttatcttcacctgcctaatattcttcatattatgaccgtgacatattacgacaaagctatcattccctcttgttgtattcatttttttctaagttaaacaaagaatatgtacaatcggataaaaacaattgatttactggcatgttctactataccaggtaagtatacgctaaaaaaaaagaaaaagaacaaaaaaaaactattttcagtatattaactaaaaccaaatcgaaaaaaactatgcactttttatagaattctgaactagaccatgattatgcaccaacaaataattacaaacaaaacaacacatagggaagaaaaaaaagatatacaacaatttattggctttacaaaaagaaaaaagaaaccagaattttattaataattatttatgttttttcacataagcattcacttggaaacttgttatttatatcgtagtctaatgaggaaataagaaggttatatcataaatcataataattaaattatatagtcaaattacatgcagtaacaaaatctcaagcatgagtgataatttcaactatagtttggctaaaaacataattacaaattcagtatcctataattccctatgtctcggattataaaattttctagataaaagcacacagtttaagaaaccataaatgttttatgttatttttataatagaaaaaagattgtagaaatgattataacattctaataaacataaattatgtatgtatatttgcgaaaatctgactaaataagaaaaagtctaaaatatctaatataatgggacataattaggagtatcatttttgaaatctaatggtaatttctaaagtcaatataaaaaaaaaatagagtaatattttattttttctacatacagtaaagtaacagctttcaattattgcatataaattatattcaaaatttagggccaaagtttggaattatacttactttctttctaattttaagtataagttatggatatatatgaccaaaaaagttaatatatatctagagagagagctgaatgcaacttagttccctatcacacacttcaataacccacaaagataaaaaaaaaaaaatg

SEQ ID NO: 8811 - DNA, 3000 bp, Unknown
  misc_feature (1)..( 3000): cDNA_ID_1388793_gDNA_ID_1971893_Annot_ID_176878 3000 nt of promoter + ATG
atgtctgccgaaccgaaccaaaccgagaaccgaactccaattataattttgccgatcggtttagccttcccttcatagtcggtaatcggaaccgaaaaaatcggtttgttcggttcggtttgttcggtttaatccgaaatcccaggcctaatgagctctatcaaactcatatcttcctcaacttaagagtccgagtgattacgctaccgttttgtaagtgggccgttattgggctttgagatttaatgtgatttgagttcaactagatttaggatttgcgtttactcgatctctacgtttctctaataatatccacagccatgaacggagaaaagtcaccaccgattacgatgacgtttctaaatgataatggtttctcacattgttttttttttcgatttgtgttacatattttcattatcccaaaccaccttttgtattcgattgtatctttgttgcatgtttcaagagctcatctcgataatggtgtctttgttgcagattgtatcagtcaccaaacgacgcagcgcccaaagctgatagaagacaagtgattggtgtgaaagagtgtggtgaaacttatgttctggcagagtataagcctatatatgttcatcagctcgtccttgtccttgcaactgctatacagctgggattgtgtatgacattgaaggatgttgaatatgaaggaagattagatggaatctttgtgatgttttgaatcttgtttgtagcttcatataaaattatgattatgtaaagtcttatgtgtaatcaaatgtttaactttttcctttattcaacaaaggatttgtatcgataatattttactagttacagaagctgaagaagaaagtattgtaacaagttagggtgtctgaaaccataaaggttgtgtcttgctagttaatttatatataacaaaggctgaaacatgaactttttaagatgattccactctcgtttgcagcattaggagacatagttgataagaagcttgatgaggattatgtaaaggaagaagttgaaatgatgatacaagtatctctgctatccacacaagcagcaccgggagaacgaccaacgatgtcggaagttgaaatttttagaaactcctgcttgtgctacataaactggttttgcaacatcatctccataatatattctaacagtttgcttttgaggattgattcaggatcatcatctatatctgttgtcttcttagtttttactctgtctcgggttatccaaacagcagacttgtgtgagtacacaaacacagaacaacagaaccaaaatctctaaacaagaccggctctctaacaagagacataaccaccaagtagactcttgtctcccttgcactgcattaattagtaatcaccaaaagtctattcctgttttgcttcttctcttataatcatcaaacacacaaaaaccaaaaacgttgtagtagaccatcagctactggaatcagaagcaacgatagagtttgagggtaaccaaaatgtgtttgggagtaagcagagattaaatatctccatcatgtcactatgttgatgggaagaattcgattgattaaaaaaggaatctctgtacaaaagcccatccaaagaaaaggaaattaagatcaagacaaatatctgcttatgtcaaagtcattaaccgactccaacggctatattgaacaaacggttatcattattgatgaagacctaattaacactttgcttataaataaagactcatacacgcagcctcttctaattcttcgttgagagaaaaaatcaaaactctctgattcacattcacgcatcttcttcttcttctttaattttcttcttgagagaatctctttatacagagactctgtgtgaattccgatgatccaattagtagtcattgatcagaagtgaaaagcggatgatgatgatgatctcctctgcaacatgatgatccgtaagagttgatttcacttttttccgatgagtcgcagatggagcaacgacggatgttaacggcggctagaccacgtttgtcctcgacgatccgtacgattacgtctcacgtggcgttctcagcaagccgtctcttgaaaccttatgttgcatatcggcttggattggaggtatgagtttcgctagcacgattgctttgggagataggacgcgaatcagaggaaaacagagaacgaatccaccggtggagataaagaaatcgccagtgattagggtttcacaacctcgaggtataccacttggagagatactagtggtttgtgctgaatagaggaatagtactataaactttcaaaataacctaaaaaaaaattactcatatacaaacaaactacaaaagtttagggaaaatggatcattttgaatgcatactactagtaggttacagatactgaatcactgatccaacacataaggcttagttagagcagaaaatgtttttaccataataggcccaaatcttatatgtgcccgataagagatccaaagaaacccaattatcactgatccaacacattcaatattttactaatctcaaataattatcgttgttttggccttttcttacatttctactacattataatccctataaaaaagacatttaattttgatgctttttttcttgacatgtgatcaccgacagagagagtaactacaagtctaccattatccagctgcaatcacgcaaacgcaccgcctttttctctctttgccaactcgtttatttccaatcataaaatgccacgttaacacactcttgcagttaattgacggaaatacccctcttcacatactacaattacgatattaatgtgttaaaaattaacggtgtgggctaatctcacgcgctttcatcatcttcttcctagattcgctcctccactgtcttaaatttcactatcttcttcttcattttccttccttctcacttcaaatccataatcgctctacttctctctctctctctagattcgaaaaa

SEQ ID NO: 8812 - DNA, 3000 bp, Unknown
  misc_feature (1)..( 3000): cDNA_ID_3043609_gDNA_ID_1971893_Annot_ID_176874 3000 nt of promoter + ATG
tgacccaaaattgtatatcgtttaatgcaataaacgtaattaagctctcgtatacttcaaatgcccaaatatcatttcaagtcagcctaaaactataccaaattttgaagttcgaccctaaacgtatatatttaaaaactcaatttcaatttttcacatcgtagaaagtttgtgtagctagagaaacatgttaatatatatagtttcgaattcatcggatatatatttaagtgtagttggtcctacatcccaatatcccatgatgtttttttggtagttcggtttctcaagttggttggtacttggttcggtttctcaacttggcccatgatatgaagcatataatatgcatacatacatctacattttcttttttaaagtgttacattcacaaatttacaaatcgaaacttgttataatatgcatacatatgcaaaacataatgtgttaccgacttcaatcgtgggtacgtatttttgagattgatgataacgtataatacatatctaaacagattataacagctgtttaggacattcagtttaatacccaaaaaaaaaaaaaagaaacaacgacaaaatagttgacgaatatacatttaaaaaaaaaaaattatagtaagatagtgtgtggctggccgtgaaccaacatggagaacaaatagctcgtagccaccaaagcactatctagcgcgtagcgaacacgtagtcaatggctaattgtaccaaagacgaacctagccacattatagtccacgttcaaacgaggcccaccagtttctataaaagtcaacttcaccccccaaaaaaaacgctcctaacttttgaccttttcgcttttcttgatttggagccagtggcattgtcgtaaaatcatttgatctaaccgctttgatgttcttgcttagtttccattacttctgtcattatcacctttatatttttttctcctaaaaaagccaaatattcgtaatcacgatctttatctcttataatttaatgtttattccaatttaaaacattaaatttataaaagctcagatctatatttctttttcccctcacttttgttaaataattttttttatctcttgtttatctttcttgaatttttttccagtttgaagcaaaatctattttctctgtaaattttgtacttttctcacaaaatactagggttttcgttttgtattttgatgagagagtgattcagtgaaccgggacatgattcaggtttactgattttactgttttaaaactttagaaaagaatagtgaacatgaacaatctggtgttctaaaatctaaaaaggggaggcttttaactaatatctctcgtgtactttttctctaattcttaaatcgttctctcttttctgtttctactttttaagatcccttttcgctttaataaattaaaataaatcacgtaaaaggtctaatttggaggaaaaaggctaaaaagcgagatcgaattcttcttcttctttttccaggtaagtgggtgtttcaccttccaactatcaatggctatgcataacaccaattaatttattttgaaacctctcatttatagaatacacgtgcatataatgtttaatcatcttcttcttttttggtgaaaatagtataatactagttgattcctttttcaattgtgtttttgtctatgtgtatagatatcagattaatcacccaattttataactggcaattatacaataatgaatagaactaggaaaatgttgaagaggtatcgtctggtgtaggagtttacgattacagcgtctcttcgatcggtagaatattaattaactcactatcaatcatgcatacttgtctacattacaaagtcaacacatgtggtgctcactttggctccagcaaaaactgattacaatatttgtgttttaaagtatataaaaattagtcagaaaagagaatcgtattattttttatagctttttgtgatcgaaattggcttatgtgacagaaaaacgccggttaattccttagaaaaacttaggttgaaaatgaattgcggctagtttttataataatcatgtcattgtccatcaacttgcacaagttaaagcttttgtctaaaaaatgggtgatttaaaatgttggtttaatgcattctaatgaacaagtcaatatgctggtattgacagaacatctacatagagtttggacaagagatcaagtcccaattagaaccaccaaaaaagaacatatgaattaggttttatataatagccttttaggtattctttccaaatttctgttcagttaggtttgttttctaagttttcttaagtccttttctaaagtttatgtccaacccaaaacgatgataaaaaaatccagaaatcaaatgttaattaataaggttctcttcgtctactcttagctaaaattaaattattttataaaaaaaaaaacgaaaggatatgattaacgttagttcttcctcgtttattgagggataactgttgcatttttaaaaaatctcactatgtgccacgtggctattctggtcaactatctctccttatagcaaaaaagtaaacgagatcattgaattgagattgttttcagtattgcacacaaagtttgccacagaaaccattgacttaatttgtttaaactttaatgtcgatcaacgccaattaaaaattgcatcttttctagttagacttttttcaatgttcttaatgtacttggtctcttagtaatccagattcatcaaattgtatatgaccaccactctcttatcattaaattaaaacaaaactatcctaaactttcgttataaataagcttcatcaatgttgctccaaaattcacacttaaaagtcatctttcaacccaattatctctatcctttctcctggttcgataccattactccatccacacaatttatataatctcaaaaacttgcaaagtaaagtactaatctaagtagtctcctgttctgtttgcagagttacatagct

SEQ ID NO: 8813 - DNA, 3000 bp, Unknown
  misc_feature (1)..( 3000): cDNA_ID_3043598_gDNA_ID_1971893_Annot_ID_176881 3000 nt of promoter + ATG
aaagagtatatcctacctattttactaccaaaacaagtttagttccaaaattaacacaattaatccaaaaaataccataaactaggtttaacagtttagcaaatattagataaattttaacaacttttaataacactaccatgacatttgttaaaaaaaagcatcgaaatttgaacaatacttgtgacagtttaagacagattattaaataaattaatcaaacacgagaaaaaacagagtgagagtgaaagaaagaaacgaacttgagcaatgcggaaccattcataggagtcgaatgaagcagcggtcaagatgacttgaggaaagctggtagcagctttaaccgttccgttaaaccggattcctggaccggcgtaggctacgccgtgtaaagcttctgaccaccattcgtacgccggaactccaagacgcggtatccctggagctgtattcaccagctgcgagatcttctcgtctatggttagcctcgagacgagatcacgcgctcgcttgccaattgggaggtcagtgcggcagaactggtagagtttcgtggttggatttgaagggtcacaggagtgcggcggaggagctgattcaacgccgtggacgatgaagagaaggagaagaagaagcagttgtttagccatggcttcgaaatgcggaaaagagatgagaaagtgatgagtgtaagagagtgacagagtctctgttcttcttattcgttccccaattatgtctgtaataaattgacttaaataaccttcttgattcaacagggtaacctaaaaatttattatattgttgtttttcaataactctttttttttgcaattaatggacatcttaaattttttattcaatagttgaataagtataatgaagttgttaaattttggtgttgtgaagtttttgtgtctttttctgatttgctattttcattattattttcagatttttatctaatcctatatccttgagatcaattagtttatagaaaatgttttaaaaacagttatatcaaaactcatcattttttaactatataaatagagatttggttcctttaatttggacacatagaaaatcgtattagattgcatattatctcaaataaaataaacaaaaagtatttgatttttatctatttctgtttaatttaatttgctaataaactatttaattcttaatcatttaatttaataaaaatcaggatagactgttgaattttattaaataaaataattgtagaatagaaaaaaatagtatatatatatatatgtttaattattagatggaaaagataacaaaaataatgtgaaaaagaaggaaaaaaaatgttgaattatattataccattataaatggtcttacgggccaaagcccaataatattttttccaaatagcttttaaggtctttgcgttaagtcatttagcatatatttttttcccagtgtacagcccaataagtctttcaaaacgttttggtatcaaaacatgtaatagcgtttttatatatcaagaattgtttaagaaatgtactgaaccgtccaaccaaccatataagtgataatggatagcaatattattataaccttatcaggtcaggccatatgtcacaatcaacctaattgtgatctataaaagttcacctggtcacgtatctaggtttgactggataaaaattgtcggtttcaaacaattaatacaacaatattactagtagataatttgtttctgtctcagctaaatgtttggtggaaggagctttgtagagaaattcatttgaagtaaaaaaatctaacacaaattcaacatgttcagaataataattcacagctgggtaaattttaatttacaattattgagtttttttttttttttgtttatgtcaaactcaaaactagtgccacgtggaggaagctaagcctataaacgattatgaccgacagttgtcactctagaagtagcggtccttgtgacggcataagctggtcataaccgcttagtggtgatgatttgacgaaattgcccattaagcgactgtgagatgtcggtagactacgatggccacgttccacagagagtgacactaacaaccaaaacctattttattactattttttcttttgtcattagtattttattactaattgtttgaatatttcctcgtggtctattattattaaacactctagtcctcttattgttcattaaaattgtctgacgcttgtctcttcctttcgttttctactagaaaattcagctattttcttaatgttttatatctcgtaaactcttaagttgtaacagtgtttcaatataatttgaacacatattgaagtttagtccaaaattcttcttctccagaatatatccaaatcgagtcacaatggaaaacaaattctcctttgtaggtaaatagaaacaaacaataattgtggcattaaagtgttttaaaacgagatcccaataatttacatcagtaagatttcaaaagtgtgtaattagaataaacaataaacctccacaatttggaagatattttgtttccatatttgtcgcgtataatttattatattgtcaattctcgagaatttttaacgttttgttttgaccaggtaacgactgttccggtaaatatgtaggtccaaaaacttcccgcggacttaactcgttttgaaatccgctgtttggttttctttttttattaccggctctaaccggtcctacccaaaaccttgtcatgtcctctcattcctccaccgtttataagtaggcccttaactccaattcccaccgtttcttcgctaaccacacaaagcttgttcttctccttccttctccaatttcgtaagctcaaagatttcgatttcgattttgattattgccaaaggtacaaacttttgaacacaggtttgtttattttgtttcactctgttcgattttatggggttttatttatattttgttcttgatcgattttaccaggtttaaag

SEQ ID NO: 8814 - DNA, 3000 bp, Unknown
  misc_feature (1)..( 3000): cDNA_ID_2037366_gDNA_ID_1971893_Annot_ID_176880 3000 nt of promoter + ATG
tattccaaacatagcaaacatagttggtcaagttctctacctgaaaatgcgctattgtggacttgacaagccttgtattgaactgaaagtcataaaagttctttcctttctctacttgcaagcattcctgacaacaaaaaatacaagaaatcataagaaagatgcacaccaaaactcaagatttcaaatcatccatcatcataagctataaaaactttgattggctaagacgaaccttatcaagctcttctctggatcgaaacagactctcaaagtttttatagtgcagcaatctattctcacggtatctatccctcgtgtaattcaagctctcccatggaatcccttgaatatcttttccattcctagcttctaacgctgatgtttcattgttcgtcttactctcactctaaaacaacaacataacaagtttgctattaatttcatcacatccattaaatttcaagcctttcctaaacttgaagcagagtaaagtatcataccagctcgaaatcaaaatcggagtccatgaaatcggaatcagactcactggtgacatcaacctctccaaagggctcatcatcatcgaaatcagcgtgaaattcatcaacaaggtattcaagatcagagttgtcgaaaatatccatctttaaacctggtaaaatcgatcaagaacaaaatataaataaaaccccataaaatcgaacagagtgaaacaaaataaacaaacctgtgttcaaaagtttgtacctttggcaataatcaaaatcgaaatcgaaatctttgagcttacgaaattggagaaggaaggagaagaacaagctttgtgtggttagcgaagaaacggtgggaattggagttaagggcctacttataaacggtggaggaatgagaggacatgacaaggttttgggtaggaccggttagagccggtaataaaaaaagaaaaccaaacagcggatttcaaaacgagttaagtccgcgggaagtttttggacctacatatttaccggaacagtcgttacctggtcaaaacaaaacgttaaaaattctcgagaattgacaatataataaattatacgcgacaaatatggaaacaaaatatcttccaaattgtggaggtttattgtttattctaattacacacttttgaaatcttactgatgtaaattattgggatctcgttttaaaacactttaatgccacaattattgtttgtttctatttacctacaaaggagaatttgttttccattgtgactcgatttggatatattctggagaagaagaattttggactaaacttcaatatgtgttcaaattatattgaaacactgttacaacttaagagtttacgagatataaaacattaagaaaatagctgaattttctagtagaaaacgaaaggaagagacaagcgtcagacaattttaatgaacaataagaggactagagtgtttaataataatagaccacgaggaaatattcaaacaattagtaataaaatactaatgacaaaagaaaaaatagtaataaaataggttttggttgttagtgtcactctctgtggaacgtggccatcgtagtctaccgacatctcacagtcgcttaatgggcaatttcgtcaaatcatcaccactaagcggttatgaccagcttatgccgtcacaaggaccgctacttctagagtgacaactgtcggtcataatcgtttataggcttagcttcctccacgtggcactagttttgagtttgacataaacaaaaaaaaaaaaaaactcaataattgtaaattaaaatttacccagctgtgaattattattctgaacatgttgaatttgtgttagatttttttacttcaaatgaatttctctacaaagctccttccaccaaacatttagctgagacagaaacaaattatctactagtaatattgttgtattaattgtttgaaaccgacaatttttatccagtcaaacctagatacgtgaccaggtgaacttttatagatcacaattaggttgattgtgacatatggcctgacctgataaggttataataatattgctatccattatcacttatatggttggttggacggttcagtacatttcttaaacaattcttgatatataaaaacgctattacatgttttgataccaaaacgttttgaaagacttattgggctgtacactgggaaaaaaatatatgctaaatgacttaacgcaaagaccttaaaagctatttggaaaaaatattattgggctttggcccgtaagaccatttataatggtataatataattcaacattttttttccttctttttcacattatttttgttatcttttccatctaataattaaacatatatatatatatactatttttttctattctacaattattttatttaataaaattcaacagtctatcctgatttttattaaattaaatgattaagaattaaatagtttattagcaaattaaattaaacagaaatagataaaaatcaaatactttttgtttattttatttgagataatatgcaatctaatacgattttctatgtgtccaaattaaaggaaccaaatctctatttatatagttaaaaaatgatgagttttgatataactgtttttaaaacattttctataaactaattgatctcaaggatataggattagataaaaatctgaaaataataatgaaaatagcaaatcagaaaaagacacaaaaacttcacaacaccaaaatttaacaacttcattatacttattcaactattgaataaaaaatttaagatgtccattaattgcaaaaaaaaagagttattgaaaaacaacaatataataaatttttaggttaccctgttgaatcaagaaggttatttaagtcaatttattacagacataattggggaacgaataagaagaacagagactctgtcactctcttacactcatcactttctcatctcttttccgcatttcgaagccatg

SEQ ID NO: 8815 - DNA, 3000 bp, Unknown
  misc_feature (1)..( 3000): cDNA_ID_3043613_gDNA_ID_1971893_Annot_ID_176872 3000 nt of promoter + ATG
aatacaagtatataattttaaacactaaacaatataaataatatcaacaaaacatatacaactcgcagtttactatacatttaaaatcaaataaaataatatcatatatttataatcaactttacaataaaagtttttagtttaactaaaatataagcctacctgctgtataatgcaagttaaaattataaataagcagattaccatcacgatggatgtaccttctcacatacacacctatcaaaaacttaaaacctttcaaaacctcttggtatattcaaattaggattcttcattcatggaatcattattccaagggttttgggatgtcttatgaaatgattttggcaaaagaggatgtaaatttttttgaataaaaagtagtcagcaaaacatatgttttattgggattttttagataattaaatcagagaatagggctgggcatatgagtaacacattcgagttcgggtagaacccgttcgggtttgggattaatgggtatatgatttactacctaatagaataattctaaatattcggttcgggtcggtccagttgggtttgagtcagtttggataaaaagtttcaggccctaaaaatactcaaaaaaatagaaacgggtattttgtatgtagatagtgcgtctccaaacaaaaaaaacttttaaatttattaagttttaataaatttaattatatttgaatatattttactaaattttgacaaatataacaaataattttgacaaacataacaaacataacaaaatatacaatttaatttatacaaaatattaatagcacgggttatgatctagtttattaactatataattgaaactattgtttttactcaagattgattgatgccctgaggaagtcaacaaaactctttatattcaatcatgtgaattattcctatagacaacaaaagcgtcgatatctcatatattttctaaccaataaaactgctatataaaaatgctactaggccgaccaaattcgctgtgcatagacagaccctgtacgacaaaacaatcaataatgtatactgtttcattcaagtggcaaataagtacacaaaaaatcaaatacatatgtttaaagtacctttgaaaaactggctgtgagaatggatacttgtgatcgatctttatccttttgatcagcttaatcagttgtgatcttacactgtgaattttgatggataagactatgtatataacagagttatttgtatatatgtaggtggggatatcgtttgcaagaataatgttgagttcgataagaccaagcattgaggccttagggaggttatcaaaaacagatatcttcggtgacataaatcagtatccaatggcaaataagactgcaggattattgactcttcgaatcagttctcctttgctatgctttgctaatgccaattttataagagacaggtcattaatcaatatttatcttcttcttttttttttttttttgttcaaacatcattagttactcttgtgaaactcttatcagtttgacaaaaaaaataaatattttttcttctttcagaatattgaattcagttcaagaaatagaaggagaggagaatgaacaagaagttctaaaagaaaatggtcttcaagtagtaattctcgacatgtcttgtaagcacatcccacattctatcatgatatactaatttatagaaaatgttttattgtatatatagtagaggtactgaatcttacatgtaacaaaatattggtgaaggcgtgatgggcgtagatacatcaggagtatttgcacttgaagaactacatcaagagctagcttctaatgacatccgggtacatctttatttctcaatcaaatgttattcattcactatagttacatatgtgggttcattggattttcaaattaccaatatttgttttatgtttgtgggctgcagttagtcatcgctagtcccagatggagggtacttcacaaattgaagcgagcaaaattggacgagaaaataaagacagaaaatatatatatgacagtaggagaagccgtagatatttatgtaagagcaagatctacgtcccacgagttgtgttgatatatatatgtaagaaacagtacaactcaaacatataacctagtgataattttattgttttctcatatagcctatagtttttatttaatgtacacctgactaaaaagtacaaatttcaatgcataaggctacaaaatattcttcttcttttttttctttttttctttttattttcttttacatcttttggtttggcttacaatttttttttacatcttttggtttggtttacattcctaagtgtttttttaagaaaaataaataaaataatacaaggatatatatagcagtgaattggaatcagaacttacattggtgtcttggtgagtgaataatcatatgaatcttccactttgaacatcatcacgaacaattcacaatgtttaagcaaaaacaccttgagatagtgtttaacggtcggaaaatatagccgttgaaggaaagtcaaatatttgaccattaagtagatattgccgaagcctctccatatgctgagagagtagccattgcgaggtaaagaggactagttgacttttatgttttgtttttacaattaattattgacaaaataaacgatatatgctggttaatctgaacgttattaattgatcccaatactcctatatgaattttctgtggcaaaaaataacatcatattcttaattcgttcaaagaacaaaacccttttaatctctcttaatctcttccatacatttctaaccaaatctctcttatacctaacctctccttctttcatggttctcttttctctcgtccgtacatctctcatatatatataggcacttttgcctccaatgatcagattttcgcattccctaaaccaaaataaagaagagtctttgagtttgttggttgcattgatcggatataagagacatg

SEQ ID NO: 8816 - DNA, 3000 bp, Unknown
  misc_feature (1)..( 3000): cDNA_ID_2024857_gDNA_ID_1971893_Annot_ID_176869 3000 nt of promoter + ATG
atcgtgcatgtgtttatttacatatattttcatagatgttatgtatcgttgaagaagacagagaacaaaccaagtcttatagagaaaacggtgggagcaacccggtgaatgaaggaaagaagaagctatgtataagtagaatcggttggttttcttattttacaattaatgaagaaattgtttttcaacttttaatttctaaaaaaccatataatgataagttttatttgatgggcctcacactgagtcattgcatgtaccgatgtcactgaaacacgacgtgtttcgttttggagtgccacatatagtacgaacttgatcgactagagagcagagcatggccatgtcggaataacaaataatatactattgtaatagcaaatggtgaaaatttatcaaaaaatccttcaaaatgtttaacaagtggaaattttatatgttaaatcgactggaaagctaatataacacttgattttgtggtgttttctaatgatttttttttgtttattttgtaacaaattgacaacaaaaattaaagattgtttgcggactgtttctttattttttaagttccggggctatttacaaagtatttcggaactttctctatttaccgaaaacatccgatacctttactatttactaaataaccccgaactctgttgttatttatagaaaagcgcagcagcgattttttctatttacataagaaatcctgaaactcttactatttttgaaatgttctgcaacttttatatactaaaatcttcagtaatatgtaaaaacgtgtcaaccctcagttgcacctctaatactgaataacaaagcagtgggggaaaaaatcaaaattactacgtagtacaaaaaatacagatccactattcggtggcttccaccaacaattttttttttgataaaaagaatatatggcttgtccgttttgtcttttaatcaaatgatatggacagtacatgtatatgcaaaacatggttacactttaattaagatgaaaaagcctaaggagaagattctagaagagcatggaacgttctagaagaagaaatggacataccttgtttgaccggaaaagagacatagtcgatcagagggagagaacatgaggagggcaagatcgatgtcacaaagtgttgacaattcataagccttttttattaaaccttttttacgttttgagaacgtaatttgtcggttcgtgctcttctctatacgctttaactccaatttaacccgacccatatccgatggtcactgcaaaataatcaaaacacaatctattattagttggcacgagagaaattgatcgaatgcaaaattgtatatttaagtaaatgagtcgacgaaaggagagtttttaggtttgtgttaagagagagagagagagagagagagagagagagagagagagttacaaatggtgagcggatagaatttttgatcttaatttagacgaatctgccatatggctaggtacatcccttacatttatactcattttatataatatttgtaaaaatgtagtttactcttattatataaccaagtgttgttacttaaaactttaacccaaaaaaaagatgtattttattcaatgttcatatttaacattataggtttcttggcacttgcctaaaggctcatatatacgtgggtgcgtatgcgtatggataatatatatagtaaatacatcaaacacatatatatttcctagtctgcctctaatttttatatatagcttgttctagctagtgtgatttgtacattgtatatacactgtgtgttttctcttctgtgaaattaaagactcaaaccttatgtgttttctctttttgtcaataacatgtacatgtgtttgaatttattggtaacccaacaaaacaagcacaatccattacacattataatggtgtgtatgagatattagatggtgtaagagagacatgatgggtatacatatagcgagtgaagttgaagcttataacgaaggtgcctctcgatgaaggagcttcaaaaggaagcaaattaggttagggctctatggaataattcttgatgttaccatatattttatagaaatattgtacatgacgaccacctggtctcagtttacgacacgtgggggatttgtttgtttgtgttgtctcggtcgttgttgttacgtgccgacaaggggaatgatattaacatagagggggaaaaaagagagagatcttcaatgtgaagtttgctctgtgtatataaatatttttacatctttcgacttattctattaattcttcaaatcataataaaaattaaaccacttttgattacttgtttcttaatttccaagataattaattataatttatctattaatatttgtctaccaaaatctaacacttaaaattagcaatttatcttaattaaataaatattgttaaactttgtcttttgtcacactagtcataactgagattgatcagttcgttccatttctatagaattcaacttatacgttgaatccgatagaaagaaaatagaaaagtaatttgaattttttttcatccacaaacaaaacttgttgaaacttgaaacattgaataatctaataaaagtataaaaaaaaatataaaaaatatatgtttaccaattatccaatttatttctgcatattttgtaaattaaaaagtaattcaaatacgtttcatgtcgacaaaatgttgaatgtacaagtggtttatgctaatttaatcactgtcaattcactgaaacgaataaatcgagtaattacttttttaattgacaaattacaaaactatagaaacattaagggcataattgaaatttccaataaattgaagagcaaaaaccctagaaaattgacacggactataaaaaggtgacgaagcggcgctttttcggtttggtcatcgtgctcctcttctcctccaccgcacagatccaagacattttgattacactccatcgccggcgaaaatg

SEQ ID NO: 8817 - DNA, 3000 bp, Unknown
  misc_feature (1)..( 3000): cDNA_ID_1989254_gDNA_ID_1971898_Annot_ID_58487 3000 nt of promoter + ATG
ttagaatacggataaagtttaaacttcacagtgaaattcagttgagataataaagtcaacccgttatatttactcatgttcttcaaatcgactaacctttgtaccaaaaggactttcagggtggtcgatgtcaagcagcctccttccctatacaaggagaacacaaaaaaaaagtcaaaactaagtttctgatctccgaaagcaacatcgaagtacactatactctttgtcaagacgaatcatctacagtagatatcaaacaatatcaatatcaatttctcttctcatctcatactctccgtcgacgatcggcgcattactttatttactctgtttttcttatgtttttacgttgtttagtttaagagataagtcccgagcttatcactcacctttgtgggagaattgttcaatttcgatttgacttggcacgtgtgagacactcgcacatgcgaatctaaggttcagtaactggatgaaatttactgaactctaggaattttttaaaatcataactataggaagaaacaaaaaatgtggtcttaactacaagaattatcacattttttaacgataaattatacaagcaaagaaaaatctatcttgatatttttttagaaataagtatataaagaaccaataaaatccaactgctattttgtttaagtttctaattaatattcacaagctttgttgggcaatattgaagattaaaccaaaaaaataaaacgattttgtccataatcattctcgaccgaccactgtcaccattctaaaatatcattgttttgtatgcaaattgcataaatcaaatggctctttcacgtttaaaataattgtatttcggagaaagtgcatatcaagacattgcaatctgacaaagaaaaaaaagcgtgtagacttatctatctccctaggttaacaatccaatgcatgcgtgtccacctttaaatctccctacacaagcaaaattcagtaaaaagcttgtacgttgattacatatccaacgaaccatatccactttcaatttgttaatcatataaatttgaccctaaaatctatctcattctctcatcaatcttcttcctttaaatccctaaatcttcacgttacttttctatctacattttcactttcaatggctttgattatcacctgctccgctctacccacgatccgagcatcttccggatccggatcccttaacccggatcaaaaccgtaagaaatctgctgcttggtgggctcctctcttcggtttaccctccgatccagattacctcaacatcgaaagctcatgctccaccgtgaatccggataaaaccgatatttccgggtcgggtcaaaagtttcgtcgcggttgttttacggaggagaaagctaagcagttgaggaggaaaaccgcagaagcttccacgttccatgacgtaatgtatcactccgccattgcttctcgacttgcgtctgatatcaccggccgagtcgaggattgaaacggattcgggtcagatctggagacgaatcaattaatgaataattaatcttttttttcttaattcagtgttcttgtaggatgcagaccatcttctatcggtgctcctttttcatttgaaccgttggcttgtgtttggtctttgtgtgttgtaaactctagttccctttctgtttcttctgtaatcaaccgttggatttccacttgttatttttagacatgtgttccctagttagctcttttatcttatctcaaatttaagacattgtgttctctaaatctacatcagaacttgactttggtctgaaaatgtctaaatataacattttctcaacggttatctacttcagaacttgaattcggacagcttttctacttcacaacttgaattcggtcttgttttacaaattccacatagacgaactataatattttgtgacatttctcactgaaaagccaacactaattaaaaccactccagatcttattcttaacgatgatcgtgaatttggttgtgtcgaatcttttaatatagtcgtctcgttgtttcaatgtagtggtgatacatctttcctctctattaagatctttttataatgttcaatgaagaaccacaaaatgtaaagtgtctgtgatctattattcattcttgtaagtttttctctccacaattcacattttctagaatcaaacctcaaattagatgttaaaacattaaacctccaaactggttctctgcctccggtagtcaccagtatcagatgcgctcctccggtgacggcaatgcctttccgattttcctttagtaaaagccctgggccaatttgggatttggccaattattgaatataacattataaactttaaaaaacaaaacattaaaccaccaaacgaaattttaatttatttatttaagaatcatactttgttttactttattttcaaaatcatgctgacaaaaaaaaaacgtacagtaaaatacactactgatttacgatttttttttctaaataaattatttacaaatggtattgtgaattgttttgtcaattacgaaaatatagggtcgcttattgcaacatatgaaacgtataggaactaaattaaaaaatacaaataaaggtcttctccttcccgtctagatgtagaaatccctaaaacttgctactgttttgcatacggggcttgtacaaataaaaaccacccaattcctacgctttcctctacaaattgtccccttttttttttaacttttatactttcaattcatctttggttctgtagaattcccaggaatcagcattccactgtaagctactggtttctctaattaactgtagatcgatcgaacttttatagattcgggattgtttctcccaatatttctgtagaaattactacaaaaaaaattagattttcagctactctgagtctaccttgaatcgtttgaaatcgaaaaccctttcctttaatttcaaagagtcgcttaattagggtttaggatagatg

SEQ ID NO: 8818 - DNA, 3000 bp, Unknown
  misc_feature (1)..( 3000): cDNA_ID_1989250_gDNA_ID_1971898_Annot_ID_58492 3000 nt of promoter + ATG
tggggtggaattgcaaccactgcttgtaagatatagttggctttaaacacttttttttgttaaagaacagactattaatattgtcttctaaaattattaattatatatatatttttaaattattaattattaacatttgtatttaaaatcattttgatgaattagggtgcgatgtcacaggaatttctgagaacatggaagatgatttggtttccataaactcaataactgcatttgtatttagccttttgcttgacgaaccacaaaatggtaacccgtaatgattaattatatatacgtcacatccatagtttatagtatgcatcaaatttctctatcaaatttgttaatcctattggcttgatagtcatgataggaataggaggtatcggcttgggtgcagcagtagctctctactgtgcgactatttatatctctggtaaaaaaatcagaaacctaagttttattgtagggatcaacggctggcttcctgcttggaggtaggctcttgaaaccctaatgtcatttattagctattactatttcagtatttcttaaggaaacttaaattgcaaacctttaaaacatggaaacctaactaaatcttgcagaaacttacttcacaatctctcatatgattatggggtcccaagtcttgctccatcagtatcaatcttacttacacatggaacttgtatgtgtatacattatctactttacgatttagatatcaattgcgagatgatgctgattcttgtcttttattttgtgtgtcacagctgatgatatagttcccttcccattcggacgcaaaagttcggacattcttcgcagggctggatttcaagtcacgttcataccaaaccaagggtctaaacatgaattagcttcactttgttttccgttaattaccaatagattttattgttctgaatctatatttggggtattccttgtgcaggtatcatcttccaatcgttccccaagtaatcaatgaggttcgcttatggatcacatcaaaactccaaccctaaagtcaatgctcgacactgcatagagaaaggaattggggagcaaaactatcatataatatatattttaaaatatttttgtcttattatctctttttctagttcataatcaattatataggcgatgtctctttgttaggagtctgaaaaatgtatatatttcttcggttaatgttataataaataaaagatttacttagatcttaacagattttttttttgtgaaaagtttttttttattaatatttattatacatttgaacttgaattatggcacagcgatgacattaacacaaaccattagattacaaattttcatgatatttaatgttttgaaagattaacagtatataacttgcttaatcaaactgaaaatacttttcttaaaagaaatagattcttgaagaaagtaaatctcatgagaagtttagatacattttacactcacaaaaaaatagaaattgatctaagtttcccaattggtctattcataaaaatgcaatcttcctaagctaagataataaaaaatatcgacaataatcctataattgaatatcgacgacggtttgtgattttccataggtctctcgaatgatcaaatggtctcttcctagctccttctttcgaacatttttggcttgaacaaagcttataacgcttgaaaacatcctaatcccgcataaggatctaaaacatgtacataatttaagacacgatagtaaagaatcaaagatggattccaacacgacaaatgactaaaaacaaatactacacaagggaaaaagataccaaaaaaaaaacacaaaatctgaagaatataaattgcctaaaagtaattaaaaaaaactaattaattttagatggaaagttgaaaccatacattatctaatttaaaacatttcttactcctaaatcatcaaaataaaataaaatagcaggagtatttaataaaagattttaccaattatagtttacaattattggtttagttagttgtagttgatgattttttatgtaaaaaagtaactttagtgatatttttttaagtatgtgtacagaaaccttaaatgtaataaatggagtataaaataacatatattgttttcatagaaaatcaaatcataaatcacaaaatcaaaataaaattaaaaagctgatgagaccttaatgtgatttaagttctgtcatgtgtcaaacatatagttattaattttaaataaatttaggttagtatttattaaaaacaaaatccagtgacttggtgggtttattatgtttatacgtgtattaattaaggttttcgacaaacaaaaacaaatactataaaatgacaaattctgattttgttttaatagatttttatatcatcttttgttaacattatctgaattagttaaggtgctatttaatttagggaaaagtttaaaattagataagaaatattatattgtaccaactacatttaaacaaaactaattaatcatccaaagatacaagttataaaacctttaataacaattttgatgaagtgtcaattatcctatagaggggggggggggggggggggggggttcccccttcgagtatgatctatagattattagattatgttacacccaaatctgttttctgttgttgtggttgcgcttttcattttgtaagccaattagacaattactaaatcaacaaaatattagtaattttaaaaaatagattatgcctccattaattaaattgtatttcacccaattagtatatgatttttgccatccacccaactttttaaggatgagattttgtcaacttttaatactaagatattttatgtcataaggctcctttggtgctttaacaaaaaagaaagaaaggaaacactcatttctattataaatacacaataccttcccttgctttctcttatatctttcatctctagtgcaagttaaaaactagttcttctcaccaaagc

SEQ ID NO: 8819 - DNA, 3000 bp, Unknown
  misc_feature (1)..( 3000): cDNA_ID_1989242_gDNA_ID_1971898_Annot_ID_58505 3000 nt of promoter + ATG
ccttgattacatctttgtacatcatctccattgttcttttctgccaatctaatatagcttggactgatccactctcaggaatcccttcaggccacattggaacaacaacatagaccttaaacttctctcctgctttgattttgctaacaatcttcaaagatagctccttcggaatcagatgcagagcattgatttcctctggtttgattccatccgcgctccaagcaaaagagcttccaaggaagtactggttttcgatatagatgaagtctttagctcgtctaatcgcgtgaatgtaagcatcttgaatactcctatcaattatattatcttttccactcacaagacctgcttccgctgcagcttcaggggagtcaggaaatccagcagctgctccaccatcaatggatctaaacaactgaacattccacacgtcatgatcctctgagaacagaacgggagaaggcgggatgataatatctccgagttctctcattttaaccaaaatatctttaccgccttgtctactccatctctgctcaaaattatacaagacatcccaagcaataggtccttcaagacgacaatgaatatcatgccatggctctctaggaccacctttggttatcgcagcgccagtgaaattcggttgatggaagtcatcgtgatgggcagtgtccaacgttctaaacaaggagtgaaacggagtgtcatatcttccatcacaaagatcaagaccaccaacaaaactcactattcttctggatcttgatcctccactcggcatttcactgtctacaacaacaatcttttggtgatgagtgaacatagttgagatttgcaagttttggacaatgcttccaccatcatcagggttacgaggacacaaaatacagttcacgtcggttcctctgaaaaaattctcagtttcctcatcatgagtagccataagtccatcttttttcagcaaatcaactgatgttctgtcatcccaaacaagcaaaataaccttaacaccttcactagctttcttcttgagtagctcaccaacagtcacatctcctccttgttttggcctcctcgagtccctcactaaagaaatctcagtgtaaacagaccaaccagtaatgtaaatcaagtgtttagcattagtaattgcatcgaaaatatcctcccaacatcgatgtggctcgtagtttttccctcccgcaagagggattttcgggacaaagtttccagggatatgagcatcttgatacaaagaaactttgcagcctctcctctgagagaagaatgtgtaaggaactcctggaaacttagcacttttgataccacgattccagtttttatccttttcaacaccgaaatattggagtttcacatggatctttgatcctccagcaattgggtttttctcattatctaagatatcaacccatctatcaacttcttctccatgcaaaatatcttccacaggaatataacctcttccgatcaacgtcgcgccaatcggattagcatccttaacagtgaaaataacatgtttagccatgtgaccacagtaaatatgaaaagactcaaaccactttgggttttttggctcctttgttattttcctcgttcttccaactcttgctttctcaagatcgattgtagcgtaaagctgagtttctcctttgccaacaccgattgtttcttctacatttgctagtatctggaaagattaaaaacagaacattaaagacagattgaaggaaaccttttgttgttgtatctctaaacaacttataaatgagagagagacaaaagacaataccgatcctaagaaacctgatctacctccttcagcatggagatgatcaacttcgtagattgtcgcgtgcaatcttccatgtaacaaacactcttccattttttcttcccgcctgtaacatcataacaatattagtaaaactcatacattagattaccaaaatacgtaaattcacattttacagatcctgtaaacaatatttttcgtttaaaaatgtaaagtaaatttatgtgcagggagagacgaatctacaagctaaagtcattaaccgtaatcagtgtccgaggaaacagaagaaactctaaatctcaagtaactgatctccatcaaaacaaaatcgaatcacagaaacagtttgagaggcaagcaaaacactgagaaattacatactgcaatcatataacgaatgtttaaactttaaccaaagtatttatgagtttcataaacattttatacacccacttgcttcacaacaagaataccagaaaccagacgatatgtgatctccaagataaacgttttaaaaaggaaaaagatctgcagagaagaggaagaagagagaaaacgaaactacctgcaaaatttctcagagattgagagagaagcttgtttggaagaattcaggtttgatccgagaaggaagctactttgtgtgtgtagctgctgaatgtttttgtgatattaatagaagatgaagcaaaaaaaaacaaaaaactggctttgagtttaagactattgctacgtgtccaaatgaccgagattactgattaacgatgatactaaaatcgctctcaaaaattccttaatgattgtaaatcggtcacagaaaaaaataactaaaaatagattaatgttggcaagcattttaattattgcagacaacatacacatgagaattacatttccaggtatatcaatggtttttttttttttaatttccaacctggttttgataggaatctgtttggtaccaaacagatttaccgaacataactgcctaatgtaattaaaaaaagagagagagcgagggagagagagaaagtaaaagctcttactttggccacaagatagtccggatctctctctcagcttcacaattttccccaagtttatcggtccaatctaatcctcaaacctcaaccaaaaagctaacgagcaaacgcgcgtgatactcttttccagaaatg

SEQ ID NO: 8820 - DNA, 3000 bp, Unknown
  misc_feature (1)..( 3000): cDNA_ID_1989241_gDNA_ID_1971898_Annot_ID_58506 3000 nt of promoter + ATG
ttttgatatgtaactgtaaaaatctttgcagggcatcaattgagtgatatattttgttttttcaggtcttacataaagtcagaagcagttttgaagatcatgaaatacattgacttaccatttccacagcttgcgttcttcttgcagtttgctcctctgtaagttctcgcttaaggtttaaatagcagaaggaaacgccgcgatgtgattgatcttaataagcatttttcttttgacatgttgcaggtttgtgagagactttttgtatgaaaatgttgcaaacaatcgatatgcaatgtttggtcgatctgattcatgtgagctctaagaatacatatgtgatcctactttgccacaaaaaaaaaaactagatatgtaatcctacagattaatataagcttttatacagatgtatagtttacaacagccattaaacaatagatacatatgtactacttttcgaatcatgtactcgtcaaatgtataacctttccgacgttgatatttgtgttatatatatggaaaaaaacttgggattgtgtgaaattgtcttttttcagagaatgtctcactggtctgctggctacaagctgctaattgaaatctctgaatggcatgctctgtatggtatgttctctaagaagcttagtgtatcccgcaatgaatctgcagaaatttcaaggaaaatttcaattatttacaggtaagggatgaaacttttcacaacactgagggttttgtttatgtgttgatggagaattcggctacttttgaacaatggttcattaaatctctttcgttaacttaccccgcaagaaggatagctagagatgtaaatctgaagatgtgttgataacacttgtgttttgatttcttgtgtttcatgtcataaccaggaggaatgtattttgggttcacgtatccgtactgcggacggagaagaaggacgaacccgaggaagaaaccagctaggaatcctccaaaatgagcagaattgtccacacgtggtaagaatccgacgcttagattcagtacaatgatcaggattaatgtcataagtgcggtgcactacaaaaaagtttgagatcagctttcaataatgcaccatattgaaaatgaataatctttttaccttattttcatagattgtccagtttgtgatgagctctgagagcattgcaccgagtaatccgaacaaagcaccagatgctccgactgatacccgttctccttgggaatctgttaagcaagacaccaggcttcctccaagcccggagatcacatacaaagctccgattctcactgtaacaccaaactcttaaatcagatcacagaaaattcaggagacggaaaatagaggggtttaaagggtcttactgaatccaaattcttgttcaaggcgcattccgatacacatgaggctgatcatgttagccatcaagtgaaggaaaccaccatgaagccatatgcaagagatgagacgccatctctcaccttcctccacaagtctcctttcgagagctccgagttttctcagcctgaatcaacaacaaagatgcattctgtaagtattgaaccagtttttaatagattccttgttctaaccggagagaaaaaaaccattatggaatcaagaaatccttccttacgtgggaatagaaggaccgagtagcatattctccttaatcggttgaaacgaaagccttccaaggacatcaaataagagacactcatctgatcttgcagggcaatcgttcacatacatggtggtagcgaatgtgacgaagttggctgctaaaatgagaggcacaagccacgcaacccatggcacgggaatgggcgggcgaaaatgtggtcgcgctggtggtggtggtccgttttcgatatctggtggaatcggcggtctcttccccatttctggaaaagagtatcacgcgcgtttgctcgttagctttttggttgaggtttgaggattagattggaccgataaacttggggaaaattgtgaagctgagagagagatccggactatcttgtggccaaagtaagagcttttactttctctctctccctcgctctctctctttttttaattacattaggcagttatgttcggtaaatctgtttggtaccaaacagattcctatcaaaaccaggttggaaattaaaaaaaaaaaaaccattgatatacctggaaatgtaattctcatgtgtatgttgtctgcaataattaaaatgcttgccaacattaatctatttttagttatttttttctgtgaccgatttacaatcattaaggaatttttgagagcgattttagtatcatcgttaatcagtaatctcggtcatttggacacgtagcaatagtcttaaactcaaagccagttttttgtttttttttgcttcatcttctattaatatcacaaaaacattcagcagctacacacacaaagtagcttccttctcggatcaaacctgaattcttccaaacaagcttctctctcaatctctgagaaattttgcaggtagtttcgttttctctcttcttcctcttctctgcagatctttttcctttttaaaacgtttatcttggagatcacatatcgtctggtttctggtattcttgttgtgaagcaagtgggtgtataaaatgtttatgaaactcataaatactttggttaaagtttaaacattcgttatatgattgcagtatgtaatttctcagtgttttgcttgcctctcaaactgtttctgtgattcgattttgttttgatggagatcagttacttgagatttagagtttcttctgtttcctcggacactgattacggttaatgactttagcttgtagattcgtctctccctgcacataaatttactttacatttttaaacgaaaaatattgtttacaggatctgtaaaatgtgaatttacgtattttggtaatctaatgtatgagttttactaatattgttatgatgttacaggcgggaagaaaaa

SEQ ID NO: 8821 - DNA, 3000 bp, Unknown
  misc_feature (1)..( 3000): cDNA_ID_1989239_gDNA_ID_1971898_Annot_ID_58509 3000 nt of promoter + ATG
gttattcagcatagttaattttcgcaaaagaaagaagccaaaattaattaaaagaagcagcaaatgttgtgtcccttttatgttttctatgcgaatggctcaatggagtaaattgctaattcacgtcatgaacacaaaaatgttgatatattaaacaagaagtccatttttgtacctcatatcaaaattttatttgtaaattttgtattaataattgtggatttgctatactatactatgaaatatttttctttatagacaagttatgttatacattaaattatttatttattaataagtacagtattttagtgtattgtcagagttcagtttctttaaagaaaacacaatattttttttttttgtcgtcaagaaaacacaatatttatgttaaacaaaaatgcatgatatttcaatagtttgtggaaaattatagaaaatatttcattttccttcttttagtttggtattaagaaggaaaaaaccaaaaacatttttttgataatgtatacataaattaaaattaaaataatgagaaaacaaaacaaggtccaaaataccttgtgaagaaaatggcgacggcgtttgccaacacgacttcaagctccaacctttacctccatcgctgccgtaaaaaccatcctcttccatctccgtcgttcttttcaccgttccggtcgtctccacttccttctcagacccttttcctcgtccccactccaaaacctgtacgacgcatcgcggtcgctcctctcggccctccaacgccgcctagtcccgacccacctccgcctaaaaacacgactgagctcacaagttcgtctttcccttcttacccttaaaacttcaatgtttcaactctgagttctgattttgtttactgccaattctatttttcaatctttcctaattcgatgaaattgcattacggaattcgaattaggagaatgaaggtggtttaactgctattgattcgtagataaagatgttaatcttagtcctcaagatcgattactgttcattgctaaagttttgatctttgtgacaatttatagacttttactcttgttaagcattaaggatttataaatctcctccttttacaacttgtgaatgtcttccaaaagttccaccattttcttttccctacaggtttagtcattggttgcaatacgagagcaatcttcttaacaatttggattcatagttgttgtttggtatcacattttgtgtaggtcttgtgggagtagcgtcgatgattcaagaccgtgtaaagatctttctttcagtactaatttggatctctctcttcttttgggcttcggctttacaaggaagaggcagcaaaggtaatggtaaagggaagaagggttcacgcttcaaatagtattagttagattggtgtggtgatgatgatgatgattgatgaaaactcctctacacgtttgtgtatatatacagaggaaatattcttccaagtaaagcaaatttcttgtcagactacagttttatactagaaactagattgttctcttcttacgatatctctagcttagagctatagagattactctactgtgatgaaactaaagtagtttgcatttaagtcaaaatgccaaatcaatatcattgtttattgaaagctgtttcagattgtaaatgactagatgtgtttggtgtgtgcttgattcagccaaacggtaaaccgcaccgtttctttgatttgaatgtttgttgtataaaatgggcctttagatatgttatataacttgtttgggcttcaacatactcttttattgggcctctctatataatataatatttccaaagttgtatttaattattatttgatttatatttaaaacagtggttgtttattcatgatatgaaaaaagaaataactggatttaggtaaaccttattcaatactgggacaatgaattaaccagctcatgattagttggacctgttttggttaaaggctggtagtaagtttagaaacagaaatttatgataagagcctaacattttgttctgaccacactgagtaatttaacaatctatctaaattaagattttatgctatgtttaatttatatttgttctgattatagcaaataaatttccatatctagagatcttcttcatacacaataaaaaaaactagtatttgaacttttgtatgtattaaaaattgcaagattttgtaagtacagattcaccaaggtgaggtgtgtgattaggaaactttgattagttgtcatgtgtcatcaacaggccatgaaaaggaaatctttgaaattcaaaaaacaataccttttgatgaaattattactatataaatactatatgtgactatgtgtggatatgcacaatcattcccactaatagtttaataaagtgtataatttttttcaaattaaaacagctaaacacacacaaccacattcaaaaaggggttaagcattgaagaatattctaagaaaatttgtttctcttcttacagaagtaaaagcgactctctctctcattaagcatcaaaggagtttcgtttttcttgctttgctgttacattcttcaggaaaaaggcgttacctttactctctctgcatcaacgaggaagcgtgtagagctaaaggagctgaatttgagagatttttttgttttgtttctgggtttgttcaaagatgcaaatttttagttgtttctgctgtggaaaaggatttgatcggtatgtatggagttttaatcttgattttcaacttgatttgctggtttatgggttttatctagtttctccattgttttgttcttcagaaatttgttcttgctttgatccgttttgctattcttctttattagggttttgagatttatatcatttctcgagcctattcatgttcaaaatttatttcttggtgtaaagtttggaactttcgaacaataatctactgtttgataagcttaagttgcagatttgataaacccaagaagaaagta

SEQ ID NO: 8822 - DNA, 595 bp, Unknown
  misc_feature (1)..( 595): cDNA_ID_1989226_gDNA_ID_1971898_Annot_ID_176940 3000 nt of
ttcgcgtcaatttagctgcgctttctcgatcttttgtacttcggaagctgcaacgttgtagaatcggcggatccaagtcggtaattactcagcttctggtaagtgttcactgaccgatcgatgtgattttgaattttttgtaaccagaagatatatttctggcttcagtcttcaaatttatccaacgcaattttctagttctaatgcttgttttgtggctctggaattgaaaatcctttgtaatctgagaaagttctggagtgttcttcagatttagtttaaaatagttgcgattaattcctaaatgcaggtcgtaagactagtttagatctgaattctaaacagttatagttcatctagtatcagatttttgttaaattagagtttgatgtactggaattagaagggatcattgcatgctaatctttgatatgtgttgtagactgattgaatgattttatctgtcttaggttgtgatgttaatgtgagctgcccaattttgtgatggtggattgaagcggttgaatttttctacttcagattgcttttgtgtttgatatgttactcataatgagattatagccttgaaattatg

SEQ ID NO: 8823 - DNA, 3000 bp, Unknown
  misc_feature (1)..( 3000): cDNA_ID_1989227_gDNA_ID_1971898_Annot_ID_176939 3000 nt of promoter + ATG
gatgttgaatatctaagagaaaatatacatcacaaaagcaacgagaaaagaagacaatatacaccaacgagaaaacaataaactaacataacatggaaaatcaagaaggaaacaagacataccagaagccgccatgtttttatgagaagaacttgaaaatagtcttttttctatactcagccgatttttgttctatattttgagaggagttttggaaaagcagtgatggtgaaaatatgtgacgaacaatgtgtatttatacacccaaaaaagcaaacacatgatatatttttctgtttcactaaatcaaaatgtcaaaaatattggttggtcactcattaatgaaggaaacctaattaattagatgtttcattatcaatatgtgcaaccagacctaggttttaatgtttaatttctttctaattctatatgaaatgataacaaggaaattgaacttatgatatctacagtgtactacagctggaaagtggaaaccaataatatatttcatattatttgttttagttttgtttaatcaattgataaaaccaactatacatatttggaaaatgttaatatgtatgaatctctgaactagtagagattttcgttttttacacgttgactattaatgatggatcttaaaaaacaataatatatatacttcattttctaaattactatttcgtagggcatgcacctacacacgtatatatgaatttttactaaatcgttttattttagttggtatacacattttggcaaaactgtaatagttatgtaacccgcaaatattatagatataaattgaggaaacaaaaaagaattaaaaaactatgagtcgtttcaaatgactaagtgagtcataggaaaacttagtcgcatcaaatttctaattggggcatgagtgtgatcaaagaatacatacacataaaagcaaattactaacaactatgaatcccataactagtatagaattaaattaaggaaacgacaaagaaaaagaatcttgactatgagtacaacaacttcaaatatttataggtaagaataaggaatttcagatgactaagtgagtcacgggtgctttccaaacaaaaagaaatttccatcctcattgtggaacacgtaaactttaatatttccttcttttttgttttaagtcccacaactaccttaaacctgaatatcaatttggttagcacttggtattcttccgtcgcacgttttggtggtttctaagaaaagtataataaaattccggtttgttatagaacaaaaaaagaaggtcatatagagttgatcttttcgtttcaaataccattgacagaaaagcttggaggaacaatttgcgaatataatgttgagtttggtgtttctcgaagctgaacaaacccaagcaacaatatgcacaaggctagaaggtggagagtattatttcaaaaggtcaaaatgttcgttggtctcattatcaaattagtgtagtaattaacgttccatctttggcttcctagattactcttatgtttgaaaaaactgacttgacaaaagctaaatgcttgttttctttttcctgtattgaaaagaggttaccatgtacaacttgataacaccaacagaaaaaaagtgaagaatcaagaaggaaaaacaataaaaagtcattgcaaaaaaaaaaaatcgattaatcttcaaccatatatacctaacagattacaaatcccttctaatatgtaatagagatcagagaaatgttttgatgtgtaattaaattaagtaaaatatcacaaagaaagacaaatgtcattacttgcacgaccttgtggtacaacaattaccaaattcgatgtggtatacattttattttacttgttaatttccgcttagtgttttggttcaacaagttatttaatttcaatttcttagtcttatgatatatatatatgtatatttttttttggtgtaaaatcaccagccccaaaacaaaatctagcagtactagcttaggaattcaaatactaaacatggaaagacaaatgaagaagaagaagatctaacgagaggaatctgagtctctagtcttatgatattatattattatttgttaacattgaccaaaatggcagaatagatgagttaacgttctaataaaaataaaaatatgatcatatgaatccgtgagctagtcccaaaaagagatatggaccaatcacatttaacatgttatcattctactgtgactaaatcagttttaaatttaaataagaaacaaatgtttttaattgaaaataagaaaaattaaatgattttttaatctatgtgggaaaattttaaacatcaaataaattgaaagagaggaagtaatatattttttagaaatttgaacttaattaatataagtttccgttttaatataaaaaaaaacaattgatactccaacaatgtgtaagcaaccaattattttaaaatcaaataatttttaaaatgtgcatagaatctttttttatatataaaaaggcgtaacagctggaaggaggagattggttagtgatgaaaaatgaaaagtttctaattacaaaagacgaagatttgcaaaagcttttaattgtttatgtcccaaagctacttgatttggtgaacctctgttctttgatcatttcaagtctgattttcgttcatccccgacatgaataccattctatattcaaatatcttaagcaaaattcgaagattcccagaaattctgggttttcgaagtagtggagtgctatggatgttgcacacaaggtgttcgacgaaatttcccaatgctatttttttatatatcattcttgtgtcacgtgactctcacgttataaaagccttgtgtcacgtgactcacacgttataaaacccagcttcttcttcgatgcaattctgttattttcgttgcttctttttttcccgcttcacaaatttctctctgaagcaagaaagcttaaagaatcttgagaatcgtctaca

SEQ ID NO: 8824 - DNA, 3000 bp, Unknown
  misc_feature (1)..( 3000): cDNA_ID_1989229_gDNA_ID_1971898_Annot_ID_176937 3000 nt of promoter + ATG
gtgacgaataatgtgtatttatacacccaaaaaagcacacacatgatgtgagagagagaatattccatttatttttccatttcactaaatcaaaatgtcaaaactattggttggtcactaattaatgaaggaaacctgatttattagatgtttcattatcattatgtgcaaccacacctaggttttaatattttctttctaattctatatgaaatgataacaaggaaattgaacttatgatatctacagtatactgtatactacagctgattaccaataatatatttcatattatttgttttagttttcatataattaattgctaaacaactatacatatttggagatttaattacgtataaatctcataactagtagagattttcgtattttacacgttgactatcaatgatggatcttaagaaccaatatacttcattttctaaaatactatttcgtaaggaatgcacctacacatgtatatatgaatttttactaaatagttttactttagtcggtatacagattttggcaaaactataatagttatgtaacccgcaaatattatagatttaaattgaggaaacaaaaacggattaaaaaactatatgagtcgtttcaaatgactaagtgagtcataggaaacttattagtcgcttcaaatttctaatctgtgtaatcaaagaatacatacacataaaagcaacttactaacaactatgaatcccataactagtatagagttaaattaaggaaacgacgaagaaaaagaatcttgactatgagtacaacgtaacaacttcaaatatttataggaaagaataaagtaatttcagatgactaagtgagtcacgagtgctttacgaacaaaaagaaagttacatccacattgtggaacacgtaaactttaatatttcattttttttcaagtcgtcccacaactataccttcaaatctctagacgtgagatatcaaagctaccttaaaacctgattatgaatttggttatagtacttggtattcttccttttcacattttggtggtttctaagaaaaataaatttcggtttgttatagaacaaaaatagaaggtcatgtagagttattttcatatattcatatctactattgacagaaaagcttgaggaataacttgcgaatataatgttgagtttggtgtttctcgaagctgaacaaacccaagcaacaatatgcacaaggctagagactggagagtattatttcaaaaggtcaaaatgtttgttggtctcattatcaaattggtgtaataattaacgttccatctttgggttcctaagttactcatatgtttgaaaaactggcttgacaaaaccgaaatacttatttttttctttttgctatcttgaaaaggggttaccatgtacaacttgataacaccgacaagaaaagtgaagaatcaacaagataaaacaataaaaatgaattgcaagaaaaatagattaattaataaccatatacctaatagattataaatcccttctaatctgtaatagagatcagagaaaaattgctgtgtaattaaattaagtaaaatatcacagagaaaaacaaatgtcatcataacgtgcgtacatttgatgtggtatacatttcattttacttgttaacttccgcttagtgttttggttcaacaagcaatttagtttcacttgcatagtcttttgatattattagttaaattgatcaaaatggcaaatagatgagttctatgttcaaaataaaaatatgatcatatgaatccgtgagctagtcccaaaaacagatatggaccaaccacatttaacatgttatatttctactgtgactaaagtcagttttaattctatgacataactacgtaacacattgatactatatatccgctcattcactctacaatgactctcatctcaatcgagtcaatcgccacaatttgtttgccaactaattacaaactcactagatatataacattcgaagtcaaaagataaaaaaaaatgtcgcttatatgatcttacgcatttgacaagaatgtcgctatatatcttgtatacatatctagcttcatgggcacgtttctatgtccttcactccccacttgtctttagttgataagaaattaatgttatacaacatcaaatgaattgaaagaaagcaagtagtatattttttcggaaacttgaaattaatttactctatcctttttgaaatgtaaggatgtttcaactaaaagcacaaaaattataaagtataattttttttttccaaaaacatcattactatttaattaagattcaaccaattatatataaaaaatattgcataataaaattgttgcaaagtactccttatgtcagttaatttgttgcaacaatatgcaaactttaaaattatttgatactccaacaatttgcaatcaaccaattattttaaaatcaaataattttaaaattttgcatagaaactaaccaaaaaaaaaaggtaacagctggaaggttgagattggttacaaagacgaattatttattatattaagccccaaagctacttgatttgtcgaacaacctctggtctctctgatcatttcaagtctgaattttgttcatccccaacatgaataccattatatatccaagtctcttaagcaaaacccgaagattcagacaaatcctgggttttcttttgtttatctattcctgaaaattcacaactaaatcgaaacagtgtagtgtagtgtactacagatgttgcacacaaggtgttcgacgaaattccccaatactaaaaattgttttttctttttctttaaaccaaagccttatgtcacgtgacactcacgttataaaagccagatttttcttcgatacaattatgttattttctcgttgctcttttttcccgcttcacaatttctctctgaagcaagaaaagccctcgagagacacaagaaagcttaaagaatcttgagaatcgtcttca

SEQ ID NO: 8825 - DNA, 3000 bp, Unknown
  misc_feature (1)..( 3000): cDNA_ID_3043669_gDNA_ID_1971898_Annot_ID_176931 3000 nt of promoter + ATG
cttctataaacactagtcttgtttttcttctacactatgaactttatccaaagactcttgaagaacttgcattgcgactttataatgatccaaagataccgctccttcttcaactacctgaagagagtttttatacaactggtcaaaccattgaacccggtccgtaccatcgacaaaaccagtcaagccgttatcagcgaagtggaggcgtttgtagtcttttctccaccgaggtagaatataccgtaaagggatttcttcaacgccgttgaaattgagaacacatagagcatgtctgcataagtatccgtagaagttgaagcagctacaaatgcaacgtacttcgccaactgatctgttgtacagaacttcgaaatcgcggatttctcttctgctggattcgcctcggacccgttctttcacaaggaagatcacgaaaggtccatcgacatggacctgcgttgtgctgaaacatgagtacatttcttctacctctatttggaatttcttgaacatgtctctcgtgtagattctcgagagctgtgtctcgaaagaacactttgttttaagctccgcggtgttcaaggtttgagactctatgtcgctgagagtttcttccctgtgcttcttctgaagagctagctcgtacttatcgagaaactctttcaatggtgtttgcttgtgaacatacctctcgaaaaatggtttcagggtttctccaggatgagcagcggcgattcctgcaaaaaaagtgtctttgagataaaccggagcccatttagctctctcttcatacaaggaacggagccattcattctcgataaccccaaaattgtgaaccatgaacccccaagctgcttcaaactcaacaacttttaaggtttcgtaaactgctttcgtaaatgccttcctcacggcatcataattatgcagcccccctaatttctctggaattttcctcattatatgtgtcagactgaatctctgatgagatcttgggaacacttgagagatggcagcctctaaaggcttgcatctgtctgtgacaatagtttgaggagaacgcttcatgacactgagccatactttaagcaaccaatggtaagactccattgtctctccagcaagaaaaccacaactaagcaatgtagttttcccatggtgattcactccggtaaatgtcaccagtggaatctcgaattttcctgatatataagaactgtcgatgaagatgacatcgccaaagtaactgcaggaaactttagagaaagcatctgcccagaatacattccgtagttgaccttcatcattcacatccatcaagtaaaaaaagtttggatttgtcaattgcatacggcaaaagtagttgtaaatggctgcagaatctcctctcttaaggttcagcaaatcaggtgacccagtagaattctgaaacttcttgttaagagtcgagtttgggttcacattgctcccattatccaccacacaagctcggtacagcttaatcgtcttagcgtctgagactggactagatacacacttcctcttccttttaaccgatttatataacttacaaccgagtaaatggttatgatcaagtgtaacttcaactacccgccacctcttagaatcaacctgtctcattcttatcatagcaggacaaccagttcgagtttcctttctaacacgattcacatcgttaatcctcttaaaaccttgactactacaacaaagcaccgcaccatacttctctttactacgccgcttaaaccacgaattcttcactcttacacgaaacccaacttcactagcataacagttataatagttataagcatcatcatacgactcaaactccattccaaccgcaggtgcatcgaattcttttctctcatcaacaagtaaaccactctgttcatcaaaccctcccattgtttcttcttcactctttctttcttcgttttgacaaaatccaacatcaatctcatgctcactactacaaactagagcttcttctcctatccgtaaagtatctgacattggatcatctctttcacgaacctcgtcgttctctaaatatgcagatgcttggacctgtaataacaaaaagctataaactttgattctagcaaaccctatttactcaattgaggcatcaaacttgtgaaggagctgaacaaaaatgataatcaacccaatgaaatcaaatgtaacatcatcacaacccttgtgcgaatcgattcataatcttcacaaaatccagaattgaaaagaggagttttagagttaaacacatacatcttcatcaacggactcacttctctccattggaggtttggttcctcttccttcttcaattcgcgggtaaattttgatgaaagcacttgactttattcgattgaaggagaacactcgtgaaattgatcggtccgggatagatccggacgggtcttacacggaaagatccgacccgagagtgatcttgcgcgggtattgacctttgaaagcggttaggtagtttaacttcttcttctgacggtgaggtggtcttttggggctcgactggtgactctagcattttcaccaacatagagacaccttaggcttagggttttcacacacaggttcaaagcacgtgctgcaaacgtcgtcgttcgcacttaaacatatcatttttgtttttccttcacttaagacacttaaacgacaattacactgaaacggagggaatgctatgaaatgaaatccaaaattgcattacatagattccctgaaatgaaatctatgagtctatgacattagtaaaacgcacaaacttgtgaatgtgatatttatgagcttataaaacagcatatataaaaaaaaaatatatcaatttctagattttacccacaatcttaatttatgtcatcattaaccactaatttttcaatattttctctctctttcgaggcgcatatataaatacaggaaatacgcttttttacttaccaatcaaaa

SEQ ID NO: 8826 - DNA, 3000 bp, Unknown
  misc_feature (1)..( 3000): cDNA_ID_2038996_gDNA_ID_1971898_Annot_ID_176930 3000 nt of promoter + ATG
tgtgggatgcctacaaggctatgtgatattctactattattagttatttaggctgttacaaggctttgtgattacctctgtccttttttgttgtatttggaagtcagaaaaatgctcggagggcagcaactactttctctggcctgtatacaaagttcaaaattcagagagtcttataagaatcaaagcagaccagaacagtatgtgtattctcataccagtcttcttgaggcaaatgcccagcaccttcgatgagtcgaagcttaacattttgggggttctgtttctcaaattcctctgctatagactgaggcagatatttatcagctattccccaagccagaagcgtaggtttatcccagctgtgaaggatcaaaacctcagcaaagtaaaagacctatctgtagccgtgtgaatttgtaaaaagttgaaatgcacttacctgcctgatgaaaacccatttgcaatttgactcaatgtgtctccaaagttgatcttcttcgcagtctcgagcaaggctaattcatcagaatctcaggatgagaagtctcttagataatagattaaaccatcataagaatcaagagtaaggtgtgtatcatgctccattcattgaatttggtttagagacgtaccaaagccaggccctccgcttgacaaatatggtagacgatacacatcagctttctcattcttcaggacgtagctatcaaaacagatatagagtaagacaattgtcagtagaagcctctatcaacatcaccaaacacatgcattttgaggctgagctaggagaatagccagtatataatgtctcatctctataatgaagatgatggttaatttgatacatacgggctacctccttcaatgaaccgctcggccaagatagcattttggcaggtgaattcaccaaacaggggaatcctgcatcagaaaaaaaatgaggaaagccaagagatacaaatagattggtgctttcacagagtattgcaagcatttagagtggtcaaaatggcaaaagagttgaacctcagctgcttaaataatccgggaactggggatgaaacggtcagcggactattaaggatcgcgagtttctcaaccttgcttggatttttcaaagcccaagttaaaccatatgaacctacaagaaatcccttgggagaccacaacaaatgcagaaataagatatatattcagtcttgatgaattattaacatattatacacaaatgggataagaacacacatccgaacctgaacaacaagaaagaaaggagatttgacctctagcacttcaagcagtttatcaaacgcctcatggtactctttttctgagaagatttaaaacttattagaacaaagaaccatgtacactgattttgcagttcacaaactattaaatgtaccatcaacgaacctgtgtaattaaaaccgtatccaggctgcggtttgtcactgaatccgaatcctatccagtcaggtgcaaagcaatgaaatccagcatctgacaactattacattgttgggaacacacaaaagatccactcaagcttcatatacatacacatgattcattggaaatcataagagtctttcattagaaacaattgtttcccatatagacacatgattcaagattcagtgtagcacctcagacatgacagttctgtagctaaaagactgagtaggagctccatgaacaaatacaatggttcctcgacgactctcctttgatcctaccggaaaataggaaaatgcttaatcagtgatcaaaaactcttcttgaatccaaaaaacaaacacaaaacttaagtctttaccagtctctctcacaaaccatctaagcttcccagatttgatagttgagccatactctttacctttatcttcagtcctctaaacccacaacataacaatcaacaaaaatataacactatgataaaaaatggaatttgaaatcaatagaagcaaatatgaaccatgcatcttttcaatttcaatcacagttcaaaattgaactgagtaaatatgtgaaatttacgtagagcatttggccgacattgccgtcttccgccggagactctggtaactgaattgcactccggctagacgggttgtctgtaacgaaaccaaatgggttaaaagatggatcctcatcacgatcgtttttactaccaccgctgtttccattctccgacgtggcgtttatgacagagaagcggattttcgacggcgtggcagtgattctagaggcggtggattttgtggcgacggtggaggagaatgagtggagcagaggaagaggagagagcaaagacatttttgattggtaagtaaaaaagcgtatttcctgtatttatatatgcgcctcgaaagagagagaaaatattgaaaaattagtggttaatgatgacataaattaagattgtgggtaaaatctagaaattgatatattttttttttatatatgctgttttataagctcataaatatcacattcacaagtttgtgcgttttactaatgtcatagactcatagatttcatttcagggaatctatgtaatgcaattttggatttcatttcatagcattccctccgtttcagtgtaattgtcgtttaagtgtcttaagtgaaggaaaaacaaaaatgatatgtttaagtgcgaacgacgacgtttgcagcacgtgctttgaacctgtgtgtgaaaaccctaagcctaaggtgtctctatgttggtgaaaatgctagagtcaccagtcgagccccaaaagaccacctcaccgtcagaagaagaagttaaactacctaaccgctttcaaaggtcaatacccgcgcaagatcactctcgggtcggatctttccgtgtaagacccgtccggatctatcccggaccgatcaatttcacgagtgttctccttcaatcgaataaagtcaagtgctttcatcaaaatttacccgcgaattgaagaaggaagaggaaccaaacctccaatg

SEQ ID NO: 8827 - DNA, 3000 bp, Unknown; identical to SEQ ID NO: 8821
  misc_feature (1)..( 3000): cDNA_ID_1989239_gDNA_ID_1971898_Annot_ID_176928 3000 nt of promoter + ATG

SEQ ID NO: 8828 - DNA, 3000 bp, Unknown; identical to SEQ ID NO: 8819
  misc_feature (1)..( 3000): cDNA_ID_1989242_gDNA_ID_1971898_Annot_ID_176921 3000 nt of promoter + ATG

SEQ ID NO: 8829 - DNA, 3000 bp, Unknown
  misc_feature (1)..( 3000): cDNA_ID_3043677_gDNA_ID_1971898_Annot_ID_176917 3000 nt of promoter + ATG
cttcagtattttgttttaaaatcctggctccaatcatattaagcttaggttggtttgttgtaattagctaaagaaaagtaatgacaatatcgagttaataaacaaaataaaaatagggtggcataattctagtgaaaaaattgcagtataacgtttttttccacttgatgcattgaatcacaatcggagccgaagtgtttgtgaaattatctaaacgaggtaatgtcacactattatgatgggagtcccgtcaaatgacctcattatctattgggccatatgaaaaggttttcttatttcatacgatacagtatcgatcgtttccttatatacaagagaagacattagtcttacgacttaacctaattccaacatatggactaagttaatcgaggcccatatggcccaatattatcttcagtgggcccaccctgcttttagaagaaagaaacgaaaatgctcgtcgtttcaccctctatcaatcacgccggaaagcagttcgccggtgagtagagtaccggagttaaaaagttactatctttgtagataaacactaatttgttttcaaaattcgaaaatgttttgaagttccgaaataaaaacaaaaaaattccagtcgtaagaaaagttgtgactggttagtagtactcttgggcaatgccagattgccagctaagggagggagcaacggctcgaacatataccacaatctctctaaaaagcacatttgcagtcatctttcactcatttgcattcgtccaaaacaccgcaaaaaaaaaatattcactcatcggcaacaaagagagaaaagatgcctcctcggtctgtcccacaagccaagatgcaaaggtatttcgaaatcatgttcttcttcttcttcttctctggtttgaactctctctttcgttacttttccaaaaatcggtgttttttttctaatttcttagcatcctctgatttagtctctctgtttactgtgtgtttctctaactttactctttttgtttagttttttcaaaatgatatagtattccagtttctcttcactcatttttgcaatcatgttcgttttctacttttttctacatgttcatgtttgtttctgatacagctttattcttcctctgatttcgttagttcttccaaaaacctgcttttttctagattcttagcatcctctgatttagtagtcttctccgtttgttttcaggatccagaacgtctacttgcactacatgttctcttaatcaacgccattgtcatttcgttggtgttcacggcaatagctgccggtagggatgacaacgaaacaatttccgagtccaactccaacaactcaacaaccgctgctcctcctcctcacagaaacatgcccgaccggatatcggtttgttcctcttcgggatacttttcgtagtatatctcatggtgaaatcctaccaactttctcttgatgacatctggtttcctttcaagaagttcttagatgaaatttcattgtggcttggagttgtgtcccttgttgttctcctgctccttaccactacagtgtttacaatctacattgcagtcccttcagtcatattggcgatagtgggaaggttcatttttgggagaccctgctttctagaattcggctacatcaccttcctacagatatcaaaatggatttgttatctctggcttctaatcgttttgggatgtgcaaagcttagaaggaatttgtttacagggacttcagaggaatccagaatgttactaacagatagggttactaaatcggggaatgcaaaggattcttccctcgtgaagtggaacaagaggattgccgctgcgagagctcgcgcaaccgctgaatctgacagagtggccaaagagaaagccgatattgaagccgatgaggacgctgccgagacagccgaagtcgagctcggcttgatggtggctccggtcaatgcccaataaggcccactttagttttccctcgttctcttttttatgtcgcttgagttttaaataaggcccagtttagccaaaccataagacccaatctagttttttttccttcgtaatatcgttttgtgggcttgttttcttttttagttttggataaatggacttgagcttgtttcttcttgcattacatttatttacacatctgtttagtttagttatgcaaattccacctttgtttcatttgaaaataatcatagaaaattaaaacaatgttaccttaaagtgagattatagttgatctgaaaatgaatataaaggaatctggtttgttcgcttcggtgtccttttaagaatgaaattaaaaaagtcttatttactttacaaacttgagattatagattgccaaaccttctcaagtcttaccaccatattatagtttgaaatggatatcgtgatcatcaagcagaatcactaaatctccaaattcatttttttttttttgtattcaaccacacgtacgtacctatgagccactcttgaagaaaattgggtagggggttataatgtaaaaaaacagattttttgttataattaattggtaaaacatttttgggaaaaaagctaaaaaaactctcaactaattttaattttgaactttaatatccaattgttttagattggaaaataaaaatctaaagtaataaatcgatatatgaaaaaatataatttttttttgagtagttgaataaaacatgcgggttaacagacgttaattttgctaacaaaaactttaaaccgaggttaatggttaaccaaacgtggttaatttggctttgcgaaagactaaaatgtcctcgttcgttttccccaaaatcgattcgttttcaccaaatttcatttgggatcgcgaaagagaaatcccaatttctctctattctgatttcactctatcgttttgtctcctttgatagagtgagaggtgatgattgttagcgtttgatcgggtgaatctatgtttgagtctgttcgtaatctatcgaaaag

SEQ ID NO: 8830 - DNA, 3000 bp, Unknown
  misc_feature (1)..( 3000): cDNA_ID_3043681_gDNA_ID_1971898_Annot_ID_176916 3000 nt of promoter + ATG
atcaaaatgttatatgttgctacatcaggcttgcagtcattagctattatccatcctatactctcagcaggatcaaccttataaccgtgcctatacttagcatcaatgatattattaaggaaccaaacactaacccttaaacccctttctttcacttcactcaaaagtcgatcactcgccacaaaatccccttccttgcagaacccgttaatcattgtaccaaaagtttccaaagtaggcataaatcccttcaacttcaactccttgaaaactaaatacgcattttcgatatcgcccagcttgcagtatccaccaatgattgtgttgtagaacacaatattcggaatacaacctttaccccatcgaccttcaatcagctttctacctacttctacctttccttcattacacatacccttgaccaatatacaagtactgtaattatcaacactatcacctctatcacacatttcgtcatacaccttccgtgcatctccaagtctcctacttttcaccaataaactcaacaacgagttacaagcaataacatcaggcacagaatcatataactcaacaacataatcataaatctccactgctttacttaaacttccagattcagcataagcgtgaagaacatgactcaatgcttcatgtgtaagcttcacattttcgtttctgagattacccaacacatcttcaatctcattgaagatcctatacctcgctaagagcttcagaaacgaagaacaagcgaacccattagaaaagaactcatctttcttctcactcgatagccaatcaaaaagcttaacgccgatttcaacatcctggattcgatcgaatacgaaaggtgaaatgtcgacaaagcggacttcttcatcagcgaagcaatcgtcgagaatttgagaccagttttgttgggttttgaggatggatacagtgtcgctgactagtttcttgatacggggagtaatcggaagatgagatcggaaggaattagatgcatgaggattggagagaggtttgatgcgagagagaagggttttagacattacagacgacggtgagtggtttcgtcgtcaacggcgtttgattcagaagtagagaggaatcagttaggggtggggaagaagagagagaaccggaataaaccaaaccaaaccaaaccgaaatcgaaccaactctgtttatgaaacactctcattacgttttcttttgaattataccgaatcgacttttaaagaaaagctaactaaatagcaccaaatggagttataaattgttttgttctataagttgataagaccgatggttggttattagttatcatcaattgattacgctgaatatctgaattttgtctgtgtatcatcaatcaattgattgcttggtcaggatctatcgtcgtagagccggtgagtcggagagtcgagttttctgggaggtttgtggcgggtttggtgagtcgacggtgaggtgcatcgtcggaaattggtttcttccgatggtggttttcaatccttcttctatgcctcaaagtcgtggaccttgaaaccaccggatctagtgcgaatggttctctgccactgggaatcaacaagttccgagcttccgttctattttctggtgacattttccgatctcttttttgtatctgtttccaagtttgtatggcccaaggcccagtccattgagatttaaaaaaaaaaaaaaaaaaaaaaactttttggatctattgaagatacatggcccggttaacattggttatcctgatctttgtttgatgttctaattaatcatgtatataagtaactacatatgtataagcttagagaaccaactctgtttatgaaccactctcaatttatggattcttcgcccattccacacacttgccttgcctaattctttttttaattaaatattaccatatttgaattccaatacataaactattatattaaaatatttttactaacgtaataggtcaattttttattttattttttgtgcaccacgtaataggtcaattaaactgtgaatcaccatgaccgtcaaataatcatatctattttactttgattacgtaaaatatctgaattttatttcttcacatcgtgtgtaaattctttttggatcagcaagattgttttgtcttttgtccatatgtgccacgtggaccaacgcgtctgtcaccgttagtcactgaatcttttgagccttacaaatcaaattatatgttgttatatagtccaataatttttttcataatttgaaaacttctcttaaaggatttgttttcactagtatctacaagtattgaaatttaagtgaacaaaacttcagtattttgttttaaaatcctggctccaatcatattaagcttaggttggtttgttgtaattagctaaagaaaagtaatgacaatatcgagttaataaacaaaataaaaatagggtggcataattctagtgaaaaaattgcagtataacgtttttttccacttgatgcattgaatcacaatcggagccgaagtgtttgtgaaattatctaaacgaggtaatgtcacactattatgatgggagtcccgtcaaatgacctcattatctattgggccatatgaaaaggttttcttatttcatacgatacagtatcgatcgtttccttatatacaagagaagacattagtcttacgacttaacctaattccaacatatggactaagttaatcgaggcccatatggcccaatattatcttcagtgggcccaccctgcttttagaagaaagaaacgaaaatgctcgtcgtttcaccctctatcaatcacgccggaaagcagttcgccggtgagtagagtaccggagttaaaaagttactatctttgtagataaacactaatttgttttcaaaattcgaaaatgttttgaagttccgaaataaaaacaaaaaaattccagtcgtaagaaaagttgtgactggttagtagtactcttgggca

SEQ ID NO: 8831 - DNA, 3000 bp, Unknown; identical to SEQ ID NO: 8826
  misc_feature (1)..( 3000): cDNA_ID_1989237_gDNA_ID_1971898_Annot_ID_58511 3000 nt of promoter + ATG

SEQ ID NO: 8832 - DNA, 3000 bp, Unknown; identical to SEQ ID NO: 8825
  misc_feature (1)..( 3000): cDNA_ID_1989236_gDNA_ID_1971898_Annot_ID_58512 3000 nt of promoter + ATG

SEQ ID NO: 8833 - DNA, 3000 bp, Unknown
  misc_feature (1)..( 3000): cDNA_ID_1989235_gDNA_ID_1971898_Annot_ID_58513 3000 nt of promoter + ATG
gtgacggccgagtttaggactttagggttttgttcttaaaagaaagaaaaagtaagttactcttagggaaaattaaagaatcccaaaaccacaagtaatctcaggagtctctttgttaaaaaccgaaataattaacgattacatatataacaagaacagagtaaaagaacttccaagagaactccctcggtctaacaccatagaaaactcctcctaatccctttggaagaaggaaataatttcttaaatactctacataaatttgaaacaattagagaaatattcccaaaaccacaagtaatctcaacagtttccgaccaaaaaaaaagacatcgtgccgttttacaattcttaacaacttctcgtttgtatcagaaaatacaagactagccatgtgttggtaacttggtatagataaagatactttaaagatataaagattgacgcatccccaacatcaacaatttttccacttgatagttgatagtttaaatatggcccaaattgaacatcagcaaagtaattaatgaaatctcagtcctcggaaaaatcaagtttaggtgtcaatctttttaccatttaatagaacactatagacataaaaatcaaataagacattaggtgtttggtagtagatattgaaatatctttttagttcttaattgggtcgttatttcaaatatatactacacagacagactatccaagtctcaccattttcatcaatatttacgaggaaatactcaaattaacaccattaagagagacactatatattttacataaagacctggcgctataatgaatcatcatcattgcatttatgacttaatcatattcaacgtatacaatatatatatttgatttactccatagtaactttttcctgatcagataactataacctagctgtttaacaaagaaaaaataaaaaataaaggaacgatttgtattaaaaggtttaaaataatacaaataagtcttacaaccacattgtattctcgacaaaatcatgaatggcaaatacgcgaataatatctctaggttgttttcttgtctttagcctagtactttcgatttcaactcttctatagcttttttgcttcacgttataataatgaacacacaatggcatattataaaaaggataacacatactaaatatctcaccagcaggagtgatacctgagaaagttctgaaatcacctccagggtattcaagcaagccaaaagtaatgttggaccattcttgcttctcagcattctccataatccacatacttatattgttttcgttgctacttatgcatcctaacttcccttggtggttaaaaagacctcgctcagtacacttgggactccacaatgtttcaggagtgcggacatgataaaatctttccgactttacgtcgaaactcatcatgaaaagttcaccataattctcattatcttttcttctaactgctacgtagtaaatagttccgtcaatgcatacccccgcccggctgactgaaatgagttcgtaatcaatattgcctcggatttttctccattgaggacaatctctacccaatgtgaaaacatgaaaagtttgcgtcaactcttgcgagtcattaaccatggccaacactttgtattcattcatgacatggtcgtatccaaagtaacagtgtttgtgtctctttggtgagagtaccattgattcgatcttgggtaaaggaagacattgcctcgtggtagggttgtatatggtaaccaaatcatatactgatgaagaacaacatataaagcctcgaacgtattgatacctgaacgcattatagtggtttcgtccaggcattattgatactttgggttttgtgctttgagagaatgtagacgacacggtgaagaaagttccaggatcacattggtggaagatgaagaccggaagcttatgaggcggctgtctcaaagaccgagccatgatcgactcaacgaagtctctacgtttgcttataatgaatgaccatggctttgagacacatcggaacctcatcaaagattttgtcgggagttttttgagtatctccacaattaggtcaaggggtagatgaacatcttttaattttgataaaagtagttgaaactcttccaatcttttttcttcctcttttaatgatctctgcttgttcaaatatctgataactttaggaacggagaaaaagaaaagaaagacagagaaggcttgcgttcttttattgacactaaacatgtagccggtgcgtggtctacgaaaacttaaactgacactcaaaagaataatcagaaaactgatctgtgaaatattggacaaagataaaagcgtgaagaatgagagtggaggagatgggaagatatcgtaacggcgaagaaaaggattgaatatattgtgttcgataaatagggttttggttaccaaagaagaaaacaattagggtttaatgtgctattattgctaaaccaattctcctaccaaacaaaaagacattgtgccgttttacactaaagacttcgaagtccgaaccacgtcttgttttgtattagaaaaatacaaatacaaatacaaaccatgctgatatatatgaatatatgataaattatttcataaataaattatcaacatggttagcgaaaattatatattcagaaatttacagaaataaaaattcacagtttaaagagatatttttttttttgaaatattttgttacttattatatttgatattttttttttttgaaattatgtttacgtttcttcattcaatgatattttcgtttaaattttttttggatacaattattttacaaaaattgtgtctattaattttcaaaagaagatttatgcttggattaaaataaaataaaatttagagagagtacaactaaagcggaacaactaaacgaagcaataaaaggcgcgaatcgaaggggaaccggagagaccaaaaccctaatttcgccgacgagaaaaaccatg

SEQ ID NO: 8834 - DNA, 3000 bp, Unknown; identical to SEQ ID NO: 8833
  misc_feature (1)..( 3000): cDNA_ID_1989234_gDNA_ID_1971898_Annot_ID_58514 3000 nt of promoter + ATG

SEQ ID NO: 8835 - DNA, 3000 bp, Unknown
  misc_feature (1)..( 3000): cDNA_ID_1989232_gDNA_ID_1971898_Annot_ID_58516 3000 nt of promoter + ATG
ctctctctaaattttattttattttaatccaagcataaatcttcttttgaaaattaatagacacaatttttgtaaaataattgtatccaaaaaaaatttaaacgaaaatatcattgaatgaagaaacgtaaacataatttcaaaaaaaaaaaatatcaaatataataagtaacaaaatatttcaaaaaaaaaaatatctctttaaactgtgaatttttatttctgtaaatttctgaatatataattttcgctaaccatgttgataatttatttatgaaataatttatcatatattcatatatatcagcatggtttgtatttgtatttgtatttttctaatacaaaacaagacgtggttcggacttcgaagtctttagtgtaaaacggcacaatgtctttttgtttggtaggagaattggtttagcaataatagcacattaaaccctaattgttttcttctttggtaaccaaaaccctatttatcgaacacaatatattcaatccttttcttcgccgttacgatatcttcccatctcctccactctcattcttcacgcttttatctttgtccaatatttcacagatcagttttctgattattcttttgagtgtcagtttaagttttcgtagaccacgcaccggctacatgtttagtgtcaataaaagaacgcaagccttctctgtctttcttttctttttctccgttcctaaagttatcagatatttgaacaagcagagatcattaaaagaggaagaaaaaagattggaagagtttcaactacttttatcaaaattaaaagatgttcatctaccccttgacctaattgtggagatactcaaaaaactcccgacaaaatctttgatgaggttccgatgtgtctcaaagccatggtcattcattataagcaaacgtagagacttcgttgagtcgatcatggctcggtctttgagacagccgcctcataagcttccggtcttcatcttccaccaatgtgatcctggaactttcttcaccgtgtcgtctacattctctcaaagcacaaaacccaaagtatcaataatgcctggacgaaaccactataatgcgttcaggtatcaatacgttcgaggctttatatgttgttcttcatcagtatatgatttggttaccatatacaaccctaccacgaggcaatgtcttcctttacccaagatcgaatcaatggtactctcaccaaagagacacaaacactgttactttggatacgaccatgtcatgaatgaatacaaagtgttggccatggttaatgactcgcaagagttgacgcaaacttttcatgttttcacattgggtagagattgtcctcaatggagaaaaatccgaggcaatattgattacgaactcatttcagtcagccgggcgggggtatgcattgacggaactatttactacgtagcagttagaagaaaagataatgagaattatggtgaacttttcatgatgagtttcgacgtaaagtcggaaagattttatcatgtccgcactcctgaaacattgtggagtcccaagtgtactgagcgaggtctttttaaccaccaagggaagttaggatgcataagtagcaacgaaaacaatataagtatgtggattatggagaatgctgagaagcaagaatggtccaacattacttttggcttgcttgaataccctggaggtgatttcagaactttctcaggtatcactcctgctggtgagatatttagtatgtgttatcctttttataatatgccattgtgtgttcattattataacgtgaagcaaaaaagctatagaagagttgaaatcgaaagtactaggctaaagacaagaaaacaacctagagatattattcgcgtatttgccattcatgattttgtcgagaatacaatgtggttgtaagacttatttgtattattttaaaccttttaatacaaatcgttcctttattttttattttttctttgttaaacagctaggttatagttatctgatcaggaaaaagttactatggagtaaatcaaatatatatattgtatacgttgaatatgattaagtcataaatgcaatgatgatgattcattatagcgccaggtctttatgtaaaatatatagtgtctctcttaatggtgttaatttgagtatttcctcgtaaatattgatgaaaatggtgagacttggatagtctgtctgtgtagtatatatttgaaataacgacccaattaagaactaaaaagatatttcaatatctactaccaaacacctaatgtcttatttgatttttatgtctatagtgttctattaaatggtaaaaagattgacacctaaacttgatttttccgaggactgagatttcattaattactttgctgatgttcaatttgggccatatttaaactatcaactatcaagtggaaaaattgttgatgttggggatgcgtcaatctttatatctttaaagtatctttatctataccaagttaccaacacatggctagtcttgtattttctgatacaaacgagaagttgttaagaattgtaaaacggcacgatgtctttttttttggtcggaaactgttgagattacttgtggttttgggaatatttctctaattgtttcaaatttatgtagagtatttaagaaattatttccttcttccaaagggattaggaggagttttctatggtgttagaccgagggagttctcttggaagttcttttactctgttcttgttatatatgtaatcgttaattatttcggtttttaacaaagagactcctgagattacttgtggttttgggattctttaattttccctaagagtaacttactttttctttcttttaagaacaaaaccctaaagtcctaaactcggccgtcacgatatctacatctttcacaattcttgtgagtttccagttatgtttcctagattaccgtcacgttttatttgtttacaaaagaaggagaaaaacagaggtc

SEQ ID NO: 8836 - DNA, 3000 bp, Unknown
  misc_feature (1)..( 3000): cDNA_ID_1989231_gDNA_ID_1971898_Annot_ID_58517 3000 nt of promoter + ATG
cggatgaaccagaaaatggtaatgcagaatgacctaatatcgacctatgcataattattagagaatataacaaaaattaaaaaagtgctcttttatatatatttataagtgctcactaaaacttttttatatatatagtcataaaaggagtgggaggttttggcatgggtgcagcagtagctctccactttgcaacaagttgtgctcttaaccattatactataaatccccgagttgttgttggaatcagcgggtggctttctaaggcgaagtatactcaaataatttctttaaactaagtaaggttacgtttcacatcccattgaatgatgaaagactaattactcaacattgcaggagcctaaaacgaagtatagaatttgcttcatatgaggctccacctcgtgctgcatcgcagtcaatcttacttacacatggacaaagtaattcatgtatctattttcctctttagacagagggaatgctaattaaatctttatatatgataatatgtttcgcaggagatcatgttcctcacctatgtggctgtggagaagaagctgcttttatacttagagaggctggatttagagacgtcaggttcttaccatttgcaaggtatagaaacatcaaatattttactttttagccctgctagctctatatagcatttttggtttgacatttttttgtctaataagtttattgggttatgaatatgtgacataggtttggaccgatcgctcatgagatcaatcgcaacgtaatggtcaaaagctggttagaagagaagctcccgctcgatgttgtgcttgcaaaagaatgtctaccataaagactttcatctatctagctagtgactagtagtttactatcgtcgtttgtttaatttgtcctgaataaattagcgtgactcatgttatgacttatgactaagttattggttttttcagactttacggtagtttgttttttccccgttggtgctatcaagttgtcgcaaccttttttaacaattaaataattattaattaactatgttgcaatcttcttataagtatacatgagtaatatatatttgaattaagccaagatataacgtaaattgataaacctatacgtatttggtaatgaaagtatgtgattagatgatagatatacatccatacaatttagtttttgaaagtgtcaatttcctttctctatacaaactacttcaatcattcaccatatgttaattaatataaactcgaactagccattatcatttatcaagttgcattagaaacagataagacattaggtatatggttgcagattaattttttctgtttctttcaattaattttattgttttccttcctaattcttcagttttttcggttggcgattattaactggtaacctttttcgaaatagcaacaagaagaaagagatggtaataattgaagtattatttttttcaaacgtaatgagtaatttagtaacccaaagatgttgttaattagaacaccaaattgataatgtgaccaacgaacatcttgaccttctgatatatcactctccaccttctagccttgtgcatgttgttgcttgggtagcttctagaaacaccatattcaacatcatatttgcaagttattcctccaagcttctgtctataagatttggaaggaaaataactctatatgacgttcttttgttttattctaacaaacccgaattttattatatatattttttagaaaccaccaaaattgataatcaggttttaagatagcttcgacatctcacgtctagagatttgaaggtatagtttgtgtgacttaaaaaaaaaattgaaatattaaagtttacgtgctccacaatgagaatgtaatattaaagtttacgtgttgggattgaaaattctttttgtttggaacgcactcgtgactcacttagtcatctggaattacttatttcctataaatatttgaagttgttgtactcatagtcaagattattttcctgtgtggtttccttaatttaactctatactagttatgggattcatagttgttacttgttagtaatttgcatttatgtgtacgtattctttaagtttggaccacacttatgccccaattagaaatttgaagcgactaagattttctaaatacctaattttattttattttattttacagctcctaaataccttaattagttatacttttgctttaagtttggaccactaatgactgaattcgtcatttgaaacgactcatcccatatcaaatatcttgccaaaatgtgtaccaactaaagtaaaactatttagtaaaaaaattcatagatgcatgccctgtagagtgtagtatttataaaatgaattatggtattggtttttaagatttaacattagtctacgtgtaaaattctaaaacctctactaattatgagatttatagatatcgtaaattttccaaatatgtatatagctgtataccaattaatcaaagtaagactaagacaaataatatgaaatacataattggttccagctaaagtacacagaagatatcaatgtcataggttcaatttcgatgatacttattacttatgatttcgatgatatcataagttcaatttccttttatatcttttcatagaactagaaagaagaaaaaattagtccctaggtgtggttccaaaaattgataatgaaacatctgattatgtttccttcattaattagtgaccaaccaatatatttgacattttgatttagtgagatagaaaaaaagaaatggaatattctctctcccatcaggtttgtgctttttgggtgtataaatacacatcgttcctcacatatttccaccatcactggcttccgaaactcctctcaaaaatatagaaaagaaaatcctttaacaaaaaacagatatagaaaaatctgctaagtaaaaaaataaaaataaaagaactagtcaagttttttctcatcaaaacatg

SEQ ID NO: 8837 - DNA, 3000 bp, Unknown; identical to SEQ ID NO: 8824
  misc_feature (1)..( 3000): cDNA_ID_1989229_gDNA_ID_1971898_Annot_ID_58519 3000 nt of promoter + ATG

SEQ ID NO: 8838 - DNA, 3000 bp, Unknown; identical to SEQ ID NO: 8823
  misc_feature (1)..( 3000): cDNA_ID_1989227_gDNA_ID_1971898_Annot_ID_58521 3000 nt of promoter + ATG

SEQ ID NO: 8839 - DNA, 3000 bp, Unknown; identical to SEQ ID NO: 8817
  misc_feature (1)..( 3000): cDNA_ID_1989254_gDNA_ID_1971898_Annot_ID_176899 3000 nt of promoter + ATG

SEQ ID NO: 8840 - DNA, 595 bp, Unknown; identical to SEQ ID NO: 8822
  misc_feature (1)..( 595): cDNA_ID_1989226_gDNA_ID_1971898_Annot_ID_58522 3000 nt of promoter + ATG

SEQ ID NO: 8841 - DNA, 3000 bp, Unknown
  misc_feature (1)..( 3000): cDNA_ID_1989262_gDNA_ID_1971905_Annot_ID_58524 3000 nt of promoter + ATG
tatgtattaaaaataattcgttccattcatggggtggttttcttattaatgtttggttgaaggagaaaagcaagcagtaattaaaatatatagaaattaatattgctgtaatttgttgatttactagatgtatgttattccaaacactaatttttgaaagataatattttaataattgttattagtcatattgaacgtttacaaaagatgtagaagaaaccaacgtgtagcttgggttcaaaacctagttctattaatactaaagtttgctaatcatgtttaaagtaaaattagatgaattttattaatccaatctctatgaatttaatatctttttatataatttcgtatgttccattgtttattatttcatattatcactcttctaattgaaatatgttattcttatcatcatttgaaaattgtttttattctctggactttcccatatataaccgctccattgttttacctttttagaaccctaatttgttctttccaggtcatttactatgtggtttttagatgtggacaataatatataagttatgaaattatctgaatctatactttttggatatgtgaaactcggataaacatcaaaatatccgtatcagaatccgtaaaatgttagtagaaaatatttgaaggtataaagagttgggcaacatgtgttagcggcaatgattttgaatgtgatgagaagtaatatctaggaacaagtggttagatacacaattatgtgaatagatgatataatagatacaacaaaaatgattgatgagaaggagatagaaaaagggaactttgttccattgaccaatgtgtttgcgatcactttttcaaattttgaagtaattgactacattgtacaatttatgtgtaatcatgcctatagtttctacatcgattcatcatacaatcatgagttttcatatatctagatcctaattactatcaaatataggtttgtgagaggttgtatgtgacttggaataaaacacaacatcctccatcatatctcttttgaggatttaagataattttgaagatttctttagttgaaaacacataaatctaaataacatgatttaaatggaatttgggaagattttcaaacaaatcataataactactctaaattcacttaagatcaacaaaatcataaaaactcaaatcatttaaaacaaagggttggatacactttgaaacttgcaacttatattttgattggtttttttttttatagtcgattgttcttaacaaaaaccctctatacttgatacatatattaataaaataaaaaaactatagactaacttttttgctgtgaaagtgtgttaattatatcttcaacatgagagaatgcatcattggtggtgtgagataaaaccattgtgtctttctaacccacatctaacaaatattttatctaattgggcattaaaataataataagtgaaggctcaataacacctaaaaatgcagcgaatattctagcttccatgcgtcataagcaagcaaaaaaaatggagactatatataagttcttctgtataattagagttacaaatttgtggagactatatataacttcttttgcctcccatgcgtcataagcaagcaaaaaaaaaaaatggagcaaactttcatcacgtggaaaacttgtctttcttttttttaatacatatttgaaggtttaaaagagttagacaggatgtgttagcgacaatgttttcgaatgtaatgaaaaataatctttaagaacaagtggttatgtacaaatttatgcgaatagatgataaagtagatacaacaaaaatgattgagtagcaagagatggagaaagagaactttgctatattaaaaaatgtgtttgagatcattttatcaatttttgaagtaattggctacatcgaataatttatgtacttatatatagtttctatatcaattcatatacttgatacatatattataaaaaataaaatccttaaaactacaatttttgtttagaaaatgtgttgtgtatatcttcaacatgagagaatgcatcagagtggtgtgatcaaactcttctaacccaaatctaacaaatattttagggttttgtgccaacaaccctcaaaaatattgttcttgcaacataacctttcatataaaatacatgtaggtcaatactctgatatcaaaagtcacccgcaatataaccacgtgcataaattttatataatccttgggcgtgtatagattttgcaaaccgtataagtatgtatataagttattaaactacgtcgtttgagcatttttcggaaaataatatattactagagtggattggaaccaataaggccccgatccagatttgaaaccagaaattggaattttcaaacttagggtttgattttggggatttataagtggggatcttttgtttatgtcacaacgtcgtcgtatctggtcaataacagagactctttcacaaccgacgtcgtatctggtcaataacggagaccctttatctctgtattttgagataactcagtcgtgaagcagtcataactaagctgtgtgactattataactcggtcaaaccctgaaagtgctttccttaagccatcagttggtacaatcaagtaattaacatatcataatcacattccaactagtggaatcatgaaactatctcatattctatatactttatccaacatcatacccaacaacatcattcctagaagtttggtcaacatagtttgtcaatcgacacttaccgaaaacccaatttattttttgttttcatattatagatcttgaaactaatagaaccaacaatttggtggctagtttgaaatctcataataacatctggtttcttataactcggtcaaaccacaaaatcttctggcataactcagtcgtaacgtattggtattgtgaggcccaagcccaagagggtcccaaccaacccaagtaacacacaaaaccctaagcgtgtgt

SEQ ID NO: 8842 - DNA, 3000 bp, Unknown
  misc_feature (1)..( 3000): cDNA_ID_1031665_gDNA_ID_1971905_Annot_ID_58531 3000 nt of promoter + ATG
tggtatgttaatacttggattaccggctaatatcataagtttatggtgatttgagatagtttcacttttgttatgaattagagttagcacctaatacaaatgttacattaacttttatcttttggactgtgttttaataagggaaagaagggatacaactttccatttagaaagagaaatgacgatgacgactggtttccctaaaaatcaataaataaatagcaaaaaagaaaaaagactacatgcaaagaataataataatctgacacaatatattcatacagtataaaaagattttcctaggggtacatacgcaatttccacatgtacaatattagtcaaacagtgatttttttggacacttaaataacaactcttccaagtatagattgtgcaattttcctaaacaaaaagcagtctaaaccgttgatagatttgtccgtcctaaccgcgtaaccatttgaactcttagctttttttaatgttaagttgttgccaataaaccgaccgtaaatgaatcgagatacttgatttgaaaagtcgatccaaaatcaaatcaaacaaagaaaaatggtttaaaaccgaaatttctttaaaaattaaggatattgtagataaacattcaataccgaaccaaaataaaaccatactaaaccatccataatttggataccagtactaagaaaccaaatttttaaaaaccgaataattcaaataaaaaccgaaccgaaatcacatggttttgtaagagatcatttgaaaaaaataaaaaatattcgctcaacaattttgtttctctataatcaatcaccaatcagcaaaattctagggtttcaattatcttctctgcgatttgaatgaacaaatccaacttcattcacaaatttcatcactctgcaaaaccacatacaatggaagataacgaagaagaagaagaatcaccgacggagttaaacacgatcaccggtttaagcggttttgtagttatctctcccgataagctatctctcaaatacactggcgtttctcaacacggtcacgatgtcggcgttgttcaagctaataaacctgctccgtgtaaacgtttcgcttattacttcgagatttatgttaaagatgctggtgttaaaggacgtgtctccattggtttcactactaatagtttcagaatcgcgagacatcctgggtatgatattgagttttgtttagatttgattaggttcttaaagatctcttatttttgtttagttgttttaagtttgattaggttcaggatttggttcaattgtgtgagttttatttatgtttggttaggatcagaacatacgaaagtgttggattttgtttctatatcattgttgctgagcattcaaattgatagttttgtgatatttcttatgtaatggttagatgggaactcaacacttgtggttatcatggtgaagatgggcttatatatctaggaaaacgtcaaggtgaagcttttggtccgacttatacaactggtgatactgttggtggtggtataaactatgattcgcaggaattctttttcacgtgagtatctaagagttcaagagtcaattcattttcatgttacagttctgacatatctttgttatgagatgccagtgtaaatggaactctggtagggacagtctccaagtacatcaagggtcctctattccctactgtagctgtacatagccaaaacgaagagtatgctctctttgtttcttaatatgatgtcagcgtgaactatttttcaagtgcttgaatatgttctttgtttgatgttctgaatcttggtagggttacagtcaacttcgggcaggagaagtttgcctttgattttaaggtaagatccttgaatatttttggtatactagtggagtttctagctcttagcttgtgtaatttatcgatgggatagtccgaagtataactatcgtatagtaaagaaacatatgcatctttttgatatggtacaaacatataatgtggcagatgattcactgtaaaaaaatacagtgattaaacatcttctcttagactctacgattaagaattgtatgtgtaatatgtgtagaaagttgaggtagagagtaatatgtgtttacttgtgcttctctttctgccttaggtttgtttgaggttaaggttacaggagtgattacgtatgatttagctgttcctctttttttctgttgtgttagggatatgaatcatcggagaggaataagcaacaaatagcaatcgaaaagatatccataccatcgaacatgagtcttgggtgagtacactcttgttctgtagttactgaggtgaagttttttcttctattcttttattgcattggtaataaaatttctgcgtagctaagaagcttctggttttttttgatcatcaggcttgtaaagaactatttgcttcattatgggtatgaagagactcatcatgctttagacttggctactaacagtacacttcctcctatcaatggagctcaagaaaatggtattgatgatacatcatatgcattgcatgagagaaaaattcttagacaggtattgaattagactgctatcttgctcgttactactactacatctctttcgttaagtattgaactgatccatacgtcggttggtaaagcttatacggaagggtgagatcgatgctgctcttgcgaaactccgagatagctatccccaacttgtacaggtggattgaggaactaatcatatcagttgattcatattgttacattgaaaatatgaactcttacctcaattgtataatctgcagaacgataaatcagaagtatgcttcctccttcactgtcaaaagttcattgaattagtacgggtatgctcttcattccttatatattaatcagatccactgcggttagactgacctctctctaagtaaataaatactaaaatgtgacatacttagattggagcactagaagaggctgtgaaatatggacgaatg

SEQ ID NO: 8843 - DNA, 3000 bp, Unknown
  misc_feature (1)..( 3000): cDNA_ID_1989256_gDNA_ID_1971905_Annot_ID_176972 3000 nt of promoter + ATG
attttttttgaaaaaataattttggcgggaaattttttttccgaaaacttttggcggaaaatgtttttgacgggaaaattttggcggaaaatttgttttggaatattttaggcgaaaaaatattaagattccattttgttaacctaaaataatttccaaataagggtaaaatggtcattaaaaatttaaagagggtagaaatgaaaatggataaaataaaaggatagagttgaaaaagggcatcatgaaaaaaaaaagaatctttcttcaattaaacatataattacaaaataattttaaaaggaaatcttgcaaaatctgccatattccactctatttctttcaatccctgccatattctgtaactccttccaactcatgccacattttgctgcacgtggaattcagtggacgaaattatccttaaggtgggtcagcgctctgacgaagatggtgacataacagcttttggctgatgtaatgatacaagacgaaaaatcatgctggaagaataaagaattaggggacaaaatagtggagaacaactggcttctactgttgttattgggtatttaaaaatgacttatttaaacaaattggttatccaaaattctgcgggggacaacgtaatatataatacattaggagacatgattacctgatagcgggggacaacgtaatatataatgcgttaggagacatgattacctattagcggagaacaattggagcaagacttttgttttagtcttcagatcttgtcctcgaatagaaattctcttttgcatctacgttttgtcctcgatttcaccatcttgctctattattatgaatcctacatcttatatgcaattgttctcatttaataattttgaattttatttaaatttttgcgatctattttgatccacagattagttgagcgttattgtcttcacctacacgttaacatattttaataatatgttatatcgggacaagttcatatcgaatgagtaatagaattggatcggggacaaagtcagatcgaatgatagacaagataatatgtaataactgaatatttttgttgttttacaatagaagaaaaaaaaatcgtgtcggtgaaaacaataatgctcaactaatctgtggaccaaaatagatggtaaaaaatgatgaaatcaaggacaagatctagatacaacagaaatattgtgatgaataaaattgagagacaaatttaattgaaagttacatgtaaagaatctgtgcaggttgtcaaagaaagtgagagagtgacaaaagcgcttcatcttcgggaagataataatatatggttaaagcgcacagatttcaaggaaggagagataaaatagagaagaaatggagagggacaaaatcgatatttcagtatgaaatatgacatgagttgtaaggcccagcaaattatggcagattgcataaggattggaaaaaatatggcatatgttgtaattttttcctttttaaaaataatctaaataattctataatcaatatgtgaacgatattatactttacagatctttttgtaacttcaccttaattatgatagaccttgcaaacaaataaatgcaacaaaaaatagacactaaaaaatctcaacaacaatctttaaattataaaaaatcacataaatatcttcgggattcaaattttaataattatttaaacggattttctaatttatatcaaaaccaaatatattgaatataaaatatacaaataggaaatacattaatttaaaagatacaaaatatttaacaagaaattgtgttattttttgttcaaagaattcgatataaaatcttcgaaacgatccgatattgattcttattagattgaaattgttaaaatttcaatatattatacaatttttctttttaaattgaaattgtaaaccgactcgaagtatattaaataaaaatattattaaaaagaaaaagaacaatttgatttttagttatcacgggacggatttatatggcgggacgggtttacaggagacgagtttacatggtaggacgggtttggatgagacgagattatatggtgctatgagtttagatgggaaaaatttggataccacgggtgtactcctagaattaacaatcaaattacaactatacaatagtaaacaaaacaaacaataataacataacaaatacaattttaatttcaaatttttagttacaaaaaaataaataaaatcaacattttagtataagtgttaatcttctttgacacctctaaatgttattcttctttgatacatttaaatgtgtaattttaatataaagttactaaactacatatgttccatggattaaatttgaaaacaccaaaagtttatattaaataatttttttataacaaattatgaataaaataaaatattatcccgtggtatggtctatcacaagtcaaatcctaaaagataaaataacatatattagacttattaatatcataattgtgactcaataaaaaacatacacaaccttatcgataattattaatcatcacaaacaacaacaaacaacaaattatattttgtgataaagaaaaataaataaataaatttaatttacggtatatcgcgggtcatatcctaattatgatacaattgtctatttttaccctatatatattacaaacgcacacatttgttgcataacatatttagacatcgcttccaaagaaagaaatcatttatctctacattatttcttcctctcattgcccctctcttctcaacgttttgtctcttatatctttacgtttcatactttttttttgttgacatttaattatttaaattttttgttcctatggacactagataggacaacaaaagatataaagaaaatctacaccacacatatcatgaggttctggaacaagtttctgcggtaagagaaaccaaaaacatgaagggcagaaaaaaaaagaacaaaccatcttcaacacagagccatg

SEQ ID NO: 8844 - DNA, 3000 bp, Unknown
  misc_feature (1)..( 3000): cDNA_ID_2138868_gDNA_ID_1971905_Annot_ID_176952 3000 nt of promoter + ATG
tataaagtactatgcatacttaaagaacgaaacaagattggaattcttacattgggagctcaagaatcatggagaatattatctaaaggtttccttagtcattacaaagtgacaggttatgcaaaatgcattgatggagtcatctactatgaaggttcttttggtgatggtttaagacaagagcttgccataatgagttttgatttaagatctgaaaagttcagtttgattaaacatccgaagaaaagtagcatagctacatgttggtcatcttatgagggaagattagctttggtaagttccattgcttctggagttagcttatggattttggaggatgctgataatcacaaacaatggatatataaacattttccttcacatcgagaattcatcaaagagagatggaagttgaagggtgttactcgtactggtgaatttatttacacatcttacagagcttatgtacttaatgttgaaggaagggttttatatcaatggttccgtattttgtatgttgatcccaagagaaacagtatgagggtagttatgcatggaggaattgcagttgacgatattaggcgacttgatgaagttggatatgatcttatgaaagacttgactgtcataccaaatcacattcagatttgaagctgatcttaccatgtcgttgtaagagttttcttcatttttcttttcttaagttctgcaaattttgtgatgatttttgaatcattgaatcccattgaggggtttttgtcttgatttaagaaattccttataaaatcgtggtagtgaagtaacacctgactctaacgcaagaacatcactgaaatgtgtagcttagtcttctatattggttacatatatagtcatctaatgttcttgaataaaaatacctcatgagcagaactccaggtcatatttttcttaatcaagagaaatacattttgttatgatttgataagttccttaatcccaacatgtttttattgtgtttggaagacagtttgattacctaagtttgtaggaggtctaggcctgaaatatcactttcatgtaataaactagaacaaactattttatcaagatggaactaatatgcactttaatattaatacataatacttttaaaaatggtgaaaaataatgagcttatctaccaaaaaacagaaccagttgtttatgatggccaaaagtgtcataattacagtccctagttgctctcatgtgtctttcagatttccagctcttgaaactttgtcaatgtaccaagtgagatgatgatgatgttatgttttgtgaattgtcaacaggtcctgaattggagcgcttgttgaaggagctgatttggactcagaatcaactggatgaaaaaacagtctatgtgtatccacgcatgaatgatttttccactggccagctcatataccgaccagaatgattcttcttccctttcagcaactaacggctctgcaaaagggaacatatatagtgatatataactgatctgtcgcaagaacatgatgaccatttcttcctagtgagtattttgagtgaggggggagtttttagccttgctcttatgatttagggattttcttattcatgacaatattggacccctaggtagtactaataacaagagagggtttttgttttcaaatgttggtttactggttaggcttttattctccaccatggtatggttcctataaagctacataagaattcattttgaagtttgtttggtgtgtgaccgaagaaccaaaaaaaaaaaaacagttgctcattctttgtctacttatctcactattcggcaatgcatatacgtcctaatctttgttttgcttatcttagttattctatctctctcccttacctaaaaagctggcttcaaaggacttgacggatcgtttataaaacagactagtcataaacatagatttatattcgagatggcttcaaatacgaatcttaaactgtttatagtatatatagtatctaatagctgcgggtgttgtgaaagggaacttagtgttgaccatggtcatggagtttaaccaagaagtttgttgaaccaaggattcacacaatagatttgtttagagagggaaaacaaatctagtaatttctcttcattaggtattctatccaagactcgattataagaggggttctaatctcttatgaaatacattagggttttgctcaagaacagaaaaagaattagagttttaaaaaggtatagctgcatccatgatggattgcctacgtaccctgtgaagggatcaagccattcgtagttttcaataggtataaagttctatgtttcttgtgaatatcccaagatctccccctttttgtgaagtccctaaggcactttatataggatccttaaaccgcctccctagcgatattcttcggaagattcttatttatccttaggtcggttctagaggataatcgtcctaaggatattctccttattcttcggaggttttggggagatttcctgatttcgacattatcttcaaagattctcctttatcatttctgaaagtcccataaaagatcccattttaccggaaatgatccttggagaatgaatggtttttacaagtctttgcctcgcgtgttcttcacggctcggtggtcgtttgagaggtggcttcggggcaaacggtatgtaccggctcggggcgcgcttgatgactgtccattaagctcagttggctgtctcccgagccgatatagatgtttcccgcagcgttctcacgattggttcgggctgtgttcatatgattaacacccgagccattttacaaactctcttcgggacggtcgatcgaataaggtcccgaggtgctttgttctaggctaggggccaatcatatgtttaaccatgaggtgattgttattcttagactgtttggctcggtcttgcttgtgggggaatccgaccccaacaaagttgtaccttgacggaagagagcacga

SEQ ID NO: 8845 - DNA, 3000 bp, Unknown; identical to SEQ ID NO: 8843
  misc_feature (1)..( 3000): cDNA_ID_1989256_gDNA_ID_1971905_Annot_ID_58533 3000 nt of promoter + ATG

SEQ ID NO: 8846 - DNA, 3000 bp, Unknown
  misc_feature (1)..( 3000): cDNA_ID_3043759_gDNA_ID_1971906_Annot_ID_176981 3000 nt of promoter + ATG
caattccttaatgtatgtgagtacaatgctccaaaacttcaagtatttgttttatgatataatttgaactaaattaaattacctctcattgaaatcttagagatactagatccatttattcttccattttcaaactaaagttaacaacttcaggcttgatggatagatattttcacattgtagattagctcagatgaatttatgaaaggattggtgggacagacttctggcttccttccccgggacttgcaagctcttgtagctgatgctggtgccaacttatacatcagtcaagagtccgagaccaagaaaattaactctctgtcagatgatcttcatggagttgatatacaccaggcaagccaaatagataacagcactgagaaattaacagctaaggaagactttaccaaagctttggatcgatcaaagaagagaaatgcatcagcccttggtgctcctaaggtaacattcacagttttcttgctgtggtgttttctcgtttgtttgtctatttatgagacaagtttgcatatttttttgttactggagatgcacataacttaaaggtttatttgtattcgtaggttccaaatgtgaaatgggatgatgttggtgggcttgaggatgtgaagacatcgatattggacacagttcaactacctctcctgcataaagatttattttcgtccggattgcgtaaacgttctggtgtacttctctatggccctccaggaacagggaaagtaagtaagccattttttctttcacttttagcatctcttaatagtctgttttttggcagttatatttttgagtttttgaattaaatttacagactttactggcaaaagctgtggcgacagagtgctccttaaatttcctcagtgtaaagggtccagaattaatcaacatgtatattggagagtcagagaaaaatgttcgagatatatttgaaaaggtaagttatatttcttcttccctaggagaagcatattgagtctttggttctgattcttaaactagtgtgttttcttcaattgcaggcaaggtcagcgcgaccttgtgtgatcttctttgatgagcttgattctcttgctccagctcgaggtgcttctggtgattctggaggagtcatggatcgagtggtatctcagatgcttgcagagatcgatggactcagcgactcttcccaggatctgtttattataggagcaagcaacagacctgacttgattgatccagctcttttacggcctggcagattcgacaaacttctatatgttggagtcaacgctgatgcgtcttacagggaaaggttaggcatttaaacaatcaaaagcatgtccaaagacaaaaaaaattagaagcttcctgattcttgtttttgacagggtacttaaagcactgactcggaaatttaagttaagcgaagatgtatctctttattcagtagcaaagaagtgtccctctacattcaccggcgctgatatgtacgccttgtgtgctgatgcttggtttcaggcagctaagcgaaaggtgagagggatagggttgaaatttaagactatataagtctctgtaaaagcttttattgaaatcgctttgtatctgcatacttggcaaatgcaggtgtcaaaatcggattcaggggatatgcctacagaagaagatgatcccgattcagtcgttgtagagtatgtggattttataaaggttaaaactcttttccttcatctactcatcaaaaagagttgccattttcatggttgagtagaaatgttaatttgttatggttcggttttatcagtcgagagttataatagtttcccactttgtcttctttgtaggcaatggatcagctctcgccatcactctccataactgagcttaagaagtatgagatgcttcgagatcaatttcaaggccgttcgagctaaacccctctcagtacataaaaattagcttataatgaagacatttcatatttttttcccagactattttctctgaacagttctgttgatttggttagtcaattgatagtaaaattaaagaatcaataatgtaaaataattttcttggtttgaattacctttgattggttacgcacaagtgattcttcgcttccatagttccatgtaataatataacacacaagtgaagcagattattcaatggtaaaaggttttcttaaaaaaatttccacaacggttcataaaagaattctgtttttggtttgggtaggaaataaaatcatcagtttgttatattaggtttgtgttttatattatctgtttgattatggtgttgttagtaatttcagaatattttctccaaacaattatttcaattggcattccaaaaatagcgtttttgttttccacacgtgactaaattccattaattacgtgaagcatagaatccatatggcgaaagttttttaaattacagtaaaaatttttatgattaaggagattttacttgcaaaaaaaagacaaatctttgaagactgaaatgacgaacttgaccactatgacatcacttgtcacgtgggatttgctttgtttgggcgagctggtccgaaatcaatttttttttttaggaaattatttttgttgagttaattttttttcctctttttcgtttgttcgagaaaacagagaatgaggaatcaaaaaacggaattttgaatttgcaacgtgaggaacctcctctgtcgtttcgatcttcaagtttttttttaaagctttctctcttcaaagctcttcacgtgagctctcccaaatctgggcgttattcgctttctggattctgaatcgcattatccaacgaattcagctgattgattttatcgggctgctttgttcaagtctctctatgtaaatgggtatttaagagttttgcttattctctcgatcgatctaagtttttttctgaggaaatttggaagattttagcttcttcgattgatatgatatatataggtttgggttttag

SEQ ID NO: 8847 - DNA, 3000 bp, Unknown
  misc_feature (1)..( 3000): cDNA_ID_2178997_gDNA_ID_1971906_Annot_ID_177010 3000 nt of promoter + ATG
gaattcttcatatggtgatttactgatttgtttgccaagtctcagttttttgataatgtaaaaaagtctttgactcttgtatctcttctatacaatgatagttgggacgaatggataaggctggactgtctgttgaaacattcagatgagaatattgagaaacagaaagaacagggtttgaaacagcaagggattaagagtgctatggcttggaaagtgtcaaagatgaaacctagaagccctaatggtcagtcagcttcttcttttgtttgttttgcatattcttgtctcgatggatatcttgctgcttttgtggatattcagagtctctatcagggactctcatttggtcttgcttgctttattctatgtcgactaagtagaagttgttgagattaaagtatacatacacatctttcgttgttagttgagatattgtgtcagttgagatattgtgtcagctgagattttgttcaatattttcttaatttttgcagttgctagaggaagaaagcggaagcaagattctgttgatacggtaatcgctcctttagtggatgtatttgcttaatctttcagcttccaaatatccagggatttttttaatcaggggagtcttactcatgtcttgttgtttgctgaatacaggagaagaatgtgcttccctctgacaaccttttaagtttcaatattccaccagcattaaggaagcaacttcttgacgattttgaatttgttactcagatgcagaaggtatttctatcagcctgttatttcttctctcaattctcaaacggtcttttctgtgtgttttgacgcagttgaccatagtcttttgattcatttagtcagagaaaaaatattcttgtagtcgcatgaatatatttgttgtgaatgtcatatttaggtgcatatgttaaggaatttattttaagtcatttttgggaattgtctgagcagcttgtgcaacttccgcgttctccaaatgtggatggcatcttgaagaagtacattgacagccaaatgaagaaacatggcaggtaagctctttgtggattatagtttctttctgctgtcagtttccaacagttacacttgttaatctcttttgttgctattctcatatacttaaagagagtataaatcatttgtatatgctccatggataatttggttgacagataaagcgtattccaagcttctgatatatctagtactttctttggtgaatctatatagggtaacagattcattagaggaaattctgaaaggcttgcgttgctactttgacaaagctttaccggtgatgttgctttacaacaatgaacggaagcagtacgaggaatccgtatcagggggtgtttctccttcaactgtgtacggagcagagcatttgttgcgactctttggtaaggccagtttttgtaatctgcaaatctgcctttatcatgtggtttagttgtcaagataagactatataaatattgagttttgcagtgaaattaccggagttgctagtacatgtgaatatggcagaagagacattgaaggaattgcaggacaactttgttgatattctcaggtttcttcttcttgttctcctacttaactctttttacaagtatttaaagacaaataacaaaaacaaaatgataaagcaggttcttgaggaagaatcagagtgtgctttttgtatcgacatacaaagcagtggaagaaatggagaagaaagaaggttaggaaattgtgcctaatgacgtgttcttgtaagtatgtgcagcgaatcttctctttgtagtattttgtaacgagacctaagaccatcctgaccatccttattgatggtctcttaacataactcttatgttaagagatatgtcttataattaacaaaagtgacttaaagtctcttatataagaaattttgttagttataaaacatgtctcttagcataagaattgttttaagagatcatcaataatgatgatctaagaactattatactatgttccgtctcgattttgaaagtacttaaacgtcgttatcgtgtttgtctcggcgttttaaattccactgtattagtaagaatttatttttaaaataactttagtcatttttaattatctcttctcccttttcaattattaatgatcatagtaacttctcttgatttgtaaatatgctacatagttgatcttttgaatatacgaatgaaaacatattataatagtatgtgttcaaaatcttttgagttttatgagtacagaactatatgtttaatgggcagattagtatataaaattaccagtgcatcagaaggaataatgatctactcgagtagtatatcaaaataatactattcaaatgtataccaacgacaatgagttcaaaatcatcaaaccccatgggatgatgagcaaataatatttttatcagctactctatacatcatttgatgataatatgcaaaaattgtataccaatgagttcaaaattatcaaaccacatgggatgagaaaaaagcatattactatttttaaacagcttctccaatataaatttatttgaccgttacggaaagggagagagatacacacactctttctcttttattattttccgtttatttgacttttcttctttatagatcgacctggtcccacgtaatcttttcaaacttaccgtttggattcgataatcaccgtccgatctcacatgaagcaacgtgaataaaatgaacggtttagatctatcgaccgtttatagcaatacctttctcctttataatctctatatctctctctctctgaatttcgaaaattataatgctcttctgcttcgtactagctgcttcagcttcttcttcttcttccttagattcaaaatctctcttcttctgagtttctgattttcaagtttgagaactactcttttccttctaaatctttgatttttttctctcgtgatttttgtggttcactgctaattgtgaaccaaag

SEQ ID NO: 8848 - DNA, 3000 bp, Unknown
  misc_feature (1)..( 3000): cDNA_ID_2178993_gDNA_ID_1971906_Annot_ID_177009 3000 nt of promoter + ATG
tacattttcaaatatggatgctgttattttgtggatttttaagtgtctaatatattatcgaatatgcagtgttttgtggattttgaagtgtctaatatttattgaatacagtaagttaatatatatatatattatatagacaaattgacatatatttttggccaaagtatctcccttggattttgatcatactctgcgaatgtgattcctttcggttttgatcatactcgccaaagtgcatgaagaaggttttttgaatgtgtttcgtggaataacatttattttcgccaagaacataactttatgctttccgatttttagtttacagtgtgttacatactctgcgaatgggcccctatttactctgtttatgaagtcaatttttgaaatgttggatgctctcgaattggatttgcagttacgaacagagaacacttatacggacaaaattctgaggttcgttatataaagcagtgggaagttaaacaacgttgtagtaactgggttcgttagcgtgttaaaacagcatgctttcaaaaagttgcatcgcccaccgtggggctcgaacccacgaccacaaggttaagagccttgcgctctaccaactgagctagacgggcttgttgactatattcacactattgttatactcatataaaaaaaacacatcccaattttaactagatgcaggaaagaaatttgcaaggacggtgctctgcgacaaaagattcttgtgaagaaacaaactgaaaactcatcagcttatattataaggctaaagctagtgttatgtctgtaaaaaagatgcatatatataaatagagctgaataaaattacaacaatgacaatcacctgcctttcccattggcgacttcacatctttattttactcagaagagtcacattcatcatcaaacatggctgatgacaacagtccctgtacaaactcacacttctttgccttctccaatttatcactatccgataaaggacacgacgatgtaccctcttttgctgctgacgaatccttaatcggattcttgtcttctacacttgaatcaggcagcacaagcttggtctgatttggtaatgcagaattgttgatgaacgataaaaattgatcggaaacatgtttagagggatgctgatgatgattcatagatggtggcaactcatcaagatgaggttgaagatatttatcagataaatatggatcttccctgtaagacatttccttctgctcactgtaaaattatcggtcaaggaatttcaaataaatcacattcattatagcgacggaaatttgacttgaaaggttttgaaaagaaacaaaaaaggatatcttcaagacatctctatgatgtgatgttatatgatccaccatatgcatcttcacccttttgctacatacaggacatatctacaaaaaccacaaaacaaccaaaacgaattgtaagatgatgctaccacatgacaattcacggaaccagattaataatgttccatcatactacttatatattcatttctttagctcgtaaaaccaatctatgcttcaaaacagagagctcaagtcacctactctctatagcaagtatgtaaagccaaaaaaagtgtcaaaagtattaatatcctaaaaccttaaactgatcaatggagagttatgtaaaacccaaagagtaacttaagataagagtggcatgtttctctattaaaactatttgcaatagcaatcagattctcaaacgcatcaatctaaaacaaatcctaatcaaaattatagattgaagttatgtttcccacaatccgaataactaagctgtgtaaaactgcttcatgtgaagcttgagtgtgaaatgaaaagagcaggagagataggaagtgaattcacaaaccccattgttagcttcatgacgatgttcttcgtcgatatggtgacacaattcaactaaatcataatcacttgcgcaaaacgggcatggatactccactgctatatcgtcgtcaacttcttcaaactcttccaaatcttgataaggccctgaaatattcaccactaattaactcgagagcaaaagagaaaaaaaaagtcttctctcatctaaaaagcaaaacgtaaagctacaatttttaacttaaacgaccaactacaaaaagtcatcaaaacagaactcaactcaatcgaaacccaattaagaccaatcttcaatcataaaccctaaaaatgaagtttgaaagaaaaattgaggggatttggataataaacctgattgatacttagcagcagtttccgatcgatagcttctagaagaaccagatgagctaacgcaccacatatcgtcttccatctgctttgtcggagcctttcttatgtaaaaatctcagataattgatgagagaccttcttcgtcgtgtcagctaaatacccaattgtgtaagagatagcagaaagaaaatgtcaagaaactactccacggaaaggccaaacctttttttaatccgccgagtcttaatggacaagaatacttcgggtggtaagagtgaactactattatacccttacattgcactgagcctttttctcagctaactcaggggtgtttttgtccttttcttgtaaggatgttactgttattgcattgctccccaagttaattatcagtaaaggcctgacttgaaattatataaatgggcttaaagtcaagattttgaaatgatataaatgggcttgaagtcaagattttgaaattatttaaatgggcttgtaggcctaataataaaagcccatgttaaaatctgagaatttttagattctgatagacggaaaatcccaattttcccggaaattttcagacaaaatcgcgttgagattcaacaactttgagtgagtttttttttttgtcatttacctttgtcgcttcgacgtgagacgagccgtggaagaagacgaaagggctcttaagctctctttactcttttcttctcctcctctttttgag

SEQ ID NO: 8849 - DNA, 3000 bp, Unknown
  misc_feature (1)..( 3000): cDNA_ID_2178989_gDNA_ID_1971906_Annot_ID_177008 3000 nt of promoter + ATG
ctacaaagagaagattcgctgcacatacttacaagaacacgtcattaggcacaatttcctaaccttctttcttctccatttcttccactgctttgtatgtcgatacaaaaagcacactctgattcttcctcaagaacctgctttatcattttgtttttgttatttgtctttaaatacttgtaaaaagagttaagtaggagaacaagaagaagaaacctgagaatatcaacaaagttgtcctgcaattccttcaatgtctcttctgccatattcacatgtactagcaactccggtaatttcactgcaaaactcaatatttatatagtcttatcttgacaactaaaccacatgataaaggcagatttgcagattacaaaaactggccttaccaaagagtcgcaacaaatgctctgctccgtacacagttgaaggagaaacaccccctgatacggattcctcgtactgcttccgttcattgttgtaaagcaacatcaccggtaaagctttgtcaaagtagcaacgcaagcctttcagaatttcctctaatgaatctgttaccctatatagattcaccaaagaaagtactagatatatcagaagcttggaatacgctttatctgtcaaccaaattatccatggagcatatacaaatgatttatactctctttaagtatatgagaatagcaacaaaagagattaacaagtgtaactgttggaaactgacagcagaaagaaactataatccacaaagagcttacctgccatgtttcttcatttggctgtcaatgtacttcttcaagatgccatccacatttggagaacgcggaagttgcacaagctgctcagacaattcccaaaaatgacttaaaataaattccttaacatatgcacctaaatatgacattcacaacaaatatattcatgcgactacaagaatattttttctctgactaaatgaatcaaaagactatggtcaactgcgtcaaaacacacagaaaagaccgtttgagaattgagagaagaaataacaggctgatagaaataccttctgcatctgagtaacaaattcaaaatcgtcaagaagttgcttccttaatgctggtggaatattgaaacttaaaaggttgtcagagggaagcacattcttctcctgtattcagcaaacaacaagacatgagtaagactcccctgattaaaaaaatccctggatatttggaagctgaaagattaagcaaatacatccactaaaggagcgattaccgtatcaacagaatcttgcttccgctttcttcctctagcaactgcaaaaattaagaaaatattgaacaaaatctcagctgacacaatatctcaactgacacaatatctcaactaacaacgaaagatgtgtatgtatactttaatctcaacaacttctacttagtcgacatagaataaagcaagcaagaccaaatgagagtccctgatagagactctgaatatccacaaaagcagcaagatatccatcgagacaagaatatgcaaaacaaacaaaagaagaagctgactgaccattagggcttctaggtttcatctttgacactttccaagccatagcactcttaatcccttgctgtttcaaaccctgttctttctgtttctcaatattctcatctgaatgtttcaacagacagtccagccttatccattcgtcccaactatcattgtatagaagagatacaagagtcaaagacttttttacattatcaaaaaactgagacttggcaaacaaatcagtaaatcaccatatgaagaattctcttatttataaatagtttcaaatgatttcaaaccgattagaagccagtaactatattggatgaagctctaaccttttgttccaaccctgccaaaagaaatcatttacatcttcaaaactaaagatagaagcaaaatagctcaaaagaatgattttaaacatatacagtatctacttacaatgtaatgcacaaaatatttccattcattgtctttaaattcaactttaagaacctgagaatattattataaaaaaaaaaaaggaaacgatcagagacataaagcataagcagagaagaacactctaattcaagaatacagagagtgtatttcactaaccttggcttcgtagaagcaatcactgtgtttggctaaaactctctctccttcttcgaagtggccgggaggagcaggtagcagaagaagaggcaaatcttctccgtcacaatcggtgttggtctctgtatcagaaccagagtcccgtcgtgtgtctccgatgaaatcatcggttgttagatccgtctcggcggcggcgttagggcttcccatctcaaaaagaggaggagaagaaaagagtaaagagagcttaagagccctttcgtcttcttccacggctcgtctcacgtcgaagcgacaaaggtaaatgacaaaaaaaaaaactcactcaaagttgttgaatctcaacgcgattttgtctgaaaatttccgggaaaattgggattttccgtctatcagaatctaaaaattctcagattttaacatgggcttttattattaggcctacaagcccatttaaataatttcaaaatcttgacttcaagcccatttatatcatttcaaaatcttgactttaagcccatttatataatttcaagtcaggcctttactgataattaacttggggagcaatgcaataacagtaacatccttacaagaaaaggacaaaaacacccctgagttagctgagaaaaaggctcagtgcaatgtaagggtataatagtagttcactcttaccacccgaagtattcttgtccattaagactcggcggattaaaaaaaggtttggcctttccgtggagtagtttcttgacattttctttctgctatctcttacacaattgggtatttagctgacacgacgaagaaggtctctcatcaattatctgagatttttacataagaaaggctccgacaaagcagatg

SEQ ID NO: 8850 - DNA, 3000 bp, Unknown
  misc_feature (1)..( 3000): cDNA_ID_2178985_gDNA_ID_1971906_Annot_ID_177007 3000 nt of promoter + ATG
aacctcaatttataaatttggtgtagcttttcaaccttgatgaaattattacatagaatcattcgttaaaagacttataattgggtttagaaaagcccattttaaatttaaagcccaatatactgctcgaaaaggaggaaaccctagaaacattgtggtatataaattcttttcgtctcgttcgctaatcagttctccgccacaccaatctccagaaaaggggagaagcaaaaatggtttctctgaagctccagaagcggctcgccgcatcagtgatgaagtgcgggaagggcaaagtttggctcgatcccaacgaaagctccgacatctccatggccaattcccgtatgttgttgcttttttcttcatccttttacttttattgttgtcctgtgtttgtctgcgacggtggtagacggtcttaggtgttgaatcactgtgtttgtttccgatctgaaaatttagagcttgtaggtgttgttacggtttcatttctctagttataggccttgtagaactgtgatttgtctcgtgaatcaaagctagaggatttgatttctgatattgcttcttaatagactgaggatttgaatgatgttccatttcgagtattgttgttatatatttgaagatctttgtagcttcaaatattaagaatgtgatgattggtgttgaacttattgtaggccaaaacatcaggaagcttgtgaaggatggtttcatcatcaggaagccaaccaagattcactctcgttccagagctcgcaaaatgaagattgccaagatgaagggtcgtcactctggatacggtatatacttcacaactctgaaaatccctctatttaatcgtgattttgaagaatgattagcgttgtttactcttgccttttttcctgtgtttatgattaaataggtaagaggaagggtacccgtgaagctaggttgccaacaaaggtactgtggatgcgtaggatgcgtgttcttaggcgtctgttgaagaaatacagagagacgaagaagattgacaagcacatgtaccatgacatgtacatgcgtgttaagggtaatgtgttcaagaacaagcgtgtcttgatggagagtatccacaagtcaaaggctgagaaggctagggagaagactctgtctgatcagtttgaggctaagagggcgaagaacaaggctagccgagaaaggaagcatgctaggagagaggagcgtttagctaaggtcagagcttaacttcttacaaactttataaagtttttttttaattttgatcagagattcttatgtgttgtggattgtttgcttgtagggtcccggtggagatgttgcgcctgtagctgctccagcacctgctgctacacctgctccaactgcagcgtaagtgttatttcaattttgttgtgaattgaatttgtttcaaattggttaacatctatctaaatcgtgtatgtgtgtttttttgcttgtgcagtgtaccgaagaagaagtctaagaagtgaagaggatatatagtgtgaagctatatcgatcatcagttcacggattagactctgaagaaggttttgaatgttttatcgaatgcgtttgtggaataacttttattttcgcaaagaacataacttatgtcagttaatctttatgctttcagatttttagcttacagtgtttcaacagacctactttgcaagttgttctttttttggtttcttattgtttttcgttcgtcatacgcaattacaaaataaccatccattaatccatccataaattgttaaattttagaattaatatatgcaataacaaccatcatctatttcgaagtgttgtttattttcttttgactttcgttttgttgattcttcactctactcctccagatgatccaacaagtggtccacctcttctgtctgctgagagcttttagtagaagcgttatttgataataactgtaatacatcaacccaaacgatactgatatgttttcatttcaatcctttacattaatcaaacactaataacaaattcacagtaacatatgaaaaacatcactgtcattaaatatcagtggaggtattacgtaccaacctgtaagcgccaattcataaaacactactaaccaacacccactcccatgtttttttctagcttttactatacatggtatactttcattttcttttagataacagctaaagctttttacaactcgtatgcgagtctatgttctccttgttgtcttattactataacgagcaaatatgtgtttgacaagagaataagacaaagaaaaaggtctcacattgacacgacttctatacacacaccaataaaccaatgtgtgtgattttggatatgcgttggagatattaacgtatacatttatttacatgtaggaaatacatagctgtatcaccaatatctccaacacattttatcacgtttaatccaaaaactacaattatctttctttttttttaattattatcataagaaaatgtaaaactataaacacatgtcaaaatcaataatgttacatatatcaaaatccaataaaaatattatgattgaatatgcgtggtgaattgattgacatgtgtcacaaaaagaaattacaaactttgaaaagtctagcttatacaataagatgatatattttaataaataatatatgtgattcttttctttttagtattataaatctattatattatcttatttcaattgatataatttaatacactttttcaaaaaacagtgattgtaatacttttattattatactatctgtaatttattagataattttccttttatttatataataaatgttctttttaaacttgtattttgggttgacaaggcccaacaaaagcccataaatgaatttcggatggatatatagaagagaaaggacatttcgcctgcatgggtaaaaaactcaacaaatcctgaaaacaacaaattcccgaatcacacagcgaggaggaagagaat

SEQ ID NO: 8851 - DNA, 3000 bp, Unknown
  misc_feature (1)..( 3000): cDNA_ID_3043733_gDNA_ID_1971906_Annot_ID_177006 3000 nt of promoter + ATG
cactgtaataccaatacttttctataaggaatcaaatctataaatagcatactaactagcactataaaaacattatgaatcctcctatgagcaaatcacttttaaatttgttaacactcttttaaaagaacaaaaaaagcaaaaaaaaaataaagatattatcaccatggctaacgcaagaagtttggtcgccaaggcaaacaatattaacgtaggttcattgattctaatggccttggtgtttggttcttgcgtggctaatggtgaatatctcggcggccgccgtggtctcgctgctaattccggtaaccccacggtctatgatattactaagtttggagccgtaggagatggttccaccaatacttttaaggtaaagtttagtttcattttcgatccataacctttttgagtattttatagtaaaatgcatgtgacattctaacgattgatccaataacattcatgcaggcgtttttgaacacatggatacaagtgtgtgacagtccagtaccagcaacgctactagttcctaagggaacatttttggctggtccagtcattttcgccggtccatgcaagagcaaagtgaccgtcaatgttataggcacaatcatcgctacgaccagcgggtacgcaactcccgagtggttcttgttcgagcgtgttgacaatctcgtcctcaccggaaccggcacattccacgggaaaggtgaagctgtctggaaagcagatggttgtggtaaaaaggtccaatgcaatcttcctccaacggtaagaccaaataactatatattatttcaaatcatgtatatatagatacttgcaataactaatcacacatttgtacgcatacatgcagtctctcaaattcaggaacatgaaaaatgttgaaatcaatggcataagctcggtgaacgcaaaggccttccacatgttcttagtcaaaactgagaatgttaacatccaaaacattaagcttaccgcaccagctgaaagccccaacaccgatggtatccatttgagcaatgcagacaacgttagcatcctcgacagtaccatagcgactggagacgattgtgtttcagtcggtcgtggctccaacaacgtaaccgtcgaacgtgtgatttgtggtccaggacacggtctaagtgtcggtagtcttggtaagtacaagaacgaggaagacgttagcggaatccacgttaacaactgcacgatgattgagaccgacaatggtcttaggatcaagacatggggtgggtcagacccaagcaaggctgtggacattaagtttgaaaacatcatcatgcagagtgtcaagaacccaatcatcattgatcaaaactacggttcaagaggcggagtaagtatatacatcactgaaaatgtctcaaaccaactattcttttgaatatatgcgttaacaattccttttttttggcatgttttgtaggattcacaagttgctataagtgatattttgttcaagaacattagaggaacaacaattacaaaagatgttgttcagattatgtgtagcaaatcggtgccgtgccaaggagtaaacgttgttgacgtgaacttggactatgtaggcaagacaggaggagagaagaagtcgtcatcaggcggtttggtcggagctctttgcgataacgccaatgttatcttcggtggaaaacttagtttccctatgtgtcccaaataagctttttggtataaataatttaatattaaaaaaaaaaatcaaaagtttcacaaacattgttttgtttgtgagttagtttgggaatttatcaacaagaaataatcagtggaatatttgacttttgataatgttttttttcccgattttttttgattttttttttggttttatgtataaataaacagatccttcagctggttgcttaatagtttctggttagaaaatttggtctgtgggtattagtgtgtacaatcattttattgctctatctaaagtcatcgatttctttctttctaagtggcaaaatatctctttcataaaaaaaaaaggaaagaataataaataaaaatatctctttcattctaacttggcattaaaatttagcaaaaactatttgtggaacttgaaaaaaatattactagctcagacttaaacttaaatagtaacaagcatattaaaagtcatgctaactgagatattgatttcctcatctcaagaaactatcttatgaatctgtttccgattattttagtttcccatcaatcatctttaatttctaggaagtttgattttttgaaaatttctccacctgcttaaatttcattacaatttttaatcttagataaacaactgtaatttatgcaaaatgaactgattatataagtcgttatgaatatttatattttttaaaaacatttcagcaaaactgatatactttttttttttttttttttgcaagcaaataaacaaacttccttgaataaaacgtgaaaaataataagagtctttaaagataaacgttgttcatatacattacgtcatataatatatataacaattaagacaatacaaacatatatacaattctcattgggttgaaacattataaagataagataaacatctgtatatatacattggtatacaatatttttcataaatttttttttctctaatcgacagttatatatatacagaaccataatttttaaagcatgctttccaatgcgttttttttttttttttttttttttgtaaaccaaagccgtgtttctaaacctcaatttataaatttggtgtagcttttcaaccttgatgaaattattacatagaatcattcgttaaaagacttataattgggtttagaaaagcccattttaaatttaaagcccaatatactgctcgaaaaggaggaaaccctagaaacattgtggtatataaattcttttcgtctcgttcgctaatcagttctccgccacaccaatctccagaaaaggggagaagcaaaa
